United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 75

SEQ ID NO: 3165407 - DNA, 17 bp, Homo sapiens
ttttgggacaattgttt

SEQ ID NO: 3165408 - DNA, 14 bp, Homo sapiens
ttttgggatgtctt

SEQ ID NO: 3165409 - DNA, 20 bp, Homo sapiens
ttttggggaaaaaagcacat

SEQ ID NO: 3165410 - DNA, 18 bp, Homo sapiens
ttttggggcatcctggat

SEQ ID NO: 3165411 - DNA, 17 bp, Homo sapiens
ttttggtagattaaata

SEQ ID NO: 3165412 - DNA, 19 bp, Homo sapiens
ttttggtataatgtttaaa

SEQ ID NO: 3165413 - DNA, 17 bp, Homo sapiens
ttttggtattacactgt

SEQ ID NO: 3165414 - DNA, 17 bp, Homo sapiens
ttttggtgattcaaatg

SEQ ID NO: 3165415 - DNA, 17 bp, Homo sapiens
ttttggtggatgtaaat

SEQ ID NO: 3165416 - DNA, 18 bp, Homo sapiens
ttttggtggatgtaaata

SEQ ID NO: 3165417 - DNA, 22 bp, Homo sapiens
ttttggttaagttggcttctgt

SEQ ID NO: 3165418 - DNA, 12 bp, Homo sapiens
ttttgtaactac

SEQ ID NO: 3165419 - DNA, 19 bp, Homo sapiens
ttttgtaactacaaagctt

SEQ ID NO: 3165420 - DNA, 17 bp, Homo sapiens
ttttgtaatgcactgtt

SEQ ID NO: 3165421 - DNA, 19 bp, Homo sapiens
ttttgtaatgcactgtttt

SEQ ID NO: 3165422 - DNA, 19 bp, Homo sapiens
ttttgtaatgtgaaaagta

SEQ ID NO: 3165423 - DNA, 22 bp, Homo sapiens
ttttgtaatgtgaaaagtatca

SEQ ID NO: 3165424 - DNA, 14 bp, Homo sapiens
ttttgtaattgtgt

SEQ ID NO: 3165425 - DNA, 18 bp, Homo sapiens
ttttgtaattgtgtaaaa

SEQ ID NO: 3165426 - DNA, 19 bp, Homo sapiens
ttttgtacaaagttttcct

SEQ ID NO: 3165427 - DNA, 21 bp, Homo sapiens
ttttgtacaaagttttccttt

SEQ ID NO: 3165428 - DNA, 19 bp, Homo sapiens
ttttgtacaattactaaat

SEQ ID NO: 3165429 - DNA, 17 bp, Homo sapiens
ttttgtactgtaaagag

SEQ ID NO: 3165430 - DNA, 14 bp, Homo sapiens
ttttgtataattgg

SEQ ID NO: 3165431 - DNA, 23 bp, Homo sapiens
ttttgtataattggatttcctaa

SEQ ID NO: 3165432 - DNA, 24 bp, Homo sapiens
ttttgtataattggatttcctaat

SEQ ID NO: 3165433 - DNA, 19 bp, Homo sapiens
ttttgtatacatcctgggt

SEQ ID NO: 3165434 - DNA, 17 bp, Homo sapiens
ttttgtatgttaaagag

SEQ ID NO: 3165435 - DNA, 18 bp, Homo sapiens
ttttgtattctttactaa

SEQ ID NO: 3165436 - DNA, 18 bp, Homo sapiens
ttttgtattttttaaaac

SEQ ID NO: 3165437 - DNA, 16 bp, Homo sapiens
ttttgtcttattgaaa

SEQ ID NO: 3165438 - DNA, 14 bp, Homo sapiens
ttttgtcttttatg

SEQ ID NO: 3165439 - DNA, 18 bp, Homo sapiens
ttttgtgaaaatgtcaaa

SEQ ID NO: 3165440 - DNA, 22 bp, Homo sapiens
ttttgtgaaatgaaaacatgta

SEQ ID NO: 3165441 - DNA, 19 bp, Homo sapiens
ttttgtgaatggattggat

SEQ ID NO: 3165442 - DNA, 14 bp, Homo sapiens
ttttgtgaattagg

SEQ ID NO: 3165443 - DNA, 13 bp, Homo sapiens
ttttgtgagatgt

SEQ ID NO: 3165444 - DNA, 21 bp, Homo sapiens
ttttgtgcaaaagcttcaaat

SEQ ID NO: 3165445 - DNA, 13 bp, Homo sapiens
ttttgtgcatttg

SEQ ID NO: 3165446 - DNA, 17 bp, Homo sapiens
ttttgtgtaatgaaaat

SEQ ID NO: 3165447 - DNA, 12 bp, Homo sapiens
ttttgtgtatgt

SEQ ID NO: 3165448 - DNA, 13 bp, Homo sapiens
ttttgtgttgtac

SEQ ID NO: 3165449 - DNA, 20 bp, Homo sapiens
ttttgtgttttcttgtaaat

SEQ ID NO: 3165450 - DNA, 15 bp, Homo sapiens
ttttgttactgttct

SEQ ID NO: 3165451 - DNA, 21 bp, Homo sapiens
ttttgttactgttcttgctgc

SEQ ID NO: 3165452 - DNA, 15 bp, Homo sapiens
ttttgttagcaaaga

SEQ ID NO: 3165453 - DNA, 16 bp, Homo sapiens
ttttgttcaatgttcc

SEQ ID NO: 3165454 - DNA, 22 bp, Homo sapiens
ttttgttgttgttgtttgtaaa

SEQ ID NO: 3165455 - DNA, 18 bp, Homo sapiens
ttttgtttcaatgaggtg

SEQ ID NO: 3165456 - DNA, 16 bp, Homo sapiens
ttttgtttcatcctgt

SEQ ID NO: 3165457 - DNA, 18 bp, Homo sapiens
ttttgtttggcaaggaaa

SEQ ID NO: 3165458 - DNA, 19 bp, Homo sapiens
ttttgtttggcaaggaaag

SEQ ID NO: 3165459 - DNA, 15 bp, Homo sapiens
ttttgtttggtaaat

SEQ ID NO: 3165460 - DNA, 14 bp, Homo sapiens
ttttgtttgtctct

SEQ ID NO: 3165461 - DNA, 17 bp, Homo sapiens
ttttgttttttgtaact

SEQ ID NO: 3165462 - DNA, 15 bp, Homo sapiens
tttttaaaaaaagaa

SEQ ID NO: 3165463 - DNA, 18 bp, Homo sapiens
tttttaaaaaatattttc

SEQ ID NO: 3165464 - DNA, 18 bp, Homo sapiens
tttttaaaaagaaactat

SEQ ID NO: 3165465 - DNA, 21 bp, Homo sapiens
tttttaaaaatgtgtcaaaat

SEQ ID NO: 3165466 - DNA, 22 bp, Homo sapiens
tttttaaaagttgttaccaaat

SEQ ID NO: 3165467 - DNA, 22 bp, Homo sapiens
tttttaaaagtttcaatgtgat

SEQ ID NO: 3165468 - DNA, 12 bp, Homo sapiens
tttttaaaatat

SEQ ID NO: 3165469 - DNA, 16 bp, Homo sapiens
tttttaaaatatttat

SEQ ID NO: 3165470 - DNA, 17 bp, Homo sapiens
tttttaaaatggtgctt

SEQ ID NO: 3165471 - DNA, 19 bp, Homo sapiens
tttttaaaatggtgcttaa

SEQ ID NO: 3165472 - DNA, 13 bp, Homo sapiens
tttttaaaattga

SEQ ID NO: 3165473 - DNA, 11 bp, Homo sapiens
tttttaaagaa

SEQ ID NO: 3165474 - DNA, 14 bp, Homo sapiens
tttttaaagcaagt

SEQ ID NO: 3165475 - DNA, 16 bp, Homo sapiens
tttttaaagcaagtca

SEQ ID NO: 3165476 - DNA, 13 bp, Homo sapiens
tttttaaagtttt

SEQ ID NO: 3165477 - DNA, 19 bp, Homo sapiens
tttttaaataaaagcacaa

SEQ ID NO: 3165478 - DNA, 14 bp, Homo sapiens
tttttaaataaact

SEQ ID NO: 3165479 - DNA, 17 bp, Homo sapiens
tttttaaataaactttt

SEQ ID NO: 3165480 - DNA, 16 bp, Homo sapiens
tttttaaatattttct

SEQ ID NO: 3165481 - DNA, 12 bp, Homo sapiens
tttttaaatttt

SEQ ID NO: 3165482 - DNA, 19 bp, Homo sapiens
tttttaacaaaaaacagat

SEQ ID NO: 3165483 - DNA, 18 bp, Homo sapiens
tttttaacaatctaacaa

SEQ ID NO: 3165484 - DNA, 17 bp, Homo sapiens
tttttaactgaaaatgt

SEQ ID NO: 3165485 - DNA, 18 bp, Homo sapiens
tttttaactgaaaatgta

SEQ ID NO: 3165486 - DNA, 13 bp, Homo sapiens
tttttaagaattg

SEQ ID NO: 3165487 - DNA, 17 bp, Homo sapiens
tttttaaggctgtgtga

SEQ ID NO: 3165488 - DNA, 23 bp, Homo sapiens
tttttaagggttatcttagatgt

SEQ ID NO: 3165489 - DNA, 21 bp, Homo sapiens
tttttaagtaatgtggaagaa

SEQ ID NO: 3165490 - DNA, 14 bp, Homo sapiens
tttttaatatgctt

SEQ ID NO: 3165491 - DNA, 12 bp, Homo sapiens
tttttaattatt

SEQ ID NO: 3165492 - DNA, 19 bp, Homo sapiens
tttttaattcaccaaagta

SEQ ID NO: 3165493 - DNA, 20 bp, Homo sapiens
tttttaattgttgtttcttt

SEQ ID NO: 3165494 - DNA, 16 bp, Homo sapiens
tttttaatttacttgt

SEQ ID NO: 3165495 - DNA, 20 bp, Homo sapiens
tttttactaagttttcaaat

SEQ ID NO: 3165496 - DNA, 16 bp, Homo sapiens
tttttactacagttgt

SEQ ID NO: 3165497 - DNA, 18 bp, Homo sapiens
tttttactcattgaaatg

SEQ ID NO: 3165498 - DNA, 22 bp, Homo sapiens
tttttagacagagtctcactgt

SEQ ID NO: 3165499 - DNA, 17 bp, Homo sapiens
tttttagatggttacac

SEQ ID NO: 3165500 - DNA, 20 bp, Homo sapiens
tttttagatggttacactgt

SEQ ID NO: 3165501 - DNA, 22 bp, Homo sapiens
tttttagccataattttgcata

SEQ ID NO: 3165502 - DNA, 13 bp, Homo sapiens
tttttagttcaat

SEQ ID NO: 3165503 - DNA, 18 bp, Homo sapiens
tttttataaaatggctgt

SEQ ID NO: 3165504 - DNA, 23 bp, Homo sapiens
tttttataacatctttattgaaa

SEQ ID NO: 3165505 - DNA, 20 bp, Homo sapiens
tttttatacaaacctaccaa

SEQ ID NO: 3165506 - DNA, 15 bp, Homo sapiens
tttttataccattca

SEQ ID NO: 3165507 - DNA, 14 bp, Homo sapiens
tttttatctttata

SEQ ID NO: 3165508 - DNA, 23 bp, Homo sapiens
tttttatgcctttctctcctagt

SEQ ID NO: 3165509 - DNA, 15 bp, Homo sapiens
tttttattatgcatt

SEQ ID NO: 3165510 - DNA, 21 bp, Homo sapiens
tttttatttaattaaatgtat

SEQ ID NO: 3165511 - DNA, 13 bp, Homo sapiens
tttttatttctaa

SEQ ID NO: 3165512 - DNA, 18 bp, Homo sapiens
tttttatttctaaatgag

SEQ ID NO: 3165513 - DNA, 15 bp, Homo sapiens
tttttatttcttcct

SEQ ID NO: 3165514 - DNA, 18 bp, Homo sapiens
tttttcaacaaatatctt

SEQ ID NO: 3165515 - DNA, 12 bp, Homo sapiens
tttttcaatgtg

SEQ ID NO: 3165516 - DNA, 14 bp, Homo sapiens
tttttcagaaatat

SEQ ID NO: 3165517 - DNA, 17 bp, Homo sapiens
tttttcaggaccttagt

SEQ ID NO: 3165518 - DNA, 13 bp, Homo sapiens
tttttcatttctt

SEQ ID NO: 3165519 - DNA, 20 bp, Homo sapiens
tttttcatttcttcctcagc

SEQ ID NO: 3165520 - DNA, 18 bp, Homo sapiens
tttttcattttaaaaagt

SEQ ID NO: 3165521 - DNA, 20 bp, Homo sapiens
tttttccactttgttcttta

SEQ ID NO: 3165522 - DNA, 11 bp, Homo sapiens
tttttccctct

SEQ ID NO: 3165523 - DNA, 21 bp, Homo sapiens
tttttcctagcctgtttcttc

SEQ ID NO: 3165524 - DNA, 15 bp, Homo sapiens
tttttcctcatgtaa

SEQ ID NO: 3165525 - DNA, 17 bp, Homo sapiens
tttttcctcatgtaaca

SEQ ID NO: 3165526 - DNA, 18 bp, Homo sapiens
tttttcctcatgtaacat

SEQ ID NO: 3165527 - DNA, 12 bp, Homo sapiens
tttttcctctgt

SEQ ID NO: 3165528 - DNA, 15 bp, Homo sapiens
tttttccttaatcca

SEQ ID NO: 3165529 - DNA, 11 bp, Homo sapiens
tttttcctttt

SEQ ID NO: 3165530 - DNA, 16 bp, Homo sapiens
tttttcgtttgtttgt

SEQ ID NO: 3165531 - DNA, 15 bp, Homo sapiens
tttttctataaatca

SEQ ID NO: 3165532 - DNA, 16 bp, Homo sapiens
tttttctataaatcag

SEQ ID NO: 3165533 - DNA, 17 bp, Homo sapiens
tttttctcatgtatctt

SEQ ID NO: 3165534 - DNA, 18 bp, Homo sapiens
tttttctgttgtaactta

SEQ ID NO: 3165535 - DNA, 11 bp, Homo sapiens
tttttcttaaa

SEQ ID NO: 3165536 - DNA, 21 bp, Homo sapiens
tttttcttaaaagtactttaa

SEQ ID NO: 3165537 - DNA, 19 bp, Homo sapiens
tttttcttaaatatgtata

SEQ ID NO: 3165538 - DNA, 16 bp, Homo sapiens
tttttcttctgtattt

SEQ ID NO: 3165539 - DNA, 14 bp, Homo sapiens
tttttcttgatctt

SEQ ID NO: 3165540 - DNA, 13 bp, Homo sapiens
tttttctttataa

SEQ ID NO: 3165541 - DNA, 16 bp, Homo sapiens
tttttgaaacccacag

SEQ ID NO: 3165542 - DNA, 23 bp, Homo sapiens
tttttgaaaggcatgttcctctg

SEQ ID NO: 3165543 - DNA, 14 bp, Homo sapiens
tttttgaaatacct

SEQ ID NO: 3165544 - DNA, 12 bp, Homo sapiens
tttttgaaatga

SEQ ID NO: 3165545 - DNA, 15 bp, Homo sapiens
tttttgaaatgaaat

SEQ ID NO: 3165546 - DNA, 16 bp, Homo sapiens
tttttgactcccagat

SEQ ID NO: 3165547 - DNA, 14 bp, Homo sapiens
tttttgatagcttt

SEQ ID NO: 3165548 - DNA, 16 bp, Homo sapiens
tttttgccacagcttt

SEQ ID NO: 3165549 - DNA, 16 bp, Homo sapiens
tttttgctataatcat

SEQ ID NO: 3165550 - DNA, 18 bp, Homo sapiens
tttttgctataatcatta

SEQ ID NO: 3165551 - DNA, 15 bp, Homo sapiens
tttttggaaagtcag

SEQ ID NO: 3165552 - DNA, 21 bp, Homo sapiens
tttttggagaaggttatcaaa

SEQ ID NO: 3165553 - DNA, 20 bp, Homo sapiens
tttttggaggtgcttaagca

SEQ ID NO: 3165554 - DNA, 17 bp, Homo sapiens
tttttggcctgtttgat

SEQ ID NO: 3165555 - DNA, 16 bp, Homo sapiens
tttttggctagagttt

SEQ ID NO: 3165556 - DNA, 19 bp, Homo sapiens
tttttggggcatcctggat

SEQ ID NO: 3165557 - DNA, 15 bp, Homo sapiens
tttttggttttaaaa

SEQ ID NO: 3165558 - DNA, 13 bp, Homo sapiens
tttttgtaagata

SEQ ID NO: 3165559 - DNA, 19 bp, Homo sapiens
tttttgtaatgcactgttt

SEQ ID NO: 3165560 - DNA, 18 bp, Homo sapiens
tttttgtacagtttgctg

SEQ ID NO: 3165561 - DNA, 18 bp, Homo sapiens
tttttgtataaaatagac

SEQ ID NO: 3165562 - DNA, 12 bp, Homo sapiens
tttttgtatctt

SEQ ID NO: 3165563 - DNA, 20 bp, Homo sapiens
tttttgtatgttatgaacat

SEQ ID NO: 3165564 - DNA, 20 bp, Homo sapiens
tttttgtgaaaatgtcaaag

SEQ ID NO: 3165565 - DNA, 17 bp, Homo sapiens
tttttgtgtatgtactt

SEQ ID NO: 3165566 - DNA, 19 bp, Homo sapiens
tttttgttaggctgtaaag

SEQ ID NO: 3165567 - DNA, 20 bp, Homo sapiens
tttttgttctggtccttttt

SEQ ID NO: 3165568 - DNA, 14 bp, Homo sapiens
tttttgttggagtg

SEQ ID NO: 3165569 - DNA, 13 bp, Homo sapiens
tttttgtttgatg

SEQ ID NO: 3165570 - DNA, 14 bp, Homo sapiens
tttttgtttggaga

SEQ ID NO: 3165571 - DNA, 12 bp, Homo sapiens
ttttttaaagaa

SEQ ID NO: 3165572 - DNA, 12 bp, Homo sapiens
ttttttaaagca

SEQ ID NO: 3165573 - DNA, 17 bp, Homo sapiens
ttttttaacacataact

SEQ ID NO: 3165574 - DNA, 10 bp, Homo sapiens
ttttttaaga

SEQ ID NO: 3165575 - DNA, 17 bp, Homo sapiens
ttttttaagaatatctg

SEQ ID NO: 3165576 - DNA, 12 bp, Homo sapiens
ttttttaagatt

SEQ ID NO: 3165577 - DNA, 12 bp, Homo sapiens
ttttttaagctt

SEQ ID NO: 3165578 - DNA, 23 bp, Homo sapiens
ttttttaagcttcagttgcttgt

SEQ ID NO: 3165579 - DNA, 12 bp, Homo sapiens
ttttttaatcta

SEQ ID NO: 3165580 - DNA, 12 bp, Homo sapiens
ttttttaattta

SEQ ID NO: 3165581 - DNA, 23 bp, Homo sapiens
ttttttagtaagttaatgtatat

SEQ ID NO: 3165582 - DNA, 11 bp, Homo sapiens
ttttttattat

SEQ ID NO: 3165583 - DNA, 12 bp, Homo sapiens
ttttttcaatgt

SEQ ID NO: 3165584 - DNA, 13 bp, Homo sapiens
ttttttcatttat

SEQ ID NO: 3165585 - DNA, 12 bp, Homo sapiens
ttttttccaaaa

SEQ ID NO: 3165586 - DNA, 13 bp, Homo sapiens
ttttttccactta

SEQ ID NO: 3165587 - DNA, 13 bp, Homo sapiens
ttttttccatctt

SEQ ID NO: 3165588 - DNA, 15 bp, Homo sapiens
ttttttctaagagaa

SEQ ID NO: 3165589 - DNA, 11 bp, Homo sapiens
ttttttctgag

SEQ ID NO: 3165590 - DNA, 13 bp, Homo sapiens
ttttttgaaacac

SEQ ID NO: 3165591 - DNA, 20 bp, Homo sapiens
ttttttgaaacacaatacct

SEQ ID NO: 3165592 - DNA, 13 bp, Homo sapiens
ttttttgaaagtg

SEQ ID NO: 3165593 - DNA, 13 bp, Homo sapiens
ttttttgagtcat

SEQ ID NO: 3165594 - DNA, 13 bp, Homo sapiens
ttttttgcaagtt

SEQ ID NO: 3165595 - DNA, 13 bp, Homo sapiens
ttttttgtaaact

SEQ ID NO: 3165596 - DNA, 12 bp, Homo sapiens
ttttttgttcaa

SEQ ID NO: 3165597 - DNA, 13 bp, Homo sapiens
tttttttcaatgt

SEQ ID NO: 3165598 - DNA, 10 bp, Homo sapiens
tttttttcca

SEQ ID NO: 3165599 - DNA, 14 bp, Homo sapiens
tttttttctaagag

SEQ ID NO: 3165600 - DNA, 12 bp, Homo sapiens
tttttttctatt

SEQ ID NO: 3165601 - DNA, 14 bp, Homo sapiens
ttttttttaaacaa

SEQ ID NO: 3165602 - DNA, 14 bp, Homo sapiens
ttttttttaaacta

SEQ ID NO: 3165603 - DNA, 14 bp, Homo sapiens
aaaagtctatttta

SEQ ID NO: 3165604 - DNA, 14 bp, Homo sapiens
aaaagtctattttt

SEQ ID NO: 3165605 - DNA, 19 bp, Homo sapiens
aaaagtctatttttttaac

SEQ ID NO: 3165606 - DNA, 15 bp, Homo sapiens
aaaagtctctattta

SEQ ID NO: 3165607 - DNA, 19 bp, Homo sapiens
aaaagtctctatttaaatt

SEQ ID NO: 3165608 - DNA, 20 bp, Homo sapiens
aaaagtctctatttaaattc

SEQ ID NO: 3165609 - DNA, 18 bp, Homo sapiens
aaaagtctgtctttcctg

SEQ ID NO: 3165610 - DNA, 19 bp, Homo sapiens
aaaagtcttcactctctga

SEQ ID NO: 3165611 - DNA, 23 bp, Homo sapiens
aaaagtcttcactctctgaagat

SEQ ID NO: 3165612 - DNA, 16 bp, Homo sapiens
aaaagtgcatgatggt

SEQ ID NO: 3165613 - DNA, 19 bp, Homo sapiens
aaaagtggcaagaccaaaa

SEQ ID NO: 3165614 - DNA, 18 bp, Homo sapiens
aaaagtgggcttgattct

SEQ ID NO: 3165615 - DNA, 14 bp, Homo sapiens
aaaagttaaactaa

SEQ ID NO: 3165616 - DNA, 12 bp, Homo sapiens
aaaagttattta

SEQ ID NO: 3165617 - DNA, 13 bp, Homo sapiens
aaaagttccaaga

SEQ ID NO: 3165618 - DNA, 23 bp, Homo sapiens
aaaagttccaagagtctaaagat

SEQ ID NO: 3165619 - DNA, 17 bp, Homo sapiens
aaaagttccctgaaaca

SEQ ID NO: 3165620 - DNA, 20 bp, Homo sapiens
aaaagttgaaccattatact

SEQ ID NO: 3165621 - DNA, 15 bp, Homo sapiens
aaaagttgttcaact

SEQ ID NO: 3165622 - DNA, 18 bp, Homo sapiens
aaaagtttcaatgtgatt

SEQ ID NO: 3165623 - DNA, 19 bp, Homo sapiens
aaaagtttcacgtcttggt

SEQ ID NO: 3165624 - DNA, 20 bp, Homo sapiens
aaaagttttgatatttattt

SEQ ID NO: 3165625 - DNA, 21 bp, Homo sapiens
aaaagttttgatatttatttt

SEQ ID NO: 3165626 - DNA, 15 bp, Homo sapiens
aaaagttttgttctt

SEQ ID NO: 3165627 - DNA, 16 bp, Homo sapiens
aaaagtttttgtttgg

SEQ ID NO: 3165628 - DNA, 20 bp, Homo sapiens
aaaataaaaaatctgaagag

SEQ ID NO: 3165629 - DNA, 21 bp, Homo sapiens
aaaataaaaagtgacacagca

SEQ ID NO: 3165630 - DNA, 13 bp, Homo sapiens
aaaataaaaatgg

SEQ ID NO: 3165631 - DNA, 15 bp, Homo sapiens
aaaataaaagaaaat

SEQ ID NO: 3165632 - DNA, 17 bp, Homo sapiens
aaaataaaatactttga

SEQ ID NO: 3165633 - DNA, 13 bp, Homo sapiens
aaaataaaccaaa

SEQ ID NO: 3165634 - DNA, 20 bp, Homo sapiens
aaaataaaggataactctgt

SEQ ID NO: 3165635 - DNA, 12 bp, Homo sapiens
aaaataaattta

SEQ ID NO: 3165636 - DNA, 13 bp, Homo sapiens
aaaataaatttaa

SEQ ID NO: 3165637 - DNA, 19 bp, Homo sapiens
aaaataacaactatttttg

SEQ ID NO: 3165638 - DNA, 17 bp, Homo sapiens
aaaataacctaattaat

SEQ ID NO: 3165639 - DNA, 21 bp, Homo sapiens
aaaataactgaaccaaattgc

SEQ ID NO: 3165640 - DNA, 22 bp, Homo sapiens
aaaataactgaaccaaattgca

SEQ ID NO: 3165641 - DNA, 13 bp, Homo sapiens
aaaataagtgaat

SEQ ID NO: 3165642 - DNA, 21 bp, Homo sapiens
aaaataagtgaataataatta

SEQ ID NO: 3165643 - DNA, 19 bp, Homo sapiens
aaaataattatttattaca

SEQ ID NO: 3165644 - DNA, 13 bp, Homo sapiens
aaaataattctaa

SEQ ID NO: 3165645 - DNA, 14 bp, Homo sapiens
aaaataattctaaa

SEQ ID NO: 3165646 - DNA, 17 bp, Homo sapiens
aaaataatttctctaca

SEQ ID NO: 3165647 - DNA, 15 bp, Homo sapiens
aaaatacaattttta

SEQ ID NO: 3165648 - DNA, 15 bp, Homo sapiens
aaaatactctagcct

SEQ ID NO: 3165649 - DNA, 15 bp, Homo sapiens
aaaatactttgagtt

SEQ ID NO: 3165650 - DNA, 11 bp, Homo sapiens
aaaatactttt

SEQ ID NO: 3165651 - DNA, 19 bp, Homo sapiens
aaaatagacaaatagaaaa

SEQ ID NO: 3165652 - DNA, 17 bp, Homo sapiens
aaaatagacatgtagtt

SEQ ID NO: 3165653 - DNA, 15 bp, Homo sapiens
aaaatagcaatgcct

SEQ ID NO: 3165654 - DNA, 12 bp, Homo sapiens
aaaatagcttgt

SEQ ID NO: 3165655 - DNA, 18 bp, Homo sapiens
aaaataggatttcttaaa

SEQ ID NO: 3165656 - DNA, 15 bp, Homo sapiens
aaaataggcttttta

SEQ ID NO: 3165657 - DNA, 17 bp, Homo sapiens
aaaataggctttttaat

SEQ ID NO: 3165658 - DNA, 15 bp, Homo sapiens
aaaatagttcccttt

SEQ ID NO: 3165659 - DNA, 19 bp, Homo sapiens
aaaatagttccctttgcca

SEQ ID NO: 3165660 - DNA, 22 bp, Homo sapiens
aaaatagtttaggagaaaccag

SEQ ID NO: 3165661 - DNA, 13 bp, Homo sapiens
aaaatagtttgtt

SEQ ID NO: 3165662 - DNA, 13 bp, Homo sapiens
aaaatataaaata

SEQ ID NO: 3165663 - DNA, 13 bp, Homo sapiens
aaaatatacaaaa

SEQ ID NO: 3165664 - DNA, 16 bp, Homo sapiens
aaaatatatttaatga

SEQ ID NO: 3165665 - DNA, 16 bp, Homo sapiens
aaaatatattttgtat

SEQ ID NO: 3165666 - DNA, 13 bp, Homo sapiens
aaaatatgatact

SEQ ID NO: 3165667 - DNA, 16 bp, Homo sapiens
aaaatatggaacttct

SEQ ID NO: 3165668 - DNA, 13 bp, Homo sapiens
aaaatatgtctcg

SEQ ID NO: 3165669 - DNA, 19 bp, Homo sapiens
aaaatattataacttaaaa

SEQ ID NO: 3165670 - DNA, 15 bp, Homo sapiens
aaaatattatgtgtt

SEQ ID NO: 3165671 - DNA, 21 bp, Homo sapiens
aaaatattatgtgtttccata

SEQ ID NO: 3165672 - DNA, 11 bp, Homo sapiens
aaaatattgtt

SEQ ID NO: 3165673 - DNA, 14 bp, Homo sapiens
aaaatattgtttct

SEQ ID NO: 3165674 - DNA, 15 bp, Homo sapiens
aaaatattgtttctg

SEQ ID NO: 3165675 - DNA, 22 bp, Homo sapiens
aaaatattgtttctgcattcat

SEQ ID NO: 3165676 - DNA, 11 bp, Homo sapiens
aaaatatttat

SEQ ID NO: 3165677 - DNA, 13 bp, Homo sapiens
aaaatatttataa

SEQ ID NO: 3165678 - DNA, 21 bp, Homo sapiens
aaaatatttataaaacttctc

SEQ ID NO: 3165679 - DNA, 19 bp, Homo sapiens
aaaatatttcagatatcaa

SEQ ID NO: 3165680 - DNA, 21 bp, Homo sapiens
aaaatatttcctgacttgagt

SEQ ID NO: 3165681 - DNA, 13 bp, Homo sapiens
aaaatattttata

SEQ ID NO: 3165682 - DNA, 17 bp, Homo sapiens
aaaatattttataattt

SEQ ID NO: 3165683 - DNA, 12 bp, Homo sapiens
aaaatattttct

SEQ ID NO: 3165684 - DNA, 13 bp, Homo sapiens
aaaatattttctc

SEQ ID NO: 3165685 - DNA, 16 bp, Homo sapiens
aaaatattttttgcaa

SEQ ID NO: 3165686 - DNA, 11 bp, Homo sapiens
aaaatcaactt

SEQ ID NO: 3165687 - DNA, 14 bp, Homo sapiens
aaaatcacaaaaat

SEQ ID NO: 3165688 - DNA, 15 bp, Homo sapiens
aaaatcagtttttca

SEQ ID NO: 3165689 - DNA, 17 bp, Homo sapiens
aaaatcatgccagtatt

SEQ ID NO: 3165690 - DNA, 18 bp, Homo sapiens
aaaatcatgccagtattt

SEQ ID NO: 3165691 - DNA, 19 bp, Homo sapiens
aaaatcatgccagtatttt

SEQ ID NO: 3165692 - DNA, 12 bp, Homo sapiens
aaaatcattgat

SEQ ID NO: 3165693 - DNA, 22 bp, Homo sapiens
aaaatcattgattgtcagctac

SEQ ID NO: 3165694 - DNA, 16 bp, Homo sapiens
aaaatccaaaatgaat

SEQ ID NO: 3165695 - DNA, 20 bp, Homo sapiens
aaaatccattttacacagca

SEQ ID NO: 3165696 - DNA, 17 bp, Homo sapiens
aaaatccctatttaatt

SEQ ID NO: 3165697 - DNA, 21 bp, Homo sapiens
aaaatcctaagacacaaatgc

SEQ ID NO: 3165698 - DNA, 22 bp, Homo sapiens
aaaatcctgaactttctccctc

SEQ ID NO: 3165699 - DNA, 23 bp, Homo sapiens
aaaatcctgaactttctccctca

SEQ ID NO: 3165700 - DNA, 21 bp, Homo sapiens
aaaatccttccaaagaattct

SEQ ID NO: 3165701 - DNA, 20 bp, Homo sapiens
aaaatccttgcttatgacat

SEQ ID NO: 3165702 - DNA, 15 bp, Homo sapiens
aaaatctaatattaa

SEQ ID NO: 3165703 - DNA, 12 bp, Homo sapiens
aaaatctagttt

SEQ ID NO: 3165704 - DNA, 21 bp, Homo sapiens
aaaatctcccattttggaatt

SEQ ID NO: 3165705 - DNA, 13 bp, Homo sapiens
aaaatctctcaga

SEQ ID NO: 3165706 - DNA, 13 bp, Homo sapiens
aaaatctgaaaat

SEQ ID NO: 3165707 - DNA, 22 bp, Homo sapiens
aaaatctgaactctcaaaagtc

SEQ ID NO: 3165708 - DNA, 13 bp, Homo sapiens
aaaatctgaagag

SEQ ID NO: 3165709 - DNA, 16 bp, Homo sapiens
aaaatctgaagaggct

SEQ ID NO: 3165710 - DNA, 17 bp, Homo sapiens
aaaatctgctgttaact

SEQ ID NO: 3165711 - DNA, 19 bp, Homo sapiens
aaaatctgtttgatccctg

SEQ ID NO: 3165712 - DNA, 18 bp, Homo sapiens
aaaatcttatagttctag

SEQ ID NO: 3165713 - DNA, 19 bp, Homo sapiens
aaaatcttatagttctagg

SEQ ID NO: 3165714 - DNA, 17 bp, Homo sapiens
aaaatcttggcacagaa

SEQ ID NO: 3165715 - DNA, 19 bp, Homo sapiens
aaaatcttgtgctagaata

SEQ ID NO: 3165716 - DNA, 22 bp, Homo sapiens
aaaatgaatatctattaatata

SEQ ID NO: 3165717 - DNA, 18 bp, Homo sapiens
aaaatgacaacagaaaaa

SEQ ID NO: 3165718 - DNA, 19 bp, Homo sapiens
aaaatgacaccatctttta

SEQ ID NO: 3165719 - DNA, 15 bp, Homo sapiens
aaaatgacagatgtt

SEQ ID NO: 3165720 - DNA, 18 bp, Homo sapiens
aaaatgacagatgttgaa

SEQ ID NO: 3165721 - DNA, 23 bp, Homo sapiens
aaaatgagctcgcatttgtcaat

SEQ ID NO: 3165722 - DNA, 16 bp, Homo sapiens
aaaatgaggacatgtt

SEQ ID NO: 3165723 - DNA, 17 bp, Homo sapiens
aaaatgcaaagctgaag

SEQ ID NO: 3165724 - DNA, 14 bp, Homo sapiens
aaaatgcacatagc

SEQ ID NO: 3165725 - DNA, 14 bp, Homo sapiens
aaaatgcacgtagc

SEQ ID NO: 3165726 - DNA, 16 bp, Homo sapiens
aaaatgccatgaatta

SEQ ID NO: 3165727 - DNA, 15 bp, Homo sapiens
aaaatgcccatttgc

SEQ ID NO: 3165728 - DNA, 22 bp, Homo sapiens
aaaatgcctttgagacagtttc

SEQ ID NO: 3165729 - DNA, 12 bp, Homo sapiens
aaaatgctgctc

SEQ ID NO: 3165730 - DNA, 21 bp, Homo sapiens
aaaggtccacaggtctagact

SEQ ID NO: 3165731 - DNA, 14 bp, Homo sapiens
aaaggtcctgccct

SEQ ID NO: 3165732 - DNA, 22 bp, Homo sapiens
aaaggtgaccttgcaacttcat

SEQ ID NO: 3165733 - DNA, 23 bp, Homo sapiens
aaaggtgagtttgagctgccttc

SEQ ID NO: 3165734 - DNA, 19 bp, Homo sapiens
aaaggtggaataaacatta

SEQ ID NO: 3165735 - DNA, 17 bp, Homo sapiens
aaaggtgtgagactggg

SEQ ID NO: 3165736 - DNA, 19 bp, Homo sapiens
aaaggtgtgagactgggaa

SEQ ID NO: 3165737 - DNA, 20 bp, Homo sapiens
aaaggttctaggtttcaaag

SEQ ID NO: 3165738 - DNA, 17 bp, Homo sapiens
aaaggttgaataatata

SEQ ID NO: 3165739 - DNA, 23 bp, Homo sapiens
aaaggttttggatcttgaatgtg

SEQ ID NO: 3165740 - DNA, 16 bp, Homo sapiens
aaaggttttgtatttt

SEQ ID NO: 3165741 - DNA, 12 bp, Homo sapiens
aaaggttttttt

SEQ ID NO: 3165742 - DNA, 17 bp, Homo sapiens
aaagtaaaattgtttca

SEQ ID NO: 3165743 - DNA, 18 bp, Homo sapiens
aaagtaaaggcctcctcc

SEQ ID NO: 3165744 - DNA, 15 bp, Homo sapiens
aaagtaactcatttg

SEQ ID NO: 3165745 - DNA, 18 bp, Homo sapiens
aaagtaactcatttgtta

SEQ ID NO: 3165746 - DNA, 20 bp, Homo sapiens
aaagtaactcatttgttaaa

SEQ ID NO: 3165747 - DNA, 16 bp, Homo sapiens
aaagtaactgtgagaa

SEQ ID NO: 3165748 - DNA, 16 bp, Homo sapiens
aaagtaagaaaacaat

SEQ ID NO: 3165749 - DNA, 13 bp, Homo sapiens
aaagtaagacatc

SEQ ID NO: 3165750 - DNA, 14 bp, Homo sapiens
aaagtaaggtgcag

SEQ ID NO: 3165751 - DNA, 21 bp, Homo sapiens
aaagtaagttaataatgtatt

SEQ ID NO: 3165752 - DNA, 14 bp, Homo sapiens
aaagtaatttctaa

SEQ ID NO: 3165753 - DNA, 18 bp, Homo sapiens
aaagtaatttctaaagca

SEQ ID NO: 3165754 - DNA, 14 bp, Homo sapiens
aaagtaatttcttt

SEQ ID NO: 3165755 - DNA, 15 bp, Homo sapiens
aaagtaattttgtca

SEQ ID NO: 3165756 - DNA, 16 bp, Homo sapiens
aaagtaattttgtcac

SEQ ID NO: 3165757 - DNA, 17 bp, Homo sapiens
aaagtaattttgtcaca

SEQ ID NO: 3165758 - DNA, 15 bp, Homo sapiens
aaagtacactctgct

SEQ ID NO: 3165759 - DNA, 22 bp, Homo sapiens
aaagtacattctggggaaacaa

SEQ ID NO: 3165760 - DNA, 13 bp, Homo sapiens
aaagtacatttaa

SEQ ID NO: 3165761 - DNA, 14 bp, Homo sapiens
aaagtaccacactg

SEQ ID NO: 3165762 - DNA, 15 bp, Homo sapiens
aaagtaccacactga

SEQ ID NO: 3165763 - DNA, 16 bp, Homo sapiens
aaagtaccacactgag

SEQ ID NO: 3165764 - DNA, 15 bp, Homo sapiens
aaagtaccagcatgt

SEQ ID NO: 3165765 - DNA, 19 bp, Homo sapiens
aaagtacttctccaccctg

SEQ ID NO: 3165766 - DNA, 23 bp, Homo sapiens
aaagtacttctccaccctgctct

SEQ ID NO: 3165767 - DNA, 18 bp, Homo sapiens
aaagtacttgagtgtaat

SEQ ID NO: 3165768 - DNA, 18 bp, Homo sapiens
aaagtactttaaaaagga

SEQ ID NO: 3165769 - DNA, 15 bp, Homo sapiens
aaagtactttcttat

SEQ ID NO: 3165770 - DNA, 22 bp, Homo sapiens
aaagtactttcttataaatttg

SEQ ID NO: 3165771 - DNA, 23 bp, Homo sapiens
aaagtagattatggcctttttaa

SEQ ID NO: 3165772 - DNA, 14 bp, Homo sapiens
aaagtataatcttt

SEQ ID NO: 3165773 - DNA, 14 bp, Homo sapiens
aaagtatatattta

SEQ ID NO: 3165774 - DNA, 15 bp, Homo sapiens
aaagtatatatttat

SEQ ID NO: 3165775 - DNA, 20 bp, Homo sapiens
aaagtatgtttttaaatttt

SEQ ID NO: 3165776 - DNA, 18 bp, Homo sapiens
aaagtattctttttcttt

SEQ ID NO: 3165777 - DNA, 21 bp, Homo sapiens
aaagtatttttttaagttaga

SEQ ID NO: 3165778 - DNA, 17 bp, Homo sapiens
aaagtcaccaaatagtg

SEQ ID NO: 3165779 - DNA, 13 bp, Homo sapiens
aaagtcagaagtt

SEQ ID NO: 3165780 - DNA, 12 bp, Homo sapiens
aaagtcataaat

SEQ ID NO: 3165781 - DNA, 18 bp, Homo sapiens
aaagtcctttttttccat

SEQ ID NO: 3165782 - DNA, 18 bp, Homo sapiens
aaagtcgttttccaaact

SEQ ID NO: 3165783 - DNA, 21 bp, Homo sapiens
aaagtctatttttttaactga

SEQ ID NO: 3165784 - DNA, 18 bp, Homo sapiens
aaagtctctaattctatt

SEQ ID NO: 3165785 - DNA, 16 bp, Homo sapiens
aaagtctgtctttcct

SEQ ID NO: 3165786 - DNA, 18 bp, Homo sapiens
aaagtctgtctttcctga

SEQ ID NO: 3165787 - DNA, 20 bp, Homo sapiens
aaagtgaatttgaatgaaaa

SEQ ID NO: 3165788 - DNA, 22 bp, Homo sapiens
aaagtgaatttgaatgaaaaat

SEQ ID NO: 3165789 - DNA, 20 bp, Homo sapiens
aaagtgactgtttggcttat

SEQ ID NO: 3165790 - DNA, 19 bp, Homo sapiens
aaagtgccagcattccaga

SEQ ID NO: 3165791 - DNA, 21 bp, Homo sapiens
aaagtgccccttaagggttga

SEQ ID NO: 3165792 - DNA, 14 bp, Homo sapiens
aaagtgctgggatt

SEQ ID NO: 3165793 - DNA, 17 bp, Homo sapiens
aaagtggcaagaccaaa

SEQ ID NO: 3165794 - DNA, 16 bp, Homo sapiens
aaagtgtaaaatagaa

SEQ ID NO: 3165795 - DNA, 17 bp, Homo sapiens
aaagtgtaaaatagaat

SEQ ID NO: 3165796 - DNA, 21 bp, Homo sapiens
aaagtgtgaaataaatttttt

SEQ ID NO: 3165797 - DNA, 16 bp, Homo sapiens
aaagtgtgtatatatt

SEQ ID NO: 3165798 - DNA, 20 bp, Homo sapiens
aaagtgtgtatatattttgt

SEQ ID NO: 3165799 - DNA, 23 bp, Homo sapiens
aaagtgtgtatatattttgtgtg

SEQ ID NO: 3165800 - DNA, 14 bp, Homo sapiens
aaagtgtgttgttg

SEQ ID NO: 3165801 - DNA, 13 bp, Homo sapiens
aaagtgttgtatc

SEQ ID NO: 3165802 - DNA, 15 bp, Homo sapiens
aaagtgtttctgtta

SEQ ID NO: 3165803 - DNA, 22 bp, Homo sapiens
aaagttaaacattgaagtaatg

SEQ ID NO: 3165804 - DNA, 19 bp, Homo sapiens
aaagttactacctgtcaag

SEQ ID NO: 3165805 - DNA, 20 bp, Homo sapiens
aaagttactaggtaacttca

SEQ ID NO: 3165806 - DNA, 22 bp, Homo sapiens
aaagttactgattcactgcatg

SEQ ID NO: 3165807 - DNA, 22 bp, Homo sapiens
aaagttatttatgctataaatt

SEQ ID NO: 3165808 - DNA, 15 bp, Homo sapiens
aaagttattttcaga

SEQ ID NO: 3165809 - DNA, 22 bp, Homo sapiens
aaagttcataacagtgccattg

SEQ ID NO: 3165810 - DNA, 12 bp, Homo sapiens
aaagttctaaga

SEQ ID NO: 3165811 - DNA, 13 bp, Homo sapiens
aaagttctgtgta

SEQ ID NO: 3165812 - DNA, 19 bp, Homo sapiens
aaagttgaaccattatact

SEQ ID NO: 3165813 - DNA, 22 bp, Homo sapiens
aaagttgaaccattatacttta

SEQ ID NO: 3165814 - DNA, 13 bp, Homo sapiens
aaagttgcagatg

SEQ ID NO: 3165815 - DNA, 23 bp, Homo sapiens
aaagttgcagatgtattgactgt

SEQ ID NO: 3165816 - DNA, 13 bp, Homo sapiens
aaagttgcatttg

SEQ ID NO: 3165817 - DNA, 23 bp, Homo sapiens
aaagttgcctttatttgctgtta

SEQ ID NO: 3165818 - DNA, 15 bp, Homo sapiens
aaagttggactaaat

SEQ ID NO: 3165819 - DNA, 19 bp, Homo sapiens
aaagttgttcaactatttt

SEQ ID NO: 3165820 - DNA, 16 bp, Homo sapiens
aaagtttacaacataa

SEQ ID NO: 3165821 - DNA, 21 bp, Homo sapiens
aaagtttctcttttcaaaaca

SEQ ID NO: 3165822 - DNA, 18 bp, Homo sapiens
aaagttttccagtattga

SEQ ID NO: 3165823 - DNA, 14 bp, Homo sapiens
aaagttttcctttg

SEQ ID NO: 3165824 - DNA, 12 bp, Homo sapiens
aaagttttgaaa

SEQ ID NO: 3165825 - DNA, 13 bp, Homo sapiens
aaagttttgaaaa

SEQ ID NO: 3165826 - DNA, 11 bp, Homo sapiens
aaagtttttta

SEQ ID NO: 3165827 - DNA, 19 bp, Homo sapiens
aaataaaaaatctgaagag

SEQ ID NO: 3165828 - DNA, 14 bp, Homo sapiens
aaataaaaactaaa

SEQ ID NO: 3165829 - DNA, 14 bp, Homo sapiens
aaataaaaagtgac

SEQ ID NO: 3165830 - DNA, 23 bp, Homo sapiens
aaataaaaattattattgatttt

SEQ ID NO: 3165831 - DNA, 11 bp, Homo sapiens
aaataaaacct

SEQ ID NO: 3165832 - DNA, 17 bp, Homo sapiens
aaataaaacctttcaaa

SEQ ID NO: 3165833 - DNA, 14 bp, Homo sapiens
aaataaaagcacaa

SEQ ID NO: 3165834 - DNA, 13 bp, Homo sapiens
aaataaaagcagt

SEQ ID NO: 3165835 - DNA, 16 bp, Homo sapiens
aaataaaagtgatcaa

SEQ ID NO: 3165836 - DNA, 14 bp, Homo sapiens
aaataaaatgaaaa

SEQ ID NO: 3165837 - DNA, 18 bp, Homo sapiens
aaataaacaaataacaat

SEQ ID NO: 3165838 - DNA, 12 bp, Homo sapiens
aaataaacactg

SEQ ID NO: 3165839 - DNA, 20 bp, Homo sapiens
aaataaacactggtgccaac

SEQ ID NO: 3165840 - DNA, 12 bp, Homo sapiens
aaataaacagct

SEQ ID NO: 3165841 - DNA, 13 bp, Homo sapiens
aaataaacagcta

SEQ ID NO: 3165842 - DNA, 14 bp, Homo sapiens
aaataaacagctat

SEQ ID NO: 3165843 - DNA, 14 bp, Homo sapiens
aaataaacatcagt

SEQ ID NO: 3165844 - DNA, 19 bp, Homo sapiens
aaataaacctcaaaatgtc

SEQ ID NO: 3165845 - DNA, 18 bp, Homo sapiens
aaataaactttttttcaa

SEQ ID NO: 3165846 - DNA, 23 bp, Homo sapiens
aaataaaggatgtgattgtggaa

SEQ ID NO: 3165847 - DNA, 19 bp, Homo sapiens
aaataaagggaagaaagga

SEQ ID NO: 3165848 - DNA, 15 bp, Homo sapiens
aaataaatatactca

SEQ ID NO: 3165849 - DNA, 12 bp, Homo sapiens
aaataaatattt

SEQ ID NO: 3165850 - DNA, 13 bp, Homo sapiens
aaataaatatttt

SEQ ID NO: 3165851 - DNA, 14 bp, Homo sapiens
aaataaatggaaat

SEQ ID NO: 3165852 - DNA, 21 bp, Homo sapiens
aaataaatggtttggtgcttt

SEQ ID NO: 3165853 - DNA, 16 bp, Homo sapiens
aaataaatgtatcata

SEQ ID NO: 3165854 - DNA, 21 bp, Homo sapiens
aaataaatgtatcatagaaat

SEQ ID NO: 3165855 - DNA, 17 bp, Homo sapiens
aaataaattagttgtta

SEQ ID NO: 3165856 - DNA, 22 bp, Homo sapiens
aaattacagatgtgaaaataaa

SEQ ID NO: 3165857 - DNA, 13 bp, Homo sapiens
aaattacagcttt

SEQ ID NO: 3165858 - DNA, 22 bp, Homo sapiens
aaattacataagttagaacaag

SEQ ID NO: 3165859 - DNA, 18 bp, Homo sapiens
aaattacctgtggatatt

SEQ ID NO: 3165860 - DNA, 16 bp, Homo sapiens
aaattacgtatgcaag

SEQ ID NO: 3165861 - DNA, 22 bp, Homo sapiens
aaattactgtgtaaatatatgt

SEQ ID NO: 3165862 - DNA, 12 bp, Homo sapiens
aaattagaaaaa

SEQ ID NO: 3165863 - DNA, 19 bp, Homo sapiens
aaattagaaaaaaattact

SEQ ID NO: 3165864 - DNA, 20 bp, Homo sapiens
aaattagactgtgattcaga

SEQ ID NO: 3165865 - DNA, 18 bp, Homo sapiens
aaattagctgtgtgaaat

SEQ ID NO: 3165866 - DNA, 16 bp, Homo sapiens
aaattaggaataaata

SEQ ID NO: 3165867 - DNA, 18 bp, Homo sapiens
aaattaggaataaataaa

SEQ ID NO: 3165868 - DNA, 14 bp, Homo sapiens
aaattagggcaatt

SEQ ID NO: 3165869 - DNA, 18 bp, Homo sapiens
aaattaggggttaaagca

SEQ ID NO: 3165870 - DNA, 16 bp, Homo sapiens
aaattagtaatgtact

SEQ ID NO: 3165871 - DNA, 14 bp, Homo sapiens
aaattataaacttt

SEQ ID NO: 3165872 - DNA, 16 bp, Homo sapiens
aaattataacttaaaa

SEQ ID NO: 3165873 - DNA, 19 bp, Homo sapiens
aaattataacttaaaatat

SEQ ID NO: 3165874 - DNA, 22 bp, Homo sapiens
aaattataacttaaaatatttt

SEQ ID NO: 3165875 - DNA, 17 bp, Homo sapiens
aaattatagcttttaag

SEQ ID NO: 3165876 - DNA, 16 bp, Homo sapiens
aaattatcaatatcta

SEQ ID NO: 3165877 - DNA, 14 bp, Homo sapiens
aaattatcagttat

SEQ ID NO: 3165878 - DNA, 14 bp, Homo sapiens
aaattatcctcttt

SEQ ID NO: 3165879 - DNA, 21 bp, Homo sapiens
aaattatcctctttgtaattt

SEQ ID NO: 3165880 - DNA, 18 bp, Homo sapiens
aaattatggaatatcatc

SEQ ID NO: 3165881 - DNA, 21 bp, Homo sapiens
aaattatggaatatcatctgt

SEQ ID NO: 3165882 - DNA, 13 bp, Homo sapiens
aaattatgtaact

SEQ ID NO: 3165883 - DNA, 19 bp, Homo sapiens
aaattatgtatgtttacat

SEQ ID NO: 3165884 - DNA, 14 bp, Homo sapiens
aaattatttcttaa

SEQ ID NO: 3165885 - DNA, 20 bp, Homo sapiens
aaattatttcttaattatta

SEQ ID NO: 3165886 - DNA, 22 bp, Homo sapiens
aaattatttgtgtaatagaaaa

SEQ ID NO: 3165887 - DNA, 23 bp, Homo sapiens
aaattatttgtgtaatagaaaac

SEQ ID NO: 3165888 - DNA, 16 bp, Homo sapiens
aaattattttaaacaa

SEQ ID NO: 3165889 - DNA, 23 bp, Homo sapiens
aaattattttctccaaataaaaa

SEQ ID NO: 3165890 - DNA, 16 bp, Homo sapiens
aaattattttggattt

SEQ ID NO: 3165891 - DNA, 15 bp, Homo sapiens
aaattcaactttgta

SEQ ID NO: 3165892 - DNA, 15 bp, Homo sapiens
aaattcaatgattct

SEQ ID NO: 3165893 - DNA, 20 bp, Homo sapiens
aaattcaattgtaaattgaa

SEQ ID NO: 3165894 - DNA, 14 bp, Homo sapiens
aaattcacaaactt

SEQ ID NO: 3165895 - DNA, 17 bp, Homo sapiens
aaattcacaaactttta

SEQ ID NO: 3165896 - DNA, 18 bp, Homo sapiens
aaattcacaaacttttat

SEQ ID NO: 3165897 - DNA, 21 bp, Homo sapiens
aaattcactgtttcactgaaa

SEQ ID NO: 3165898 - DNA, 15 bp, Homo sapiens
aaattcagagtcctt

SEQ ID NO: 3165899 - DNA, 21 bp, Homo sapiens
aaattcagatcaaaatgcctt

SEQ ID NO: 3165900 - DNA, 13 bp, Homo sapiens
aaattcagtttca

SEQ ID NO: 3165901 - DNA, 13 bp, Homo sapiens
aaattcagttttt

SEQ ID NO: 3165902 - DNA, 16 bp, Homo sapiens
aaattcagtttttgta

SEQ ID NO: 3165903 - DNA, 21 bp, Homo sapiens
aaattcatggcatgcttaaat

SEQ ID NO: 3165904 - DNA, 20 bp, Homo sapiens
aaattcattgacttagggga

SEQ ID NO: 3165905 - DNA, 17 bp, Homo sapiens
aaattcatttcacatta

SEQ ID NO: 3165906 - DNA, 16 bp, Homo sapiens
aaattcatttctaatt

SEQ ID NO: 3165907 - DNA, 19 bp, Homo sapiens
aaattcattttttaaattc

SEQ ID NO: 3165908 - DNA, 12 bp, Homo sapiens
aaattccaaagt

SEQ ID NO: 3165909 - DNA, 13 bp, Homo sapiens
aaattccactgga

SEQ ID NO: 3165910 - DNA, 17 bp, Homo sapiens
aaattcccgttttgtca

SEQ ID NO: 3165911 - DNA, 11 bp, Homo sapiens
aaattcctgta

SEQ ID NO: 3165912 - DNA, 18 bp, Homo sapiens
aaattctactaagttatt

SEQ ID NO: 3165913 - DNA, 19 bp, Homo sapiens
aaattctataggaacatat

SEQ ID NO: 3165914 - DNA, 19 bp, Homo sapiens
aaattctattacagtatgt

SEQ ID NO: 3165915 - DNA, 16 bp, Homo sapiens
aaattctcaaagtttt

SEQ ID NO: 3165916 - DNA, 18 bp, Homo sapiens
aaattctcaaagttttat

SEQ ID NO: 3165917 - DNA, 13 bp, Homo sapiens
aaattctcctgga

SEQ ID NO: 3165918 - DNA, 16 bp, Homo sapiens
aaattctcctggaggt

SEQ ID NO: 3165919 - DNA, 15 bp, Homo sapiens
aaattctcttctttt

SEQ ID NO: 3165920 - DNA, 16 bp, Homo sapiens
aaattctgtgccttgt

SEQ ID NO: 3165921 - DNA, 22 bp, Homo sapiens
aaattctgtgccttgttttttg

SEQ ID NO: 3165922 - DNA, 20 bp, Homo sapiens
aaattctgttaaaatctatt

SEQ ID NO: 3165923 - DNA, 23 bp, Homo sapiens
aaattcttttttaaattttcttc

SEQ ID NO: 3165924 - DNA, 12 bp, Homo sapiens
aaattgaaattg

SEQ ID NO: 3165925 - DNA, 13 bp, Homo sapiens
aaattgaaattgt

SEQ ID NO: 3165926 - DNA, 15 bp, Homo sapiens
aaattgaacttccca

SEQ ID NO: 3165927 - DNA, 18 bp, Homo sapiens
aaattgatttttctcttc

SEQ ID NO: 3165928 - DNA, 20 bp, Homo sapiens
aaattgatttttctcttcat

SEQ ID NO: 3165929 - DNA, 14 bp, Homo sapiens
aaattgcactaaat

SEQ ID NO: 3165930 - DNA, 16 bp, Homo sapiens
aaattgcactgaagtt

SEQ ID NO: 3165931 - DNA, 12 bp, Homo sapiens
aaattgcatact

SEQ ID NO: 3165932 - DNA, 15 bp, Homo sapiens
aaattgcatactttg

SEQ ID NO: 3165933 - DNA, 18 bp, Homo sapiens
aaattgcatttcctgaca

SEQ ID NO: 3165934 - DNA, 15 bp, Homo sapiens
aaattgccattttat

SEQ ID NO: 3165935 - DNA, 13 bp, Homo sapiens
aaattgctatgtt

SEQ ID NO: 3165936 - DNA, 22 bp, Homo sapiens
aaattgctatgttactattttc

SEQ ID NO: 3165937 - DNA, 13 bp, Homo sapiens
aaattgctccttg

SEQ ID NO: 3165938 - DNA, 14 bp, Homo sapiens
aaattgctctgtgt

SEQ ID NO: 3165939 - DNA, 16 bp, Homo sapiens
aaattgctctgtgtat

SEQ ID NO: 3165940 - DNA, 21 bp, Homo sapiens
aaattgctctgtgtatatctc

SEQ ID NO: 3165941 - DNA, 13 bp, Homo sapiens
aaattgcttttgt

SEQ ID NO: 3165942 - DNA, 16 bp, Homo sapiens
aaattggaatggaact

SEQ ID NO: 3165943 - DNA, 21 bp, Homo sapiens
aaattgggcttgtgatttcca

SEQ ID NO: 3165944 - DNA, 23 bp, Homo sapiens
aaattgggcttgtgatttccatt

SEQ ID NO: 3165945 - DNA, 19 bp, Homo sapiens
aaattggggaggagggggc

SEQ ID NO: 3165946 - DNA, 19 bp, Homo sapiens
aaattggtgataagtggaa

SEQ ID NO: 3165947 - DNA, 22 bp, Homo sapiens
aaattgtacatatttgtggaat

SEQ ID NO: 3165948 - DNA, 18 bp, Homo sapiens
aaattgtatacattttgt

SEQ ID NO: 3165949 - DNA, 20 bp, Homo sapiens
aaattgtatacattttgtta

SEQ ID NO: 3165950 - DNA, 22 bp, Homo sapiens
aaattgtatcttattataaaat

SEQ ID NO: 3165951 - DNA, 13 bp, Homo sapiens
aaattgtatgaaa

SEQ ID NO: 3165952 - DNA, 23 bp, Homo sapiens
aaattgtccgtgttcatacattt

SEQ ID NO: 3165953 - DNA, 14 bp, Homo sapiens
aaattgtctggtac

SEQ ID NO: 3165954 - DNA, 20 bp, Homo sapiens
aaattgtctttaaaaactgt

SEQ ID NO: 3165955 - DNA, 15 bp, Homo sapiens
aaattgtctttatga

SEQ ID NO: 3165956 - DNA, 23 bp, Homo sapiens
aaattgtgcagtactttgtgcat

SEQ ID NO: 3165957 - DNA, 21 bp, Homo sapiens
aaattgtgcttctccccagaa

SEQ ID NO: 3165958 - DNA, 22 bp, Homo sapiens
aaattgtttaagtgttgtaaat

SEQ ID NO: 3165959 - DNA, 19 bp, Homo sapiens
aaattgtttggcttcctcc

SEQ ID NO: 3165960 - DNA, 21 bp, Homo sapiens
aaattgtttggcttcctcctg

SEQ ID NO: 3165961 - DNA, 18 bp, Homo sapiens
aaattgttttcacttgta

SEQ ID NO: 3165962 - DNA, 16 bp, Homo sapiens
aaatttaaaaaataaa

SEQ ID NO: 3165963 - DNA, 19 bp, Homo sapiens
aaatttaaaaaataaataa

SEQ ID NO: 3165964 - DNA, 17 bp, Homo sapiens
aaatttaaaagtaaaat

SEQ ID NO: 3165965 - DNA, 18 bp, Homo sapiens
aaatttaaaagtaaaatg

SEQ ID NO: 3165966 - DNA, 19 bp, Homo sapiens
aaatttaaaagtaaaatgt

SEQ ID NO: 3165967 - DNA, 22 bp, Homo sapiens
aaatttaaaagtaaaatgtctt

SEQ ID NO: 3165968 - DNA, 12 bp, Homo sapiens
aaatttaaaatt

SEQ ID NO: 3165969 - DNA, 16 bp, Homo sapiens
aaatttaaaattacgt

SEQ ID NO: 3165970 - DNA, 15 bp, Homo sapiens
aaatttaaagatatt

SEQ ID NO: 3165971 - DNA, 12 bp, Homo sapiens
aaatttaagcat

SEQ ID NO: 3165972 - DNA, 13 bp, Homo sapiens
aaatttaagcatt

SEQ ID NO: 3165973 - DNA, 14 bp, Homo sapiens
aaatttaagcattg

SEQ ID NO: 3165974 - DNA, 13 bp, Homo sapiens
aaatttaatgctg

SEQ ID NO: 3165975 - DNA, 15 bp, Homo sapiens
aaatttaatgctgcc

SEQ ID NO: 3165976 - DNA, 13 bp, Homo sapiens
aaatttacattta

SEQ ID NO: 3165977 - DNA, 15 bp, Homo sapiens
aaatttagtttttgt

SEQ ID NO: 3165978 - DNA, 18 bp, Homo sapiens
aaatttagtttttgttct

SEQ ID NO: 3165979 - DNA, 19 bp, Homo sapiens
aaatttatatactttttga

SEQ ID NO: 3165980 - DNA, 13 bp, Homo sapiens
aaatttatcaaag

SEQ ID NO: 3165981 - DNA, 21 bp, Homo sapiens
aaatttatgcatttcattcaa

SEQ ID NO: 3165982 - DNA, 16 bp, Homo sapiens
aaccattcgacctata

SEQ ID NO: 3165983 - DNA, 11 bp, Homo sapiens
aaccattgtaa

SEQ ID NO: 3165984 - DNA, 18 bp, Homo sapiens
aaccattgtcttgttctg

SEQ ID NO: 3165985 - DNA, 19 bp, Homo sapiens
aaccattgtcttgttctgt

SEQ ID NO: 3165986 - DNA, 23 bp, Homo sapiens
aaccatttgaagtgtacctgtgt

SEQ ID NO: 3165987 - DNA, 14 bp, Homo sapiens
aaccattttcatta

SEQ ID NO: 3165988 - DNA, 13 bp, Homo sapiens
aacccaaaccatg

SEQ ID NO: 3165989 - DNA, 13 bp, Homo sapiens
aacccaaggagca

SEQ ID NO: 3165990 - DNA, 16 bp, Homo sapiens
aacccaaggagcacag

SEQ ID NO: 3165991 - DNA, 22 bp, Homo sapiens
aacccaaggagcacaggtccca

SEQ ID NO: 3165992 - DNA, 22 bp, Homo sapiens
aacccaaggtgggtagatcacg

SEQ ID NO: 3165993 - DNA, 22 bp, Homo sapiens
aacccaagtttatttctctctt

SEQ ID NO: 3165994 - DNA, 19 bp, Homo sapiens
aacccaatgacttccctgc

SEQ ID NO: 3165995 - DNA, 18 bp, Homo sapiens
aacccacaccgtcttcct

SEQ ID NO: 3165996 - DNA, 21 bp, Homo sapiens
aacccacctctggccctgtgt

SEQ ID NO: 3165997 - DNA, 22 bp, Homo sapiens
aacccacctctggccctgtgta

SEQ ID NO: 3165998 - DNA, 21 bp, Homo sapiens
aacccagattttgctgtatat

SEQ ID NO: 3165999 - DNA, 16 bp, Homo sapiens
aacccaggacatctcc

SEQ ID NO: 3166000 - DNA, 19 bp, Homo sapiens
aacccaggacatctcctgg

SEQ ID NO: 3166001 - DNA, 20 bp, Homo sapiens
aacccagggctctgccccag

SEQ ID NO: 3166002 - DNA, 13 bp, Homo sapiens
aacccagttactt

SEQ ID NO: 3166003 - DNA, 21 bp, Homo sapiens
aacccatcggtaggcaaagga

SEQ ID NO: 3166004 - DNA, 18 bp, Homo sapiens
aaccccaacgcacaggaa

SEQ ID NO: 3166005 - DNA, 19 bp, Homo sapiens
aaccccaacgcacaggaaa

SEQ ID NO: 3166006 - DNA, 12 bp, Homo sapiens
aaccccagcctg

SEQ ID NO: 3166007 - DNA, 13 bp, Homo sapiens
aaccccagcctga

SEQ ID NO: 3166008 - DNA, 12 bp, Homo sapiens
aaccccagttct

SEQ ID NO: 3166009 - DNA, 23 bp, Homo sapiens
aaccccagttctgctcctctcca

SEQ ID NO: 3166010 - DNA, 17 bp, Homo sapiens
aacccccaccccacact

SEQ ID NO: 3166011 - DNA, 15 bp, Homo sapiens
aacccccagcctgct

SEQ ID NO: 3166012 - DNA, 15 bp, Homo sapiens
aacccccctcctgct

SEQ ID NO: 3166013 - DNA, 18 bp, Homo sapiens
aacccccgccacctcagg

SEQ ID NO: 3166014 - DNA, 15 bp, Homo sapiens
aacccccttccccgc

SEQ ID NO: 3166015 - DNA, 16 bp, Homo sapiens
aaccccctttgtgctg

SEQ ID NO: 3166016 - DNA, 18 bp, Homo sapiens
aaccccctttgtgctgtg

SEQ ID NO: 3166017 - DNA, 15 bp, Homo sapiens
aaccccgcagcccgt

SEQ ID NO: 3166018 - DNA, 22 bp, Homo sapiens
aaccccgtcgaggggctctcag

SEQ ID NO: 3166019 - DNA, 21 bp, Homo sapiens
aacccctacatgaaacagaaa

SEQ ID NO: 3166020 - DNA, 21 bp, Homo sapiens
aacccgaggggccggggaagc

SEQ ID NO: 3166021 - DNA, 22 bp, Homo sapiens
aaccctaatctttcacttgaaa

SEQ ID NO: 3166022 - DNA, 16 bp, Homo sapiens
aaccctagccttgctt

SEQ ID NO: 3166023 - DNA, 18 bp, Homo sapiens
aaccctagccttgcttgt

SEQ ID NO: 3166024 - DNA, 22 bp, Homo sapiens
aaccctagtcaaaactattttt

SEQ ID NO: 3166025 - DNA, 23 bp, Homo sapiens
aaccctatctcctgacagaaggt

SEQ ID NO: 3166026 - DNA, 19 bp, Homo sapiens
aaccctggggaaggagcca

SEQ ID NO: 3166027 - DNA, 12 bp, Homo sapiens
aaccctgtgctg

SEQ ID NO: 3166028 - DNA, 14 bp, Homo sapiens
aaccctgtgctggt

SEQ ID NO: 3166029 - DNA, 23 bp, Homo sapiens
aaccctgttttatactgtactta

SEQ ID NO: 3166030 - DNA, 15 bp, Homo sapiens
aacccttaactgaca

SEQ ID NO: 3166031 - DNA, 17 bp, Homo sapiens
aacccttacagtgaaga

SEQ ID NO: 3166032 - DNA, 18 bp, Homo sapiens
aacccttacagtgaagat

SEQ ID NO: 3166033 - DNA, 23 bp, Homo sapiens
aacccttaccccttagcctccct

SEQ ID NO: 3166034 - DNA, 21 bp, Homo sapiens
aacccttgtcagtgacagtat

SEQ ID NO: 3166035 - DNA, 13 bp, Homo sapiens
aaccgcacagctc

SEQ ID NO: 3166036 - DNA, 19 bp, Homo sapiens
aaccgctcacctagagcca

SEQ ID NO: 3166037 - DNA, 22 bp, Homo sapiens
aaccgtctgttatgctgtgaca

SEQ ID NO: 3166038 - DNA, 15 bp, Homo sapiens
aaccgttattataat

SEQ ID NO: 3166039 - DNA, 19 bp, Homo sapiens
aacctacaagaactaatga

SEQ ID NO: 3166040 - DNA, 18 bp, Homo sapiens
aacctacacactgtcatg

SEQ ID NO: 3166041 - DNA, 20 bp, Homo sapiens
aacctacagttttaactgtg

SEQ ID NO: 3166042 - DNA, 15 bp, Homo sapiens
aacctagatgtttaa

SEQ ID NO: 3166043 - DNA, 20 bp, Homo sapiens
aacctagatgtttaacaaat

SEQ ID NO: 3166044 - DNA, 23 bp, Homo sapiens
aacctagatgtttaacaaatcta

SEQ ID NO: 3166045 - DNA, 17 bp, Homo sapiens
aacctagtaaaaccttg

SEQ ID NO: 3166046 - DNA, 21 bp, Homo sapiens
aacctagtaaaaccttgttct

SEQ ID NO: 3166047 - DNA, 18 bp, Homo sapiens
aacctagtactctctgct

SEQ ID NO: 3166048 - DNA, 21 bp, Homo sapiens
aacctagtactctctgctcta

SEQ ID NO: 3166049 - DNA, 22 bp, Homo sapiens
aacctatgatattttctgtgcc

SEQ ID NO: 3166050 - DNA, 22 bp, Homo sapiens
aacctatttccacattctctct

SEQ ID NO: 3166051 - DNA, 17 bp, Homo sapiens
aacctattttcatttgt

SEQ ID NO: 3166052 - DNA, 18 bp, Homo sapiens
aacctattttcatttgta

SEQ ID NO: 3166053 - DNA, 19 bp, Homo sapiens
aacctattttcatttgtac

SEQ ID NO: 3166054 - DNA, 22 bp, Homo sapiens
aacctattttcatttgtacaag

SEQ ID NO: 3166055 - DNA, 17 bp, Homo sapiens
aacctcaaaatgtctaa

SEQ ID NO: 3166056 - DNA, 17 bp, Homo sapiens
aacctcaactgcctact

SEQ ID NO: 3166057 - DNA, 20 bp, Homo sapiens
aacctcaagtaaactcccct

SEQ ID NO: 3166058 - DNA, 14 bp, Homo sapiens
aacctcagctctgg

SEQ ID NO: 3166059 - DNA, 15 bp, Homo sapiens
aacctcagctctggg

SEQ ID NO: 3166060 - DNA, 18 bp, Homo sapiens
aacctcaggcttccttgg

SEQ ID NO: 3166061 - DNA, 13 bp, Homo sapiens
aacctcagtgtca

SEQ ID NO: 3166062 - DNA, 18 bp, Homo sapiens
aacctcagtgtcatttat

SEQ ID NO: 3166063 - DNA, 16 bp, Homo sapiens
aacctcattggccagc

SEQ ID NO: 3166064 - DNA, 20 bp, Homo sapiens
aacctcccagaggtccagcc

SEQ ID NO: 3166065 - DNA, 19 bp, Homo sapiens
aacctccctcttgttttgt

SEQ ID NO: 3166066 - DNA, 20 bp, Homo sapiens
aacctccctcttgttttgtt

SEQ ID NO: 3166067 - DNA, 14 bp, Homo sapiens
aacctcctgggcta

SEQ ID NO: 3166068 - DNA, 16 bp, Homo sapiens
aacctcgggcctgctg

SEQ ID NO: 3166069 - DNA, 12 bp, Homo sapiens
aacctctgcctt

SEQ ID NO: 3166070 - DNA, 21 bp, Homo sapiens
aacctctggcccttggaataa

SEQ ID NO: 3166071 - DNA, 14 bp, Homo sapiens
aacctctgtctcat

SEQ ID NO: 3166072 - DNA, 12 bp, Homo sapiens
aacctcttcccc

SEQ ID NO: 3166073 - DNA, 16 bp, Homo sapiens
aacctcttttctgcat

SEQ ID NO: 3166074 - DNA, 23 bp, Homo sapiens
aacctgacagatgtcagccgagc

SEQ ID NO: 3166075 - DNA, 17 bp, Homo sapiens
aacctgacccctgctca

SEQ ID NO: 3166076 - DNA, 20 bp, Homo sapiens
aacctgagtcgtacagaaag

SEQ ID NO: 3166077 - DNA, 17 bp, Homo sapiens
aacctgatgttaaaatt

SEQ ID NO: 3166078 - DNA, 16 bp, Homo sapiens
aacctggatccagcac

SEQ ID NO: 3166079 - DNA, 17 bp, Homo sapiens
aacctggatccagcact

SEQ ID NO: 3166080 - DNA, 19 bp, Homo sapiens
aacctggattttttaaatc

SEQ ID NO: 3166081 - DNA, 23 bp, Homo sapiens
aacctggccgcgtttagaccaag

SEQ ID NO: 3166082 - DNA, 17 bp, Homo sapiens
aacctgggctgtgctgc

SEQ ID NO: 3166083 - DNA, 22 bp, Homo sapiens
aacctggggtgaatacttattt

SEQ ID NO: 3166084 - DNA, 17 bp, Homo sapiens
aacctgggtccaaataa

SEQ ID NO: 3166085 - DNA, 18 bp, Homo sapiens
aacctgggtccaaataaa

SEQ ID NO: 3166086 - DNA, 19 bp, Homo sapiens
aacctgggtccaaataaaa

SEQ ID NO: 3166087 - DNA, 11 bp, Homo sapiens
aacctggtgct

SEQ ID NO: 3166088 - DNA, 16 bp, Homo sapiens
aacctggtggcaccag

SEQ ID NO: 3166089 - DNA, 21 bp, Homo sapiens
aacctggtggcaccagatgca

SEQ ID NO: 3166090 - DNA, 17 bp, Homo sapiens
aacctggtgtgtttctt

SEQ ID NO: 3166091 - DNA, 23 bp, Homo sapiens
aacctgtacttcaagttaaagtg

SEQ ID NO: 3166092 - DNA, 17 bp, Homo sapiens
aacctgtagaatcaatt

SEQ ID NO: 3166093 - DNA, 22 bp, Homo sapiens
aacctgtataagtggaggcact

SEQ ID NO: 3166094 - DNA, 22 bp, Homo sapiens
aacctgtctccactgtgccttt

SEQ ID NO: 3166095 - DNA, 19 bp, Homo sapiens
aacctgtcttggggccact

SEQ ID NO: 3166096 - DNA, 21 bp, Homo sapiens
aacctgttgctgtgtttaatt

SEQ ID NO: 3166097 - DNA, 15 bp, Homo sapiens
aacctgttttgttaa

SEQ ID NO: 3166098 - DNA, 21 bp, Homo sapiens
aacctgttttgttaatgctct

SEQ ID NO: 3166099 - DNA, 18 bp, Homo sapiens
aacctgtttttttttcat

SEQ ID NO: 3166100 - DNA, 17 bp, Homo sapiens
aaccttaatgacaacac

SEQ ID NO: 3166101 - DNA, 16 bp, Homo sapiens
aaccttagctccctcc

SEQ ID NO: 3166102 - DNA, 17 bp, Homo sapiens
aaccttattgtacctct

SEQ ID NO: 3166103 - DNA, 13 bp, Homo sapiens
aaccttcaaagaa

SEQ ID NO: 3166104 - DNA, 16 bp, Homo sapiens
aaccttcaaagaaact

SEQ ID NO: 3166105 - DNA, 14 bp, Homo sapiens
aaccttcaacccag

SEQ ID NO: 3166106 - DNA, 19 bp, Homo sapiens
aaccttcacatctgtcacg

SEQ ID NO: 3166107 - DNA, 17 bp, Homo sapiens
aagactgtacaaagtag

SEQ ID NO: 3166108 - DNA, 20 bp, Homo sapiens
aagactgtactggccagtgt

SEQ ID NO: 3166109 - DNA, 16 bp, Homo sapiens
aagactgtagatatgt

SEQ ID NO: 3166110 - DNA, 24 bp, Homo sapiens
aagactgttgctcaaatctattca

SEQ ID NO: 3166111 - DNA, 21 bp, Homo sapiens
aagactgttgtgatcttgcat

SEQ ID NO: 3166112 - DNA, 17 bp, Homo sapiens
aagacttactctaagat

SEQ ID NO: 3166113 - DNA, 20 bp, Homo sapiens
aagacttactctaagatctt

SEQ ID NO: 3166114 - DNA, 14 bp, Homo sapiens
aagacttcccagct

SEQ ID NO: 3166115 - DNA, 17 bp, Homo sapiens
aagacttggcaacagaa

SEQ ID NO: 3166116 - DNA, 20 bp, Homo sapiens
aagacttggcaacagaagca

SEQ ID NO: 3166117 - DNA, 23 bp, Homo sapiens
aagacttggttggtagggtggga

SEQ ID NO: 3166118 - DNA, 18 bp, Homo sapiens
aagacttttattaataaa

SEQ ID NO: 3166119 - DNA, 15 bp, Homo sapiens
aagagaaaagagaga

SEQ ID NO: 3166120 - DNA, 13 bp, Homo sapiens
aagagaaaatgat

SEQ ID NO: 3166121 - DNA, 21 bp, Homo sapiens
aagagaaaatgtaaaggaggg

SEQ ID NO: 3166122 - DNA, 20 bp, Homo sapiens
aagagaaacagttggtaact

SEQ ID NO: 3166123 - DNA, 21 bp, Homo sapiens
aagagaaaccgggagaaggca

SEQ ID NO: 3166124 - DNA, 14 bp, Homo sapiens
aagagaaactttgt

SEQ ID NO: 3166125 - DNA, 19 bp, Homo sapiens
aagagaaaggcctgcacac

SEQ ID NO: 3166126 - DNA, 18 bp, Homo sapiens
aagagaaagtgatttcta

SEQ ID NO: 3166127 - DNA, 16 bp, Homo sapiens
aagagaaccgagcaaa

SEQ ID NO: 3166128 - DNA, 22 bp, Homo sapiens
aagagaaccgagcaaagatcaa

SEQ ID NO: 3166129 - DNA, 11 bp, Homo sapiens
aagagaactcg

SEQ ID NO: 3166130 - DNA, 15 bp, Homo sapiens
aagagaaggaagcca

SEQ ID NO: 3166131 - DNA, 19 bp, Homo sapiens
aagagaatgccattctctt

SEQ ID NO: 3166132 - DNA, 17 bp, Homo sapiens
aagagacctacctcagg

SEQ ID NO: 3166133 - DNA, 14 bp, Homo sapiens
aagagagaaagaag

SEQ ID NO: 3166134 - DNA, 14 bp, Homo sapiens
aagagagaagccag

SEQ ID NO: 3166135 - DNA, 15 bp, Homo sapiens
aagagagaagccagc

SEQ ID NO: 3166136 - DNA, 12 bp, Homo sapiens
aagagagaatgt

SEQ ID NO: 3166137 - DNA, 20 bp, Homo sapiens
aagagagagagagaaaaaaa

SEQ ID NO: 3166138 - DNA, 15 bp, Homo sapiens
aagagaggacacaaa

SEQ ID NO: 3166139 - DNA, 17 bp, Homo sapiens
aagagaggagaggagag

SEQ ID NO: 3166140 - DNA, 18 bp, Homo sapiens
aagagaggagaggagaga

SEQ ID NO: 3166141 - DNA, 20 bp, Homo sapiens
aagagaggatgtgcaagcga

SEQ ID NO: 3166142 - DNA, 15 bp, Homo sapiens
aagagagggacaggc

SEQ ID NO: 3166143 - DNA, 16 bp, Homo sapiens
aagagagggacaggca

SEQ ID NO: 3166144 - DNA, 14 bp, Homo sapiens
aagagatacagagg

SEQ ID NO: 3166145 - DNA, 17 bp, Homo sapiens
aagagatgagaaatgat

SEQ ID NO: 3166146 - DNA, 18 bp, Homo sapiens
aagagatgggcttgtttt

SEQ ID NO: 3166147 - DNA, 20 bp, Homo sapiens
aagagatgggcttgttttct

SEQ ID NO: 3166148 - DNA, 14 bp, Homo sapiens
aagagatttatctt

SEQ ID NO: 3166149 - DNA, 18 bp, Homo sapiens
aagagatttatctttata

SEQ ID NO: 3166150 - DNA, 16 bp, Homo sapiens
aagagatttcaacata

SEQ ID NO: 3166151 - DNA, 13 bp, Homo sapiens
aagagcagcctga

SEQ ID NO: 3166152 - DNA, 14 bp, Homo sapiens
aagagcagcctgat

SEQ ID NO: 3166153 - DNA, 23 bp, Homo sapiens
aagagcagcctgatggccaaggg

SEQ ID NO: 3166154 - DNA, 16 bp, Homo sapiens
aagagcagcctgtggc

SEQ ID NO: 3166155 - DNA, 18 bp, Homo sapiens
aagagcagcctgtggcat

SEQ ID NO: 3166156 - DNA, 22 bp, Homo sapiens
aagagcaggactccaggcccaa

SEQ ID NO: 3166157 - DNA, 23 bp, Homo sapiens
aagagcaggcacatggaggagct

SEQ ID NO: 3166158 - DNA, 19 bp, Homo sapiens
aagagcatggatgcatttc

SEQ ID NO: 3166159 - DNA, 23 bp, Homo sapiens
aagagccctggacacccctgctc

SEQ ID NO: 3166160 - DNA, 23 bp, Homo sapiens
aagagccctgtggccgccacctg

SEQ ID NO: 3166161 - DNA, 14 bp, Homo sapiens
aagagcccttgcct

SEQ ID NO: 3166162 - DNA, 23 bp, Homo sapiens
aagagcgagagatcaaagatgaa

SEQ ID NO: 3166163 - DNA, 12 bp, Homo sapiens
aagagctgcctg

SEQ ID NO: 3166164 - DNA, 13 bp, Homo sapiens
aagagctgcctgg

SEQ ID NO: 3166165 - DNA, 14 bp, Homo sapiens
aagagcttaagaac

SEQ ID NO: 3166166 - DNA, 13 bp, Homo sapiens
aagagcttgcttt

SEQ ID NO: 3166167 - DNA, 14 bp, Homo sapiens
aagagcttgctttg

SEQ ID NO: 3166168 - DNA, 22 bp, Homo sapiens
aagaggaaaagctgtaagaaaa

SEQ ID NO: 3166169 - DNA, 22 bp, Homo sapiens
aagaggaacagcactggggagt

SEQ ID NO: 3166170 - DNA, 18 bp, Homo sapiens
aagaggaacagtgtggtt

SEQ ID NO: 3166171 - DNA, 15 bp, Homo sapiens
aagaggagaccctgg

SEQ ID NO: 3166172 - DNA, 16 bp, Homo sapiens
aagaggagaccctgga

SEQ ID NO: 3166173 - DNA, 18 bp, Homo sapiens
aagaggagcacttccaaa

SEQ ID NO: 3166174 - DNA, 13 bp, Homo sapiens
aagaggcagagtt

SEQ ID NO: 3166175 - DNA, 11 bp, Homo sapiens
aagaggcaggg

SEQ ID NO: 3166176 - DNA, 23 bp, Homo sapiens
aagaggccctgtctgtacctaac

SEQ ID NO: 3166177 - DNA, 14 bp, Homo sapiens
aagaggcgggccag

SEQ ID NO: 3166178 - DNA, 15 bp, Homo sapiens
aagaggcgggccagc

SEQ ID NO: 3166179 - DNA, 18 bp, Homo sapiens
aagaggcgggccagccag

SEQ ID NO: 3166180 - DNA, 21 bp, Homo sapiens
aagaggcgggccagccaggcg

SEQ ID NO: 3166181 - DNA, 16 bp, Homo sapiens
aagaggctgaaagagg

SEQ ID NO: 3166182 - DNA, 15 bp, Homo sapiens
aagaggctgaggcct

SEQ ID NO: 3166183 - DNA, 18 bp, Homo sapiens
aagaggctgaggcctgga

SEQ ID NO: 3166184 - DNA, 21 bp, Homo sapiens
aagaggctgcccctctcacca

SEQ ID NO: 3166185 - DNA, 23 bp, Homo sapiens
aagaggctgcccctctcaccaaa

SEQ ID NO: 3166186 - DNA, 20 bp, Homo sapiens
aagaggcttctcctgtttta

SEQ ID NO: 3166187 - DNA, 22 bp, Homo sapiens
aagagggaccagggtgggagag

SEQ ID NO: 3166188 - DNA, 21 bp, Homo sapiens
aagagggcccagcccagagcc

SEQ ID NO: 3166189 - DNA, 15 bp, Homo sapiens
aagagggctgagctg

SEQ ID NO: 3166190 - DNA, 16 bp, Homo sapiens
aagagggctgagctga

SEQ ID NO: 3166191 - DNA, 13 bp, Homo sapiens
aagaggggctggg

SEQ ID NO: 3166192 - DNA, 16 bp, Homo sapiens
aagaggtgggagggcc

SEQ ID NO: 3166193 - DNA, 13 bp, Homo sapiens
aagaggtgttatt

SEQ ID NO: 3166194 - DNA, 15 bp, Homo sapiens
aagaggtgttatttg

SEQ ID NO: 3166195 - DNA, 22 bp, Homo sapiens
aagaggttgggcttccatgcct

SEQ ID NO: 3166196 - DNA, 19 bp, Homo sapiens
aagagtactgggagaatca

SEQ ID NO: 3166197 - DNA, 14 bp, Homo sapiens
aagagtagcatttc

SEQ ID NO: 3166198 - DNA, 16 bp, Homo sapiens
aagagtccctttgaag

SEQ ID NO: 3166199 - DNA, 14 bp, Homo sapiens
aagagtctaaagat

SEQ ID NO: 3166200 - DNA, 14 bp, Homo sapiens
aagagtctagattc

SEQ ID NO: 3166201 - DNA, 23 bp, Homo sapiens
aagagtctagattcaaaggttct

SEQ ID NO: 3166202 - DNA, 14 bp, Homo sapiens
aagagtcttcaaca

SEQ ID NO: 3166203 - DNA, 18 bp, Homo sapiens
aagagtgactagtacaaa

SEQ ID NO: 3166204 - DNA, 20 bp, Homo sapiens
aagagtgactagtacaaatt

SEQ ID NO: 3166205 - DNA, 14 bp, Homo sapiens
aagagtgcattttc

SEQ ID NO: 3166206 - DNA, 14 bp, Homo sapiens
aagagtgtagaagc

SEQ ID NO: 3166207 - DNA, 18 bp, Homo sapiens
aagagtgtagaagcattc

SEQ ID NO: 3166208 - DNA, 22 bp, Homo sapiens
aagagtgtagaagcattccttc

SEQ ID NO: 3166209 - DNA, 23 bp, Homo sapiens
aagagtttgttctgttctggggg

SEQ ID NO: 3166210 - DNA, 14 bp, Homo sapiens
aagataaaagaatg

SEQ ID NO: 3166211 - DNA, 17 bp, Homo sapiens
aagataaacctggagat

SEQ ID NO: 3166212 - DNA, 12 bp, Homo sapiens
aagataaagatg

SEQ ID NO: 3166213 - DNA, 14 bp, Homo sapiens
aagataaagatgat

SEQ ID NO: 3166214 - DNA, 15 bp, Homo sapiens
aagataacttactgt

SEQ ID NO: 3166215 - DNA, 19 bp, Homo sapiens
aagataagaaatgatcttt

SEQ ID NO: 3166216 - DNA, 15 bp, Homo sapiens
aagataagcctgagc

SEQ ID NO: 3166217 - DNA, 19 bp, Homo sapiens
aagataaggactagatact

SEQ ID NO: 3166218 - DNA, 12 bp, Homo sapiens
aagataattata

SEQ ID NO: 3166219 - DNA, 17 bp, Homo sapiens
aagataattgctattta

SEQ ID NO: 3166220 - DNA, 19 bp, Homo sapiens
aagataattgttgaaattt

SEQ ID NO: 3166221 - DNA, 15 bp, Homo sapiens
aagataatttgcata

SEQ ID NO: 3166222 - DNA, 20 bp, Homo sapiens
aagatacaaattaattttac

SEQ ID NO: 3166223 - DNA, 20 bp, Homo sapiens
aagatactaaggacgttgtt

SEQ ID NO: 3166224 - DNA, 17 bp, Homo sapiens
aagatagacttattctt

SEQ ID NO: 3166225 - DNA, 13 bp, Homo sapiens
aagataggctctg

SEQ ID NO: 3166226 - DNA, 15 bp, Homo sapiens
aagataggctctgca

SEQ ID NO: 3166227 - DNA, 17 bp, Homo sapiens
aagataggctctgcaca

SEQ ID NO: 3166228 - DNA, 20 bp, Homo sapiens
aagatagtcttggaagctgt

SEQ ID NO: 3166229 - DNA, 12 bp, Homo sapiens
aagatatataga

SEQ ID NO: 3166230 - DNA, 17 bp, Homo sapiens
aagatatcagagctctt

SEQ ID NO: 3166231 - DNA, 15 bp, Homo sapiens
aagatatggagaatt

SEQ ID NO: 3166232 - DNA, 16 bp, Homo sapiens
aagatatggcacttct

SEQ ID NO: 3166233 - DNA, 18 bp, Homo sapiens
aaggaaaacctgaagact

SEQ ID NO: 3166234 - DNA, 17 bp, Homo sapiens
aaggaaaactgcatgga

SEQ ID NO: 3166235 - DNA, 15 bp, Homo sapiens
aaggaaaccagtgca

SEQ ID NO: 3166236 - DNA, 16 bp, Homo sapiens
aaggaaactcttatct

SEQ ID NO: 3166237 - DNA, 16 bp, Homo sapiens
aaggaaagcaataaat

SEQ ID NO: 3166238 - DNA, 18 bp, Homo sapiens
aaggaaagctgtgtttat

SEQ ID NO: 3166239 - DNA, 16 bp, Homo sapiens
aaggaaatacacttct

SEQ ID NO: 3166240 - DNA, 22 bp, Homo sapiens
aaggaaatctcaccccatccca

SEQ ID NO: 3166241 - DNA, 15 bp, Homo sapiens
aaggaaatttgtttg

SEQ ID NO: 3166242 - DNA, 18 bp, Homo sapiens
aaggaaatttgtttgtat

SEQ ID NO: 3166243 - DNA, 20 bp, Homo sapiens
aaggaaatttgtttgtattt

SEQ ID NO: 3166244 - DNA, 22 bp, Homo sapiens
aaggaacaaaaattacaaagaa

SEQ ID NO: 3166245 - DNA, 21 bp, Homo sapiens
aaggaaccttccttcctgctt

SEQ ID NO: 3166246 - DNA, 15 bp, Homo sapiens
aaggaagagaagaca

SEQ ID NO: 3166247 - DNA, 21 bp, Homo sapiens
aaggaagagccaatgttttcc

SEQ ID NO: 3166248 - DNA, 18 bp, Homo sapiens
aaggaagatatacatgaa

SEQ ID NO: 3166249 - DNA, 14 bp, Homo sapiens
aaggaagctgtgtt

SEQ ID NO: 3166250 - DNA, 21 bp, Homo sapiens
aaggaagctgtgttgaaacag

SEQ ID NO: 3166251 - DNA, 12 bp, Homo sapiens
aaggaagggcag

SEQ ID NO: 3166252 - DNA, 17 bp, Homo sapiens
aaggaaggtggatggcc

SEQ ID NO: 3166253 - DNA, 15 bp, Homo sapiens
aaggaaggttcatgt

SEQ ID NO: 3166254 - DNA, 16 bp, Homo sapiens
aaggaagtgccccctc

SEQ ID NO: 3166255 - DNA, 15 bp, Homo sapiens
aaggaagtttgattt

SEQ ID NO: 3166256 - DNA, 21 bp, Homo sapiens
aaggaataaattgctccttga

SEQ ID NO: 3166257 - DNA, 17 bp, Homo sapiens
aaggaatagccagagag

SEQ ID NO: 3166258 - DNA, 13 bp, Homo sapiens
aaggaatcttctc

SEQ ID NO: 3166259 - DNA, 16 bp, Homo sapiens
aaggaatttcttaact

SEQ ID NO: 3166260 - DNA, 20 bp, Homo sapiens
aaggaatttcttaacttctt

SEQ ID NO: 3166261 - DNA, 13 bp, Homo sapiens
aaggaatttgtac

SEQ ID NO: 3166262 - DNA, 15 bp, Homo sapiens
aaggaatttgtactt

SEQ ID NO: 3166263 - DNA, 16 bp, Homo sapiens
aaggaatttgtacttc

SEQ ID NO: 3166264 - DNA, 21 bp, Homo sapiens
aaggacagactggccgggcag

SEQ ID NO: 3166265 - DNA, 15 bp, Homo sapiens
aaggacaggaccctc

SEQ ID NO: 3166266 - DNA, 16 bp, Homo sapiens
aaggacaggaggagga

SEQ ID NO: 3166267 - DNA, 17 bp, Homo sapiens
aaggacattatgtgtgc

SEQ ID NO: 3166268 - DNA, 14 bp, Homo sapiens
aaggaccagcgtcc

SEQ ID NO: 3166269 - DNA, 18 bp, Homo sapiens
aaggacccacccatcttc

SEQ ID NO: 3166270 - DNA, 24 bp, Homo sapiens
aaggacccacccatcttcctgctg

SEQ ID NO: 3166271 - DNA, 22 bp, Homo sapiens
aaggacccggaggggcctggca

SEQ ID NO: 3166272 - DNA, 19 bp, Homo sapiens
aaggaccgtggccctgccc

SEQ ID NO: 3166273 - DNA, 23 bp, Homo sapiens
aaggacctcctcttcccccttcc

SEQ ID NO: 3166274 - DNA, 17 bp, Homo sapiens
aaggacgggttggggcc

SEQ ID NO: 3166275 - DNA, 19 bp, Homo sapiens
aaggactatattaatcacc

SEQ ID NO: 3166276 - DNA, 21 bp, Homo sapiens
aaggactgactgagacacgat

SEQ ID NO: 3166277 - DNA, 16 bp, Homo sapiens
aaggacttcaggaaca

SEQ ID NO: 3166278 - DNA, 15 bp, Homo sapiens
aaggacttccacatt

SEQ ID NO: 3166279 - DNA, 17 bp, Homo sapiens
aaggacttccacatttt

SEQ ID NO: 3166280 - DNA, 17 bp, Homo sapiens
aaggacttgaaagcatc

SEQ ID NO: 3166281 - DNA, 16 bp, Homo sapiens
aaggagaatatgataa

SEQ ID NO: 3166282 - DNA, 22 bp, Homo sapiens
aaggagagcaagaaggaaagat

SEQ ID NO: 3166283 - DNA, 15 bp, Homo sapiens
aaggagagtggccat

SEQ ID NO: 3166284 - DNA, 22 bp, Homo sapiens
aaggagagttcaagcctgtggg

SEQ ID NO: 3166285 - DNA, 14 bp, Homo sapiens
aaggagcatcagcc

SEQ ID NO: 3166286 - DNA, 15 bp, Homo sapiens
aaggagccagtttgc

SEQ ID NO: 3166287 - DNA, 15 bp, Homo sapiens
aaggagccttgttgg

SEQ ID NO: 3166288 - DNA, 19 bp, Homo sapiens
aaggagctcaccctgcccg

SEQ ID NO: 3166289 - DNA, 21 bp, Homo sapiens
aaggagctgatttccaggccc

SEQ ID NO: 3166290 - DNA, 16 bp, Homo sapiens
aaggaggcatgcctct

SEQ ID NO: 3166291 - DNA, 18 bp, Homo sapiens
aaggaggcatgcctctga

SEQ ID NO: 3166292 - DNA, 14 bp, Homo sapiens
aaggaggctggcag

SEQ ID NO: 3166293 - DNA, 14 bp, Homo sapiens
aaggagggcagagc

SEQ ID NO: 3166294 - DNA, 16 bp, Homo sapiens
aaggagggcagagcca

SEQ ID NO: 3166295 - DNA, 17 bp, Homo sapiens
aaggagggcagagccat

SEQ ID NO: 3166296 - DNA, 15 bp, Homo sapiens
aaggaggggaagctg

SEQ ID NO: 3166297 - DNA, 18 bp, Homo sapiens
aaggaggggaagctgcag

SEQ ID NO: 3166298 - DNA, 19 bp, Homo sapiens
aaggagggtacagctgggc

SEQ ID NO: 3166299 - DNA, 19 bp, Homo sapiens
aaggataatgaaataatca

SEQ ID NO: 3166300 - DNA, 20 bp, Homo sapiens
aaggataatgaaataatcag

SEQ ID NO: 3166301 - DNA, 19 bp, Homo sapiens
aaggatagatcaaagtcaa

SEQ ID NO: 3166302 - DNA, 14 bp, Homo sapiens
aaggatatgattaa

SEQ ID NO: 3166303 - DNA, 17 bp, Homo sapiens
aaggatatttaagaaaa

SEQ ID NO: 3166304 - DNA, 17 bp, Homo sapiens
aaggatccggaaagaag

SEQ ID NO: 3166305 - DNA, 21 bp, Homo sapiens
aaggatctctcaggagcacag

SEQ ID NO: 3166306 - DNA, 13 bp, Homo sapiens
aaggatgaaagct

SEQ ID NO: 3166307 - DNA, 20 bp, Homo sapiens
aaggatgaagaacacagcat

SEQ ID NO: 3166308 - DNA, 22 bp, Homo sapiens
aaggatgaagaacacagcatgt

SEQ ID NO: 3166309 - DNA, 16 bp, Homo sapiens
aaggatgtcacagggc

SEQ ID NO: 3166310 - DNA, 17 bp, Homo sapiens
aaggatgtcacagggcc

SEQ ID NO: 3166311 - DNA, 17 bp, Homo sapiens
aaggatgtgattgtgga

SEQ ID NO: 3166312 - DNA, 14 bp, Homo sapiens
aaggattacagaaa

SEQ ID NO: 3166313 - DNA, 16 bp, Homo sapiens
aaggattacagaaact

SEQ ID NO: 3166314 - DNA, 18 bp, Homo sapiens
aaggattacagaaactga

SEQ ID NO: 3166315 - DNA, 19 bp, Homo sapiens
aaggattacagaaactgat

SEQ ID NO: 3166316 - DNA, 19 bp, Homo sapiens
aaggattatggaaaaataa

SEQ ID NO: 3166317 - DNA, 21 bp, Homo sapiens
aaggattgatcactttgttaa

SEQ ID NO: 3166318 - DNA, 21 bp, Homo sapiens
aaggattgtaaaaaaaaatgc

SEQ ID NO: 3166319 - DNA, 19 bp, Homo sapiens
aaggattttaccaaagcat

SEQ ID NO: 3166320 - DNA, 23 bp, Homo sapiens
aaggcaaaaaactcttaatctgt

SEQ ID NO: 3166321 - DNA, 14 bp, Homo sapiens
aaggcaaaaatgta

SEQ ID NO: 3166322 - DNA, 20 bp, Homo sapiens
aaggcaaagcacgaaatgtt

SEQ ID NO: 3166323 - DNA, 17 bp, Homo sapiens
aaggcacaaaattttgt

SEQ ID NO: 3166324 - DNA, 12 bp, Homo sapiens
aaggcacagtgg

SEQ ID NO: 3166325 - DNA, 19 bp, Homo sapiens
aaggcacagtgggagctga

SEQ ID NO: 3166326 - DNA, 14 bp, Homo sapiens
aaggcactctagat

SEQ ID NO: 3166327 - DNA, 22 bp, Homo sapiens
aaggcagagaaatctaagctgt

SEQ ID NO: 3166328 - DNA, 18 bp, Homo sapiens
aaggcagcctccagagcc

SEQ ID NO: 3166329 - DNA, 19 bp, Homo sapiens
aaggcagcctccagagcca

SEQ ID NO: 3166330 - DNA, 23 bp, Homo sapiens
aaggcagcctccagagccagcct

SEQ ID NO: 3166331 - DNA, 11 bp, Homo sapiens
aaggcagctgc

SEQ ID NO: 3166332 - DNA, 17 bp, Homo sapiens
aaggcagctgcctctgc

SEQ ID NO: 3166333 - DNA, 19 bp, Homo sapiens
aaggcagctgcctctgctc

SEQ ID NO: 3166334 - DNA, 12 bp, Homo sapiens
aaggcagctgct

SEQ ID NO: 3166335 - DNA, 13 bp, Homo sapiens
aaggcagctgctc

SEQ ID NO: 3166336 - DNA, 18 bp, Homo sapiens
aaggcagggaaaggctct

SEQ ID NO: 3166337 - DNA, 20 bp, Homo sapiens
aaggcaggtgcctccaggtg

SEQ ID NO: 3166338 - DNA, 22 bp, Homo sapiens
aaggcaggtgcctccaggtgtg

SEQ ID NO: 3166339 - DNA, 21 bp, Homo sapiens
aaggcatacgagagcagaggt

SEQ ID NO: 3166340 - DNA, 21 bp, Homo sapiens
aaggcatgatgttaaccagaa

SEQ ID NO: 3166341 - DNA, 15 bp, Homo sapiens
aaggcattgattgca

SEQ ID NO: 3166342 - DNA, 20 bp, Homo sapiens
aaggccaaagataaaaggtt

SEQ ID NO: 3166343 - DNA, 19 bp, Homo sapiens
aaggccagagtggcctggc

SEQ ID NO: 3166344 - DNA, 22 bp, Homo sapiens
aaggccagagtggcctggccag

SEQ ID NO: 3166345 - DNA, 21 bp, Homo sapiens
aaggccagtggaaattcaggt

SEQ ID NO: 3166346 - DNA, 14 bp, Homo sapiens
aaggccataaaaca

SEQ ID NO: 3166347 - DNA, 13 bp, Homo sapiens
aaggcccaagagc

SEQ ID NO: 3166348 - DNA, 15 bp, Homo sapiens
aaggcccaagagcag

SEQ ID NO: 3166349 - DNA, 15 bp, Homo sapiens
aaggcccacaggagg

SEQ ID NO: 3166350 - DNA, 18 bp, Homo sapiens
aaggcccagcccctagaa

SEQ ID NO: 3166351 - DNA, 12 bp, Homo sapiens
aaggcccctccc

SEQ ID NO: 3166352 - DNA, 19 bp, Homo sapiens
aaggccgaagctctggctg

SEQ ID NO: 3166353 - DNA, 20 bp, Homo sapiens
aaggccgaagctctggctga

SEQ ID NO: 3166354 - DNA, 16 bp, Homo sapiens
aaggccgtgtctctga

SEQ ID NO: 3166355 - DNA, 22 bp, Homo sapiens
aaggcctaggctaggacgttgg

SEQ ID NO: 3166356 - DNA, 16 bp, Homo sapiens
aaggcctcctccccca

SEQ ID NO: 3166357 - DNA, 14 bp, Homo sapiens
aaggcctgcacaca

SEQ ID NO: 3166358 - DNA, 15 bp, Homo sapiens
aaggcctgcacacaa

SEQ ID NO: 3166359 - DNA, 16 bp, Homo sapiens
aagttctgtgtattta

SEQ ID NO: 3166360 - DNA, 20 bp, Homo sapiens
aagttcttcacctctatcca

SEQ ID NO: 3166361 - DNA, 15 bp, Homo sapiens
aagttcttctccaat

SEQ ID NO: 3166362 - DNA, 16 bp, Homo sapiens
aagttgcagatgtatt

SEQ ID NO: 3166363 - DNA, 23 bp, Homo sapiens
aagttgcgacggagagaaaaaag

SEQ ID NO: 3166364 - DNA, 23 bp, Homo sapiens
aagttgctgtttattttttttgg

SEQ ID NO: 3166365 - DNA, 19 bp, Homo sapiens
aagttggcacatttcatga

SEQ ID NO: 3166366 - DNA, 17 bp, Homo sapiens
aagttggcttctgtttc

SEQ ID NO: 3166367 - DNA, 16 bp, Homo sapiens
aagttggtattaataa

SEQ ID NO: 3166368 - DNA, 14 bp, Homo sapiens
aagttgtacaaatg

SEQ ID NO: 3166369 - DNA, 15 bp, Homo sapiens
aagttgtacaaatgt

SEQ ID NO: 3166370 - DNA, 16 bp, Homo sapiens
aagttgtacaaatgta

SEQ ID NO: 3166371 - DNA, 20 bp, Homo sapiens
aagttgtgcttgagccagga

SEQ ID NO: 3166372 - DNA, 13 bp, Homo sapiens
aagttgttattgt

SEQ ID NO: 3166373 - DNA, 20 bp, Homo sapiens
aagttgttcacatatatgta

SEQ ID NO: 3166374 - DNA, 19 bp, Homo sapiens
aagtttaagtgtgcagcca

SEQ ID NO: 3166375 - DNA, 18 bp, Homo sapiens
aagtttacaagtgtatat

SEQ ID NO: 3166376 - DNA, 21 bp, Homo sapiens
aagtttacaagtgtatatcag

SEQ ID NO: 3166377 - DNA, 23 bp, Homo sapiens
aagtttacaagtgtatatcagaa

SEQ ID NO: 3166378 - DNA, 20 bp, Homo sapiens
aagtttacacctttatcttt

SEQ ID NO: 3166379 - DNA, 19 bp, Homo sapiens
aagtttacattgtaaatag

SEQ ID NO: 3166380 - DNA, 11 bp, Homo sapiens
aagtttagaga

SEQ ID NO: 3166381 - DNA, 16 bp, Homo sapiens
aagtttcaatgtgatt

SEQ ID NO: 3166382 - DNA, 12 bp, Homo sapiens
aagtttcaggtg

SEQ ID NO: 3166383 - DNA, 17 bp, Homo sapiens
aagtttcaggtgacatg

SEQ ID NO: 3166384 - DNA, 12 bp, Homo sapiens
aagtttcccttc

SEQ ID NO: 3166385 - DNA, 21 bp, Homo sapiens
aagtttcctaatcagaaattt

SEQ ID NO: 3166386 - DNA, 21 bp, Homo sapiens
aagtttctaagattctaaagg

SEQ ID NO: 3166387 - DNA, 14 bp, Homo sapiens
aagtttctattctg

SEQ ID NO: 3166388 - DNA, 13 bp, Homo sapiens
aagtttctcttct

SEQ ID NO: 3166389 - DNA, 20 bp, Homo sapiens
aagtttgaaaagcaatattg

SEQ ID NO: 3166390 - DNA, 15 bp, Homo sapiens
aagtttgatcaaatc

SEQ ID NO: 3166391 - DNA, 14 bp, Homo sapiens
aagtttgcactgta

SEQ ID NO: 3166392 - DNA, 21 bp, Homo sapiens
aagtttgcactgtatgctgga

SEQ ID NO: 3166393 - DNA, 19 bp, Homo sapiens
aagtttggcaatagtttgc

SEQ ID NO: 3166394 - DNA, 16 bp, Homo sapiens
aagtttgtaaaaatat

SEQ ID NO: 3166395 - DNA, 14 bp, Homo sapiens
aagtttgtgggggc

SEQ ID NO: 3166396 - DNA, 15 bp, Homo sapiens
aagtttgtgttctgt

SEQ ID NO: 3166397 - DNA, 21 bp, Homo sapiens
aagttttaacttccagtggct

SEQ ID NO: 3166398 - DNA, 13 bp, Homo sapiens
aagttttatatgc

SEQ ID NO: 3166399 - DNA, 18 bp, Homo sapiens
aagttttattataaattc

SEQ ID NO: 3166400 - DNA, 13 bp, Homo sapiens
aagttttcctgag

SEQ ID NO: 3166401 - DNA, 11 bp, Homo sapiens
aagttttcctt

SEQ ID NO: 3166402 - DNA, 13 bp, Homo sapiens
aagttttcctttg

SEQ ID NO: 3166403 - DNA, 21 bp, Homo sapiens
aagttttctgtagtcatttac

SEQ ID NO: 3166404 - DNA, 22 bp, Homo sapiens
aagttttctgtagtcatttact

SEQ ID NO: 3166405 - DNA, 12 bp, Homo sapiens
aagttttgaaaa

SEQ ID NO: 3166406 - DNA, 23 bp, Homo sapiens
aagttttgagtagatattacttt

SEQ ID NO: 3166407 - DNA, 12 bp, Homo sapiens
aagttttgtata

SEQ ID NO: 3166408 - DNA, 18 bp, Homo sapiens
aagtttttgaaatacctt

SEQ ID NO: 3166409 - DNA, 12 bp, Homo sapiens
aagtttttgtac

SEQ ID NO: 3166410 - DNA, 15 bp, Homo sapiens
aataaaaaatagaca

SEQ ID NO: 3166411 - DNA, 13 bp, Homo sapiens
aataaaaaatctg

SEQ ID NO: 3166412 - DNA, 17 bp, Homo sapiens
aataaaaaatctgaaga

SEQ ID NO: 3166413 - DNA, 21 bp, Homo sapiens
aataaaaaatctgaagaggct

SEQ ID NO: 3166414 - DNA, 13 bp, Homo sapiens
aataaaaaatgga

SEQ ID NO: 3166415 - DNA, 21 bp, Homo sapiens
aataaaaacccacaaaaatgt

SEQ ID NO: 3166416 - DNA, 17 bp, Homo sapiens
aataaaaactaatttca

SEQ ID NO: 3166417 - DNA, 19 bp, Homo sapiens
aataaaaagtgacacagca

SEQ ID NO: 3166418 - DNA, 12 bp, Homo sapiens
aataaaaagttc

SEQ ID NO: 3166419 - DNA, 21 bp, Homo sapiens
aataaaaatcaacttgtgtac

SEQ ID NO: 3166420 - DNA, 14 bp, Homo sapiens
aataaaaatgttta

SEQ ID NO: 3166421 - DNA, 13 bp, Homo sapiens
aataaaacaggac

SEQ ID NO: 3166422 - DNA, 12 bp, Homo sapiens
aataaaaccttt

SEQ ID NO: 3166423 - DNA, 20 bp, Homo sapiens
aataaaactgcacagtgctg

SEQ ID NO: 3166424 - DNA, 22 bp, Homo sapiens
aataaaacttatgctagtttat

SEQ ID NO: 3166425 - DNA, 13 bp, Homo sapiens
aataaaacttcac

SEQ ID NO: 3166426 - DNA, 22 bp, Homo sapiens
aataaaactttatgtactgctg

SEQ ID NO: 3166427 - DNA, 13 bp, Homo sapiens
aataaaagcacaa

SEQ ID NO: 3166428 - DNA, 22 bp, Homo sapiens
aataaaagctataaagtatata

SEQ ID NO: 3166429 - DNA, 14 bp, Homo sapiens
aataaaagtacaaa

SEQ ID NO: 3166430 - DNA, 16 bp, Homo sapiens
aataaaataattatct

SEQ ID NO: 3166431 - DNA, 16 bp, Homo sapiens
aataaaataattctaa

SEQ ID NO: 3166432 - DNA, 13 bp, Homo sapiens
aataaaatcaatt

SEQ ID NO: 3166433 - DNA, 14 bp, Homo sapiens
aataaaatgaaaat

SEQ ID NO: 3166434 - DNA, 19 bp, Homo sapiens
aataaaatgaaaattgtat

SEQ ID NO: 3166435 - DNA, 13 bp, Homo sapiens
aataaaatgtgta

SEQ ID NO: 3166436 - DNA, 15 bp, Homo sapiens
aataaaattggcacc

SEQ ID NO: 3166437 - DNA, 12 bp, Homo sapiens
aataaaatttaa

SEQ ID NO: 3166438 - DNA, 21 bp, Homo sapiens
aataaaatttctaagagagct

SEQ ID NO: 3166439 - DNA, 13 bp, Homo sapiens
aataaacaaataa

SEQ ID NO: 3166440 - DNA, 19 bp, Homo sapiens
aataaacactggctctggg

SEQ ID NO: 3166441 - DNA, 20 bp, Homo sapiens
aataaacactggctctggga

SEQ ID NO: 3166442 - DNA, 22 bp, Homo sapiens
aataaacactggctctgggact

SEQ ID NO: 3166443 - DNA, 21 bp, Homo sapiens
aataaacactggtgccaacca

SEQ ID NO: 3166444 - DNA, 16 bp, Homo sapiens
aataaacagctattta

SEQ ID NO: 3166445 - DNA, 17 bp, Homo sapiens
aataaacagctatttaa

SEQ ID NO: 3166446 - DNA, 16 bp, Homo sapiens
aataaacaggaatttt

SEQ ID NO: 3166447 - DNA, 18 bp, Homo sapiens
aataaacaggaattttat

SEQ ID NO: 3166448 - DNA, 15 bp, Homo sapiens
aataaacagtatatt

SEQ ID NO: 3166449 - DNA, 22 bp, Homo sapiens
aataaacattaattttgtgcat

SEQ ID NO: 3166450 - DNA, 23 bp, Homo sapiens
aataaacattaattttgtgcatt

SEQ ID NO: 3166451 - DNA, 17 bp, Homo sapiens
aataaaccaaaggacat

SEQ ID NO: 3166452 - DNA, 20 bp, Homo sapiens
aataaacctcaaaatgtcta

SEQ ID NO: 3166453 - DNA, 18 bp, Homo sapiens
aataaacctgggctcagc

SEQ ID NO: 3166454 - DNA, 21 bp, Homo sapiens
aataaactgaatattttggaa

SEQ ID NO: 3166455 - DNA, 22 bp, Homo sapiens
aataaactgaatattttggaaa

SEQ ID NO: 3166456 - DNA, 10 bp, Homo sapiens
aataaactgg

SEQ ID NO: 3166457 - DNA, 17 bp, Homo sapiens
aataaactgtattaaat

SEQ ID NO: 3166458 - DNA, 13 bp, Homo sapiens
aataaactgttta

SEQ ID NO: 3166459 - DNA, 16 bp, Homo sapiens
aataaactgtttatat

SEQ ID NO: 3166460 - DNA, 19 bp, Homo sapiens
aataaacttagaggaaaat

SEQ ID NO: 3166461 - DNA, 20 bp, Homo sapiens
aataaacttagaggaaaatg

SEQ ID NO: 3166462 - DNA, 13 bp, Homo sapiens
aataaactttaat

SEQ ID NO: 3166463 - DNA, 17 bp, Homo sapiens
aataaactttttttcaa

SEQ ID NO: 3166464 - DNA, 21 bp, Homo sapiens
aataaactttttttcaatgtg

SEQ ID NO: 3166465 - DNA, 21 bp, Homo sapiens
aataaagaactccttattttg

SEQ ID NO: 3166466 - DNA, 18 bp, Homo sapiens
aataaagagttagaatga

SEQ ID NO: 3166467 - DNA, 13 bp, Homo sapiens
aataaagataacc

SEQ ID NO: 3166468 - DNA, 12 bp, Homo sapiens
aataaagcagcc

SEQ ID NO: 3166469 - DNA, 22 bp, Homo sapiens
aataaagcagcctgattgaaaa

SEQ ID NO: 3166470 - DNA, 10 bp, Homo sapiens
aataaagcat

SEQ ID NO: 3166471 - DNA, 16 bp, Homo sapiens
aataaagccttttaaa

SEQ ID NO: 3166472 - DNA, 13 bp, Homo sapiens
aataaaggcagct

SEQ ID NO: 3166473 - DNA, 15 bp, Homo sapiens
aataaaggcagctgc

SEQ ID NO: 3166474 - DNA, 21 bp, Homo sapiens
aataaaggcagctgcctctgc

SEQ ID NO: 3166475 - DNA, 12 bp, Homo sapiens
aataaagtataa

SEQ ID NO: 3166476 - DNA, 14 bp, Homo sapiens
aataaagtattcta

SEQ ID NO: 3166477 - DNA, 13 bp, Homo sapiens
aataaagtgtttt

SEQ ID NO: 3166478 - DNA, 17 bp, Homo sapiens
aataaagtgttttcaga

SEQ ID NO: 3166479 - DNA, 19 bp, Homo sapiens
aataaagtttgcttagaaa

SEQ ID NO: 3166480 - DNA, 18 bp, Homo sapiens
aataaataaaaactaatt

SEQ ID NO: 3166481 - DNA, 12 bp, Homo sapiens
aataaatactgc

SEQ ID NO: 3166482 - DNA, 19 bp, Homo sapiens
aataaatagctatatccat

SEQ ID NO: 3166483 - DNA, 21 bp, Homo sapiens
aataaatagctatatccatgt

SEQ ID NO: 3166484 - DNA, 12 bp, Homo sapiens
aataaatatacc

SEQ ID NO: 3166485 - DNA, 15 bp, Homo sapiens
aataaatatatctac

SEQ ID NO: 3166486 - DNA, 14 bp, Homo sapiens
aattttaaagtatg

SEQ ID NO: 3166487 - DNA, 13 bp, Homo sapiens
aattttaaagtgc

SEQ ID NO: 3166488 - DNA, 22 bp, Homo sapiens
aattttaaataaaagtgatcaa

SEQ ID NO: 3166489 - DNA, 12 bp, Homo sapiens
aattttaaatta

SEQ ID NO: 3166490 - DNA, 13 bp, Homo sapiens
aattttaatgcta

SEQ ID NO: 3166491 - DNA, 13 bp, Homo sapiens
aattttaatgtga

SEQ ID NO: 3166492 - DNA, 16 bp, Homo sapiens
aattttaatgtgaaga

SEQ ID NO: 3166493 - DNA, 22 bp, Homo sapiens
aattttaatgtgaagacatttt

SEQ ID NO: 3166494 - DNA, 13 bp, Homo sapiens
aattttacacatt

SEQ ID NO: 3166495 - DNA, 13 bp, Homo sapiens
aattttagaactt

SEQ ID NO: 3166496 - DNA, 15 bp, Homo sapiens
aattttagaacttta

SEQ ID NO: 3166497 - DNA, 23 bp, Homo sapiens
aattttaggcactcttaaatgat

SEQ ID NO: 3166498 - DNA, 15 bp, Homo sapiens
aattttagtacattt

SEQ ID NO: 3166499 - DNA, 19 bp, Homo sapiens
aattttagtagagacaggg

SEQ ID NO: 3166500 - DNA, 21 bp, Homo sapiens
aattttataagcaaatttcaa

SEQ ID NO: 3166501 - DNA, 15 bp, Homo sapiens
aattttataatctgc

SEQ ID NO: 3166502 - DNA, 19 bp, Homo sapiens
aattttataggactgttct

SEQ ID NO: 3166503 - DNA, 19 bp, Homo sapiens
aattttatctgtttcctga

SEQ ID NO: 3166504 - DNA, 12 bp, Homo sapiens
aattttatgaat

SEQ ID NO: 3166505 - DNA, 22 bp, Homo sapiens
aattttattttaaaatttcata

SEQ ID NO: 3166506 - DNA, 15 bp, Homo sapiens
aattttattttgctg

SEQ ID NO: 3166507 - DNA, 16 bp, Homo sapiens
aattttattttgctga

SEQ ID NO: 3166508 - DNA, 23 bp, Homo sapiens
aattttattttgctgagttgttc

SEQ ID NO: 3166509 - DNA, 20 bp, Homo sapiens
aattttattttgtgctcatt

SEQ ID NO: 3166510 - DNA, 14 bp, Homo sapiens
aattttcaagttta

SEQ ID NO: 3166511 - DNA, 15 bp, Homo sapiens
aattttccaaccttt

SEQ ID NO: 3166512 - DNA, 23 bp, Homo sapiens
aattttcctcaatcacactacac

SEQ ID NO: 3166513 - DNA, 12 bp, Homo sapiens
aattttctagac

SEQ ID NO: 3166514 - DNA, 17 bp, Homo sapiens
aattttctagactttct

SEQ ID NO: 3166515 - DNA, 23 bp, Homo sapiens
aattttctccctttatgtatctc

SEQ ID NO: 3166516 - DNA, 17 bp, Homo sapiens
aattttcttcagttggt

SEQ ID NO: 3166517 - DNA, 19 bp, Homo sapiens
aattttgaagtgctgttta

SEQ ID NO: 3166518 - DNA, 20 bp, Homo sapiens
aattttgaagtgctgtttat

SEQ ID NO: 3166519 - DNA, 13 bp, Homo sapiens
aattttgatatac

SEQ ID NO: 3166520 - DNA, 22 bp, Homo sapiens
aattttgatatacattgtgtga

SEQ ID NO: 3166521 - DNA, 18 bp, Homo sapiens
aattttgcaaatataaac

SEQ ID NO: 3166522 - DNA, 18 bp, Homo sapiens
aattttgcatactgaaaa

SEQ ID NO: 3166523 - DNA, 16 bp, Homo sapiens
aattttgcttttaatt

SEQ ID NO: 3166524 - DNA, 18 bp, Homo sapiens
aattttgcttttaattaa

SEQ ID NO: 3166525 - DNA, 13 bp, Homo sapiens
aattttgtacaaa

SEQ ID NO: 3166526 - DNA, 14 bp, Homo sapiens
aattttgtacaaat

SEQ ID NO: 3166527 - DNA, 20 bp, Homo sapiens
aattttgtatgttaaagaga

SEQ ID NO: 3166528 - DNA, 18 bp, Homo sapiens
aattttgtgcattctttg

SEQ ID NO: 3166529 - DNA, 21 bp, Homo sapiens
aattttgtgcattctttggta

SEQ ID NO: 3166530 - DNA, 22 bp, Homo sapiens
aatttttaaagtatatatttat

SEQ ID NO: 3166531 - DNA, 20 bp, Homo sapiens
aatttttaaatgtaaaacat

SEQ ID NO: 3166532 - DNA, 11 bp, Homo sapiens
aatttttaata

SEQ ID NO: 3166533 - DNA, 20 bp, Homo sapiens
aatttttaccctaatgtctt

SEQ ID NO: 3166534 - DNA, 22 bp, Homo sapiens
aatttttaccctaatgtcttca

SEQ ID NO: 3166535 - DNA, 16 bp, Homo sapiens
aatttttaggaagttt

SEQ ID NO: 3166536 - DNA, 22 bp, Homo sapiens
aatttttaggaagttttctgta

SEQ ID NO: 3166537 - DNA, 22 bp, Homo sapiens
aatttttatatttaattattaa

SEQ ID NO: 3166538 - DNA, 15 bp, Homo sapiens
aatttttatttcttt

SEQ ID NO: 3166539 - DNA, 17 bp, Homo sapiens
aatttttatttttgaac

SEQ ID NO: 3166540 - DNA, 20 bp, Homo sapiens
aatttttctcagtttgtata

SEQ ID NO: 3166541 - DNA, 13 bp, Homo sapiens
aatttttgaaaag

SEQ ID NO: 3166542 - DNA, 18 bp, Homo sapiens
aatttttgcttttagaaa

SEQ ID NO: 3166543 - DNA, 20 bp, Homo sapiens
aatttttgcttttagaaaag

SEQ ID NO: 3166544 - DNA, 20 bp, Homo sapiens
aatttttggggaaaaaagca

SEQ ID NO: 3166545 - DNA, 17 bp, Homo sapiens
aattttttataaaagtg

SEQ ID NO: 3166546 - DNA, 18 bp, Homo sapiens
aattttttatcatgcatg

SEQ ID NO: 3166547 - DNA, 12 bp, Homo sapiens
aattttttgaaa

SEQ ID NO: 3166548 - DNA, 20 bp, Homo sapiens
aattttttggcacttgccat

SEQ ID NO: 3166549 - DNA, 15 bp, Homo sapiens
aatttttttcaatat

SEQ ID NO: 3166550 - DNA, 16 bp, Homo sapiens
aattttttttaaagaa

SEQ ID NO: 3166551 - DNA, 15 bp, Homo sapiens
aattttttttaatgt

SEQ ID NO: 3166552 - DNA, 20 bp, Homo sapiens
aattttttttaatgtacaag

SEQ ID NO: 3166553 - DNA, 20 bp, Homo sapiens
aattttttttcaaaaatgct

SEQ ID NO: 3166554 - DNA, 19 bp, Homo sapiens
aatttttttttcctagccc

SEQ ID NO: 3166555 - DNA, 23 bp, Homo sapiens
aattttttttttcctcttcagaa

SEQ ID NO: 3166556 - DNA, 20 bp, Homo sapiens
aattttttttttttaacttt

SEQ ID NO: 3166557 - DNA, 21 bp, Homo sapiens
acaaaaaaaaagttttatttt

SEQ ID NO: 3166558 - DNA, 18 bp, Homo sapiens
acaaaaaacagattctat

SEQ ID NO: 3166559 - DNA, 15 bp, Homo sapiens
acaaaaaactcccct

SEQ ID NO: 3166560 - DNA, 12 bp, Homo sapiens
acaaaaaagcaa

SEQ ID NO: 3166561 - DNA, 14 bp, Homo sapiens
acaaaaaatgtttt

SEQ ID NO: 3166562 - DNA, 14 bp, Homo sapiens
acaaaaagaaatct

SEQ ID NO: 3166563 - DNA, 20 bp, Homo sapiens
acaaaaagaaatcttgtctt

SEQ ID NO: 3166564 - DNA, 21 bp, Homo sapiens
acaaaaagaaatcttgtctta

SEQ ID NO: 3166565 - DNA, 20 bp, Homo sapiens
acaaaaagccacaatgaaca

SEQ ID NO: 3166566 - DNA, 20 bp, Homo sapiens
acaaaaaggttctcaggtgt

SEQ ID NO: 3166567 - DNA, 22 bp, Homo sapiens
acaaaaatgaaagcatgtctca

SEQ ID NO: 3166568 - DNA, 12 bp, Homo sapiens
acaaaactgtaa

SEQ ID NO: 3166569 - DNA, 19 bp, Homo sapiens
acaaaactgttcttttgca

SEQ ID NO: 3166570 - DNA, 20 bp, Homo sapiens
acaaaactgttcttttgcat

SEQ ID NO: 3166571 - DNA, 19 bp, Homo sapiens
acaaaacttaaaagtattc

SEQ ID NO: 3166572 - DNA, 20 bp, Homo sapiens
acaaaacttaaaagtattca

SEQ ID NO: 3166573 - DNA, 21 bp, Homo sapiens
acaaaacttaaaagtattcat

SEQ ID NO: 3166574 - DNA, 18 bp, Homo sapiens
acaaaacttcttgtcaga

SEQ ID NO: 3166575 - DNA, 19 bp, Homo sapiens
acaaaacttcttgtcagac

SEQ ID NO: 3166576 - DNA, 18 bp, Homo sapiens
acaaaagagcatggatgc

SEQ ID NO: 3166577 - DNA, 21 bp, Homo sapiens
acaaaagagcatggatgcatt

SEQ ID NO: 3166578 - DNA, 23 bp, Homo sapiens
acaaaagaggagcacttccaaaa

SEQ ID NO: 3166579 - DNA, 21 bp, Homo sapiens
acaaaagatgtatccttccaa

SEQ ID NO: 3166580 - DNA, 23 bp, Homo sapiens
acaaaagcaagactgttgctcaa

SEQ ID NO: 3166581 - DNA, 18 bp, Homo sapiens
acaaaagcacttactttt

SEQ ID NO: 3166582 - DNA, 21 bp, Homo sapiens
acaaaagggtttaaactgatt

SEQ ID NO: 3166583 - DNA, 12 bp, Homo sapiens
acaaaatagaag

SEQ ID NO: 3166584 - DNA, 16 bp, Homo sapiens
acaaaatatttcccat

SEQ ID NO: 3166585 - DNA, 20 bp, Homo sapiens
acaaaatccagctatgaata

SEQ ID NO: 3166586 - DNA, 14 bp, Homo sapiens
acaaaatctcctct

SEQ ID NO: 3166587 - DNA, 23 bp, Homo sapiens
acaaaatctgaactctcaaaagt

SEQ ID NO: 3166588 - DNA, 18 bp, Homo sapiens
acaaaattcaaagcatgg

SEQ ID NO: 3166589 - DNA, 20 bp, Homo sapiens
acaaaatttagtttttgttc

SEQ ID NO: 3166590 - DNA, 13 bp, Homo sapiens
acaaaatttgact

SEQ ID NO: 3166591 - DNA, 15 bp, Homo sapiens
acaaaattttatttt

SEQ ID NO: 3166592 - DNA, 22 bp, Homo sapiens
acaaaattttattttgtgctca

SEQ ID NO: 3166593 - DNA, 16 bp, Homo sapiens
acaaaattttctcatt

SEQ ID NO: 3166594 - DNA, 13 bp, Homo sapiens
acaaaattttgtt

SEQ ID NO: 3166595 - DNA, 23 bp, Homo sapiens
acaaacaaaaaatacaataaata

SEQ ID NO: 3166596 - DNA, 22 bp, Homo sapiens
acaaacatctaataagtatata

SEQ ID NO: 3166597 - DNA, 22 bp, Homo sapiens
acaaacatggatacttcctggg

SEQ ID NO: 3166598 - DNA, 16 bp, Homo sapiens
acaaacattgtgttga

SEQ ID NO: 3166599 - DNA, 22 bp, Homo sapiens
acaaaccaacatctttgcgaaa

SEQ ID NO: 3166600 - DNA, 12 bp, Homo sapiens
acaaaccaagtc

SEQ ID NO: 3166601 - DNA, 14 bp, Homo sapiens
acaaaccatgcaaa

SEQ ID NO: 3166602 - DNA, 18 bp, Homo sapiens
acaaacctaccaaaatgg

SEQ ID NO: 3166603 - DNA, 21 bp, Homo sapiens
acaaacctaccaaaatggaat

SEQ ID NO: 3166604 - DNA, 16 bp, Homo sapiens
acaaacctcactgaga

SEQ ID NO: 3166605 - DNA, 14 bp, Homo sapiens
acaaactaaaaata

SEQ ID NO: 3166606 - DNA, 15 bp, Homo sapiens
acaaactaaaaatat

SEQ ID NO: 3166607 - DNA, 13 bp, Homo sapiens
acaaactcttgaa

SEQ ID NO: 3166608 - DNA, 16 bp, Homo sapiens
acaaactgcaatagag

SEQ ID NO: 3166609 - DNA, 22 bp, Homo sapiens
acaaactgcttcccttactttg

SEQ ID NO: 3166610 - DNA, 14 bp, Homo sapiens
acaaactggagtct

SEQ ID NO: 3166611 - DNA, 22 bp, Homo sapiens
acaccattctcctgcctcaccc

SEQ ID NO: 3166612 - DNA, 19 bp, Homo sapiens
acacccaaagaggtattta

SEQ ID NO: 3166613 - DNA, 16 bp, Homo sapiens
acacccaatgctgctc

SEQ ID NO: 3166614 - DNA, 21 bp, Homo sapiens
acacccaccctgtgccatcac

SEQ ID NO: 3166615 - DNA, 23 bp, Homo sapiens
acacccaccgtccgccctgctcc

SEQ ID NO: 3166616 - DNA, 20 bp, Homo sapiens
acacccagcccacttctgcc

SEQ ID NO: 3166617 - DNA, 13 bp, Homo sapiens
acacccagcctca

SEQ ID NO: 3166618 - DNA, 17 bp, Homo sapiens
acacccagcctcagtcc

SEQ ID NO: 3166619 - DNA, 12 bp, Homo sapiens
acaccccaggcc

SEQ ID NO: 3166620 - DNA, 18 bp, Homo sapiens
acacccccacctcctgca

SEQ ID NO: 3166621 - DNA, 17 bp, Homo sapiens
acaccctcactctgcca

SEQ ID NO: 3166622 - DNA, 14 bp, Homo sapiens
acaccctccagaga

SEQ ID NO: 3166623 - DNA, 13 bp, Homo sapiens
acaccctcccccg

SEQ ID NO: 3166624 - DNA, 16 bp, Homo sapiens
acaccctcccccgcca

SEQ ID NO: 3166625 - DNA, 16 bp, Homo sapiens
acaccctgcccctgca

SEQ ID NO: 3166626 - DNA, 23 bp, Homo sapiens
acaccctgcccctgcaaagacag

SEQ ID NO: 3166627 - DNA, 15 bp, Homo sapiens
acacccttagaaaat

SEQ ID NO: 3166628 - DNA, 13 bp, Homo sapiens
acaccgactagcc

SEQ ID NO: 3166629 - DNA, 14 bp, Homo sapiens
acaccgggcctgga

SEQ ID NO: 3166630 - DNA, 16 bp, Homo sapiens
acacctaccatgctgc

SEQ ID NO: 3166631 - DNA, 18 bp, Homo sapiens
acacctagctttattctt

SEQ ID NO: 3166632 - DNA, 18 bp, Homo sapiens
acacctcagttcccttgg

SEQ ID NO: 3166633 - DNA, 21 bp, Homo sapiens
acacctcagttcccttggcct

SEQ ID NO: 3166634 - DNA, 12 bp, Homo sapiens
acacctccaccg

SEQ ID NO: 3166635 - DNA, 13 bp, Homo sapiens
acacctcccagga

SEQ ID NO: 3166636 - DNA, 21 bp, Homo sapiens
acacctgactctgaaatctga

SEQ ID NO: 3166637 - DNA, 17 bp, Homo sapiens
acacctgcaatcccagc

SEQ ID NO: 3166638 - DNA, 21 bp, Homo sapiens
acacctgcaatcccagcacct

SEQ ID NO: 3166639 - DNA, 12 bp, Homo sapiens
acacctggactg

SEQ ID NO: 3166640 - DNA, 17 bp, Homo sapiens
acacctggactgagcca

SEQ ID NO: 3166641 - DNA, 20 bp, Homo sapiens
acacctgggcatttggtgag

SEQ ID NO: 3166642 - DNA, 15 bp, Homo sapiens
acacctgtgcctcct

SEQ ID NO: 3166643 - DNA, 16 bp, Homo sapiens
acaccttcatccagat

SEQ ID NO: 3166644 - DNA, 15 bp, Homo sapiens
acaccttccagggcc

SEQ ID NO: 3166645 - DNA, 16 bp, Homo sapiens
acaccttccagggccc

SEQ ID NO: 3166646 - DNA, 14 bp, Homo sapiens
acaccttccccacc

SEQ ID NO: 3166647 - DNA, 20 bp, Homo sapiens
acaccttccccacccttgag

SEQ ID NO: 3166648 - DNA, 16 bp, Homo sapiens
acaccttcctcctgca

SEQ ID NO: 3166649 - DNA, 17 bp, Homo sapiens
acaccttcctcctgcag

SEQ ID NO: 3166650 - DNA, 18 bp, Homo sapiens
acaccttcctcctgcaga

SEQ ID NO: 3166651 - DNA, 18 bp, Homo sapiens
acaccttctgagtattct

SEQ ID NO: 3166652 - DNA, 21 bp, Homo sapiens
acaccttctgagtattctcat

SEQ ID NO: 3166653 - DNA, 16 bp, Homo sapiens
acaccttgacagggca

SEQ ID NO: 3166654 - DNA, 23 bp, Homo sapiens
acaccttggacatcctcctccca

SEQ ID NO: 3166655 - DNA, 15 bp, Homo sapiens
acacctttaggttct

SEQ ID NO: 3166656 - DNA, 15 bp, Homo sapiens
acacgatgcatttaa

SEQ ID NO: 3166657 - DNA, 13 bp, Homo sapiens
acacgattagctt

SEQ ID NO: 3166658 - DNA, 20 bp, Homo sapiens
acacgattagctttattatg

SEQ ID NO: 3166659 - DNA, 21 bp, Homo sapiens
acacgcaagggcatcaggcac

SEQ ID NO: 3166660 - DNA, 24 bp, Homo sapiens
acacgcaagggcatcaggcactgg

SEQ ID NO: 3166661 - DNA, 13 bp, Homo sapiens
acacgcacgcaca

SEQ ID NO: 3166662 - DNA, 16 bp, Homo sapiens
acacgcacgcacacac

SEQ ID NO: 3166663 - DNA, 17 bp, Homo sapiens
acacgcacgcacacaca

SEQ ID NO: 3166664 - DNA, 16 bp, Homo sapiens
acacgccttcccctca

SEQ ID NO: 3166665 - DNA, 21 bp, Homo sapiens
acacgcgggcgcgatcccaca

SEQ ID NO: 3166666 - DNA, 15 bp, Homo sapiens
acacgcgtgcacaca

SEQ ID NO: 3166667 - DNA, 16 bp, Homo sapiens
acacgctcgcgggcag

SEQ ID NO: 3166668 - DNA, 18 bp, Homo sapiens
acacggagcccagccctc

SEQ ID NO: 3166669 - DNA, 18 bp, Homo sapiens
acacggaggcatctgcac

SEQ ID NO: 3166670 - DNA, 13 bp, Homo sapiens
acacgtatttata

SEQ ID NO: 3166671 - DNA, 23 bp, Homo sapiens
acacgtatttatatttggaaaga

SEQ ID NO: 3166672 - DNA, 15 bp, Homo sapiens
acacgtgaggggggg

SEQ ID NO: 3166673 - DNA, 12 bp, Homo sapiens
acacgtgtcctg

SEQ ID NO: 3166674 - DNA, 23 bp, Homo sapiens
acacgttcacccatcttatcaag

SEQ ID NO: 3166675 - DNA, 15 bp, Homo sapiens
acactaaaattttag

SEQ ID NO: 3166676 - DNA, 13 bp, Homo sapiens
acactaacatttc

SEQ ID NO: 3166677 - DNA, 17 bp, Homo sapiens
acactaaccacgctgga

SEQ ID NO: 3166678 - DNA, 15 bp, Homo sapiens
acactaacctgggtt

SEQ ID NO: 3166679 - DNA, 20 bp, Homo sapiens
acactaactcaccagcccca

SEQ ID NO: 3166680 - DNA, 14 bp, Homo sapiens
acactaagggtgta

SEQ ID NO: 3166681 - DNA, 14 bp, Homo sapiens
acactactacctct

SEQ ID NO: 3166682 - DNA, 17 bp, Homo sapiens
acactactgctaaatcc

SEQ ID NO: 3166683 - DNA, 14 bp, Homo sapiens
acactagaaagaag

SEQ ID NO: 3166684 - DNA, 17 bp, Homo sapiens
acactagcccaatgaaa

SEQ ID NO: 3166685 - DNA, 19 bp, Homo sapiens
acactatggtatttgagtg

SEQ ID NO: 3166686 - DNA, 22 bp, Homo sapiens
acactatggtatttgagtgttt

SEQ ID NO: 3166687 - DNA, 19 bp, Homo sapiens
acactattttcagaatctg

SEQ ID NO: 3166688 - DNA, 19 bp, Homo sapiens
acactcaaaagacaaacat

SEQ ID NO: 3166689 - DNA, 21 bp, Homo sapiens
acactcaaaagacaaacatgc

SEQ ID NO: 3166690 - DNA, 19 bp, Homo sapiens
acactcagacctgaattct

SEQ ID NO: 3166691 - DNA, 22 bp, Homo sapiens
acactccaccctccaccttcca

SEQ ID NO: 3166692 - DNA, 12 bp, Homo sapiens
acactccagcct

SEQ ID NO: 3166693 - DNA, 16 bp, Homo sapiens
acactccaggccctgc

SEQ ID NO: 3166694 - DNA, 16 bp, Homo sapiens
acactccagtgccagc

SEQ ID NO: 3166695 - DNA, 19 bp, Homo sapiens
acactctgccagcaaagag

SEQ ID NO: 3166696 - DNA, 21 bp, Homo sapiens
acactcttcagtgactcctgc

SEQ ID NO: 3166697 - DNA, 23 bp, Homo sapiens
acactcttcagtgactcctgctg

SEQ ID NO: 3166698 - DNA, 12 bp, Homo sapiens
acactctttgta

SEQ ID NO: 3166699 - DNA, 16 bp, Homo sapiens
acactgaaaaattata

SEQ ID NO: 3166700 - DNA, 22 bp, Homo sapiens
acactgaaaagaaggaaagatg

SEQ ID NO: 3166701 - DNA, 15 bp, Homo sapiens
acactgaaaccaaaa

SEQ ID NO: 3166702 - DNA, 19 bp, Homo sapiens
acactgaaaccaaaacata

SEQ ID NO: 3166703 - DNA, 23 bp, Homo sapiens
acactgaatatttatatttcact

SEQ ID NO: 3166704 - DNA, 23 bp, Homo sapiens
acactgaccttggagagacacag

SEQ ID NO: 3166705 - DNA, 17 bp, Homo sapiens
acactgagccccacctc

SEQ ID NO: 3166706 - DNA, 23 bp, Homo sapiens
acactgagttctatcagttatcc

SEQ ID NO: 3166707 - DNA, 15 bp, Homo sapiens
acactgataaaagtt

SEQ ID NO: 3166708 - DNA, 20 bp, Homo sapiens
acactgcagtgaccacttat

SEQ ID NO: 3166709 - DNA, 20 bp, Homo sapiens
acactgccaaataaacagct

SEQ ID NO: 3166710 - DNA, 16 bp, Homo sapiens
acactgcctgtatact

SEQ ID NO: 3166711 - DNA, 13 bp, Homo sapiens
acactgctgcacc

SEQ ID NO: 3166712 - DNA, 15 bp, Homo sapiens
acactgctgcaccag

SEQ ID NO: 3166713 - DNA, 19 bp, Homo sapiens
acactgctgcaccagagtg

SEQ ID NO: 3166714 - DNA, 21 bp, Homo sapiens
acactgctgctccagtgcagg

SEQ ID NO: 3166715 - DNA, 11 bp, Homo sapiens
acactgctgta

SEQ ID NO: 3166716 - DNA, 21 bp, Homo sapiens
acactgctgtacccagatgcc

SEQ ID NO: 3166717 - DNA, 22 bp, Homo sapiens
acactggcacactgctcttaag

SEQ ID NO: 3166718 - DNA, 13 bp, Homo sapiens
acactggcccctc

SEQ ID NO: 3166719 - DNA, 13 bp, Homo sapiens
acactgggtggtg

SEQ ID NO: 3166720 - DNA, 13 bp, Homo sapiens
acactgtgccctg

SEQ ID NO: 3166721 - DNA, 14 bp, Homo sapiens
acactgtgccctgg

SEQ ID NO: 3166722 - DNA, 16 bp, Homo sapiens
acactgtgccctggtg

SEQ ID NO: 3166723 - DNA, 17 bp, Homo sapiens
acactgtgccctggtgg

SEQ ID NO: 3166724 - DNA, 19 bp, Homo sapiens
acactgtggaactaataaa

SEQ ID NO: 3166725 - DNA, 23 bp, Homo sapiens
acactgtggaactaataaataca

SEQ ID NO: 3166726 - DNA, 23 bp, Homo sapiens
acacttaaaattgtaacctgcat

SEQ ID NO: 3166727 - DNA, 13 bp, Homo sapiens
acacttaacagat

SEQ ID NO: 3166728 - DNA, 14 bp, Homo sapiens
acacttaatactac

SEQ ID NO: 3166729 - DNA, 20 bp, Homo sapiens
acacttagtgatcatttaaa

SEQ ID NO: 3166730 - DNA, 15 bp, Homo sapiens
acacttatcttctgg

SEQ ID NO: 3166731 - DNA, 19 bp, Homo sapiens
acacttatcttctggatta

SEQ ID NO: 3166732 - DNA, 20 bp, Homo sapiens
acacttattggaactctgct

SEQ ID NO: 3166733 - DNA, 19 bp, Homo sapiens
acacttcagatctgaggtt

SEQ ID NO: 3166734 - DNA, 23 bp, Homo sapiens
acacttctgtgagacccccacac

SEQ ID NO: 3166735 - DNA, 18 bp, Homo sapiens
acacttgagaggatgaat

SEQ ID NO: 3166736 - DNA, 16 bp, Homo sapiens
acacttgctcccaacc

SEQ ID NO: 3166737 - DNA, 14 bp, Homo sapiens
acagtcatcatcag

SEQ ID NO: 3166738 - DNA, 17 bp, Homo sapiens
acagtcatcatcagggc

SEQ ID NO: 3166739 - DNA, 21 bp, Homo sapiens
acagtcatcatcagggcctgg

SEQ ID NO: 3166740 - DNA, 21 bp, Homo sapiens
acagtcatcgctcgtgtgttc

SEQ ID NO: 3166741 - DNA, 13 bp, Homo sapiens
acagtcatcttta

SEQ ID NO: 3166742 - DNA, 14 bp, Homo sapiens
acagtcatttaaaa

SEQ ID NO: 3166743 - DNA, 18 bp, Homo sapiens
acagtccaaactgttctg

SEQ ID NO: 3166744 - DNA, 21 bp, Homo sapiens
acagtccagtgtcacctctct

SEQ ID NO: 3166745 - DNA, 22 bp, Homo sapiens
acagtcctgggagaacctcagg

SEQ ID NO: 3166746 - DNA, 23 bp, Homo sapiens
acagtccttcaaaatccttccaa

SEQ ID NO: 3166747 - DNA, 23 bp, Homo sapiens
acagtcggaaaagcgtctttaag

SEQ ID NO: 3166748 - DNA, 14 bp, Homo sapiens
acagtctagtttcc

SEQ ID NO: 3166749 - DNA, 14 bp, Homo sapiens
acagtctctttctt

SEQ ID NO: 3166750 - DNA, 16 bp, Homo sapiens
acagtctctttcttcc

SEQ ID NO: 3166751 - DNA, 20 bp, Homo sapiens
acagtctctttcttcctttc

SEQ ID NO: 3166752 - DNA, 16 bp, Homo sapiens
acagtctggagaaggt

SEQ ID NO: 3166753 - DNA, 16 bp, Homo sapiens
acagtgaagttttact

SEQ ID NO: 3166754 - DNA, 13 bp, Homo sapiens
acagtgaattgtc

SEQ ID NO: 3166755 - DNA, 14 bp, Homo sapiens
acagtgaattgtct

SEQ ID NO: 3166756 - DNA, 16 bp, Homo sapiens
acagtgaattgtcttt

SEQ ID NO: 3166757 - DNA, 16 bp, Homo sapiens
acagtgacccttccca

SEQ ID NO: 3166758 - DNA, 16 bp, Homo sapiens
acagtgaccttttctt

SEQ ID NO: 3166759 - DNA, 21 bp, Homo sapiens
acagtgaccttttcttcattt

SEQ ID NO: 3166760 - DNA, 19 bp, Homo sapiens
acagtgacttggccccaga

SEQ ID NO: 3166761 - DNA, 17 bp, Homo sapiens
acagtgagcctgaattt

SEQ ID NO: 3166762 - DNA, 18 bp, Homo sapiens
acagtgagcctgaatttt

SEQ ID NO: 3166763 - DNA, 21 bp, Homo sapiens
acagtgagcctgaattttgtt

SEQ ID NO: 3166764 - DNA, 14 bp, Homo sapiens
acagtgaggagggt

SEQ ID NO: 3166765 - DNA, 15 bp, Homo sapiens
acagtgcagacaggc

SEQ ID NO: 3166766 - DNA, 17 bp, Homo sapiens
acagtgcagacaggcca

SEQ ID NO: 3166767 - DNA, 18 bp, Homo sapiens
acagtgccattgtcttta

SEQ ID NO: 3166768 - DNA, 12 bp, Homo sapiens
acagtgctgctt

SEQ ID NO: 3166769 - DNA, 15 bp, Homo sapiens
acagtgctgcttctc

SEQ ID NO: 3166770 - DNA, 16 bp, Homo sapiens
acagtggactcagcag

SEQ ID NO: 3166771 - DNA, 17 bp, Homo sapiens
acagtggattgcatttc

SEQ ID NO: 3166772 - DNA, 18 bp, Homo sapiens
acagtggcacaaaaaaat

SEQ ID NO: 3166773 - DNA, 12 bp, Homo sapiens
acagtggctggg

SEQ ID NO: 3166774 - DNA, 18 bp, Homo sapiens
acagtgggaactctgaca

SEQ ID NO: 3166775 - DNA, 19 bp, Homo sapiens
acagtgggaactctgacaa

SEQ ID NO: 3166776 - DNA, 21 bp, Homo sapiens
acagtgggaactctgacaagg

SEQ ID NO: 3166777 - DNA, 14 bp, Homo sapiens
acagtgggagccct

SEQ ID NO: 3166778 - DNA, 14 bp, Homo sapiens
acagtgggagctga

SEQ ID NO: 3166779 - DNA, 18 bp, Homo sapiens
acagtgggagctgagctg

SEQ ID NO: 3166780 - DNA, 23 bp, Homo sapiens
acagtgggagctgagctggaagg

SEQ ID NO: 3166781 - DNA, 15 bp, Homo sapiens
acagtgggcatcagc

SEQ ID NO: 3166782 - DNA, 16 bp, Homo sapiens
acagtgggcatcagca

SEQ ID NO: 3166783 - DNA, 18 bp, Homo sapiens
acagtgggcatcagcagc

SEQ ID NO: 3166784 - DNA, 19 bp, Homo sapiens
acagtgggcgttgggagcc

SEQ ID NO: 3166785 - DNA, 23 bp, Homo sapiens
acagtgggcgttgggagcctagc

SEQ ID NO: 3166786 - DNA, 16 bp, Homo sapiens
acagtgggtggcacct

SEQ ID NO: 3166787 - DNA, 15 bp, Homo sapiens
acagtggttgcctgg

SEQ ID NO: 3166788 - DNA, 15 bp, Homo sapiens
acagtgtacaaaact

SEQ ID NO: 3166789 - DNA, 14 bp, Homo sapiens
acagtgtgtgaact

SEQ ID NO: 3166790 - DNA, 16 bp, Homo sapiens
acagtgttcatttgaa

SEQ ID NO: 3166791 - DNA, 21 bp, Homo sapiens
acagtgttgaaaatgttcaga

SEQ ID NO: 3166792 - DNA, 15 bp, Homo sapiens
acagtgtttcccata

SEQ ID NO: 3166793 - DNA, 20 bp, Homo sapiens
acagtgtttggacaggaggg

SEQ ID NO: 3166794 - DNA, 18 bp, Homo sapiens
acagttagggttttgcaa

SEQ ID NO: 3166795 - DNA, 19 bp, Homo sapiens
acagttagggttttgcaat

SEQ ID NO: 3166796 - DNA, 21 bp, Homo sapiens
acagttagggttttgcaataa

SEQ ID NO: 3166797 - DNA, 19 bp, Homo sapiens
acagttataaaattaaaag

SEQ ID NO: 3166798 - DNA, 22 bp, Homo sapiens
acagttatatttttgtgttttc

SEQ ID NO: 3166799 - DNA, 16 bp, Homo sapiens
acagttatcttagctg

SEQ ID NO: 3166800 - DNA, 18 bp, Homo sapiens
acagttatttatagtcat

SEQ ID NO: 3166801 - DNA, 18 bp, Homo sapiens
acagttattttggatata

SEQ ID NO: 3166802 - DNA, 22 bp, Homo sapiens
acagttattttggatatattat

SEQ ID NO: 3166803 - DNA, 15 bp, Homo sapiens
acagttcacaccctg

SEQ ID NO: 3166804 - DNA, 19 bp, Homo sapiens
acagttcacaccctgcaag

SEQ ID NO: 3166805 - DNA, 20 bp, Homo sapiens
acagttcacaccctgcaagg

SEQ ID NO: 3166806 - DNA, 20 bp, Homo sapiens
acagttcagtggcagggctc

SEQ ID NO: 3166807 - DNA, 21 bp, Homo sapiens
acagttcagtggcagggctca

SEQ ID NO: 3166808 - DNA, 12 bp, Homo sapiens
acagttcataat

SEQ ID NO: 3166809 - DNA, 21 bp, Homo sapiens
acagttcctgggaacatcaca

SEQ ID NO: 3166810 - DNA, 22 bp, Homo sapiens
acagttgaagggaggggctgtg

SEQ ID NO: 3166811 - DNA, 15 bp, Homo sapiens
acagttgctgtcata

SEQ ID NO: 3166812 - DNA, 21 bp, Homo sapiens
acagttgctgtcataagaatg

SEQ ID NO: 3166813 - DNA, 13 bp, Homo sapiens
acagttggcagag

SEQ ID NO: 3166814 - DNA, 22 bp, Homo sapiens
acagttggcagagaaggcctct

SEQ ID NO: 3166815 - DNA, 15 bp, Homo sapiens
acagttggtaacttt

SEQ ID NO: 3166816 - DNA, 17 bp, Homo sapiens
acagttgtctagagata

SEQ ID NO: 3166817 - DNA, 20 bp, Homo sapiens
acagttgtctattctgagcc

SEQ ID NO: 3166818 - DNA, 21 bp, Homo sapiens
acagttgtctattctgagcct

SEQ ID NO: 3166819 - DNA, 17 bp, Homo sapiens
acagtttcttagctttt

SEQ ID NO: 3166820 - DNA, 20 bp, Homo sapiens
acagtttcttagctttttaa

SEQ ID NO: 3166821 - DNA, 21 bp, Homo sapiens
acagttttaactgtggatatt

SEQ ID NO: 3166822 - DNA, 19 bp, Homo sapiens
acagttttagttggtgctg

SEQ ID NO: 3166823 - DNA, 16 bp, Homo sapiens
acagttttatgctctt

SEQ ID NO: 3166824 - DNA, 20 bp, Homo sapiens
acagttttatgctctttttt

SEQ ID NO: 3166825 - DNA, 12 bp, Homo sapiens
acagttttccat

SEQ ID NO: 3166826 - DNA, 15 bp, Homo sapiens
acagttttccatgaa

SEQ ID NO: 3166827 - DNA, 17 bp, Homo sapiens
acagttttccatgaaaa

SEQ ID NO: 3166828 - DNA, 18 bp, Homo sapiens
acagttttccatgaaaac

SEQ ID NO: 3166829 - DNA, 23 bp, Homo sapiens
acagttttccatgaaaacgtttt

SEQ ID NO: 3166830 - DNA, 23 bp, Homo sapiens
acataaaaaagaagcactttgat

SEQ ID NO: 3166831 - DNA, 13 bp, Homo sapiens
acataaaattttc

SEQ ID NO: 3166832 - DNA, 14 bp, Homo sapiens
acataaaattttct

SEQ ID NO: 3166833 - DNA, 16 bp, Homo sapiens
acataaagccatgttt

SEQ ID NO: 3166834 - DNA, 17 bp, Homo sapiens
acataaatgttcacttt

SEQ ID NO: 3166835 - DNA, 13 bp, Homo sapiens
acataaattagag

SEQ ID NO: 3166836 - DNA, 12 bp, Homo sapiens
acataaattatg

SEQ ID NO: 3166837 - DNA, 17 bp, Homo sapiens
acataaattatgagatt

SEQ ID NO: 3166838 - DNA, 20 bp, Homo sapiens
acataaattgcataaagcat

SEQ ID NO: 3166839 - DNA, 12 bp, Homo sapiens
acataacaagaa

SEQ ID NO: 3166840 - DNA, 13 bp, Homo sapiens
acataacaagaaa

SEQ ID NO: 3166841 - DNA, 12 bp, Homo sapiens
acataactaaat

SEQ ID NO: 3166842 - DNA, 15 bp, Homo sapiens
acataactaaatttg

SEQ ID NO: 3166843 - DNA, 18 bp, Homo sapiens
acataactaaatttgata

SEQ ID NO: 3166844 - DNA, 22 bp, Homo sapiens
acataactaaatttgatactta

SEQ ID NO: 3166845 - DNA, 23 bp, Homo sapiens
acataactaaatttgatacttat

SEQ ID NO: 3166846 - DNA, 22 bp, Homo sapiens
acataagcggcgtaagtttaaa

SEQ ID NO: 3166847 - DNA, 19 bp, Homo sapiens
acataaggggtttgccatt

SEQ ID NO: 3166848 - DNA, 20 bp, Homo sapiens
acataagtaattcaagaaaa

SEQ ID NO: 3166849 - DNA, 14 bp, Homo sapiens
acataataaatcac

SEQ ID NO: 3166850 - DNA, 20 bp, Homo sapiens
acataatgcttaatttctaa

SEQ ID NO: 3166851 - DNA, 21 bp, Homo sapiens
acataattttttttttttaac

SEQ ID NO: 3166852 - DNA, 19 bp, Homo sapiens
acatacacttgtataaatg

SEQ ID NO: 3166853 - DNA, 18 bp, Homo sapiens
acatacagattttaccta

SEQ ID NO: 3166854 - DNA, 13 bp, Homo sapiens
acatacaggtgct

SEQ ID NO: 3166855 - DNA, 17 bp, Homo sapiens
acatacaggtgctcaat

SEQ ID NO: 3166856 - DNA, 11 bp, Homo sapiens
acatacattaa

SEQ ID NO: 3166857 - DNA, 21 bp, Homo sapiens
acataccaagacccccgtctc

SEQ ID NO: 3166858 - DNA, 15 bp, Homo sapiens
acataccagcttaga

SEQ ID NO: 3166859 - DNA, 20 bp, Homo sapiens
acataccctggccgccccct

SEQ ID NO: 3166860 - DNA, 14 bp, Homo sapiens
acatacggtcaggt

SEQ ID NO: 3166861 - DNA, 19 bp, Homo sapiens
acatactctctgcctggtg

SEQ ID NO: 3166862 - DNA, 14 bp, Homo sapiens
acatactctgctta

SEQ ID NO: 3166863 - DNA, 22 bp, Homo sapiens
accacagacacaatatgtatgc

SEQ ID NO: 3166864 - DNA, 14 bp, Homo sapiens
accacagacacaca

SEQ ID NO: 3166865 - DNA, 12 bp, Homo sapiens
accacagcatcg

SEQ ID NO: 3166866 - DNA, 17 bp, Homo sapiens
accacagccagcacctg

SEQ ID NO: 3166867 - DNA, 20 bp, Homo sapiens
accacagccagcacctggca

SEQ ID NO: 3166868 - DNA, 22 bp, Homo sapiens
accacagggttcaaaatgtctg

SEQ ID NO: 3166869 - DNA, 23 bp, Homo sapiens
accacagggttcaaaatgtctgt

SEQ ID NO: 3166870 - DNA, 22 bp, Homo sapiens
accacaggttcatgccaccatg

SEQ ID NO: 3166871 - DNA, 21 bp, Homo sapiens
accacagtgggtggcacctcc

SEQ ID NO: 3166872 - DNA, 12 bp, Homo sapiens
accacagtgtct

SEQ ID NO: 3166873 - DNA, 13 bp, Homo sapiens
accacagtgtctg

SEQ ID NO: 3166874 - DNA, 20 bp, Homo sapiens
accacatcctccgtccagcc

SEQ ID NO: 3166875 - DNA, 22 bp, Homo sapiens
accacatcctccgtccagccgc

SEQ ID NO: 3166876 - DNA, 13 bp, Homo sapiens
accacatctgcca

SEQ ID NO: 3166877 - DNA, 19 bp, Homo sapiens
accacatcttgctctgctg

SEQ ID NO: 3166878 - DNA, 20 bp, Homo sapiens
accacatcttgctctgctga

SEQ ID NO: 3166879 - DNA, 24 bp, Homo sapiens
accacatcttgctctgctgacaga

SEQ ID NO: 3166880 - DNA, 13 bp, Homo sapiens
accacattgcttt

SEQ ID NO: 3166881 - DNA, 16 bp, Homo sapiens
accaccactggccacc

SEQ ID NO: 3166882 - DNA, 19 bp, Homo sapiens
accaccatccaccgctgct

SEQ ID NO: 3166883 - DNA, 22 bp, Homo sapiens
accacccccccccatccccgct

SEQ ID NO: 3166884 - DNA, 15 bp, Homo sapiens
accaccctcccctct

SEQ ID NO: 3166885 - DNA, 15 bp, Homo sapiens
accacctcactcctg

SEQ ID NO: 3166886 - DNA, 23 bp, Homo sapiens
accaccttctgtccccagccctg

SEQ ID NO: 3166887 - DNA, 17 bp, Homo sapiens
accaccttttattacat

SEQ ID NO: 3166888 - DNA, 19 bp, Homo sapiens
accacgcccgtcctgcctg

SEQ ID NO: 3166889 - DNA, 23 bp, Homo sapiens
accacgcccgtcctgcctgtggc

SEQ ID NO: 3166890 - DNA, 21 bp, Homo sapiens
accacggacgtttccatcagg

SEQ ID NO: 3166891 - DNA, 17 bp, Homo sapiens
accacgtctgccaggcc

SEQ ID NO: 3166892 - DNA, 23 bp, Homo sapiens
accacgtctgccaggcccatctc

SEQ ID NO: 3166893 - DNA, 17 bp, Homo sapiens
accacgtggggctcact

SEQ ID NO: 3166894 - DNA, 20 bp, Homo sapiens
accactaggaatcccagagg

SEQ ID NO: 3166895 - DNA, 17 bp, Homo sapiens
accactaggactctgag

SEQ ID NO: 3166896 - DNA, 15 bp, Homo sapiens
accactatgaagcta

SEQ ID NO: 3166897 - DNA, 12 bp, Homo sapiens
accactccattc

SEQ ID NO: 3166898 - DNA, 18 bp, Homo sapiens
accactgaacatttgctt

SEQ ID NO: 3166899 - DNA, 20 bp, Homo sapiens
accactgagtaccaggggct

SEQ ID NO: 3166900 - DNA, 13 bp, Homo sapiens
accactgcctgac

SEQ ID NO: 3166901 - DNA, 19 bp, Homo sapiens
accactgtaaaatgaaatt

SEQ ID NO: 3166902 - DNA, 20 bp, Homo sapiens
accactgtacacacccgcct

SEQ ID NO: 3166903 - DNA, 15 bp, Homo sapiens
accactgtctttttc

SEQ ID NO: 3166904 - DNA, 14 bp, Homo sapiens
accacttacctcaa

SEQ ID NO: 3166905 - DNA, 17 bp, Homo sapiens
accacttacctcaaatt

SEQ ID NO: 3166906 - DNA, 17 bp, Homo sapiens
accacttcactgaaaga

SEQ ID NO: 3166907 - DNA, 18 bp, Homo sapiens
accacttcactgaaagac

SEQ ID NO: 3166908 - DNA, 14 bp, Homo sapiens
accacttcattctg

SEQ ID NO: 3166909 - DNA, 18 bp, Homo sapiens
accacttcctgctacagg

SEQ ID NO: 3166910 - DNA, 15 bp, Homo sapiens
accacttcctttaaa

SEQ ID NO: 3166911 - DNA, 23 bp, Homo sapiens
accagacaaggaaatacccttct

SEQ ID NO: 3166912 - DNA, 22 bp, Homo sapiens
accagacaccttgacagggcac

SEQ ID NO: 3166913 - DNA, 17 bp, Homo sapiens
accagacagcacagggc

SEQ ID NO: 3166914 - DNA, 13 bp, Homo sapiens
accagactgcagg

SEQ ID NO: 3166915 - DNA, 16 bp, Homo sapiens
accagactgcaggttg

SEQ ID NO: 3166916 - DNA, 16 bp, Homo sapiens
accagagaccgtcctc

SEQ ID NO: 3166917 - DNA, 15 bp, Homo sapiens
accagagagagttgt

SEQ ID NO: 3166918 - DNA, 20 bp, Homo sapiens
accagagcaacctctcactc

SEQ ID NO: 3166919 - DNA, 15 bp, Homo sapiens
accagagcagatgca

SEQ ID NO: 3166920 - DNA, 17 bp, Homo sapiens
accagagcagatgcaga

SEQ ID NO: 3166921 - DNA, 16 bp, Homo sapiens
accagagcccaccttg

SEQ ID NO: 3166922 - DNA, 17 bp, Homo sapiens
accagagccccacacgg

SEQ ID NO: 3166923 - DNA, 20 bp, Homo sapiens
accagagccccacacggagg

SEQ ID NO: 3166924 - DNA, 16 bp, Homo sapiens
accagagccttcaagt

SEQ ID NO: 3166925 - DNA, 17 bp, Homo sapiens
accagagccttcaagtg

SEQ ID NO: 3166926 - DNA, 18 bp, Homo sapiens
accagagccttcaagtgc

SEQ ID NO: 3166927 - DNA, 13 bp, Homo sapiens
accagagctagtt

SEQ ID NO: 3166928 - DNA, 17 bp, Homo sapiens
accagagtcagcacagg

SEQ ID NO: 3166929 - DNA, 20 bp, Homo sapiens
accagataagaatgctggtt

SEQ ID NO: 3166930 - DNA, 21 bp, Homo sapiens
accagataagaatgctggttt

SEQ ID NO: 3166931 - DNA, 11 bp, Homo sapiens
accagatgctg

SEQ ID NO: 3166932 - DNA, 12 bp, Homo sapiens
accagatgctga

SEQ ID NO: 3166933 - DNA, 23 bp, Homo sapiens
accagcaacttgtctttttctgg

SEQ ID NO: 3166934 - DNA, 12 bp, Homo sapiens
accagcaggtgt

SEQ ID NO: 3166935 - DNA, 21 bp, Homo sapiens
accagcaggtgtggtggctca

SEQ ID NO: 3166936 - DNA, 16 bp, Homo sapiens
accagcatccaccttg

SEQ ID NO: 3166937 - DNA, 17 bp, Homo sapiens
accagcatctcagcgcc

SEQ ID NO: 3166938 - DNA, 20 bp, Homo sapiens
accagcccatggccctgtgc

SEQ ID NO: 3166939 - DNA, 23 bp, Homo sapiens
accagccccactgccagcagcag

SEQ ID NO: 3166940 - DNA, 17 bp, Homo sapiens
accagccccctggatgg

SEQ ID NO: 3166941 - DNA, 12 bp, Homo sapiens
accagcccctgc

SEQ ID NO: 3166942 - DNA, 19 bp, Homo sapiens
accagcccgacagtgccat

SEQ ID NO: 3166943 - DNA, 14 bp, Homo sapiens
accagcccggcctg

SEQ ID NO: 3166944 - DNA, 18 bp, Homo sapiens
accagccctggggctggg

SEQ ID NO: 3166945 - DNA, 18 bp, Homo sapiens
accagcccttgagggaga

SEQ ID NO: 3166946 - DNA, 18 bp, Homo sapiens
accagcctacaagctggc

SEQ ID NO: 3166947 - DNA, 19 bp, Homo sapiens
accagcctccatgctgcct

SEQ ID NO: 3166948 - DNA, 11 bp, Homo sapiens
accagcctggc

SEQ ID NO: 3166949 - DNA, 17 bp, Homo sapiens
accagctatctgtcatc

SEQ ID NO: 3166950 - DNA, 19 bp, Homo sapiens
accagctatctgtcatctc

SEQ ID NO: 3166951 - DNA, 21 bp, Homo sapiens
accagctcgtttttcagcacc

SEQ ID NO: 3166952 - DNA, 17 bp, Homo sapiens
accagctctgtggcctg

SEQ ID NO: 3166953 - DNA, 19 bp, Homo sapiens
accagctctgtggcctgtg

SEQ ID NO: 3166954 - DNA, 13 bp, Homo sapiens
accagctgctctg

SEQ ID NO: 3166955 - DNA, 10 bp, Homo sapiens
accagctggg

SEQ ID NO: 3166956 - DNA, 11 bp, Homo sapiens
accagctgggg

SEQ ID NO: 3166957 - DNA, 17 bp, Homo sapiens
accagctgtaacacagc

SEQ ID NO: 3166958 - DNA, 21 bp, Homo sapiens
accagcttgttctgggctcag

SEQ ID NO: 3166959 - DNA, 23 bp, Homo sapiens
accagcttgttctgggctcaggg

SEQ ID NO: 3166960 - DNA, 22 bp, Homo sapiens
accaggactagggctggagtga

SEQ ID NO: 3166961 - DNA, 20 bp, Homo sapiens
accaggagaaccactacatg

SEQ ID NO: 3166962 - DNA, 15 bp, Homo sapiens
accaggatttctaat

SEQ ID NO: 3166963 - DNA, 15 bp, Homo sapiens
accaggcaaattcac

SEQ ID NO: 3166964 - DNA, 14 bp, Homo sapiens
accaggccacctcc

SEQ ID NO: 3166965 - DNA, 13 bp, Homo sapiens
accaggcccagcc

SEQ ID NO: 3166966 - DNA, 20 bp, Homo sapiens
accaggctggcgcagccaag

SEQ ID NO: 3166967 - DNA, 20 bp, Homo sapiens
accagggagcccctttgatg

SEQ ID NO: 3166968 - DNA, 15 bp, Homo sapiens
accagggatgctggg

SEQ ID NO: 3166969 - DNA, 18 bp, Homo sapiens
accagggcattcgggcca

SEQ ID NO: 3166970 - DNA, 21 bp, Homo sapiens
accagggcattcgggccacag

SEQ ID NO: 3166971 - DNA, 22 bp, Homo sapiens
accagggcattcgggccacagg

SEQ ID NO: 3166972 - DNA, 16 bp, Homo sapiens
accaggggaggagcct

SEQ ID NO: 3166973 - DNA, 22 bp, Homo sapiens
accaggggtgctcacctctgcc

SEQ ID NO: 3166974 - DNA, 14 bp, Homo sapiens
accaggggtttctc

SEQ ID NO: 3166975 - DNA, 17 bp, Homo sapiens
accaggggtttctcgca

SEQ ID NO: 3166976 - DNA, 19 bp, Homo sapiens
accagggtccgcaccagct

SEQ ID NO: 3166977 - DNA, 23 bp, Homo sapiens
accagggtccgcaccagctgctc

SEQ ID NO: 3166978 - DNA, 21 bp, Homo sapiens
accagggtccttttgacactg

SEQ ID NO: 3166979 - DNA, 19 bp, Homo sapiens
accaggtccattttgcctg

SEQ ID NO: 3166980 - DNA, 18 bp, Homo sapiens
accaggtgtgcctggaag

SEQ ID NO: 3166981 - DNA, 19 bp, Homo sapiens
accaggtgttctacactca

SEQ ID NO: 3166982 - DNA, 20 bp, Homo sapiens
accagtatcgctcatagatc

SEQ ID NO: 3166983 - DNA, 14 bp, Homo sapiens
accagtctcctcac

SEQ ID NO: 3166984 - DNA, 19 bp, Homo sapiens
accagtctcctcactctgt

SEQ ID NO: 3166985 - DNA, 15 bp, Homo sapiens
accagtctgtctact

SEQ ID NO: 3166986 - DNA, 20 bp, Homo sapiens
accagtctttaaaggcccag

SEQ ID NO: 3166987 - DNA, 21 bp, Homo sapiens
accagtctttaaaggcccagc

SEQ ID NO: 3166988 - DNA, 15 bp, Homo sapiens
accctgtccggccca

SEQ ID NO: 3166989 - DNA, 23 bp, Homo sapiens
accctgtccggcccagtgccact

SEQ ID NO: 3166990 - DNA, 21 bp, Homo sapiens
accctgtgacatggtgcctga

SEQ ID NO: 3166991 - DNA, 15 bp, Homo sapiens
accctgtggccctgg

SEQ ID NO: 3166992 - DNA, 17 bp, Homo sapiens
accctgttaccattttg

SEQ ID NO: 3166993 - DNA, 14 bp, Homo sapiens
acccttaacccaag

SEQ ID NO: 3166994 - DNA, 18 bp, Homo sapiens
acccttaacccaaggagc

SEQ ID NO: 3166995 - DNA, 14 bp, Homo sapiens
acccttaactgaca

SEQ ID NO: 3166996 - DNA, 18 bp, Homo sapiens
acccttaccccttagcct

SEQ ID NO: 3166997 - DNA, 12 bp, Homo sapiens
acccttagaaaa

SEQ ID NO: 3166998 - DNA, 15 bp, Homo sapiens
acccttattgctgtc

SEQ ID NO: 3166999 - DNA, 15 bp, Homo sapiens
acccttcagacccca

SEQ ID NO: 3167000 - DNA, 14 bp, Homo sapiens
acccttcagggcca

SEQ ID NO: 3167001 - DNA, 16 bp, Homo sapiens
acccttcagggccaga

SEQ ID NO: 3167002 - DNA, 16 bp, Homo sapiens
acccttccagacatac

SEQ ID NO: 3167003 - DNA, 23 bp, Homo sapiens
acccttcccaatcagcactgaaa

SEQ ID NO: 3167004 - DNA, 15 bp, Homo sapiens
acccttccctgcact

SEQ ID NO: 3167005 - DNA, 22 bp, Homo sapiens
acccttccctgcactaaagcca

SEQ ID NO: 3167006 - DNA, 15 bp, Homo sapiens
acccttctttcctct

SEQ ID NO: 3167007 - DNA, 18 bp, Homo sapiens
acccttctttcctcttcc

SEQ ID NO: 3167008 - DNA, 21 bp, Homo sapiens
acccttgcatccattgttgtg

SEQ ID NO: 3167009 - DNA, 20 bp, Homo sapiens
acccttgctttcctgggcct

SEQ ID NO: 3167010 - DNA, 13 bp, Homo sapiens
acccttggcctgt

SEQ ID NO: 3167011 - DNA, 19 bp, Homo sapiens
acccttgggcctgggcctc

SEQ ID NO: 3167012 - DNA, 20 bp, Homo sapiens
accctttcccccttctctta

SEQ ID NO: 3167013 - DNA, 20 bp, Homo sapiens
accctttcctcctttatcac

SEQ ID NO: 3167014 - DNA, 12 bp, Homo sapiens
accctttggttt

SEQ ID NO: 3167015 - DNA, 17 bp, Homo sapiens
acccttttcctttgtgg

SEQ ID NO: 3167016 - DNA, 15 bp, Homo sapiens
accgacagctcttac

SEQ ID NO: 3167017 - DNA, 16 bp, Homo sapiens
accgacgcgtctcctg

SEQ ID NO: 3167018 - DNA, 17 bp, Homo sapiens
accgactagccaggaag

SEQ ID NO: 3167019 - DNA, 18 bp, Homo sapiens
accgagtctcttctccac

SEQ ID NO: 3167020 - DNA, 20 bp, Homo sapiens
accgagtctcttctccactg

SEQ ID NO: 3167021 - DNA, 24 bp, Homo sapiens
accgagtctcttctccactggatg

SEQ ID NO: 3167022 - DNA, 17 bp, Homo sapiens
accgatggagcccccag

SEQ ID NO: 3167023 - DNA, 16 bp, Homo sapiens
accgattctttggagt

SEQ ID NO: 3167024 - DNA, 14 bp, Homo sapiens
accgcacagctcag

SEQ ID NO: 3167025 - DNA, 17 bp, Homo sapiens
accgcacatgcacacac

SEQ ID NO: 3167026 - DNA, 13 bp, Homo sapiens
accgcagtcacca

SEQ ID NO: 3167027 - DNA, 22 bp, Homo sapiens
accgcccccaccccttccccag

SEQ ID NO: 3167028 - DNA, 11 bp, Homo sapiens
accgccccctc

SEQ ID NO: 3167029 - DNA, 14 bp, Homo sapiens
accgccccctcctc

SEQ ID NO: 3167030 - DNA, 15 bp, Homo sapiens
accgccctgggctgg

SEQ ID NO: 3167031 - DNA, 17 bp, Homo sapiens
accgccctgggctggac

SEQ ID NO: 3167032 - DNA, 18 bp, Homo sapiens
accgccgactttgtaccc

SEQ ID NO: 3167033 - DNA, 20 bp, Homo sapiens
accgcgactaatttcaaaat

SEQ ID NO: 3167034 - DNA, 18 bp, Homo sapiens
accgctcacctagagcca

SEQ ID NO: 3167035 - DNA, 19 bp, Homo sapiens
accgctcacctagagccag

SEQ ID NO: 3167036 - DNA, 20 bp, Homo sapiens
accgctctcttttctgtact

SEQ ID NO: 3167037 - DNA, 16 bp, Homo sapiens
accgctgccagcacag

SEQ ID NO: 3167038 - DNA, 16 bp, Homo sapiens
accgcttcacccctgc

SEQ ID NO: 3167039 - DNA, 17 bp, Homo sapiens
accgcttcacccctgca

SEQ ID NO: 3167040 - DNA, 18 bp, Homo sapiens
accgcttgtggggaccca

SEQ ID NO: 3167041 - DNA, 21 bp, Homo sapiens
accgcttgtggggacccaggc

SEQ ID NO: 3167042 - DNA, 15 bp, Homo sapiens
accggaaggttttta

SEQ ID NO: 3167043 - DNA, 23 bp, Homo sapiens
accggagctttcaaagaaggaat

SEQ ID NO: 3167044 - DNA, 14 bp, Homo sapiens
accggcgcgctctt

SEQ ID NO: 3167045 - DNA, 15 bp, Homo sapiens
accggcgctgcaggt

SEQ ID NO: 3167046 - DNA, 18 bp, Homo sapiens
accgggagaaggcatgag

SEQ ID NO: 3167047 - DNA, 15 bp, Homo sapiens
accgggagcctcccc

SEQ ID NO: 3167048 - DNA, 19 bp, Homo sapiens
accgggagcctccccctca

SEQ ID NO: 3167049 - DNA, 20 bp, Homo sapiens
accgggagcctccccctcag

SEQ ID NO: 3167050 - DNA, 14 bp, Homo sapiens
accgggcactcaga

SEQ ID NO: 3167051 - DNA, 15 bp, Homo sapiens
accgggccacagaga

SEQ ID NO: 3167052 - DNA, 19 bp, Homo sapiens
accgggccacagagaaagt

SEQ ID NO: 3167053 - DNA, 22 bp, Homo sapiens
accgggtgggcctggcctgagc

SEQ ID NO: 3167054 - DNA, 23 bp, Homo sapiens
accgggtgggcctggcctgagct

SEQ ID NO: 3167055 - DNA, 13 bp, Homo sapiens
accggtcagtgcc

SEQ ID NO: 3167056 - DNA, 17 bp, Homo sapiens
accggtccagctggcct

SEQ ID NO: 3167057 - DNA, 15 bp, Homo sapiens
accggtgctgcagga

SEQ ID NO: 3167058 - DNA, 18 bp, Homo sapiens
accgtactctcacatgtg

SEQ ID NO: 3167059 - DNA, 23 bp, Homo sapiens
accgtcatggcttaatgtttatt

SEQ ID NO: 3167060 - DNA, 14 bp, Homo sapiens
accgtccgccctgc

SEQ ID NO: 3167061 - DNA, 15 bp, Homo sapiens
accgtccgccctgct

SEQ ID NO: 3167062 - DNA, 16 bp, Homo sapiens
accgtccgccctgctc

SEQ ID NO: 3167063 - DNA, 15 bp, Homo sapiens
accgtctacatttca

SEQ ID NO: 3167064 - DNA, 16 bp, Homo sapiens
accgtctacatttcac

SEQ ID NO: 3167065 - DNA, 12 bp, Homo sapiens
accgtcttcctt

SEQ ID NO: 3167066 - DNA, 15 bp, Homo sapiens
accgtggacaggccc

SEQ ID NO: 3167067 - DNA, 18 bp, Homo sapiens
accgtggacaggcccagc

SEQ ID NO: 3167068 - DNA, 22 bp, Homo sapiens
accgtggaggaggaaggcaaga

SEQ ID NO: 3167069 - DNA, 15 bp, Homo sapiens
accgtggccctgccc

SEQ ID NO: 3167070 - DNA, 21 bp, Homo sapiens
accgtggccctgccctctcct

SEQ ID NO: 3167071 - DNA, 20 bp, Homo sapiens
accgtgtcccaaggagctga

SEQ ID NO: 3167072 - DNA, 16 bp, Homo sapiens
accgttcaagcgccag

SEQ ID NO: 3167073 - DNA, 21 bp, Homo sapiens
accgttcagtgtcccaggcag

SEQ ID NO: 3167074 - DNA, 16 bp, Homo sapiens
accgttggggccctta

SEQ ID NO: 3167075 - DNA, 12 bp, Homo sapiens
accgtttcttcc

SEQ ID NO: 3167076 - DNA, 17 bp, Homo sapiens
acctaaaaaaagagaat

SEQ ID NO: 3167077 - DNA, 21 bp, Homo sapiens
acctaaaaggaaatctcaccc

SEQ ID NO: 3167078 - DNA, 18 bp, Homo sapiens
acctaacattatttattc

SEQ ID NO: 3167079 - DNA, 19 bp, Homo sapiens
acctaacattcgatctcat

SEQ ID NO: 3167080 - DNA, 21 bp, Homo sapiens
acctaagattacaaatcagaa

SEQ ID NO: 3167081 - DNA, 15 bp, Homo sapiens
acctaagtactgtaa

SEQ ID NO: 3167082 - DNA, 17 bp, Homo sapiens
acctaagtactgtaata

SEQ ID NO: 3167083 - DNA, 17 bp, Homo sapiens
acctaatacccagttta

SEQ ID NO: 3167084 - DNA, 23 bp, Homo sapiens
acctaatgtctcactgttctgca

SEQ ID NO: 3167085 - DNA, 20 bp, Homo sapiens
acctaatgtttatgagccag

SEQ ID NO: 3167086 - DNA, 14 bp, Homo sapiens
acctaattgtggat

SEQ ID NO: 3167087 - DNA, 17 bp, Homo sapiens
acctacaataaactggt

SEQ ID NO: 3167088 - DNA, 23 bp, Homo sapiens
acctacacactgtcatgcttcat

SEQ ID NO: 3167089 - DNA, 16 bp, Homo sapiens
acctacagttttaact

SEQ ID NO: 3167090 - DNA, 21 bp, Homo sapiens
acctacatgctgaaaaatata

SEQ ID NO: 3167091 - DNA, 15 bp, Homo sapiens
acctaccacagtgtc

SEQ ID NO: 3167092 - DNA, 16 bp, Homo sapiens
acctaccacagtgtct

SEQ ID NO: 3167093 - DNA, 20 bp, Homo sapiens
acctaccactcacatgacac

SEQ ID NO: 3167094 - DNA, 17 bp, Homo sapiens
acctaccagttggccat

SEQ ID NO: 3167095 - DNA, 14 bp, Homo sapiens
acctaccatcaggg

SEQ ID NO: 3167096 - DNA, 16 bp, Homo sapiens
acctacctcaggttgc

SEQ ID NO: 3167097 - DNA, 23 bp, Homo sapiens
acctacgagggaggaacacctga

SEQ ID NO: 3167098 - DNA, 18 bp, Homo sapiens
acctactatgtgctgggt

SEQ ID NO: 3167099 - DNA, 11 bp, Homo sapiens
acctactgagt

SEQ ID NO: 3167100 - DNA, 20 bp, Homo sapiens
acctactgtgtcttggaatc

SEQ ID NO: 3167101 - DNA, 16 bp, Homo sapiens
acctactgttcctttc

SEQ ID NO: 3167102 - DNA, 15 bp, Homo sapiens
acctactgttctaaa

SEQ ID NO: 3167103 - DNA, 16 bp, Homo sapiens
acctactgttctaaag

SEQ ID NO: 3167104 - DNA, 18 bp, Homo sapiens
acctactgttctaaagct

SEQ ID NO: 3167105 - DNA, 13 bp, Homo sapiens
acctactttcttc

SEQ ID NO: 3167106 - DNA, 20 bp, Homo sapiens
acctactttgactttttgca

SEQ ID NO: 3167107 - DNA, 22 bp, Homo sapiens
acctagagaacaggtggttttt

SEQ ID NO: 3167108 - DNA, 17 bp, Homo sapiens
acctagagaagataatt

SEQ ID NO: 3167109 - DNA, 13 bp, Homo sapiens
acctagagccaga

SEQ ID NO: 3167110 - DNA, 16 bp, Homo sapiens
acctagagccagacca

SEQ ID NO: 3167111 - DNA, 14 bp, Homo sapiens
acctagcagcctca

SEQ ID NO: 3167112 - DNA, 13 bp, Homo sapiens
acctagccttaga

SEQ ID NO: 3167113 - DNA, 19 bp, Homo sapiens
acctagctggtagcataaa

SEQ ID NO: 3167114 - DNA, 15 bp, Homo sapiens
acgcacgcacacaca

SEQ ID NO: 3167115 - DNA, 16 bp, Homo sapiens
acgcactccatgagca

SEQ ID NO: 3167116 - DNA, 16 bp, Homo sapiens
acgcagaggacgcacg

SEQ ID NO: 3167117 - DNA, 22 bp, Homo sapiens
acgcagccctgctttgggctgc

SEQ ID NO: 3167118 - DNA, 22 bp, Homo sapiens
acgcaggagaatcactgcagcc

SEQ ID NO: 3167119 - DNA, 15 bp, Homo sapiens
acgcatccagcaaga

SEQ ID NO: 3167120 - DNA, 21 bp, Homo sapiens
acgcatctcaaaacagagggc

SEQ ID NO: 3167121 - DNA, 22 bp, Homo sapiens
acgcatctcaaaacagagggct

SEQ ID NO: 3167122 - DNA, 23 bp, Homo sapiens
acgcatctcaaaacagagggctg

SEQ ID NO: 3167123 - DNA, 18 bp, Homo sapiens
acgccactgcactatagc

SEQ ID NO: 3167124 - DNA, 18 bp, Homo sapiens
acgccagataaaatgttc

SEQ ID NO: 3167125 - DNA, 13 bp, Homo sapiens
acgccccagcccg

SEQ ID NO: 3167126 - DNA, 19 bp, Homo sapiens
acgccccgggcaaagggtc

SEQ ID NO: 3167127 - DNA, 23 bp, Homo sapiens
acgccccgggcaaagggtctttt

SEQ ID NO: 3167128 - DNA, 12 bp, Homo sapiens
acgcccctgtgg

SEQ ID NO: 3167129 - DNA, 18 bp, Homo sapiens
acgcccgtcctgcctgtg

SEQ ID NO: 3167130 - DNA, 19 bp, Homo sapiens
acgcccgtcctgcctgtgg

SEQ ID NO: 3167131 - DNA, 17 bp, Homo sapiens
acgccctactccactgc

SEQ ID NO: 3167132 - DNA, 13 bp, Homo sapiens
acgccctattttt

SEQ ID NO: 3167133 - DNA, 14 bp, Homo sapiens
acgccctcccctcc

SEQ ID NO: 3167134 - DNA, 15 bp, Homo sapiens
acgccctcccctccc

SEQ ID NO: 3167135 - DNA, 21 bp, Homo sapiens
acgccctcccctcccctgctg

SEQ ID NO: 3167136 - DNA, 17 bp, Homo sapiens
acgccctccctctccca

SEQ ID NO: 3167137 - DNA, 22 bp, Homo sapiens
acgccctgcgttggagccactc

SEQ ID NO: 3167138 - DNA, 18 bp, Homo sapiens
acgccctttcctcctcag

SEQ ID NO: 3167139 - DNA, 17 bp, Homo sapiens
acgcctatgatcccagc

SEQ ID NO: 3167140 - DNA, 18 bp, Homo sapiens
acgcctatgatcccagca

SEQ ID NO: 3167141 - DNA, 18 bp, Homo sapiens
acgcctcactgaaacatg

SEQ ID NO: 3167142 - DNA, 22 bp, Homo sapiens
acgcctccggtgagcagggtca

SEQ ID NO: 3167143 - DNA, 14 bp, Homo sapiens
acgcctcctggcca

SEQ ID NO: 3167144 - DNA, 16 bp, Homo sapiens
acgcctcctggccaga

SEQ ID NO: 3167145 - DNA, 23 bp, Homo sapiens
acgcctctccctaggagaagagt

SEQ ID NO: 3167146 - DNA, 21 bp, Homo sapiens
acgcctgccctccccagagca

SEQ ID NO: 3167147 - DNA, 20 bp, Homo sapiens
acgcctgtcctcctggaagg

SEQ ID NO: 3167148 - DNA, 12 bp, Homo sapiens
acgcgtctcctg

SEQ ID NO: 3167149 - DNA, 13 bp, Homo sapiens
acgcgtcttcctg

SEQ ID NO: 3167150 - DNA, 23 bp, Homo sapiens
acgcgtgcacacaccagagccca

SEQ ID NO: 3167151 - DNA, 21 bp, Homo sapiens
acgctaaagagcccttgcctc

SEQ ID NO: 3167152 - DNA, 20 bp, Homo sapiens
acgctacctctctgtccctt

SEQ ID NO: 3167153 - DNA, 18 bp, Homo sapiens
acgctactataaagagaa

SEQ ID NO: 3167154 - DNA, 11 bp, Homo sapiens
acgctccagct

SEQ ID NO: 3167155 - DNA, 16 bp, Homo sapiens
acgctccagctgcccc

SEQ ID NO: 3167156 - DNA, 15 bp, Homo sapiens
acgctcgctgccatc

SEQ ID NO: 3167157 - DNA, 14 bp, Homo sapiens
acgctctctggcct

SEQ ID NO: 3167158 - DNA, 17 bp, Homo sapiens
acgctctctggccttcg

SEQ ID NO: 3167159 - DNA, 14 bp, Homo sapiens
acgctgcagagcac

SEQ ID NO: 3167160 - DNA, 13 bp, Homo sapiens
acgctggaccttg

SEQ ID NO: 3167161 - DNA, 18 bp, Homo sapiens
acgctggagtgcagtgag

SEQ ID NO: 3167162 - DNA, 22 bp, Homo sapiens
acgctggcgacacactccgtcc

SEQ ID NO: 3167163 - DNA, 16 bp, Homo sapiens
acgctggggctctctg

SEQ ID NO: 3167164 - DNA, 19 bp, Homo sapiens
acgctggggctctctgaga

SEQ ID NO: 3167165 - DNA, 20 bp, Homo sapiens
acgcttgcgtatgtctgtta

SEQ ID NO: 3167166 - DNA, 20 bp, Homo sapiens
acgcttgtagaactcactct

SEQ ID NO: 3167167 - DNA, 21 bp, Homo sapiens
acgcttgtagaactcactctg

SEQ ID NO: 3167168 - DNA, 14 bp, Homo sapiens
acgctttgattcat

SEQ ID NO: 3167169 - DNA, 16 bp, Homo sapiens
acgctttgattcatag

SEQ ID NO: 3167170 - DNA, 22 bp, Homo sapiens
acgctttgctgctaccgccctg

SEQ ID NO: 3167171 - DNA, 21 bp, Homo sapiens
acggactcccgggccacgccc

SEQ ID NO: 3167172 - DNA, 12 bp, Homo sapiens
acggagaagaat

SEQ ID NO: 3167173 - DNA, 13 bp, Homo sapiens
acggagagaaaaa

SEQ ID NO: 3167174 - DNA, 22 bp, Homo sapiens
acggagagtgcttgggtggtgg

SEQ ID NO: 3167175 - DNA, 13 bp, Homo sapiens
acggagccctccc

SEQ ID NO: 3167176 - DNA, 21 bp, Homo sapiens
acggagccctccctatgtctg

SEQ ID NO: 3167177 - DNA, 23 bp, Homo sapiens
acggagccctccctatgtctgca

SEQ ID NO: 3167178 - DNA, 18 bp, Homo sapiens
acggaggagggatgctgc

SEQ ID NO: 3167179 - DNA, 19 bp, Homo sapiens
acggaggtcctttggacag

SEQ ID NO: 3167180 - DNA, 19 bp, Homo sapiens
acggagtcccaccttggct

SEQ ID NO: 3167181 - DNA, 19 bp, Homo sapiens
acggagtggggggacagag

SEQ ID NO: 3167182 - DNA, 14 bp, Homo sapiens
acggattttcagtt

SEQ ID NO: 3167183 - DNA, 19 bp, Homo sapiens
acggcagaaaacagagcct

SEQ ID NO: 3167184 - DNA, 22 bp, Homo sapiens
acggcagaaaacagagcctgcc

SEQ ID NO: 3167185 - DNA, 18 bp, Homo sapiens
acggcaggctcactgcca

SEQ ID NO: 3167186 - DNA, 20 bp, Homo sapiens
acggcaggctcactgccagg

SEQ ID NO: 3167187 - DNA, 22 bp, Homo sapiens
acggcaggctcactgccaggcc

SEQ ID NO: 3167188 - DNA, 21 bp, Homo sapiens
acggcattagcttcctgcccc

SEQ ID NO: 3167189 - DNA, 13 bp, Homo sapiens
acggccaggccag

SEQ ID NO: 3167190 - DNA, 22 bp, Homo sapiens
acggccctcatctatgaggaaa

SEQ ID NO: 3167191 - DNA, 11 bp, Homo sapiens
acggccctgca

SEQ ID NO: 3167192 - DNA, 13 bp, Homo sapiens
acggccctgcaat

SEQ ID NO: 3167193 - DNA, 18 bp, Homo sapiens
acggccctgcagccagct

SEQ ID NO: 3167194 - DNA, 15 bp, Homo sapiens
acggccgctccaggg

SEQ ID NO: 3167195 - DNA, 12 bp, Homo sapiens
acggcctggctg

SEQ ID NO: 3167196 - DNA, 17 bp, Homo sapiens
acggcctggctggtggg

SEQ ID NO: 3167197 - DNA, 16 bp, Homo sapiens
acggcgcccccagtgt

SEQ ID NO: 3167198 - DNA, 17 bp, Homo sapiens
acggcgcccccagtgtg

SEQ ID NO: 3167199 - DNA, 14 bp, Homo sapiens
acggcggccaggca

SEQ ID NO: 3167200 - DNA, 18 bp, Homo sapiens
acggcggccaggcacagg

SEQ ID NO: 3167201 - DNA, 14 bp, Homo sapiens
acggctcactgcag

SEQ ID NO: 3167202 - DNA, 22 bp, Homo sapiens
acggctgcctgacactgagccc

SEQ ID NO: 3167203 - DNA, 22 bp, Homo sapiens
acggctgtggaccgtggacagg

SEQ ID NO: 3167204 - DNA, 21 bp, Homo sapiens
acgggaggccccagctctgag

SEQ ID NO: 3167205 - DNA, 22 bp, Homo sapiens
acgggaggccccagctctgagg

SEQ ID NO: 3167206 - DNA, 13 bp, Homo sapiens
acgggaggctggg

SEQ ID NO: 3167207 - DNA, 16 bp, Homo sapiens
acgggaggctgggcac

SEQ ID NO: 3167208 - DNA, 18 bp, Homo sapiens
acgggcaagaagctgctt

SEQ ID NO: 3167209 - DNA, 10 bp, Homo sapiens
acgggcacag

SEQ ID NO: 3167210 - DNA, 14 bp, Homo sapiens
acggggactgggga

SEQ ID NO: 3167211 - DNA, 18 bp, Homo sapiens
acggggcctccaacccat

SEQ ID NO: 3167212 - DNA, 20 bp, Homo sapiens
acgggtcagtattaaggttt

SEQ ID NO: 3167213 - DNA, 18 bp, Homo sapiens
acggtgcgtggctgtggc

SEQ ID NO: 3167214 - DNA, 19 bp, Homo sapiens
acggtgggcatttgtgagg

SEQ ID NO: 3167215 - DNA, 18 bp, Homo sapiens
acggtggtgcatgcctgt

SEQ ID NO: 3167216 - DNA, 17 bp, Homo sapiens
acggtgttttgccatgt

SEQ ID NO: 3167217 - DNA, 14 bp, Homo sapiens
acggttaactgtaa

SEQ ID NO: 3167218 - DNA, 12 bp, Homo sapiens
acggttcctggt

SEQ ID NO: 3167219 - DNA, 13 bp, Homo sapiens
acggttcctggtg

SEQ ID NO: 3167220 - DNA, 21 bp, Homo sapiens
acgtaaagccttgttttctct

SEQ ID NO: 3167221 - DNA, 22 bp, Homo sapiens
acgtaaagccttgttttctctg

SEQ ID NO: 3167222 - DNA, 16 bp, Homo sapiens
acgtagttgtgctttt

SEQ ID NO: 3167223 - DNA, 15 bp, Homo sapiens
acgtatatataaaca

SEQ ID NO: 3167224 - DNA, 20 bp, Homo sapiens
acgtatgcaagtctgtgagt

SEQ ID NO: 3167225 - DNA, 18 bp, Homo sapiens
acgtcatgtatttgagca

SEQ ID NO: 3167226 - DNA, 21 bp, Homo sapiens
acgtccaggttcaacccacag

SEQ ID NO: 3167227 - DNA, 20 bp, Homo sapiens
acgtcccagcatccctggag

SEQ ID NO: 3167228 - DNA, 21 bp, Homo sapiens
acgtcccagcatccctggagc

SEQ ID NO: 3167229 - DNA, 13 bp, Homo sapiens
acgtccccctggg

SEQ ID NO: 3167230 - DNA, 14 bp, Homo sapiens
acgtcctatctccc

SEQ ID NO: 3167231 - DNA, 22 bp, Homo sapiens
acgtctgaagcttgactcccaa

SEQ ID NO: 3167232 - DNA, 13 bp, Homo sapiens
acgtctgacaggc

SEQ ID NO: 3167233 - DNA, 13 bp, Homo sapiens
acgtctgccaggc

SEQ ID NO: 3167234 - DNA, 16 bp, Homo sapiens
acgtctgccaggccca

SEQ ID NO: 3167235 - DNA, 20 bp, Homo sapiens
acgtctgccaggcccatctc

SEQ ID NO: 3167236 - DNA, 21 bp, Homo sapiens
acgtcttggtgccttttgtgt

SEQ ID NO: 3167237 - DNA, 23 bp, Homo sapiens
acgtgagagaaagagagaagcca

SEQ ID NO: 3167238 - DNA, 22 bp, Homo sapiens
acgtgaggggggggtgggtgag

SEQ ID NO: 3167239 - DNA, 15 bp, Homo sapiens
actagaattgttgca

SEQ ID NO: 3167240 - DNA, 18 bp, Homo sapiens
actagaatttgtattttg

SEQ ID NO: 3167241 - DNA, 20 bp, Homo sapiens
actagaatttgtattttgct

SEQ ID NO: 3167242 - DNA, 15 bp, Homo sapiens
actagacatgtcatg

SEQ ID NO: 3167243 - DNA, 17 bp, Homo sapiens
actagactcttcactgt

SEQ ID NO: 3167244 - DNA, 20 bp, Homo sapiens
actagagaatgcacagatat

SEQ ID NO: 3167245 - DNA, 17 bp, Homo sapiens
actagagacaaatcttt

SEQ ID NO: 3167246 - DNA, 17 bp, Homo sapiens
actagagatctggtttt

SEQ ID NO: 3167247 - DNA, 23 bp, Homo sapiens
actagagatctggttttgctatt

SEQ ID NO: 3167248 - DNA, 14 bp, Homo sapiens
actagaggcaggga

SEQ ID NO: 3167249 - DNA, 15 bp, Homo sapiens
actagaggcagggag

SEQ ID NO: 3167250 - DNA, 23 bp, Homo sapiens
actagagtaaaggccatcaaact

SEQ ID NO: 3167251 - DNA, 16 bp, Homo sapiens
actagatgtagtattt

SEQ ID NO: 3167252 - DNA, 13 bp, Homo sapiens
actagatttgtcc

SEQ ID NO: 3167253 - DNA, 14 bp, Homo sapiens
actagccaaaccag

SEQ ID NO: 3167254 - DNA, 12 bp, Homo sapiens
actagccaaggc

SEQ ID NO: 3167255 - DNA, 21 bp, Homo sapiens
actagccatgataactgcaat

SEQ ID NO: 3167256 - DNA, 15 bp, Homo sapiens
actagcccaatgaaa

SEQ ID NO: 3167257 - DNA, 17 bp, Homo sapiens
actagcccaatgaaatg

SEQ ID NO: 3167258 - DNA, 17 bp, Homo sapiens
actagcctttggctctg

SEQ ID NO: 3167259 - DNA, 19 bp, Homo sapiens
actagcctttggctctgga

SEQ ID NO: 3167260 - DNA, 20 bp, Homo sapiens
actagcctttggctctggag

SEQ ID NO: 3167261 - DNA, 18 bp, Homo sapiens
actaggagaaccaaatct

SEQ ID NO: 3167262 - DNA, 20 bp, Homo sapiens
actaggcccccacttgcctc

SEQ ID NO: 3167263 - DNA, 19 bp, Homo sapiens
actagggattcaggctgct

SEQ ID NO: 3167264 - DNA, 15 bp, Homo sapiens
actaggtaacttcat

SEQ ID NO: 3167265 - DNA, 22 bp, Homo sapiens
actaggtaatgttttgtatata

SEQ ID NO: 3167266 - DNA, 15 bp, Homo sapiens
actaggttcttttcc

SEQ ID NO: 3167267 - DNA, 19 bp, Homo sapiens
actaggttggacagccccc

SEQ ID NO: 3167268 - DNA, 14 bp, Homo sapiens
actagtagatttct

SEQ ID NO: 3167269 - DNA, 19 bp, Homo sapiens
actagtagttcctgctaca

SEQ ID NO: 3167270 - DNA, 21 bp, Homo sapiens
actagtttttcctatcatgtt

SEQ ID NO: 3167271 - DNA, 13 bp, Homo sapiens
actataaacatta

SEQ ID NO: 3167272 - DNA, 14 bp, Homo sapiens
actataaagagaag

SEQ ID NO: 3167273 - DNA, 17 bp, Homo sapiens
actataatcaaatgatt

SEQ ID NO: 3167274 - DNA, 19 bp, Homo sapiens
actataatcaaatgatttc

SEQ ID NO: 3167275 - DNA, 13 bp, Homo sapiens
actataatgtaag

SEQ ID NO: 3167276 - DNA, 12 bp, Homo sapiens
actataatttga

SEQ ID NO: 3167277 - DNA, 21 bp, Homo sapiens
actatagtaacttaatactct

SEQ ID NO: 3167278 - DNA, 21 bp, Homo sapiens
actatataatttatttccact

SEQ ID NO: 3167279 - DNA, 18 bp, Homo sapiens
actatatacatatatatt

SEQ ID NO: 3167280 - DNA, 16 bp, Homo sapiens
actatatacatgtgtg

SEQ ID NO: 3167281 - DNA, 17 bp, Homo sapiens
actatatacatgtgtgt

SEQ ID NO: 3167282 - DNA, 16 bp, Homo sapiens
actatatagagatgtt

SEQ ID NO: 3167283 - DNA, 16 bp, Homo sapiens
actatatgtttacaca

SEQ ID NO: 3167284 - DNA, 18 bp, Homo sapiens
actatatgtttacacaat

SEQ ID NO: 3167285 - DNA, 19 bp, Homo sapiens
actatatgtttacacaatt

SEQ ID NO: 3167286 - DNA, 19 bp, Homo sapiens
actatattgattgtccttt

SEQ ID NO: 3167287 - DNA, 15 bp, Homo sapiens
actatcattctcagt

SEQ ID NO: 3167288 - DNA, 17 bp, Homo sapiens
actatccatgcaccaaa

SEQ ID NO: 3167289 - DNA, 22 bp, Homo sapiens
actatcccaatcaaagaattac

SEQ ID NO: 3167290 - DNA, 18 bp, Homo sapiens
actatctgtatttattat

SEQ ID NO: 3167291 - DNA, 21 bp, Homo sapiens
actatctgtatttattatttg

SEQ ID NO: 3167292 - DNA, 17 bp, Homo sapiens
actatcttcttcaaata

SEQ ID NO: 3167293 - DNA, 19 bp, Homo sapiens
actatcttcttcaaataca

SEQ ID NO: 3167294 - DNA, 11 bp, Homo sapiens
actatcttgtg

SEQ ID NO: 3167295 - DNA, 11 bp, Homo sapiens
actatgaaata

SEQ ID NO: 3167296 - DNA, 16 bp, Homo sapiens
actatgaaataaaaaa

SEQ ID NO: 3167297 - DNA, 16 bp, Homo sapiens
actatgcacaatttaa

SEQ ID NO: 3167298 - DNA, 14 bp, Homo sapiens
actatgcacagagc

SEQ ID NO: 3167299 - DNA, 16 bp, Homo sapiens
actatgcacagagccc

SEQ ID NO: 3167300 - DNA, 13 bp, Homo sapiens
actatggaaaatc

SEQ ID NO: 3167301 - DNA, 16 bp, Homo sapiens
actatggctgagttct

SEQ ID NO: 3167302 - DNA, 16 bp, Homo sapiens
actatggtatttgagt

SEQ ID NO: 3167303 - DNA, 16 bp, Homo sapiens
actatgtatttttcta

SEQ ID NO: 3167304 - DNA, 17 bp, Homo sapiens
actatgtatttttctat

SEQ ID NO: 3167305 - DNA, 20 bp, Homo sapiens
actatgtggctgaaaatgca

SEQ ID NO: 3167306 - DNA, 14 bp, Homo sapiens
actatgtgtttttc

SEQ ID NO: 3167307 - DNA, 17 bp, Homo sapiens
actatgttgcccaggca

SEQ ID NO: 3167308 - DNA, 18 bp, Homo sapiens
actatgttgcccaggcag

SEQ ID NO: 3167309 - DNA, 19 bp, Homo sapiens
actatgttgcccaggcagg

SEQ ID NO: 3167310 - DNA, 13 bp, Homo sapiens
actattaaccttt

SEQ ID NO: 3167311 - DNA, 14 bp, Homo sapiens
actattaacctttt

SEQ ID NO: 3167312 - DNA, 22 bp, Homo sapiens
actattaggtgcaatttcaagg

SEQ ID NO: 3167313 - DNA, 11 bp, Homo sapiens
actattattat

SEQ ID NO: 3167314 - DNA, 18 bp, Homo sapiens
actattcattaaatgttt

SEQ ID NO: 3167315 - DNA, 19 bp, Homo sapiens
actattcattaaatgtttg

SEQ ID NO: 3167316 - DNA, 20 bp, Homo sapiens
actattcattaaatgtttga

SEQ ID NO: 3167317 - DNA, 16 bp, Homo sapiens
actattccctttgact

SEQ ID NO: 3167318 - DNA, 14 bp, Homo sapiens
actattggaaagta

SEQ ID NO: 3167319 - DNA, 13 bp, Homo sapiens
actattggagggt

SEQ ID NO: 3167320 - DNA, 21 bp, Homo sapiens
actatttaaacttataaatca

SEQ ID NO: 3167321 - DNA, 16 bp, Homo sapiens
actatttgtctttcag

SEQ ID NO: 3167322 - DNA, 14 bp, Homo sapiens
actattttctacaa

SEQ ID NO: 3167323 - DNA, 12 bp, Homo sapiens
actatttttgta

SEQ ID NO: 3167324 - DNA, 17 bp, Homo sapiens
actcaaaagacaaacat

SEQ ID NO: 3167325 - DNA, 15 bp, Homo sapiens
actcaaaatatttgt

SEQ ID NO: 3167326 - DNA, 19 bp, Homo sapiens
actcaaatacacatttgct

SEQ ID NO: 3167327 - DNA, 17 bp, Homo sapiens
actcaacatgttactga

SEQ ID NO: 3167328 - DNA, 22 bp, Homo sapiens
actcaacatgttactgaccagc

SEQ ID NO: 3167329 - DNA, 15 bp, Homo sapiens
actcaactctgagcc

SEQ ID NO: 3167330 - DNA, 23 bp, Homo sapiens
actcaagaagtgaagaatgcaca

SEQ ID NO: 3167331 - DNA, 17 bp, Homo sapiens
actcaaggactttgcag

SEQ ID NO: 3167332 - DNA, 12 bp, Homo sapiens
actcaataaatt

SEQ ID NO: 3167333 - DNA, 18 bp, Homo sapiens
actcaataaattgcaaca

SEQ ID NO: 3167334 - DNA, 15 bp, Homo sapiens
actcaatactacctc

SEQ ID NO: 3167335 - DNA, 17 bp, Homo sapiens
actcaatactacctctg

SEQ ID NO: 3167336 - DNA, 13 bp, Homo sapiens
actcaatattaaa

SEQ ID NO: 3167337 - DNA, 23 bp, Homo sapiens
actcaatggagtatgtctgatgg

SEQ ID NO: 3167338 - DNA, 18 bp, Homo sapiens
actcacagacctggagcc

SEQ ID NO: 3167339 - DNA, 22 bp, Homo sapiens
actcacagccgcattggtgact

SEQ ID NO: 3167340 - DNA, 23 bp, Homo sapiens
actcaccagccccactgccagca

SEQ ID NO: 3167341 - DNA, 13 bp, Homo sapiens
actcaccagggtc

SEQ ID NO: 3167342 - DNA, 19 bp, Homo sapiens
actcaccagggtccgcacc

SEQ ID NO: 3167343 - DNA, 21 bp, Homo sapiens
actcaccagggtccgcaccag

SEQ ID NO: 3167344 - DNA, 19 bp, Homo sapiens
actcaccagtgtcccctcc

SEQ ID NO: 3167345 - DNA, 19 bp, Homo sapiens
actcaccgtgctgtcttct

SEQ ID NO: 3167346 - DNA, 20 bp, Homo sapiens
actcaccgtgctgtcttctg

SEQ ID NO: 3167347 - DNA, 22 bp, Homo sapiens
actcacctgcactaacagagtg

SEQ ID NO: 3167348 - DNA, 20 bp, Homo sapiens
actcacggaccactcgaggc

SEQ ID NO: 3167349 - DNA, 14 bp, Homo sapiens
actcactaggcccc

SEQ ID NO: 3167350 - DNA, 17 bp, Homo sapiens
actcactaggcccccac

SEQ ID NO: 3167351 - DNA, 13 bp, Homo sapiens
actcactctgggc

SEQ ID NO: 3167352 - DNA, 16 bp, Homo sapiens
actcactctgggctgt

SEQ ID NO: 3167353 - DNA, 12 bp, Homo sapiens
actcactgaagc

SEQ ID NO: 3167354 - DNA, 13 bp, Homo sapiens
actcactgaagcc

SEQ ID NO: 3167355 - DNA, 14 bp, Homo sapiens
actcactgaagcct

SEQ ID NO: 3167356 - DNA, 22 bp, Homo sapiens
actcactggggcctacagcttt

SEQ ID NO: 3167357 - DNA, 21 bp, Homo sapiens
actcactttcccttgtgtcaa

SEQ ID NO: 3167358 - DNA, 21 bp, Homo sapiens
actcagaaagaggtctcccca

SEQ ID NO: 3167359 - DNA, 13 bp, Homo sapiens
actcagaagcctg

SEQ ID NO: 3167360 - DNA, 14 bp, Homo sapiens
actcagaagcctga

SEQ ID NO: 3167361 - DNA, 22 bp, Homo sapiens
actcagaatataacatgtaaaa

SEQ ID NO: 3167362 - DNA, 17 bp, Homo sapiens
actcagaattattttta

SEQ ID NO: 3167363 - DNA, 21 bp, Homo sapiens
actcagagaaaaatgctcccc

SEQ ID NO: 3167364 - DNA, 11 bp, Homo sapiens
actcagagcag

SEQ ID NO: 3167365 - DNA, 13 bp, Homo sapiens
actgattttgaaa

SEQ ID NO: 3167366 - DNA, 13 bp, Homo sapiens
actgatttttaag

SEQ ID NO: 3167367 - DNA, 14 bp, Homo sapiens
actgatttttgtga

SEQ ID NO: 3167368 - DNA, 15 bp, Homo sapiens
actgatttttgtgat

SEQ ID NO: 3167369 - DNA, 20 bp, Homo sapiens
actgcaaaaaaagcctccaa

SEQ ID NO: 3167370 - DNA, 22 bp, Homo sapiens
actgcaaaaagaaaatctttat

SEQ ID NO: 3167371 - DNA, 18 bp, Homo sapiens
actgcaaacttttttata

SEQ ID NO: 3167372 - DNA, 24 bp, Homo sapiens
actgcaaacttttttatatctttt

SEQ ID NO: 3167373 - DNA, 18 bp, Homo sapiens
actgcaaataaagccttt

SEQ ID NO: 3167374 - DNA, 15 bp, Homo sapiens
actgcaaccttcacc

SEQ ID NO: 3167375 - DNA, 14 bp, Homo sapiens
actgcaaccttgtt

SEQ ID NO: 3167376 - DNA, 17 bp, Homo sapiens
actgcaaccttgtttat

SEQ ID NO: 3167377 - DNA, 16 bp, Homo sapiens
actgcaagaaaatgat

SEQ ID NO: 3167378 - DNA, 18 bp, Homo sapiens
actgcaataacttctgac

SEQ ID NO: 3167379 - DNA, 20 bp, Homo sapiens
actgcaataacttctgacct

SEQ ID NO: 3167380 - DNA, 22 bp, Homo sapiens
actgcaatagagactgtagatt

SEQ ID NO: 3167381 - DNA, 18 bp, Homo sapiens
actgcacacacagctcct

SEQ ID NO: 3167382 - DNA, 19 bp, Homo sapiens
actgcacacacagctcctc

SEQ ID NO: 3167383 - DNA, 16 bp, Homo sapiens
actgcacagagctctc

SEQ ID NO: 3167384 - DNA, 16 bp, Homo sapiens
actgcacagtgcatct

SEQ ID NO: 3167385 - DNA, 22 bp, Homo sapiens
actgcacagtgcatctcagccc

SEQ ID NO: 3167386 - DNA, 16 bp, Homo sapiens
actgcacagtggcaca

SEQ ID NO: 3167387 - DNA, 16 bp, Homo sapiens
actgcacccagctcca

SEQ ID NO: 3167388 - DNA, 14 bp, Homo sapiens
actgcaccgggcca

SEQ ID NO: 3167389 - DNA, 15 bp, Homo sapiens
actgcactccagcct

SEQ ID NO: 3167390 - DNA, 19 bp, Homo sapiens
actgcactccagcctgggc

SEQ ID NO: 3167391 - DNA, 20 bp, Homo sapiens
actgcactccagcctgggca

SEQ ID NO: 3167392 - DNA, 21 bp, Homo sapiens
actgcagaatacagtaagctg

SEQ ID NO: 3167393 - DNA, 21 bp, Homo sapiens
actgcagaggggaaagacttc

SEQ ID NO: 3167394 - DNA, 18 bp, Homo sapiens
actgcagcacctccaggc

SEQ ID NO: 3167395 - DNA, 13 bp, Homo sapiens
actgcagcccagg

SEQ ID NO: 3167396 - DNA, 14 bp, Homo sapiens
actgcagcccagga

SEQ ID NO: 3167397 - DNA, 23 bp, Homo sapiens
actgcagcctcaacctcctgggc

SEQ ID NO: 3167398 - DNA, 12 bp, Homo sapiens
actgcaggccct

SEQ ID NO: 3167399 - DNA, 15 bp, Homo sapiens
actgcaggccctggc

SEQ ID NO: 3167400 - DNA, 19 bp, Homo sapiens
actgcaggccctggcctcc

SEQ ID NO: 3167401 - DNA, 18 bp, Homo sapiens
actgcaggttggacccca

SEQ ID NO: 3167402 - DNA, 19 bp, Homo sapiens
actgcaggttggaccccag

SEQ ID NO: 3167403 - DNA, 21 bp, Homo sapiens
actgcaggttggaccccagag

SEQ ID NO: 3167404 - DNA, 19 bp, Homo sapiens
actgcagttgactttctcc

SEQ ID NO: 3167405 - DNA, 17 bp, Homo sapiens
actgcatactttttaaa

SEQ ID NO: 3167406 - DNA, 20 bp, Homo sapiens
actgcatactttttaaatgt

SEQ ID NO: 3167407 - DNA, 16 bp, Homo sapiens
actgcatatgaaagga

SEQ ID NO: 3167408 - DNA, 21 bp, Homo sapiens
actgcatggacctaacattcg

SEQ ID NO: 3167409 - DNA, 20 bp, Homo sapiens
actgcattctctcccatcct

SEQ ID NO: 3167410 - DNA, 23 bp, Homo sapiens
actgcatttaaatttgatttcca

SEQ ID NO: 3167411 - DNA, 20 bp, Homo sapiens
actgccaaataaacagctat

SEQ ID NO: 3167412 - DNA, 14 bp, Homo sapiens
actgccaagccaga

SEQ ID NO: 3167413 - DNA, 22 bp, Homo sapiens
actgccaagccagattctcttg

SEQ ID NO: 3167414 - DNA, 23 bp, Homo sapiens
actgccaatatagaaaaataaaa

SEQ ID NO: 3167415 - DNA, 16 bp, Homo sapiens
actgccactttgcaca

SEQ ID NO: 3167416 - DNA, 22 bp, Homo sapiens
actgccactttgcacattttga

SEQ ID NO: 3167417 - DNA, 12 bp, Homo sapiens
actgccagcagc

SEQ ID NO: 3167418 - DNA, 18 bp, Homo sapiens
actgccagcagcagcagg

SEQ ID NO: 3167419 - DNA, 19 bp, Homo sapiens
actgccagcagcagcaggt

SEQ ID NO: 3167420 - DNA, 13 bp, Homo sapiens
actgccaggcacc

SEQ ID NO: 3167421 - DNA, 14 bp, Homo sapiens
actgccaggcacct

SEQ ID NO: 3167422 - DNA, 22 bp, Homo sapiens
actgccaggcacctggcctgct

SEQ ID NO: 3167423 - DNA, 15 bp, Homo sapiens
actgccaggccagcc

SEQ ID NO: 3167424 - DNA, 17 bp, Homo sapiens
actgccaggccagcctc

SEQ ID NO: 3167425 - DNA, 19 bp, Homo sapiens
actgccaggccagcctccg

SEQ ID NO: 3167426 - DNA, 16 bp, Homo sapiens
actgccagtctcactg

SEQ ID NO: 3167427 - DNA, 18 bp, Homo sapiens
actgccatgatagctggg

SEQ ID NO: 3167428 - DNA, 21 bp, Homo sapiens
actgccatgtactagttttag

SEQ ID NO: 3167429 - DNA, 21 bp, Homo sapiens
actgccattattttctgtcag

SEQ ID NO: 3167430 - DNA, 16 bp, Homo sapiens
actgcccaccccctca

SEQ ID NO: 3167431 - DNA, 17 bp, Homo sapiens
actgcccaccccctcaa

SEQ ID NO: 3167432 - DNA, 19 bp, Homo sapiens
actgccccccatgaggaag

SEQ ID NO: 3167433 - DNA, 22 bp, Homo sapiens
actgccccccatgaggaaggaa

SEQ ID NO: 3167434 - DNA, 18 bp, Homo sapiens
actgccccccgaggctgc

SEQ ID NO: 3167435 - DNA, 20 bp, Homo sapiens
actgccccccgaggctgcta

SEQ ID NO: 3167436 - DNA, 15 bp, Homo sapiens
actgcccgagctggt

SEQ ID NO: 3167437 - DNA, 22 bp, Homo sapiens
actgcccgagctggtgcattac

SEQ ID NO: 3167438 - DNA, 14 bp, Homo sapiens
actgcccgcacacc

SEQ ID NO: 3167439 - DNA, 16 bp, Homo sapiens
actgcccgcacaccct

SEQ ID NO: 3167440 - DNA, 11 bp, Homo sapiens
actgccctgcc

SEQ ID NO: 3167441 - DNA, 14 bp, Homo sapiens
actgccctgcctgc

SEQ ID NO: 3167442 - DNA, 23 bp, Homo sapiens
actgccctgcctgcccacttagc

SEQ ID NO: 3167443 - DNA, 14 bp, Homo sapiens
actgccctggcagc

SEQ ID NO: 3167444 - DNA, 18 bp, Homo sapiens
actgccctggcagcagca

SEQ ID NO: 3167445 - DNA, 19 bp, Homo sapiens
actgccctggcagcagcag

SEQ ID NO: 3167446 - DNA, 22 bp, Homo sapiens
actgccctgttcatgtgcctct

SEQ ID NO: 3167447 - DNA, 23 bp, Homo sapiens
actgccctgttcatgtgcctctg

SEQ ID NO: 3167448 - DNA, 16 bp, Homo sapiens
actgccgtaatttaac

SEQ ID NO: 3167449 - DNA, 20 bp, Homo sapiens
actgccgtgcattagcacag

SEQ ID NO: 3167450 - DNA, 21 bp, Homo sapiens
actgcctataatcttatacaa

SEQ ID NO: 3167451 - DNA, 22 bp, Homo sapiens
actgcctataatcttatacaac

SEQ ID NO: 3167452 - DNA, 16 bp, Homo sapiens
actgcctcaggttcct

SEQ ID NO: 3167453 - DNA, 11 bp, Homo sapiens
actgcctctgc

SEQ ID NO: 3167454 - DNA, 15 bp, Homo sapiens
actgcctcttcctcc

SEQ ID NO: 3167455 - DNA, 16 bp, Homo sapiens
actgcctgccaccgcg

SEQ ID NO: 3167456 - DNA, 16 bp, Homo sapiens
actgccttctcctctc

SEQ ID NO: 3167457 - DNA, 19 bp, Homo sapiens
actgccttctcctctctgg

SEQ ID NO: 3167458 - DNA, 17 bp, Homo sapiens
actgcgactttctgcct

SEQ ID NO: 3167459 - DNA, 17 bp, Homo sapiens
actgcgggagctctgta

SEQ ID NO: 3167460 - DNA, 23 bp, Homo sapiens
actgcgggagctctgtatggtca

SEQ ID NO: 3167461 - DNA, 15 bp, Homo sapiens
actgctaatgcaaat

SEQ ID NO: 3167462 - DNA, 14 bp, Homo sapiens
actgctacctctga

SEQ ID NO: 3167463 - DNA, 15 bp, Homo sapiens
actgctccctgaagc

SEQ ID NO: 3167464 - DNA, 19 bp, Homo sapiens
actgctccctgaagccagc

SEQ ID NO: 3167465 - DNA, 17 bp, Homo sapiens
actgctcttaagaaact

SEQ ID NO: 3167466 - DNA, 15 bp, Homo sapiens
actgctcttgaacat

SEQ ID NO: 3167467 - DNA, 16 bp, Homo sapiens
actgctcttgaacatt

SEQ ID NO: 3167468 - DNA, 18 bp, Homo sapiens
actgctcttgtttctttt

SEQ ID NO: 3167469 - DNA, 17 bp, Homo sapiens
actgctgatcgtagaaa

SEQ ID NO: 3167470 - DNA, 18 bp, Homo sapiens
actgctgcccagcctcca

SEQ ID NO: 3167471 - DNA, 15 bp, Homo sapiens
actgctggctgcctt

SEQ ID NO: 3167472 - DNA, 21 bp, Homo sapiens
actgctgtaaaattataaact

SEQ ID NO: 3167473 - DNA, 15 bp, Homo sapiens
actgctgtacccaga

SEQ ID NO: 3167474 - DNA, 16 bp, Homo sapiens
actgctgtacccagat

SEQ ID NO: 3167475 - DNA, 14 bp, Homo sapiens
actgctgtcttcca

SEQ ID NO: 3167476 - DNA, 13 bp, Homo sapiens
actgctgttcctg

SEQ ID NO: 3167477 - DNA, 20 bp, Homo sapiens
actgctgttcctgctccatg

SEQ ID NO: 3167478 - DNA, 15 bp, Homo sapiens
actgcttcccatcct

SEQ ID NO: 3167479 - DNA, 23 bp, Homo sapiens
actgcttgaactaggctgagcaa

SEQ ID NO: 3167480 - DNA, 23 bp, Homo sapiens
actgcttgatgaagcaaggaaga

SEQ ID NO: 3167481 - DNA, 12 bp, Homo sapiens
actgcttgctta

SEQ ID NO: 3167482 - DNA, 21 bp, Homo sapiens
actgcttgcttacaatcttta

SEQ ID NO: 3167483 - DNA, 22 bp, Homo sapiens
actgcttgcttacaatctttat

SEQ ID NO: 3167484 - DNA, 13 bp, Homo sapiens
actgctttcaagt

SEQ ID NO: 3167485 - DNA, 12 bp, Homo sapiens
actgctttctgt

SEQ ID NO: 3167486 - DNA, 22 bp, Homo sapiens
actgctttgggatttaatttcc

SEQ ID NO: 3167487 - DNA, 19 bp, Homo sapiens
actgctttggtctcttctt

SEQ ID NO: 3167488 - DNA, 19 bp, Homo sapiens
actgcttttcctcaagcaa

SEQ ID NO: 3167489 - DNA, 22 bp, Homo sapiens
actgcttttcctcaagcaataa

SEQ ID NO: 3167490 - DNA, 16 bp, Homo sapiens
acttccttgctctccc

SEQ ID NO: 3167491 - DNA, 19 bp, Homo sapiens
acttccttgctctccctct

SEQ ID NO: 3167492 - DNA, 16 bp, Homo sapiens
acttcggggaagatac

SEQ ID NO: 3167493 - DNA, 15 bp, Homo sapiens
acttcgtcttctaat

SEQ ID NO: 3167494 - DNA, 19 bp, Homo sapiens
acttcgtcttctaatttca

SEQ ID NO: 3167495 - DNA, 16 bp, Homo sapiens
acttctaatatcattc

SEQ ID NO: 3167496 - DNA, 18 bp, Homo sapiens
acttctacccagatggaa

SEQ ID NO: 3167497 - DNA, 14 bp, Homo sapiens
acttctacctgccc

SEQ ID NO: 3167498 - DNA, 16 bp, Homo sapiens
acttctatattttaat

SEQ ID NO: 3167499 - DNA, 17 bp, Homo sapiens
acttctatattttaata

SEQ ID NO: 3167500 - DNA, 19 bp, Homo sapiens
acttctatattttaataga

SEQ ID NO: 3167501 - DNA, 22 bp, Homo sapiens
acttctccagacccaccacacc

SEQ ID NO: 3167502 - DNA, 23 bp, Homo sapiens
acttctctgatcaaaattacttt

SEQ ID NO: 3167503 - DNA, 23 bp, Homo sapiens
acttctctgcctttgacatttaa

SEQ ID NO: 3167504 - DNA, 19 bp, Homo sapiens
acttctcttaaacttgtga

SEQ ID NO: 3167505 - DNA, 20 bp, Homo sapiens
acttctcttaaacttgtgaa

SEQ ID NO: 3167506 - DNA, 13 bp, Homo sapiens
acttctgaagact

SEQ ID NO: 3167507 - DNA, 20 bp, Homo sapiens
acttctgaagactgagaact

SEQ ID NO: 3167508 - DNA, 16 bp, Homo sapiens
acttctgcaacaagca

SEQ ID NO: 3167509 - DNA, 12 bp, Homo sapiens
acttctgcagct

SEQ ID NO: 3167510 - DNA, 22 bp, Homo sapiens
acttctgcattcctgtaacttt

SEQ ID NO: 3167511 - DNA, 18 bp, Homo sapiens
acttctgccatattctgt

SEQ ID NO: 3167512 - DNA, 19 bp, Homo sapiens
acttctggaaggctggctg

SEQ ID NO: 3167513 - DNA, 20 bp, Homo sapiens
acttctggaaggctggctga

SEQ ID NO: 3167514 - DNA, 22 bp, Homo sapiens
acttctggaaggctggctgagt

SEQ ID NO: 3167515 - DNA, 13 bp, Homo sapiens
acttctggctcct

SEQ ID NO: 3167516 - DNA, 17 bp, Homo sapiens
acttctgggcttcatct

SEQ ID NO: 3167517 - DNA, 19 bp, Homo sapiens
acttctgtgagacccccac

SEQ ID NO: 3167518 - DNA, 20 bp, Homo sapiens
acttctgtgagacccccaca

SEQ ID NO: 3167519 - DNA, 15 bp, Homo sapiens
acttctgtgggcccc

SEQ ID NO: 3167520 - DNA, 13 bp, Homo sapiens
acttctgtgttca

SEQ ID NO: 3167521 - DNA, 12 bp, Homo sapiens
acttctgtttgg

SEQ ID NO: 3167522 - DNA, 16 bp, Homo sapiens
acttcttaaaagttgt

SEQ ID NO: 3167523 - DNA, 16 bp, Homo sapiens
acttcttaaaggcctg

SEQ ID NO: 3167524 - DNA, 18 bp, Homo sapiens
acttcttatacatttgat

SEQ ID NO: 3167525 - DNA, 20 bp, Homo sapiens
acttcttatggaattgattt

SEQ ID NO: 3167526 - DNA, 13 bp, Homo sapiens
acttcttcctgct

SEQ ID NO: 3167527 - DNA, 16 bp, Homo sapiens
acttcttcctgctgga

SEQ ID NO: 3167528 - DNA, 13 bp, Homo sapiens
acttcttgaatat

SEQ ID NO: 3167529 - DNA, 11 bp, Homo sapiens
acttcttgctt

SEQ ID NO: 3167530 - DNA, 19 bp, Homo sapiens
acttcttgcttctttctag

SEQ ID NO: 3167531 - DNA, 20 bp, Homo sapiens
acttcttgcttctttctaga

SEQ ID NO: 3167532 - DNA, 16 bp, Homo sapiens
acttcttgtcagacat

SEQ ID NO: 3167533 - DNA, 22 bp, Homo sapiens
acttcttgtcagacataaagcc

SEQ ID NO: 3167534 - DNA, 24 bp, Homo sapiens
acttcttgtcagacataaagccat

SEQ ID NO: 3167535 - DNA, 20 bp, Homo sapiens
acttcttttgctcttagctg

SEQ ID NO: 3167536 - DNA, 18 bp, Homo sapiens
acttgaaatctaggatta

SEQ ID NO: 3167537 - DNA, 23 bp, Homo sapiens
acttgaaatgttagtcattgtta

SEQ ID NO: 3167538 - DNA, 15 bp, Homo sapiens
acttgaagctttgta

SEQ ID NO: 3167539 - DNA, 13 bp, Homo sapiens
acttgaatatgta

SEQ ID NO: 3167540 - DNA, 24 bp, Homo sapiens
acttgaatgctagttatacttatt

SEQ ID NO: 3167541 - DNA, 16 bp, Homo sapiens
acttgaatgtgtcact

SEQ ID NO: 3167542 - DNA, 15 bp, Homo sapiens
acttgaatgtgtcag

SEQ ID NO: 3167543 - DNA, 16 bp, Homo sapiens
acttgagaggatgaat

SEQ ID NO: 3167544 - DNA, 17 bp, Homo sapiens
acttgagggcccagagc

SEQ ID NO: 3167545 - DNA, 18 bp, Homo sapiens
acttgagggcccagagca

SEQ ID NO: 3167546 - DNA, 19 bp, Homo sapiens
acttgagggcccagagcag

SEQ ID NO: 3167547 - DNA, 20 bp, Homo sapiens
acttgagggcccagagcagg

SEQ ID NO: 3167548 - DNA, 16 bp, Homo sapiens
acttgagtgtaatgtt

SEQ ID NO: 3167549 - DNA, 22 bp, Homo sapiens
acttgataatattagtgattct

SEQ ID NO: 3167550 - DNA, 17 bp, Homo sapiens
acttgatactgaatgca

SEQ ID NO: 3167551 - DNA, 13 bp, Homo sapiens
acttgatttcttc

SEQ ID NO: 3167552 - DNA, 17 bp, Homo sapiens
acttgatttcttctaga

SEQ ID NO: 3167553 - DNA, 12 bp, Homo sapiens
acttgatttgat

SEQ ID NO: 3167554 - DNA, 18 bp, Homo sapiens
acttgatttgcatggatt

SEQ ID NO: 3167555 - DNA, 14 bp, Homo sapiens
acttgcaaagacct

SEQ ID NO: 3167556 - DNA, 15 bp, Homo sapiens
acttgcatggagcag

SEQ ID NO: 3167557 - DNA, 22 bp, Homo sapiens
acttgcctaactaactggcagg

SEQ ID NO: 3167558 - DNA, 13 bp, Homo sapiens
acttgcctcttcc

SEQ ID NO: 3167559 - DNA, 17 bp, Homo sapiens
acttgcctcttccttga

SEQ ID NO: 3167560 - DNA, 17 bp, Homo sapiens
acttgcgagaaattcgt

SEQ ID NO: 3167561 - DNA, 18 bp, Homo sapiens
acttgcgtcctgcagagg

SEQ ID NO: 3167562 - DNA, 23 bp, Homo sapiens
acttgctggggctcacggggcct

SEQ ID NO: 3167563 - DNA, 17 bp, Homo sapiens
acttgctggtcctggct

SEQ ID NO: 3167564 - DNA, 19 bp, Homo sapiens
acttgcttattacatttaa

SEQ ID NO: 3167565 - DNA, 15 bp, Homo sapiens
acttgcttctctagc

SEQ ID NO: 3167566 - DNA, 16 bp, Homo sapiens
acttgcttctctagct

SEQ ID NO: 3167567 - DNA, 22 bp, Homo sapiens
acttgctttatgccttcttatt

SEQ ID NO: 3167568 - DNA, 21 bp, Homo sapiens
acttggaaaaatccagaaaga

SEQ ID NO: 3167569 - DNA, 14 bp, Homo sapiens
acttggaagctccg

SEQ ID NO: 3167570 - DNA, 22 bp, Homo sapiens
acttggaatttgtaacctcagc

SEQ ID NO: 3167571 - DNA, 23 bp, Homo sapiens
acttggaatttgtaacctcagct

SEQ ID NO: 3167572 - DNA, 22 bp, Homo sapiens
acttggacaggagtcagtgtct

SEQ ID NO: 3167573 - DNA, 18 bp, Homo sapiens
acttggactcttgctctt

SEQ ID NO: 3167574 - DNA, 19 bp, Homo sapiens
acttggactcttgctcttt

SEQ ID NO: 3167575 - DNA, 16 bp, Homo sapiens
acttggagactcctgg

SEQ ID NO: 3167576 - DNA, 22 bp, Homo sapiens
acttggagactcctggtctgtg

SEQ ID NO: 3167577 - DNA, 16 bp, Homo sapiens
acttggagcccgtgca

SEQ ID NO: 3167578 - DNA, 18 bp, Homo sapiens
acttggatacttggattt

SEQ ID NO: 3167579 - DNA, 13 bp, Homo sapiens
acttggcacttaa

SEQ ID NO: 3167580 - DNA, 16 bp, Homo sapiens
acttggcaggtgcctg

SEQ ID NO: 3167581 - DNA, 16 bp, Homo sapiens
acttggcctcagctgg

SEQ ID NO: 3167582 - DNA, 22 bp, Homo sapiens
acttggctcgaatctctgtgcc

SEQ ID NO: 3167583 - DNA, 22 bp, Homo sapiens
acttgggggaacgatgtgtctg

SEQ ID NO: 3167584 - DNA, 19 bp, Homo sapiens
acttgggggttcaggcccg

SEQ ID NO: 3167585 - DNA, 20 bp, Homo sapiens
acttgggggttcaggcccgg

SEQ ID NO: 3167586 - DNA, 21 bp, Homo sapiens
acttggtacagttgcaggagc

SEQ ID NO: 3167587 - DNA, 15 bp, Homo sapiens
acttggtctgtgaga

SEQ ID NO: 3167588 - DNA, 16 bp, Homo sapiens
acttggtgtactgggt

SEQ ID NO: 3167589 - DNA, 20 bp, Homo sapiens
acttggttggtagggtggga

SEQ ID NO: 3167590 - DNA, 19 bp, Homo sapiens
acttggtttttggctcttt

SEQ ID NO: 3167591 - DNA, 20 bp, Homo sapiens
acttggtttttggctctttc

SEQ ID NO: 3167592 - DNA, 13 bp, Homo sapiens
acttgtaaataca

SEQ ID NO: 3167593 - DNA, 14 bp, Homo sapiens
acttgtacaaaata

SEQ ID NO: 3167594 - DNA, 18 bp, Homo sapiens
acttgtacaaaataaaca

SEQ ID NO: 3167595 - DNA, 17 bp, Homo sapiens
acttgtagctgtaaaac

SEQ ID NO: 3167596 - DNA, 15 bp, Homo sapiens
acttgtataaatgta

SEQ ID NO: 3167597 - DNA, 15 bp, Homo sapiens
acttgtatatttgta

SEQ ID NO: 3167598 - DNA, 17 bp, Homo sapiens
acttgtatatttgtaca

SEQ ID NO: 3167599 - DNA, 20 bp, Homo sapiens
acttgtatattttaagaaat

SEQ ID NO: 3167600 - DNA, 14 bp, Homo sapiens
acttgtatgaaaga

SEQ ID NO: 3167601 - DNA, 13 bp, Homo sapiens
acttgtattgact

SEQ ID NO: 3167602 - DNA, 14 bp, Homo sapiens
acttgtattgactt

SEQ ID NO: 3167603 - DNA, 18 bp, Homo sapiens
acttgtcactgacacaaa

SEQ ID NO: 3167604 - DNA, 21 bp, Homo sapiens
acttgtcactgacacaaagga

SEQ ID NO: 3167605 - DNA, 22 bp, Homo sapiens
acttgtcactgacacaaaggaa

SEQ ID NO: 3167606 - DNA, 17 bp, Homo sapiens
acttgtctgaggcctca

SEQ ID NO: 3167607 - DNA, 19 bp, Homo sapiens
acttgtctgggaattgtgt

SEQ ID NO: 3167608 - DNA, 15 bp, Homo sapiens
acttgtctttttctg

SEQ ID NO: 3167609 - DNA, 20 bp, Homo sapiens
acttgtgaaacacagctgtt

SEQ ID NO: 3167610 - DNA, 13 bp, Homo sapiens
acttgtgaatgct

SEQ ID NO: 3167611 - DNA, 22 bp, Homo sapiens
acttgtgctgatcgtgctaaat

SEQ ID NO: 3167612 - DNA, 21 bp, Homo sapiens
acttgtgctttcagttagcct

SEQ ID NO: 3167613 - DNA, 14 bp, Homo sapiens
acttgtggacacag

SEQ ID NO: 3167614 - DNA, 15 bp, Homo sapiens
acttgtggacacagc

SEQ ID NO: 3167615 - DNA, 15 bp, Homo sapiens
agaacaaagctgtta

SEQ ID NO: 3167616 - DNA, 18 bp, Homo sapiens
agaacaaagctgttaaac

SEQ ID NO: 3167617 - DNA, 19 bp, Homo sapiens
agaacaaagctgttaaact

SEQ ID NO: 3167618 - DNA, 21 bp, Homo sapiens
agaacaaaggacagagtatga

SEQ ID NO: 3167619 - DNA, 18 bp, Homo sapiens
agaacaagtcacagctgc

SEQ ID NO: 3167620 - DNA, 20 bp, Homo sapiens
agaacaagtcacagctgcag

SEQ ID NO: 3167621 - DNA, 15 bp, Homo sapiens
agaacacacagactt

SEQ ID NO: 3167622 - DNA, 19 bp, Homo sapiens
agaacacacagactttctg

SEQ ID NO: 3167623 - DNA, 16 bp, Homo sapiens
agaacacagcatgtgc

SEQ ID NO: 3167624 - DNA, 20 bp, Homo sapiens
agaacacagcatgtgccaag

SEQ ID NO: 3167625 - DNA, 11 bp, Homo sapiens
agaacacagtt

SEQ ID NO: 3167626 - DNA, 15 bp, Homo sapiens
agaacactaattcat

SEQ ID NO: 3167627 - DNA, 14 bp, Homo sapiens
agaacactattttc

SEQ ID NO: 3167628 - DNA, 16 bp, Homo sapiens
agaacactattttcag

SEQ ID NO: 3167629 - DNA, 20 bp, Homo sapiens
agaacactattttcagaatc

SEQ ID NO: 3167630 - DNA, 16 bp, Homo sapiens
agaacagatcttttac

SEQ ID NO: 3167631 - DNA, 23 bp, Homo sapiens
agaacagcagggtagtctggttt

SEQ ID NO: 3167632 - DNA, 22 bp, Homo sapiens
agaacagcatcatgtcataaac

SEQ ID NO: 3167633 - DNA, 12 bp, Homo sapiens
agaacagcttca

SEQ ID NO: 3167634 - DNA, 17 bp, Homo sapiens
agaacaggaggtgtgaa

SEQ ID NO: 3167635 - DNA, 18 bp, Homo sapiens
agaacaggaggtgtgaat

SEQ ID NO: 3167636 - DNA, 21 bp, Homo sapiens
agaacaggaggtgtgaatgca

SEQ ID NO: 3167637 - DNA, 19 bp, Homo sapiens
agaacagggaaaataggca

SEQ ID NO: 3167638 - DNA, 13 bp, Homo sapiens
agaacagtaaaca

SEQ ID NO: 3167639 - DNA, 16 bp, Homo sapiens
agaacagtgaaaggta

SEQ ID NO: 3167640 - DNA, 12 bp, Homo sapiens
agaacagtgggc

SEQ ID NO: 3167641 - DNA, 22 bp, Homo sapiens
agaacagtgggcgttgggagcc

SEQ ID NO: 3167642 - DNA, 18 bp, Homo sapiens
agaacagtggttgcctgg

SEQ ID NO: 3167643 - DNA, 14 bp, Homo sapiens
agaacatcattaga

SEQ ID NO: 3167644 - DNA, 18 bp, Homo sapiens
agaacatcattagaacaa

SEQ ID NO: 3167645 - DNA, 14 bp, Homo sapiens
agaacatgaaatgc

SEQ ID NO: 3167646 - DNA, 14 bp, Homo sapiens
agaacatggacttg

SEQ ID NO: 3167647 - DNA, 22 bp, Homo sapiens
agaacatgtgagaggtttgact

SEQ ID NO: 3167648 - DNA, 15 bp, Homo sapiens
agaacattcagctct

SEQ ID NO: 3167649 - DNA, 21 bp, Homo sapiens
agaacattcagctctggagaa

SEQ ID NO: 3167650 - DNA, 22 bp, Homo sapiens
agaacattcagctctggagaac

SEQ ID NO: 3167651 - DNA, 16 bp, Homo sapiens
agaacattttaattca

SEQ ID NO: 3167652 - DNA, 18 bp, Homo sapiens
agaaccaaaagttttcct

SEQ ID NO: 3167653 - DNA, 13 bp, Homo sapiens
agaaccaaatctg

SEQ ID NO: 3167654 - DNA, 16 bp, Homo sapiens
agaaccaaatctggaa

SEQ ID NO: 3167655 - DNA, 21 bp, Homo sapiens
agaaccacacttgaaaccttt

SEQ ID NO: 3167656 - DNA, 17 bp, Homo sapiens
agaaccagccgtatttt

SEQ ID NO: 3167657 - DNA, 19 bp, Homo sapiens
agaaccagccgtattttac

SEQ ID NO: 3167658 - DNA, 22 bp, Homo sapiens
agaaccatccctattttgtatt

SEQ ID NO: 3167659 - DNA, 14 bp, Homo sapiens
agaaccatgcagga

SEQ ID NO: 3167660 - DNA, 13 bp, Homo sapiens
agaacccagggct

SEQ ID NO: 3167661 - DNA, 19 bp, Homo sapiens
agaacccctacatgaaaca

SEQ ID NO: 3167662 - DNA, 22 bp, Homo sapiens
agaaccgagcaaagatcaaaat

SEQ ID NO: 3167663 - DNA, 17 bp, Homo sapiens
agaacctactgttcctt

SEQ ID NO: 3167664 - DNA, 20 bp, Homo sapiens
agaacctactgttcctttca

SEQ ID NO: 3167665 - DNA, 14 bp, Homo sapiens
agaacctcttcccc

SEQ ID NO: 3167666 - DNA, 14 bp, Homo sapiens
agaacctgggctgt

SEQ ID NO: 3167667 - DNA, 21 bp, Homo sapiens
agaacggagccccaggcctct

SEQ ID NO: 3167668 - DNA, 11 bp, Homo sapiens
agaactaaatg

SEQ ID NO: 3167669 - DNA, 13 bp, Homo sapiens
agaactaaatgtt

SEQ ID NO: 3167670 - DNA, 21 bp, Homo sapiens
agaactagccaaaccaggacc

SEQ ID NO: 3167671 - DNA, 19 bp, Homo sapiens
agaactcactctgggctgt

SEQ ID NO: 3167672 - DNA, 20 bp, Homo sapiens
agaactcactctgggctgta

SEQ ID NO: 3167673 - DNA, 16 bp, Homo sapiens
agaactcagcagttga

SEQ ID NO: 3167674 - DNA, 17 bp, Homo sapiens
agaactcagttttaact

SEQ ID NO: 3167675 - DNA, 16 bp, Homo sapiens
agaactccaggccctc

SEQ ID NO: 3167676 - DNA, 17 bp, Homo sapiens
agaactccaggccctcc

SEQ ID NO: 3167677 - DNA, 15 bp, Homo sapiens
agaactccctttcaa

SEQ ID NO: 3167678 - DNA, 14 bp, Homo sapiens
agaactcctgactg

SEQ ID NO: 3167679 - DNA, 14 bp, Homo sapiens
agaactgaaataaa

SEQ ID NO: 3167680 - DNA, 16 bp, Homo sapiens
agaactgaagtgtgct

SEQ ID NO: 3167681 - DNA, 19 bp, Homo sapiens
agaactgaattttgggact

SEQ ID NO: 3167682 - DNA, 18 bp, Homo sapiens
agaactgcaggccctggc

SEQ ID NO: 3167683 - DNA, 20 bp, Homo sapiens
agaactgccattattttctg

SEQ ID NO: 3167684 - DNA, 15 bp, Homo sapiens
agaactgcccccact

SEQ ID NO: 3167685 - DNA, 12 bp, Homo sapiens
agaactgccctt

SEQ ID NO: 3167686 - DNA, 18 bp, Homo sapiens
agaactgcccttgctgcc

SEQ ID NO: 3167687 - DNA, 21 bp, Homo sapiens
agaactgcccttgctgcccgc

SEQ ID NO: 3167688 - DNA, 22 bp, Homo sapiens
agaactgcccttgctgcccgcg

SEQ ID NO: 3167689 - DNA, 20 bp, Homo sapiens
agaactgcttcatgtgaaca

SEQ ID NO: 3167690 - DNA, 12 bp, Homo sapiens
agaactgggtaa

SEQ ID NO: 3167691 - DNA, 18 bp, Homo sapiens
agaactgggtaaatgcaa

SEQ ID NO: 3167692 - DNA, 14 bp, Homo sapiens
agaactgtctgtga

SEQ ID NO: 3167693 - DNA, 23 bp, Homo sapiens
agaactgttgcctaattggaaag

SEQ ID NO: 3167694 - DNA, 14 bp, Homo sapiens
agaacttcagaaag

SEQ ID NO: 3167695 - DNA, 17 bp, Homo sapiens
agaacttcagaaagact

SEQ ID NO: 3167696 - DNA, 18 bp, Homo sapiens
agaacttgaatgtgtcag

SEQ ID NO: 3167697 - DNA, 17 bp, Homo sapiens
agaacttgatttgcatg

SEQ ID NO: 3167698 - DNA, 14 bp, Homo sapiens
agaacttttttaaa

SEQ ID NO: 3167699 - DNA, 16 bp, Homo sapiens
agaacttttttaaata

SEQ ID NO: 3167700 - DNA, 18 bp, Homo sapiens
agaacttttttaaataaa

SEQ ID NO: 3167701 - DNA, 21 bp, Homo sapiens
agaacttttttaaataaactt

SEQ ID NO: 3167702 - DNA, 15 bp, Homo sapiens
agaagaaagactcta

SEQ ID NO: 3167703 - DNA, 15 bp, Homo sapiens
agaagaaagatgttt

SEQ ID NO: 3167704 - DNA, 11 bp, Homo sapiens
agaagaaagca

SEQ ID NO: 3167705 - DNA, 13 bp, Homo sapiens
agaagaacatcca

SEQ ID NO: 3167706 - DNA, 20 bp, Homo sapiens
agaagaactgtgtttcaagt

SEQ ID NO: 3167707 - DNA, 21 bp, Homo sapiens
agaagaactgtgtttcaagtt

SEQ ID NO: 3167708 - DNA, 12 bp, Homo sapiens
agaagaaggaga

SEQ ID NO: 3167709 - DNA, 19 bp, Homo sapiens
agaagaaggagagcaagaa

SEQ ID NO: 3167710 - DNA, 16 bp, Homo sapiens
agaagaagttcatgtc

SEQ ID NO: 3167711 - DNA, 14 bp, Homo sapiens
agaagaatattcag

SEQ ID NO: 3167712 - DNA, 15 bp, Homo sapiens
agaagaatattcagg

SEQ ID NO: 3167713 - DNA, 19 bp, Homo sapiens
agaagaatattcaggactt

SEQ ID NO: 3167714 - DNA, 15 bp, Homo sapiens
agaagacaaaaagac

SEQ ID NO: 3167715 - DNA, 14 bp, Homo sapiens
agaagacaccagag

SEQ ID NO: 3167716 - DNA, 16 bp, Homo sapiens
agaagacatggagact

SEQ ID NO: 3167717 - DNA, 19 bp, Homo sapiens
agaagacatggagactcct

SEQ ID NO: 3167718 - DNA, 22 bp, Homo sapiens
agaagacatggagactcctgcc

SEQ ID NO: 3167719 - DNA, 22 bp, Homo sapiens
agaagaccaaagcattgcctgc

SEQ ID NO: 3167720 - DNA, 19 bp, Homo sapiens
agaagacccacgtgctagg

SEQ ID NO: 3167721 - DNA, 18 bp, Homo sapiens
agaagactttaattatat

SEQ ID NO: 3167722 - DNA, 15 bp, Homo sapiens
agaagagaaggaagc

SEQ ID NO: 3167723 - DNA, 13 bp, Homo sapiens
agaagagaggaga

SEQ ID NO: 3167724 - DNA, 21 bp, Homo sapiens
agaagagaggagaggagagag

SEQ ID NO: 3167725 - DNA, 19 bp, Homo sapiens
agaagagatgagaaatgat

SEQ ID NO: 3167726 - DNA, 20 bp, Homo sapiens
agaagagatgcactatatgt

SEQ ID NO: 3167727 - DNA, 22 bp, Homo sapiens
agaagagatgggcttgttttct

SEQ ID NO: 3167728 - DNA, 12 bp, Homo sapiens
agaagagccctg

SEQ ID NO: 3167729 - DNA, 24 bp, Homo sapiens
agaagagcgagagatcaaagatga

SEQ ID NO: 3167730 - DNA, 22 bp, Homo sapiens
agaagaggcatcctgcctgggt

SEQ ID NO: 3167731 - DNA, 16 bp, Homo sapiens
agaagagggcccagcc

SEQ ID NO: 3167732 - DNA, 17 bp, Homo sapiens
agaagagggcccagccc

SEQ ID NO: 3167733 - DNA, 19 bp, Homo sapiens
agaagagggcccagcccag

SEQ ID NO: 3167734 - DNA, 14 bp, Homo sapiens
agaagagggcctgt

SEQ ID NO: 3167735 - DNA, 24 bp, Homo sapiens
agaagagggcctgtgggagcctgc

SEQ ID NO: 3167736 - DNA, 17 bp, Homo sapiens
agaagagggtgtgtttg

SEQ ID NO: 3167737 - DNA, 23 bp, Homo sapiens
agaagagttgaggaactgtacag

SEQ ID NO: 3167738 - DNA, 16 bp, Homo sapiens
agaagataacattttc

SEQ ID NO: 3167739 - DNA, 17 bp, Homo sapiens
agaagataacattttca

SEQ ID NO: 3167740 - DNA, 17 bp, Homo sapiens
agaagatgatcagacct

SEQ ID NO: 3167741 - DNA, 16 bp, Homo sapiens
agagcaaatgagggag

SEQ ID NO: 3167742 - DNA, 18 bp, Homo sapiens
agagcaaatgagggaggg

SEQ ID NO: 3167743 - DNA, 13 bp, Homo sapiens
agagcaacccctg

SEQ ID NO: 3167744 - DNA, 18 bp, Homo sapiens
agagcaagactccatctc

SEQ ID NO: 3167745 - DNA, 20 bp, Homo sapiens
agagcaagagataagtcttt

SEQ ID NO: 3167746 - DNA, 13 bp, Homo sapiens
agagcacaaacat

SEQ ID NO: 3167747 - DNA, 18 bp, Homo sapiens
agagcacaaacttcagaa

SEQ ID NO: 3167748 - DNA, 16 bp, Homo sapiens
agagcacacagagaag

SEQ ID NO: 3167749 - DNA, 21 bp, Homo sapiens
agagcacacagagaagggaag

SEQ ID NO: 3167750 - DNA, 20 bp, Homo sapiens
agagcacccccaagcctggg

SEQ ID NO: 3167751 - DNA, 15 bp, Homo sapiens
agagcaccccctgct

SEQ ID NO: 3167752 - DNA, 13 bp, Homo sapiens
agagcactcccta

SEQ ID NO: 3167753 - DNA, 13 bp, Homo sapiens
agagcactttagc

SEQ ID NO: 3167754 - DNA, 21 bp, Homo sapiens
agagcactttagcagatgtgg

SEQ ID NO: 3167755 - DNA, 13 bp, Homo sapiens
agagcagagttta

SEQ ID NO: 3167756 - DNA, 19 bp, Homo sapiens
agagcagatgcagagagcc

SEQ ID NO: 3167757 - DNA, 15 bp, Homo sapiens
agagcagcagcacca

SEQ ID NO: 3167758 - DNA, 12 bp, Homo sapiens
agagcagcctga

SEQ ID NO: 3167759 - DNA, 13 bp, Homo sapiens
agagcagcctgat

SEQ ID NO: 3167760 - DNA, 21 bp, Homo sapiens
agagcagcctgatggccaagg

SEQ ID NO: 3167761 - DNA, 12 bp, Homo sapiens
agagcagcctgt

SEQ ID NO: 3167762 - DNA, 16 bp, Homo sapiens
agagcagcctgtggca

SEQ ID NO: 3167763 - DNA, 23 bp, Homo sapiens
agagcagcggggcgaagcccagg

SEQ ID NO: 3167764 - DNA, 18 bp, Homo sapiens
agagcagctttaaactca

SEQ ID NO: 3167765 - DNA, 20 bp, Homo sapiens
agagcagctttaaactcagg

SEQ ID NO: 3167766 - DNA, 12 bp, Homo sapiens
agagcaggcaca

SEQ ID NO: 3167767 - DNA, 22 bp, Homo sapiens
agagcagggattaacctctgca

SEQ ID NO: 3167768 - DNA, 24 bp, Homo sapiens
agagcagggattaacctctgcact

SEQ ID NO: 3167769 - DNA, 15 bp, Homo sapiens
agagcatacaaaata

SEQ ID NO: 3167770 - DNA, 21 bp, Homo sapiens
agagcatatttgccaataaag

SEQ ID NO: 3167771 - DNA, 16 bp, Homo sapiens
agagcatcgtgaccct

SEQ ID NO: 3167772 - DNA, 20 bp, Homo sapiens
agagcatggatgcatttcaa

SEQ ID NO: 3167773 - DNA, 21 bp, Homo sapiens
agagcatggatgcatttcaaa

SEQ ID NO: 3167774 - DNA, 23 bp, Homo sapiens
agagcatggatgcatttcaaatg

SEQ ID NO: 3167775 - DNA, 15 bp, Homo sapiens
agagcattgccattc

SEQ ID NO: 3167776 - DNA, 18 bp, Homo sapiens
agagcattgccattccct

SEQ ID NO: 3167777 - DNA, 20 bp, Homo sapiens
agagccaacctcggcttgtg

SEQ ID NO: 3167778 - DNA, 13 bp, Homo sapiens
agagccagaccaa

SEQ ID NO: 3167779 - DNA, 19 bp, Homo sapiens
agagccagatgcaggacag

SEQ ID NO: 3167780 - DNA, 14 bp, Homo sapiens
agagccagcctggg

SEQ ID NO: 3167781 - DNA, 13 bp, Homo sapiens
agagccagctccc

SEQ ID NO: 3167782 - DNA, 13 bp, Homo sapiens
agagccagcttgg

SEQ ID NO: 3167783 - DNA, 15 bp, Homo sapiens
agagccaggatgccc

SEQ ID NO: 3167784 - DNA, 21 bp, Homo sapiens
agagccaggatgcccagatga

SEQ ID NO: 3167785 - DNA, 22 bp, Homo sapiens
agagccaggatgcccagatgaa

SEQ ID NO: 3167786 - DNA, 22 bp, Homo sapiens
agagccatataagtttgaagga

SEQ ID NO: 3167787 - DNA, 14 bp, Homo sapiens
agagccatgggcct

SEQ ID NO: 3167788 - DNA, 18 bp, Homo sapiens
agagccatgggcctgggc

SEQ ID NO: 3167789 - DNA, 22 bp, Homo sapiens
agagccatgggcctgggcctgc

SEQ ID NO: 3167790 - DNA, 23 bp, Homo sapiens
agagcccaatgcatagagccctg

SEQ ID NO: 3167791 - DNA, 13 bp, Homo sapiens
agagcccaccttg

SEQ ID NO: 3167792 - DNA, 14 bp, Homo sapiens
agagcccagaggta

SEQ ID NO: 3167793 - DNA, 14 bp, Homo sapiens
agagcccccagccc

SEQ ID NO: 3167794 - DNA, 17 bp, Homo sapiens
agagcccccagccctgg

SEQ ID NO: 3167795 - DNA, 15 bp, Homo sapiens
agagcccctcctcca

SEQ ID NO: 3167796 - DNA, 14 bp, Homo sapiens
agagcccctgcccc

SEQ ID NO: 3167797 - DNA, 16 bp, Homo sapiens
agagcccctggggcct

SEQ ID NO: 3167798 - DNA, 16 bp, Homo sapiens
agagccctgctgtggg

SEQ ID NO: 3167799 - DNA, 20 bp, Homo sapiens
agagccctgctgtgggagag

SEQ ID NO: 3167800 - DNA, 13 bp, Homo sapiens
agagccctggaca

SEQ ID NO: 3167801 - DNA, 20 bp, Homo sapiens
agagccctggacacccctgc

SEQ ID NO: 3167802 - DNA, 23 bp, Homo sapiens
agagccctggacacccctgctct

SEQ ID NO: 3167803 - DNA, 13 bp, Homo sapiens
agagccctggcca

SEQ ID NO: 3167804 - DNA, 15 bp, Homo sapiens
agagccctggccagc

SEQ ID NO: 3167805 - DNA, 17 bp, Homo sapiens
agagccctggccagccc

SEQ ID NO: 3167806 - DNA, 16 bp, Homo sapiens
agagccctggctgggt

SEQ ID NO: 3167807 - DNA, 14 bp, Homo sapiens
agagcccttgcctc

SEQ ID NO: 3167808 - DNA, 13 bp, Homo sapiens
agagcctcttagt

SEQ ID NO: 3167809 - DNA, 13 bp, Homo sapiens
agagcctgatctc

SEQ ID NO: 3167810 - DNA, 16 bp, Homo sapiens
agagcctgatctcttc

SEQ ID NO: 3167811 - DNA, 18 bp, Homo sapiens
agagcctgatctcttcct

SEQ ID NO: 3167812 - DNA, 19 bp, Homo sapiens
agagcctgatctcttcctg

SEQ ID NO: 3167813 - DNA, 19 bp, Homo sapiens
agagcctgcctaaccaggc

SEQ ID NO: 3167814 - DNA, 20 bp, Homo sapiens
agagcctgcctaaccaggcc

SEQ ID NO: 3167815 - DNA, 22 bp, Homo sapiens
agagcctgcctaaccaggccca

SEQ ID NO: 3167816 - DNA, 17 bp, Homo sapiens
agagcctgctgcatggg

SEQ ID NO: 3167817 - DNA, 24 bp, Homo sapiens
agagcctgctggcacccaccgtgg

SEQ ID NO: 3167818 - DNA, 14 bp, Homo sapiens
agagccttcaagtg

SEQ ID NO: 3167819 - DNA, 20 bp, Homo sapiens
agagccttcaagtgccaaac

SEQ ID NO: 3167820 - DNA, 15 bp, Homo sapiens
agagccttttgtgca

SEQ ID NO: 3167821 - DNA, 14 bp, Homo sapiens
agagcgcggctggc

SEQ ID NO: 3167822 - DNA, 16 bp, Homo sapiens
agagcgcggctggctc

SEQ ID NO: 3167823 - DNA, 13 bp, Homo sapiens
agagcggctgccc

SEQ ID NO: 3167824 - DNA, 23 bp, Homo sapiens
agagcggtctcaggctggtggga

SEQ ID NO: 3167825 - DNA, 17 bp, Homo sapiens
agagcgtccttccccct

SEQ ID NO: 3167826 - DNA, 18 bp, Homo sapiens
agagctaagggtgggtgc

SEQ ID NO: 3167827 - DNA, 20 bp, Homo sapiens
agagctaataaatctcttct

SEQ ID NO: 3167828 - DNA, 21 bp, Homo sapiens
agagctaataaatctcttctt

SEQ ID NO: 3167829 - DNA, 14 bp, Homo sapiens
agagctctccagct

SEQ ID NO: 3167830 - DNA, 17 bp, Homo sapiens
agagctcttcaagctgt

SEQ ID NO: 3167831 - DNA, 16 bp, Homo sapiens
agagctgacgggaggc

SEQ ID NO: 3167832 - DNA, 20 bp, Homo sapiens
agagctgacgggaggcccca

SEQ ID NO: 3167833 - DNA, 12 bp, Homo sapiens
agagctgagcca

SEQ ID NO: 3167834 - DNA, 16 bp, Homo sapiens
agagctgagccagttg

SEQ ID NO: 3167835 - DNA, 18 bp, Homo sapiens
agagctgagccagttgtc

SEQ ID NO: 3167836 - DNA, 23 bp, Homo sapiens
agagctgattgcagaaaggagag

SEQ ID NO: 3167837 - DNA, 18 bp, Homo sapiens
agagctgcacttggcctc

SEQ ID NO: 3167838 - DNA, 12 bp, Homo sapiens
agagctgcctgg

SEQ ID NO: 3167839 - DNA, 17 bp, Homo sapiens
agagctgcctggatgag

SEQ ID NO: 3167840 - DNA, 19 bp, Homo sapiens
agagctgcctggatgagaa

SEQ ID NO: 3167841 - DNA, 15 bp, Homo sapiens
agagctggaaggcag

SEQ ID NO: 3167842 - DNA, 22 bp, Homo sapiens
agagctgggaggcatggccctg

SEQ ID NO: 3167843 - DNA, 16 bp, Homo sapiens
agagctgggtggcctg

SEQ ID NO: 3167844 - DNA, 19 bp, Homo sapiens
agagctgggtgtcaagagg

SEQ ID NO: 3167845 - DNA, 15 bp, Homo sapiens
agagctggtgcccgg

SEQ ID NO: 3167846 - DNA, 15 bp, Homo sapiens
agagctggtgtctga

SEQ ID NO: 3167847 - DNA, 20 bp, Homo sapiens
agagctgtctatgcagcctg

SEQ ID NO: 3167848 - DNA, 21 bp, Homo sapiens
agagctgtctatgcagcctgc

SEQ ID NO: 3167849 - DNA, 22 bp, Homo sapiens
agagctgtctatgcagcctgct

SEQ ID NO: 3167850 - DNA, 17 bp, Homo sapiens
agagctgtctgaactca

SEQ ID NO: 3167851 - DNA, 17 bp, Homo sapiens
agagctgtgccagcagg

SEQ ID NO: 3167852 - DNA, 19 bp, Homo sapiens
agagctgtttatggcctca

SEQ ID NO: 3167853 - DNA, 17 bp, Homo sapiens
agagcttgtaataaata

SEQ ID NO: 3167854 - DNA, 19 bp, Homo sapiens
agagcttgtaataaatact

SEQ ID NO: 3167855 - DNA, 22 bp, Homo sapiens
agaggaaaagctgtaagaaaat

SEQ ID NO: 3167856 - DNA, 15 bp, Homo sapiens
agaggaacagtgtgg

SEQ ID NO: 3167857 - DNA, 20 bp, Homo sapiens
agaggaacgggcagcctggg

SEQ ID NO: 3167858 - DNA, 21 bp, Homo sapiens
agaggaactccttggcctagc

SEQ ID NO: 3167859 - DNA, 19 bp, Homo sapiens
agaggaactgtccagagag

SEQ ID NO: 3167860 - DNA, 20 bp, Homo sapiens
agaggaactgtccagagagc

SEQ ID NO: 3167861 - DNA, 21 bp, Homo sapiens
agaggaactgtccagagagca

SEQ ID NO: 3167862 - DNA, 14 bp, Homo sapiens
agaggaaggagatt

SEQ ID NO: 3167863 - DNA, 21 bp, Homo sapiens
agaggaataaggcccagagcg

SEQ ID NO: 3167864 - DNA, 15 bp, Homo sapiens
agaggaatcctggca

SEQ ID NO: 3167865 - DNA, 17 bp, Homo sapiens
agaggaatcctggcagc

SEQ ID NO: 3167866 - DNA, 19 bp, Homo sapiens
agaggaatttataacaaat

SEQ ID NO: 3167867 - DNA, 19 bp, Homo sapiens
agatgcagagagccatttt

SEQ ID NO: 3167868 - DNA, 20 bp, Homo sapiens
agatgcagagagccattttg

SEQ ID NO: 3167869 - DNA, 19 bp, Homo sapiens
agatgcatcgggaaagaag

SEQ ID NO: 3167870 - DNA, 23 bp, Homo sapiens
agatgcatcgggaaagaagaaac

SEQ ID NO: 3167871 - DNA, 16 bp, Homo sapiens
agatgccacacctgct

SEQ ID NO: 3167872 - DNA, 17 bp, Homo sapiens
agatgccaccctagcca

SEQ ID NO: 3167873 - DNA, 14 bp, Homo sapiens
agatgccagccctt

SEQ ID NO: 3167874 - DNA, 19 bp, Homo sapiens
agatgccagcccttcagga

SEQ ID NO: 3167875 - DNA, 16 bp, Homo sapiens
agatgccatctgtgtc

SEQ ID NO: 3167876 - DNA, 12 bp, Homo sapiens
agatgccccaga

SEQ ID NO: 3167877 - DNA, 17 bp, Homo sapiens
agatgccccagagctgt

SEQ ID NO: 3167878 - DNA, 16 bp, Homo sapiens
agatgccccctccagg

SEQ ID NO: 3167879 - DNA, 19 bp, Homo sapiens
agatgccccctccaggaga

SEQ ID NO: 3167880 - DNA, 21 bp, Homo sapiens
agatgccccctccaggagaga

SEQ ID NO: 3167881 - DNA, 23 bp, Homo sapiens
agatgccccctccaggagagagc

SEQ ID NO: 3167882 - DNA, 21 bp, Homo sapiens
agatgcgaaccacccaaaaca

SEQ ID NO: 3167883 - DNA, 22 bp, Homo sapiens
agatgcgaaccacccaaaacac

SEQ ID NO: 3167884 - DNA, 20 bp, Homo sapiens
agatgctaaaatccctggat

SEQ ID NO: 3167885 - DNA, 11 bp, Homo sapiens
agatgctactg

SEQ ID NO: 3167886 - DNA, 16 bp, Homo sapiens
agatgctagaaaaatg

SEQ ID NO: 3167887 - DNA, 22 bp, Homo sapiens
agatgctagaactccctttcaa

SEQ ID NO: 3167888 - DNA, 15 bp, Homo sapiens
agatgctccaagatt

SEQ ID NO: 3167889 - DNA, 20 bp, Homo sapiens
agatgctccaagattctaga

SEQ ID NO: 3167890 - DNA, 17 bp, Homo sapiens
agatgctgaatatctgt

SEQ ID NO: 3167891 - DNA, 18 bp, Homo sapiens
agatgctgaatatctgtt

SEQ ID NO: 3167892 - DNA, 20 bp, Homo sapiens
agatgctgaatatctgttca

SEQ ID NO: 3167893 - DNA, 20 bp, Homo sapiens
agatgctgactgtactcctc

SEQ ID NO: 3167894 - DNA, 23 bp, Homo sapiens
agatgctgactgtactcctccca

SEQ ID NO: 3167895 - DNA, 11 bp, Homo sapiens
agatgctgatg

SEQ ID NO: 3167896 - DNA, 20 bp, Homo sapiens
agatgctgatggagccttcc

SEQ ID NO: 3167897 - DNA, 11 bp, Homo sapiens
agatgctggag

SEQ ID NO: 3167898 - DNA, 19 bp, Homo sapiens
agatgctggagaagagagg

SEQ ID NO: 3167899 - DNA, 22 bp, Homo sapiens
agatgctgtaacttaaaatagg

SEQ ID NO: 3167900 - DNA, 16 bp, Homo sapiens
agatgctgtgagtctt

SEQ ID NO: 3167901 - DNA, 18 bp, Homo sapiens
agatggaaaattcatttt

SEQ ID NO: 3167902 - DNA, 23 bp, Homo sapiens
agatggaaagaggtgaaaatgaa

SEQ ID NO: 3167903 - DNA, 15 bp, Homo sapiens
agatggaatgctgtg

SEQ ID NO: 3167904 - DNA, 15 bp, Homo sapiens
agatggactctgaaa

SEQ ID NO: 3167905 - DNA, 13 bp, Homo sapiens
agatggagcccat

SEQ ID NO: 3167906 - DNA, 21 bp, Homo sapiens
agatggaggtttccttttgga

SEQ ID NO: 3167907 - DNA, 17 bp, Homo sapiens
agatggagttcttgtgc

SEQ ID NO: 3167908 - DNA, 19 bp, Homo sapiens
agatggagttcttgtgcca

SEQ ID NO: 3167909 - DNA, 11 bp, Homo sapiens
agatggattct

SEQ ID NO: 3167910 - DNA, 16 bp, Homo sapiens
agatggattctcagat

SEQ ID NO: 3167911 - DNA, 18 bp, Homo sapiens
agatggattctcagatat

SEQ ID NO: 3167912 - DNA, 15 bp, Homo sapiens
agatggatttgcctg

SEQ ID NO: 3167913 - DNA, 13 bp, Homo sapiens
agatggcccctcc

SEQ ID NO: 3167914 - DNA, 21 bp, Homo sapiens
agatggcccctccactgggga

SEQ ID NO: 3167915 - DNA, 21 bp, Homo sapiens
agatggcccggatgctgcttc

SEQ ID NO: 3167916 - DNA, 21 bp, Homo sapiens
agatggctggaaggggtccag

SEQ ID NO: 3167917 - DNA, 18 bp, Homo sapiens
agatggctgtgcctctgc

SEQ ID NO: 3167918 - DNA, 19 bp, Homo sapiens
agatggctgtgcctctgcc

SEQ ID NO: 3167919 - DNA, 14 bp, Homo sapiens
agatggcttatttt

SEQ ID NO: 3167920 - DNA, 20 bp, Homo sapiens
agatgggaggaaagagagca

SEQ ID NO: 3167921 - DNA, 20 bp, Homo sapiens
agatgggtctgatattaatc

SEQ ID NO: 3167922 - DNA, 19 bp, Homo sapiens
agatgggtgggggctcctg

SEQ ID NO: 3167923 - DNA, 17 bp, Homo sapiens
agatggttaaaaaggcc

SEQ ID NO: 3167924 - DNA, 18 bp, Homo sapiens
agatggttaaaaaggcca

SEQ ID NO: 3167925 - DNA, 19 bp, Homo sapiens
agatggttaaaaaggccaa

SEQ ID NO: 3167926 - DNA, 22 bp, Homo sapiens
agatggttaaaaaggccaaaga

SEQ ID NO: 3167927 - DNA, 19 bp, Homo sapiens
agatggttacactgttaga

SEQ ID NO: 3167928 - DNA, 16 bp, Homo sapiens
agatggtttcaattca

SEQ ID NO: 3167929 - DNA, 21 bp, Homo sapiens
agatgtacatagagatctatt

SEQ ID NO: 3167930 - DNA, 14 bp, Homo sapiens
agatgtagtatttt

SEQ ID NO: 3167931 - DNA, 12 bp, Homo sapiens
agatgtatcctt

SEQ ID NO: 3167932 - DNA, 18 bp, Homo sapiens
agatgtcagccgagccgg

SEQ ID NO: 3167933 - DNA, 22 bp, Homo sapiens
agatgtcatcagagctcctctg

SEQ ID NO: 3167934 - DNA, 23 bp, Homo sapiens
agatgtcatttagttcagcatcc

SEQ ID NO: 3167935 - DNA, 20 bp, Homo sapiens
agatgtccctttcttggcca

SEQ ID NO: 3167936 - DNA, 18 bp, Homo sapiens
agatgtctaatagttatt

SEQ ID NO: 3167937 - DNA, 14 bp, Homo sapiens
agatgtctctgggg

SEQ ID NO: 3167938 - DNA, 19 bp, Homo sapiens
agatgtcttctgcctgtta

SEQ ID NO: 3167939 - DNA, 13 bp, Homo sapiens
agatgtctttagg

SEQ ID NO: 3167940 - DNA, 10 bp, Homo sapiens
agatgtgaaa

SEQ ID NO: 3167941 - DNA, 19 bp, Homo sapiens
agatgtgaaaatatacttg

SEQ ID NO: 3167942 - DNA, 17 bp, Homo sapiens
agatgtgataaggatca

SEQ ID NO: 3167943 - DNA, 17 bp, Homo sapiens
agatgtgatattctaag

SEQ ID NO: 3167944 - DNA, 13 bp, Homo sapiens
agatgtgcttctg

SEQ ID NO: 3167945 - DNA, 16 bp, Homo sapiens
agatgtgggttctttt

SEQ ID NO: 3167946 - DNA, 20 bp, Homo sapiens
agatgtgttcctcctgctgt

SEQ ID NO: 3167947 - DNA, 15 bp, Homo sapiens
agatgtgttcttatt

SEQ ID NO: 3167948 - DNA, 19 bp, Homo sapiens
agatgtgttgctatcctga

SEQ ID NO: 3167949 - DNA, 18 bp, Homo sapiens
agatgttaaaataaatgg

SEQ ID NO: 3167950 - DNA, 14 bp, Homo sapiens
agatgttaagcatt

SEQ ID NO: 3167951 - DNA, 15 bp, Homo sapiens
agatgttgtgtggca

SEQ ID NO: 3167952 - DNA, 12 bp, Homo sapiens
agatgtttaaca

SEQ ID NO: 3167953 - DNA, 19 bp, Homo sapiens
agatgtttaacaaatctaa

SEQ ID NO: 3167954 - DNA, 20 bp, Homo sapiens
agatgtttattcttctagag

SEQ ID NO: 3167955 - DNA, 17 bp, Homo sapiens
agatgtttgtcagatat

SEQ ID NO: 3167956 - DNA, 19 bp, Homo sapiens
agatgttttggtagattaa

SEQ ID NO: 3167957 - DNA, 21 bp, Homo sapiens
agatgttttggtagattaaat

SEQ ID NO: 3167958 - DNA, 14 bp, Homo sapiens
agattaaacagatg

SEQ ID NO: 3167959 - DNA, 17 bp, Homo sapiens
agattaaacagatgatg

SEQ ID NO: 3167960 - DNA, 14 bp, Homo sapiens
agattaaaggaagg

SEQ ID NO: 3167961 - DNA, 15 bp, Homo sapiens
agattaaaggaagga

SEQ ID NO: 3167962 - DNA, 17 bp, Homo sapiens
agattaaaggaaggaaa

SEQ ID NO: 3167963 - DNA, 12 bp, Homo sapiens
agattaaatata

SEQ ID NO: 3167964 - DNA, 13 bp, Homo sapiens
agattaaatatag

SEQ ID NO: 3167965 - DNA, 15 bp, Homo sapiens
agattaaattacagc

SEQ ID NO: 3167966 - DNA, 15 bp, Homo sapiens
agattaacactaatt

SEQ ID NO: 3167967 - DNA, 20 bp, Homo sapiens
agattacaaatcagaagtca

SEQ ID NO: 3167968 - DNA, 20 bp, Homo sapiens
agattacaggaatgaagaac

SEQ ID NO: 3167969 - DNA, 15 bp, Homo sapiens
agattagaagctgaa

SEQ ID NO: 3167970 - DNA, 11 bp, Homo sapiens
agattaggatt

SEQ ID NO: 3167971 - DNA, 13 bp, Homo sapiens
agattaggattaa

SEQ ID NO: 3167972 - DNA, 14 bp, Homo sapiens
agattatagattct

SEQ ID NO: 3167973 - DNA, 20 bp, Homo sapiens
agattatagattctaaagat

SEQ ID NO: 3167974 - DNA, 21 bp, Homo sapiens
agattatagattctaaagatt

SEQ ID NO: 3167975 - DNA, 23 bp, Homo sapiens
agattatagattctaaagattct

SEQ ID NO: 3167976 - DNA, 15 bp, Homo sapiens
agattatatcaaagt

SEQ ID NO: 3167977 - DNA, 14 bp, Homo sapiens
agattatgatgcat

SEQ ID NO: 3167978 - DNA, 17 bp, Homo sapiens
agattatgatgcataca

SEQ ID NO: 3167979 - DNA, 20 bp, Homo sapiens
agattatggagcttttttcc

SEQ ID NO: 3167980 - DNA, 20 bp, Homo sapiens
agattatggcctttttaagt

SEQ ID NO: 3167981 - DNA, 14 bp, Homo sapiens
agattcaaaggttc

SEQ ID NO: 3167982 - DNA, 18 bp, Homo sapiens
agattcaaaggttctagg

SEQ ID NO: 3167983 - DNA, 16 bp, Homo sapiens
agattcaggccagccc

SEQ ID NO: 3167984 - DNA, 19 bp, Homo sapiens
agattcaggtatgttgcct

SEQ ID NO: 3167985 - DNA, 13 bp, Homo sapiens
agattcatattta

SEQ ID NO: 3167986 - DNA, 16 bp, Homo sapiens
agattcatatttactt

SEQ ID NO: 3167987 - DNA, 18 bp, Homo sapiens
agattccagagagtggct

SEQ ID NO: 3167988 - DNA, 19 bp, Homo sapiens
agattccattggtccaaga

SEQ ID NO: 3167989 - DNA, 20 bp, Homo sapiens
agattccattggtccaagat

SEQ ID NO: 3167990 - DNA, 22 bp, Homo sapiens
agattccattggtccaagattc

SEQ ID NO: 3167991 - DNA, 20 bp, Homo sapiens
agattccggatcctaagcat

SEQ ID NO: 3167992 - DNA, 23 bp, Homo sapiens
agattccggatcctaagcatcta

SEQ ID NO: 3167993 - DNA, 13 bp, Homo sapiens
agcatactttgta

SEQ ID NO: 3167994 - DNA, 22 bp, Homo sapiens
agcatactttgtaaataggatt

SEQ ID NO: 3167995 - DNA, 16 bp, Homo sapiens
agcatagaaaccacta

SEQ ID NO: 3167996 - DNA, 21 bp, Homo sapiens
agcatagcagaggggccaggc

SEQ ID NO: 3167997 - DNA, 17 bp, Homo sapiens
agcatataaaaacatca

SEQ ID NO: 3167998 - DNA, 21 bp, Homo sapiens
agcatatttgccaataaagct

SEQ ID NO: 3167999 - DNA, 20 bp, Homo sapiens
agcatcacctcaggccaggt

SEQ ID NO: 3168000 - DNA, 23 bp, Homo sapiens
agcatcagagagtgtacatcatg

SEQ ID NO: 3168001 - DNA, 21 bp, Homo sapiens
agcatcagccagtgaatctgt

SEQ ID NO: 3168002 - DNA, 22 bp, Homo sapiens
agcatcagccagtgaatctgtt

SEQ ID NO: 3168003 - DNA, 16 bp, Homo sapiens
agcatccaagtggcat

SEQ ID NO: 3168004 - DNA, 20 bp, Homo sapiens
agcatccaccttggctctgc

SEQ ID NO: 3168005 - DNA, 14 bp, Homo sapiens
agcatccagcctgt

SEQ ID NO: 3168006 - DNA, 14 bp, Homo sapiens
agcatcccggagga

SEQ ID NO: 3168007 - DNA, 19 bp, Homo sapiens
agcatccctggagcaggag

SEQ ID NO: 3168008 - DNA, 22 bp, Homo sapiens
agcatcctccacatcctgtgtc

SEQ ID NO: 3168009 - DNA, 13 bp, Homo sapiens
agcatcctgagcc

SEQ ID NO: 3168010 - DNA, 18 bp, Homo sapiens
agcatcctggcacccggc

SEQ ID NO: 3168011 - DNA, 23 bp, Homo sapiens
agcatcggacaagacccccagca

SEQ ID NO: 3168012 - DNA, 19 bp, Homo sapiens
agcatcgggagcacccaga

SEQ ID NO: 3168013 - DNA, 20 bp, Homo sapiens
agcatcgggagcacccagag

SEQ ID NO: 3168014 - DNA, 20 bp, Homo sapiens
agcatcgtgacccttcaggg

SEQ ID NO: 3168015 - DNA, 22 bp, Homo sapiens
agcatcgtgacccttcagggcc

SEQ ID NO: 3168016 - DNA, 23 bp, Homo sapiens
agcatcgtgacccttcagggcca

SEQ ID NO: 3168017 - DNA, 20 bp, Homo sapiens
agcatctaagttataagact

SEQ ID NO: 3168018 - DNA, 17 bp, Homo sapiens
agcatctcagcgccagc

SEQ ID NO: 3168019 - DNA, 14 bp, Homo sapiens
agcatctcccagca

SEQ ID NO: 3168020 - DNA, 13 bp, Homo sapiens
agcatctggctct

SEQ ID NO: 3168021 - DNA, 16 bp, Homo sapiens
agcatctggctctaat

SEQ ID NO: 3168022 - DNA, 23 bp, Homo sapiens
agcatctggctgtttagcagaac

SEQ ID NO: 3168023 - DNA, 20 bp, Homo sapiens
agcatcttcacttctaaatg

SEQ ID NO: 3168024 - DNA, 12 bp, Homo sapiens
agcatcttctgg

SEQ ID NO: 3168025 - DNA, 21 bp, Homo sapiens
agcatcttgggggggtggccg

SEQ ID NO: 3168026 - DNA, 13 bp, Homo sapiens
agcatgaaaaagc

SEQ ID NO: 3168027 - DNA, 14 bp, Homo sapiens
agcatgaaaaagca

SEQ ID NO: 3168028 - DNA, 17 bp, Homo sapiens
agcatgacaacttttaa

SEQ ID NO: 3168029 - DNA, 19 bp, Homo sapiens
agcatgacaacttttaaag

SEQ ID NO: 3168030 - DNA, 18 bp, Homo sapiens
agcatgacctgtgaccag

SEQ ID NO: 3168031 - DNA, 14 bp, Homo sapiens
agcatgactatgta

SEQ ID NO: 3168032 - DNA, 19 bp, Homo sapiens
agcatgatgggaaaatatt

SEQ ID NO: 3168033 - DNA, 20 bp, Homo sapiens
agcatgatgggaaaatattt

SEQ ID NO: 3168034 - DNA, 20 bp, Homo sapiens
agcatgattctttaatagaa

SEQ ID NO: 3168035 - DNA, 18 bp, Homo sapiens
agcatgcacaaagtgtat

SEQ ID NO: 3168036 - DNA, 21 bp, Homo sapiens
agcatgcacaaagtgtattca

SEQ ID NO: 3168037 - DNA, 14 bp, Homo sapiens
agcatgcattttct

SEQ ID NO: 3168038 - DNA, 21 bp, Homo sapiens
agcatgcattttcttgtatga

SEQ ID NO: 3168039 - DNA, 12 bp, Homo sapiens
agcatgcccctt

SEQ ID NO: 3168040 - DNA, 19 bp, Homo sapiens
agcatgcttcccagaggga

SEQ ID NO: 3168041 - DNA, 20 bp, Homo sapiens
agcatgcttcccagagggag

SEQ ID NO: 3168042 - DNA, 22 bp, Homo sapiens
agcatgcttcccagagggagca

SEQ ID NO: 3168043 - DNA, 14 bp, Homo sapiens
agcatgctttgctg

SEQ ID NO: 3168044 - DNA, 17 bp, Homo sapiens
agcatgctttgctgcta

SEQ ID NO: 3168045 - DNA, 15 bp, Homo sapiens
agcatggaaaaatgg

SEQ ID NO: 3168046 - DNA, 19 bp, Homo sapiens
agcatggaaaaatggttga

SEQ ID NO: 3168047 - DNA, 18 bp, Homo sapiens
agcatggacatttagaag

SEQ ID NO: 3168048 - DNA, 20 bp, Homo sapiens
agcatggacatttagaagaa

SEQ ID NO: 3168049 - DNA, 23 bp, Homo sapiens
agcatggactaaccccaacgcac

SEQ ID NO: 3168050 - DNA, 22 bp, Homo sapiens
agcatggagagcctcttagtga

SEQ ID NO: 3168051 - DNA, 14 bp, Homo sapiens
agcatggatgcatt

SEQ ID NO: 3168052 - DNA, 16 bp, Homo sapiens
agcatggatgcatttc

SEQ ID NO: 3168053 - DNA, 19 bp, Homo sapiens
agcatggatgcatttcaaa

SEQ ID NO: 3168054 - DNA, 20 bp, Homo sapiens
agcatgggtccaagagacat

SEQ ID NO: 3168055 - DNA, 21 bp, Homo sapiens
agcatgggtccaagagacatg

SEQ ID NO: 3168056 - DNA, 17 bp, Homo sapiens
agcatgggtgtgccctt

SEQ ID NO: 3168057 - DNA, 17 bp, Homo sapiens
agcatggtccctgcctt

SEQ ID NO: 3168058 - DNA, 23 bp, Homo sapiens
agcatggtgttttcattccccct

SEQ ID NO: 3168059 - DNA, 13 bp, Homo sapiens
agcatgtaatggt

SEQ ID NO: 3168060 - DNA, 20 bp, Homo sapiens
agcatgtacggattttcagt

SEQ ID NO: 3168061 - DNA, 21 bp, Homo sapiens
agcatgtactgagccttgtaa

SEQ ID NO: 3168062 - DNA, 20 bp, Homo sapiens
agcatgtgacacccacaatc

SEQ ID NO: 3168063 - DNA, 22 bp, Homo sapiens
agcatgtgccaagattctactc

SEQ ID NO: 3168064 - DNA, 18 bp, Homo sapiens
agcatgtgccttaatgct

SEQ ID NO: 3168065 - DNA, 17 bp, Homo sapiens
agcatgtggcatgttca

SEQ ID NO: 3168066 - DNA, 17 bp, Homo sapiens
agcatgtgtcagagtgt

SEQ ID NO: 3168067 - DNA, 16 bp, Homo sapiens
agcatgttgagccagg

SEQ ID NO: 3168068 - DNA, 14 bp, Homo sapiens
agcatgtttcatgt

SEQ ID NO: 3168069 - DNA, 17 bp, Homo sapiens
agcatgtttcatgtttt

SEQ ID NO: 3168070 - DNA, 14 bp, Homo sapiens
agcatgttttgtat

SEQ ID NO: 3168071 - DNA, 17 bp, Homo sapiens
agcatgttttgtataca

SEQ ID NO: 3168072 - DNA, 18 bp, Homo sapiens
agcattaacttctctgga

SEQ ID NO: 3168073 - DNA, 20 bp, Homo sapiens
agcattaagctgttcctgtt

SEQ ID NO: 3168074 - DNA, 21 bp, Homo sapiens
agcattaggcttttaagaaac

SEQ ID NO: 3168075 - DNA, 15 bp, Homo sapiens
agcattattcttcag

SEQ ID NO: 3168076 - DNA, 16 bp, Homo sapiens
agcattcagagagcag

SEQ ID NO: 3168077 - DNA, 15 bp, Homo sapiens
agcattccagacttc

SEQ ID NO: 3168078 - DNA, 18 bp, Homo sapiens
agcattccagacttcaaa

SEQ ID NO: 3168079 - DNA, 13 bp, Homo sapiens
agcattccagtaa

SEQ ID NO: 3168080 - DNA, 17 bp, Homo sapiens
agcattccagtaacttt

SEQ ID NO: 3168081 - DNA, 16 bp, Homo sapiens
agcattccttctttga

SEQ ID NO: 3168082 - DNA, 22 bp, Homo sapiens
agcattccttctttgataatgt

SEQ ID NO: 3168083 - DNA, 18 bp, Homo sapiens
agcattctcactcctacc

SEQ ID NO: 3168084 - DNA, 20 bp, Homo sapiens
agcattctcactcctacctg

SEQ ID NO: 3168085 - DNA, 18 bp, Homo sapiens
agcattcttagcctgtgg

SEQ ID NO: 3168086 - DNA, 19 bp, Homo sapiens
agcattcttagcctgtggc

SEQ ID NO: 3168087 - DNA, 20 bp, Homo sapiens
agcattcttagcctgtggca

SEQ ID NO: 3168088 - DNA, 23 bp, Homo sapiens
agcattcttagcctgtggcagta

SEQ ID NO: 3168089 - DNA, 21 bp, Homo sapiens
agcattcttgtcacaataaat

SEQ ID NO: 3168090 - DNA, 22 bp, Homo sapiens
agcattcttgtcacaataaatg

SEQ ID NO: 3168091 - DNA, 24 bp, Homo sapiens
agcattctttggagttaaaatgca

SEQ ID NO: 3168092 - DNA, 15 bp, Homo sapiens
agcattgataatctt

SEQ ID NO: 3168093 - DNA, 12 bp, Homo sapiens
agcattgcactt

SEQ ID NO: 3168094 - DNA, 13 bp, Homo sapiens
agcattgccattc

SEQ ID NO: 3168095 - DNA, 16 bp, Homo sapiens
agcattgctggttcta

SEQ ID NO: 3168096 - DNA, 23 bp, Homo sapiens
agcattgctggttctatttaatg

SEQ ID NO: 3168097 - DNA, 11 bp, Homo sapiens
agcattgcttt

SEQ ID NO: 3168098 - DNA, 13 bp, Homo sapiens
agcattgctttct

SEQ ID NO: 3168099 - DNA, 14 bp, Homo sapiens
agcattgctttctg

SEQ ID NO: 3168100 - DNA, 16 bp, Homo sapiens
agcattgtctttgctg

SEQ ID NO: 3168101 - DNA, 17 bp, Homo sapiens
agcattgtctttgctgt

SEQ ID NO: 3168102 - DNA, 21 bp, Homo sapiens
agcattgtctttgctgtactc

SEQ ID NO: 3168103 - DNA, 23 bp, Homo sapiens
agcattgtttgcttattgttcca

SEQ ID NO: 3168104 - DNA, 23 bp, Homo sapiens
agcattgttttcttttacagact

SEQ ID NO: 3168105 - DNA, 14 bp, Homo sapiens
agcatttaaggaaa

SEQ ID NO: 3168106 - DNA, 16 bp, Homo sapiens
agcatttaaggaaact

SEQ ID NO: 3168107 - DNA, 23 bp, Homo sapiens
agcatttagcttgttccactgca

SEQ ID NO: 3168108 - DNA, 16 bp, Homo sapiens
agcatttatcattctt

SEQ ID NO: 3168109 - DNA, 19 bp, Homo sapiens
agcatttccaacaccacag

SEQ ID NO: 3168110 - DNA, 17 bp, Homo sapiens
agcatttgcacctctgt

SEQ ID NO: 3168111 - DNA, 18 bp, Homo sapiens
agccaaaaccatcttctg

SEQ ID NO: 3168112 - DNA, 17 bp, Homo sapiens
agccaaaatgtaggctt

SEQ ID NO: 3168113 - DNA, 14 bp, Homo sapiens
agccaaacaagcct

SEQ ID NO: 3168114 - DNA, 19 bp, Homo sapiens
agccaaacaagccttagct

SEQ ID NO: 3168115 - DNA, 12 bp, Homo sapiens
agccaaaccagg

SEQ ID NO: 3168116 - DNA, 12 bp, Homo sapiens
agccaaagaaaa

SEQ ID NO: 3168117 - DNA, 18 bp, Homo sapiens
agccaaagaaacaagctg

SEQ ID NO: 3168118 - DNA, 12 bp, Homo sapiens
agcccttgcctc

SEQ ID NO: 3168119 - DNA, 23 bp, Homo sapiens
agcccttgcctccccatttccca

SEQ ID NO: 3168120 - DNA, 14 bp, Homo sapiens
agcccttgggcagt

SEQ ID NO: 3168121 - DNA, 12 bp, Homo sapiens
agcccttgggtt

SEQ ID NO: 3168122 - DNA, 14 bp, Homo sapiens
agcccttgtccctt

SEQ ID NO: 3168123 - DNA, 15 bp, Homo sapiens
agccgaccttccctc

SEQ ID NO: 3168124 - DNA, 13 bp, Homo sapiens
agccgactctggc

SEQ ID NO: 3168125 - DNA, 16 bp, Homo sapiens
agccgactgcgctgct

SEQ ID NO: 3168126 - DNA, 20 bp, Homo sapiens
agccgagatcacgccactgc

SEQ ID NO: 3168127 - DNA, 21 bp, Homo sapiens
agccgagatcacgccactgca

SEQ ID NO: 3168128 - DNA, 19 bp, Homo sapiens
agccgagattgcaccactg

SEQ ID NO: 3168129 - DNA, 21 bp, Homo sapiens
agccgagattgcaccactgca

SEQ ID NO: 3168130 - DNA, 19 bp, Homo sapiens
agccgagattgcgccactg

SEQ ID NO: 3168131 - DNA, 16 bp, Homo sapiens
agccgagccgggcctg

SEQ ID NO: 3168132 - DNA, 22 bp, Homo sapiens
agccgcaaggatccttccctgt

SEQ ID NO: 3168133 - DNA, 21 bp, Homo sapiens
agccgcaccctgcacctgctg

SEQ ID NO: 3168134 - DNA, 22 bp, Homo sapiens
agccgcaccctgcacctgctgc

SEQ ID NO: 3168135 - DNA, 23 bp, Homo sapiens
agccgcaccctgcacctgctgcg

SEQ ID NO: 3168136 - DNA, 15 bp, Homo sapiens
agccgcattggtgac

SEQ ID NO: 3168137 - DNA, 14 bp, Homo sapiens
agccgccagctggg

SEQ ID NO: 3168138 - DNA, 13 bp, Homo sapiens
agccgccctgggc

SEQ ID NO: 3168139 - DNA, 24 bp, Homo sapiens
agccgccctgggctgtctgtcacc

SEQ ID NO: 3168140 - DNA, 22 bp, Homo sapiens
agccgccggaagtggctccgtg

SEQ ID NO: 3168141 - DNA, 22 bp, Homo sapiens
agccgctgcagggctcccatgg

SEQ ID NO: 3168142 - DNA, 19 bp, Homo sapiens
agccgctgtgagcccctgg

SEQ ID NO: 3168143 - DNA, 22 bp, Homo sapiens
agccgctgtgagcccctggtcc

SEQ ID NO: 3168144 - DNA, 19 bp, Homo sapiens
agccggcactgagaagaac

SEQ ID NO: 3168145 - DNA, 19 bp, Homo sapiens
agccggccaccagatgctg

SEQ ID NO: 3168146 - DNA, 18 bp, Homo sapiens
agccggcctctctggcct

SEQ ID NO: 3168147 - DNA, 19 bp, Homo sapiens
agccggcctctctggcctc

SEQ ID NO: 3168148 - DNA, 22 bp, Homo sapiens
agccggcctctctggcctccca

SEQ ID NO: 3168149 - DNA, 19 bp, Homo sapiens
agccggcgtggcaaatata

SEQ ID NO: 3168150 - DNA, 14 bp, Homo sapiens
agccgggcccctgg

SEQ ID NO: 3168151 - DNA, 22 bp, Homo sapiens
agccgggcgtggtggcgggcac

SEQ ID NO: 3168152 - DNA, 13 bp, Homo sapiens
agccggtgcctgg

SEQ ID NO: 3168153 - DNA, 14 bp, Homo sapiens
agccggtgcctggc

SEQ ID NO: 3168154 - DNA, 13 bp, Homo sapiens
agccggtggtgcc

SEQ ID NO: 3168155 - DNA, 14 bp, Homo sapiens
agccggtggtgccc

SEQ ID NO: 3168156 - DNA, 14 bp, Homo sapiens
agccgtccatggca

SEQ ID NO: 3168157 - DNA, 15 bp, Homo sapiens
agccgtccatggcac

SEQ ID NO: 3168158 - DNA, 17 bp, Homo sapiens
agccgtccatggcacca

SEQ ID NO: 3168159 - DNA, 18 bp, Homo sapiens
agccgtccatggcaccag

SEQ ID NO: 3168160 - DNA, 19 bp, Homo sapiens
agccgtctgactccagagt

SEQ ID NO: 3168161 - DNA, 20 bp, Homo sapiens
agccgtctgactccagagtc

SEQ ID NO: 3168162 - DNA, 22 bp, Homo sapiens
agccgtctgactccagagtctg

SEQ ID NO: 3168163 - DNA, 23 bp, Homo sapiens
agccgtctgactccagagtctga

SEQ ID NO: 3168164 - DNA, 24 bp, Homo sapiens
agccgtctgactccagagtctgag

SEQ ID NO: 3168165 - DNA, 17 bp, Homo sapiens
agccgtgaactgtgcat

SEQ ID NO: 3168166 - DNA, 15 bp, Homo sapiens
agccgtgccttcagc

SEQ ID NO: 3168167 - DNA, 23 bp, Homo sapiens
agccgtggcttcccgctcagccc

SEQ ID NO: 3168168 - DNA, 16 bp, Homo sapiens
agcctaaagggcaggg

SEQ ID NO: 3168169 - DNA, 17 bp, Homo sapiens
agcctaaagggcagggc

SEQ ID NO: 3168170 - DNA, 23 bp, Homo sapiens
agcctaaagggcagggcccacgt

SEQ ID NO: 3168171 - DNA, 16 bp, Homo sapiens
agcctaagggatcctg

SEQ ID NO: 3168172 - DNA, 21 bp, Homo sapiens
agcctaagggatcctgcctgc

SEQ ID NO: 3168173 - DNA, 15 bp, Homo sapiens
agcctaatacaacat

SEQ ID NO: 3168174 - DNA, 22 bp, Homo sapiens
agcctaatccctgggcattgct

SEQ ID NO: 3168175 - DNA, 12 bp, Homo sapiens
agcctaatgaaa

SEQ ID NO: 3168176 - DNA, 16 bp, Homo sapiens
agcctacaagctggca

SEQ ID NO: 3168177 - DNA, 18 bp, Homo sapiens
agcctagaccctcctcct

SEQ ID NO: 3168178 - DNA, 17 bp, Homo sapiens
agcctagcccttgtccc

SEQ ID NO: 3168179 - DNA, 18 bp, Homo sapiens
agcctagcggagcccagc

SEQ ID NO: 3168180 - DNA, 19 bp, Homo sapiens
agcctagcggagcccagcc

SEQ ID NO: 3168181 - DNA, 23 bp, Homo sapiens
agcctagcggagcccagcctggg

SEQ ID NO: 3168182 - DNA, 21 bp, Homo sapiens
agcctagctcctgccacatgg

SEQ ID NO: 3168183 - DNA, 19 bp, Homo sapiens
agcctaggaccactcagcc

SEQ ID NO: 3168184 - DNA, 20 bp, Homo sapiens
agcctaggaccactcagccc

SEQ ID NO: 3168185 - DNA, 23 bp, Homo sapiens
agcctagttcatccaatcctcac

SEQ ID NO: 3168186 - DNA, 22 bp, Homo sapiens
agcctataagaggaatttcttt

SEQ ID NO: 3168187 - DNA, 16 bp, Homo sapiens
agcctatgagcatcct

SEQ ID NO: 3168188 - DNA, 18 bp, Homo sapiens
agcctatgagcatcctga

SEQ ID NO: 3168189 - DNA, 23 bp, Homo sapiens
agcctatgagcatcctgagcccc

SEQ ID NO: 3168190 - DNA, 20 bp, Homo sapiens
agcctatgggggctctcgga

SEQ ID NO: 3168191 - DNA, 16 bp, Homo sapiens
agcctcaaaacgggtc

SEQ ID NO: 3168192 - DNA, 18 bp, Homo sapiens
agcctcaacctcctgggc

SEQ ID NO: 3168193 - DNA, 12 bp, Homo sapiens
agcctcagagga

SEQ ID NO: 3168194 - DNA, 13 bp, Homo sapiens
agcctcagcatcc

SEQ ID NO: 3168195 - DNA, 14 bp, Homo sapiens
agcctcagcatcct

SEQ ID NO: 3168196 - DNA, 15 bp, Homo sapiens
agcctcagcatcctg

SEQ ID NO: 3168197 - DNA, 17 bp, Homo sapiens
agcctcagcatcctggc

SEQ ID NO: 3168198 - DNA, 20 bp, Homo sapiens
agcctcagcatcctggcacc

SEQ ID NO: 3168199 - DNA, 21 bp, Homo sapiens
agcctcagcatcctggcaccc

SEQ ID NO: 3168200 - DNA, 23 bp, Homo sapiens
agcctcagcatcctggcacccgg

SEQ ID NO: 3168201 - DNA, 16 bp, Homo sapiens
agcctcagctacccac

SEQ ID NO: 3168202 - DNA, 11 bp, Homo sapiens
agcctcagtcc

SEQ ID NO: 3168203 - DNA, 17 bp, Homo sapiens
agcctcagtcctcccct

SEQ ID NO: 3168204 - DNA, 19 bp, Homo sapiens
agcctcagtcctcccctca

SEQ ID NO: 3168205 - DNA, 16 bp, Homo sapiens
agcctcatatttaaag

SEQ ID NO: 3168206 - DNA, 19 bp, Homo sapiens
agcctcattctgaggcctg

SEQ ID NO: 3168207 - DNA, 14 bp, Homo sapiens
agcctccacagcga

SEQ ID NO: 3168208 - DNA, 15 bp, Homo sapiens
agcctccacagcgag

SEQ ID NO: 3168209 - DNA, 22 bp, Homo sapiens
agcctccacagcgagggcagct

SEQ ID NO: 3168210 - DNA, 23 bp, Homo sapiens
agcctccacagcgagggcagctg

SEQ ID NO: 3168211 - DNA, 16 bp, Homo sapiens
agcctccagagccagc

SEQ ID NO: 3168212 - DNA, 18 bp, Homo sapiens
agcctccagagccagcct

SEQ ID NO: 3168213 - DNA, 23 bp, Homo sapiens
agcctccagagccagcctgggac

SEQ ID NO: 3168214 - DNA, 17 bp, Homo sapiens
agcctccagggcccccc

SEQ ID NO: 3168215 - DNA, 15 bp, Homo sapiens
agcctccatttagtt

SEQ ID NO: 3168216 - DNA, 17 bp, Homo sapiens
agcctccatttagttct

SEQ ID NO: 3168217 - DNA, 21 bp, Homo sapiens
agcctccatttagttctttgt

SEQ ID NO: 3168218 - DNA, 13 bp, Homo sapiens
agcctcccaaagt

SEQ ID NO: 3168219 - DNA, 18 bp, Homo sapiens
agcctcccaaagtgctgg

SEQ ID NO: 3168220 - DNA, 23 bp, Homo sapiens
agcctccccctcagatgatctct

SEQ ID NO: 3168221 - DNA, 19 bp, Homo sapiens
agcctcccgagtagctggg

SEQ ID NO: 3168222 - DNA, 22 bp, Homo sapiens
agcctcccgagtagctgggact

SEQ ID NO: 3168223 - DNA, 14 bp, Homo sapiens
agcctccctctgac

SEQ ID NO: 3168224 - DNA, 14 bp, Homo sapiens
agcctccgagaggg

SEQ ID NO: 3168225 - DNA, 16 bp, Homo sapiens
agcctccgagagggag

SEQ ID NO: 3168226 - DNA, 15 bp, Homo sapiens
agcctccgccaagat

SEQ ID NO: 3168227 - DNA, 23 bp, Homo sapiens
agcctccggagtagctgggacca

SEQ ID NO: 3168228 - DNA, 18 bp, Homo sapiens
agcctccgtttatgggcc

SEQ ID NO: 3168229 - DNA, 22 bp, Homo sapiens
agcctccgtttatgggccttgc

SEQ ID NO: 3168230 - DNA, 20 bp, Homo sapiens
agcctcctcatcccgtgttc

SEQ ID NO: 3168231 - DNA, 13 bp, Homo sapiens
agcctcctctctc

SEQ ID NO: 3168232 - DNA, 14 bp, Homo sapiens
agcctcctgagcct

SEQ ID NO: 3168233 - DNA, 18 bp, Homo sapiens
agcctcctgagcctgtgg

SEQ ID NO: 3168234 - DNA, 13 bp, Homo sapiens
agcctcctgccca

SEQ ID NO: 3168235 - DNA, 14 bp, Homo sapiens
agcctcctgcccag

SEQ ID NO: 3168236 - DNA, 15 bp, Homo sapiens
agcctcctgcccagt

SEQ ID NO: 3168237 - DNA, 18 bp, Homo sapiens
agcctcctgcccagtccc

SEQ ID NO: 3168238 - DNA, 14 bp, Homo sapiens
agcctcctgtacct

SEQ ID NO: 3168239 - DNA, 15 bp, Homo sapiens
agcctcgtgtcatct

SEQ ID NO: 3168240 - DNA, 23 bp, Homo sapiens
agcctctccaggaatgcctcctc

SEQ ID NO: 3168241 - DNA, 15 bp, Homo sapiens
agcctctcccggctg

SEQ ID NO: 3168242 - DNA, 20 bp, Homo sapiens
agcctctcccggctgcctgc

SEQ ID NO: 3168243 - DNA, 15 bp, Homo sapiens
agctgcctagcaagc

SEQ ID NO: 3168244 - DNA, 22 bp, Homo sapiens
agctgcctagcaagctggcctc

SEQ ID NO: 3168245 - DNA, 23 bp, Homo sapiens
agctgcctcccctctccttcctg

SEQ ID NO: 3168246 - DNA, 12 bp, Homo sapiens
agctgcctctgc

SEQ ID NO: 3168247 - DNA, 13 bp, Homo sapiens
agctgcctctgct

SEQ ID NO: 3168248 - DNA, 17 bp, Homo sapiens
agctgcctctgctccct

SEQ ID NO: 3168249 - DNA, 18 bp, Homo sapiens
agctgcctctgctccctc

SEQ ID NO: 3168250 - DNA, 15 bp, Homo sapiens
agctgcctggtatat

SEQ ID NO: 3168251 - DNA, 19 bp, Homo sapiens
agctgcctgtagttaggaa

SEQ ID NO: 3168252 - DNA, 17 bp, Homo sapiens
agctgcctgtgcctgcc

SEQ ID NO: 3168253 - DNA, 21 bp, Homo sapiens
agctgcctgttcagctccagc

SEQ ID NO: 3168254 - DNA, 22 bp, Homo sapiens
agctgcctgttcagctccagct

SEQ ID NO: 3168255 - DNA, 16 bp, Homo sapiens
agctgccttccctagc

SEQ ID NO: 3168256 - DNA, 18 bp, Homo sapiens
agctgccttcctcatccc

SEQ ID NO: 3168257 - DNA, 19 bp, Homo sapiens
agctgccttcctcatcccc

SEQ ID NO: 3168258 - DNA, 14 bp, Homo sapiens
agctgccttgagct

SEQ ID NO: 3168259 - DNA, 16 bp, Homo sapiens
agctgccttggctcag

SEQ ID NO: 3168260 - DNA, 22 bp, Homo sapiens
agctgcgggctccctggcagga

SEQ ID NO: 3168261 - DNA, 18 bp, Homo sapiens
agctgcgggtctgaagga

SEQ ID NO: 3168262 - DNA, 16 bp, Homo sapiens
agctgcggtccaccca

SEQ ID NO: 3168263 - DNA, 19 bp, Homo sapiens
agctgcggtccacccagga

SEQ ID NO: 3168264 - DNA, 21 bp, Homo sapiens
agctgcggtccacccaggagc

SEQ ID NO: 3168265 - DNA, 23 bp, Homo sapiens
agctgcggtccacccaggagccc

SEQ ID NO: 3168266 - DNA, 14 bp, Homo sapiens
agctgctaaatctc

SEQ ID NO: 3168267 - DNA, 23 bp, Homo sapiens
agctgctatccccatctccctgc

SEQ ID NO: 3168268 - DNA, 19 bp, Homo sapiens
agctgctatttattttcct

SEQ ID NO: 3168269 - DNA, 13 bp, Homo sapiens
agctgctcagaat

SEQ ID NO: 3168270 - DNA, 15 bp, Homo sapiens
agctgctccaggcct

SEQ ID NO: 3168271 - DNA, 17 bp, Homo sapiens
agctgctccaggcctgc

SEQ ID NO: 3168272 - DNA, 20 bp, Homo sapiens
agctgctcttagtgcccgcc

SEQ ID NO: 3168273 - DNA, 21 bp, Homo sapiens
agctgctcttagtgcccgcct

SEQ ID NO: 3168274 - DNA, 12 bp, Homo sapiens
agctgctgacag

SEQ ID NO: 3168275 - DNA, 17 bp, Homo sapiens
agctgctgctctcccct

SEQ ID NO: 3168276 - DNA, 22 bp, Homo sapiens
agctgctgctctcccctcccag

SEQ ID NO: 3168277 - DNA, 23 bp, Homo sapiens
agctgctgctctcccctcccagt

SEQ ID NO: 3168278 - DNA, 21 bp, Homo sapiens
agctgcttttgtctatgggac

SEQ ID NO: 3168279 - DNA, 17 bp, Homo sapiens
agctggaacatttgata

SEQ ID NO: 3168280 - DNA, 12 bp, Homo sapiens
agctggaaggca

SEQ ID NO: 3168281 - DNA, 17 bp, Homo sapiens
agctggaaggcagggca

SEQ ID NO: 3168282 - DNA, 21 bp, Homo sapiens
agctggaaggcagggcagagg

SEQ ID NO: 3168283 - DNA, 19 bp, Homo sapiens
agctggaccctgcttcacc

SEQ ID NO: 3168284 - DNA, 20 bp, Homo sapiens
agctggaggctccaggactc

SEQ ID NO: 3168285 - DNA, 17 bp, Homo sapiens
agctggatataatgtat

SEQ ID NO: 3168286 - DNA, 17 bp, Homo sapiens
agctggcaggacacatc

SEQ ID NO: 3168287 - DNA, 23 bp, Homo sapiens
agctggcaggacacatcccggcc

SEQ ID NO: 3168288 - DNA, 15 bp, Homo sapiens
agctggccctgcctc

SEQ ID NO: 3168289 - DNA, 19 bp, Homo sapiens
agctggccctgcctcctgg

SEQ ID NO: 3168290 - DNA, 22 bp, Homo sapiens
agctggccctgcctcctgggaa

SEQ ID NO: 3168291 - DNA, 19 bp, Homo sapiens
agctggctctgagcgcctc

SEQ ID NO: 3168292 - DNA, 23 bp, Homo sapiens
agctggctctgagcgcctccatc

SEQ ID NO: 3168293 - DNA, 20 bp, Homo sapiens
agctgggaaaaaagttttga

SEQ ID NO: 3168294 - DNA, 22 bp, Homo sapiens
agctgggaaaaaagttttgatg

SEQ ID NO: 3168295 - DNA, 14 bp, Homo sapiens
agctgggaaagcat

SEQ ID NO: 3168296 - DNA, 14 bp, Homo sapiens
agctgggaaccagc

SEQ ID NO: 3168297 - DNA, 18 bp, Homo sapiens
agctgggaagctgtactc

SEQ ID NO: 3168298 - DNA, 15 bp, Homo sapiens
agctgggactacagg

SEQ ID NO: 3168299 - DNA, 19 bp, Homo sapiens
agctgggactacaggcacc

SEQ ID NO: 3168300 - DNA, 16 bp, Homo sapiens
agctgggaggcaagag

SEQ ID NO: 3168301 - DNA, 17 bp, Homo sapiens
agctgggaggcaagagg

SEQ ID NO: 3168302 - DNA, 19 bp, Homo sapiens
agctgggaggcaagagggg

SEQ ID NO: 3168303 - DNA, 23 bp, Homo sapiens
agctgggaggcaagaggggtgga

SEQ ID NO: 3168304 - DNA, 21 bp, Homo sapiens
agctgggcatggtaccagccc

SEQ ID NO: 3168305 - DNA, 21 bp, Homo sapiens
agctgggcccagcccctccac

SEQ ID NO: 3168306 - DNA, 20 bp, Homo sapiens
agctgggccccatgctctgc

SEQ ID NO: 3168307 - DNA, 21 bp, Homo sapiens
agctgggccccatgctctgcc

SEQ ID NO: 3168308 - DNA, 22 bp, Homo sapiens
agctgggccccatgctctgccc

SEQ ID NO: 3168309 - DNA, 23 bp, Homo sapiens
agctgggcggggctcgaggctgg

SEQ ID NO: 3168310 - DNA, 15 bp, Homo sapiens
agctggggactcagg

SEQ ID NO: 3168311 - DNA, 17 bp, Homo sapiens
agctggggactcaggga

SEQ ID NO: 3168312 - DNA, 18 bp, Homo sapiens
agctggggactcagggac

SEQ ID NO: 3168313 - DNA, 18 bp, Homo sapiens
agctggggcgtggggagg

SEQ ID NO: 3168314 - DNA, 14 bp, Homo sapiens
agctggggtacagg

SEQ ID NO: 3168315 - DNA, 19 bp, Homo sapiens
agctggtcccactcagtcc

SEQ ID NO: 3168316 - DNA, 17 bp, Homo sapiens
agctggtgcattacaga

SEQ ID NO: 3168317 - DNA, 18 bp, Homo sapiens
agctggtgcattacagag

SEQ ID NO: 3168318 - DNA, 20 bp, Homo sapiens
agctggtgcattacagagag

SEQ ID NO: 3168319 - DNA, 22 bp, Homo sapiens
agctggtgcattacagagagga

SEQ ID NO: 3168320 - DNA, 20 bp, Homo sapiens
agctggtgcccttcctcaca

SEQ ID NO: 3168321 - DNA, 18 bp, Homo sapiens
agctggtgtctgattgtt

SEQ ID NO: 3168322 - DNA, 21 bp, Homo sapiens
agctggttactcagggttcat

SEQ ID NO: 3168323 - DNA, 13 bp, Homo sapiens
agctggttgctcc

SEQ ID NO: 3168324 - DNA, 22 bp, Homo sapiens
agctggtttttagcggagacgg

SEQ ID NO: 3168325 - DNA, 17 bp, Homo sapiens
agctgtaagaaaatgct

SEQ ID NO: 3168326 - DNA, 14 bp, Homo sapiens
agctgtaagggcag

SEQ ID NO: 3168327 - DNA, 17 bp, Homo sapiens
agctgtaagggcagtgc

SEQ ID NO: 3168328 - DNA, 20 bp, Homo sapiens
agctgtactataagtagttg

SEQ ID NO: 3168329 - DNA, 23 bp, Homo sapiens
agctgtactataagtagttggtt

SEQ ID NO: 3168330 - DNA, 17 bp, Homo sapiens
agctgtactcagagcag

SEQ ID NO: 3168331 - DNA, 19 bp, Homo sapiens
agctgtactcagagcagag

SEQ ID NO: 3168332 - DNA, 19 bp, Homo sapiens
agctgtacttcgtcttcta

SEQ ID NO: 3168333 - DNA, 20 bp, Homo sapiens
agctgtacttcttgaatata

SEQ ID NO: 3168334 - DNA, 14 bp, Homo sapiens
agctgtagccatgg

SEQ ID NO: 3168335 - DNA, 19 bp, Homo sapiens
agctgtagccatggctcag

SEQ ID NO: 3168336 - DNA, 21 bp, Homo sapiens
agctgtagctacaagggaagc

SEQ ID NO: 3168337 - DNA, 21 bp, Homo sapiens
agctgtagtagccctttctgt

SEQ ID NO: 3168338 - DNA, 21 bp, Homo sapiens
agctgtataattaattgtcat

SEQ ID NO: 3168339 - DNA, 14 bp, Homo sapiens
agctgtatgatttg

SEQ ID NO: 3168340 - DNA, 15 bp, Homo sapiens
agctgtatgatttgt

SEQ ID NO: 3168341 - DNA, 16 bp, Homo sapiens
agctgtatgatttgtt

SEQ ID NO: 3168342 - DNA, 20 bp, Homo sapiens
agctgtatgatttgttttga

SEQ ID NO: 3168343 - DNA, 22 bp, Homo sapiens
agctgtatgatttgttttgaat

SEQ ID NO: 3168344 - DNA, 16 bp, Homo sapiens
agctgtcccctctgtc

SEQ ID NO: 3168345 - DNA, 19 bp, Homo sapiens
agctgtccctgcagggcca

SEQ ID NO: 3168346 - DNA, 20 bp, Homo sapiens
agctgtccctgcagggccat

SEQ ID NO: 3168347 - DNA, 17 bp, Homo sapiens
agctgtcctccctccac

SEQ ID NO: 3168348 - DNA, 22 bp, Homo sapiens
agctgtcctgcagcaaacactc

SEQ ID NO: 3168349 - DNA, 18 bp, Homo sapiens
agctgtctatgcagcctg

SEQ ID NO: 3168350 - DNA, 20 bp, Homo sapiens
agctgtctatgcagcctgct

SEQ ID NO: 3168351 - DNA, 15 bp, Homo sapiens
agctgtgagccttgg

SEQ ID NO: 3168352 - DNA, 16 bp, Homo sapiens
agctgtgcaggcatgg

SEQ ID NO: 3168353 - DNA, 14 bp, Homo sapiens
agctgtgccagcag

SEQ ID NO: 3168354 - DNA, 15 bp, Homo sapiens
agctgtgccagcagg

SEQ ID NO: 3168355 - DNA, 17 bp, Homo sapiens
agctgtgccagcagggg

SEQ ID NO: 3168356 - DNA, 13 bp, Homo sapiens
agctgtgtgaaat

SEQ ID NO: 3168357 - DNA, 13 bp, Homo sapiens
agctgtgtgcagg

SEQ ID NO: 3168358 - DNA, 12 bp, Homo sapiens
agctgttaaact

SEQ ID NO: 3168359 - DNA, 15 bp, Homo sapiens
agctgttaaactgtt

SEQ ID NO: 3168360 - DNA, 16 bp, Homo sapiens
agctgttaaactgtta

SEQ ID NO: 3168361 - DNA, 23 bp, Homo sapiens
agctgttaaactgttagcactgt

SEQ ID NO: 3168362 - DNA, 15 bp, Homo sapiens
agctgttaccattca

SEQ ID NO: 3168363 - DNA, 19 bp, Homo sapiens
agctgttcctgttcagtaa

SEQ ID NO: 3168364 - DNA, 22 bp, Homo sapiens
agctgttgtacatttatgattt

SEQ ID NO: 3168365 - DNA, 20 bp, Homo sapiens
agctgtttatggcctcagct

SEQ ID NO: 3168366 - DNA, 21 bp, Homo sapiens
agctgtttatggcctcagctg

SEQ ID NO: 3168367 - DNA, 12 bp, Homo sapiens
aggagctgctgg

SEQ ID NO: 3168368 - DNA, 21 bp, Homo sapiens
aggagctgtcaccaaggaaac

SEQ ID NO: 3168369 - DNA, 17 bp, Homo sapiens
aggagcttttttacaca

SEQ ID NO: 3168370 - DNA, 13 bp, Homo sapiens
aggaggaaaagga

SEQ ID NO: 3168371 - DNA, 16 bp, Homo sapiens
aggaggaaaaggaaaa

SEQ ID NO: 3168372 - DNA, 22 bp, Homo sapiens
aggaggaatcatgtcaggcctg

SEQ ID NO: 3168373 - DNA, 13 bp, Homo sapiens
aggaggaggagaa

SEQ ID NO: 3168374 - DNA, 16 bp, Homo sapiens
aggaggaggagatggc

SEQ ID NO: 3168375 - DNA, 16 bp, Homo sapiens
aggaggaggagggaga

SEQ ID NO: 3168376 - DNA, 13 bp, Homo sapiens
aggaggagggaga

SEQ ID NO: 3168377 - DNA, 22 bp, Homo sapiens
aggaggagggagaagagaaaat

SEQ ID NO: 3168378 - DNA, 14 bp, Homo sapiens
aggaggagggaggc

SEQ ID NO: 3168379 - DNA, 22 bp, Homo sapiens
aggaggagggaggcgctgctgg

SEQ ID NO: 3168380 - DNA, 18 bp, Homo sapiens
aggaggatgactaacaag

SEQ ID NO: 3168381 - DNA, 17 bp, Homo sapiens
aggaggatgtccctggg

SEQ ID NO: 3168382 - DNA, 20 bp, Homo sapiens
aggaggatgtccctgggcca

SEQ ID NO: 3168383 - DNA, 21 bp, Homo sapiens
aggaggatgtccctgggccag

SEQ ID NO: 3168384 - DNA, 14 bp, Homo sapiens
aggaggcagccccc

SEQ ID NO: 3168385 - DNA, 20 bp, Homo sapiens
aggaggcagccccctccaca

SEQ ID NO: 3168386 - DNA, 17 bp, Homo sapiens
aggaggccaaccagccc

SEQ ID NO: 3168387 - DNA, 22 bp, Homo sapiens
aggaggccaaccagcccgacag

SEQ ID NO: 3168388 - DNA, 23 bp, Homo sapiens
aggaggccacctctccaagggct

SEQ ID NO: 3168389 - DNA, 15 bp, Homo sapiens
aggaggccagtgggc

SEQ ID NO: 3168390 - DNA, 14 bp, Homo sapiens
aggaggcctgggga

SEQ ID NO: 3168391 - DNA, 17 bp, Homo sapiens
aggaggcgcggcctccc

SEQ ID NO: 3168392 - DNA, 15 bp, Homo sapiens
aggaggcggcccggc

SEQ ID NO: 3168393 - DNA, 21 bp, Homo sapiens
aggaggcgtctcgggagagga

SEQ ID NO: 3168394 - DNA, 13 bp, Homo sapiens
aggagggagaaga

SEQ ID NO: 3168395 - DNA, 15 bp, Homo sapiens
aggagggatgctgct

SEQ ID NO: 3168396 - DNA, 13 bp, Homo sapiens
aggagggcagagc

SEQ ID NO: 3168397 - DNA, 14 bp, Homo sapiens
aggagggcagagcc

SEQ ID NO: 3168398 - DNA, 15 bp, Homo sapiens
aggagggcagagcca

SEQ ID NO: 3168399 - DNA, 23 bp, Homo sapiens
aggagggcagagccatgggcctg

SEQ ID NO: 3168400 - DNA, 16 bp, Homo sapiens
aggaggggaagctgca

SEQ ID NO: 3168401 - DNA, 13 bp, Homo sapiens
aggaggggtctca

SEQ ID NO: 3168402 - DNA, 15 bp, Homo sapiens
aggagggtacagctg

SEQ ID NO: 3168403 - DNA, 18 bp, Homo sapiens
aggagggtacagctgggc

SEQ ID NO: 3168404 - DNA, 18 bp, Homo sapiens
aggagggtggaggaaggt

SEQ ID NO: 3168405 - DNA, 23 bp, Homo sapiens
aggagggttcctcttaggtcaga

SEQ ID NO: 3168406 - DNA, 17 bp, Homo sapiens
aggagggtttgggcaga

SEQ ID NO: 3168407 - DNA, 19 bp, Homo sapiens
aggagggtttgggcagagc

SEQ ID NO: 3168408 - DNA, 15 bp, Homo sapiens
aggaggtagagaggg

SEQ ID NO: 3168409 - DNA, 14 bp, Homo sapiens
aggaggtagtttct

SEQ ID NO: 3168410 - DNA, 23 bp, Homo sapiens
aggaggtccttaggcctctgaga

SEQ ID NO: 3168411 - DNA, 15 bp, Homo sapiens
aggaggtgagagtgg

SEQ ID NO: 3168412 - DNA, 23 bp, Homo sapiens
aggaggtggcagccctgtaggga

SEQ ID NO: 3168413 - DNA, 14 bp, Homo sapiens
aggaggtgtgaatg

SEQ ID NO: 3168414 - DNA, 19 bp, Homo sapiens
aggaggttggtgactgaaa

SEQ ID NO: 3168415 - DNA, 14 bp, Homo sapiens
aggaggtttggatg

SEQ ID NO: 3168416 - DNA, 14 bp, Homo sapiens
aggagtaaaattca

SEQ ID NO: 3168417 - DNA, 21 bp, Homo sapiens
aggagtaaaattcagtttttt

SEQ ID NO: 3168418 - DNA, 12 bp, Homo sapiens
aggagtattttg

SEQ ID NO: 3168419 - DNA, 20 bp, Homo sapiens
aggagtccactttgtttcgt

SEQ ID NO: 3168420 - DNA, 15 bp, Homo sapiens
aggagtctctgccac

SEQ ID NO: 3168421 - DNA, 18 bp, Homo sapiens
aggagtctctgccaccca

SEQ ID NO: 3168422 - DNA, 22 bp, Homo sapiens
aggagtctctgccacccactca

SEQ ID NO: 3168423 - DNA, 22 bp, Homo sapiens
aggagtgaaacctttagggcag

SEQ ID NO: 3168424 - DNA, 12 bp, Homo sapiens
aggagtgaggaa

SEQ ID NO: 3168425 - DNA, 20 bp, Homo sapiens
aggagtgggtgacaagagcc

SEQ ID NO: 3168426 - DNA, 23 bp, Homo sapiens
aggagtgggtgacaagagcctga

SEQ ID NO: 3168427 - DNA, 14 bp, Homo sapiens
aggagtggtgcaga

SEQ ID NO: 3168428 - DNA, 16 bp, Homo sapiens
aggagtgtggccacgt

SEQ ID NO: 3168429 - DNA, 18 bp, Homo sapiens
aggagtgtgtgatttttt

SEQ ID NO: 3168430 - DNA, 20 bp, Homo sapiens
aggagttaaagagcagcctg

SEQ ID NO: 3168431 - DNA, 19 bp, Homo sapiens
aggagttccacagattgtt

SEQ ID NO: 3168432 - DNA, 22 bp, Homo sapiens
aggagttcgagaccagcctggc

SEQ ID NO: 3168433 - DNA, 18 bp, Homo sapiens
aggagttgtttctgaccc

SEQ ID NO: 3168434 - DNA, 20 bp, Homo sapiens
aggagttgtttctgacccac

SEQ ID NO: 3168435 - DNA, 19 bp, Homo sapiens
aggagtttaagaccagcct

SEQ ID NO: 3168436 - DNA, 21 bp, Homo sapiens
aggagtttaagaccagcctgg

SEQ ID NO: 3168437 - DNA, 21 bp, Homo sapiens
aggagtttgagacaagccctg

SEQ ID NO: 3168438 - DNA, 12 bp, Homo sapiens
aggataaaataa

SEQ ID NO: 3168439 - DNA, 18 bp, Homo sapiens
aggataacacaagtaaaa

SEQ ID NO: 3168440 - DNA, 13 bp, Homo sapiens
aggataactctgt

SEQ ID NO: 3168441 - DNA, 13 bp, Homo sapiens
aggataagtgaaa

SEQ ID NO: 3168442 - DNA, 21 bp, Homo sapiens
aggataatggtgaacatttta

SEQ ID NO: 3168443 - DNA, 18 bp, Homo sapiens
aggatactggcacagagg

SEQ ID NO: 3168444 - DNA, 23 bp, Homo sapiens
aggatagctaactgtaaatcatg

SEQ ID NO: 3168445 - DNA, 16 bp, Homo sapiens
aggatagtatttttat

SEQ ID NO: 3168446 - DNA, 17 bp, Homo sapiens
aggatatccttatcaga

SEQ ID NO: 3168447 - DNA, 22 bp, Homo sapiens
aggatatccttatcagagctaa

SEQ ID NO: 3168448 - DNA, 13 bp, Homo sapiens
aggatatgattaa

SEQ ID NO: 3168449 - DNA, 19 bp, Homo sapiens
aggatatgattaatattat

SEQ ID NO: 3168450 - DNA, 21 bp, Homo sapiens
aggatattagttaatgagcca

SEQ ID NO: 3168451 - DNA, 14 bp, Homo sapiens
aggatatttaagaa

SEQ ID NO: 3168452 - DNA, 16 bp, Homo sapiens
aggatatttaagaaaa

SEQ ID NO: 3168453 - DNA, 11 bp, Homo sapiens
aggatatttga

SEQ ID NO: 3168454 - DNA, 15 bp, Homo sapiens
aggatatttgcacta

SEQ ID NO: 3168455 - DNA, 19 bp, Homo sapiens
aggatcactggagcccagg

SEQ ID NO: 3168456 - DNA, 20 bp, Homo sapiens
aggatcactggagcccagga

SEQ ID NO: 3168457 - DNA, 12 bp, Homo sapiens
aggatcagtctg

SEQ ID NO: 3168458 - DNA, 13 bp, Homo sapiens
aggatcagtctga

SEQ ID NO: 3168459 - DNA, 17 bp, Homo sapiens
aggatcatggtgtaata

SEQ ID NO: 3168460 - DNA, 18 bp, Homo sapiens
aggatcatggtgtaataa

SEQ ID NO: 3168461 - DNA, 17 bp, Homo sapiens
aggatccaggaatatga

SEQ ID NO: 3168462 - DNA, 14 bp, Homo sapiens
aggatccgctgcca

SEQ ID NO: 3168463 - DNA, 22 bp, Homo sapiens
aggatccgtgctgtctcctttg

SEQ ID NO: 3168464 - DNA, 13 bp, Homo sapiens
aggatcctgcagg

SEQ ID NO: 3168465 - DNA, 14 bp, Homo sapiens
aggatcctgcagga

SEQ ID NO: 3168466 - DNA, 16 bp, Homo sapiens
aggatcctgcaggaac

SEQ ID NO: 3168467 - DNA, 20 bp, Homo sapiens
aggatctctcaggagcacag

SEQ ID NO: 3168468 - DNA, 15 bp, Homo sapiens
aggatctttgactga

SEQ ID NO: 3168469 - DNA, 19 bp, Homo sapiens
aggatgaagaacacagcat

SEQ ID NO: 3168470 - DNA, 13 bp, Homo sapiens
aggatgagagccc

SEQ ID NO: 3168471 - DNA, 18 bp, Homo sapiens
aggatgagagcccagagg

SEQ ID NO: 3168472 - DNA, 15 bp, Homo sapiens
aggatgcacatttct

SEQ ID NO: 3168473 - DNA, 21 bp, Homo sapiens
aggatgcacatttctggattg

SEQ ID NO: 3168474 - DNA, 23 bp, Homo sapiens
aggatgcagcgccgtgtcctctc

SEQ ID NO: 3168475 - DNA, 13 bp, Homo sapiens
aggatgccagccc

SEQ ID NO: 3168476 - DNA, 17 bp, Homo sapiens
aggatgccagcccctgc

SEQ ID NO: 3168477 - DNA, 19 bp, Homo sapiens
aggatgccagcccctgcct

SEQ ID NO: 3168478 - DNA, 23 bp, Homo sapiens
aggatgccagcccctgcctgggt

SEQ ID NO: 3168479 - DNA, 19 bp, Homo sapiens
aggatgctaacatctaaaa

SEQ ID NO: 3168480 - DNA, 22 bp, Homo sapiens
aggatgctaacatctaaaaata

SEQ ID NO: 3168481 - DNA, 16 bp, Homo sapiens
aggatgctctttccct

SEQ ID NO: 3168482 - DNA, 17 bp, Homo sapiens
aggatgctctttccctt

SEQ ID NO: 3168483 - DNA, 13 bp, Homo sapiens
aggatgctgagct

SEQ ID NO: 3168484 - DNA, 21 bp, Homo sapiens
aggatgcttgattccagtggt

SEQ ID NO: 3168485 - DNA, 13 bp, Homo sapiens
aggatggagagag

SEQ ID NO: 3168486 - DNA, 16 bp, Homo sapiens
aggatggagagagggg

SEQ ID NO: 3168487 - DNA, 12 bp, Homo sapiens
aggatggagggg

SEQ ID NO: 3168488 - DNA, 16 bp, Homo sapiens
aggatggccagtgtct

SEQ ID NO: 3168489 - DNA, 20 bp, Homo sapiens
aggatggccagtgtctgtcc

SEQ ID NO: 3168490 - DNA, 17 bp, Homo sapiens
aggatggggctcccagc

SEQ ID NO: 3168491 - DNA, 18 bp, Homo sapiens
aggatggggctcccagct

SEQ ID NO: 3168492 - DNA, 20 bp, Homo sapiens
aggatgtaggggttaacttg

SEQ ID NO: 3168493 - DNA, 18 bp, Homo sapiens
aggctcttcctggacctg

SEQ ID NO: 3168494 - DNA, 15 bp, Homo sapiens
aggctctttctgggc

SEQ ID NO: 3168495 - DNA, 20 bp, Homo sapiens
aggctctttctgggccaagt

SEQ ID NO: 3168496 - DNA, 16 bp, Homo sapiens
aggctgaactcttcag

SEQ ID NO: 3168497 - DNA, 20 bp, Homo sapiens
aggctgaactcttcagaaca

SEQ ID NO: 3168498 - DNA, 19 bp, Homo sapiens
aggctgaagagagggacag

SEQ ID NO: 3168499 - DNA, 17 bp, Homo sapiens
aggctgaccaagagaga

SEQ ID NO: 3168500 - DNA, 19 bp, Homo sapiens
aggctgaccaagagagaaa

SEQ ID NO: 3168501 - DNA, 16 bp, Homo sapiens
aggctgacgtgtgagg

SEQ ID NO: 3168502 - DNA, 20 bp, Homo sapiens
aggctgagaaggaacaggga

SEQ ID NO: 3168503 - DNA, 11 bp, Homo sapiens
aggctgagcca

SEQ ID NO: 3168504 - DNA, 11 bp, Homo sapiens
aggctgaggac

SEQ ID NO: 3168505 - DNA, 11 bp, Homo sapiens
aggctgaggcg

SEQ ID NO: 3168506 - DNA, 21 bp, Homo sapiens
aggctgatgtcaatttctgtg

SEQ ID NO: 3168507 - DNA, 20 bp, Homo sapiens
aggctgcagagctgacccag

SEQ ID NO: 3168508 - DNA, 18 bp, Homo sapiens
aggctgcagaggcacctc

SEQ ID NO: 3168509 - DNA, 20 bp, Homo sapiens
aggctgctggggcctcagac

SEQ ID NO: 3168510 - DNA, 15 bp, Homo sapiens
aggctggcagctctc

SEQ ID NO: 3168511 - DNA, 13 bp, Homo sapiens
aggctggccagca

SEQ ID NO: 3168512 - DNA, 20 bp, Homo sapiens
aggctggccagcaaggcagg

SEQ ID NO: 3168513 - DNA, 17 bp, Homo sapiens
aggctggcgcagccaag

SEQ ID NO: 3168514 - DNA, 19 bp, Homo sapiens
aggctggcgcagccaaggc

SEQ ID NO: 3168515 - DNA, 22 bp, Homo sapiens
aggctggcgcagccaaggccga

SEQ ID NO: 3168516 - DNA, 17 bp, Homo sapiens
aggctggcgtgcagtgg

SEQ ID NO: 3168517 - DNA, 11 bp, Homo sapiens
aggctggctga

SEQ ID NO: 3168518 - DNA, 22 bp, Homo sapiens
aggctggctggcccgtcatgtt

SEQ ID NO: 3168519 - DNA, 13 bp, Homo sapiens
aggctgggagcat

SEQ ID NO: 3168520 - DNA, 20 bp, Homo sapiens
aggctgggcagccccagaga

SEQ ID NO: 3168521 - DNA, 18 bp, Homo sapiens
aggctgggccatgtccaa

SEQ ID NO: 3168522 - DNA, 22 bp, Homo sapiens
aggctgggccatgtccaaagag

SEQ ID NO: 3168523 - DNA, 15 bp, Homo sapiens
aggctgggcccctgg

SEQ ID NO: 3168524 - DNA, 16 bp, Homo sapiens
aggctgggcccctggg

SEQ ID NO: 3168525 - DNA, 17 bp, Homo sapiens
aggctgggctgggtggc

SEQ ID NO: 3168526 - DNA, 19 bp, Homo sapiens
aggctgggcttcagtggca

SEQ ID NO: 3168527 - DNA, 21 bp, Homo sapiens
aggctgggcttcagtggcagc

SEQ ID NO: 3168528 - DNA, 19 bp, Homo sapiens
aggctggtccgagctgagg

SEQ ID NO: 3168529 - DNA, 12 bp, Homo sapiens
aggctggtgaca

SEQ ID NO: 3168530 - DNA, 18 bp, Homo sapiens
aggctggtgccaggcgcg

SEQ ID NO: 3168531 - DNA, 16 bp, Homo sapiens
aggctgtaaattgaac

SEQ ID NO: 3168532 - DNA, 20 bp, Homo sapiens
aggctgtcacagtcctgagt

SEQ ID NO: 3168533 - DNA, 21 bp, Homo sapiens
aggctgtcctgtacattgtgg

SEQ ID NO: 3168534 - DNA, 14 bp, Homo sapiens
aggctgtctggggc

SEQ ID NO: 3168535 - DNA, 15 bp, Homo sapiens
aggctgtgggcctca

SEQ ID NO: 3168536 - DNA, 18 bp, Homo sapiens
aggctgtgggcctcaagg

SEQ ID NO: 3168537 - DNA, 22 bp, Homo sapiens
aggctgtgtccctcttctcttc

SEQ ID NO: 3168538 - DNA, 20 bp, Homo sapiens
aggctgtgtgaatttttcta

SEQ ID NO: 3168539 - DNA, 18 bp, Homo sapiens
aggctgttctgcactgaa

SEQ ID NO: 3168540 - DNA, 19 bp, Homo sapiens
aggctgttctgcactgaaa

SEQ ID NO: 3168541 - DNA, 19 bp, Homo sapiens
aggcttaataaaaatgaca

SEQ ID NO: 3168542 - DNA, 12 bp, Homo sapiens
aggcttcaccct

SEQ ID NO: 3168543 - DNA, 12 bp, Homo sapiens
aggcttccaggc

SEQ ID NO: 3168544 - DNA, 20 bp, Homo sapiens
aggcttccctgacttgcttt

SEQ ID NO: 3168545 - DNA, 21 bp, Homo sapiens
aggcttcctgcaattttctaa

SEQ ID NO: 3168546 - DNA, 20 bp, Homo sapiens
aggcttcctgcgtcctcctc

SEQ ID NO: 3168547 - DNA, 21 bp, Homo sapiens
aggcttcctgcgtcctcctca

SEQ ID NO: 3168548 - DNA, 18 bp, Homo sapiens
aggcttctccgccagcct

SEQ ID NO: 3168549 - DNA, 22 bp, Homo sapiens
aggcttctccgccagcctcctc

SEQ ID NO: 3168550 - DNA, 12 bp, Homo sapiens
aggcttctcctg

SEQ ID NO: 3168551 - DNA, 18 bp, Homo sapiens
aggcttctcctgttttat

SEQ ID NO: 3168552 - DNA, 16 bp, Homo sapiens
aggcttctccttctcc

SEQ ID NO: 3168553 - DNA, 19 bp, Homo sapiens
aggctttctgggtgtgact

SEQ ID NO: 3168554 - DNA, 18 bp, Homo sapiens
aggctttggtaactgcgg

SEQ ID NO: 3168555 - DNA, 15 bp, Homo sapiens
aggcttttcactgcc

SEQ ID NO: 3168556 - DNA, 20 bp, Homo sapiens
agggaaaataggcaggaagc

SEQ ID NO: 3168557 - DNA, 22 bp, Homo sapiens
agggaaactaagattcttttaa

SEQ ID NO: 3168558 - DNA, 19 bp, Homo sapiens
agggaaaggggtgctttta

SEQ ID NO: 3168559 - DNA, 21 bp, Homo sapiens
agggaaataatagggaaaata

SEQ ID NO: 3168560 - DNA, 15 bp, Homo sapiens
agggaaatatcattt

SEQ ID NO: 3168561 - DNA, 19 bp, Homo sapiens
agggaaccgtctgttttta

SEQ ID NO: 3168562 - DNA, 20 bp, Homo sapiens
agggaaccgtctgtttttaa

SEQ ID NO: 3168563 - DNA, 22 bp, Homo sapiens
agggaaccgttattataattgt

SEQ ID NO: 3168564 - DNA, 14 bp, Homo sapiens
agggaacctgtgtc

SEQ ID NO: 3168565 - DNA, 14 bp, Homo sapiens
agggaactctgggg

SEQ ID NO: 3168566 - DNA, 15 bp, Homo sapiens
agggaactctggggt

SEQ ID NO: 3168567 - DNA, 23 bp, Homo sapiens
agggaagaaaactatcctgcggg

SEQ ID NO: 3168568 - DNA, 19 bp, Homo sapiens
agggaagaaaggaggcagc

SEQ ID NO: 3168569 - DNA, 17 bp, Homo sapiens
agggaagaaggggccat

SEQ ID NO: 3168570 - DNA, 15 bp, Homo sapiens
agggaagagaaagtg

SEQ ID NO: 3168571 - DNA, 12 bp, Homo sapiens
agggaagagggc

SEQ ID NO: 3168572 - DNA, 13 bp, Homo sapiens
agggaagctggcc

SEQ ID NO: 3168573 - DNA, 16 bp, Homo sapiens
agggaagctggcctga

SEQ ID NO: 3168574 - DNA, 17 bp, Homo sapiens
agggaagctggcctgag

SEQ ID NO: 3168575 - DNA, 13 bp, Homo sapiens
agggaaggaaaaa

SEQ ID NO: 3168576 - DNA, 18 bp, Homo sapiens
agggaaggacagaaagga

SEQ ID NO: 3168577 - DNA, 20 bp, Homo sapiens
agggaaggggaggcagccgg

SEQ ID NO: 3168578 - DNA, 16 bp, Homo sapiens
agggaaggtgaagatg

SEQ ID NO: 3168579 - DNA, 20 bp, Homo sapiens
agggaaggtgaagatgaaga

SEQ ID NO: 3168580 - DNA, 12 bp, Homo sapiens
agggaaggtggg

SEQ ID NO: 3168581 - DNA, 16 bp, Homo sapiens
agggaaggtggggccc

SEQ ID NO: 3168582 - DNA, 19 bp, Homo sapiens
agggaaggtggggccctgc

SEQ ID NO: 3168583 - DNA, 15 bp, Homo sapiens
agggaagtgtgagcg

SEQ ID NO: 3168584 - DNA, 21 bp, Homo sapiens
agggaatcagggaccagcttt

SEQ ID NO: 3168585 - DNA, 16 bp, Homo sapiens
agggaatccaagcctc

SEQ ID NO: 3168586 - DNA, 19 bp, Homo sapiens
agggaatccaagcctccac

SEQ ID NO: 3168587 - DNA, 22 bp, Homo sapiens
agggaatccaagcctccacagc

SEQ ID NO: 3168588 - DNA, 15 bp, Homo sapiens
agggaatctggatta

SEQ ID NO: 3168589 - DNA, 16 bp, Homo sapiens
agggaatgttccctgc

SEQ ID NO: 3168590 - DNA, 17 bp, Homo sapiens
agggaatgttccctgca

SEQ ID NO: 3168591 - DNA, 19 bp, Homo sapiens
agggaatgttccctgcacc

SEQ ID NO: 3168592 - DNA, 12 bp, Homo sapiens
agggaattgctc

SEQ ID NO: 3168593 - DNA, 18 bp, Homo sapiens
agggacaagggattctgg

SEQ ID NO: 3168594 - DNA, 14 bp, Homo sapiens
agggacagcatgcc

SEQ ID NO: 3168595 - DNA, 16 bp, Homo sapiens
agggacaggctgaaga

SEQ ID NO: 3168596 - DNA, 20 bp, Homo sapiens
agggacaggctgaagagagg

SEQ ID NO: 3168597 - DNA, 13 bp, Homo sapiens
agggacagggtct

SEQ ID NO: 3168598 - DNA, 23 bp, Homo sapiens
agggaccaaggcaaggcaggtgc

SEQ ID NO: 3168599 - DNA, 18 bp, Homo sapiens
agggaccacaccctgtac

SEQ ID NO: 3168600 - DNA, 14 bp, Homo sapiens
agggaccagcttta

SEQ ID NO: 3168601 - DNA, 15 bp, Homo sapiens
agggaccggtgctgc

SEQ ID NO: 3168602 - DNA, 20 bp, Homo sapiens
agggaccggtgctgcaggag

SEQ ID NO: 3168603 - DNA, 22 bp, Homo sapiens
agggaccggtgctgcaggagtg

SEQ ID NO: 3168604 - DNA, 22 bp, Homo sapiens
agggaccttcatgcccttctga

SEQ ID NO: 3168605 - DNA, 23 bp, Homo sapiens
agggactgccagtccccctgccc

SEQ ID NO: 3168606 - DNA, 15 bp, Homo sapiens
agggactgcctctgc

SEQ ID NO: 3168607 - DNA, 16 bp, Homo sapiens
agggactgcctctgcc

SEQ ID NO: 3168608 - DNA, 17 bp, Homo sapiens
agggactgcctctgcca

SEQ ID NO: 3168609 - DNA, 12 bp, Homo sapiens
agggacttaaaa

SEQ ID NO: 3168610 - DNA, 16 bp, Homo sapiens
agggacttaacttgtt

SEQ ID NO: 3168611 - DNA, 15 bp, Homo sapiens
agggacttggaagct

SEQ ID NO: 3168612 - DNA, 20 bp, Homo sapiens
agggacttggaagctccgct

SEQ ID NO: 3168613 - DNA, 13 bp, Homo sapiens
agggagaaaagag

SEQ ID NO: 3168614 - DNA, 16 bp, Homo sapiens
agggagaaaagagaaa

SEQ ID NO: 3168615 - DNA, 20 bp, Homo sapiens
agggagaaaatccaggtcat

SEQ ID NO: 3168616 - DNA, 20 bp, Homo sapiens
agggagaaactccaaagtcc

SEQ ID NO: 3168617 - DNA, 10 bp, Homo sapiens
agggagaaga

SEQ ID NO: 3168618 - DNA, 19 bp, Homo sapiens
agggagaagacactgcagt

SEQ ID NO: 3168619 - DNA, 16 bp, Homo sapiens
aggggcaagctaggcc

SEQ ID NO: 3168620 - DNA, 16 bp, Homo sapiens
aggggcacaccactgc

SEQ ID NO: 3168621 - DNA, 20 bp, Homo sapiens
aggggcacaccactgccctg

SEQ ID NO: 3168622 - DNA, 14 bp, Homo sapiens
aggggcaggactga

SEQ ID NO: 3168623 - DNA, 18 bp, Homo sapiens
aggggcaggagaggctgg

SEQ ID NO: 3168624 - DNA, 13 bp, Homo sapiens
aggggcaggcctg

SEQ ID NO: 3168625 - DNA, 17 bp, Homo sapiens
aggggcaggcctgggac

SEQ ID NO: 3168626 - DNA, 23 bp, Homo sapiens
aggggcagggaaggacaggaccc

SEQ ID NO: 3168627 - DNA, 16 bp, Homo sapiens
aggggcatctgcccct

SEQ ID NO: 3168628 - DNA, 19 bp, Homo sapiens
aggggcatctgcccctccc

SEQ ID NO: 3168629 - DNA, 22 bp, Homo sapiens
aggggcatctgcccctccccca

SEQ ID NO: 3168630 - DNA, 11 bp, Homo sapiens
aggggccacct

SEQ ID NO: 3168631 - DNA, 18 bp, Homo sapiens
aggggccacctcctcccc

SEQ ID NO: 3168632 - DNA, 22 bp, Homo sapiens
aggggccagaggaactgtccag

SEQ ID NO: 3168633 - DNA, 22 bp, Homo sapiens
aggggcccaaattctttcagtg

SEQ ID NO: 3168634 - DNA, 17 bp, Homo sapiens
aggggcccaagccccat

SEQ ID NO: 3168635 - DNA, 15 bp, Homo sapiens
aggggccccagatct

SEQ ID NO: 3168636 - DNA, 22 bp, Homo sapiens
aggggccccagatctgcctggg

SEQ ID NO: 3168637 - DNA, 13 bp, Homo sapiens
aggggcccctgct

SEQ ID NO: 3168638 - DNA, 15 bp, Homo sapiens
aggggcccgggaact

SEQ ID NO: 3168639 - DNA, 19 bp, Homo sapiens
aggggcccgggaactcctg

SEQ ID NO: 3168640 - DNA, 21 bp, Homo sapiens
aggggcccggtggcggcaggg

SEQ ID NO: 3168641 - DNA, 15 bp, Homo sapiens
aggggccctccgagg

SEQ ID NO: 3168642 - DNA, 16 bp, Homo sapiens
aggggccctggccagg

SEQ ID NO: 3168643 - DNA, 21 bp, Homo sapiens
aggggccggggaagctgccag

SEQ ID NO: 3168644 - DNA, 23 bp, Homo sapiens
aggggccggggaagctgccagcc

SEQ ID NO: 3168645 - DNA, 13 bp, Homo sapiens
aggggcctggaga

SEQ ID NO: 3168646 - DNA, 18 bp, Homo sapiens
aggggcctggagatcctc

SEQ ID NO: 3168647 - DNA, 22 bp, Homo sapiens
aggggcctggagatcctcctgc

SEQ ID NO: 3168648 - DNA, 12 bp, Homo sapiens
aggggcctggca

SEQ ID NO: 3168649 - DNA, 13 bp, Homo sapiens
aggggcctggcag

SEQ ID NO: 3168650 - DNA, 14 bp, Homo sapiens
aggggccttgctga

SEQ ID NO: 3168651 - DNA, 13 bp, Homo sapiens
aggggcgctggcc

SEQ ID NO: 3168652 - DNA, 16 bp, Homo sapiens
aggggcgctggcccag

SEQ ID NO: 3168653 - DNA, 17 bp, Homo sapiens
aggggcgctggcccagc

SEQ ID NO: 3168654 - DNA, 19 bp, Homo sapiens
aggggcgctggcccagccg

SEQ ID NO: 3168655 - DNA, 13 bp, Homo sapiens
aggggcggggcag

SEQ ID NO: 3168656 - DNA, 14 bp, Homo sapiens
aggggcggggcagg

SEQ ID NO: 3168657 - DNA, 16 bp, Homo sapiens
aggggcggggcaggaa

SEQ ID NO: 3168658 - DNA, 18 bp, Homo sapiens
aggggcggtgcccacacc

SEQ ID NO: 3168659 - DNA, 17 bp, Homo sapiens
aggggctacaagaggga

SEQ ID NO: 3168660 - DNA, 18 bp, Homo sapiens
aggggctacaagagggaa

SEQ ID NO: 3168661 - DNA, 17 bp, Homo sapiens
aggggctctcagctcag

SEQ ID NO: 3168662 - DNA, 13 bp, Homo sapiens
aggggctgacact

SEQ ID NO: 3168663 - DNA, 14 bp, Homo sapiens
aggggctgagtgag

SEQ ID NO: 3168664 - DNA, 16 bp, Homo sapiens
aggggctgctggggca

SEQ ID NO: 3168665 - DNA, 18 bp, Homo sapiens
aggggctgctggggcatg

SEQ ID NO: 3168666 - DNA, 20 bp, Homo sapiens
aggggctgctggggcatgtg

SEQ ID NO: 3168667 - DNA, 15 bp, Homo sapiens
aggggctgcttcctc

SEQ ID NO: 3168668 - DNA, 20 bp, Homo sapiens
aggggctgcttcctcctgga

SEQ ID NO: 3168669 - DNA, 14 bp, Homo sapiens
aggggctggggact

SEQ ID NO: 3168670 - DNA, 12 bp, Homo sapiens
aggggctggggc

SEQ ID NO: 3168671 - DNA, 19 bp, Homo sapiens
aggggctgtggccgtctcc

SEQ ID NO: 3168672 - DNA, 21 bp, Homo sapiens
aggggctgtggccgtctcctc

SEQ ID NO: 3168673 - DNA, 15 bp, Homo sapiens
aggggcttcctgggt

SEQ ID NO: 3168674 - DNA, 14 bp, Homo sapiens
aggggctttctgga

SEQ ID NO: 3168675 - DNA, 16 bp, Homo sapiens
aggggctttctggaga

SEQ ID NO: 3168676 - DNA, 17 bp, Homo sapiens
aggggctttctggagag

SEQ ID NO: 3168677 - DNA, 22 bp, Homo sapiens
agggggaaggtggggtcctgga

SEQ ID NO: 3168678 - DNA, 16 bp, Homo sapiens
agggggaggggaagtc

SEQ ID NO: 3168679 - DNA, 20 bp, Homo sapiens
agggggagggggttacaaac

SEQ ID NO: 3168680 - DNA, 16 bp, Homo sapiens
agggggatgccactcc

SEQ ID NO: 3168681 - DNA, 18 bp, Homo sapiens
agggggccccgccagggc

SEQ ID NO: 3168682 - DNA, 22 bp, Homo sapiens
agggggccccgccagggctggg

SEQ ID NO: 3168683 - DNA, 12 bp, Homo sapiens
agggggccctgc

SEQ ID NO: 3168684 - DNA, 13 bp, Homo sapiens
agggggccctgct

SEQ ID NO: 3168685 - DNA, 14 bp, Homo sapiens
agggggccctgcta

SEQ ID NO: 3168686 - DNA, 15 bp, Homo sapiens
agggggccctgctac

SEQ ID NO: 3168687 - DNA, 22 bp, Homo sapiens
agggggcgctcaggacccaggc

SEQ ID NO: 3168688 - DNA, 23 bp, Homo sapiens
agggggcgttatttatggaccac

SEQ ID NO: 3168689 - DNA, 11 bp, Homo sapiens
agggggctctc

SEQ ID NO: 3168690 - DNA, 22 bp, Homo sapiens
agggggctctccaaaggggctg

SEQ ID NO: 3168691 - DNA, 14 bp, Homo sapiens
aggggggagctggg

SEQ ID NO: 3168692 - DNA, 23 bp, Homo sapiens
aggggggggtatttcaattacct

SEQ ID NO: 3168693 - DNA, 14 bp, Homo sapiens
aggggggggtgggg

SEQ ID NO: 3168694 - DNA, 19 bp, Homo sapiens
agggggtcccagtgggagg

SEQ ID NO: 3168695 - DNA, 24 bp, Homo sapiens
agggggtcccagtgggaggggcag

SEQ ID NO: 3168696 - DNA, 23 bp, Homo sapiens
agggggtgattagagggaggaga

SEQ ID NO: 3168697 - DNA, 12 bp, Homo sapiens
agggggttacaa

SEQ ID NO: 3168698 - DNA, 20 bp, Homo sapiens
agggggttacaaactgcaat

SEQ ID NO: 3168699 - DNA, 18 bp, Homo sapiens
aggggtaggatgtacagg

SEQ ID NO: 3168700 - DNA, 14 bp, Homo sapiens
aggggtcaaagaaa

SEQ ID NO: 3168701 - DNA, 15 bp, Homo sapiens
aggggtcaggctcca

SEQ ID NO: 3168702 - DNA, 16 bp, Homo sapiens
aggggtcaggctccat

SEQ ID NO: 3168703 - DNA, 13 bp, Homo sapiens
aggggtccctgct

SEQ ID NO: 3168704 - DNA, 21 bp, Homo sapiens
aggggtcggctgaccatgctc

SEQ ID NO: 3168705 - DNA, 14 bp, Homo sapiens
aggggtctccctgg

SEQ ID NO: 3168706 - DNA, 19 bp, Homo sapiens
aggggtgagtcccctactc

SEQ ID NO: 3168707 - DNA, 23 bp, Homo sapiens
aggggtgcacccactcaccaggg

SEQ ID NO: 3168708 - DNA, 11 bp, Homo sapiens
aggggtgcccc

SEQ ID NO: 3168709 - DNA, 13 bp, Homo sapiens
aggggtgccccct

SEQ ID NO: 3168710 - DNA, 16 bp, Homo sapiens
aggggtgccccctcct

SEQ ID NO: 3168711 - DNA, 13 bp, Homo sapiens
aggggtggtcctg

SEQ ID NO: 3168712 - DNA, 15 bp, Homo sapiens
aggggtggtcctgac

SEQ ID NO: 3168713 - DNA, 24 bp, Homo sapiens
aggggtgtcttgggcagagctggc

SEQ ID NO: 3168714 - DNA, 19 bp, Homo sapiens
aggggttgccacaggcctc

SEQ ID NO: 3168715 - DNA, 22 bp, Homo sapiens
aggggttgccacaggcctccct

SEQ ID NO: 3168716 - DNA, 23 bp, Homo sapiens
aggggttgccacaggcctccctg

SEQ ID NO: 3168717 - DNA, 21 bp, Homo sapiens
aggggttggggtgacagtcat

SEQ ID NO: 3168718 - DNA, 17 bp, Homo sapiens
aggggtttggtctggga

SEQ ID NO: 3168719 - DNA, 11 bp, Homo sapiens
agggtaaatca

SEQ ID NO: 3168720 - DNA, 23 bp, Homo sapiens
agggtaaatcagtaagaggtgtt

SEQ ID NO: 3168721 - DNA, 15 bp, Homo sapiens
agggtacagctgggc

SEQ ID NO: 3168722 - DNA, 18 bp, Homo sapiens
agggtaccctttggggag

SEQ ID NO: 3168723 - DNA, 20 bp, Homo sapiens
agggtaccctttggggagca

SEQ ID NO: 3168724 - DNA, 21 bp, Homo sapiens
agggtaccctttggggagcag

SEQ ID NO: 3168725 - DNA, 19 bp, Homo sapiens
agggtagaatgattaatca

SEQ ID NO: 3168726 - DNA, 14 bp, Homo sapiens
agggtagccttgat

SEQ ID NO: 3168727 - DNA, 17 bp, Homo sapiens
agggtagctgggcgggg

SEQ ID NO: 3168728 - DNA, 17 bp, Homo sapiens
agggtagtctggtttct

SEQ ID NO: 3168729 - DNA, 18 bp, Homo sapiens
agggtatcaggtgctgcc

SEQ ID NO: 3168730 - DNA, 19 bp, Homo sapiens
agggtatcaggtgctgcca

SEQ ID NO: 3168731 - DNA, 16 bp, Homo sapiens
agggtcagtggaagcc

SEQ ID NO: 3168732 - DNA, 20 bp, Homo sapiens
agggtcccatttctcactga

SEQ ID NO: 3168733 - DNA, 14 bp, Homo sapiens
agggtccctctgtg

SEQ ID NO: 3168734 - DNA, 15 bp, Homo sapiens
agggtccctctgtgt

SEQ ID NO: 3168735 - DNA, 17 bp, Homo sapiens
agggtccgcaccagctg

SEQ ID NO: 3168736 - DNA, 19 bp, Homo sapiens
agggtccgcaccagctgct

SEQ ID NO: 3168737 - DNA, 23 bp, Homo sapiens
agggtccgcaccagctgctctgc

SEQ ID NO: 3168738 - DNA, 20 bp, Homo sapiens
agggtcctgccggtgggacc

SEQ ID NO: 3168739 - DNA, 20 bp, Homo sapiens
agggtcctttagtacctgaa

SEQ ID NO: 3168740 - DNA, 22 bp, Homo sapiens
agggtccttttgacactgctct

SEQ ID NO: 3168741 - DNA, 16 bp, Homo sapiens
agggtcgaaagctcta

SEQ ID NO: 3168742 - DNA, 22 bp, Homo sapiens
agggtcgaaagctctagaatct

SEQ ID NO: 3168743 - DNA, 21 bp, Homo sapiens
agggtctcactatgttgccca

SEQ ID NO: 3168744 - DNA, 22 bp, Homo sapiens
agggtctcactatgttgcccag

SEQ ID NO: 3168745 - DNA, 22 bp, Homo sapiens
agtactgaagccaaatgaaact

SEQ ID NO: 3168746 - DNA, 21 bp, Homo sapiens
agtactgtaataatacctcaa

SEQ ID NO: 3168747 - DNA, 23 bp, Homo sapiens
agtactgtaataatacctcaatg

SEQ ID NO: 3168748 - DNA, 17 bp, Homo sapiens
agtactgtttaccattt

SEQ ID NO: 3168749 - DNA, 13 bp, Homo sapiens
agtacttccctca

SEQ ID NO: 3168750 - DNA, 20 bp, Homo sapiens
agtacttctccaccctgctc

SEQ ID NO: 3168751 - DNA, 12 bp, Homo sapiens
agtacttctttt

SEQ ID NO: 3168752 - DNA, 18 bp, Homo sapiens
agtacttgagtgtaatgt

SEQ ID NO: 3168753 - DNA, 22 bp, Homo sapiens
agtacttgagtgtaatgtttgt

SEQ ID NO: 3168754 - DNA, 18 bp, Homo sapiens
agtactttaaaaaggaaa

SEQ ID NO: 3168755 - DNA, 21 bp, Homo sapiens
agtactttaaaaaggaaattt

SEQ ID NO: 3168756 - DNA, 15 bp, Homo sapiens
agtactttattgtac

SEQ ID NO: 3168757 - DNA, 19 bp, Homo sapiens
agtacttttgttgtatggg

SEQ ID NO: 3168758 - DNA, 20 bp, Homo sapiens
agtacttttgttgtatggga

SEQ ID NO: 3168759 - DNA, 15 bp, Homo sapiens
agtagaaataaaagt

SEQ ID NO: 3168760 - DNA, 18 bp, Homo sapiens
agtagaaataatatgcat

SEQ ID NO: 3168761 - DNA, 14 bp, Homo sapiens
agtagaaattttac

SEQ ID NO: 3168762 - DNA, 20 bp, Homo sapiens
agtagaagatttgatgctgg

SEQ ID NO: 3168763 - DNA, 19 bp, Homo sapiens
agtagaagtcttagatgta

SEQ ID NO: 3168764 - DNA, 14 bp, Homo sapiens
agtagaataaaaac

SEQ ID NO: 3168765 - DNA, 14 bp, Homo sapiens
agtagaattaccat

SEQ ID NO: 3168766 - DNA, 21 bp, Homo sapiens
agtagaccttgttacttctga

SEQ ID NO: 3168767 - DNA, 14 bp, Homo sapiens
agtagagtcatctc

SEQ ID NO: 3168768 - DNA, 17 bp, Homo sapiens
agtagagtcatctccat

SEQ ID NO: 3168769 - DNA, 15 bp, Homo sapiens
agtagatctatatta

SEQ ID NO: 3168770 - DNA, 20 bp, Homo sapiens
agtagattgcagaaaattct

SEQ ID NO: 3168771 - DNA, 14 bp, Homo sapiens
agtagcatgagaga

SEQ ID NO: 3168772 - DNA, 19 bp, Homo sapiens
agtagcatgttgagccagg

SEQ ID NO: 3168773 - DNA, 20 bp, Homo sapiens
agtagcatgttgagccaggc

SEQ ID NO: 3168774 - DNA, 15 bp, Homo sapiens
agtagccctttctgt

SEQ ID NO: 3168775 - DNA, 23 bp, Homo sapiens
agtagctgggactacagatgtgg

SEQ ID NO: 3168776 - DNA, 21 bp, Homo sapiens
agtagctgggactacaggcac

SEQ ID NO: 3168777 - DNA, 22 bp, Homo sapiens
agtagctgtggcctcaccctga

SEQ ID NO: 3168778 - DNA, 13 bp, Homo sapiens
agtagcttgctcc

SEQ ID NO: 3168779 - DNA, 16 bp, Homo sapiens
agtagcttgctccctg

SEQ ID NO: 3168780 - DNA, 17 bp, Homo sapiens
agtagcttgctccctgt

SEQ ID NO: 3168781 - DNA, 23 bp, Homo sapiens
agtaggatatagcgaaaggcgag

SEQ ID NO: 3168782 - DNA, 17 bp, Homo sapiens
agtaggcttttaccatt

SEQ ID NO: 3168783 - DNA, 22 bp, Homo sapiens
agtaggcttttaccattagcat

SEQ ID NO: 3168784 - DNA, 16 bp, Homo sapiens
agtagtaatagagcaa

SEQ ID NO: 3168785 - DNA, 13 bp, Homo sapiens
agtagtctgctca

SEQ ID NO: 3168786 - DNA, 14 bp, Homo sapiens
agtagtctgctcac

SEQ ID NO: 3168787 - DNA, 17 bp, Homo sapiens
agtagttggtttgtatg

SEQ ID NO: 3168788 - DNA, 22 bp, Homo sapiens
agtagttggtttgtatgagatg

SEQ ID NO: 3168789 - DNA, 14 bp, Homo sapiens
agtagttgtattct

SEQ ID NO: 3168790 - DNA, 14 bp, Homo sapiens
agtagtttggtttg

SEQ ID NO: 3168791 - DNA, 15 bp, Homo sapiens
agtataaaaacttga

SEQ ID NO: 3168792 - DNA, 19 bp, Homo sapiens
agtataaacaaagttacta

SEQ ID NO: 3168793 - DNA, 19 bp, Homo sapiens
agtataaccatatgatact

SEQ ID NO: 3168794 - DNA, 12 bp, Homo sapiens
agtataatcttt

SEQ ID NO: 3168795 - DNA, 15 bp, Homo sapiens
agtatacaatatata

SEQ ID NO: 3168796 - DNA, 21 bp, Homo sapiens
agtatacaatatataaaaata

SEQ ID NO: 3168797 - DNA, 23 bp, Homo sapiens
agtatacaatatataaaaatata

SEQ ID NO: 3168798 - DNA, 19 bp, Homo sapiens
agtatacctcatttttcat

SEQ ID NO: 3168799 - DNA, 16 bp, Homo sapiens
agtatactgtgtggga

SEQ ID NO: 3168800 - DNA, 14 bp, Homo sapiens
agtatagagagaag

SEQ ID NO: 3168801 - DNA, 20 bp, Homo sapiens
agtatagccacaaatgcctt

SEQ ID NO: 3168802 - DNA, 15 bp, Homo sapiens
agtatatctggacaa

SEQ ID NO: 3168803 - DNA, 16 bp, Homo sapiens
agtatatctggacaag

SEQ ID NO: 3168804 - DNA, 15 bp, Homo sapiens
agtatattatgtatt

SEQ ID NO: 3168805 - DNA, 11 bp, Homo sapiens
agtatattctt

SEQ ID NO: 3168806 - DNA, 21 bp, Homo sapiens
agtatattcttattggaaatg

SEQ ID NO: 3168807 - DNA, 14 bp, Homo sapiens
agtatattgttgaa

SEQ ID NO: 3168808 - DNA, 18 bp, Homo sapiens
agtatattgttgaagaga

SEQ ID NO: 3168809 - DNA, 15 bp, Homo sapiens
agtatatttaaactc

SEQ ID NO: 3168810 - DNA, 15 bp, Homo sapiens
agtatcaggtctccc

SEQ ID NO: 3168811 - DNA, 13 bp, Homo sapiens
agtatcagtgttt

SEQ ID NO: 3168812 - DNA, 17 bp, Homo sapiens
agtatcagtgttttaaa

SEQ ID NO: 3168813 - DNA, 12 bp, Homo sapiens
agtatcccacat

SEQ ID NO: 3168814 - DNA, 18 bp, Homo sapiens
agtatcccacatccaact

SEQ ID NO: 3168815 - DNA, 19 bp, Homo sapiens
agtatctatatatgtgtat

SEQ ID NO: 3168816 - DNA, 22 bp, Homo sapiens
agtatctatatatgtgtatgta

SEQ ID NO: 3168817 - DNA, 15 bp, Homo sapiens
agtatctgtatctct

SEQ ID NO: 3168818 - DNA, 16 bp, Homo sapiens
agtatgaataaagaca

SEQ ID NO: 3168819 - DNA, 13 bp, Homo sapiens
agtatgaatatta

SEQ ID NO: 3168820 - DNA, 20 bp, Homo sapiens
agtatgacgctgatacataa

SEQ ID NO: 3168821 - DNA, 21 bp, Homo sapiens
agtatgcattattaaattgta

SEQ ID NO: 3168822 - DNA, 14 bp, Homo sapiens
agtatggtggctgg

SEQ ID NO: 3168823 - DNA, 14 bp, Homo sapiens
agtatggttcaaga

SEQ ID NO: 3168824 - DNA, 15 bp, Homo sapiens
agtatggttcaagat

SEQ ID NO: 3168825 - DNA, 22 bp, Homo sapiens
agtatggttcaagattgttgat

SEQ ID NO: 3168826 - DNA, 14 bp, Homo sapiens
agtatgtctgatgg

SEQ ID NO: 3168827 - DNA, 18 bp, Homo sapiens
agtatgtctgtttttgta

SEQ ID NO: 3168828 - DNA, 14 bp, Homo sapiens
agtatgtgactttt

SEQ ID NO: 3168829 - DNA, 21 bp, Homo sapiens
agtatgtgacttttctgatta

SEQ ID NO: 3168830 - DNA, 22 bp, Homo sapiens
agtatgtgacttttctgattaa

SEQ ID NO: 3168831 - DNA, 23 bp, Homo sapiens
agtatgtgggcagattttcagca

SEQ ID NO: 3168832 - DNA, 19 bp, Homo sapiens
agtattaaaagttgcattt

SEQ ID NO: 3168833 - DNA, 15 bp, Homo sapiens
agtattaacttacaa

SEQ ID NO: 3168834 - DNA, 15 bp, Homo sapiens
agtattacttctgct

SEQ ID NO: 3168835 - DNA, 23 bp, Homo sapiens
agtattatcttgttcaggaaaag

SEQ ID NO: 3168836 - DNA, 12 bp, Homo sapiens
agtattatgcat

SEQ ID NO: 3168837 - DNA, 22 bp, Homo sapiens
agtattcctttatacacagtgg

SEQ ID NO: 3168838 - DNA, 23 bp, Homo sapiens
agtattcgctgtgttcatggtct

SEQ ID NO: 3168839 - DNA, 22 bp, Homo sapiens
agtattctcagagcatgtgtca

SEQ ID NO: 3168840 - DNA, 15 bp, Homo sapiens
agtattcttgtcaaa

SEQ ID NO: 3168841 - DNA, 18 bp, Homo sapiens
agtattggggtctgaccc

SEQ ID NO: 3168842 - DNA, 15 bp, Homo sapiens
agtatttaaatgttc

SEQ ID NO: 3168843 - DNA, 12 bp, Homo sapiens
agtatttatata

SEQ ID NO: 3168844 - DNA, 13 bp, Homo sapiens
agtatttatatat

SEQ ID NO: 3168845 - DNA, 16 bp, Homo sapiens
agtatttatatattta

SEQ ID NO: 3168846 - DNA, 13 bp, Homo sapiens
agtatttatgggt

SEQ ID NO: 3168847 - DNA, 17 bp, Homo sapiens
agtatttcaactgctgt

SEQ ID NO: 3168848 - DNA, 23 bp, Homo sapiens
agtatttcagtgtagttaattta

SEQ ID NO: 3168849 - DNA, 21 bp, Homo sapiens
agtatttcattgcctgtgtat

SEQ ID NO: 3168850 - DNA, 18 bp, Homo sapiens
agtatttctcctttgcaa

SEQ ID NO: 3168851 - DNA, 19 bp, Homo sapiens
agtatttctcctttgcaat

SEQ ID NO: 3168852 - DNA, 21 bp, Homo sapiens
agtatttgtcgtgtgtagaaa

SEQ ID NO: 3168853 - DNA, 12 bp, Homo sapiens
agtattttaatc

SEQ ID NO: 3168854 - DNA, 14 bp, Homo sapiens
agtattttcccaat

SEQ ID NO: 3168855 - DNA, 13 bp, Homo sapiens
agtatttttataa

SEQ ID NO: 3168856 - DNA, 19 bp, Homo sapiens
agtatttttatacaaacct

SEQ ID NO: 3168857 - DNA, 14 bp, Homo sapiens
agtatttttatcca

SEQ ID NO: 3168858 - DNA, 22 bp, Homo sapiens
agtattttttgtataattggat

SEQ ID NO: 3168859 - DNA, 17 bp, Homo sapiens
agtcaaaactacaaatc

SEQ ID NO: 3168860 - DNA, 15 bp, Homo sapiens
agtcaaaactatttt

SEQ ID NO: 3168861 - DNA, 21 bp, Homo sapiens
agtcaaaactatttttgtaaa

SEQ ID NO: 3168862 - DNA, 23 bp, Homo sapiens
agtcaaaaggaacaaaaattaca

SEQ ID NO: 3168863 - DNA, 18 bp, Homo sapiens
agtcaaacatttcaaagt

SEQ ID NO: 3168864 - DNA, 18 bp, Homo sapiens
agtcaaaggcatctccct

SEQ ID NO: 3168865 - DNA, 22 bp, Homo sapiens
agtcaaatggtaggcatttcct

SEQ ID NO: 3168866 - DNA, 23 bp, Homo sapiens
agtcaaatggtaggcatttccta

SEQ ID NO: 3168867 - DNA, 15 bp, Homo sapiens
agtcaaattaataat

SEQ ID NO: 3168868 - DNA, 20 bp, Homo sapiens
agtcaaattaataatcttat

SEQ ID NO: 3168869 - DNA, 22 bp, Homo sapiens
agtcaaattaataatcttatta

SEQ ID NO: 3168870 - DNA, 17 bp, Homo sapiens
agtcaaatttacattta

SEQ ID NO: 3168871 - DNA, 20 bp, Homo sapiens
agtctttttctgttgtaact

SEQ ID NO: 3168872 - DNA, 22 bp, Homo sapiens
agtgaaaaatatgttgagtgtt

SEQ ID NO: 3168873 - DNA, 16 bp, Homo sapiens
agtgaaaattctgttg

SEQ ID NO: 3168874 - DNA, 16 bp, Homo sapiens
agtgaaacacttgctt

SEQ ID NO: 3168875 - DNA, 13 bp, Homo sapiens
agtgaaccacagg

SEQ ID NO: 3168876 - DNA, 19 bp, Homo sapiens
agtgaaccacaggttttag

SEQ ID NO: 3168877 - DNA, 20 bp, Homo sapiens
agtgaactacgcttgctcat

SEQ ID NO: 3168878 - DNA, 21 bp, Homo sapiens
agtgaagactagaaaattaga

SEQ ID NO: 3168879 - DNA, 21 bp, Homo sapiens
agtgaagaggggcagcccttg

SEQ ID NO: 3168880 - DNA, 16 bp, Homo sapiens
agtgaagatgtttact

SEQ ID NO: 3168881 - DNA, 15 bp, Homo sapiens
agtgaaggtctttgt

SEQ ID NO: 3168882 - DNA, 13 bp, Homo sapiens
agtgaataaatgt

SEQ ID NO: 3168883 - DNA, 15 bp, Homo sapiens
agtgaatctgtttca

SEQ ID NO: 3168884 - DNA, 13 bp, Homo sapiens
agtgaatgaaaga

SEQ ID NO: 3168885 - DNA, 13 bp, Homo sapiens
agtgaattgtctt

SEQ ID NO: 3168886 - DNA, 20 bp, Homo sapiens
agtgaattgtcttttagaca

SEQ ID NO: 3168887 - DNA, 18 bp, Homo sapiens
agtgaatttctaaatgtt

SEQ ID NO: 3168888 - DNA, 20 bp, Homo sapiens
agtgaatttgaatgaaaaat

SEQ ID NO: 3168889 - DNA, 21 bp, Homo sapiens
agtgacaaagactcctctggg

SEQ ID NO: 3168890 - DNA, 17 bp, Homo sapiens
agtgacacagcagcttc

SEQ ID NO: 3168891 - DNA, 16 bp, Homo sapiens
agtgacagacaggctc

SEQ ID NO: 3168892 - DNA, 17 bp, Homo sapiens
agtgacagacaggctct

SEQ ID NO: 3168893 - DNA, 14 bp, Homo sapiens
agtgacagaggcag

SEQ ID NO: 3168894 - DNA, 15 bp, Homo sapiens
agtgacagtattttg

SEQ ID NO: 3168895 - DNA, 19 bp, Homo sapiens
agtgacagtggattgcatt

SEQ ID NO: 3168896 - DNA, 20 bp, Homo sapiens
agtgacagtggattgcattt

SEQ ID NO: 3168897 - DNA, 13 bp, Homo sapiens
agtgaccacttat

SEQ ID NO: 3168898 - DNA, 14 bp, Homo sapiens
agtgaccccagaaa

SEQ ID NO: 3168899 - DNA, 13 bp, Homo sapiens
agtgacccttccc

SEQ ID NO: 3168900 - DNA, 21 bp, Homo sapiens
agtgacccttcccaatcagca

SEQ ID NO: 3168901 - DNA, 15 bp, Homo sapiens
agtgactcctgctgg

SEQ ID NO: 3168902 - DNA, 15 bp, Homo sapiens
agtgactggcaggtg

SEQ ID NO: 3168903 - DNA, 16 bp, Homo sapiens
agtgactgtaattaat

SEQ ID NO: 3168904 - DNA, 17 bp, Homo sapiens
agtgactttaaaagaaa

SEQ ID NO: 3168905 - DNA, 19 bp, Homo sapiens
agtgactttaaaagaaaat

SEQ ID NO: 3168906 - DNA, 15 bp, Homo sapiens
agtgagacaaaattt

SEQ ID NO: 3168907 - DNA, 16 bp, Homo sapiens
agtgagaccctgtctc

SEQ ID NO: 3168908 - DNA, 16 bp, Homo sapiens
agtgagaccttgtctc

SEQ ID NO: 3168909 - DNA, 18 bp, Homo sapiens
agtgagactgactgcaag

SEQ ID NO: 3168910 - DNA, 13 bp, Homo sapiens
agtgagagggcat

SEQ ID NO: 3168911 - DNA, 22 bp, Homo sapiens
agtgagcactaaggtgtgctct

SEQ ID NO: 3168912 - DNA, 18 bp, Homo sapiens
agtgagccgagatagcac

SEQ ID NO: 3168913 - DNA, 23 bp, Homo sapiens
agtgagccgagattgcaccactg

SEQ ID NO: 3168914 - DNA, 11 bp, Homo sapiens
agtgagcctga

SEQ ID NO: 3168915 - DNA, 13 bp, Homo sapiens
agtgagcctggct

SEQ ID NO: 3168916 - DNA, 15 bp, Homo sapiens
agtgagcctggctct

SEQ ID NO: 3168917 - DNA, 16 bp, Homo sapiens
agtgagctacagagcc

SEQ ID NO: 3168918 - DNA, 21 bp, Homo sapiens
agtgagctgggcatggtacca

SEQ ID NO: 3168919 - DNA, 24 bp, Homo sapiens
agtgagcttgtaattgcaccactg

SEQ ID NO: 3168920 - DNA, 21 bp, Homo sapiens
agtgaggattttgttgatacc

SEQ ID NO: 3168921 - DNA, 14 bp, Homo sapiens
agtgaggcttccag

SEQ ID NO: 3168922 - DNA, 15 bp, Homo sapiens
agtgaggcttccagg

SEQ ID NO: 3168923 - DNA, 17 bp, Homo sapiens
agtgaggcttccaggct

SEQ ID NO: 3168924 - DNA, 19 bp, Homo sapiens
agtgaggcttccaggctct

SEQ ID NO: 3168925 - DNA, 22 bp, Homo sapiens
agtgaggtgtgtcacaatgaga

SEQ ID NO: 3168926 - DNA, 16 bp, Homo sapiens
agtgagtcgaggacag

SEQ ID NO: 3168927 - DNA, 14 bp, Homo sapiens
agtgagtgagcctg

SEQ ID NO: 3168928 - DNA, 23 bp, Homo sapiens
agtgagtgtgctgactttttaac

SEQ ID NO: 3168929 - DNA, 14 bp, Homo sapiens
agtgagttcaacta

SEQ ID NO: 3168930 - DNA, 19 bp, Homo sapiens
agtgataattttatttata

SEQ ID NO: 3168931 - DNA, 14 bp, Homo sapiens
agtgataggcccaa

SEQ ID NO: 3168932 - DNA, 16 bp, Homo sapiens
agtgataggcccaagg

SEQ ID NO: 3168933 - DNA, 14 bp, Homo sapiens
agtgatatggcaga

SEQ ID NO: 3168934 - DNA, 17 bp, Homo sapiens
agtgatatggcagaaga

SEQ ID NO: 3168935 - DNA, 16 bp, Homo sapiens
agtgatcaataaaatg

SEQ ID NO: 3168936 - DNA, 20 bp, Homo sapiens
agtgatcatttaaaaagctc

SEQ ID NO: 3168937 - DNA, 20 bp, Homo sapiens
agtgatcctcccacctcagc

SEQ ID NO: 3168938 - DNA, 24 bp, Homo sapiens
agtgatcctcccacctcagcctcc

SEQ ID NO: 3168939 - DNA, 21 bp, Homo sapiens
agtgatctatgtttgtgtgat

SEQ ID NO: 3168940 - DNA, 21 bp, Homo sapiens
agtgatctccatatgttacac

SEQ ID NO: 3168941 - DNA, 21 bp, Homo sapiens
agtgatgctgtgctatgaatt

SEQ ID NO: 3168942 - DNA, 21 bp, Homo sapiens
agtgatggcgcgggaggcacc

SEQ ID NO: 3168943 - DNA, 16 bp, Homo sapiens
agtgatgtaccatgaa

SEQ ID NO: 3168944 - DNA, 19 bp, Homo sapiens
agtgatgttcagatttcta

SEQ ID NO: 3168945 - DNA, 14 bp, Homo sapiens
agtgattctcctgc

SEQ ID NO: 3168946 - DNA, 24 bp, Homo sapiens
agtgattgtgtctgcattgttatt

SEQ ID NO: 3168947 - DNA, 16 bp, Homo sapiens
agtgatttccatctct

SEQ ID NO: 3168948 - DNA, 15 bp, Homo sapiens
agtgatttctagaaa

SEQ ID NO: 3168949 - DNA, 20 bp, Homo sapiens
agtgcacacagaaatatata

SEQ ID NO: 3168950 - DNA, 13 bp, Homo sapiens
agtgcacagctgt

SEQ ID NO: 3168951 - DNA, 15 bp, Homo sapiens
agtgcacagctgtcc

SEQ ID NO: 3168952 - DNA, 18 bp, Homo sapiens
agtgcacggggcacagcg

SEQ ID NO: 3168953 - DNA, 15 bp, Homo sapiens
agtgcacttttttat

SEQ ID NO: 3168954 - DNA, 18 bp, Homo sapiens
agtgcacttttttatgaa

SEQ ID NO: 3168955 - DNA, 16 bp, Homo sapiens
agtgcagaaatgaaat

SEQ ID NO: 3168956 - DNA, 16 bp, Homo sapiens
agtgcagacaggccat

SEQ ID NO: 3168957 - DNA, 16 bp, Homo sapiens
agtgcagcagaggaca

SEQ ID NO: 3168958 - DNA, 14 bp, Homo sapiens
agtgcagccactgg

SEQ ID NO: 3168959 - DNA, 15 bp, Homo sapiens
agtgcagctgatttt

SEQ ID NO: 3168960 - DNA, 17 bp, Homo sapiens
agtgcagtgagccgaga

SEQ ID NO: 3168961 - DNA, 21 bp, Homo sapiens
agtgcatagttgtagacaaag

SEQ ID NO: 3168962 - DNA, 16 bp, Homo sapiens
agtgcatattcctttc

SEQ ID NO: 3168963 - DNA, 18 bp, Homo sapiens
agtgcatattcctttcta

SEQ ID NO: 3168964 - DNA, 12 bp, Homo sapiens
agtgcatgatgg

SEQ ID NO: 3168965 - DNA, 18 bp, Homo sapiens
agtgcatgtgaagcatgc

SEQ ID NO: 3168966 - DNA, 21 bp, Homo sapiens
agtgcatttgtgctagaaatt

SEQ ID NO: 3168967 - DNA, 15 bp, Homo sapiens
agtgccaaacagagt

SEQ ID NO: 3168968 - DNA, 16 bp, Homo sapiens
agtgccaactcctcac

SEQ ID NO: 3168969 - DNA, 18 bp, Homo sapiens
agtgccactgccccccga

SEQ ID NO: 3168970 - DNA, 22 bp, Homo sapiens
agtgccactgcccgagctggtg

SEQ ID NO: 3168971 - DNA, 17 bp, Homo sapiens
agtgccactgttgtttt

SEQ ID NO: 3168972 - DNA, 14 bp, Homo sapiens
agtgccacttaatg

SEQ ID NO: 3168973 - DNA, 20 bp, Homo sapiens
agtgccagaattttaggaac

SEQ ID NO: 3168974 - DNA, 15 bp, Homo sapiens
agtgccagaggtggg

SEQ ID NO: 3168975 - DNA, 19 bp, Homo sapiens
agtgccagaggtgggcagg

SEQ ID NO: 3168976 - DNA, 20 bp, Homo sapiens
agtgccagaggtgggcaggt

SEQ ID NO: 3168977 - DNA, 21 bp, Homo sapiens
agtgccagaggtgggcaggtg

SEQ ID NO: 3168978 - DNA, 15 bp, Homo sapiens
agtgccagcattcca

SEQ ID NO: 3168979 - DNA, 17 bp, Homo sapiens
agtgccagcattccaga

SEQ ID NO: 3168980 - DNA, 21 bp, Homo sapiens
agtgccagcattccagacttc

SEQ ID NO: 3168981 - DNA, 23 bp, Homo sapiens
agtgccagcattccagacttcaa

SEQ ID NO: 3168982 - DNA, 15 bp, Homo sapiens
agtgccatgtaaatc

SEQ ID NO: 3168983 - DNA, 16 bp, Homo sapiens
agtgccattccactcc

SEQ ID NO: 3168984 - DNA, 14 bp, Homo sapiens
agtgccattgtctt

SEQ ID NO: 3168985 - DNA, 15 bp, Homo sapiens
agtgccattgtcttt

SEQ ID NO: 3168986 - DNA, 21 bp, Homo sapiens
agtgccattgtctttatatga

SEQ ID NO: 3168987 - DNA, 10 bp, Homo sapiens
agtgcccaaa

SEQ ID NO: 3168988 - DNA, 17 bp, Homo sapiens
agtgcccaaagtgggga

SEQ ID NO: 3168989 - DNA, 19 bp, Homo sapiens
agtgcccaaagtggggagg

SEQ ID NO: 3168990 - DNA, 18 bp, Homo sapiens
agtgcccaccctgggaga

SEQ ID NO: 3168991 - DNA, 18 bp, Homo sapiens
agtgcccatgtgtacatt

SEQ ID NO: 3168992 - DNA, 19 bp, Homo sapiens
agtgcccgcctaggagttg

SEQ ID NO: 3168993 - DNA, 16 bp, Homo sapiens
agtgccctccacagcc

SEQ ID NO: 3168994 - DNA, 21 bp, Homo sapiens
agtgccctccacagccgcagc

SEQ ID NO: 3168995 - DNA, 13 bp, Homo sapiens
agtgccctgcccc

SEQ ID NO: 3168996 - DNA, 22 bp, Homo sapiens
agtgccctgccccctggctgac

SEQ ID NO: 3168997 - DNA, 13 bp, Homo sapiens
ataaaataaagta

SEQ ID NO: 3168998 - DNA, 15 bp, Homo sapiens
ataaaataattctaa

SEQ ID NO: 3168999 - DNA, 16 bp, Homo sapiens
ataaaataattctaaa

SEQ ID NO: 3169000 - DNA, 18 bp, Homo sapiens
ataaaataattctaaagg

SEQ ID NO: 3169001 - DNA, 17 bp, Homo sapiens
ataaaatactctagcct

SEQ ID NO: 3169002 - DNA, 16 bp, Homo sapiens
ataaaatcaattttta

SEQ ID NO: 3169003 - DNA, 13 bp, Homo sapiens
ataaaatgaaaat

SEQ ID NO: 3169004 - DNA, 16 bp, Homo sapiens
ataaaatgaaaattgt

SEQ ID NO: 3169005 - DNA, 17 bp, Homo sapiens
ataaaatgaaaattgta

SEQ ID NO: 3169006 - DNA, 18 bp, Homo sapiens
ataaaatgaggacatgtt

SEQ ID NO: 3169007 - DNA, 17 bp, Homo sapiens
ataaaatgtaattactt

SEQ ID NO: 3169008 - DNA, 18 bp, Homo sapiens
ataaaatgtgtacagtga

SEQ ID NO: 3169009 - DNA, 23 bp, Homo sapiens
ataaaattaaatgccttgtataa

SEQ ID NO: 3169010 - DNA, 20 bp, Homo sapiens
ataaaatttaaaaaataaat

SEQ ID NO: 3169011 - DNA, 16 bp, Homo sapiens
ataaaattttgctttt

SEQ ID NO: 3169012 - DNA, 16 bp, Homo sapiens
ataaacaacttaatgt

SEQ ID NO: 3169013 - DNA, 18 bp, Homo sapiens
ataaacaatgatgccctg

SEQ ID NO: 3169014 - DNA, 19 bp, Homo sapiens
ataaacactggtgccaacc

SEQ ID NO: 3169015 - DNA, 20 bp, Homo sapiens
ataaacactggtgccaacca

SEQ ID NO: 3169016 - DNA, 14 bp, Homo sapiens
ataaacagacaata

SEQ ID NO: 3169017 - DNA, 15 bp, Homo sapiens
ataaacagatgaata

SEQ ID NO: 3169018 - DNA, 14 bp, Homo sapiens
ataaacagctattt

SEQ ID NO: 3169019 - DNA, 18 bp, Homo sapiens
ataaacagctatttaagg

SEQ ID NO: 3169020 - DNA, 17 bp, Homo sapiens
ataaacaggaattttat

SEQ ID NO: 3169021 - DNA, 21 bp, Homo sapiens
ataaacaggaattttattttg

SEQ ID NO: 3169022 - DNA, 16 bp, Homo sapiens
ataaacattaaaagaa

SEQ ID NO: 3169023 - DNA, 17 bp, Homo sapiens
ataaacattaaatgtct

SEQ ID NO: 3169024 - DNA, 13 bp, Homo sapiens
ataaaccaaagga

SEQ ID NO: 3169025 - DNA, 15 bp, Homo sapiens
ataaaccaaaggaca

SEQ ID NO: 3169026 - DNA, 22 bp, Homo sapiens
ataaaccaaatatgttaaagtt

SEQ ID NO: 3169027 - DNA, 18 bp, Homo sapiens
ataaaccgtttttaacac

SEQ ID NO: 3169028 - DNA, 14 bp, Homo sapiens
ataaactatcagtt

SEQ ID NO: 3169029 - DNA, 18 bp, Homo sapiens
ataaactattggaaagta

SEQ ID NO: 3169030 - DNA, 18 bp, Homo sapiens
ataaactccttaacttca

SEQ ID NO: 3169031 - DNA, 17 bp, Homo sapiens
ataaactgaatattttg

SEQ ID NO: 3169032 - DNA, 22 bp, Homo sapiens
ataaactgaatattttggaaac

SEQ ID NO: 3169033 - DNA, 13 bp, Homo sapiens
ataaactgacttt

SEQ ID NO: 3169034 - DNA, 20 bp, Homo sapiens
ataaactgactttatcctca

SEQ ID NO: 3169035 - DNA, 12 bp, Homo sapiens
ataaactgagcc

SEQ ID NO: 3169036 - DNA, 13 bp, Homo sapiens
ataaactgagcct

SEQ ID NO: 3169037 - DNA, 17 bp, Homo sapiens
ataaactggtatgaata

SEQ ID NO: 3169038 - DNA, 18 bp, Homo sapiens
ataaactggtatgaataa

SEQ ID NO: 3169039 - DNA, 23 bp, Homo sapiens
ataaactggtatgaataattgca

SEQ ID NO: 3169040 - DNA, 19 bp, Homo sapiens
ataaactgtttatataaag

SEQ ID NO: 3169041 - DNA, 17 bp, Homo sapiens
ataaacttggattctct

SEQ ID NO: 3169042 - DNA, 12 bp, Homo sapiens
ataaacttttat

SEQ ID NO: 3169043 - DNA, 21 bp, Homo sapiens
ataaacttttatacttgggta

SEQ ID NO: 3169044 - DNA, 15 bp, Homo sapiens
ataaactttttttca

SEQ ID NO: 3169045 - DNA, 17 bp, Homo sapiens
ataaactttttttcaat

SEQ ID NO: 3169046 - DNA, 19 bp, Homo sapiens
ataaagaaaacttccatag

SEQ ID NO: 3169047 - DNA, 15 bp, Homo sapiens
ataaagaacaaggta

SEQ ID NO: 3169048 - DNA, 22 bp, Homo sapiens
ataaagaactccttattttgta

SEQ ID NO: 3169049 - DNA, 16 bp, Homo sapiens
ataaagacccaggggg

SEQ ID NO: 3169050 - DNA, 16 bp, Homo sapiens
ataaagacctataaat

SEQ ID NO: 3169051 - DNA, 13 bp, Homo sapiens
ataaagagttaga

SEQ ID NO: 3169052 - DNA, 21 bp, Homo sapiens
ataaagataacccttattcca

SEQ ID NO: 3169053 - DNA, 11 bp, Homo sapiens
ataaagatgat

SEQ ID NO: 3169054 - DNA, 16 bp, Homo sapiens
ataaagattgtactta

SEQ ID NO: 3169055 - DNA, 16 bp, Homo sapiens
ataaagcaatgtgttt

SEQ ID NO: 3169056 - DNA, 22 bp, Homo sapiens
ataaagcagcctgattgaaaag

SEQ ID NO: 3169057 - DNA, 20 bp, Homo sapiens
ataaagcataagtatacagt

SEQ ID NO: 3169058 - DNA, 14 bp, Homo sapiens
ataaagcatttata

SEQ ID NO: 3169059 - DNA, 18 bp, Homo sapiens
ataaagcatttataaatt

SEQ ID NO: 3169060 - DNA, 18 bp, Homo sapiens
ataaagcctcaaggtttt

SEQ ID NO: 3169061 - DNA, 17 bp, Homo sapiens
ataaagccttttaaatc

SEQ ID NO: 3169062 - DNA, 20 bp, Homo sapiens
ataaagccttttaaatcatc

SEQ ID NO: 3169063 - DNA, 17 bp, Homo sapiens
ataaagcgatatacaga

SEQ ID NO: 3169064 - DNA, 19 bp, Homo sapiens
ataaagcgatatacagatg

SEQ ID NO: 3169065 - DNA, 22 bp, Homo sapiens
ataaagcgatatacagatgaaa

SEQ ID NO: 3169066 - DNA, 17 bp, Homo sapiens
ataaagcttgtggcccc

SEQ ID NO: 3169067 - DNA, 23 bp, Homo sapiens
ataaaggataactctgtattaca

SEQ ID NO: 3169068 - DNA, 21 bp, Homo sapiens
ataaaggatgtgattgtggaa

SEQ ID NO: 3169069 - DNA, 22 bp, Homo sapiens
ataaaggatgtgattgtggaat

SEQ ID NO: 3169070 - DNA, 11 bp, Homo sapiens
ataaaggcagc

SEQ ID NO: 3169071 - DNA, 12 bp, Homo sapiens
ataaaggcagct

SEQ ID NO: 3169072 - DNA, 14 bp, Homo sapiens
ataaaggcagctgc

SEQ ID NO: 3169073 - DNA, 19 bp, Homo sapiens
ataaaggcagctgcctctg

SEQ ID NO: 3169074 - DNA, 22 bp, Homo sapiens
ataaaggcagctgcctctgctc

SEQ ID NO: 3169075 - DNA, 16 bp, Homo sapiens
ataaaggcagttttct

SEQ ID NO: 3169076 - DNA, 17 bp, Homo sapiens
ataaagggttgaaaatg

SEQ ID NO: 3169077 - DNA, 17 bp, Homo sapiens
ataaaggttttggttgc

SEQ ID NO: 3169078 - DNA, 14 bp, Homo sapiens
ataaagtaaagcta

SEQ ID NO: 3169079 - DNA, 13 bp, Homo sapiens
ataaagtacttga

SEQ ID NO: 3169080 - DNA, 20 bp, Homo sapiens
ataaagtatagagagaagtt

SEQ ID NO: 3169081 - DNA, 14 bp, Homo sapiens
ataaagtatatatt

SEQ ID NO: 3169082 - DNA, 17 bp, Homo sapiens
ataaagtgccttctggg

SEQ ID NO: 3169083 - DNA, 20 bp, Homo sapiens
ataaagtgccttctgggctt

SEQ ID NO: 3169084 - DNA, 16 bp, Homo sapiens
ataaagtgttttcaga

SEQ ID NO: 3169085 - DNA, 21 bp, Homo sapiens
ataaagttctgagtgttttta

SEQ ID NO: 3169086 - DNA, 22 bp, Homo sapiens
ataaagttgaagctaagattta

SEQ ID NO: 3169087 - DNA, 19 bp, Homo sapiens
ataaagtttgcttagaaaa

SEQ ID NO: 3169088 - DNA, 15 bp, Homo sapiens
ataaataaaaatgga

SEQ ID NO: 3169089 - DNA, 17 bp, Homo sapiens
ataaataaaaatggata

SEQ ID NO: 3169090 - DNA, 19 bp, Homo sapiens
ataaataaaactgaatctc

SEQ ID NO: 3169091 - DNA, 13 bp, Homo sapiens
ataaataataaag

SEQ ID NO: 3169092 - DNA, 15 bp, Homo sapiens
ataaataatctgtac

SEQ ID NO: 3169093 - DNA, 12 bp, Homo sapiens
ataaatacatac

SEQ ID NO: 3169094 - DNA, 19 bp, Homo sapiens
ataaatacatacggtcagg

SEQ ID NO: 3169095 - DNA, 15 bp, Homo sapiens
ataaatagaaaagta

SEQ ID NO: 3169096 - DNA, 18 bp, Homo sapiens
ataaatagaaaagtagac

SEQ ID NO: 3169097 - DNA, 15 bp, Homo sapiens
ataaatagctatatc

SEQ ID NO: 3169098 - DNA, 16 bp, Homo sapiens
ataaataggagaggat

SEQ ID NO: 3169099 - DNA, 14 bp, Homo sapiens
ataaatatatataa

SEQ ID NO: 3169100 - DNA, 16 bp, Homo sapiens
ataaatatatataaag

SEQ ID NO: 3169101 - DNA, 21 bp, Homo sapiens
ataaatatatctaccccagac

SEQ ID NO: 3169102 - DNA, 14 bp, Homo sapiens
ataaatatgcagtg

SEQ ID NO: 3169103 - DNA, 14 bp, Homo sapiens
ataaatatttatgt

SEQ ID NO: 3169104 - DNA, 18 bp, Homo sapiens
ataaatatttttgccata

SEQ ID NO: 3169105 - DNA, 15 bp, Homo sapiens
ataaatcaatgtcac

SEQ ID NO: 3169106 - DNA, 14 bp, Homo sapiens
ataaatcacacatt

SEQ ID NO: 3169107 - DNA, 18 bp, Homo sapiens
ataaatcagagagcaagg

SEQ ID NO: 3169108 - DNA, 14 bp, Homo sapiens
ataaatcagtattt

SEQ ID NO: 3169109 - DNA, 17 bp, Homo sapiens
ataaatcagtatttttt

SEQ ID NO: 3169110 - DNA, 15 bp, Homo sapiens
ataaatcataaagtc

SEQ ID NO: 3169111 - DNA, 16 bp, Homo sapiens
ataaatcataaagtca

SEQ ID NO: 3169112 - DNA, 15 bp, Homo sapiens
ataaatcatattgat

SEQ ID NO: 3169113 - DNA, 18 bp, Homo sapiens
ataaatcatattgatgaa

SEQ ID NO: 3169114 - DNA, 20 bp, Homo sapiens
ataaatcatattgatgaaaa

SEQ ID NO: 3169115 - DNA, 14 bp, Homo sapiens
ataaatcatttcag

SEQ ID NO: 3169116 - DNA, 16 bp, Homo sapiens
ataaatcatttcagta

SEQ ID NO: 3169117 - DNA, 15 bp, Homo sapiens
ataaatccaaaacaa

SEQ ID NO: 3169118 - DNA, 17 bp, Homo sapiens
ataaatccaaaacaaac

SEQ ID NO: 3169119 - DNA, 14 bp, Homo sapiens
ataaatcttaaaaa

SEQ ID NO: 3169120 - DNA, 20 bp, Homo sapiens
ataaatgaagcagctttaaa

SEQ ID NO: 3169121 - DNA, 20 bp, Homo sapiens
ataaatggtttggtgctttt

SEQ ID NO: 3169122 - DNA, 21 bp, Homo sapiens
ataaatggtttggtgcttttt

SEQ ID NO: 3169123 - DNA, 17 bp, Homo sapiens
ataaatgtataaatata

SEQ ID NO: 3169124 - DNA, 21 bp, Homo sapiens
atactatttaaagcctcctca

SEQ ID NO: 3169125 - DNA, 16 bp, Homo sapiens
atactatttagatttt

SEQ ID NO: 3169126 - DNA, 20 bp, Homo sapiens
atactcaaatgagtaacatt

SEQ ID NO: 3169127 - DNA, 15 bp, Homo sapiens
atactcagcctgctg

SEQ ID NO: 3169128 - DNA, 20 bp, Homo sapiens
atactcagcctgctgcccag

SEQ ID NO: 3169129 - DNA, 19 bp, Homo sapiens
atactcatcagagcagcta

SEQ ID NO: 3169130 - DNA, 19 bp, Homo sapiens
atactcatttctaaaagaa

SEQ ID NO: 3169131 - DNA, 22 bp, Homo sapiens
atactcatttctaaaagaatat

SEQ ID NO: 3169132 - DNA, 16 bp, Homo sapiens
atactccagtgtacat

SEQ ID NO: 3169133 - DNA, 18 bp, Homo sapiens
atactctctgcctggtgg

SEQ ID NO: 3169134 - DNA, 16 bp, Homo sapiens
atactctgttgtacta

SEQ ID NO: 3169135 - DNA, 19 bp, Homo sapiens
atactcttaggaagagaaa

SEQ ID NO: 3169136 - DNA, 21 bp, Homo sapiens
atactcttaggaagagaaacc

SEQ ID NO: 3169137 - DNA, 17 bp, Homo sapiens
atactgaaaatccaata

SEQ ID NO: 3169138 - DNA, 14 bp, Homo sapiens
atactgaaattatt

SEQ ID NO: 3169139 - DNA, 12 bp, Homo sapiens
atactgaaggaa

SEQ ID NO: 3169140 - DNA, 15 bp, Homo sapiens
atactgaaggaaaaa

SEQ ID NO: 3169141 - DNA, 22 bp, Homo sapiens
atactgaaggaaaaacacaagc

SEQ ID NO: 3169142 - DNA, 17 bp, Homo sapiens
atactgaagtgtgggat

SEQ ID NO: 3169143 - DNA, 15 bp, Homo sapiens
atactgaatgcataa

SEQ ID NO: 3169144 - DNA, 21 bp, Homo sapiens
atactgaatgcataaataaat

SEQ ID NO: 3169145 - DNA, 18 bp, Homo sapiens
atactgactcaacatgga

SEQ ID NO: 3169146 - DNA, 14 bp, Homo sapiens
atactgagggacca

SEQ ID NO: 3169147 - DNA, 20 bp, Homo sapiens
atactgattatgtcttttat

SEQ ID NO: 3169148 - DNA, 12 bp, Homo sapiens
atactgattttt

SEQ ID NO: 3169149 - DNA, 14 bp, Homo sapiens
atactgcaagaaaa

SEQ ID NO: 3169150 - DNA, 18 bp, Homo sapiens
atactgcacagtggcaca

SEQ ID NO: 3169151 - DNA, 19 bp, Homo sapiens
atactgcacagtggcacaa

SEQ ID NO: 3169152 - DNA, 15 bp, Homo sapiens
atactgcatactttt

SEQ ID NO: 3169153 - DNA, 19 bp, Homo sapiens
atactgcgactttctgcct

SEQ ID NO: 3169154 - DNA, 20 bp, Homo sapiens
atactgcggaccaagggact

SEQ ID NO: 3169155 - DNA, 15 bp, Homo sapiens
atactgctactgtaa

SEQ ID NO: 3169156 - DNA, 20 bp, Homo sapiens
atactgctactgtaatttta

SEQ ID NO: 3169157 - DNA, 17 bp, Homo sapiens
atactggaagttttgca

SEQ ID NO: 3169158 - DNA, 13 bp, Homo sapiens
atactggcacaga

SEQ ID NO: 3169159 - DNA, 15 bp, Homo sapiens
atactggcacagagg

SEQ ID NO: 3169160 - DNA, 14 bp, Homo sapiens
atactggcctggac

SEQ ID NO: 3169161 - DNA, 23 bp, Homo sapiens
atactgggacaccattaccaaaa

SEQ ID NO: 3169162 - DNA, 16 bp, Homo sapiens
atactgggttcttgtt

SEQ ID NO: 3169163 - DNA, 16 bp, Homo sapiens
atactgggtttcaaga

SEQ ID NO: 3169164 - DNA, 18 bp, Homo sapiens
atactgggtttcaagaaa

SEQ ID NO: 3169165 - DNA, 21 bp, Homo sapiens
atactggtgcagtcattatga

SEQ ID NO: 3169166 - DNA, 16 bp, Homo sapiens
atactgtacttaataa

SEQ ID NO: 3169167 - DNA, 17 bp, Homo sapiens
atactgtacttaataaa

SEQ ID NO: 3169168 - DNA, 13 bp, Homo sapiens
atactgtatttct

SEQ ID NO: 3169169 - DNA, 16 bp, Homo sapiens
atactgtcccacttct

SEQ ID NO: 3169170 - DNA, 21 bp, Homo sapiens
atactgtcggttttttttaaa

SEQ ID NO: 3169171 - DNA, 20 bp, Homo sapiens
atactgtgcagaataatgga

SEQ ID NO: 3169172 - DNA, 20 bp, Homo sapiens
atactgtgtgggatacttag

SEQ ID NO: 3169173 - DNA, 22 bp, Homo sapiens
atacttaataaatctgccattt

SEQ ID NO: 3169174 - DNA, 21 bp, Homo sapiens
atacttagtggtatgtctctt

SEQ ID NO: 3169175 - DNA, 17 bp, Homo sapiens
atacttatatttcccta

SEQ ID NO: 3169176 - DNA, 23 bp, Homo sapiens
atacttatattttcgtatgaaaa

SEQ ID NO: 3169177 - DNA, 17 bp, Homo sapiens
atacttcaaaaataatg

SEQ ID NO: 3169178 - DNA, 16 bp, Homo sapiens
atacttcaaaagccat

SEQ ID NO: 3169179 - DNA, 17 bp, Homo sapiens
atacttcatttaaaaaa

SEQ ID NO: 3169180 - DNA, 19 bp, Homo sapiens
atacttgactctaatatga

SEQ ID NO: 3169181 - DNA, 17 bp, Homo sapiens
atacttggatttagttt

SEQ ID NO: 3169182 - DNA, 22 bp, Homo sapiens
atacttggatttagtttcagta

SEQ ID NO: 3169183 - DNA, 18 bp, Homo sapiens
atacttgtggttttcaaa

SEQ ID NO: 3169184 - DNA, 17 bp, Homo sapiens
atacttgtttcagcttc

SEQ ID NO: 3169185 - DNA, 14 bp, Homo sapiens
atactttatatctg

SEQ ID NO: 3169186 - DNA, 16 bp, Homo sapiens
atactttatatctgta

SEQ ID NO: 3169187 - DNA, 21 bp, Homo sapiens
atactttatcaatgtgtcttt

SEQ ID NO: 3169188 - DNA, 18 bp, Homo sapiens
atactttcgaaatttcat

SEQ ID NO: 3169189 - DNA, 22 bp, Homo sapiens
atactttcggagaaattctctt

SEQ ID NO: 3169190 - DNA, 16 bp, Homo sapiens
atactttgagttttga

SEQ ID NO: 3169191 - DNA, 16 bp, Homo sapiens
atacttttaaattatg

SEQ ID NO: 3169192 - DNA, 18 bp, Homo sapiens
atacttttcccctgttaa

SEQ ID NO: 3169193 - DNA, 21 bp, Homo sapiens
atacttttcccctgttaaaca

SEQ ID NO: 3169194 - DNA, 12 bp, Homo sapiens
atacttttgcaa

SEQ ID NO: 3169195 - DNA, 20 bp, Homo sapiens
atactttttacaattaaaaa

SEQ ID NO: 3169196 - DNA, 15 bp, Homo sapiens
atagaaaaaaaatct

SEQ ID NO: 3169197 - DNA, 13 bp, Homo sapiens
atagaaaaggaag

SEQ ID NO: 3169198 - DNA, 21 bp, Homo sapiens
atagaaacatgacactgacct

SEQ ID NO: 3169199 - DNA, 13 bp, Homo sapiens
atagaaataaatt

SEQ ID NO: 3169200 - DNA, 18 bp, Homo sapiens
atagaaataaattcctaa

SEQ ID NO: 3169201 - DNA, 14 bp, Homo sapiens
atagaactgggtaa

SEQ ID NO: 3169202 - DNA, 19 bp, Homo sapiens
atagaactgggtaaatgca

SEQ ID NO: 3169203 - DNA, 20 bp, Homo sapiens
atagaactgggtaaatgcaa

SEQ ID NO: 3169204 - DNA, 13 bp, Homo sapiens
atagaaggtgatg

SEQ ID NO: 3169205 - DNA, 21 bp, Homo sapiens
atagaagtttgtccatttgta

SEQ ID NO: 3169206 - DNA, 22 bp, Homo sapiens
atagaagtttgtccatttgtaa

SEQ ID NO: 3169207 - DNA, 18 bp, Homo sapiens
atagaataaaatataatt

SEQ ID NO: 3169208 - DNA, 19 bp, Homo sapiens
atagaataaaggcagtttt

SEQ ID NO: 3169209 - DNA, 13 bp, Homo sapiens
atagaatatttat

SEQ ID NO: 3169210 - DNA, 21 bp, Homo sapiens
atagaatgtggccacttattt

SEQ ID NO: 3169211 - DNA, 13 bp, Homo sapiens
atagaattcagaa

SEQ ID NO: 3169212 - DNA, 22 bp, Homo sapiens
atagaattgtagactgatgttt

SEQ ID NO: 3169213 - DNA, 15 bp, Homo sapiens
atagacaaaaagtat

SEQ ID NO: 3169214 - DNA, 16 bp, Homo sapiens
atagacaaatagaaaa

SEQ ID NO: 3169215 - DNA, 12 bp, Homo sapiens
atagacatgaaa

SEQ ID NO: 3169216 - DNA, 17 bp, Homo sapiens
atagactagagaaaccg

SEQ ID NO: 3169217 - DNA, 20 bp, Homo sapiens
atagactgaggtataaagac

SEQ ID NO: 3169218 - DNA, 21 bp, Homo sapiens
atagactgaggtataaagaca

SEQ ID NO: 3169219 - DNA, 21 bp, Homo sapiens
atagactgccgtgcattagca

SEQ ID NO: 3169220 - DNA, 17 bp, Homo sapiens
atagactggaaaaaatg

SEQ ID NO: 3169221 - DNA, 15 bp, Homo sapiens
atagacttattcttt

SEQ ID NO: 3169222 - DNA, 19 bp, Homo sapiens
atagagaaaaactttcatt

SEQ ID NO: 3169223 - DNA, 14 bp, Homo sapiens
atagagaatttaag

SEQ ID NO: 3169224 - DNA, 17 bp, Homo sapiens
atagagacaatctattt

SEQ ID NO: 3169225 - DNA, 14 bp, Homo sapiens
atagagagagacca

SEQ ID NO: 3169226 - DNA, 17 bp, Homo sapiens
atagagagttgttgtgt

SEQ ID NO: 3169227 - DNA, 21 bp, Homo sapiens
atagagcaaaattgatgtgtt

SEQ ID NO: 3169228 - DNA, 22 bp, Homo sapiens
atagagcaaaattgatgtgttt

SEQ ID NO: 3169229 - DNA, 21 bp, Homo sapiens
atagagcacctagtccagtga

SEQ ID NO: 3169230 - DNA, 15 bp, Homo sapiens
atagagcccctcctg

SEQ ID NO: 3169231 - DNA, 14 bp, Homo sapiens
atagagccctggcc

SEQ ID NO: 3169232 - DNA, 12 bp, Homo sapiens
atagagctttta

SEQ ID NO: 3169233 - DNA, 14 bp, Homo sapiens
atagaggaagaaat

SEQ ID NO: 3169234 - DNA, 16 bp, Homo sapiens
atagaggcattacttg

SEQ ID NO: 3169235 - DNA, 20 bp, Homo sapiens
atagaggcattacttgcttt

SEQ ID NO: 3169236 - DNA, 12 bp, Homo sapiens
atagaggctagc

SEQ ID NO: 3169237 - DNA, 20 bp, Homo sapiens
atagaggctagcttctgctt

SEQ ID NO: 3169238 - DNA, 18 bp, Homo sapiens
atagaggtatattggaag

SEQ ID NO: 3169239 - DNA, 16 bp, Homo sapiens
atagagtatactaaaa

SEQ ID NO: 3169240 - DNA, 21 bp, Homo sapiens
atagagtgtacttaactattc

SEQ ID NO: 3169241 - DNA, 20 bp, Homo sapiens
atagatataatgaacaaaat

SEQ ID NO: 3169242 - DNA, 23 bp, Homo sapiens
atagatataatgaacaaaattat

SEQ ID NO: 3169243 - DNA, 13 bp, Homo sapiens
atagatattttca

SEQ ID NO: 3169244 - DNA, 19 bp, Homo sapiens
atagatctccagcgtcagc

SEQ ID NO: 3169245 - DNA, 21 bp, Homo sapiens
atagatctgatggtgagctgg

SEQ ID NO: 3169246 - DNA, 16 bp, Homo sapiens
atagatgactttgcag

SEQ ID NO: 3169247 - DNA, 22 bp, Homo sapiens
atagatgatggtatgattctat

SEQ ID NO: 3169248 - DNA, 22 bp, Homo sapiens
atagatgtccctttcttggcca

SEQ ID NO: 3169249 - DNA, 21 bp, Homo sapiens
atatcatcaatgtgacattta

SEQ ID NO: 3169250 - DNA, 15 bp, Homo sapiens
atatcatctgtcatt

SEQ ID NO: 3169251 - DNA, 24 bp, Homo sapiens
atatcatctgtcattatattctaa

SEQ ID NO: 3169252 - DNA, 20 bp, Homo sapiens
atatcatgcaaaatatgttt

SEQ ID NO: 3169253 - DNA, 22 bp, Homo sapiens
atatcatgctttaaagtgtaat

SEQ ID NO: 3169254 - DNA, 17 bp, Homo sapiens
atatcattaaattggaa

SEQ ID NO: 3169255 - DNA, 19 bp, Homo sapiens
atatcattctacagaataa

SEQ ID NO: 3169256 - DNA, 20 bp, Homo sapiens
atatcattctacagaataat

SEQ ID NO: 3169257 - DNA, 17 bp, Homo sapiens
atatcattgattttata

SEQ ID NO: 3169258 - DNA, 21 bp, Homo sapiens
atatcatttattttttacatt

SEQ ID NO: 3169259 - DNA, 12 bp, Homo sapiens
atatcattttaa

SEQ ID NO: 3169260 - DNA, 13 bp, Homo sapiens
atatccatctttt

SEQ ID NO: 3169261 - DNA, 12 bp, Homo sapiens
atatccatgtac

SEQ ID NO: 3169262 - DNA, 16 bp, Homo sapiens
atatcccaagtgcact

SEQ ID NO: 3169263 - DNA, 15 bp, Homo sapiens
atatccccactactc

SEQ ID NO: 3169264 - DNA, 13 bp, Homo sapiens
atatcccctgcta

SEQ ID NO: 3169265 - DNA, 15 bp, Homo sapiens
atatccctacatgta

SEQ ID NO: 3169266 - DNA, 17 bp, Homo sapiens
atatccctacatgtatt

SEQ ID NO: 3169267 - DNA, 16 bp, Homo sapiens
atatccctcttgtaag

SEQ ID NO: 3169268 - DNA, 14 bp, Homo sapiens
atatcctatatagg

SEQ ID NO: 3169269 - DNA, 18 bp, Homo sapiens
atatcctgtattcttgtt

SEQ ID NO: 3169270 - DNA, 20 bp, Homo sapiens
atatcctgtgactgtctcac

SEQ ID NO: 3169271 - DNA, 18 bp, Homo sapiens
atatccttatcagagcta

SEQ ID NO: 3169272 - DNA, 16 bp, Homo sapiens
atatcctttctaacaa

SEQ ID NO: 3169273 - DNA, 17 bp, Homo sapiens
atatctaatatatatga

SEQ ID NO: 3169274 - DNA, 18 bp, Homo sapiens
atatctaatatatatgaa

SEQ ID NO: 3169275 - DNA, 19 bp, Homo sapiens
atatctaatatatatgaat

SEQ ID NO: 3169276 - DNA, 14 bp, Homo sapiens
atatctacagatag

SEQ ID NO: 3169277 - DNA, 23 bp, Homo sapiens
atatctaccccagactagatgta

SEQ ID NO: 3169278 - DNA, 18 bp, Homo sapiens
atatctattaatatatgt

SEQ ID NO: 3169279 - DNA, 15 bp, Homo sapiens
atatctcttggaaaa

SEQ ID NO: 3169280 - DNA, 17 bp, Homo sapiens
atatctcttggaaaata

SEQ ID NO: 3169281 - DNA, 17 bp, Homo sapiens
atatctgaaaatgtatg

SEQ ID NO: 3169282 - DNA, 22 bp, Homo sapiens
atatctgaaaatgtatgtgtaa

SEQ ID NO: 3169283 - DNA, 15 bp, Homo sapiens
atatctgaagccctc

SEQ ID NO: 3169284 - DNA, 13 bp, Homo sapiens
atatctgcttcag

SEQ ID NO: 3169285 - DNA, 19 bp, Homo sapiens
atatctggcactgttaata

SEQ ID NO: 3169286 - DNA, 15 bp, Homo sapiens
atatctgtaatggta

SEQ ID NO: 3169287 - DNA, 15 bp, Homo sapiens
atatctgttcacttt

SEQ ID NO: 3169288 - DNA, 19 bp, Homo sapiens
atatcttaaagaaacagct

SEQ ID NO: 3169289 - DNA, 15 bp, Homo sapiens
atatcttatgttaaa

SEQ ID NO: 3169290 - DNA, 19 bp, Homo sapiens
atatcttcacattgtgtga

SEQ ID NO: 3169291 - DNA, 20 bp, Homo sapiens
atatcttcagctctttttgt

SEQ ID NO: 3169292 - DNA, 20 bp, Homo sapiens
atatcttctatatctgaaga

SEQ ID NO: 3169293 - DNA, 13 bp, Homo sapiens
atatcttgccttc

SEQ ID NO: 3169294 - DNA, 16 bp, Homo sapiens
atatctttattaatca

SEQ ID NO: 3169295 - DNA, 12 bp, Homo sapiens
atatctttctgc

SEQ ID NO: 3169296 - DNA, 23 bp, Homo sapiens
atatctttgtgataatttaagag

SEQ ID NO: 3169297 - DNA, 17 bp, Homo sapiens
atatctttttcattatt

SEQ ID NO: 3169298 - DNA, 20 bp, Homo sapiens
atatgaaactctacatttaa

SEQ ID NO: 3169299 - DNA, 13 bp, Homo sapiens
atatgaaagctga

SEQ ID NO: 3169300 - DNA, 13 bp, Homo sapiens
atatgaacatata

SEQ ID NO: 3169301 - DNA, 19 bp, Homo sapiens
atatgaacatattgttgaa

SEQ ID NO: 3169302 - DNA, 20 bp, Homo sapiens
atatgaacctattttcattt

SEQ ID NO: 3169303 - DNA, 22 bp, Homo sapiens
atatgaacctattttcatttgt

SEQ ID NO: 3169304 - DNA, 15 bp, Homo sapiens
atatgaattgtacag

SEQ ID NO: 3169305 - DNA, 17 bp, Homo sapiens
atatgaatttaaatata

SEQ ID NO: 3169306 - DNA, 20 bp, Homo sapiens
atatgacggaagaacataga

SEQ ID NO: 3169307 - DNA, 23 bp, Homo sapiens
atatgagccggttattacttctg

SEQ ID NO: 3169308 - DNA, 21 bp, Homo sapiens
atatgagcttccttctgtgaa

SEQ ID NO: 3169309 - DNA, 16 bp, Homo sapiens
atatgagtatacaata

SEQ ID NO: 3169310 - DNA, 18 bp, Homo sapiens
atatgagtatacaatata

SEQ ID NO: 3169311 - DNA, 21 bp, Homo sapiens
atatgagtatacaatatataa

SEQ ID NO: 3169312 - DNA, 20 bp, Homo sapiens
atatgagtgtggaagccgga

SEQ ID NO: 3169313 - DNA, 16 bp, Homo sapiens
atatgatatgtaaaca

SEQ ID NO: 3169314 - DNA, 18 bp, Homo sapiens
atatgatcattgaaatac

SEQ ID NO: 3169315 - DNA, 20 bp, Homo sapiens
atatgatccagagcagagtt

SEQ ID NO: 3169316 - DNA, 13 bp, Homo sapiens
atatgatttatag

SEQ ID NO: 3169317 - DNA, 19 bp, Homo sapiens
atatgattttatttgacaa

SEQ ID NO: 3169318 - DNA, 13 bp, Homo sapiens
atatgcaagcagc

SEQ ID NO: 3169319 - DNA, 14 bp, Homo sapiens
atatgcaagcagct

SEQ ID NO: 3169320 - DNA, 16 bp, Homo sapiens
atatgcaagcagcttt

SEQ ID NO: 3169321 - DNA, 18 bp, Homo sapiens
atatgccctcaagtaaaa

SEQ ID NO: 3169322 - DNA, 22 bp, Homo sapiens
atatgccctcaagtaaaagaaa

SEQ ID NO: 3169323 - DNA, 17 bp, Homo sapiens
atatgctctgcatgtta

SEQ ID NO: 3169324 - DNA, 14 bp, Homo sapiens
atatgctctgcttt

SEQ ID NO: 3169325 - DNA, 17 bp, Homo sapiens
atatgctctgcttttag

SEQ ID NO: 3169326 - DNA, 22 bp, Homo sapiens
atatgctgaacgcagaagaaag

SEQ ID NO: 3169327 - DNA, 22 bp, Homo sapiens
atatgctgccaaattttggcca

SEQ ID NO: 3169328 - DNA, 22 bp, Homo sapiens
atatgctgtatagcctttgtca

SEQ ID NO: 3169329 - DNA, 19 bp, Homo sapiens
atatgcttatacacttaca

SEQ ID NO: 3169330 - DNA, 13 bp, Homo sapiens
atatggaaccttc

SEQ ID NO: 3169331 - DNA, 16 bp, Homo sapiens
atatggaaccttccct

SEQ ID NO: 3169332 - DNA, 19 bp, Homo sapiens
atatggaaccttccctcca

SEQ ID NO: 3169333 - DNA, 20 bp, Homo sapiens
atatggaaccttccctccaa

SEQ ID NO: 3169334 - DNA, 16 bp, Homo sapiens
atatggaagaaagtaa

SEQ ID NO: 3169335 - DNA, 15 bp, Homo sapiens
atatggactctgcac

SEQ ID NO: 3169336 - DNA, 18 bp, Homo sapiens
atatggatgattcagaaa

SEQ ID NO: 3169337 - DNA, 16 bp, Homo sapiens
atatggcaaaaatggc

SEQ ID NO: 3169338 - DNA, 16 bp, Homo sapiens
atatggctagttttca

SEQ ID NO: 3169339 - DNA, 15 bp, Homo sapiens
atatggctataaata

SEQ ID NO: 3169340 - DNA, 12 bp, Homo sapiens
atatggctgccc

SEQ ID NO: 3169341 - DNA, 14 bp, Homo sapiens
atatggctgcccag

SEQ ID NO: 3169342 - DNA, 17 bp, Homo sapiens
atatggctgcccaggag

SEQ ID NO: 3169343 - DNA, 19 bp, Homo sapiens
atatggcttcaagttgtaa

SEQ ID NO: 3169344 - DNA, 22 bp, Homo sapiens
atatgggtttataattttctga

SEQ ID NO: 3169345 - DNA, 23 bp, Homo sapiens
atatggtgcagagaagctggact

SEQ ID NO: 3169346 - DNA, 16 bp, Homo sapiens
atatgtaacaagccac

SEQ ID NO: 3169347 - DNA, 17 bp, Homo sapiens
atatgtaacaagccacc

SEQ ID NO: 3169348 - DNA, 14 bp, Homo sapiens
atatgtaagtactt

SEQ ID NO: 3169349 - DNA, 12 bp, Homo sapiens
atatgtagaaac

SEQ ID NO: 3169350 - DNA, 16 bp, Homo sapiens
atatgtagactatata

SEQ ID NO: 3169351 - DNA, 19 bp, Homo sapiens
atatgtagactatatacat

SEQ ID NO: 3169352 - DNA, 17 bp, Homo sapiens
atatgtatatgacattt

SEQ ID NO: 3169353 - DNA, 21 bp, Homo sapiens
atatgtatatgacatttaaat

SEQ ID NO: 3169354 - DNA, 23 bp, Homo sapiens
atatgtatatttttttaatttaa

SEQ ID NO: 3169355 - DNA, 13 bp, Homo sapiens
atatgtatgcttt

SEQ ID NO: 3169356 - DNA, 17 bp, Homo sapiens
atatgtatgggtagggt

SEQ ID NO: 3169357 - DNA, 23 bp, Homo sapiens
atatgtatgggtagggtaaatca

SEQ ID NO: 3169358 - DNA, 17 bp, Homo sapiens
atatgtattacaaatgg

SEQ ID NO: 3169359 - DNA, 17 bp, Homo sapiens
atatgtattatttataa

SEQ ID NO: 3169360 - DNA, 18 bp, Homo sapiens
atatgtattatttataat

SEQ ID NO: 3169361 - DNA, 18 bp, Homo sapiens
atatgtattcccttgtat

SEQ ID NO: 3169362 - DNA, 21 bp, Homo sapiens
atatgtgaatcctcttcttta

SEQ ID NO: 3169363 - DNA, 20 bp, Homo sapiens
atatgtgagtgccttttgca

SEQ ID NO: 3169364 - DNA, 18 bp, Homo sapiens
atatgtgctggaattcta

SEQ ID NO: 3169365 - DNA, 19 bp, Homo sapiens
atatgtgctggaattctaa

SEQ ID NO: 3169366 - DNA, 13 bp, Homo sapiens
atatgtgtatata

SEQ ID NO: 3169367 - DNA, 16 bp, Homo sapiens
atatgtgtatgtacgt

SEQ ID NO: 3169368 - DNA, 16 bp, Homo sapiens
atatgtgtgtgtatgt

SEQ ID NO: 3169369 - DNA, 11 bp, Homo sapiens
atatgttaaag

SEQ ID NO: 3169370 - DNA, 14 bp, Homo sapiens
atatgttaaagttt

SEQ ID NO: 3169371 - DNA, 15 bp, Homo sapiens
atatgttaaagttta

SEQ ID NO: 3169372 - DNA, 20 bp, Homo sapiens
atatgttaacctcagtgtca

SEQ ID NO: 3169373 - DNA, 20 bp, Homo sapiens
atatgttggggtttttttaa

SEQ ID NO: 3169374 - DNA, 22 bp, Homo sapiens
atatgttggggtttttttaaga

SEQ ID NO: 3169375 - DNA, 20 bp, Homo sapiens
atcagtgggcaggataaact

SEQ ID NO: 3169376 - DNA, 14 bp, Homo sapiens
atcagtgtctcaca

SEQ ID NO: 3169377 - DNA, 15 bp, Homo sapiens
atcagtgtctcacac

SEQ ID NO: 3169378 - DNA, 12 bp, Homo sapiens
atcagtgttaaa

SEQ ID NO: 3169379 - DNA, 13 bp, Homo sapiens
atcagtgttaaaa

SEQ ID NO: 3169380 - DNA, 19 bp, Homo sapiens
atcagtgttaaaaaatttt

SEQ ID NO: 3169381 - DNA, 21 bp, Homo sapiens
atcagtgttgttgctctagga

SEQ ID NO: 3169382 - DNA, 15 bp, Homo sapiens
atcagttactggtat

SEQ ID NO: 3169383 - DNA, 22 bp, Homo sapiens
atcagttatacagttataaaat

SEQ ID NO: 3169384 - DNA, 17 bp, Homo sapiens
atcagttatcctttgtg

SEQ ID NO: 3169385 - DNA, 18 bp, Homo sapiens
atcagttatcctttgtga

SEQ ID NO: 3169386 - DNA, 19 bp, Homo sapiens
atcagttatcctttgtgag

SEQ ID NO: 3169387 - DNA, 21 bp, Homo sapiens
atcagttatcctttgtgagcc

SEQ ID NO: 3169388 - DNA, 14 bp, Homo sapiens
atcagttattcatt

SEQ ID NO: 3169389 - DNA, 16 bp, Homo sapiens
atcagttattcattct

SEQ ID NO: 3169390 - DNA, 19 bp, Homo sapiens
atcagttcccccagtacct

SEQ ID NO: 3169391 - DNA, 20 bp, Homo sapiens
atcagttcccccagtacctc

SEQ ID NO: 3169392 - DNA, 17 bp, Homo sapiens
atcagttcctttgtgtg

SEQ ID NO: 3169393 - DNA, 18 bp, Homo sapiens
atcagtttcatgaaatga

SEQ ID NO: 3169394 - DNA, 19 bp, Homo sapiens
atcataaaagtgattcttt

SEQ ID NO: 3169395 - DNA, 12 bp, Homo sapiens
atcataaaataa

SEQ ID NO: 3169396 - DNA, 13 bp, Homo sapiens
atcataaaataaa

SEQ ID NO: 3169397 - DNA, 16 bp, Homo sapiens
atcataagtgaattta

SEQ ID NO: 3169398 - DNA, 12 bp, Homo sapiens
atcataattaca

SEQ ID NO: 3169399 - DNA, 13 bp, Homo sapiens
atcataattacat

SEQ ID NO: 3169400 - DNA, 16 bp, Homo sapiens
atcataattacattcc

SEQ ID NO: 3169401 - DNA, 19 bp, Homo sapiens
atcataattacattcctaa

SEQ ID NO: 3169402 - DNA, 16 bp, Homo sapiens
atcatactgattttta

SEQ ID NO: 3169403 - DNA, 15 bp, Homo sapiens
atcatagaaatgtaa

SEQ ID NO: 3169404 - DNA, 21 bp, Homo sapiens
atcataggaagggaccaaggc

SEQ ID NO: 3169405 - DNA, 16 bp, Homo sapiens
atcataggtatttcaa

SEQ ID NO: 3169406 - DNA, 13 bp, Homo sapiens
atcatataaacat

SEQ ID NO: 3169407 - DNA, 19 bp, Homo sapiens
atcatatgtgtctttatag

SEQ ID NO: 3169408 - DNA, 22 bp, Homo sapiens
atcatattaaaattacagatgt

SEQ ID NO: 3169409 - DNA, 14 bp, Homo sapiens
atcatcaaaaagaa

SEQ ID NO: 3169410 - DNA, 14 bp, Homo sapiens
atcatcagtgcctc

SEQ ID NO: 3169411 - DNA, 15 bp, Homo sapiens
atcatcatgtagaat

SEQ ID NO: 3169412 - DNA, 22 bp, Homo sapiens
atcatcatgtagaatatggcta

SEQ ID NO: 3169413 - DNA, 14 bp, Homo sapiens
atcatcccagctgc

SEQ ID NO: 3169414 - DNA, 22 bp, Homo sapiens
atcatcctggaggggtgttgta

SEQ ID NO: 3169415 - DNA, 15 bp, Homo sapiens
atcatcctgttttct

SEQ ID NO: 3169416 - DNA, 21 bp, Homo sapiens
atcatcctttaggtaagaagt

SEQ ID NO: 3169417 - DNA, 22 bp, Homo sapiens
atcatcctttgttctgagcatt

SEQ ID NO: 3169418 - DNA, 15 bp, Homo sapiens
atcatcgaaaattca

SEQ ID NO: 3169419 - DNA, 16 bp, Homo sapiens
atcatcgccagaggtg

SEQ ID NO: 3169420 - DNA, 20 bp, Homo sapiens
atcatcgccagaggtgcttc

SEQ ID NO: 3169421 - DNA, 24 bp, Homo sapiens
atcatcggagtcagccaggagctg

SEQ ID NO: 3169422 - DNA, 16 bp, Homo sapiens
atcatctataaagaag

SEQ ID NO: 3169423 - DNA, 18 bp, Homo sapiens
atcatctataaagaagaa

SEQ ID NO: 3169424 - DNA, 17 bp, Homo sapiens
atcatctgcagttcttt

SEQ ID NO: 3169425 - DNA, 22 bp, Homo sapiens
atcatctgcagttctttttgta

SEQ ID NO: 3169426 - DNA, 13 bp, Homo sapiens
atcatctgtcatt

SEQ ID NO: 3169427 - DNA, 15 bp, Homo sapiens
atcatgaaatatgca

SEQ ID NO: 3169428 - DNA, 16 bp, Homo sapiens
atcatgaaatatgcat

SEQ ID NO: 3169429 - DNA, 16 bp, Homo sapiens
atcatgaatgctttta

SEQ ID NO: 3169430 - DNA, 21 bp, Homo sapiens
atcatgaattcccttttaatc

SEQ ID NO: 3169431 - DNA, 19 bp, Homo sapiens
atcatgcccggtcccaccc

SEQ ID NO: 3169432 - DNA, 24 bp, Homo sapiens
atcatgccttgataaatatatatg

SEQ ID NO: 3169433 - DNA, 17 bp, Homo sapiens
atcatgctttaaagtgt

SEQ ID NO: 3169434 - DNA, 17 bp, Homo sapiens
atcatggtgtaataaga

SEQ ID NO: 3169435 - DNA, 19 bp, Homo sapiens
atcatggtgtaataagaca

SEQ ID NO: 3169436 - DNA, 21 bp, Homo sapiens
atcatggtgtaataagacata

SEQ ID NO: 3169437 - DNA, 21 bp, Homo sapiens
atcatgtactttggcatcttt

SEQ ID NO: 3169438 - DNA, 11 bp, Homo sapiens
atcatgtatgt

SEQ ID NO: 3169439 - DNA, 18 bp, Homo sapiens
atcatgtcaggcctgtgt

SEQ ID NO: 3169440 - DNA, 16 bp, Homo sapiens
atcatgtcgatcctgg

SEQ ID NO: 3169441 - DNA, 14 bp, Homo sapiens
atcatgtctggcta

SEQ ID NO: 3169442 - DNA, 21 bp, Homo sapiens
atcatgtgctcagaagaggaa

SEQ ID NO: 3169443 - DNA, 22 bp, Homo sapiens
atcatgtgctcagaagaggaaa

SEQ ID NO: 3169444 - DNA, 18 bp, Homo sapiens
atcatgtgggtgagccag

SEQ ID NO: 3169445 - DNA, 17 bp, Homo sapiens
atcatgttatgatttgt

SEQ ID NO: 3169446 - DNA, 21 bp, Homo sapiens
atcatgttgttaaaattatga

SEQ ID NO: 3169447 - DNA, 23 bp, Homo sapiens
atcattaaattggaattttctta

SEQ ID NO: 3169448 - DNA, 11 bp, Homo sapiens
atcattaatac

SEQ ID NO: 3169449 - DNA, 17 bp, Homo sapiens
atcattacccttccctg

SEQ ID NO: 3169450 - DNA, 16 bp, Homo sapiens
atcattataaacgtga

SEQ ID NO: 3169451 - DNA, 12 bp, Homo sapiens
atcattcagaaa

SEQ ID NO: 3169452 - DNA, 15 bp, Homo sapiens
atcattccagtgcta

SEQ ID NO: 3169453 - DNA, 15 bp, Homo sapiens
atcattccctctcat

SEQ ID NO: 3169454 - DNA, 17 bp, Homo sapiens
atcattctacagaataa

SEQ ID NO: 3169455 - DNA, 18 bp, Homo sapiens
atcattctacagaataat

SEQ ID NO: 3169456 - DNA, 12 bp, Homo sapiens
atcattctttta

SEQ ID NO: 3169457 - DNA, 14 bp, Homo sapiens
atcattgaaatact

SEQ ID NO: 3169458 - DNA, 15 bp, Homo sapiens
atcattgaaatactt

SEQ ID NO: 3169459 - DNA, 15 bp, Homo sapiens
atcattgaagtatat

SEQ ID NO: 3169460 - DNA, 21 bp, Homo sapiens
atcattgcactctagcctggg

SEQ ID NO: 3169461 - DNA, 23 bp, Homo sapiens
atcattgctttgaagcagttgtg

SEQ ID NO: 3169462 - DNA, 23 bp, Homo sapiens
atcattgtttaggggtgaaggag

SEQ ID NO: 3169463 - DNA, 19 bp, Homo sapiens
atcatttccgttttgcctg

SEQ ID NO: 3169464 - DNA, 14 bp, Homo sapiens
atcatttgaggaat

SEQ ID NO: 3169465 - DNA, 18 bp, Homo sapiens
atcatttgatttaaacaa

SEQ ID NO: 3169466 - DNA, 18 bp, Homo sapiens
atcatttgttggaatgaa

SEQ ID NO: 3169467 - DNA, 17 bp, Homo sapiens
atcattttaaaaacttt

SEQ ID NO: 3169468 - DNA, 14 bp, Homo sapiens
atcattttaattat

SEQ ID NO: 3169469 - DNA, 13 bp, Homo sapiens
atcatttttcact

SEQ ID NO: 3169470 - DNA, 13 bp, Homo sapiens
atcatttttgtac

SEQ ID NO: 3169471 - DNA, 20 bp, Homo sapiens
atcatttttgtacagtttgc

SEQ ID NO: 3169472 - DNA, 18 bp, Homo sapiens
atccaaaaatagccctgc

SEQ ID NO: 3169473 - DNA, 13 bp, Homo sapiens
atccaaaagcttt

SEQ ID NO: 3169474 - DNA, 19 bp, Homo sapiens
atccaaaatattttttgca

SEQ ID NO: 3169475 - DNA, 16 bp, Homo sapiens
atccaaaatgaatgca

SEQ ID NO: 3169476 - DNA, 22 bp, Homo sapiens
atccaaagaacttgatttgcat

SEQ ID NO: 3169477 - DNA, 16 bp, Homo sapiens
atccaaagactgtact

SEQ ID NO: 3169478 - DNA, 19 bp, Homo sapiens
atccaaatcttgaatttct

SEQ ID NO: 3169479 - DNA, 18 bp, Homo sapiens
atccaaccccccacctgc

SEQ ID NO: 3169480 - DNA, 20 bp, Homo sapiens
atccaaccccccacctgcca

SEQ ID NO: 3169481 - DNA, 16 bp, Homo sapiens
atccaactaatgcctt

SEQ ID NO: 3169482 - DNA, 20 bp, Homo sapiens
atccaactaatgccttactc

SEQ ID NO: 3169483 - DNA, 14 bp, Homo sapiens
atccaactccagca

SEQ ID NO: 3169484 - DNA, 16 bp, Homo sapiens
atccaactccagcaac

SEQ ID NO: 3169485 - DNA, 14 bp, Homo sapiens
atccaactccagga

SEQ ID NO: 3169486 - DNA, 15 bp, Homo sapiens
atccaacttccaaga

SEQ ID NO: 3169487 - DNA, 12 bp, Homo sapiens
atccaagcctcc

SEQ ID NO: 3169488 - DNA, 18 bp, Homo sapiens
atccaagcctccacagcg

SEQ ID NO: 3169489 - DNA, 14 bp, Homo sapiens
atccaagctccctg

SEQ ID NO: 3169490 - DNA, 18 bp, Homo sapiens
atccaagctggtcccact

SEQ ID NO: 3169491 - DNA, 14 bp, Homo sapiens
atccaaggagaaac

SEQ ID NO: 3169492 - DNA, 22 bp, Homo sapiens
atccaaggagaaacagagacag

SEQ ID NO: 3169493 - DNA, 13 bp, Homo sapiens
atccaaggcaaac

SEQ ID NO: 3169494 - DNA, 16 bp, Homo sapiens
atccaaggcaaacaat

SEQ ID NO: 3169495 - DNA, 23 bp, Homo sapiens
atccaagtaccaatgctgttgta

SEQ ID NO: 3169496 - DNA, 22 bp, Homo sapiens
atccaatattttctttaatgct

SEQ ID NO: 3169497 - DNA, 24 bp, Homo sapiens
atccaatattttctttaatgcttt

SEQ ID NO: 3169498 - DNA, 14 bp, Homo sapiens
atccaatcctcact

SEQ ID NO: 3169499 - DNA, 16 bp, Homo sapiens
atccacacacagagga

SEQ ID NO: 3169500 - DNA, 23 bp, Homo sapiens
atccacacacagaggaagagcag

SEQ ID NO: 3169501 - DNA, 16 bp, Homo sapiens
atcgggaacagtgttt

SEQ ID NO: 3169502 - DNA, 17 bp, Homo sapiens
atcgggagcagtgtctt

SEQ ID NO: 3169503 - DNA, 14 bp, Homo sapiens
atcggtaggcaaag

SEQ ID NO: 3169504 - DNA, 21 bp, Homo sapiens
atcggtgaaactaacagataa

SEQ ID NO: 3169505 - DNA, 19 bp, Homo sapiens
atcgtagaaaatttgcttt

SEQ ID NO: 3169506 - DNA, 16 bp, Homo sapiens
atcgtccttcctctca

SEQ ID NO: 3169507 - DNA, 13 bp, Homo sapiens
atcgtctaaactt

SEQ ID NO: 3169508 - DNA, 14 bp, Homo sapiens
atcgtgacaacact

SEQ ID NO: 3169509 - DNA, 20 bp, Homo sapiens
atcgtgacccttcagggcca

SEQ ID NO: 3169510 - DNA, 21 bp, Homo sapiens
atcgtgacccttcagggccag

SEQ ID NO: 3169511 - DNA, 12 bp, Homo sapiens
atcgtgctaaat

SEQ ID NO: 3169512 - DNA, 15 bp, Homo sapiens
atcgttccagttccc

SEQ ID NO: 3169513 - DNA, 15 bp, Homo sapiens
atcgttggaaaataa

SEQ ID NO: 3169514 - DNA, 19 bp, Homo sapiens
atctaaaaatagacttaaa

SEQ ID NO: 3169515 - DNA, 19 bp, Homo sapiens
atctaaaagaaatgtctat

SEQ ID NO: 3169516 - DNA, 18 bp, Homo sapiens
atctaaacgtggtcacct

SEQ ID NO: 3169517 - DNA, 19 bp, Homo sapiens
atctaaacgtggtcacctt

SEQ ID NO: 3169518 - DNA, 21 bp, Homo sapiens
atctaaacgtggtcaccttcg

SEQ ID NO: 3169519 - DNA, 15 bp, Homo sapiens
atctaaagcagcagg

SEQ ID NO: 3169520 - DNA, 20 bp, Homo sapiens
atctaaagctttggacaagt

SEQ ID NO: 3169521 - DNA, 23 bp, Homo sapiens
atctaaagtgtgttgttgcttta

SEQ ID NO: 3169522 - DNA, 18 bp, Homo sapiens
atctaaatctatttatta

SEQ ID NO: 3169523 - DNA, 17 bp, Homo sapiens
atctaaatttaattacc

SEQ ID NO: 3169524 - DNA, 19 bp, Homo sapiens
atctaacaataatatttca

SEQ ID NO: 3169525 - DNA, 23 bp, Homo sapiens
atctaacaataatatttcaagtg

SEQ ID NO: 3169526 - DNA, 16 bp, Homo sapiens
atctaacaatggaaga

SEQ ID NO: 3169527 - DNA, 18 bp, Homo sapiens
atctaagcctttccataa

SEQ ID NO: 3169528 - DNA, 20 bp, Homo sapiens
atctaaggatgtcacagggc

SEQ ID NO: 3169529 - DNA, 15 bp, Homo sapiens
atctaagtgatataa

SEQ ID NO: 3169530 - DNA, 17 bp, Homo sapiens
atctaatacctctgtgt

SEQ ID NO: 3169531 - DNA, 21 bp, Homo sapiens
atctaatagcgggttactttc

SEQ ID NO: 3169532 - DNA, 22 bp, Homo sapiens
atctaatatatatgaataaagt

SEQ ID NO: 3169533 - DNA, 15 bp, Homo sapiens
atctaatctcttatt

SEQ ID NO: 3169534 - DNA, 18 bp, Homo sapiens
atctaatctcttattcta

SEQ ID NO: 3169535 - DNA, 13 bp, Homo sapiens
atctaattctgat

SEQ ID NO: 3169536 - DNA, 14 bp, Homo sapiens
atctaatttataaa

SEQ ID NO: 3169537 - DNA, 23 bp, Homo sapiens
atctaatttataaaaaggtgttt

SEQ ID NO: 3169538 - DNA, 19 bp, Homo sapiens
atctacaatctctttttgt

SEQ ID NO: 3169539 - DNA, 23 bp, Homo sapiens
atctacagatcctttttccatca

SEQ ID NO: 3169540 - DNA, 21 bp, Homo sapiens
atctacccaagggcagaaagt

SEQ ID NO: 3169541 - DNA, 14 bp, Homo sapiens
atctaccccagact

SEQ ID NO: 3169542 - DNA, 21 bp, Homo sapiens
atctaccccagactagatgta

SEQ ID NO: 3169543 - DNA, 22 bp, Homo sapiens
atctaccccagactagatgtag

SEQ ID NO: 3169544 - DNA, 23 bp, Homo sapiens
atctacttctgtaattgtgtgga

SEQ ID NO: 3169545 - DNA, 19 bp, Homo sapiens
atctagattatggagcttt

SEQ ID NO: 3169546 - DNA, 22 bp, Homo sapiens
atctagccagagcccttcactg

SEQ ID NO: 3169547 - DNA, 14 bp, Homo sapiens
atctagtgcagctg

SEQ ID NO: 3169548 - DNA, 21 bp, Homo sapiens
atctagtgcagctgattttaa

SEQ ID NO: 3169549 - DNA, 22 bp, Homo sapiens
atctagtgcagctgattttaac

SEQ ID NO: 3169550 - DNA, 16 bp, Homo sapiens
atctagtttacagaaa

SEQ ID NO: 3169551 - DNA, 20 bp, Homo sapiens
atctagtttacagaaaaatc

SEQ ID NO: 3169552 - DNA, 18 bp, Homo sapiens
atctagttttttttgtaa

SEQ ID NO: 3169553 - DNA, 13 bp, Homo sapiens
atctataaagaag

SEQ ID NO: 3169554 - DNA, 21 bp, Homo sapiens
atctataaagcgatatacaga

SEQ ID NO: 3169555 - DNA, 16 bp, Homo sapiens
atctatacatatcttt

SEQ ID NO: 3169556 - DNA, 13 bp, Homo sapiens
atctatatataat

SEQ ID NO: 3169557 - DNA, 17 bp, Homo sapiens
atctatatatgtgtatg

SEQ ID NO: 3169558 - DNA, 17 bp, Homo sapiens
atctatcgagtttgcaa

SEQ ID NO: 3169559 - DNA, 16 bp, Homo sapiens
atctatctagttctaa

SEQ ID NO: 3169560 - DNA, 19 bp, Homo sapiens
atctatctcatctatctca

SEQ ID NO: 3169561 - DNA, 13 bp, Homo sapiens
atctatcttccaa

SEQ ID NO: 3169562 - DNA, 13 bp, Homo sapiens
atctatgaggaaa

SEQ ID NO: 3169563 - DNA, 23 bp, Homo sapiens
atctatgagggtgtttcctctaa

SEQ ID NO: 3169564 - DNA, 17 bp, Homo sapiens
atctatggtcgggagac

SEQ ID NO: 3169565 - DNA, 22 bp, Homo sapiens
atctatgtttgtgtgatttcct

SEQ ID NO: 3169566 - DNA, 20 bp, Homo sapiens
atctattaaaattgccattt

SEQ ID NO: 3169567 - DNA, 21 bp, Homo sapiens
atctattcagacaagcaacag

SEQ ID NO: 3169568 - DNA, 19 bp, Homo sapiens
atctattctcaaagttaaa

SEQ ID NO: 3169569 - DNA, 19 bp, Homo sapiens
atctatttttggcagtctg

SEQ ID NO: 3169570 - DNA, 23 bp, Homo sapiens
atctatttttggcagtctgaatt

SEQ ID NO: 3169571 - DNA, 18 bp, Homo sapiens
atctcaaggaatctttaa

SEQ ID NO: 3169572 - DNA, 22 bp, Homo sapiens
atctcaccccatcccacaccct

SEQ ID NO: 3169573 - DNA, 15 bp, Homo sapiens
atctcagaaagtgcc

SEQ ID NO: 3169574 - DNA, 16 bp, Homo sapiens
atctcagaaagtgcct

SEQ ID NO: 3169575 - DNA, 18 bp, Homo sapiens
atctcagaaagtgcctga

SEQ ID NO: 3169576 - DNA, 19 bp, Homo sapiens
atctcagaaagtgcctgac

SEQ ID NO: 3169577 - DNA, 15 bp, Homo sapiens
atctcagagtccact

SEQ ID NO: 3169578 - DNA, 11 bp, Homo sapiens
atctcagccca

SEQ ID NO: 3169579 - DNA, 12 bp, Homo sapiens
atctcagcctcc

SEQ ID NO: 3169580 - DNA, 20 bp, Homo sapiens
atctcagcctcctgagcctg

SEQ ID NO: 3169581 - DNA, 13 bp, Homo sapiens
atctcagctttga

SEQ ID NO: 3169582 - DNA, 23 bp, Homo sapiens
atctcagctttgagaagccttca

SEQ ID NO: 3169583 - DNA, 14 bp, Homo sapiens
atctcaggagatgg

SEQ ID NO: 3169584 - DNA, 15 bp, Homo sapiens
atctcaggggccaga

SEQ ID NO: 3169585 - DNA, 20 bp, Homo sapiens
atctcaggggctgtttgagg

SEQ ID NO: 3169586 - DNA, 19 bp, Homo sapiens
atctcataatgctttgtta

SEQ ID NO: 3169587 - DNA, 15 bp, Homo sapiens
atctcatactgtctg

SEQ ID NO: 3169588 - DNA, 17 bp, Homo sapiens
atctcataggttgccaa

SEQ ID NO: 3169589 - DNA, 23 bp, Homo sapiens
atctcataggttgccaataatac

SEQ ID NO: 3169590 - DNA, 16 bp, Homo sapiens
atctcattcagtatta

SEQ ID NO: 3169591 - DNA, 20 bp, Homo sapiens
atctccaagataagcctgag

SEQ ID NO: 3169592 - DNA, 21 bp, Homo sapiens
atctccaagataagcctgagc

SEQ ID NO: 3169593 - DNA, 19 bp, Homo sapiens
atctccacagtcaaagaag

SEQ ID NO: 3169594 - DNA, 15 bp, Homo sapiens
atctccactccagat

SEQ ID NO: 3169595 - DNA, 22 bp, Homo sapiens
atctccagggagcaagacagag

SEQ ID NO: 3169596 - DNA, 18 bp, Homo sapiens
atctccagtattcttgtc

SEQ ID NO: 3169597 - DNA, 19 bp, Homo sapiens
atctccatcatatgcctga

SEQ ID NO: 3169598 - DNA, 17 bp, Homo sapiens
atctcccactgcgggga

SEQ ID NO: 3169599 - DNA, 17 bp, Homo sapiens
atctcccattttggaat

SEQ ID NO: 3169600 - DNA, 19 bp, Homo sapiens
atctcccattttggaattt

SEQ ID NO: 3169601 - DNA, 13 bp, Homo sapiens
atctccccactct

SEQ ID NO: 3169602 - DNA, 12 bp, Homo sapiens
atctccccaggc

SEQ ID NO: 3169603 - DNA, 15 bp, Homo sapiens
atctccccaggcctc

SEQ ID NO: 3169604 - DNA, 16 bp, Homo sapiens
atctccccaggcctcc

SEQ ID NO: 3169605 - DNA, 19 bp, Homo sapiens
atctccccaggcctccagc

SEQ ID NO: 3169606 - DNA, 22 bp, Homo sapiens
atctccccaggcctccagcctc

SEQ ID NO: 3169607 - DNA, 14 bp, Homo sapiens
atctcccccaaccc

SEQ ID NO: 3169608 - DNA, 20 bp, Homo sapiens
atctcccccaacccacctct

SEQ ID NO: 3169609 - DNA, 14 bp, Homo sapiens
atctccctccccag

SEQ ID NO: 3169610 - DNA, 14 bp, Homo sapiens
atctccctgcctgg

SEQ ID NO: 3169611 - DNA, 17 bp, Homo sapiens
atctccctgcctggccc

SEQ ID NO: 3169612 - DNA, 18 bp, Homo sapiens
atctccctgcctggcccc

SEQ ID NO: 3169613 - DNA, 19 bp, Homo sapiens
atctcccttagaagagagc

SEQ ID NO: 3169614 - DNA, 21 bp, Homo sapiens
atctcctataatctgtcaaaa

SEQ ID NO: 3169615 - DNA, 11 bp, Homo sapiens
atctcctgctc

SEQ ID NO: 3169616 - DNA, 21 bp, Homo sapiens
atctcctggctaagcctctgc

SEQ ID NO: 3169617 - DNA, 21 bp, Homo sapiens
atctcctgtccatcagccagg

SEQ ID NO: 3169618 - DNA, 19 bp, Homo sapiens
atctcctgtcttttcaggt

SEQ ID NO: 3169619 - DNA, 15 bp, Homo sapiens
atctcctgtgcatgg

SEQ ID NO: 3169620 - DNA, 15 bp, Homo sapiens
atctccttgggctgg

SEQ ID NO: 3169621 - DNA, 19 bp, Homo sapiens
atctcggctcactgcaacc

SEQ ID NO: 3169622 - DNA, 22 bp, Homo sapiens
atctctaatatggcaaaaatgg

SEQ ID NO: 3169623 - DNA, 20 bp, Homo sapiens
atctctacccctttcttctc

SEQ ID NO: 3169624 - DNA, 20 bp, Homo sapiens
atctctacgactaatcacct

SEQ ID NO: 3169625 - DNA, 17 bp, Homo sapiens
atctctactaaaaatac

SEQ ID NO: 3169626 - DNA, 14 bp, Homo sapiens
atgactaaaaatat

SEQ ID NO: 3169627 - DNA, 23 bp, Homo sapiens
atgactaaaaatattataactta

SEQ ID NO: 3169628 - DNA, 11 bp, Homo sapiens
atgactaaaga

SEQ ID NO: 3169629 - DNA, 12 bp, Homo sapiens
atgactaaagag

SEQ ID NO: 3169630 - DNA, 14 bp, Homo sapiens
atgactaaagagag

SEQ ID NO: 3169631 - DNA, 15 bp, Homo sapiens
atgactaaagagaga

SEQ ID NO: 3169632 - DNA, 13 bp, Homo sapiens
atgactaattagg

SEQ ID NO: 3169633 - DNA, 21 bp, Homo sapiens
atgactaattagggtacattt

SEQ ID NO: 3169634 - DNA, 15 bp, Homo sapiens
atgactagtcacctg

SEQ ID NO: 3169635 - DNA, 14 bp, Homo sapiens
atgactataaacat

SEQ ID NO: 3169636 - DNA, 22 bp, Homo sapiens
atgactatataatttatttcca

SEQ ID NO: 3169637 - DNA, 16 bp, Homo sapiens
atgactatgtattttt

SEQ ID NO: 3169638 - DNA, 17 bp, Homo sapiens
atgactcacatgatgca

SEQ ID NO: 3169639 - DNA, 14 bp, Homo sapiens
atgactcagaatat

SEQ ID NO: 3169640 - DNA, 23 bp, Homo sapiens
atgactctttctgaaggaagaga

SEQ ID NO: 3169641 - DNA, 13 bp, Homo sapiens
atgactgcacatg

SEQ ID NO: 3169642 - DNA, 18 bp, Homo sapiens
atgactgcacccagctcc

SEQ ID NO: 3169643 - DNA, 23 bp, Homo sapiens
atgactgcacccagctccagggg

SEQ ID NO: 3169644 - DNA, 22 bp, Homo sapiens
atgactgctccccagccctggc

SEQ ID NO: 3169645 - DNA, 19 bp, Homo sapiens
atgactggctgtctgcctg

SEQ ID NO: 3169646 - DNA, 17 bp, Homo sapiens
atgactgtgaccacctt

SEQ ID NO: 3169647 - DNA, 22 bp, Homo sapiens
atgactgtgctactgtctttgg

SEQ ID NO: 3169648 - DNA, 14 bp, Homo sapiens
atgacttatttctg

SEQ ID NO: 3169649 - DNA, 22 bp, Homo sapiens
atgacttatttctgctctggaa

SEQ ID NO: 3169650 - DNA, 13 bp, Homo sapiens
atgactttttata

SEQ ID NO: 3169651 - DNA, 18 bp, Homo sapiens
atgactttttataaaatg

SEQ ID NO: 3169652 - DNA, 14 bp, Homo sapiens
atgagaacaaagct

SEQ ID NO: 3169653 - DNA, 15 bp, Homo sapiens
atgagaacaaagctg

SEQ ID NO: 3169654 - DNA, 16 bp, Homo sapiens
atgagaagagggcctg

SEQ ID NO: 3169655 - DNA, 16 bp, Homo sapiens
atgagaaggaacttcc

SEQ ID NO: 3169656 - DNA, 23 bp, Homo sapiens
atgagaatctacccccagatcca

SEQ ID NO: 3169657 - DNA, 15 bp, Homo sapiens
atgagacgaaatgct

SEQ ID NO: 3169658 - DNA, 18 bp, Homo sapiens
atgagactctagggtcca

SEQ ID NO: 3169659 - DNA, 16 bp, Homo sapiens
atgagactgaactgtg

SEQ ID NO: 3169660 - DNA, 21 bp, Homo sapiens
atgagactttccgactgcttt

SEQ ID NO: 3169661 - DNA, 16 bp, Homo sapiens
atgagagcccagaggt

SEQ ID NO: 3169662 - DNA, 21 bp, Homo sapiens
atgagatattaaattctcaaa

SEQ ID NO: 3169663 - DNA, 22 bp, Homo sapiens
atgagatctaagcctttccata

SEQ ID NO: 3169664 - DNA, 13 bp, Homo sapiens
atgagatggttaa

SEQ ID NO: 3169665 - DNA, 13 bp, Homo sapiens
atgagattgaatt

SEQ ID NO: 3169666 - DNA, 20 bp, Homo sapiens
atgagatttttaaaaaatat

SEQ ID NO: 3169667 - DNA, 17 bp, Homo sapiens
atgagcatcctgagccc

SEQ ID NO: 3169668 - DNA, 16 bp, Homo sapiens
atgagccatcactaga

SEQ ID NO: 3169669 - DNA, 18 bp, Homo sapiens
atgagccatcactagaag

SEQ ID NO: 3169670 - DNA, 20 bp, Homo sapiens
atgagccatcactagaagaa

SEQ ID NO: 3169671 - DNA, 11 bp, Homo sapiens
atgagcccaga

SEQ ID NO: 3169672 - DNA, 20 bp, Homo sapiens
atgagccggttattacttct

SEQ ID NO: 3169673 - DNA, 18 bp, Homo sapiens
atgagcctcagcatcctg

SEQ ID NO: 3169674 - DNA, 11 bp, Homo sapiens
atgagcctgcc

SEQ ID NO: 3169675 - DNA, 13 bp, Homo sapiens
atgagcctgcccg

SEQ ID NO: 3169676 - DNA, 20 bp, Homo sapiens
atgagctacaacaaaaggac

SEQ ID NO: 3169677 - DNA, 22 bp, Homo sapiens
atgagctctgaaatcttcccat

SEQ ID NO: 3169678 - DNA, 23 bp, Homo sapiens
atgagctttctttgcacttaaaa

SEQ ID NO: 3169679 - DNA, 13 bp, Homo sapiens
atgaggacatgtt

SEQ ID NO: 3169680 - DNA, 19 bp, Homo sapiens
atgaggagtaaaattcagt

SEQ ID NO: 3169681 - DNA, 18 bp, Homo sapiens
atgaggcaacctgattgt

SEQ ID NO: 3169682 - DNA, 16 bp, Homo sapiens
atgaggccatctcagg

SEQ ID NO: 3169683 - DNA, 22 bp, Homo sapiens
atgaggccatctcaggagatgg

SEQ ID NO: 3169684 - DNA, 14 bp, Homo sapiens
atgagggacagggt

SEQ ID NO: 3169685 - DNA, 13 bp, Homo sapiens
atgaggggagggg

SEQ ID NO: 3169686 - DNA, 22 bp, Homo sapiens
atgaggtcaccaggggaggagc

SEQ ID NO: 3169687 - DNA, 15 bp, Homo sapiens
atgaggtcagagcct

SEQ ID NO: 3169688 - DNA, 19 bp, Homo sapiens
atgaggtcagagcctgcag

SEQ ID NO: 3169689 - DNA, 14 bp, Homo sapiens
atgaggtctgaaat

SEQ ID NO: 3169690 - DNA, 15 bp, Homo sapiens
atgaggtctgaaatg

SEQ ID NO: 3169691 - DNA, 16 bp, Homo sapiens
atgagtaacatttgct

SEQ ID NO: 3169692 - DNA, 13 bp, Homo sapiens
atgagtagccagg

SEQ ID NO: 3169693 - DNA, 14 bp, Homo sapiens
atgagtatacaata

SEQ ID NO: 3169694 - DNA, 13 bp, Homo sapiens
atgagtatttggt

SEQ ID NO: 3169695 - DNA, 18 bp, Homo sapiens
atgagtccttgaaaatat

SEQ ID NO: 3169696 - DNA, 20 bp, Homo sapiens
atgagtccttgaaaatattt

SEQ ID NO: 3169697 - DNA, 21 bp, Homo sapiens
atgagtccttgaaaatatttt

SEQ ID NO: 3169698 - DNA, 18 bp, Homo sapiens
atgagtgtattttttaaa

SEQ ID NO: 3169699 - DNA, 13 bp, Homo sapiens
atgagtgtgcatg

SEQ ID NO: 3169700 - DNA, 22 bp, Homo sapiens
atgagttaactgtgaaatacca

SEQ ID NO: 3169701 - DNA, 17 bp, Homo sapiens
atgagttggacttcagt

SEQ ID NO: 3169702 - DNA, 20 bp, Homo sapiens
atgagttgtcagctttgact

SEQ ID NO: 3169703 - DNA, 14 bp, Homo sapiens
atgagttgtgatga

SEQ ID NO: 3169704 - DNA, 13 bp, Homo sapiens
atgagtttttgat

SEQ ID NO: 3169705 - DNA, 21 bp, Homo sapiens
atgagtttttgatagctttat

SEQ ID NO: 3169706 - DNA, 17 bp, Homo sapiens
atgataaagagacagtg

SEQ ID NO: 3169707 - DNA, 12 bp, Homo sapiens
atgataaattat

SEQ ID NO: 3169708 - DNA, 20 bp, Homo sapiens
atgataagttcctttccttt

SEQ ID NO: 3169709 - DNA, 17 bp, Homo sapiens
atgatacaagattagaa

SEQ ID NO: 3169710 - DNA, 17 bp, Homo sapiens
atgataccacctttact

SEQ ID NO: 3169711 - DNA, 21 bp, Homo sapiens
atgatactatcatactactga

SEQ ID NO: 3169712 - DNA, 18 bp, Homo sapiens
atgatactgattatgaaa

SEQ ID NO: 3169713 - DNA, 19 bp, Homo sapiens
atgatactgattatgaaat

SEQ ID NO: 3169714 - DNA, 20 bp, Homo sapiens
atgatactgattatgaaatg

SEQ ID NO: 3169715 - DNA, 20 bp, Homo sapiens
atgatattgtttaaaattca

SEQ ID NO: 3169716 - DNA, 22 bp, Homo sapiens
atgatattgtttaaaattcagt

SEQ ID NO: 3169717 - DNA, 16 bp, Homo sapiens
atgatcaaaacatgct

SEQ ID NO: 3169718 - DNA, 19 bp, Homo sapiens
atgatcaaaacctgtgcca

SEQ ID NO: 3169719 - DNA, 20 bp, Homo sapiens
atgatcaaaacctgtgccag

SEQ ID NO: 3169720 - DNA, 15 bp, Homo sapiens
atgatcacggctcac

SEQ ID NO: 3169721 - DNA, 18 bp, Homo sapiens
atgatcacggctcactgc

SEQ ID NO: 3169722 - DNA, 19 bp, Homo sapiens
atgatcagctgtttgtcat

SEQ ID NO: 3169723 - DNA, 18 bp, Homo sapiens
atgatcattgaaatactt

SEQ ID NO: 3169724 - DNA, 19 bp, Homo sapiens
atgatcattgaaatacttt

SEQ ID NO: 3169725 - DNA, 19 bp, Homo sapiens
atgatccagagcagagttt

SEQ ID NO: 3169726 - DNA, 20 bp, Homo sapiens
atgatccctgtgttgtctct

SEQ ID NO: 3169727 - DNA, 17 bp, Homo sapiens
atgatccttttttgtca

SEQ ID NO: 3169728 - DNA, 17 bp, Homo sapiens
atgatcgagccactgca

SEQ ID NO: 3169729 - DNA, 16 bp, Homo sapiens
atgatctactcagaaa

SEQ ID NO: 3169730 - DNA, 18 bp, Homo sapiens
atgatctactcagaaatt

SEQ ID NO: 3169731 - DNA, 17 bp, Homo sapiens
atgatctattgctcatc

SEQ ID NO: 3169732 - DNA, 15 bp, Homo sapiens
atgatctatttgtag

SEQ ID NO: 3169733 - DNA, 19 bp, Homo sapiens
atgatctcggatgaccaaa

SEQ ID NO: 3169734 - DNA, 14 bp, Homo sapiens
atgatcttctttat

SEQ ID NO: 3169735 - DNA, 19 bp, Homo sapiens
atgatctttgcagacaggc

SEQ ID NO: 3169736 - DNA, 21 bp, Homo sapiens
atgatctttgcagacaggcaa

SEQ ID NO: 3169737 - DNA, 18 bp, Homo sapiens
atgatgaaaaggttgcct

SEQ ID NO: 3169738 - DNA, 18 bp, Homo sapiens
atgatgaaatgaggtcag

SEQ ID NO: 3169739 - DNA, 15 bp, Homo sapiens
atgatgaatgagaat

SEQ ID NO: 3169740 - DNA, 22 bp, Homo sapiens
atgatgacgacgacaacgatga

SEQ ID NO: 3169741 - DNA, 20 bp, Homo sapiens
atgatgatcaattatagttt

SEQ ID NO: 3169742 - DNA, 20 bp, Homo sapiens
atgatgatgtggaagaactt

SEQ ID NO: 3169743 - DNA, 16 bp, Homo sapiens
atgatgcatacagttt

SEQ ID NO: 3169744 - DNA, 23 bp, Homo sapiens
atgatgcttctataattttgcct

SEQ ID NO: 3169745 - DNA, 21 bp, Homo sapiens
atgatgcttgtaacaagaaaa

SEQ ID NO: 3169746 - DNA, 15 bp, Homo sapiens
atgatggatgccaat

SEQ ID NO: 3169747 - DNA, 18 bp, Homo sapiens
atgatggatggcagactc

SEQ ID NO: 3169748 - DNA, 22 bp, Homo sapiens
atgatgggaatagggagacagg

SEQ ID NO: 3169749 - DNA, 14 bp, Homo sapiens
atgatgggggaaaa

SEQ ID NO: 3169750 - DNA, 14 bp, Homo sapiens
atgatgtacagatt

SEQ ID NO: 3169751 - DNA, 21 bp, Homo sapiens
atgatgtacagattctttcag

SEQ ID NO: 3169752 - DNA, 15 bp, Homo sapiens
atggacctaacattc

SEQ ID NO: 3169753 - DNA, 21 bp, Homo sapiens
atggacctctcagcagaaaca

SEQ ID NO: 3169754 - DNA, 22 bp, Homo sapiens
atggacgtgtctgcacagggtc

SEQ ID NO: 3169755 - DNA, 21 bp, Homo sapiens
atggactatctgtctggtggc

SEQ ID NO: 3169756 - DNA, 15 bp, Homo sapiens
atggactctgcacat

SEQ ID NO: 3169757 - DNA, 23 bp, Homo sapiens
atggactcttctcggctcaggct

SEQ ID NO: 3169758 - DNA, 16 bp, Homo sapiens
atggagaatggtgttc

SEQ ID NO: 3169759 - DNA, 17 bp, Homo sapiens
atggagaattgctgaag

SEQ ID NO: 3169760 - DNA, 18 bp, Homo sapiens
atggagacgcatttcggt

SEQ ID NO: 3169761 - DNA, 14 bp, Homo sapiens
atggagactcctgc

SEQ ID NO: 3169762 - DNA, 20 bp, Homo sapiens
atggagactcctgccctgtt

SEQ ID NO: 3169763 - DNA, 13 bp, Homo sapiens
atggagagagggg

SEQ ID NO: 3169764 - DNA, 18 bp, Homo sapiens
atggagaggcggcctcgt

SEQ ID NO: 3169765 - DNA, 19 bp, Homo sapiens
atggagattcagttttcat

SEQ ID NO: 3169766 - DNA, 19 bp, Homo sapiens
atggagcagtacatgggaa

SEQ ID NO: 3169767 - DNA, 18 bp, Homo sapiens
atggagccagctccctct

SEQ ID NO: 3169768 - DNA, 21 bp, Homo sapiens
atggagccagctctgcattat

SEQ ID NO: 3169769 - DNA, 21 bp, Homo sapiens
atggagcccataggccacccc

SEQ ID NO: 3169770 - DNA, 15 bp, Homo sapiens
atggagcccccagat

SEQ ID NO: 3169771 - DNA, 22 bp, Homo sapiens
atggagcccccagatagagctg

SEQ ID NO: 3169772 - DNA, 17 bp, Homo sapiens
atggagccccctctgcc

SEQ ID NO: 3169773 - DNA, 18 bp, Homo sapiens
atggaggatggagagagg

SEQ ID NO: 3169774 - DNA, 16 bp, Homo sapiens
atggaggcagagacct

SEQ ID NO: 3169775 - DNA, 19 bp, Homo sapiens
atggagggcttggcccagc

SEQ ID NO: 3169776 - DNA, 20 bp, Homo sapiens
atggaggggtggtcctgact

SEQ ID NO: 3169777 - DNA, 22 bp, Homo sapiens
atggaggggtggtcctgactca

SEQ ID NO: 3169778 - DNA, 13 bp, Homo sapiens
atggaggttctaa

SEQ ID NO: 3169779 - DNA, 17 bp, Homo sapiens
atggataaactgagcct

SEQ ID NO: 3169780 - DNA, 13 bp, Homo sapiens
atggatactacat

SEQ ID NO: 3169781 - DNA, 22 bp, Homo sapiens
atggatatagttttacttttaa

SEQ ID NO: 3169782 - DNA, 18 bp, Homo sapiens
atggatgattcagaaatt

SEQ ID NO: 3169783 - DNA, 19 bp, Homo sapiens
atggatgcaaagtacaatg

SEQ ID NO: 3169784 - DNA, 17 bp, Homo sapiens
atggatgcatttcaaat

SEQ ID NO: 3169785 - DNA, 18 bp, Homo sapiens
atggatgcatttcaaatg

SEQ ID NO: 3169786 - DNA, 19 bp, Homo sapiens
atggatgcatttcaaatgt

SEQ ID NO: 3169787 - DNA, 23 bp, Homo sapiens
atggatgccaatattaaatctgc

SEQ ID NO: 3169788 - DNA, 17 bp, Homo sapiens
atggatgtggggtcccc

SEQ ID NO: 3169789 - DNA, 12 bp, Homo sapiens
atggattcagca

SEQ ID NO: 3169790 - DNA, 22 bp, Homo sapiens
atggattctcagatatttatat

SEQ ID NO: 3169791 - DNA, 17 bp, Homo sapiens
atggatttgatgctgtt

SEQ ID NO: 3169792 - DNA, 21 bp, Homo sapiens
atggatttgcctgtgccaccc

SEQ ID NO: 3169793 - DNA, 18 bp, Homo sapiens
atggattttctattgtta

SEQ ID NO: 3169794 - DNA, 15 bp, Homo sapiens
atggattttgggagt

SEQ ID NO: 3169795 - DNA, 21 bp, Homo sapiens
atggattttgggagtgactca

SEQ ID NO: 3169796 - DNA, 18 bp, Homo sapiens
atggcaaaggaaggtgga

SEQ ID NO: 3169797 - DNA, 12 bp, Homo sapiens
atggcaaggaac

SEQ ID NO: 3169798 - DNA, 19 bp, Homo sapiens
atggcaaggactgcaggga

SEQ ID NO: 3169799 - DNA, 18 bp, Homo sapiens
atggcaagtctagagtct

SEQ ID NO: 3169800 - DNA, 22 bp, Homo sapiens
atggcaagtctagagtctcaga

SEQ ID NO: 3169801 - DNA, 22 bp, Homo sapiens
atggcaagttgccattttgtaa

SEQ ID NO: 3169802 - DNA, 18 bp, Homo sapiens
atggcaatagggtagaat

SEQ ID NO: 3169803 - DNA, 12 bp, Homo sapiens
atggcacaatga

SEQ ID NO: 3169804 - DNA, 18 bp, Homo sapiens
atggcacaatgaatgtat

SEQ ID NO: 3169805 - DNA, 18 bp, Homo sapiens
atggcaccagccccctgg

SEQ ID NO: 3169806 - DNA, 20 bp, Homo sapiens
atggcacttagctatcagaa

SEQ ID NO: 3169807 - DNA, 16 bp, Homo sapiens
atggcagaagacacca

SEQ ID NO: 3169808 - DNA, 17 bp, Homo sapiens
atggcagaagacaccag

SEQ ID NO: 3169809 - DNA, 19 bp, Homo sapiens
atggcagaagacaccagag

SEQ ID NO: 3169810 - DNA, 14 bp, Homo sapiens
atggcagaagggaa

SEQ ID NO: 3169811 - DNA, 21 bp, Homo sapiens
atggcagactctttaataaat

SEQ ID NO: 3169812 - DNA, 19 bp, Homo sapiens
atggcagaggaatatcaat

SEQ ID NO: 3169813 - DNA, 19 bp, Homo sapiens
atggcagagtttgtgtgtt

SEQ ID NO: 3169814 - DNA, 19 bp, Homo sapiens
atggcagcctactctcctt

SEQ ID NO: 3169815 - DNA, 15 bp, Homo sapiens
atggcaggtgtcata

SEQ ID NO: 3169816 - DNA, 16 bp, Homo sapiens
atggccaggtggccac

SEQ ID NO: 3169817 - DNA, 15 bp, Homo sapiens
atggccagtgtctgt

SEQ ID NO: 3169818 - DNA, 16 bp, Homo sapiens
atggccagtgtctgtc

SEQ ID NO: 3169819 - DNA, 17 bp, Homo sapiens
atggccagtgtctgtcc

SEQ ID NO: 3169820 - DNA, 20 bp, Homo sapiens
atggccccagcacagcttga

SEQ ID NO: 3169821 - DNA, 22 bp, Homo sapiens
atggcccccaggggcaggactg

SEQ ID NO: 3169822 - DNA, 15 bp, Homo sapiens
atggcccctccactg

SEQ ID NO: 3169823 - DNA, 18 bp, Homo sapiens
atggcccggatgctgctt

SEQ ID NO: 3169824 - DNA, 19 bp, Homo sapiens
atggcccggatgctgcttc

SEQ ID NO: 3169825 - DNA, 21 bp, Homo sapiens
atggccctgtagccagcacct

SEQ ID NO: 3169826 - DNA, 20 bp, Homo sapiens
atggcctattatattaaaat

SEQ ID NO: 3169827 - DNA, 13 bp, Homo sapiens
atggcctcagctg

SEQ ID NO: 3169828 - DNA, 20 bp, Homo sapiens
atggcctcatgtggctggaa

SEQ ID NO: 3169829 - DNA, 21 bp, Homo sapiens
atggcctcgcctccccaccct

SEQ ID NO: 3169830 - DNA, 19 bp, Homo sapiens
atggcctgccttgaagcca

SEQ ID NO: 3169831 - DNA, 13 bp, Homo sapiens
atggccttgaaac

SEQ ID NO: 3169832 - DNA, 14 bp, Homo sapiens
atggccttgaaaca

SEQ ID NO: 3169833 - DNA, 12 bp, Homo sapiens
atggcctttcta

SEQ ID NO: 3169834 - DNA, 19 bp, Homo sapiens
atggcgcgggaggcaccag

SEQ ID NO: 3169835 - DNA, 19 bp, Homo sapiens
atggcgtaatgggcctgcc

SEQ ID NO: 3169836 - DNA, 19 bp, Homo sapiens
atggcgttttgtctgtgtt

SEQ ID NO: 3169837 - DNA, 22 bp, Homo sapiens
atggcgttttgtctgtgttgct

SEQ ID NO: 3169838 - DNA, 18 bp, Homo sapiens
atggctaatgtactgcat

SEQ ID NO: 3169839 - DNA, 18 bp, Homo sapiens
atggctactttggtttct

SEQ ID NO: 3169840 - DNA, 14 bp, Homo sapiens
atggctataaatat

SEQ ID NO: 3169841 - DNA, 15 bp, Homo sapiens
atggctataaatata

SEQ ID NO: 3169842 - DNA, 21 bp, Homo sapiens
atggctataaatatataaaaa

SEQ ID NO: 3169843 - DNA, 22 bp, Homo sapiens
atggctcaagtagaaaagcagt

SEQ ID NO: 3169844 - DNA, 12 bp, Homo sapiens
atggctcaggca

SEQ ID NO: 3169845 - DNA, 13 bp, Homo sapiens
atggctccaacag

SEQ ID NO: 3169846 - DNA, 17 bp, Homo sapiens
atggctccagaaatgtc

SEQ ID NO: 3169847 - DNA, 17 bp, Homo sapiens
atggctctggactctaa

SEQ ID NO: 3169848 - DNA, 14 bp, Homo sapiens
atggctgcccagga

SEQ ID NO: 3169849 - DNA, 19 bp, Homo sapiens
atggctgcttgattttgta

SEQ ID NO: 3169850 - DNA, 22 bp, Homo sapiens
atggctggccactgcacagagc

SEQ ID NO: 3169851 - DNA, 16 bp, Homo sapiens
atggctgtgcctctgc

SEQ ID NO: 3169852 - DNA, 20 bp, Homo sapiens
atggctgtgcctctgcctgt

SEQ ID NO: 3169853 - DNA, 21 bp, Homo sapiens
atggctgtgtttgcagcctgc

SEQ ID NO: 3169854 - DNA, 16 bp, Homo sapiens
atggcttaaaaatact

SEQ ID NO: 3169855 - DNA, 22 bp, Homo sapiens
atggcttattttttaaaatatt

SEQ ID NO: 3169856 - DNA, 16 bp, Homo sapiens
atggcttgacatgtgc

SEQ ID NO: 3169857 - DNA, 15 bp, Homo sapiens
atggcttgtgaactg

SEQ ID NO: 3169858 - DNA, 22 bp, Homo sapiens
atggctttttttgcctaccatt

SEQ ID NO: 3169859 - DNA, 13 bp, Homo sapiens
atgggaaaatatt

SEQ ID NO: 3169860 - DNA, 17 bp, Homo sapiens
atgggaaagccacctct

SEQ ID NO: 3169861 - DNA, 23 bp, Homo sapiens
atgggaaaggaggcatgcctctg

SEQ ID NO: 3169862 - DNA, 14 bp, Homo sapiens
atgggaagacatga

SEQ ID NO: 3169863 - DNA, 15 bp, Homo sapiens
atgggaagcaggacc

SEQ ID NO: 3169864 - DNA, 17 bp, Homo sapiens
atgggaattggaatcaa

SEQ ID NO: 3169865 - DNA, 15 bp, Homo sapiens
atgggacagggagga

SEQ ID NO: 3169866 - DNA, 11 bp, Homo sapiens
atgggaccagg

SEQ ID NO: 3169867 - DNA, 17 bp, Homo sapiens
atgggacggaggtcctt

SEQ ID NO: 3169868 - DNA, 11 bp, Homo sapiens
atgggagccag

SEQ ID NO: 3169869 - DNA, 19 bp, Homo sapiens
atgggagccagctgctttt

SEQ ID NO: 3169870 - DNA, 18 bp, Homo sapiens
atgggagccaggcccaga

SEQ ID NO: 3169871 - DNA, 22 bp, Homo sapiens
atgggagctggttagaaatgca

SEQ ID NO: 3169872 - DNA, 20 bp, Homo sapiens
atgggagggggcttgaagcc

SEQ ID NO: 3169873 - DNA, 22 bp, Homo sapiens
atgggagggggcttgaagccaa

SEQ ID NO: 3169874 - DNA, 18 bp, Homo sapiens
atgggagtaagttcttca

SEQ ID NO: 3169875 - DNA, 19 bp, Homo sapiens
atgggagtgggcacctcag

SEQ ID NO: 3169876 - DNA, 21 bp, Homo sapiens
atgggatatgtggtgtatatc

SEQ ID NO: 3169877 - DNA, 20 bp, Homo sapiens
atgtgtctgtatttcatgtg

SEQ ID NO: 3169878 - DNA, 21 bp, Homo sapiens
atgtgtctgtatttcatgtgg

SEQ ID NO: 3169879 - DNA, 19 bp, Homo sapiens
atgtgtctttctaagaaat

SEQ ID NO: 3169880 - DNA, 18 bp, Homo sapiens
atgtgtgaattctgcaac

SEQ ID NO: 3169881 - DNA, 15 bp, Homo sapiens
atgtgtgaggagctg

SEQ ID NO: 3169882 - DNA, 15 bp, Homo sapiens
atgtgtgcatgtgtg

SEQ ID NO: 3169883 - DNA, 18 bp, Homo sapiens
atgtgtgcatgtgtgtat

SEQ ID NO: 3169884 - DNA, 22 bp, Homo sapiens
atgtgtgccatagagtttaaca

SEQ ID NO: 3169885 - DNA, 12 bp, Homo sapiens
atgtgtgcctgt

SEQ ID NO: 3169886 - DNA, 16 bp, Homo sapiens
atgtgtggtggcctca

SEQ ID NO: 3169887 - DNA, 19 bp, Homo sapiens
atgtgtggtggcctcagct

SEQ ID NO: 3169888 - DNA, 12 bp, Homo sapiens
atgtgtggtttc

SEQ ID NO: 3169889 - DNA, 17 bp, Homo sapiens
atgtgtgtaagtgtgtg

SEQ ID NO: 3169890 - DNA, 20 bp, Homo sapiens
atgtgtgtagacaaatattt

SEQ ID NO: 3169891 - DNA, 14 bp, Homo sapiens
atgtgtgtatatat

SEQ ID NO: 3169892 - DNA, 18 bp, Homo sapiens
atgtgtgtatatatgtgt

SEQ ID NO: 3169893 - DNA, 20 bp, Homo sapiens
atgtgtgtatatatgtgtat

SEQ ID NO: 3169894 - DNA, 16 bp, Homo sapiens
atgtgtgtatgtgtat

SEQ ID NO: 3169895 - DNA, 16 bp, Homo sapiens
atgtgtgttgtcagcc

SEQ ID NO: 3169896 - DNA, 19 bp, Homo sapiens
atgtgtgttgtcagcctgt

SEQ ID NO: 3169897 - DNA, 18 bp, Homo sapiens
atgtgttcattcaagcta

SEQ ID NO: 3169898 - DNA, 14 bp, Homo sapiens
atgtgttcctcctg

SEQ ID NO: 3169899 - DNA, 14 bp, Homo sapiens
atgtgttgaaaaaa

SEQ ID NO: 3169900 - DNA, 14 bp, Homo sapiens
atgtgttgaaactg

SEQ ID NO: 3169901 - DNA, 14 bp, Homo sapiens
atgtgttgtgatag

SEQ ID NO: 3169902 - DNA, 12 bp, Homo sapiens
atgtgtttccat

SEQ ID NO: 3169903 - DNA, 13 bp, Homo sapiens
atgtgtttgctgc

SEQ ID NO: 3169904 - DNA, 13 bp, Homo sapiens
atgtgtttttctc

SEQ ID NO: 3169905 - DNA, 15 bp, Homo sapiens
atgtgtttttctcca

SEQ ID NO: 3169906 - DNA, 17 bp, Homo sapiens
atgtgtttttctccagt

SEQ ID NO: 3169907 - DNA, 18 bp, Homo sapiens
atgttaaaataaatggtt

SEQ ID NO: 3169908 - DNA, 17 bp, Homo sapiens
atgttaaagagaatgag

SEQ ID NO: 3169909 - DNA, 18 bp, Homo sapiens
atgttaaagagaatgagt

SEQ ID NO: 3169910 - DNA, 14 bp, Homo sapiens
atgttaaagtttaa

SEQ ID NO: 3169911 - DNA, 12 bp, Homo sapiens
atgttaaatact

SEQ ID NO: 3169912 - DNA, 13 bp, Homo sapiens
atgttaaatactg

SEQ ID NO: 3169913 - DNA, 14 bp, Homo sapiens
atgttaaatactgt

SEQ ID NO: 3169914 - DNA, 19 bp, Homo sapiens
atgttaaatactgtgcaga

SEQ ID NO: 3169915 - DNA, 22 bp, Homo sapiens
atgttaaatactgtgcagaata

SEQ ID NO: 3169916 - DNA, 14 bp, Homo sapiens
atgttaaatttgta

SEQ ID NO: 3169917 - DNA, 20 bp, Homo sapiens
atgttaaatttgtaagtttc

SEQ ID NO: 3169918 - DNA, 22 bp, Homo sapiens
atgttaacaagaggggaaaaca

SEQ ID NO: 3169919 - DNA, 23 bp, Homo sapiens
atgttaaccagaataaagttctg

SEQ ID NO: 3169920 - DNA, 18 bp, Homo sapiens
atgttaacctcagtgtca

SEQ ID NO: 3169921 - DNA, 20 bp, Homo sapiens
atgttaactttattacaatt

SEQ ID NO: 3169922 - DNA, 13 bp, Homo sapiens
atgttaagctctt

SEQ ID NO: 3169923 - DNA, 13 bp, Homo sapiens
atgttaaggaaac

SEQ ID NO: 3169924 - DNA, 18 bp, Homo sapiens
atgttaaggaaactctta

SEQ ID NO: 3169925 - DNA, 20 bp, Homo sapiens
atgttaagggaagaattcca

SEQ ID NO: 3169926 - DNA, 22 bp, Homo sapiens
atgttaattcagcactgatttc

SEQ ID NO: 3169927 - DNA, 20 bp, Homo sapiens
atgttacataagataaatgt

SEQ ID NO: 3169928 - DNA, 20 bp, Homo sapiens
atgttacatctgttttaaat

SEQ ID NO: 3169929 - DNA, 14 bp, Homo sapiens
atgttacattgttt

SEQ ID NO: 3169930 - DNA, 16 bp, Homo sapiens
atgttaccatcttact

SEQ ID NO: 3169931 - DNA, 22 bp, Homo sapiens
atgttactaaattacgtatgca

SEQ ID NO: 3169932 - DNA, 14 bp, Homo sapiens
atgttactattttc

SEQ ID NO: 3169933 - DNA, 23 bp, Homo sapiens
atgttactattttctacaattaa

SEQ ID NO: 3169934 - DNA, 14 bp, Homo sapiens
atgttactcagtgt

SEQ ID NO: 3169935 - DNA, 18 bp, Homo sapiens
atgttactcagtgttaga

SEQ ID NO: 3169936 - DNA, 13 bp, Homo sapiens
atgttactgacca

SEQ ID NO: 3169937 - DNA, 19 bp, Homo sapiens
atgttactgatcatgcatt

SEQ ID NO: 3169938 - DNA, 16 bp, Homo sapiens
atgttaggagaactac

SEQ ID NO: 3169939 - DNA, 16 bp, Homo sapiens
atgttagggtgctctg

SEQ ID NO: 3169940 - DNA, 19 bp, Homo sapiens
atgttagtaatggcagagc

SEQ ID NO: 3169941 - DNA, 22 bp, Homo sapiens
atgttagtaatggcagagcagt

SEQ ID NO: 3169942 - DNA, 19 bp, Homo sapiens
atgttagtattttaatcct

SEQ ID NO: 3169943 - DNA, 21 bp, Homo sapiens
atgttagtattttaatcctgt

SEQ ID NO: 3169944 - DNA, 21 bp, Homo sapiens
atgttagttaccttatagtta

SEQ ID NO: 3169945 - DNA, 15 bp, Homo sapiens
atgttatacaaggca

SEQ ID NO: 3169946 - DNA, 20 bp, Homo sapiens
atgttatacaaggcaagcat

SEQ ID NO: 3169947 - DNA, 17 bp, Homo sapiens
atgttatatattttttg

SEQ ID NO: 3169948 - DNA, 15 bp, Homo sapiens
atgttatcttctcaa

SEQ ID NO: 3169949 - DNA, 11 bp, Homo sapiens
atgttatgaac

SEQ ID NO: 3169950 - DNA, 14 bp, Homo sapiens
atgttatgaacatg

SEQ ID NO: 3169951 - DNA, 18 bp, Homo sapiens
atgttatgatattgttta

SEQ ID NO: 3169952 - DNA, 20 bp, Homo sapiens
atgttatgatattgtttaaa

SEQ ID NO: 3169953 - DNA, 20 bp, Homo sapiens
atgttatgatttgtaacatt

SEQ ID NO: 3169954 - DNA, 23 bp, Homo sapiens
atgttatgggatgtaaacaatgt

SEQ ID NO: 3169955 - DNA, 23 bp, Homo sapiens
atgttatttaacagctgaattat

SEQ ID NO: 3169956 - DNA, 17 bp, Homo sapiens
atgttattttttaatta

SEQ ID NO: 3169957 - DNA, 20 bp, Homo sapiens
atgttattttttaattatta

SEQ ID NO: 3169958 - DNA, 15 bp, Homo sapiens
atgttcactgtgagt

SEQ ID NO: 3169959 - DNA, 23 bp, Homo sapiens
atgttcagaaggttgctctagat

SEQ ID NO: 3169960 - DNA, 21 bp, Homo sapiens
atgttcatcatcctaagctat

SEQ ID NO: 3169961 - DNA, 14 bp, Homo sapiens
atgttcattgtaat

SEQ ID NO: 3169962 - DNA, 12 bp, Homo sapiens
atgttcattttt

SEQ ID NO: 3169963 - DNA, 22 bp, Homo sapiens
atgttccttttttcaatatgca

SEQ ID NO: 3169964 - DNA, 15 bp, Homo sapiens
atgttcgggtgtggg

SEQ ID NO: 3169965 - DNA, 23 bp, Homo sapiens
atgttctaaaatgtcaaggcagt

SEQ ID NO: 3169966 - DNA, 17 bp, Homo sapiens
atgttctaacagatcag

SEQ ID NO: 3169967 - DNA, 14 bp, Homo sapiens
atgttctaaggctc

SEQ ID NO: 3169968 - DNA, 15 bp, Homo sapiens
atgttctaaggctct

SEQ ID NO: 3169969 - DNA, 17 bp, Homo sapiens
atgttctaaggctctga

SEQ ID NO: 3169970 - DNA, 19 bp, Homo sapiens
atgttctaaggctctgaga

SEQ ID NO: 3169971 - DNA, 23 bp, Homo sapiens
atgttctaagtttctaagattct

SEQ ID NO: 3169972 - DNA, 16 bp, Homo sapiens
atgttctaatactttg

SEQ ID NO: 3169973 - DNA, 14 bp, Homo sapiens
atgttctgacatta

SEQ ID NO: 3169974 - DNA, 19 bp, Homo sapiens
atgttctgacattaacagt

SEQ ID NO: 3169975 - DNA, 20 bp, Homo sapiens
atgttctgacattaacagtt

SEQ ID NO: 3169976 - DNA, 16 bp, Homo sapiens
atgttctgcccccagc

SEQ ID NO: 3169977 - DNA, 17 bp, Homo sapiens
atgttctgcccccagcc

SEQ ID NO: 3169978 - DNA, 16 bp, Homo sapiens
atgttctttggaaagt

SEQ ID NO: 3169979 - DNA, 14 bp, Homo sapiens
atgttgaatacttt

SEQ ID NO: 3169980 - DNA, 19 bp, Homo sapiens
atgttgaatactttttaca

SEQ ID NO: 3169981 - DNA, 15 bp, Homo sapiens
atgttgcaatgtgaa

SEQ ID NO: 3169982 - DNA, 22 bp, Homo sapiens
atgttgcaatgtgaaaaatctg

SEQ ID NO: 3169983 - DNA, 19 bp, Homo sapiens
atgttgctatgtgccttat

SEQ ID NO: 3169984 - DNA, 17 bp, Homo sapiens
atgttggacacctttag

SEQ ID NO: 3169985 - DNA, 23 bp, Homo sapiens
atgttggacacctttaggttctt

SEQ ID NO: 3169986 - DNA, 20 bp, Homo sapiens
atgttgggaaacttggctcg

SEQ ID NO: 3169987 - DNA, 18 bp, Homo sapiens
atgttggggtttttttaa

SEQ ID NO: 3169988 - DNA, 17 bp, Homo sapiens
atgttggtttactttca

SEQ ID NO: 3169989 - DNA, 22 bp, Homo sapiens
atgttgtaaattaggaggctca

SEQ ID NO: 3169990 - DNA, 17 bp, Homo sapiens
atgttgtaatatttctt

SEQ ID NO: 3169991 - DNA, 22 bp, Homo sapiens
atgttgtccaattgttgacagt

SEQ ID NO: 3169992 - DNA, 15 bp, Homo sapiens
atgttgtgtggcaat

SEQ ID NO: 3169993 - DNA, 16 bp, Homo sapiens
atgttgtgttctaata

SEQ ID NO: 3169994 - DNA, 17 bp, Homo sapiens
atgttgttaaaattatg

SEQ ID NO: 3169995 - DNA, 12 bp, Homo sapiens
atgttgttattt

SEQ ID NO: 3169996 - DNA, 15 bp, Homo sapiens
atgttgttcaaatgc

SEQ ID NO: 3169997 - DNA, 18 bp, Homo sapiens
atgtttaaaaaaacatta

SEQ ID NO: 3169998 - DNA, 12 bp, Homo sapiens
atgtttaaaata

SEQ ID NO: 3169999 - DNA, 17 bp, Homo sapiens
atgtttaaaataaaatg

SEQ ID NO: 3170000 - DNA, 14 bp, Homo sapiens
atgtttaaatcatg

SEQ ID NO: 3170001 - DNA, 17 bp, Homo sapiens
atgtttaaatcatgtat

SEQ ID NO: 3170002 - DNA, 22 bp, Homo sapiens
atgtttaaatcatgtatgttat

SEQ ID NO: 3170003 - DNA, 18 bp, Homo sapiens
attattgtggtaggcctt

SEQ ID NO: 3170004 - DNA, 22 bp, Homo sapiens
attattgttcccctaagtggat

SEQ ID NO: 3170005 - DNA, 11 bp, Homo sapiens
attatttaaac

SEQ ID NO: 3170006 - DNA, 13 bp, Homo sapiens
attatttaataaa

SEQ ID NO: 3170007 - DNA, 13 bp, Homo sapiens
attatttaataac

SEQ ID NO: 3170008 - DNA, 14 bp, Homo sapiens
attatttaataaca

SEQ ID NO: 3170009 - DNA, 22 bp, Homo sapiens
attatttatatggggaatatat

SEQ ID NO: 3170010 - DNA, 21 bp, Homo sapiens
attatttattaaaaatgttct

SEQ ID NO: 3170011 - DNA, 23 bp, Homo sapiens
attatttattcagcttcatttgt

SEQ ID NO: 3170012 - DNA, 15 bp, Homo sapiens
attatttatttattt

SEQ ID NO: 3170013 - DNA, 22 bp, Homo sapiens
attatttctgtcacagtaaaaa

SEQ ID NO: 3170014 - DNA, 12 bp, Homo sapiens
attatttgcttt

SEQ ID NO: 3170015 - DNA, 22 bp, Homo sapiens
attatttgcttttcatgtagaa

SEQ ID NO: 3170016 - DNA, 23 bp, Homo sapiens
attatttggcagtttggtatttg

SEQ ID NO: 3170017 - DNA, 17 bp, Homo sapiens
attatttgtaagatatt

SEQ ID NO: 3170018 - DNA, 20 bp, Homo sapiens
attatttgtgtaatagaaaa

SEQ ID NO: 3170019 - DNA, 22 bp, Homo sapiens
attatttgtgttttaatttaaa

SEQ ID NO: 3170020 - DNA, 16 bp, Homo sapiens
attattttaaaatatt

SEQ ID NO: 3170021 - DNA, 17 bp, Homo sapiens
attattttaaaatattt

SEQ ID NO: 3170022 - DNA, 18 bp, Homo sapiens
attattttaaaatattta

SEQ ID NO: 3170023 - DNA, 14 bp, Homo sapiens
attattttcattac

SEQ ID NO: 3170024 - DNA, 19 bp, Homo sapiens
attattttcattacaatgg

SEQ ID NO: 3170025 - DNA, 15 bp, Homo sapiens
attattttctgtcag

SEQ ID NO: 3170026 - DNA, 16 bp, Homo sapiens
attattttctgtcaga

SEQ ID NO: 3170027 - DNA, 14 bp, Homo sapiens
attattttcttcat

SEQ ID NO: 3170028 - DNA, 16 bp, Homo sapiens
attattttggggtctc

SEQ ID NO: 3170029 - DNA, 20 bp, Homo sapiens
attattttggtacttttatg

SEQ ID NO: 3170030 - DNA, 14 bp, Homo sapiens
attattttgtattc

SEQ ID NO: 3170031 - DNA, 17 bp, Homo sapiens
attattttgtggttcta

SEQ ID NO: 3170032 - DNA, 21 bp, Homo sapiens
attattttgtggttctatttt

SEQ ID NO: 3170033 - DNA, 22 bp, Homo sapiens
attattttgtggttctatttta

SEQ ID NO: 3170034 - DNA, 19 bp, Homo sapiens
attatttttataattgtac

SEQ ID NO: 3170035 - DNA, 19 bp, Homo sapiens
attatttttccactttgtt

SEQ ID NO: 3170036 - DNA, 22 bp, Homo sapiens
attatttttccactttgttctt

SEQ ID NO: 3170037 - DNA, 14 bp, Homo sapiens
attatttttgtaga

SEQ ID NO: 3170038 - DNA, 20 bp, Homo sapiens
attatttttgttagcaaaga

SEQ ID NO: 3170039 - DNA, 22 bp, Homo sapiens
attatttttttaaaattttgta

SEQ ID NO: 3170040 - DNA, 13 bp, Homo sapiens
attcaaaagttcc

SEQ ID NO: 3170041 - DNA, 16 bp, Homo sapiens
attcaaaagttccaag

SEQ ID NO: 3170042 - DNA, 17 bp, Homo sapiens
attcaaaagttccaaga

SEQ ID NO: 3170043 - DNA, 19 bp, Homo sapiens
attcaaactgcacttttag

SEQ ID NO: 3170044 - DNA, 17 bp, Homo sapiens
attcaaagcttgtgaaa

SEQ ID NO: 3170045 - DNA, 13 bp, Homo sapiens
attcaaaggttct

SEQ ID NO: 3170046 - DNA, 17 bp, Homo sapiens
attcaaaggttctaggt

SEQ ID NO: 3170047 - DNA, 15 bp, Homo sapiens
attcaaatcagtgat

SEQ ID NO: 3170048 - DNA, 18 bp, Homo sapiens
attcaaatcagtgatcta

SEQ ID NO: 3170049 - DNA, 15 bp, Homo sapiens
attcaaattgctgct

SEQ ID NO: 3170050 - DNA, 18 bp, Homo sapiens
attcaaattgctgcttgg

SEQ ID NO: 3170051 - DNA, 17 bp, Homo sapiens
attcaacaatttcaata

SEQ ID NO: 3170052 - DNA, 22 bp, Homo sapiens
attcaaccactgtaaaatgaaa

SEQ ID NO: 3170053 - DNA, 13 bp, Homo sapiens
attcaactttgta

SEQ ID NO: 3170054 - DNA, 22 bp, Homo sapiens
attcaagaaaacaacttcaata

SEQ ID NO: 3170055 - DNA, 15 bp, Homo sapiens
attcaagcaaacatc

SEQ ID NO: 3170056 - DNA, 17 bp, Homo sapiens
attcaaggaatttctta

SEQ ID NO: 3170057 - DNA, 18 bp, Homo sapiens
attcaaggaatttcttaa

SEQ ID NO: 3170058 - DNA, 19 bp, Homo sapiens
attcaaggaatttcttaac

SEQ ID NO: 3170059 - DNA, 20 bp, Homo sapiens
attcaagtattgagaacctg

SEQ ID NO: 3170060 - DNA, 20 bp, Homo sapiens
attcaatgtgaacactggca

SEQ ID NO: 3170061 - DNA, 13 bp, Homo sapiens
attcaatgtgaca

SEQ ID NO: 3170062 - DNA, 13 bp, Homo sapiens
attcaattgtaaa

SEQ ID NO: 3170063 - DNA, 18 bp, Homo sapiens
attcaattgtaaattgaa

SEQ ID NO: 3170064 - DNA, 22 bp, Homo sapiens
attcaattgtaaattgaatcag

SEQ ID NO: 3170065 - DNA, 22 bp, Homo sapiens
attcacaaacttttatactctt

SEQ ID NO: 3170066 - DNA, 15 bp, Homo sapiens
attcacacctgactc

SEQ ID NO: 3170067 - DNA, 19 bp, Homo sapiens
attcacactttttatttaa

SEQ ID NO: 3170068 - DNA, 21 bp, Homo sapiens
attcacagtgctcttttctcc

SEQ ID NO: 3170069 - DNA, 22 bp, Homo sapiens
attcaccccctttcctggacac

SEQ ID NO: 3170070 - DNA, 20 bp, Homo sapiens
attcaccctccacttcccgt

SEQ ID NO: 3170071 - DNA, 17 bp, Homo sapiens
attcactcaagcactga

SEQ ID NO: 3170072 - DNA, 18 bp, Homo sapiens
attcactcaagcactgat

SEQ ID NO: 3170073 - DNA, 22 bp, Homo sapiens
attcactcactcactcattcct

SEQ ID NO: 3170074 - DNA, 21 bp, Homo sapiens
attcactgtataaactttttt

SEQ ID NO: 3170075 - DNA, 14 bp, Homo sapiens
attcactgtgcttc

SEQ ID NO: 3170076 - DNA, 18 bp, Homo sapiens
attcactgtgcttcgagc

SEQ ID NO: 3170077 - DNA, 17 bp, Homo sapiens
attcactgtttcactga

SEQ ID NO: 3170078 - DNA, 23 bp, Homo sapiens
attcacttcagtttaatgtctcc

SEQ ID NO: 3170079 - DNA, 18 bp, Homo sapiens
attcagaaaatgttctgt

SEQ ID NO: 3170080 - DNA, 13 bp, Homo sapiens
attcagaaatgtt

SEQ ID NO: 3170081 - DNA, 14 bp, Homo sapiens
attcagaaattgga

SEQ ID NO: 3170082 - DNA, 23 bp, Homo sapiens
attcagatcaaaatgcctttcag

SEQ ID NO: 3170083 - DNA, 22 bp, Homo sapiens
attcagattgtcttgcaacttc

SEQ ID NO: 3170084 - DNA, 18 bp, Homo sapiens
attcagcaccctgggtgc

SEQ ID NO: 3170085 - DNA, 14 bp, Homo sapiens
attcagcactgatt

SEQ ID NO: 3170086 - DNA, 19 bp, Homo sapiens
attcagcactgatttcaca

SEQ ID NO: 3170087 - DNA, 19 bp, Homo sapiens
attcagcagcaaattttca

SEQ ID NO: 3170088 - DNA, 14 bp, Homo sapiens
attcagcctgtttg

SEQ ID NO: 3170089 - DNA, 18 bp, Homo sapiens
attcagcgaagtctcatg

SEQ ID NO: 3170090 - DNA, 14 bp, Homo sapiens
attcagctctggag

SEQ ID NO: 3170091 - DNA, 15 bp, Homo sapiens
attcagctctggaga

SEQ ID NO: 3170092 - DNA, 17 bp, Homo sapiens
attcaggaagataaaaa

SEQ ID NO: 3170093 - DNA, 21 bp, Homo sapiens
attcaggagagtagaacagat

SEQ ID NO: 3170094 - DNA, 17 bp, Homo sapiens
attcaggccagcccagc

SEQ ID NO: 3170095 - DNA, 20 bp, Homo sapiens
attcaggccagcccagccag

SEQ ID NO: 3170096 - DNA, 12 bp, Homo sapiens
attcaggggctg

SEQ ID NO: 3170097 - DNA, 17 bp, Homo sapiens
attcaggggctgggggt

SEQ ID NO: 3170098 - DNA, 20 bp, Homo sapiens
attcaggtatgttgccttta

SEQ ID NO: 3170099 - DNA, 15 bp, Homo sapiens
attcagtaataactc

SEQ ID NO: 3170100 - DNA, 15 bp, Homo sapiens
attcagtgattactg

SEQ ID NO: 3170101 - DNA, 17 bp, Homo sapiens
attcagtgattactgtc

SEQ ID NO: 3170102 - DNA, 17 bp, Homo sapiens
attcagtgcttcttaaa

SEQ ID NO: 3170103 - DNA, 13 bp, Homo sapiens
attcagtttcata

SEQ ID NO: 3170104 - DNA, 15 bp, Homo sapiens
attcagtttttgtat

SEQ ID NO: 3170105 - DNA, 16 bp, Homo sapiens
attcagtttttgtatc

SEQ ID NO: 3170106 - DNA, 15 bp, Homo sapiens
attcataaagagaaa

SEQ ID NO: 3170107 - DNA, 17 bp, Homo sapiens
attcataaagagaaaat

SEQ ID NO: 3170108 - DNA, 23 bp, Homo sapiens
attcataacaatgtatgtgaaag

SEQ ID NO: 3170109 - DNA, 13 bp, Homo sapiens
attcataatgaat

SEQ ID NO: 3170110 - DNA, 19 bp, Homo sapiens
attcataatgaattataac

SEQ ID NO: 3170111 - DNA, 21 bp, Homo sapiens
attcataatgaattataacag

SEQ ID NO: 3170112 - DNA, 22 bp, Homo sapiens
attcatagggaaaggttttgta

SEQ ID NO: 3170113 - DNA, 17 bp, Homo sapiens
attcatattaagacagt

SEQ ID NO: 3170114 - DNA, 19 bp, Homo sapiens
attcatattctgttggaag

SEQ ID NO: 3170115 - DNA, 14 bp, Homo sapiens
attcatatttactt

SEQ ID NO: 3170116 - DNA, 14 bp, Homo sapiens
attcatcagcattt

SEQ ID NO: 3170117 - DNA, 19 bp, Homo sapiens
attcatctgggaggcagaa

SEQ ID NO: 3170118 - DNA, 20 bp, Homo sapiens
attcatggcatgcttaaatt

SEQ ID NO: 3170119 - DNA, 17 bp, Homo sapiens
attcatgttatatttaa

SEQ ID NO: 3170120 - DNA, 22 bp, Homo sapiens
attcatgttatatttaatgcat

SEQ ID NO: 3170121 - DNA, 21 bp, Homo sapiens
attcatgttttgagacataaa

SEQ ID NO: 3170122 - DNA, 14 bp, Homo sapiens
attcattacagctt

SEQ ID NO: 3170123 - DNA, 20 bp, Homo sapiens
attcattggttaacaataaa

SEQ ID NO: 3170124 - DNA, 10 bp, Homo sapiens
attcatttaa

SEQ ID NO: 3170125 - DNA, 15 bp, Homo sapiens
attcatttaaaatga

SEQ ID NO: 3170126 - DNA, 17 bp, Homo sapiens
attcatttaaaatgatt

SEQ ID NO: 3170127 - DNA, 20 bp, Homo sapiens
attcatttcacattaatggt

SEQ ID NO: 3170128 - DNA, 16 bp, Homo sapiens
attgacctctcagggc

SEQ ID NO: 3170129 - DNA, 17 bp, Homo sapiens
attgacctgaggagaca

SEQ ID NO: 3170130 - DNA, 19 bp, Homo sapiens
attgacctgaggagacatc

SEQ ID NO: 3170131 - DNA, 17 bp, Homo sapiens
attgacctgctccgctg

SEQ ID NO: 3170132 - DNA, 16 bp, Homo sapiens
attgacgattccttct

SEQ ID NO: 3170133 - DNA, 22 bp, Homo sapiens
attgactattttcgttcattac

SEQ ID NO: 3170134 - DNA, 11 bp, Homo sapiens
attgacttcat

SEQ ID NO: 3170135 - DNA, 13 bp, Homo sapiens
attgacttcattt

SEQ ID NO: 3170136 - DNA, 23 bp, Homo sapiens
attgacttcattttatatttaaa

SEQ ID NO: 3170137 - DNA, 13 bp, Homo sapiens
attgactttgaca

SEQ ID NO: 3170138 - DNA, 13 bp, Homo sapiens
attgagaaggaga

SEQ ID NO: 3170139 - DNA, 16 bp, Homo sapiens
attgagaaggagagaa

SEQ ID NO: 3170140 - DNA, 21 bp, Homo sapiens
attgagaattttaaattataa

SEQ ID NO: 3170141 - DNA, 14 bp, Homo sapiens
attgagagttttgt

SEQ ID NO: 3170142 - DNA, 12 bp, Homo sapiens
attgagatttct

SEQ ID NO: 3170143 - DNA, 22 bp, Homo sapiens
attgagctgatataaattctgt

SEQ ID NO: 3170144 - DNA, 14 bp, Homo sapiens
attgagcttgcatg

SEQ ID NO: 3170145 - DNA, 15 bp, Homo sapiens
attgaggaagagtct

SEQ ID NO: 3170146 - DNA, 16 bp, Homo sapiens
attgaggagctgcact

SEQ ID NO: 3170147 - DNA, 17 bp, Homo sapiens
attgagtaagatttacc

SEQ ID NO: 3170148 - DNA, 16 bp, Homo sapiens
attgagtattgtttaa

SEQ ID NO: 3170149 - DNA, 20 bp, Homo sapiens
attgagtattgtttaaaatg

SEQ ID NO: 3170150 - DNA, 15 bp, Homo sapiens
attgagtcaaatggt

SEQ ID NO: 3170151 - DNA, 16 bp, Homo sapiens
attgagtttgtaggta

SEQ ID NO: 3170152 - DNA, 14 bp, Homo sapiens
attgataatcttca

SEQ ID NO: 3170153 - DNA, 20 bp, Homo sapiens
attgataatcttcaggtgaa

SEQ ID NO: 3170154 - DNA, 21 bp, Homo sapiens
attgatatacacggatgactt

SEQ ID NO: 3170155 - DNA, 21 bp, Homo sapiens
attgatcaaatatagaaagtt

SEQ ID NO: 3170156 - DNA, 18 bp, Homo sapiens
attgatcattttcccccc

SEQ ID NO: 3170157 - DNA, 19 bp, Homo sapiens
attgatcggagcctcctct

SEQ ID NO: 3170158 - DNA, 22 bp, Homo sapiens
attgatgaaaagatttaagcac

SEQ ID NO: 3170159 - DNA, 14 bp, Homo sapiens
attgatgtatatgt

SEQ ID NO: 3170160 - DNA, 12 bp, Homo sapiens
attgatgtgttt

SEQ ID NO: 3170161 - DNA, 22 bp, Homo sapiens
attgattattctgattccactt

SEQ ID NO: 3170162 - DNA, 13 bp, Homo sapiens
attgattgggaaa

SEQ ID NO: 3170163 - DNA, 14 bp, Homo sapiens
attgattgggaaaa

SEQ ID NO: 3170164 - DNA, 15 bp, Homo sapiens
attgatttgcattga

SEQ ID NO: 3170165 - DNA, 15 bp, Homo sapiens
attgattttataatt

SEQ ID NO: 3170166 - DNA, 17 bp, Homo sapiens
attgatttttctcttca

SEQ ID NO: 3170167 - DNA, 18 bp, Homo sapiens
attgatttttctcttcat

SEQ ID NO: 3170168 - DNA, 16 bp, Homo sapiens
attgcaaatcttgaaa

SEQ ID NO: 3170169 - DNA, 17 bp, Homo sapiens
attgcaacaggctgggc

SEQ ID NO: 3170170 - DNA, 17 bp, Homo sapiens
attgcaataaagtataa

SEQ ID NO: 3170171 - DNA, 12 bp, Homo sapiens
attgcacacaga

SEQ ID NO: 3170172 - DNA, 23 bp, Homo sapiens
attgcaccactgcactccagcct

SEQ ID NO: 3170173 - DNA, 15 bp, Homo sapiens
attgcacgtggcctc

SEQ ID NO: 3170174 - DNA, 13 bp, Homo sapiens
attgcactaaatg

SEQ ID NO: 3170175 - DNA, 17 bp, Homo sapiens
attgcactgaagttttt

SEQ ID NO: 3170176 - DNA, 19 bp, Homo sapiens
attgcactgaagtttttga

SEQ ID NO: 3170177 - DNA, 14 bp, Homo sapiens
attgcactgctgtt

SEQ ID NO: 3170178 - DNA, 15 bp, Homo sapiens
attgcactgctgttc

SEQ ID NO: 3170179 - DNA, 18 bp, Homo sapiens
attgcagaaaattctgtg

SEQ ID NO: 3170180 - DNA, 17 bp, Homo sapiens
attgcagaaaggagaga

SEQ ID NO: 3170181 - DNA, 18 bp, Homo sapiens
attgcagcagataacttt

SEQ ID NO: 3170182 - DNA, 20 bp, Homo sapiens
attgcaggagacattttcat

SEQ ID NO: 3170183 - DNA, 23 bp, Homo sapiens
attgcagtctaaaacttcaaaaa

SEQ ID NO: 3170184 - DNA, 13 bp, Homo sapiens
attgcataaagca

SEQ ID NO: 3170185 - DNA, 14 bp, Homo sapiens
attgcataaagcat

SEQ ID NO: 3170186 - DNA, 13 bp, Homo sapiens
attgcatccacta

SEQ ID NO: 3170187 - DNA, 19 bp, Homo sapiens
attgcatccactagcttct

SEQ ID NO: 3170188 - DNA, 23 bp, Homo sapiens
attgcatcggactaaactatctg

SEQ ID NO: 3170189 - DNA, 19 bp, Homo sapiens
attgcatctcaaaattatt

SEQ ID NO: 3170190 - DNA, 16 bp, Homo sapiens
attgcatttcctgaca

SEQ ID NO: 3170191 - DNA, 17 bp, Homo sapiens
attgcatttcctgacag

SEQ ID NO: 3170192 - DNA, 14 bp, Homo sapiens
attgccaaattgac

SEQ ID NO: 3170193 - DNA, 14 bp, Homo sapiens
attgccaccaggag

SEQ ID NO: 3170194 - DNA, 15 bp, Homo sapiens
attgccaccaggaga

SEQ ID NO: 3170195 - DNA, 15 bp, Homo sapiens
attgccagtgtcttt

SEQ ID NO: 3170196 - DNA, 17 bp, Homo sapiens
attgccatggtctttcc

SEQ ID NO: 3170197 - DNA, 17 bp, Homo sapiens
attgcccacgctggagt

SEQ ID NO: 3170198 - DNA, 20 bp, Homo sapiens
attgcctcttttcacatttt

SEQ ID NO: 3170199 - DNA, 22 bp, Homo sapiens
attgcctgtgtatggaaaaacc

SEQ ID NO: 3170200 - DNA, 17 bp, Homo sapiens
attgccttttaattttt

SEQ ID NO: 3170201 - DNA, 19 bp, Homo sapiens
attgcggacagccacggcc

SEQ ID NO: 3170202 - DNA, 20 bp, Homo sapiens
attgcgtttgaccttttatg

SEQ ID NO: 3170203 - DNA, 21 bp, Homo sapiens
attgcgtttgaccttttatgt

SEQ ID NO: 3170204 - DNA, 21 bp, Homo sapiens
attgctaatcaccaaaggctc

SEQ ID NO: 3170205 - DNA, 21 bp, Homo sapiens
attgctactataatcaaatga

SEQ ID NO: 3170206 - DNA, 14 bp, Homo sapiens
attgctactgtcct

SEQ ID NO: 3170207 - DNA, 18 bp, Homo sapiens
attgctagccagcattcc

SEQ ID NO: 3170208 - DNA, 13 bp, Homo sapiens
attgctcctaact

SEQ ID NO: 3170209 - DNA, 19 bp, Homo sapiens
attgctcctaactccaccg

SEQ ID NO: 3170210 - DNA, 14 bp, Homo sapiens
attgctctctgggc

SEQ ID NO: 3170211 - DNA, 18 bp, Homo sapiens
attgctctgtgtatatct

SEQ ID NO: 3170212 - DNA, 19 bp, Homo sapiens
attgctctgtgtatatctc

SEQ ID NO: 3170213 - DNA, 12 bp, Homo sapiens
attgctgaaatt

SEQ ID NO: 3170214 - DNA, 13 bp, Homo sapiens
attgctgaaattt

SEQ ID NO: 3170215 - DNA, 17 bp, Homo sapiens
attgctgagaagcaaac

SEQ ID NO: 3170216 - DNA, 23 bp, Homo sapiens
attgctgagagaaatatggaact

SEQ ID NO: 3170217 - DNA, 14 bp, Homo sapiens
attgctgagcctct

SEQ ID NO: 3170218 - DNA, 16 bp, Homo sapiens
attgctgagcctctgc

SEQ ID NO: 3170219 - DNA, 22 bp, Homo sapiens
attgctggtagagacccccagg

SEQ ID NO: 3170220 - DNA, 14 bp, Homo sapiens
attgctggttctat

SEQ ID NO: 3170221 - DNA, 19 bp, Homo sapiens
attgctgtctatgattgta

SEQ ID NO: 3170222 - DNA, 18 bp, Homo sapiens
attgctgtgctttatgga

SEQ ID NO: 3170223 - DNA, 13 bp, Homo sapiens
attgctgttgaga

SEQ ID NO: 3170224 - DNA, 19 bp, Homo sapiens
attgcttacatttttacaa

SEQ ID NO: 3170225 - DNA, 20 bp, Homo sapiens
attgcttacatttttacaat

SEQ ID NO: 3170226 - DNA, 14 bp, Homo sapiens
attgcttattttat

SEQ ID NO: 3170227 - DNA, 16 bp, Homo sapiens
attgcttattttatta

SEQ ID NO: 3170228 - DNA, 16 bp, Homo sapiens
attgcttcctcctccc

SEQ ID NO: 3170229 - DNA, 11 bp, Homo sapiens
attgcttcttg

SEQ ID NO: 3170230 - DNA, 14 bp, Homo sapiens
attgcttcttgtgt

SEQ ID NO: 3170231 - DNA, 16 bp, Homo sapiens
attgctttctgaaatt

SEQ ID NO: 3170232 - DNA, 15 bp, Homo sapiens
attgctttgccaaaa

SEQ ID NO: 3170233 - DNA, 23 bp, Homo sapiens
attgcttttttccaaaacaaaaa

SEQ ID NO: 3170234 - DNA, 18 bp, Homo sapiens
attgcttttttgtattgg

SEQ ID NO: 3170235 - DNA, 23 bp, Homo sapiens
attggaaatggatgcaaagtaca

SEQ ID NO: 3170236 - DNA, 15 bp, Homo sapiens
attggaaatgtactt

SEQ ID NO: 3170237 - DNA, 16 bp, Homo sapiens
attggaacagaatgtt

SEQ ID NO: 3170238 - DNA, 14 bp, Homo sapiens
attggaatctgata

SEQ ID NO: 3170239 - DNA, 21 bp, Homo sapiens
attggaatggaactactgtac

SEQ ID NO: 3170240 - DNA, 16 bp, Homo sapiens
attggaattaacctgg

SEQ ID NO: 3170241 - DNA, 19 bp, Homo sapiens
attggaattaacctggtgc

SEQ ID NO: 3170242 - DNA, 20 bp, Homo sapiens
attggaattaacctggtgct

SEQ ID NO: 3170243 - DNA, 21 bp, Homo sapiens
attggacagttgtctagagat

SEQ ID NO: 3170244 - DNA, 22 bp, Homo sapiens
attggacatagatattttcaca

SEQ ID NO: 3170245 - DNA, 22 bp, Homo sapiens
attggagctgactgttcttggt

SEQ ID NO: 3170246 - DNA, 23 bp, Homo sapiens
attggaggtgagatcacagcctc

SEQ ID NO: 3170247 - DNA, 14 bp, Homo sapiens
attggatatttgat

SEQ ID NO: 3170248 - DNA, 16 bp, Homo sapiens
attggattatttaata

SEQ ID NO: 3170249 - DNA, 18 bp, Homo sapiens
attggattatttaataac

SEQ ID NO: 3170250 - DNA, 20 bp, Homo sapiens
attggattatttaataacat

SEQ ID NO: 3170251 - DNA, 14 bp, Homo sapiens
attggatttcctaa

SEQ ID NO: 3170252 - DNA, 15 bp, Homo sapiens
attggcaccatgtgc

SEQ ID NO: 3170253 - DNA, 15 bp, Homo sapiens
attggcagtgacttt

SEQ ID NO: 3170254 - DNA, 12 bp, Homo sapiens
atttcaaggttc

SEQ ID NO: 3170255 - DNA, 11 bp, Homo sapiens
atttcaagtgc

SEQ ID NO: 3170256 - DNA, 16 bp, Homo sapiens
atttcaagtgcctaga

SEQ ID NO: 3170257 - DNA, 16 bp, Homo sapiens
atttcaatactgctga

SEQ ID NO: 3170258 - DNA, 14 bp, Homo sapiens
atttcaatcattga

SEQ ID NO: 3170259 - DNA, 22 bp, Homo sapiens
atttcaatcccacgtacttata

SEQ ID NO: 3170260 - DNA, 20 bp, Homo sapiens
atttcaatgtgtataaattg

SEQ ID NO: 3170261 - DNA, 14 bp, Homo sapiens
atttcaattctcaa

SEQ ID NO: 3170262 - DNA, 15 bp, Homo sapiens
atttcacaacagatc

SEQ ID NO: 3170263 - DNA, 20 bp, Homo sapiens
atttcacaacagatcaattt

SEQ ID NO: 3170264 - DNA, 20 bp, Homo sapiens
atttcacaatataaagttct

SEQ ID NO: 3170265 - DNA, 17 bp, Homo sapiens
atttcacacataagaaa

SEQ ID NO: 3170266 - DNA, 18 bp, Homo sapiens
atttcacattaatggtct

SEQ ID NO: 3170267 - DNA, 11 bp, Homo sapiens
atttcacattg

SEQ ID NO: 3170268 - DNA, 18 bp, Homo sapiens
atttcaccagaagttaca

SEQ ID NO: 3170269 - DNA, 14 bp, Homo sapiens
atttcacctcctta

SEQ ID NO: 3170270 - DNA, 22 bp, Homo sapiens
atttcacctccttagtccccct

SEQ ID NO: 3170271 - DNA, 18 bp, Homo sapiens
atttcactactagattga

SEQ ID NO: 3170272 - DNA, 22 bp, Homo sapiens
atttcactagagacaaatcttt

SEQ ID NO: 3170273 - DNA, 14 bp, Homo sapiens
atttcactattttt

SEQ ID NO: 3170274 - DNA, 22 bp, Homo sapiens
atttcactgtctttaattctgt

SEQ ID NO: 3170275 - DNA, 12 bp, Homo sapiens
atttcacttgat

SEQ ID NO: 3170276 - DNA, 15 bp, Homo sapiens
atttcactttagatg

SEQ ID NO: 3170277 - DNA, 15 bp, Homo sapiens
atttcacttttgttc

SEQ ID NO: 3170278 - DNA, 16 bp, Homo sapiens
atttcacttttgttct

SEQ ID NO: 3170279 - DNA, 18 bp, Homo sapiens
atttcacttttgttctgc

SEQ ID NO: 3170280 - DNA, 22 bp, Homo sapiens
atttcagacctagcagggaagg

SEQ ID NO: 3170281 - DNA, 16 bp, Homo sapiens
atttcagactgcagag

SEQ ID NO: 3170282 - DNA, 19 bp, Homo sapiens
atttcagggagaaactcca

SEQ ID NO: 3170283 - DNA, 20 bp, Homo sapiens
atttcagggagaaactccaa

SEQ ID NO: 3170284 - DNA, 21 bp, Homo sapiens
atttcagggagaaactccaaa

SEQ ID NO: 3170285 - DNA, 17 bp, Homo sapiens
atttcagtatcatctcc

SEQ ID NO: 3170286 - DNA, 19 bp, Homo sapiens
atttcagtgtaaagtgtgt

SEQ ID NO: 3170287 - DNA, 20 bp, Homo sapiens
atttcagtgtagttaattta

SEQ ID NO: 3170288 - DNA, 15 bp, Homo sapiens
atttcagtttttcat

SEQ ID NO: 3170289 - DNA, 16 bp, Homo sapiens
atttcagtttttcatt

SEQ ID NO: 3170290 - DNA, 21 bp, Homo sapiens
atttcagtttttcatttgttt

SEQ ID NO: 3170291 - DNA, 18 bp, Homo sapiens
atttcataaacaacttaa

SEQ ID NO: 3170292 - DNA, 23 bp, Homo sapiens
atttcatactgaaattattttct

SEQ ID NO: 3170293 - DNA, 23 bp, Homo sapiens
atttcatactgtaacattcagga

SEQ ID NO: 3170294 - DNA, 13 bp, Homo sapiens
atttcatagttca

SEQ ID NO: 3170295 - DNA, 15 bp, Homo sapiens
atttcatagttcaga

SEQ ID NO: 3170296 - DNA, 16 bp, Homo sapiens
atttcatagttcagaa

SEQ ID NO: 3170297 - DNA, 17 bp, Homo sapiens
atttcatagttcagaat

SEQ ID NO: 3170298 - DNA, 20 bp, Homo sapiens
atttcatatctacagataga

SEQ ID NO: 3170299 - DNA, 16 bp, Homo sapiens
atttcatattgatctt

SEQ ID NO: 3170300 - DNA, 14 bp, Homo sapiens
atttcatcattgtt

SEQ ID NO: 3170301 - DNA, 14 bp, Homo sapiens
atttcatgtggctg

SEQ ID NO: 3170302 - DNA, 15 bp, Homo sapiens
atttcattcaaatca

SEQ ID NO: 3170303 - DNA, 18 bp, Homo sapiens
atttcattcaaatcagtg

SEQ ID NO: 3170304 - DNA, 20 bp, Homo sapiens
atttcattcaaatcagtgat

SEQ ID NO: 3170305 - DNA, 14 bp, Homo sapiens
atttcattcctaac

SEQ ID NO: 3170306 - DNA, 17 bp, Homo sapiens
atttcattgcctgtgta

SEQ ID NO: 3170307 - DNA, 14 bp, Homo sapiens
atttcattgtatga

SEQ ID NO: 3170308 - DNA, 15 bp, Homo sapiens
atttcattgtatgat

SEQ ID NO: 3170309 - DNA, 19 bp, Homo sapiens
atttcattgtatgatgtgt

SEQ ID NO: 3170310 - DNA, 20 bp, Homo sapiens
atttcattgtatgatgtgtt

SEQ ID NO: 3170311 - DNA, 21 bp, Homo sapiens
atttcattgtatgatgtgttg

SEQ ID NO: 3170312 - DNA, 16 bp, Homo sapiens
atttcattttttgcat

SEQ ID NO: 3170313 - DNA, 19 bp, Homo sapiens
atttccaacaccacagaca

SEQ ID NO: 3170314 - DNA, 19 bp, Homo sapiens
atttccaactcgaatctgt

SEQ ID NO: 3170315 - DNA, 20 bp, Homo sapiens
atttccaactcgaatctgtg

SEQ ID NO: 3170316 - DNA, 19 bp, Homo sapiens
atttccaagtaatataatg

SEQ ID NO: 3170317 - DNA, 23 bp, Homo sapiens
atttccacatggaatcaatcttt

SEQ ID NO: 3170318 - DNA, 11 bp, Homo sapiens
atttccaggcc

SEQ ID NO: 3170319 - DNA, 12 bp, Homo sapiens
atttccaggccc

SEQ ID NO: 3170320 - DNA, 19 bp, Homo sapiens
atttccaggcccctgagga

SEQ ID NO: 3170321 - DNA, 23 bp, Homo sapiens
atttccaggcccctgaggactgg

SEQ ID NO: 3170322 - DNA, 18 bp, Homo sapiens
atttccagtgagtgtaaa

SEQ ID NO: 3170323 - DNA, 19 bp, Homo sapiens
atttccagtgagtgtaaat

SEQ ID NO: 3170324 - DNA, 21 bp, Homo sapiens
atttccagtgttctatgaaca

SEQ ID NO: 3170325 - DNA, 17 bp, Homo sapiens
atttccatatggatttt

SEQ ID NO: 3170326 - DNA, 16 bp, Homo sapiens
atttccatctctggta

SEQ ID NO: 3170327 - DNA, 15 bp, Homo sapiens
atttccattatttat

SEQ ID NO: 3170328 - DNA, 17 bp, Homo sapiens
atttccattccagaata

SEQ ID NO: 3170329 - DNA, 14 bp, Homo sapiens
atttcccacatctt

SEQ ID NO: 3170330 - DNA, 15 bp, Homo sapiens
atttcccacatcttt

SEQ ID NO: 3170331 - DNA, 14 bp, Homo sapiens
atttcccatctgca

SEQ ID NO: 3170332 - DNA, 21 bp, Homo sapiens
atttcccatttgtgccagagg

SEQ ID NO: 3170333 - DNA, 22 bp, Homo sapiens
atttcccatttgtgccagagga

SEQ ID NO: 3170334 - DNA, 21 bp, Homo sapiens
atttccccaggggaaaatgaa

SEQ ID NO: 3170335 - DNA, 16 bp, Homo sapiens
atttcccctccttccc

SEQ ID NO: 3170336 - DNA, 18 bp, Homo sapiens
atttccctaaaatacatt

SEQ ID NO: 3170337 - DNA, 21 bp, Homo sapiens
atttccctaaaatacatttaa

SEQ ID NO: 3170338 - DNA, 16 bp, Homo sapiens
atttccctatggctga

SEQ ID NO: 3170339 - DNA, 14 bp, Homo sapiens
atttccctcaggtt

SEQ ID NO: 3170340 - DNA, 20 bp, Homo sapiens
atttccctcaggttctattt

SEQ ID NO: 3170341 - DNA, 13 bp, Homo sapiens
atttcccttcttg

SEQ ID NO: 3170342 - DNA, 23 bp, Homo sapiens
atttcccttgaaattttaaacta

SEQ ID NO: 3170343 - DNA, 13 bp, Homo sapiens
atttccggctgct

SEQ ID NO: 3170344 - DNA, 20 bp, Homo sapiens
atttcctaaacataattgtg

SEQ ID NO: 3170345 - DNA, 17 bp, Homo sapiens
atttcctaatactgtca

SEQ ID NO: 3170346 - DNA, 16 bp, Homo sapiens
atttcctggccctcca

SEQ ID NO: 3170347 - DNA, 14 bp, Homo sapiens
atttcctgtgtctt

SEQ ID NO: 3170348 - DNA, 21 bp, Homo sapiens
atttccttaaaatctctaata

SEQ ID NO: 3170349 - DNA, 15 bp, Homo sapiens
atttcgcttcttaga

SEQ ID NO: 3170350 - DNA, 17 bp, Homo sapiens
atttcggattttttcca

SEQ ID NO: 3170351 - DNA, 19 bp, Homo sapiens
atttcggattttttccaaa

SEQ ID NO: 3170352 - DNA, 20 bp, Homo sapiens
atttcggattttttccaaaa

SEQ ID NO: 3170353 - DNA, 20 bp, Homo sapiens
atttcggttgagaatggaaa

SEQ ID NO: 3170354 - DNA, 14 bp, Homo sapiens
atttctaaaaagat

SEQ ID NO: 3170355 - DNA, 20 bp, Homo sapiens
atttctaaaaagattagcaa

SEQ ID NO: 3170356 - DNA, 12 bp, Homo sapiens
atttctaaaaga

SEQ ID NO: 3170357 - DNA, 14 bp, Homo sapiens
atttctaaaatctt

SEQ ID NO: 3170358 - DNA, 14 bp, Homo sapiens
atttctaactatat

SEQ ID NO: 3170359 - DNA, 15 bp, Homo sapiens
atttctaagtattta

SEQ ID NO: 3170360 - DNA, 19 bp, Homo sapiens
atttctaagtatttaaatg

SEQ ID NO: 3170361 - DNA, 18 bp, Homo sapiens
atttctaatgttggacac

SEQ ID NO: 3170362 - DNA, 18 bp, Homo sapiens
atttctaccatttcagag

SEQ ID NO: 3170363 - DNA, 18 bp, Homo sapiens
atttctagctttttaatt

SEQ ID NO: 3170364 - DNA, 13 bp, Homo sapiens
atttctagttttt

SEQ ID NO: 3170365 - DNA, 16 bp, Homo sapiens
atttctatactttaca

SEQ ID NO: 3170366 - DNA, 15 bp, Homo sapiens
atttctatatttatt

SEQ ID NO: 3170367 - DNA, 22 bp, Homo sapiens
atttctattattaattgcaaaa

SEQ ID NO: 3170368 - DNA, 19 bp, Homo sapiens
atttctcaacaaagcacag

SEQ ID NO: 3170369 - DNA, 16 bp, Homo sapiens
atttctccagttggga

SEQ ID NO: 3170370 - DNA, 15 bp, Homo sapiens
atttctccatacgca

SEQ ID NO: 3170371 - DNA, 16 bp, Homo sapiens
atttctcctttgcaat

SEQ ID NO: 3170372 - DNA, 21 bp, Homo sapiens
atttctcctttgcaatagcag

SEQ ID NO: 3170373 - DNA, 20 bp, Homo sapiens
atttctctccccactgaaaa

SEQ ID NO: 3170374 - DNA, 13 bp, Homo sapiens
atttctcttctca

SEQ ID NO: 3170375 - DNA, 23 bp, Homo sapiens
atttctgagtttcattctcctgc

SEQ ID NO: 3170376 - DNA, 21 bp, Homo sapiens
atttctgcagatcttccgtgg

SEQ ID NO: 3170377 - DNA, 18 bp, Homo sapiens
atttctgcatatgttgaa

SEQ ID NO: 3170378 - DNA, 16 bp, Homo sapiens
atttctgggtcttttg

SEQ ID NO: 3170379 - DNA, 18 bp, Homo sapiens
atttctgggtcttttgct

SEQ ID NO: 3170380 - DNA, 17 bp, Homo sapiens
atttttatttcttccta

SEQ ID NO: 3170381 - DNA, 16 bp, Homo sapiens
atttttatttttctaa

SEQ ID NO: 3170382 - DNA, 11 bp, Homo sapiens
atttttcaatc

SEQ ID NO: 3170383 - DNA, 14 bp, Homo sapiens
atttttcagatgct

SEQ ID NO: 3170384 - DNA, 15 bp, Homo sapiens
atttttcagatgctt

SEQ ID NO: 3170385 - DNA, 18 bp, Homo sapiens
atttttcagttccaagaa

SEQ ID NO: 3170386 - DNA, 22 bp, Homo sapiens
atttttcagttccaagaaagat

SEQ ID NO: 3170387 - DNA, 15 bp, Homo sapiens
atttttccaaaataa

SEQ ID NO: 3170388 - DNA, 13 bp, Homo sapiens
atttttccaacta

SEQ ID NO: 3170389 - DNA, 14 bp, Homo sapiens
atttttccatttat

SEQ ID NO: 3170390 - DNA, 17 bp, Homo sapiens
atttttccgtttgcttt

SEQ ID NO: 3170391 - DNA, 23 bp, Homo sapiens
atttttcggaggccccactgatg

SEQ ID NO: 3170392 - DNA, 14 bp, Homo sapiens
atttttctaaagaa

SEQ ID NO: 3170393 - DNA, 19 bp, Homo sapiens
atttttctcagtttgtata

SEQ ID NO: 3170394 - DNA, 10 bp, Homo sapiens
atttttctct

SEQ ID NO: 3170395 - DNA, 18 bp, Homo sapiens
atttttgacatggaaatg

SEQ ID NO: 3170396 - DNA, 22 bp, Homo sapiens
atttttgattgttatgtaaaac

SEQ ID NO: 3170397 - DNA, 15 bp, Homo sapiens
atttttgccatacat

SEQ ID NO: 3170398 - DNA, 18 bp, Homo sapiens
atttttgccatacatcag

SEQ ID NO: 3170399 - DNA, 18 bp, Homo sapiens
atttttgcctcttccagt

SEQ ID NO: 3170400 - DNA, 18 bp, Homo sapiens
atttttgcttttagaaaa

SEQ ID NO: 3170401 - DNA, 20 bp, Homo sapiens
atttttggggaaaaaagcac

SEQ ID NO: 3170402 - DNA, 21 bp, Homo sapiens
atttttggggaaaaaagcaca

SEQ ID NO: 3170403 - DNA, 19 bp, Homo sapiens
atttttggttgtcaatatt

SEQ ID NO: 3170404 - DNA, 18 bp, Homo sapiens
atttttgtaaaagacatt

SEQ ID NO: 3170405 - DNA, 19 bp, Homo sapiens
atttttgtaatgtgaaaag

SEQ ID NO: 3170406 - DNA, 12 bp, Homo sapiens
atttttgtacat

SEQ ID NO: 3170407 - DNA, 17 bp, Homo sapiens
atttttgtacatattgt

SEQ ID NO: 3170408 - DNA, 20 bp, Homo sapiens
atttttgtgttttcttgtaa

SEQ ID NO: 3170409 - DNA, 21 bp, Homo sapiens
atttttgttaattttcctcat

SEQ ID NO: 3170410 - DNA, 16 bp, Homo sapiens
atttttgttgttgttg

SEQ ID NO: 3170411 - DNA, 22 bp, Homo sapiens
atttttgtttcttccaaagcac

SEQ ID NO: 3170412 - DNA, 17 bp, Homo sapiens
atttttgtttttgtaat

SEQ ID NO: 3170413 - DNA, 21 bp, Homo sapiens
attttttaaaacactaaaagc

SEQ ID NO: 3170414 - DNA, 17 bp, Homo sapiens
attttttaaaagaaatt

SEQ ID NO: 3170415 - DNA, 13 bp, Homo sapiens
attttttaaaata

SEQ ID NO: 3170416 - DNA, 19 bp, Homo sapiens
attttttaaatgaaagaag

SEQ ID NO: 3170417 - DNA, 17 bp, Homo sapiens
attttttaaggaaacaa

SEQ ID NO: 3170418 - DNA, 18 bp, Homo sapiens
attttttaagtatttata

SEQ ID NO: 3170419 - DNA, 19 bp, Homo sapiens
attttttaagtatttatat

SEQ ID NO: 3170420 - DNA, 19 bp, Homo sapiens
attttttaatttaaagctt

SEQ ID NO: 3170421 - DNA, 21 bp, Homo sapiens
attttttaatttgatgaaagc

SEQ ID NO: 3170422 - DNA, 22 bp, Homo sapiens
attttttaatttgatgaaagct

SEQ ID NO: 3170423 - DNA, 22 bp, Homo sapiens
attttttatgggcattgacaaa

SEQ ID NO: 3170424 - DNA, 16 bp, Homo sapiens
attttttatttacatt

SEQ ID NO: 3170425 - DNA, 14 bp, Homo sapiens
attttttatttcta

SEQ ID NO: 3170426 - DNA, 13 bp, Homo sapiens
attttttcagaaa

SEQ ID NO: 3170427 - DNA, 22 bp, Homo sapiens
attttttcagaaatatgtggtt

SEQ ID NO: 3170428 - DNA, 14 bp, Homo sapiens
attttttccctcct

SEQ ID NO: 3170429 - DNA, 21 bp, Homo sapiens
attttttctaaaacattcccc

SEQ ID NO: 3170430 - DNA, 14 bp, Homo sapiens
attttttcttttgt

SEQ ID NO: 3170431 - DNA, 20 bp, Homo sapiens
attttttcttttgtaattgt

SEQ ID NO: 3170432 - DNA, 14 bp, Homo sapiens
attttttgaaagtt

SEQ ID NO: 3170433 - DNA, 14 bp, Homo sapiens
attttttgtataat

SEQ ID NO: 3170434 - DNA, 14 bp, Homo sapiens
attttttgttctgt

SEQ ID NO: 3170435 - DNA, 17 bp, Homo sapiens
atttttttaaaattttg

SEQ ID NO: 3170436 - DNA, 22 bp, Homo sapiens
atttttttaagttagagaatat

SEQ ID NO: 3170437 - DNA, 16 bp, Homo sapiens
atttttttattactga

SEQ ID NO: 3170438 - DNA, 21 bp, Homo sapiens
atttttttcactggagttaca

SEQ ID NO: 3170439 - DNA, 22 bp, Homo sapiens
atttttttcactggagttacat

SEQ ID NO: 3170440 - DNA, 16 bp, Homo sapiens
atttttttcctaagtt

SEQ ID NO: 3170441 - DNA, 13 bp, Homo sapiens
atttttttctacc

SEQ ID NO: 3170442 - DNA, 16 bp, Homo sapiens
atttttttctacctat

SEQ ID NO: 3170443 - DNA, 20 bp, Homo sapiens
atttttttctaccttgaggt

SEQ ID NO: 3170444 - DNA, 23 bp, Homo sapiens
atttttttgcatgcatgcaaatg

SEQ ID NO: 3170445 - DNA, 15 bp, Homo sapiens
attttttttcaaaaa

SEQ ID NO: 3170446 - DNA, 16 bp, Homo sapiens
atttttttttcaatca

SEQ ID NO: 3170447 - DNA, 19 bp, Homo sapiens
atttttttttcaatcaact

SEQ ID NO: 3170448 - DNA, 14 bp, Homo sapiens
atttttttttcata

SEQ ID NO: 3170449 - DNA, 19 bp, Homo sapiens
atttttttttcatacactt

SEQ ID NO: 3170450 - DNA, 20 bp, Homo sapiens
atttttttttcatacactta

SEQ ID NO: 3170451 - DNA, 17 bp, Homo sapiens
atttttttttcctagcc

SEQ ID NO: 3170452 - DNA, 21 bp, Homo sapiens
attttttttttcctcttcaga

SEQ ID NO: 3170453 - DNA, 22 bp, Homo sapiens
caaaaaaaaaaaaaagcatcta

SEQ ID NO: 3170454 - DNA, 21 bp, Homo sapiens
caaaaaaaaaaaaagaagacc

SEQ ID NO: 3170455 - DNA, 15 bp, Homo sapiens
caaaaaaaatttaaa

SEQ ID NO: 3170456 - DNA, 17 bp, Homo sapiens
caaaaaaaggaaaaata

SEQ ID NO: 3170457 - DNA, 22 bp, Homo sapiens
caaaaaaaggaaaaataatcaa

SEQ ID NO: 3170458 - DNA, 23 bp, Homo sapiens
caaaaaaatatatttaatgataa

SEQ ID NO: 3170459 - DNA, 18 bp, Homo sapiens
caaaaaaatttaaaatta

SEQ ID NO: 3170460 - DNA, 15 bp, Homo sapiens
caaaaaatgttttaa

SEQ ID NO: 3170461 - DNA, 13 bp, Homo sapiens
caaaaaattatat

SEQ ID NO: 3170462 - DNA, 20 bp, Homo sapiens
caaaaacaggtatatacttt

SEQ ID NO: 3170463 - DNA, 17 bp, Homo sapiens
caaaaagaaaaatcaaa

SEQ ID NO: 3170464 - DNA, 14 bp, Homo sapiens
caaaaagaaatgac

SEQ ID NO: 3170465 - DNA, 22 bp, Homo sapiens
caaaaagaatctgcatttagca

SEQ ID NO: 3170466 - DNA, 23 bp, Homo sapiens
caaaaagaatctgcatttagcac

SEQ ID NO: 3170467 - DNA, 20 bp, Homo sapiens
caaaaagcaagggagaaaag

SEQ ID NO: 3170468 - DNA, 16 bp, Homo sapiens
caaaaagcagagtgga

SEQ ID NO: 3170469 - DNA, 21 bp, Homo sapiens
caaaaagcagagtggactgca

SEQ ID NO: 3170470 - DNA, 22 bp, Homo sapiens
caaaaaggctagtttattttgt

SEQ ID NO: 3170471 - DNA, 20 bp, Homo sapiens
caaaaagggaaactattgtc

SEQ ID NO: 3170472 - DNA, 13 bp, Homo sapiens
caaaaaggttgct

SEQ ID NO: 3170473 - DNA, 17 bp, Homo sapiens
caaaaataaaaaatctg

SEQ ID NO: 3170474 - DNA, 22 bp, Homo sapiens
caaaaataaaaaatctgaagag

SEQ ID NO: 3170475 - DNA, 15 bp, Homo sapiens
caaaaatataaaata

SEQ ID NO: 3170476 - DNA, 14 bp, Homo sapiens
caaaaatatttata

SEQ ID NO: 3170477 - DNA, 19 bp, Homo sapiens
caaaaatctcccagtgaca

SEQ ID NO: 3170478 - DNA, 17 bp, Homo sapiens
caaaaatgacaacagaa

SEQ ID NO: 3170479 - DNA, 10 bp, Homo sapiens
caaaaatggg

SEQ ID NO: 3170480 - DNA, 19 bp, Homo sapiens
caaaaatgggaaaaataaa

SEQ ID NO: 3170481 - DNA, 11 bp, Homo sapiens
caaaaatgttg

SEQ ID NO: 3170482 - DNA, 14 bp, Homo sapiens
caaaaatgttgaac

SEQ ID NO: 3170483 - DNA, 15 bp, Homo sapiens
caaaaattacaaaga

SEQ ID NO: 3170484 - DNA, 18 bp, Homo sapiens
caaaaattaggtattttg

SEQ ID NO: 3170485 - DNA, 23 bp, Homo sapiens
caaaaattcagagtccttgcaaa

SEQ ID NO: 3170486 - DNA, 17 bp, Homo sapiens
caaaaattgtctttatg

SEQ ID NO: 3170487 - DNA, 21 bp, Homo sapiens
caaaaatttctgtaaaacagg

SEQ ID NO: 3170488 - DNA, 22 bp, Homo sapiens
caaaaatttctgtaaaacaggt

SEQ ID NO: 3170489 - DNA, 16 bp, Homo sapiens
caaaacaaaaagatgt

SEQ ID NO: 3170490 - DNA, 18 bp, Homo sapiens
caaaacaaaaagatgtct

SEQ ID NO: 3170491 - DNA, 22 bp, Homo sapiens
caaaacaaaaattaggtatttt

SEQ ID NO: 3170492 - DNA, 23 bp, Homo sapiens
caaaacaaaaattaggtattttg

SEQ ID NO: 3170493 - DNA, 16 bp, Homo sapiens
caaaacaaacatgcag

SEQ ID NO: 3170494 - DNA, 19 bp, Homo sapiens
caaaacacactactacctc

SEQ ID NO: 3170495 - DNA, 13 bp, Homo sapiens
caaaacactgtgg

SEQ ID NO: 3170496 - DNA, 16 bp, Homo sapiens
caaaacactgtggaac

SEQ ID NO: 3170497 - DNA, 14 bp, Homo sapiens
caaaaccatctctc

SEQ ID NO: 3170498 - DNA, 14 bp, Homo sapiens
caaaacccaggaca

SEQ ID NO: 3170499 - DNA, 17 bp, Homo sapiens
caaaactccgcccccag

SEQ ID NO: 3170500 - DNA, 21 bp, Homo sapiens
caaaactccgcccccagccta

SEQ ID NO: 3170501 - DNA, 11 bp, Homo sapiens
caaaactctac

SEQ ID NO: 3170502 - DNA, 19 bp, Homo sapiens
caaaactgcctgaaagcaa

SEQ ID NO: 3170503 - DNA, 11 bp, Homo sapiens
caaaactgttc

SEQ ID NO: 3170504 - DNA, 15 bp, Homo sapiens
caaaactgttctttt

SEQ ID NO: 3170505 - DNA, 17 bp, Homo sapiens
caaattcagtttcataa

SEQ ID NO: 3170506 - DNA, 23 bp, Homo sapiens
caaattcatggcatgcttaaatt

SEQ ID NO: 3170507 - DNA, 20 bp, Homo sapiens
caaattctacaacttttcct

SEQ ID NO: 3170508 - DNA, 18 bp, Homo sapiens
caaattctcttctttttc

SEQ ID NO: 3170509 - DNA, 22 bp, Homo sapiens
caaattctgcttgcttgctttt

SEQ ID NO: 3170510 - DNA, 15 bp, Homo sapiens
caaattcttctgaac

SEQ ID NO: 3170511 - DNA, 13 bp, Homo sapiens
caaattgaaaaca

SEQ ID NO: 3170512 - DNA, 18 bp, Homo sapiens
caaattgattgtctttcc

SEQ ID NO: 3170513 - DNA, 19 bp, Homo sapiens
caaattgattgtctttccc

SEQ ID NO: 3170514 - DNA, 20 bp, Homo sapiens
caaattgcactgaagttttt

SEQ ID NO: 3170515 - DNA, 21 bp, Homo sapiens
caaattgcactgaagtttttg

SEQ ID NO: 3170516 - DNA, 15 bp, Homo sapiens
caaattgctgcttgg

SEQ ID NO: 3170517 - DNA, 20 bp, Homo sapiens
caaattgcttttttccaaaa

SEQ ID NO: 3170518 - DNA, 22 bp, Homo sapiens
caaattgcttttttccaaaaca

SEQ ID NO: 3170519 - DNA, 21 bp, Homo sapiens
caaattggaatggaactactg

SEQ ID NO: 3170520 - DNA, 18 bp, Homo sapiens
caaattgtatctagtgca

SEQ ID NO: 3170521 - DNA, 22 bp, Homo sapiens
caaattgtatctagtgcagctg

SEQ ID NO: 3170522 - DNA, 19 bp, Homo sapiens
caaattgtatcttattata

SEQ ID NO: 3170523 - DNA, 22 bp, Homo sapiens
caaattgtatcttattataaaa

SEQ ID NO: 3170524 - DNA, 14 bp, Homo sapiens
caaattgtccttca

SEQ ID NO: 3170525 - DNA, 21 bp, Homo sapiens
caaattgtgcttctccccaga

SEQ ID NO: 3170526 - DNA, 19 bp, Homo sapiens
caaatttaaaactgttgga

SEQ ID NO: 3170527 - DNA, 14 bp, Homo sapiens
caaatttacattta

SEQ ID NO: 3170528 - DNA, 17 bp, Homo sapiens
caaatttatcaaagcat

SEQ ID NO: 3170529 - DNA, 12 bp, Homo sapiens
caaatttatgca

SEQ ID NO: 3170530 - DNA, 19 bp, Homo sapiens
caaatttatgcatttcatt

SEQ ID NO: 3170531 - DNA, 14 bp, Homo sapiens
caaatttgattgat

SEQ ID NO: 3170532 - DNA, 22 bp, Homo sapiens
caaatttggctcacttgcctta

SEQ ID NO: 3170533 - DNA, 19 bp, Homo sapiens
caaatttgtacaggactgt

SEQ ID NO: 3170534 - DNA, 13 bp, Homo sapiens
caaattttggcca

SEQ ID NO: 3170535 - DNA, 15 bp, Homo sapiens
caacaaagaaacaaa

SEQ ID NO: 3170536 - DNA, 17 bp, Homo sapiens
caacaaagcacagtgtt

SEQ ID NO: 3170537 - DNA, 16 bp, Homo sapiens
caacaacaattggtaa

SEQ ID NO: 3170538 - DNA, 13 bp, Homo sapiens
caacaacatccat

SEQ ID NO: 3170539 - DNA, 19 bp, Homo sapiens
caacaacctcaactgccta

SEQ ID NO: 3170540 - DNA, 22 bp, Homo sapiens
caacaacgtgagagaaagagag

SEQ ID NO: 3170541 - DNA, 15 bp, Homo sapiens
caacaagagtttatt

SEQ ID NO: 3170542 - DNA, 15 bp, Homo sapiens
caacaagggagagac

SEQ ID NO: 3170543 - DNA, 22 bp, Homo sapiens
caacaagtgctcctgaaagaaa

SEQ ID NO: 3170544 - DNA, 23 bp, Homo sapiens
caacaataaacaggaattttatt

SEQ ID NO: 3170545 - DNA, 16 bp, Homo sapiens
caacaatggggtgggc

SEQ ID NO: 3170546 - DNA, 18 bp, Homo sapiens
caacaatggggtgggccc

SEQ ID NO: 3170547 - DNA, 15 bp, Homo sapiens
caacaattggtaaaa

SEQ ID NO: 3170548 - DNA, 18 bp, Homo sapiens
caacaattggtaaaactc

SEQ ID NO: 3170549 - DNA, 14 bp, Homo sapiens
caacaatttatgaa

SEQ ID NO: 3170550 - DNA, 17 bp, Homo sapiens
caacaatttatgaattg

SEQ ID NO: 3170551 - DNA, 16 bp, Homo sapiens
caacacagttgggacc

SEQ ID NO: 3170552 - DNA, 16 bp, Homo sapiens
caacaccacagacaca

SEQ ID NO: 3170553 - DNA, 22 bp, Homo sapiens
caacaccactaggaatcccaga

SEQ ID NO: 3170554 - DNA, 18 bp, Homo sapiens
caacaccagcccctgccc

SEQ ID NO: 3170555 - DNA, 23 bp, Homo sapiens
caacaccttcagaggctgaggtg

SEQ ID NO: 3170556 - DNA, 18 bp, Homo sapiens
caacaccttcctcctgca

SEQ ID NO: 3170557 - DNA, 22 bp, Homo sapiens
caacactcacatttattctgct

SEQ ID NO: 3170558 - DNA, 13 bp, Homo sapiens
caacactgtgccc

SEQ ID NO: 3170559 - DNA, 23 bp, Homo sapiens
caacacttgcaggggtccctgct

SEQ ID NO: 3170560 - DNA, 18 bp, Homo sapiens
caacactttgagcatttt

SEQ ID NO: 3170561 - DNA, 15 bp, Homo sapiens
caacagaactaaatg

SEQ ID NO: 3170562 - DNA, 16 bp, Homo sapiens
caacagaactaaatgt

SEQ ID NO: 3170563 - DNA, 19 bp, Homo sapiens
caacagaagcatttgtatt

SEQ ID NO: 3170564 - DNA, 16 bp, Homo sapiens
caacagaagcttcaga

SEQ ID NO: 3170565 - DNA, 17 bp, Homo sapiens
caacagaagcttcagaa

SEQ ID NO: 3170566 - DNA, 15 bp, Homo sapiens
caacagaagcttcca

SEQ ID NO: 3170567 - DNA, 15 bp, Homo sapiens
caacagaataaagca

SEQ ID NO: 3170568 - DNA, 17 bp, Homo sapiens
caacagaataaagcagc

SEQ ID NO: 3170569 - DNA, 19 bp, Homo sapiens
caacagaataaagcagcct

SEQ ID NO: 3170570 - DNA, 20 bp, Homo sapiens
caacagaataaagcagcctg

SEQ ID NO: 3170571 - DNA, 16 bp, Homo sapiens
caacagaataatgcat

SEQ ID NO: 3170572 - DNA, 20 bp, Homo sapiens
caacagagactgaatagata

SEQ ID NO: 3170573 - DNA, 13 bp, Homo sapiens
caacagagcactt

SEQ ID NO: 3170574 - DNA, 14 bp, Homo sapiens
caacagatactgga

SEQ ID NO: 3170575 - DNA, 22 bp, Homo sapiens
caacagcacctccccgctggga

SEQ ID NO: 3170576 - DNA, 12 bp, Homo sapiens
caacagcactgg

SEQ ID NO: 3170577 - DNA, 15 bp, Homo sapiens
caacagcactggctc

SEQ ID NO: 3170578 - DNA, 13 bp, Homo sapiens
caacagcagtctc

SEQ ID NO: 3170579 - DNA, 21 bp, Homo sapiens
caacagcagtctccttcagca

SEQ ID NO: 3170580 - DNA, 22 bp, Homo sapiens
caacagcagtctccttcagcac

SEQ ID NO: 3170581 - DNA, 17 bp, Homo sapiens
caacagccaagtgtgac

SEQ ID NO: 3170582 - DNA, 12 bp, Homo sapiens
caacagccatgc

SEQ ID NO: 3170583 - DNA, 23 bp, Homo sapiens
caacagcgacatagcccatccct

SEQ ID NO: 3170584 - DNA, 22 bp, Homo sapiens
caacagctcaagtcttccctga

SEQ ID NO: 3170585 - DNA, 11 bp, Homo sapiens
caacaggacag

SEQ ID NO: 3170586 - DNA, 17 bp, Homo sapiens
caacaggacagagttca

SEQ ID NO: 3170587 - DNA, 19 bp, Homo sapiens
caacaggacagagttcaca

SEQ ID NO: 3170588 - DNA, 13 bp, Homo sapiens
caacaggcccagg

SEQ ID NO: 3170589 - DNA, 15 bp, Homo sapiens
caacaggcccaggga

SEQ ID NO: 3170590 - DNA, 17 bp, Homo sapiens
caacaggcccagggagg

SEQ ID NO: 3170591 - DNA, 18 bp, Homo sapiens
caacaggcccagggaggg

SEQ ID NO: 3170592 - DNA, 19 bp, Homo sapiens
caacaggcccagggaggga

SEQ ID NO: 3170593 - DNA, 12 bp, Homo sapiens
caacaggctggg

SEQ ID NO: 3170594 - DNA, 13 bp, Homo sapiens
caacaggctgggc

SEQ ID NO: 3170595 - DNA, 23 bp, Homo sapiens
caacaggctgggcttcagtggca

SEQ ID NO: 3170596 - DNA, 19 bp, Homo sapiens
caacaggctgttctgcact

SEQ ID NO: 3170597 - DNA, 20 bp, Homo sapiens
caacaggctgttctgcactg

SEQ ID NO: 3170598 - DNA, 22 bp, Homo sapiens
caacaggctgttctgcactgaa

SEQ ID NO: 3170599 - DNA, 23 bp, Homo sapiens
caacaggctgttctgcactgaaa

SEQ ID NO: 3170600 - DNA, 17 bp, Homo sapiens
caacaggggaggaaaaa

SEQ ID NO: 3170601 - DNA, 17 bp, Homo sapiens
caacaggtaaaacaggg

SEQ ID NO: 3170602 - DNA, 20 bp, Homo sapiens
caacaggtcacttgatcatg

SEQ ID NO: 3170603 - DNA, 11 bp, Homo sapiens
caacagtgagt

SEQ ID NO: 3170604 - DNA, 22 bp, Homo sapiens
caacagttttttatgctaatca

SEQ ID NO: 3170605 - DNA, 17 bp, Homo sapiens
caacataactcaagtct

SEQ ID NO: 3170606 - DNA, 15 bp, Homo sapiens
caacatatcattttt

SEQ ID NO: 3170607 - DNA, 15 bp, Homo sapiens
caacatcaatgttca

SEQ ID NO: 3170608 - DNA, 16 bp, Homo sapiens
caacatcaatgttcat

SEQ ID NO: 3170609 - DNA, 22 bp, Homo sapiens
caacatcttggtcagatttgaa

SEQ ID NO: 3170610 - DNA, 21 bp, Homo sapiens
caacatctttgcgaaaagata

SEQ ID NO: 3170611 - DNA, 15 bp, Homo sapiens
caacatgcactgatg

SEQ ID NO: 3170612 - DNA, 13 bp, Homo sapiens
caacatggctttg

SEQ ID NO: 3170613 - DNA, 20 bp, Homo sapiens
caacatgttactgaccagca

SEQ ID NO: 3170614 - DNA, 20 bp, Homo sapiens
caacattaaggcagtatgat

SEQ ID NO: 3170615 - DNA, 20 bp, Homo sapiens
caaccaatttacactgccat

SEQ ID NO: 3170616 - DNA, 12 bp, Homo sapiens
caaccacagaga

SEQ ID NO: 3170617 - DNA, 13 bp, Homo sapiens
caaccaccatgga

SEQ ID NO: 3170618 - DNA, 14 bp, Homo sapiens
caaccactggtctg

SEQ ID NO: 3170619 - DNA, 17 bp, Homo sapiens
caaccactgtaaaatga

SEQ ID NO: 3170620 - DNA, 21 bp, Homo sapiens
caaccactgtaaaatgaaatt

SEQ ID NO: 3170621 - DNA, 12 bp, Homo sapiens
caaccagacagc

SEQ ID NO: 3170622 - DNA, 22 bp, Homo sapiens
caaccaggcagtagatgtgctt

SEQ ID NO: 3170623 - DNA, 15 bp, Homo sapiens
caaccagtgccaagg

SEQ ID NO: 3170624 - DNA, 16 bp, Homo sapiens
caaccagtgccaagga

SEQ ID NO: 3170625 - DNA, 19 bp, Homo sapiens
caaccagtgccaaggacct

SEQ ID NO: 3170626 - DNA, 16 bp, Homo sapiens
caaccatccctgccac

SEQ ID NO: 3170627 - DNA, 14 bp, Homo sapiens
caaccattaaagtc

SEQ ID NO: 3170628 - DNA, 17 bp, Homo sapiens
caaccattaaagtcaga

SEQ ID NO: 3170629 - DNA, 14 bp, Homo sapiens
caaccattccagac

SEQ ID NO: 3170630 - DNA, 16 bp, Homo sapiens
caaccattccagactg

SEQ ID NO: 3170631 - DNA, 13 bp, Homo sapiens
caaggttttaggt

SEQ ID NO: 3170632 - DNA, 20 bp, Homo sapiens
caaggttttaggttctaaag

SEQ ID NO: 3170633 - DNA, 21 bp, Homo sapiens
caaggttttaggttctaaagt

SEQ ID NO: 3170634 - DNA, 23 bp, Homo sapiens
caaggttttaggttctaaagttc

SEQ ID NO: 3170635 - DNA, 19 bp, Homo sapiens
caaggttttataaggctga

SEQ ID NO: 3170636 - DNA, 13 bp, Homo sapiens
caagtaaacattc

SEQ ID NO: 3170637 - DNA, 13 bp, Homo sapiens
caagtaagaagac

SEQ ID NO: 3170638 - DNA, 18 bp, Homo sapiens
caagtaagaagacatgaa

SEQ ID NO: 3170639 - DNA, 14 bp, Homo sapiens
caagtaatttcagt

SEQ ID NO: 3170640 - DNA, 23 bp, Homo sapiens
caagtaatttcagtgtaaagtgt

SEQ ID NO: 3170641 - DNA, 14 bp, Homo sapiens
caagtaccaccaag

SEQ ID NO: 3170642 - DNA, 18 bp, Homo sapiens
caagtagataaatatttg

SEQ ID NO: 3170643 - DNA, 16 bp, Homo sapiens
caagtagtctgctcac

SEQ ID NO: 3170644 - DNA, 12 bp, Homo sapiens
caagtataatta

SEQ ID NO: 3170645 - DNA, 22 bp, Homo sapiens
caagtatatgtgaaaaaaatga

SEQ ID NO: 3170646 - DNA, 15 bp, Homo sapiens
caagtatcttctatt

SEQ ID NO: 3170647 - DNA, 16 bp, Homo sapiens
caagtatgaataaaga

SEQ ID NO: 3170648 - DNA, 19 bp, Homo sapiens
caagtatgaataaagacac

SEQ ID NO: 3170649 - DNA, 21 bp, Homo sapiens
caagtatgaataaagacacct

SEQ ID NO: 3170650 - DNA, 22 bp, Homo sapiens
caagtatgtgggcagattttca

SEQ ID NO: 3170651 - DNA, 17 bp, Homo sapiens
caagtattgagaacctg

SEQ ID NO: 3170652 - DNA, 20 bp, Homo sapiens
caagtatttattattgaaga

SEQ ID NO: 3170653 - DNA, 16 bp, Homo sapiens
caagtcaaattaataa

SEQ ID NO: 3170654 - DNA, 17 bp, Homo sapiens
caagtcaatcatttctc

SEQ ID NO: 3170655 - DNA, 14 bp, Homo sapiens
caagtcacagctgc

SEQ ID NO: 3170656 - DNA, 16 bp, Homo sapiens
caagtcacagctgcag

SEQ ID NO: 3170657 - DNA, 14 bp, Homo sapiens
caagtcagaggatg

SEQ ID NO: 3170658 - DNA, 22 bp, Homo sapiens
caagtcagaggatggccagtgt

SEQ ID NO: 3170659 - DNA, 16 bp, Homo sapiens
caagtcagctccagct

SEQ ID NO: 3170660 - DNA, 17 bp, Homo sapiens
caagtcatgtgcatttc

SEQ ID NO: 3170661 - DNA, 12 bp, Homo sapiens
caagtcatttta

SEQ ID NO: 3170662 - DNA, 15 bp, Homo sapiens
caagtccaaatgttt

SEQ ID NO: 3170663 - DNA, 22 bp, Homo sapiens
caagtccagctgggaagccctt

SEQ ID NO: 3170664 - DNA, 18 bp, Homo sapiens
caagtccctgactctctg

SEQ ID NO: 3170665 - DNA, 21 bp, Homo sapiens
caagtccctgactctctgtga

SEQ ID NO: 3170666 - DNA, 19 bp, Homo sapiens
caagtccgcagaagccctg

SEQ ID NO: 3170667 - DNA, 21 bp, Homo sapiens
caagtcctcttttctgagagg

SEQ ID NO: 3170668 - DNA, 16 bp, Homo sapiens
caagtcctgaagaggc

SEQ ID NO: 3170669 - DNA, 23 bp, Homo sapiens
caagtcctgaagaggcgggccag

SEQ ID NO: 3170670 - DNA, 19 bp, Homo sapiens
caagtcctggatgttgtgt

SEQ ID NO: 3170671 - DNA, 18 bp, Homo sapiens
caagtcctgtgaatttct

SEQ ID NO: 3170672 - DNA, 15 bp, Homo sapiens
caagtctcagaagag

SEQ ID NO: 3170673 - DNA, 17 bp, Homo sapiens
caagtctccttcccctt

SEQ ID NO: 3170674 - DNA, 14 bp, Homo sapiens
caagtctctctgtg

SEQ ID NO: 3170675 - DNA, 22 bp, Homo sapiens
caagtctctctgtgaatacaat

SEQ ID NO: 3170676 - DNA, 19 bp, Homo sapiens
caagtctctgctggcccag

SEQ ID NO: 3170677 - DNA, 13 bp, Homo sapiens
caagtctgcagcc

SEQ ID NO: 3170678 - DNA, 21 bp, Homo sapiens
caagtctgtacctcaaatgaa

SEQ ID NO: 3170679 - DNA, 14 bp, Homo sapiens
caagtcttaacaaa

SEQ ID NO: 3170680 - DNA, 15 bp, Homo sapiens
caagtcttccctgat

SEQ ID NO: 3170681 - DNA, 18 bp, Homo sapiens
caagtgagagctgggtgt

SEQ ID NO: 3170682 - DNA, 19 bp, Homo sapiens
caagtgaggtgtgtcacaa

SEQ ID NO: 3170683 - DNA, 16 bp, Homo sapiens
caagtgattctcctgc

SEQ ID NO: 3170684 - DNA, 21 bp, Homo sapiens
caagtgattctcctgcctcag

SEQ ID NO: 3170685 - DNA, 22 bp, Homo sapiens
caagtgattctcctgcctcagc

SEQ ID NO: 3170686 - DNA, 19 bp, Homo sapiens
caagtgattgaaaatagta

SEQ ID NO: 3170687 - DNA, 22 bp, Homo sapiens
caagtgccactgcccgagctgg

SEQ ID NO: 3170688 - DNA, 15 bp, Homo sapiens
caagtgccagaggtg

SEQ ID NO: 3170689 - DNA, 17 bp, Homo sapiens
caagtgccagaggtggg

SEQ ID NO: 3170690 - DNA, 17 bp, Homo sapiens
caagtgcctagactgtt

SEQ ID NO: 3170691 - DNA, 20 bp, Homo sapiens
caagtgcctagactgttact

SEQ ID NO: 3170692 - DNA, 21 bp, Homo sapiens
caagtgcctagactgttactt

SEQ ID NO: 3170693 - DNA, 13 bp, Homo sapiens
caagtgccttaat

SEQ ID NO: 3170694 - DNA, 14 bp, Homo sapiens
caagtgctgaacag

SEQ ID NO: 3170695 - DNA, 17 bp, Homo sapiens
caagtgctgaacagtgg

SEQ ID NO: 3170696 - DNA, 15 bp, Homo sapiens
caagtggatgggaat

SEQ ID NO: 3170697 - DNA, 21 bp, Homo sapiens
caagtggatgggaatttgtca

SEQ ID NO: 3170698 - DNA, 23 bp, Homo sapiens
caagtggatgggaatttgtcagc

SEQ ID NO: 3170699 - DNA, 19 bp, Homo sapiens
caagtggctcccacaccct

SEQ ID NO: 3170700 - DNA, 21 bp, Homo sapiens
caagtggggatggggcctccc

SEQ ID NO: 3170701 - DNA, 15 bp, Homo sapiens
caagtggggtgctgg

SEQ ID NO: 3170702 - DNA, 18 bp, Homo sapiens
caagtgtatatcagaaaa

SEQ ID NO: 3170703 - DNA, 14 bp, Homo sapiens
caagtgtgaacaaa

SEQ ID NO: 3170704 - DNA, 22 bp, Homo sapiens
caagtgtggtagggacttaaaa

SEQ ID NO: 3170705 - DNA, 23 bp, Homo sapiens
caagtgtggtagggacttaaaaa

SEQ ID NO: 3170706 - DNA, 19 bp, Homo sapiens
caagtgttgttttttaagt

SEQ ID NO: 3170707 - DNA, 13 bp, Homo sapiens
caagttagctcag

SEQ ID NO: 3170708 - DNA, 14 bp, Homo sapiens
caagttagctcagg

SEQ ID NO: 3170709 - DNA, 20 bp, Homo sapiens
caagttataaatcaatgtca

SEQ ID NO: 3170710 - DNA, 19 bp, Homo sapiens
caagttattcaaatttgta

SEQ ID NO: 3170711 - DNA, 20 bp, Homo sapiens
caagttattcaaatttgtac

SEQ ID NO: 3170712 - DNA, 20 bp, Homo sapiens
caagttattgtacagctgtt

SEQ ID NO: 3170713 - DNA, 12 bp, Homo sapiens
caagttccaaat

SEQ ID NO: 3170714 - DNA, 22 bp, Homo sapiens
caagttccatgggatacaacct

SEQ ID NO: 3170715 - DNA, 14 bp, Homo sapiens
caagttctaagatt

SEQ ID NO: 3170716 - DNA, 20 bp, Homo sapiens
caagttctaagattctaatg

SEQ ID NO: 3170717 - DNA, 14 bp, Homo sapiens
caagttcttcacct

SEQ ID NO: 3170718 - DNA, 19 bp, Homo sapiens
caagttcttcacctctatc

SEQ ID NO: 3170719 - DNA, 14 bp, Homo sapiens
caagttgaagggaa

SEQ ID NO: 3170720 - DNA, 15 bp, Homo sapiens
caagttgaattgagg

SEQ ID NO: 3170721 - DNA, 14 bp, Homo sapiens
caagttgtaaaaat

SEQ ID NO: 3170722 - DNA, 20 bp, Homo sapiens
caagttgtaaaaatgaaagt

SEQ ID NO: 3170723 - DNA, 13 bp, Homo sapiens
caagttgtgcttg

SEQ ID NO: 3170724 - DNA, 17 bp, Homo sapiens
caagttgtgcttgttta

SEQ ID NO: 3170725 - DNA, 18 bp, Homo sapiens
caagttgttattgttgaa

SEQ ID NO: 3170726 - DNA, 16 bp, Homo sapiens
caagtttaaaagccat

SEQ ID NO: 3170727 - DNA, 13 bp, Homo sapiens
caagtttacactt

SEQ ID NO: 3170728 - DNA, 15 bp, Homo sapiens
caagtttacacttca

SEQ ID NO: 3170729 - DNA, 14 bp, Homo sapiens
caagtttatttctc

SEQ ID NO: 3170730 - DNA, 15 bp, Homo sapiens
caagtttcagacagg

SEQ ID NO: 3170731 - DNA, 13 bp, Homo sapiens
caagttttaaagt

SEQ ID NO: 3170732 - DNA, 14 bp, Homo sapiens
caagttttaaagtt

SEQ ID NO: 3170733 - DNA, 21 bp, Homo sapiens
caagttttcttccatgatttt

SEQ ID NO: 3170734 - DNA, 14 bp, Homo sapiens
caagttttgtataa

SEQ ID NO: 3170735 - DNA, 17 bp, Homo sapiens
caagttttgtataaata

SEQ ID NO: 3170736 - DNA, 20 bp, Homo sapiens
caataaaaacattttgaagt

SEQ ID NO: 3170737 - DNA, 13 bp, Homo sapiens
caataaaaagttc

SEQ ID NO: 3170738 - DNA, 15 bp, Homo sapiens
caataaaaagttcag

SEQ ID NO: 3170739 - DNA, 13 bp, Homo sapiens
caataaaaatgtt

SEQ ID NO: 3170740 - DNA, 12 bp, Homo sapiens
caataaaacatt

SEQ ID NO: 3170741 - DNA, 20 bp, Homo sapiens
caataaaagttttctccaac

SEQ ID NO: 3170742 - DNA, 13 bp, Homo sapiens
caataaaatttaa

SEQ ID NO: 3170743 - DNA, 14 bp, Homo sapiens
caataaaatttaaa

SEQ ID NO: 3170744 - DNA, 20 bp, Homo sapiens
caataaaatttttttaaagt

SEQ ID NO: 3170745 - DNA, 16 bp, Homo sapiens
caataaacaacagctg

SEQ ID NO: 3170746 - DNA, 16 bp, Homo sapiens
caataaacaggaattt

SEQ ID NO: 3170747 - DNA, 23 bp, Homo sapiens
caataaaccaggtttagacagta

SEQ ID NO: 3170748 - DNA, 12 bp, Homo sapiens
caataaagaaaa

SEQ ID NO: 3170749 - DNA, 12 bp, Homo sapiens
caataaagagat

SEQ ID NO: 3170750 - DNA, 14 bp, Homo sapiens
caataaagcttttg

SEQ ID NO: 3170751 - DNA, 16 bp, Homo sapiens
caataaagcttttgga

SEQ ID NO: 3170752 - DNA, 18 bp, Homo sapiens
caataaagcttttggaag

SEQ ID NO: 3170753 - DNA, 16 bp, Homo sapiens
caataaaggcagctgc

SEQ ID NO: 3170754 - DNA, 17 bp, Homo sapiens
caataaaggcagctgcc

SEQ ID NO: 3170755 - DNA, 18 bp, Homo sapiens
caataaaggcagctgcct

SEQ ID NO: 3170756 - DNA, 19 bp, Homo sapiens
caataaaggcagctgcctc

SEQ ID NO: 3170757 - DNA, 21 bp, Homo sapiens
cacacgcgcgcgcacacacac

SEQ ID NO: 3170758 - DNA, 23 bp, Homo sapiens
cacacggactcccgggccacgcc

SEQ ID NO: 3170759 - DNA, 18 bp, Homo sapiens
cacacggaggcatctgca

SEQ ID NO: 3170760 - DNA, 19 bp, Homo sapiens
cacactaaccaagctgagt

SEQ ID NO: 3170761 - DNA, 18 bp, Homo sapiens
cacactactacctcttaa

SEQ ID NO: 3170762 - DNA, 19 bp, Homo sapiens
cacactagcctctccagga

SEQ ID NO: 3170763 - DNA, 15 bp, Homo sapiens
cacactatgcacaga

SEQ ID NO: 3170764 - DNA, 18 bp, Homo sapiens
cacactattaccatgaga

SEQ ID NO: 3170765 - DNA, 19 bp, Homo sapiens
cacactattaccatgagaa

SEQ ID NO: 3170766 - DNA, 12 bp, Homo sapiens
cacactctgacg

SEQ ID NO: 3170767 - DNA, 20 bp, Homo sapiens
cacactctgagtctctgaat

SEQ ID NO: 3170768 - DNA, 19 bp, Homo sapiens
cacactctgccagcaaaga

SEQ ID NO: 3170769 - DNA, 22 bp, Homo sapiens
cacactcttcagtgactcctgc

SEQ ID NO: 3170770 - DNA, 23 bp, Homo sapiens
cacactcttcagtgactcctgct

SEQ ID NO: 3170771 - DNA, 18 bp, Homo sapiens
cacactgaaaccaaaaca

SEQ ID NO: 3170772 - DNA, 19 bp, Homo sapiens
cacactgaaaccaaaacat

SEQ ID NO: 3170773 - DNA, 14 bp, Homo sapiens
cacactgagttcta

SEQ ID NO: 3170774 - DNA, 17 bp, Homo sapiens
cacactgagttctatca

SEQ ID NO: 3170775 - DNA, 18 bp, Homo sapiens
cacactgatgcttagatg

SEQ ID NO: 3170776 - DNA, 19 bp, Homo sapiens
cacactgctcttaagaaac

SEQ ID NO: 3170777 - DNA, 18 bp, Homo sapiens
cacactgtcatgcttcat

SEQ ID NO: 3170778 - DNA, 21 bp, Homo sapiens
cacactgtcatgcttcatcat

SEQ ID NO: 3170779 - DNA, 21 bp, Homo sapiens
cacacttcaggctcttctcct

SEQ ID NO: 3170780 - DNA, 15 bp, Homo sapiens
cacacttctgtgaga

SEQ ID NO: 3170781 - DNA, 17 bp, Homo sapiens
cacacttgagaggatga

SEQ ID NO: 3170782 - DNA, 14 bp, Homo sapiens
cacacttgctgggg

SEQ ID NO: 3170783 - DNA, 16 bp, Homo sapiens
cacacttgttccagct

SEQ ID NO: 3170784 - DNA, 19 bp, Homo sapiens
cacacttgttccagctctt

SEQ ID NO: 3170785 - DNA, 20 bp, Homo sapiens
cacacttgttccagctcttt

SEQ ID NO: 3170786 - DNA, 13 bp, Homo sapiens
cacagaaaagcat

SEQ ID NO: 3170787 - DNA, 13 bp, Homo sapiens
cacagaaacacaa

SEQ ID NO: 3170788 - DNA, 16 bp, Homo sapiens
cacagaaaccaatttt

SEQ ID NO: 3170789 - DNA, 13 bp, Homo sapiens
cacagaaatatat

SEQ ID NO: 3170790 - DNA, 20 bp, Homo sapiens
cacagaaatatatatacata

SEQ ID NO: 3170791 - DNA, 17 bp, Homo sapiens
cacagaaatcagaggag

SEQ ID NO: 3170792 - DNA, 21 bp, Homo sapiens
cacagaacaggaggtgtgaat

SEQ ID NO: 3170793 - DNA, 19 bp, Homo sapiens
cacagaaccttcaacccag

SEQ ID NO: 3170794 - DNA, 14 bp, Homo sapiens
cacagacaagcagc

SEQ ID NO: 3170795 - DNA, 15 bp, Homo sapiens
cacagacaagcagcc

SEQ ID NO: 3170796 - DNA, 21 bp, Homo sapiens
cacagacaagcagcccttgct

SEQ ID NO: 3170797 - DNA, 12 bp, Homo sapiens
cacagacccctc

SEQ ID NO: 3170798 - DNA, 16 bp, Homo sapiens
cacagacccctgggag

SEQ ID NO: 3170799 - DNA, 17 bp, Homo sapiens
cacagactggcaataaa

SEQ ID NO: 3170800 - DNA, 18 bp, Homo sapiens
cacagacttctggaaggc

SEQ ID NO: 3170801 - DNA, 23 bp, Homo sapiens
cacagacttctggaaggctggct

SEQ ID NO: 3170802 - DNA, 20 bp, Homo sapiens
cacagagaaagtacttctcc

SEQ ID NO: 3170803 - DNA, 21 bp, Homo sapiens
cacagagaagtttgtagccag

SEQ ID NO: 3170804 - DNA, 18 bp, Homo sapiens
cacagagagacagacttg

SEQ ID NO: 3170805 - DNA, 20 bp, Homo sapiens
cacagagagacagacttgag

SEQ ID NO: 3170806 - DNA, 18 bp, Homo sapiens
cacagagagtcccactgc

SEQ ID NO: 3170807 - DNA, 19 bp, Homo sapiens
cacagagagtcccactgcc

SEQ ID NO: 3170808 - DNA, 14 bp, Homo sapiens
cacagagcaggact

SEQ ID NO: 3170809 - DNA, 13 bp, Homo sapiens
cacagaggaagag

SEQ ID NO: 3170810 - DNA, 21 bp, Homo sapiens
cacagaggcagcccgcacacc

SEQ ID NO: 3170811 - DNA, 13 bp, Homo sapiens
cacagaggctgcc

SEQ ID NO: 3170812 - DNA, 16 bp, Homo sapiens
cacagatacacacaca

SEQ ID NO: 3170813 - DNA, 17 bp, Homo sapiens
cacagatatactttgtg

SEQ ID NO: 3170814 - DNA, 15 bp, Homo sapiens
cacagatatcttttt

SEQ ID NO: 3170815 - DNA, 18 bp, Homo sapiens
cacagatatctttttcat

SEQ ID NO: 3170816 - DNA, 17 bp, Homo sapiens
cacagatctgcatctga

SEQ ID NO: 3170817 - DNA, 20 bp, Homo sapiens
cacagatggatttgcctgtg

SEQ ID NO: 3170818 - DNA, 22 bp, Homo sapiens
cacagattgtttctatacaaat

SEQ ID NO: 3170819 - DNA, 13 bp, Homo sapiens
cacagattttaat

SEQ ID NO: 3170820 - DNA, 19 bp, Homo sapiens
cacagattttaattgtcat

SEQ ID NO: 3170821 - DNA, 21 bp, Homo sapiens
cacagattttaattgtcatgg

SEQ ID NO: 3170822 - DNA, 17 bp, Homo sapiens
cacagcaatatttaaca

SEQ ID NO: 3170823 - DNA, 16 bp, Homo sapiens
cacagcaattcctcag

SEQ ID NO: 3170824 - DNA, 15 bp, Homo sapiens
cacagcacaccagcc

SEQ ID NO: 3170825 - DNA, 17 bp, Homo sapiens
cacagcacaccagccgc

SEQ ID NO: 3170826 - DNA, 21 bp, Homo sapiens
cacagcacaccagccgctgca

SEQ ID NO: 3170827 - DNA, 13 bp, Homo sapiens
cacagcacagctc

SEQ ID NO: 3170828 - DNA, 14 bp, Homo sapiens
cacagcacatgctg

SEQ ID NO: 3170829 - DNA, 20 bp, Homo sapiens
cacagcacatgctggccagc

SEQ ID NO: 3170830 - DNA, 21 bp, Homo sapiens
cacagcacatgctggccagcc

SEQ ID NO: 3170831 - DNA, 16 bp, Homo sapiens
cacagcagcagaacaa

SEQ ID NO: 3170832 - DNA, 20 bp, Homo sapiens
cacagcagccccccagcact

SEQ ID NO: 3170833 - DNA, 14 bp, Homo sapiens
cacagcagcctgct

SEQ ID NO: 3170834 - DNA, 22 bp, Homo sapiens
cacagcatcgggagcacccaga

SEQ ID NO: 3170835 - DNA, 16 bp, Homo sapiens
cacagcatggaggagg

SEQ ID NO: 3170836 - DNA, 20 bp, Homo sapiens
cacagcatggaggaggaggg

SEQ ID NO: 3170837 - DNA, 22 bp, Homo sapiens
cacagcatggaggaggagggag

SEQ ID NO: 3170838 - DNA, 14 bp, Homo sapiens
cacagcatgtgcca

SEQ ID NO: 3170839 - DNA, 14 bp, Homo sapiens
cacagcccagggcc

SEQ ID NO: 3170840 - DNA, 15 bp, Homo sapiens
cacagcccagggcct

SEQ ID NO: 3170841 - DNA, 22 bp, Homo sapiens
cacagcccccttgccctccgcc

SEQ ID NO: 3170842 - DNA, 14 bp, Homo sapiens
cacagccctccgac

SEQ ID NO: 3170843 - DNA, 23 bp, Homo sapiens
cacagccctccgaccctcatggc

SEQ ID NO: 3170844 - DNA, 11 bp, Homo sapiens
cacagccctgg

SEQ ID NO: 3170845 - DNA, 15 bp, Homo sapiens
cacagccctgggagg

SEQ ID NO: 3170846 - DNA, 23 bp, Homo sapiens
cacagcccttatgcggttaattt

SEQ ID NO: 3170847 - DNA, 14 bp, Homo sapiens
cacagccgcagcct

SEQ ID NO: 3170848 - DNA, 23 bp, Homo sapiens
cacagcctcacgcccccaggaat

SEQ ID NO: 3170849 - DNA, 14 bp, Homo sapiens
cacagcctccaggg

SEQ ID NO: 3170850 - DNA, 17 bp, Homo sapiens
cacagcctctgacccct

SEQ ID NO: 3170851 - DNA, 20 bp, Homo sapiens
cacagcctctgacccctcct

SEQ ID NO: 3170852 - DNA, 15 bp, Homo sapiens
cacagcctctggctc

SEQ ID NO: 3170853 - DNA, 19 bp, Homo sapiens
cacagcctctggctccaca

SEQ ID NO: 3170854 - DNA, 21 bp, Homo sapiens
cacagcctctggctccacacc

SEQ ID NO: 3170855 - DNA, 13 bp, Homo sapiens
cacagccttcgga

SEQ ID NO: 3170856 - DNA, 16 bp, Homo sapiens
cacagccttggctcct

SEQ ID NO: 3170857 - DNA, 16 bp, Homo sapiens
cacagcgagggcagct

SEQ ID NO: 3170858 - DNA, 17 bp, Homo sapiens
cacagcgagggcagctg

SEQ ID NO: 3170859 - DNA, 20 bp, Homo sapiens
cacagcggggccccagggct

SEQ ID NO: 3170860 - DNA, 15 bp, Homo sapiens
cacagcgtccctagc

SEQ ID NO: 3170861 - DNA, 22 bp, Homo sapiens
cacagcgtccctggcgcaggtg

SEQ ID NO: 3170862 - DNA, 15 bp, Homo sapiens
cacagctacctgaga

SEQ ID NO: 3170863 - DNA, 16 bp, Homo sapiens
cacagctacctgagac

SEQ ID NO: 3170864 - DNA, 14 bp, Homo sapiens
cacagctccctgcc

SEQ ID NO: 3170865 - DNA, 10 bp, Homo sapiens
cacagctcct

SEQ ID NO: 3170866 - DNA, 22 bp, Homo sapiens
cacagctcctcttaccgtagcc

SEQ ID NO: 3170867 - DNA, 15 bp, Homo sapiens
cacagctctgtcctg

SEQ ID NO: 3170868 - DNA, 18 bp, Homo sapiens
cacagctctgtcctggga

SEQ ID NO: 3170869 - DNA, 19 bp, Homo sapiens
cacagctctgtcctgggag

SEQ ID NO: 3170870 - DNA, 14 bp, Homo sapiens
cacagctctgtgtt

SEQ ID NO: 3170871 - DNA, 12 bp, Homo sapiens
cacagctcttca

SEQ ID NO: 3170872 - DNA, 14 bp, Homo sapiens
cacagctcttcatt

SEQ ID NO: 3170873 - DNA, 16 bp, Homo sapiens
cacagctgcagctggg

SEQ ID NO: 3170874 - DNA, 17 bp, Homo sapiens
cacagctgcagctgggc

SEQ ID NO: 3170875 - DNA, 18 bp, Homo sapiens
cacagctgcagctgggcc

SEQ ID NO: 3170876 - DNA, 19 bp, Homo sapiens
cacagctgcagctgggccc

SEQ ID NO: 3170877 - DNA, 14 bp, Homo sapiens
cacagctgtagtgg

SEQ ID NO: 3170878 - DNA, 17 bp, Homo sapiens
cacagcttaacaatgca

SEQ ID NO: 3170879 - DNA, 21 bp, Homo sapiens
cacagcttcatttcctgtgtc

SEQ ID NO: 3170880 - DNA, 20 bp, Homo sapiens
cacagcttgacctgaggctg

SEQ ID NO: 3170881 - DNA, 12 bp, Homo sapiens
cacagcttttgc

SEQ ID NO: 3170882 - DNA, 14 bp, Homo sapiens
cacagcttttgcaa

SEQ ID NO: 3170883 - DNA, 20 bp, Homo sapiens
cacatgactcgggggtgggg

SEQ ID NO: 3170884 - DNA, 18 bp, Homo sapiens
cacatgagctatttccat

SEQ ID NO: 3170885 - DNA, 21 bp, Homo sapiens
cacatgaggccatctcaggag

SEQ ID NO: 3170886 - DNA, 22 bp, Homo sapiens
cacatgaggccatctcaggaga

SEQ ID NO: 3170887 - DNA, 23 bp, Homo sapiens
cacatgaggccatctcaggagat

SEQ ID NO: 3170888 - DNA, 14 bp, Homo sapiens
cacatgccctcctg

SEQ ID NO: 3170889 - DNA, 21 bp, Homo sapiens
cacatgctaggatgcggaaat

SEQ ID NO: 3170890 - DNA, 16 bp, Homo sapiens
cacatgctgagtctcc

SEQ ID NO: 3170891 - DNA, 17 bp, Homo sapiens
cacatgctgagtctccc

SEQ ID NO: 3170892 - DNA, 23 bp, Homo sapiens
cacatgcttagcttatctttctt

SEQ ID NO: 3170893 - DNA, 20 bp, Homo sapiens
cacatggagccccctctgcc

SEQ ID NO: 3170894 - DNA, 12 bp, Homo sapiens
cacatgtacata

SEQ ID NO: 3170895 - DNA, 20 bp, Homo sapiens
cacatgtcttgtacatgtgt

SEQ ID NO: 3170896 - DNA, 15 bp, Homo sapiens
cacatgtgacacata

SEQ ID NO: 3170897 - DNA, 12 bp, Homo sapiens
cacatgttcata

SEQ ID NO: 3170898 - DNA, 16 bp, Homo sapiens
cacattaaaaaatgaa

SEQ ID NO: 3170899 - DNA, 18 bp, Homo sapiens
cacattaatggtctaaaa

SEQ ID NO: 3170900 - DNA, 22 bp, Homo sapiens
cacattaatggtctaaaaataa

SEQ ID NO: 3170901 - DNA, 14 bp, Homo sapiens
cacattaattaatt

SEQ ID NO: 3170902 - DNA, 23 bp, Homo sapiens
cacattagattttattttactat

SEQ ID NO: 3170903 - DNA, 23 bp, Homo sapiens
cacattatttattaaaaatgttc

SEQ ID NO: 3170904 - DNA, 13 bp, Homo sapiens
cacattatttcta

SEQ ID NO: 3170905 - DNA, 17 bp, Homo sapiens
cacatttattctgctca

SEQ ID NO: 3170906 - DNA, 15 bp, Homo sapiens
cacatttcacctcct

SEQ ID NO: 3170907 - DNA, 12 bp, Homo sapiens
cacatttctgat

SEQ ID NO: 3170908 - DNA, 16 bp, Homo sapiens
cacatttctgatcaga

SEQ ID NO: 3170909 - DNA, 18 bp, Homo sapiens
cacatttctgatcagagg

SEQ ID NO: 3170910 - DNA, 14 bp, Homo sapiens
cacatttctggatt

SEQ ID NO: 3170911 - DNA, 15 bp, Homo sapiens
cacatttctggattg

SEQ ID NO: 3170912 - DNA, 17 bp, Homo sapiens
cacatttggaatacttt

SEQ ID NO: 3170913 - DNA, 19 bp, Homo sapiens
cacatttggaatacttttt

SEQ ID NO: 3170914 - DNA, 19 bp, Homo sapiens
cacatttgggatgttcctt

SEQ ID NO: 3170915 - DNA, 11 bp, Homo sapiens
cacatttgtac

SEQ ID NO: 3170916 - DNA, 17 bp, Homo sapiens
cacatttgtcagtattt

SEQ ID NO: 3170917 - DNA, 17 bp, Homo sapiens
cacatttttgcacagat

SEQ ID NO: 3170918 - DNA, 23 bp, Homo sapiens
cacatttttgcacagattatgct

SEQ ID NO: 3170919 - DNA, 23 bp, Homo sapiens
caccaaaaccaaacttgttcatt

SEQ ID NO: 3170920 - DNA, 15 bp, Homo sapiens
caccaaagatgcagc

SEQ ID NO: 3170921 - DNA, 18 bp, Homo sapiens
caccaaagatgcagccgc

SEQ ID NO: 3170922 - DNA, 14 bp, Homo sapiens
caccaaagctgccc

SEQ ID NO: 3170923 - DNA, 18 bp, Homo sapiens
caccaaagctgcccactg

SEQ ID NO: 3170924 - DNA, 14 bp, Homo sapiens
caccaaagttctaa

SEQ ID NO: 3170925 - DNA, 22 bp, Homo sapiens
caccaaagttctaataatttct

SEQ ID NO: 3170926 - DNA, 15 bp, Homo sapiens
caccaaccagacagc

SEQ ID NO: 3170927 - DNA, 15 bp, Homo sapiens
caccaaccgacaggc

SEQ ID NO: 3170928 - DNA, 11 bp, Homo sapiens
caccaaggaaa

SEQ ID NO: 3170929 - DNA, 14 bp, Homo sapiens
caccaagggatctg

SEQ ID NO: 3170930 - DNA, 15 bp, Homo sapiens
caccaatcccagggc

SEQ ID NO: 3170931 - DNA, 17 bp, Homo sapiens
caccaatcccagggctg

SEQ ID NO: 3170932 - DNA, 21 bp, Homo sapiens
caccaatcccagggctggctc

SEQ ID NO: 3170933 - DNA, 16 bp, Homo sapiens
caccaatgcccagcag

SEQ ID NO: 3170934 - DNA, 17 bp, Homo sapiens
caccaatgcccagcagg

SEQ ID NO: 3170935 - DNA, 16 bp, Homo sapiens
caccaattatcatctt

SEQ ID NO: 3170936 - DNA, 12 bp, Homo sapiens
caccacaaaata

SEQ ID NO: 3170937 - DNA, 15 bp, Homo sapiens
caccacacccagccc

SEQ ID NO: 3170938 - DNA, 16 bp, Homo sapiens
caccacacccagcctc

SEQ ID NO: 3170939 - DNA, 17 bp, Homo sapiens
caccacacccagcctca

SEQ ID NO: 3170940 - DNA, 20 bp, Homo sapiens
caccacagacacacacacgc

SEQ ID NO: 3170941 - DNA, 17 bp, Homo sapiens
caccacagccagcacct

SEQ ID NO: 3170942 - DNA, 18 bp, Homo sapiens
caccacatgtgcacatgc

SEQ ID NO: 3170943 - DNA, 14 bp, Homo sapiens
caccaccacactac

SEQ ID NO: 3170944 - DNA, 18 bp, Homo sapiens
caccaccacactacacag

SEQ ID NO: 3170945 - DNA, 18 bp, Homo sapiens
caccaccccaacaaacca

SEQ ID NO: 3170946 - DNA, 22 bp, Homo sapiens
caccaccctagtcccttcccct

SEQ ID NO: 3170947 - DNA, 17 bp, Homo sapiens
caccacctcactcctgt

SEQ ID NO: 3170948 - DNA, 18 bp, Homo sapiens
caccacctcactcctgtt

SEQ ID NO: 3170949 - DNA, 14 bp, Homo sapiens
caccacctccctca

SEQ ID NO: 3170950 - DNA, 12 bp, Homo sapiens
caccacctctcc

SEQ ID NO: 3170951 - DNA, 17 bp, Homo sapiens
caccacgtctgccaggc

SEQ ID NO: 3170952 - DNA, 18 bp, Homo sapiens
caccacgtctgccaggcc

SEQ ID NO: 3170953 - DNA, 21 bp, Homo sapiens
caccactaggaatcccagagg

SEQ ID NO: 3170954 - DNA, 20 bp, Homo sapiens
caccactccactcctccagc

SEQ ID NO: 3170955 - DNA, 13 bp, Homo sapiens
caccactccattc

SEQ ID NO: 3170956 - DNA, 17 bp, Homo sapiens
caccactgcactccagc

SEQ ID NO: 3170957 - DNA, 18 bp, Homo sapiens
caccactgcactccagcc

SEQ ID NO: 3170958 - DNA, 17 bp, Homo sapiens
caccactgccctgcctg

SEQ ID NO: 3170959 - DNA, 19 bp, Homo sapiens
caccactggccaccaggct

SEQ ID NO: 3170960 - DNA, 20 bp, Homo sapiens
caccactggccaccaggctg

SEQ ID NO: 3170961 - DNA, 12 bp, Homo sapiens
caccagagcaga

SEQ ID NO: 3170962 - DNA, 16 bp, Homo sapiens
caccagagcagatgca

SEQ ID NO: 3170963 - DNA, 18 bp, Homo sapiens
caccagagcagatgcaga

SEQ ID NO: 3170964 - DNA, 15 bp, Homo sapiens
caccagagcccacct

SEQ ID NO: 3170965 - DNA, 18 bp, Homo sapiens
caccagagcccaccttgg

SEQ ID NO: 3170966 - DNA, 11 bp, Homo sapiens
caccagaggcc

SEQ ID NO: 3170967 - DNA, 23 bp, Homo sapiens
caccagatgcaacctcactatgg

SEQ ID NO: 3170968 - DNA, 15 bp, Homo sapiens
caccagcagcatggc

SEQ ID NO: 3170969 - DNA, 20 bp, Homo sapiens
caccagcatccaccttggct

SEQ ID NO: 3170970 - DNA, 11 bp, Homo sapiens
caccagccagc

SEQ ID NO: 3170971 - DNA, 14 bp, Homo sapiens
caccagccccactg

SEQ ID NO: 3170972 - DNA, 21 bp, Homo sapiens
caccagccccactgccagcag

SEQ ID NO: 3170973 - DNA, 23 bp, Homo sapiens
caccagccccactgccagcagca

SEQ ID NO: 3170974 - DNA, 13 bp, Homo sapiens
caccagccccagt

SEQ ID NO: 3170975 - DNA, 16 bp, Homo sapiens
caccagccccctggat

SEQ ID NO: 3170976 - DNA, 20 bp, Homo sapiens
caccagccccctggatgggc

SEQ ID NO: 3170977 - DNA, 13 bp, Homo sapiens
caccagcccctgc

SEQ ID NO: 3170978 - DNA, 17 bp, Homo sapiens
caccagcccctgcccca

SEQ ID NO: 3170979 - DNA, 19 bp, Homo sapiens
caccagcccctgccccagc

SEQ ID NO: 3170980 - DNA, 21 bp, Homo sapiens
caccagcccttagcagggaaa

SEQ ID NO: 3170981 - DNA, 18 bp, Homo sapiens
caccagccgccccagccc

SEQ ID NO: 3170982 - DNA, 21 bp, Homo sapiens
caccagccgctgcagggctcc

SEQ ID NO: 3170983 - DNA, 22 bp, Homo sapiens
caccagccgctgcagggctccc

SEQ ID NO: 3170984 - DNA, 23 bp, Homo sapiens
caccagcctggtgcccatcctcc

SEQ ID NO: 3170985 - DNA, 14 bp, Homo sapiens
caccagctctgtgg

SEQ ID NO: 3170986 - DNA, 16 bp, Homo sapiens
caccagctctgtggcc

SEQ ID NO: 3170987 - DNA, 17 bp, Homo sapiens
caccagctctgtggcct

SEQ ID NO: 3170988 - DNA, 14 bp, Homo sapiens
caccagctgctctg

SEQ ID NO: 3170989 - DNA, 17 bp, Homo sapiens
caccagctgctctgccc

SEQ ID NO: 3170990 - DNA, 16 bp, Homo sapiens
caccagcttaagcgtt

SEQ ID NO: 3170991 - DNA, 11 bp, Homo sapiens
caccaggactt

SEQ ID NO: 3170992 - DNA, 20 bp, Homo sapiens
caccaggacttggggtcagg

SEQ ID NO: 3170993 - DNA, 21 bp, Homo sapiens
caccaggacttggggtcagga

SEQ ID NO: 3170994 - DNA, 23 bp, Homo sapiens
caccaggacttggggtcaggaac

SEQ ID NO: 3170995 - DNA, 17 bp, Homo sapiens
caccaggagaaccacta

SEQ ID NO: 3170996 - DNA, 15 bp, Homo sapiens
caccaggccacctcc

SEQ ID NO: 3170997 - DNA, 13 bp, Homo sapiens
caccaggctggcg

SEQ ID NO: 3170998 - DNA, 15 bp, Homo sapiens
caccaggctggcgca

SEQ ID NO: 3170999 - DNA, 16 bp, Homo sapiens
caccaggctggcgcag

SEQ ID NO: 3171000 - DNA, 17 bp, Homo sapiens
caccaggctggcgcagc

SEQ ID NO: 3171001 - DNA, 19 bp, Homo sapiens
caccaggctggcgcagcca

SEQ ID NO: 3171002 - DNA, 20 bp, Homo sapiens
caccaggctggcgcagccaa

SEQ ID NO: 3171003 - DNA, 22 bp, Homo sapiens
caccaggctggcgcagccaagg

SEQ ID NO: 3171004 - DNA, 23 bp, Homo sapiens
caccaggctggcgcagccaaggc

SEQ ID NO: 3171005 - DNA, 13 bp, Homo sapiens
caccagggaagaa

SEQ ID NO: 3171006 - DNA, 15 bp, Homo sapiens
caccaggggtttctc

SEQ ID NO: 3171007 - DNA, 13 bp, Homo sapiens
caccagtctgtct

SEQ ID NO: 3171008 - DNA, 16 bp, Homo sapiens
caccagtctgtctact

SEQ ID NO: 3171009 - DNA, 12 bp, Homo sapiens
cacgcacacaca

SEQ ID NO: 3171010 - DNA, 12 bp, Homo sapiens
cacgcacgcaca

SEQ ID NO: 3171011 - DNA, 16 bp, Homo sapiens
cacgcactgggccacg

SEQ ID NO: 3171012 - DNA, 18 bp, Homo sapiens
cacgcactgggccacgga

SEQ ID NO: 3171013 - DNA, 20 bp, Homo sapiens
cacgcactgggccacggagg

SEQ ID NO: 3171014 - DNA, 21 bp, Homo sapiens
cacgcactgggccacggagga

SEQ ID NO: 3171015 - DNA, 21 bp, Homo sapiens
cacgcagaggacgcacgctcg

SEQ ID NO: 3171016 - DNA, 15 bp, Homo sapiens
cacgcatacacacat

SEQ ID NO: 3171017 - DNA, 22 bp, Homo sapiens
cacgcatacacacatgccctcc

SEQ ID NO: 3171018 - DNA, 13 bp, Homo sapiens
cacgccccagccc

SEQ ID NO: 3171019 - DNA, 18 bp, Homo sapiens
cacgccccagcccgacaa

SEQ ID NO: 3171020 - DNA, 16 bp, Homo sapiens
cacgcccgtcctgcct

SEQ ID NO: 3171021 - DNA, 18 bp, Homo sapiens
cacgccctactccactgc

SEQ ID NO: 3171022 - DNA, 13 bp, Homo sapiens
cacgccctcccct

SEQ ID NO: 3171023 - DNA, 24 bp, Homo sapiens
cacgccctcccctcccctgctgca

SEQ ID NO: 3171024 - DNA, 18 bp, Homo sapiens
cacgccctccctctccca

SEQ ID NO: 3171025 - DNA, 18 bp, Homo sapiens
cacgcctatgatcccagc

SEQ ID NO: 3171026 - DNA, 18 bp, Homo sapiens
cacgcctcctggccagac

SEQ ID NO: 3171027 - DNA, 19 bp, Homo sapiens
cacgcctgtaatcccagca

SEQ ID NO: 3171028 - DNA, 17 bp, Homo sapiens
cacgcctgtcctcctgg

SEQ ID NO: 3171029 - DNA, 19 bp, Homo sapiens
cacgcctgtcctcctggaa

SEQ ID NO: 3171030 - DNA, 17 bp, Homo sapiens
cacgcgcgcgcacacac

SEQ ID NO: 3171031 - DNA, 18 bp, Homo sapiens
cacgcgctctccaccacc

SEQ ID NO: 3171032 - DNA, 19 bp, Homo sapiens
cacgcgcttcgacttttct

SEQ ID NO: 3171033 - DNA, 15 bp, Homo sapiens
cacgcgtgcacacac

SEQ ID NO: 3171034 - DNA, 16 bp, Homo sapiens
cacgcgtgcacacacc

SEQ ID NO: 3171035 - DNA, 23 bp, Homo sapiens
cacgcgtgcacacaccagagccc

SEQ ID NO: 3171036 - DNA, 15 bp, Homo sapiens
cacgctccagctgcc

SEQ ID NO: 3171037 - DNA, 15 bp, Homo sapiens
cacgctccccgcctg

SEQ ID NO: 3171038 - DNA, 16 bp, Homo sapiens
cacgctcgctgccatc

SEQ ID NO: 3171039 - DNA, 15 bp, Homo sapiens
cacgctggagtgcag

SEQ ID NO: 3171040 - DNA, 14 bp, Homo sapiens
cacgctgtcctctc

SEQ ID NO: 3171041 - DNA, 18 bp, Homo sapiens
cacgctgtcctctcgagc

SEQ ID NO: 3171042 - DNA, 22 bp, Homo sapiens
cacgctgtcctctcgagcccag

SEQ ID NO: 3171043 - DNA, 20 bp, Homo sapiens
cacgctgtggccctggaggg

SEQ ID NO: 3171044 - DNA, 19 bp, Homo sapiens
cacgcttgcgtatgtctgt

SEQ ID NO: 3171045 - DNA, 15 bp, Homo sapiens
cacgctttgctgcta

SEQ ID NO: 3171046 - DNA, 19 bp, Homo sapiens
cacggacaataaacctccg

SEQ ID NO: 3171047 - DNA, 20 bp, Homo sapiens
cacggaccactcgaggcctg

SEQ ID NO: 3171048 - DNA, 22 bp, Homo sapiens
cacggaccactcgaggcctgca

SEQ ID NO: 3171049 - DNA, 14 bp, Homo sapiens
cacggacccccaga

SEQ ID NO: 3171050 - DNA, 14 bp, Homo sapiens
cacggactcccggg

SEQ ID NO: 3171051 - DNA, 19 bp, Homo sapiens
cacggagcccagccctccc

SEQ ID NO: 3171052 - DNA, 12 bp, Homo sapiens
cacggagccctc

SEQ ID NO: 3171053 - DNA, 19 bp, Homo sapiens
cacggaggcctcgagcaga

SEQ ID NO: 3171054 - DNA, 23 bp, Homo sapiens
cacggaggcctcgagcagagaga

SEQ ID NO: 3171055 - DNA, 23 bp, Homo sapiens
cacggagggggacggggctcagc

SEQ ID NO: 3171056 - DNA, 17 bp, Homo sapiens
cacggccaggccagagg

SEQ ID NO: 3171057 - DNA, 14 bp, Homo sapiens
cacggccgctccag

SEQ ID NO: 3171058 - DNA, 15 bp, Homo sapiens
cacggccgctccagg

SEQ ID NO: 3171059 - DNA, 16 bp, Homo sapiens
cacggccgctccaggg

SEQ ID NO: 3171060 - DNA, 22 bp, Homo sapiens
cacggcgtggtgtgtccctgga

SEQ ID NO: 3171061 - DNA, 15 bp, Homo sapiens
cacgggagatttctt

SEQ ID NO: 3171062 - DNA, 23 bp, Homo sapiens
cacggtgcgtggctgtggcacag

SEQ ID NO: 3171063 - DNA, 18 bp, Homo sapiens
cacgtacacacacataca

SEQ ID NO: 3171064 - DNA, 22 bp, Homo sapiens
cacgtatttatatttggaaaga

SEQ ID NO: 3171065 - DNA, 20 bp, Homo sapiens
cacgtcaaatgcatacaagt

SEQ ID NO: 3171066 - DNA, 14 bp, Homo sapiens
cacgtctgacaaat

SEQ ID NO: 3171067 - DNA, 15 bp, Homo sapiens
cacgtctgccaggcc

SEQ ID NO: 3171068 - DNA, 18 bp, Homo sapiens
cacgtctggccaggcact

SEQ ID NO: 3171069 - DNA, 15 bp, Homo sapiens
cacgtctgtcttcac

SEQ ID NO: 3171070 - DNA, 16 bp, Homo sapiens
cacgtcttggtgcctt

SEQ ID NO: 3171071 - DNA, 18 bp, Homo sapiens
cacgtcttggtgcctttt

SEQ ID NO: 3171072 - DNA, 18 bp, Homo sapiens
cacgtggcatgtggcctg

SEQ ID NO: 3171073 - DNA, 18 bp, Homo sapiens
cacgtggcctcttgagca

SEQ ID NO: 3171074 - DNA, 20 bp, Homo sapiens
cacgtggcctcttgagcagt

SEQ ID NO: 3171075 - DNA, 23 bp, Homo sapiens
cacgtggcctcttgagcagtggc

SEQ ID NO: 3171076 - DNA, 15 bp, Homo sapiens
cacgtggtcactgtg

SEQ ID NO: 3171077 - DNA, 17 bp, Homo sapiens
cacgtggtcactgtgca

SEQ ID NO: 3171078 - DNA, 19 bp, Homo sapiens
cacgtgtatagtatctgta

SEQ ID NO: 3171079 - DNA, 14 bp, Homo sapiens
cacgtgtcttccac

SEQ ID NO: 3171080 - DNA, 19 bp, Homo sapiens
cacgttctcacacccaccg

SEQ ID NO: 3171081 - DNA, 13 bp, Homo sapiens
cacgttctttccc

SEQ ID NO: 3171082 - DNA, 19 bp, Homo sapiens
cacgtttggtttgcgcagt

SEQ ID NO: 3171083 - DNA, 15 bp, Homo sapiens
cacgtttttctggac

SEQ ID NO: 3171084 - DNA, 14 bp, Homo sapiens
cactaaactttatt

SEQ ID NO: 3171085 - DNA, 20 bp, Homo sapiens
cactaaactttatttgtaaa

SEQ ID NO: 3171086 - DNA, 12 bp, Homo sapiens
cactaaagcagt

SEQ ID NO: 3171087 - DNA, 18 bp, Homo sapiens
cactaaagccagcctgac

SEQ ID NO: 3171088 - DNA, 20 bp, Homo sapiens
cactaaagccagcctgacct

SEQ ID NO: 3171089 - DNA, 22 bp, Homo sapiens
cactaaagtatagagaaaagtg

SEQ ID NO: 3171090 - DNA, 15 bp, Homo sapiens
cactaaagtatgtaa

SEQ ID NO: 3171091 - DNA, 16 bp, Homo sapiens
cactaaagtatgtaaa

SEQ ID NO: 3171092 - DNA, 22 bp, Homo sapiens
cactaaagtatgtaaagtatgt

SEQ ID NO: 3171093 - DNA, 18 bp, Homo sapiens
cactaacattatattgca

SEQ ID NO: 3171094 - DNA, 13 bp, Homo sapiens
cactaacatttcc

SEQ ID NO: 3171095 - DNA, 22 bp, Homo sapiens
cactaaccaagctgagtttcct

SEQ ID NO: 3171096 - DNA, 19 bp, Homo sapiens
cactaacgacttcagggca

SEQ ID NO: 3171097 - DNA, 19 bp, Homo sapiens
cactaactcaccagcccca

SEQ ID NO: 3171098 - DNA, 15 bp, Homo sapiens
cactaagagggcaga

SEQ ID NO: 3171099 - DNA, 19 bp, Homo sapiens
cactaagagggcagactgt

SEQ ID NO: 3171100 - DNA, 21 bp, Homo sapiens
cactaaggccgtgtctctgag

SEQ ID NO: 3171101 - DNA, 17 bp, Homo sapiens
cactaagttatagtata

SEQ ID NO: 3171102 - DNA, 14 bp, Homo sapiens
cactaataaagtgc

SEQ ID NO: 3171103 - DNA, 16 bp, Homo sapiens
cactaatctgaaagga

SEQ ID NO: 3171104 - DNA, 20 bp, Homo sapiens
cactaatttttgtattattt

SEQ ID NO: 3171105 - DNA, 15 bp, Homo sapiens
cactacacagcacac

SEQ ID NO: 3171106 - DNA, 23 bp, Homo sapiens
cactacacctggctgaggttcct

SEQ ID NO: 3171107 - DNA, 17 bp, Homo sapiens
cactacatatctaaagc

SEQ ID NO: 3171108 - DNA, 15 bp, Homo sapiens
cactacatgcagccc

SEQ ID NO: 3171109 - DNA, 15 bp, Homo sapiens
cactaccgattcttt

SEQ ID NO: 3171110 - DNA, 15 bp, Homo sapiens
cactacctgaacatt

SEQ ID NO: 3171111 - DNA, 23 bp, Homo sapiens
cactacggaatagttggctagga

SEQ ID NO: 3171112 - DNA, 12 bp, Homo sapiens
cactactacctc

SEQ ID NO: 3171113 - DNA, 15 bp, Homo sapiens
cactactcctctgca

SEQ ID NO: 3171114 - DNA, 19 bp, Homo sapiens
cactactcctctgcagtgc

SEQ ID NO: 3171115 - DNA, 13 bp, Homo sapiens
cactactgcagca

SEQ ID NO: 3171116 - DNA, 14 bp, Homo sapiens
cactagacaaaact

SEQ ID NO: 3171117 - DNA, 15 bp, Homo sapiens
cactagacaaaactg

SEQ ID NO: 3171118 - DNA, 23 bp, Homo sapiens
cactagagaatgcacagatatac

SEQ ID NO: 3171119 - DNA, 16 bp, Homo sapiens
cactagcccaatgaaa

SEQ ID NO: 3171120 - DNA, 21 bp, Homo sapiens
cactagcctctccaggaatgc

SEQ ID NO: 3171121 - DNA, 17 bp, Homo sapiens
cactagcctttggctct

SEQ ID NO: 3171122 - DNA, 18 bp, Homo sapiens
cactagcctttggctctg

SEQ ID NO: 3171123 - DNA, 21 bp, Homo sapiens
cactagcctttggctctggag

SEQ ID NO: 3171124 - DNA, 22 bp, Homo sapiens
cactagcctttggctctggaga

SEQ ID NO: 3171125 - DNA, 17 bp, Homo sapiens
cactaggactctgaggc

SEQ ID NO: 3171126 - DNA, 18 bp, Homo sapiens
cactaggactctgaggct

SEQ ID NO: 3171127 - DNA, 22 bp, Homo sapiens
cactaggcccccacttgcctct

SEQ ID NO: 3171128 - DNA, 17 bp, Homo sapiens
cactagggccttggaaa

SEQ ID NO: 3171129 - DNA, 20 bp, Homo sapiens
cactaggggatataggagag

SEQ ID NO: 3171130 - DNA, 21 bp, Homo sapiens
cactaggggatataggagagg

SEQ ID NO: 3171131 - DNA, 15 bp, Homo sapiens
cactaggtaacttat

SEQ ID NO: 3171132 - DNA, 21 bp, Homo sapiens
cactagtaagtaattatgcac

SEQ ID NO: 3171133 - DNA, 21 bp, Homo sapiens
cactagtgaccccttccctgt

SEQ ID NO: 3171134 - DNA, 14 bp, Homo sapiens
cacttatgtacttg

SEQ ID NO: 3171135 - DNA, 17 bp, Homo sapiens
cacttatgtacttgata

SEQ ID NO: 3171136 - DNA, 23 bp, Homo sapiens
cacttatgttactggtgtccagc

SEQ ID NO: 3171137 - DNA, 13 bp, Homo sapiens
cacttattctgta

SEQ ID NO: 3171138 - DNA, 21 bp, Homo sapiens
cacttattggaactctgcttg

SEQ ID NO: 3171139 - DNA, 12 bp, Homo sapiens
cacttatttcac

SEQ ID NO: 3171140 - DNA, 13 bp, Homo sapiens
cacttatttcact

SEQ ID NO: 3171141 - DNA, 22 bp, Homo sapiens
cacttatttcactatcttcttc

SEQ ID NO: 3171142 - DNA, 17 bp, Homo sapiens
cacttatttcataaaca

SEQ ID NO: 3171143 - DNA, 22 bp, Homo sapiens
cacttcaaggtgacagaaggac

SEQ ID NO: 3171144 - DNA, 21 bp, Homo sapiens
cacttcactgcgaagaccctc

SEQ ID NO: 3171145 - DNA, 17 bp, Homo sapiens
cacttcagagagctggt

SEQ ID NO: 3171146 - DNA, 16 bp, Homo sapiens
cacttcagatctgagg

SEQ ID NO: 3171147 - DNA, 19 bp, Homo sapiens
cacttcagggctttactcc

SEQ ID NO: 3171148 - DNA, 17 bp, Homo sapiens
cacttcaggggatgggt

SEQ ID NO: 3171149 - DNA, 12 bp, Homo sapiens
cacttccagggg

SEQ ID NO: 3171150 - DNA, 20 bp, Homo sapiens
cacttccaggggaacctgcc

SEQ ID NO: 3171151 - DNA, 13 bp, Homo sapiens
cacttccagggtt

SEQ ID NO: 3171152 - DNA, 18 bp, Homo sapiens
cacttccatacagctcta

SEQ ID NO: 3171153 - DNA, 13 bp, Homo sapiens
cacttccatggga

SEQ ID NO: 3171154 - DNA, 14 bp, Homo sapiens
cacttccccctctt

SEQ ID NO: 3171155 - DNA, 19 bp, Homo sapiens
cacttcccctccaagaccc

SEQ ID NO: 3171156 - DNA, 17 bp, Homo sapiens
cacttcctgttttataa

SEQ ID NO: 3171157 - DNA, 17 bp, Homo sapiens
cacttctaactccactg

SEQ ID NO: 3171158 - DNA, 16 bp, Homo sapiens
cacttctccccagaaa

SEQ ID NO: 3171159 - DNA, 21 bp, Homo sapiens
cacttctcttaaacttgtgaa

SEQ ID NO: 3171160 - DNA, 22 bp, Homo sapiens
cacttctgtgagacccccacac

SEQ ID NO: 3171161 - DNA, 18 bp, Homo sapiens
cacttcttaaaggcctgg

SEQ ID NO: 3171162 - DNA, 17 bp, Homo sapiens
cacttcttcctttctct

SEQ ID NO: 3171163 - DNA, 16 bp, Homo sapiens
cacttcttttgaacat

SEQ ID NO: 3171164 - DNA, 12 bp, Homo sapiens
cacttgaaagat

SEQ ID NO: 3171165 - DNA, 14 bp, Homo sapiens
cacttgacaccaac

SEQ ID NO: 3171166 - DNA, 19 bp, Homo sapiens
cacttgacaccaaccagac

SEQ ID NO: 3171167 - DNA, 20 bp, Homo sapiens
cacttgagaaccagtctcct

SEQ ID NO: 3171168 - DNA, 13 bp, Homo sapiens
cacttgagagaaa

SEQ ID NO: 3171169 - DNA, 13 bp, Homo sapiens
cacttgagaggat

SEQ ID NO: 3171170 - DNA, 13 bp, Homo sapiens
cacttgcctcttc

SEQ ID NO: 3171171 - DNA, 14 bp, Homo sapiens
cacttgcctcttcc

SEQ ID NO: 3171172 - DNA, 12 bp, Homo sapiens
cacttgccttag

SEQ ID NO: 3171173 - DNA, 17 bp, Homo sapiens
cacttggactcttgctc

SEQ ID NO: 3171174 - DNA, 18 bp, Homo sapiens
cacttggactcttgctct

SEQ ID NO: 3171175 - DNA, 15 bp, Homo sapiens
cacttggagcccgtg

SEQ ID NO: 3171176 - DNA, 18 bp, Homo sapiens
cacttggagcccgtgcag

SEQ ID NO: 3171177 - DNA, 12 bp, Homo sapiens
cacttggcctca

SEQ ID NO: 3171178 - DNA, 22 bp, Homo sapiens
cacttggcctcagctggctgta

SEQ ID NO: 3171179 - DNA, 15 bp, Homo sapiens
cacttggtctgtgag

SEQ ID NO: 3171180 - DNA, 19 bp, Homo sapiens
cacttggttagacgccttc

SEQ ID NO: 3171181 - DNA, 14 bp, Homo sapiens
cacttgtagagcag

SEQ ID NO: 3171182 - DNA, 12 bp, Homo sapiens
cacttgtataaa

SEQ ID NO: 3171183 - DNA, 20 bp, Homo sapiens
cacttgtataaatgtatata

SEQ ID NO: 3171184 - DNA, 17 bp, Homo sapiens
cacttgtattgacttta

SEQ ID NO: 3171185 - DNA, 19 bp, Homo sapiens
cacttgtgctttgctcttg

SEQ ID NO: 3171186 - DNA, 13 bp, Homo sapiens
cacttgtgtgtgg

SEQ ID NO: 3171187 - DNA, 17 bp, Homo sapiens
cacttgtgtgtgggctg

SEQ ID NO: 3171188 - DNA, 21 bp, Homo sapiens
cacttgtgtgtgggctgtgag

SEQ ID NO: 3171189 - DNA, 13 bp, Homo sapiens
cacttgttccagc

SEQ ID NO: 3171190 - DNA, 15 bp, Homo sapiens
cacttgttccagctc

SEQ ID NO: 3171191 - DNA, 19 bp, Homo sapiens
cactttaaagcaattgcat

SEQ ID NO: 3171192 - DNA, 14 bp, Homo sapiens
cactttacccacct

SEQ ID NO: 3171193 - DNA, 20 bp, Homo sapiens
cactttacccacctagaaca

SEQ ID NO: 3171194 - DNA, 15 bp, Homo sapiens
cactttagatgctga

SEQ ID NO: 3171195 - DNA, 16 bp, Homo sapiens
cactttagatgctgat

SEQ ID NO: 3171196 - DNA, 21 bp, Homo sapiens
cactttagatgctgatgattt

SEQ ID NO: 3171197 - DNA, 18 bp, Homo sapiens
cactttagggctgtaaaa

SEQ ID NO: 3171198 - DNA, 23 bp, Homo sapiens
cactttagggctgtaaaatgcat

SEQ ID NO: 3171199 - DNA, 18 bp, Homo sapiens
cactttataagtcattgt

SEQ ID NO: 3171200 - DNA, 14 bp, Homo sapiens
cactttatttactt

SEQ ID NO: 3171201 - DNA, 17 bp, Homo sapiens
cactttatttacttcgt

SEQ ID NO: 3171202 - DNA, 14 bp, Homo sapiens
cactttcattgcca

SEQ ID NO: 3171203 - DNA, 21 bp, Homo sapiens
cactttcattgccagtgtctt

SEQ ID NO: 3171204 - DNA, 12 bp, Homo sapiens
cactttccactt

SEQ ID NO: 3171205 - DNA, 16 bp, Homo sapiens
cactttctaatgtttc

SEQ ID NO: 3171206 - DNA, 18 bp, Homo sapiens
cactttctaatgtttctg

SEQ ID NO: 3171207 - DNA, 16 bp, Homo sapiens
cactttgagaaacacc

SEQ ID NO: 3171208 - DNA, 21 bp, Homo sapiens
cactttgagatgtgttcctcc

SEQ ID NO: 3171209 - DNA, 22 bp, Homo sapiens
cactttgagatgtgttcctcct

SEQ ID NO: 3171210 - DNA, 17 bp, Homo sapiens
cactttgcacagctctc

SEQ ID NO: 3171211 - DNA, 22 bp, Homo sapiens
cactttgcactgatatatcatg

SEQ ID NO: 3171212 - DNA, 13 bp, Homo sapiens
cactttgcctcct

SEQ ID NO: 3171213 - DNA, 13 bp, Homo sapiens
cactttgctctgg

SEQ ID NO: 3171214 - DNA, 19 bp, Homo sapiens
cactttgctctgggtggaa

SEQ ID NO: 3171215 - DNA, 14 bp, Homo sapiens
cactttgggaggcc

SEQ ID NO: 3171216 - DNA, 20 bp, Homo sapiens
cactttggtacatggccagt

SEQ ID NO: 3171217 - DNA, 14 bp, Homo sapiens
cactttgtattact

SEQ ID NO: 3171218 - DNA, 20 bp, Homo sapiens
cactttgtcgcccaggctgg

SEQ ID NO: 3171219 - DNA, 18 bp, Homo sapiens
cactttgttctttaggag

SEQ ID NO: 3171220 - DNA, 17 bp, Homo sapiens
cacttttatttcctgta

SEQ ID NO: 3171221 - DNA, 15 bp, Homo sapiens
cacttttgagacttt

SEQ ID NO: 3171222 - DNA, 18 bp, Homo sapiens
cacttttgttattccatc

SEQ ID NO: 3171223 - DNA, 19 bp, Homo sapiens
cactttttcatttgcctat

SEQ ID NO: 3171224 - DNA, 23 bp, Homo sapiens
cacttttttatgaagaaaaagta

SEQ ID NO: 3171225 - DNA, 12 bp, Homo sapiens
cagaaaaacaat

SEQ ID NO: 3171226 - DNA, 15 bp, Homo sapiens
cagaaaaacaatctt

SEQ ID NO: 3171227 - DNA, 16 bp, Homo sapiens
cagaaaaactctggga

SEQ ID NO: 3171228 - DNA, 15 bp, Homo sapiens
cagaaaaaggcagtg

SEQ ID NO: 3171229 - DNA, 23 bp, Homo sapiens
cagaaaacaacttggcatttcta

SEQ ID NO: 3171230 - DNA, 15 bp, Homo sapiens
cagaaaacagagcct

SEQ ID NO: 3171231 - DNA, 18 bp, Homo sapiens
cagaaaacagagcctgcc

SEQ ID NO: 3171232 - DNA, 14 bp, Homo sapiens
cagaaaaccccagc

SEQ ID NO: 3171233 - DNA, 15 bp, Homo sapiens
cagaaaactttaaaa

SEQ ID NO: 3171234 - DNA, 14 bp, Homo sapiens
cagaaaagaaaacc

SEQ ID NO: 3171235 - DNA, 17 bp, Homo sapiens
cagaaaagaaaaccatt

SEQ ID NO: 3171236 - DNA, 19 bp, Homo sapiens
cagaaaagaggagaccctg

SEQ ID NO: 3171237 - DNA, 20 bp, Homo sapiens
cagaaaagaggagaccctgg

SEQ ID NO: 3171238 - DNA, 21 bp, Homo sapiens
cagaaaagaggagaccctgga

SEQ ID NO: 3171239 - DNA, 18 bp, Homo sapiens
cagaaaagggaagttgtg

SEQ ID NO: 3171240 - DNA, 19 bp, Homo sapiens
cagaaaagtaattttgtca

SEQ ID NO: 3171241 - DNA, 14 bp, Homo sapiens
cagaaaattctgtg

SEQ ID NO: 3171242 - DNA, 17 bp, Homo sapiens
cagaaaattctgtgcct

SEQ ID NO: 3171243 - DNA, 23 bp, Homo sapiens
cagaaaattctgtgccttgtttt

SEQ ID NO: 3171244 - DNA, 19 bp, Homo sapiens
cagaaaattggcagtggca

SEQ ID NO: 3171245 - DNA, 18 bp, Homo sapiens
cagaaacagccattgcgg

SEQ ID NO: 3171246 - DNA, 15 bp, Homo sapiens
cagaaacagtgggag

SEQ ID NO: 3171247 - DNA, 12 bp, Homo sapiens
cagaaacatgaa

SEQ ID NO: 3171248 - DNA, 13 bp, Homo sapiens
cagaaaccagtta

SEQ ID NO: 3171249 - DNA, 20 bp, Homo sapiens
cagaaacccggcttcctgtg

SEQ ID NO: 3171250 - DNA, 22 bp, Homo sapiens
cagaaaccctcattgtgtttct

SEQ ID NO: 3171251 - DNA, 15 bp, Homo sapiens
cagaaacgtgttaaa

SEQ ID NO: 3171252 - DNA, 19 bp, Homo sapiens
cagaaactggattaaaaca

SEQ ID NO: 3171253 - DNA, 22 bp, Homo sapiens
cagaaactggattaaaacaatt

SEQ ID NO: 3171254 - DNA, 14 bp, Homo sapiens
cagaaagaggtctc

SEQ ID NO: 3171255 - DNA, 21 bp, Homo sapiens
cagaaagatggatgtgctttg

SEQ ID NO: 3171256 - DNA, 20 bp, Homo sapiens
cagaaaggaaaacctgaaga

SEQ ID NO: 3171257 - DNA, 20 bp, Homo sapiens
cagaaaggactcctcctttt

SEQ ID NO: 3171258 - DNA, 13 bp, Homo sapiens
cagaaaggagaga

SEQ ID NO: 3171259 - DNA, 13 bp, Homo sapiens
cagaaaggagagt

SEQ ID NO: 3171260 - DNA, 16 bp, Homo sapiens
cagaaaggatatttaa

SEQ ID NO: 3171261 - DNA, 23 bp, Homo sapiens
cagagacggcagaaaacagagcc

SEQ ID NO: 3171262 - DNA, 10 bp, Homo sapiens
cagagactca

SEQ ID NO: 3171263 - DNA, 22 bp, Homo sapiens
cagagactcagatgaggacaga

SEQ ID NO: 3171264 - DNA, 18 bp, Homo sapiens
cagagactcagcgctcct

SEQ ID NO: 3171265 - DNA, 15 bp, Homo sapiens
cagagagaaaaagat

SEQ ID NO: 3171266 - DNA, 17 bp, Homo sapiens
cagagagacagacttga

SEQ ID NO: 3171267 - DNA, 15 bp, Homo sapiens
cagagagcatctttc

SEQ ID NO: 3171268 - DNA, 13 bp, Homo sapiens
cagagagctggta

SEQ ID NO: 3171269 - DNA, 17 bp, Homo sapiens
cagagaggagaaacaca

SEQ ID NO: 3171270 - DNA, 22 bp, Homo sapiens
cagagaggagaaacacatcttc

SEQ ID NO: 3171271 - DNA, 21 bp, Homo sapiens
cagagaggagcacctgaaccc

SEQ ID NO: 3171272 - DNA, 20 bp, Homo sapiens
cagagaggccttttggaatg

SEQ ID NO: 3171273 - DNA, 16 bp, Homo sapiens
cagagagggcccagct

SEQ ID NO: 3171274 - DNA, 12 bp, Homo sapiens
cagagagggtgg

SEQ ID NO: 3171275 - DNA, 23 bp, Homo sapiens
cagagagggtggtgacctctgcc

SEQ ID NO: 3171276 - DNA, 12 bp, Homo sapiens
cagagagtccca

SEQ ID NO: 3171277 - DNA, 22 bp, Homo sapiens
cagagagtcccactgcctcagg

SEQ ID NO: 3171278 - DNA, 23 bp, Homo sapiens
cagagagtcccactgcctcaggt

SEQ ID NO: 3171279 - DNA, 15 bp, Homo sapiens
cagagagtcctgtgc

SEQ ID NO: 3171280 - DNA, 14 bp, Homo sapiens
cagagagtggctcc

SEQ ID NO: 3171281 - DNA, 15 bp, Homo sapiens
cagagagtggctcct

SEQ ID NO: 3171282 - DNA, 18 bp, Homo sapiens
cagagagtggctcctccc

SEQ ID NO: 3171283 - DNA, 14 bp, Homo sapiens
cagagagtgtacat

SEQ ID NO: 3171284 - DNA, 21 bp, Homo sapiens
cagagatgcaccaccaagcca

SEQ ID NO: 3171285 - DNA, 13 bp, Homo sapiens
cagagatgccagc

SEQ ID NO: 3171286 - DNA, 15 bp, Homo sapiens
cagagatgccagccc

SEQ ID NO: 3171287 - DNA, 16 bp, Homo sapiens
cagagatgccagccct

SEQ ID NO: 3171288 - DNA, 17 bp, Homo sapiens
cagagatgccagccctt

SEQ ID NO: 3171289 - DNA, 23 bp, Homo sapiens
cagagatgtcatcagagctcctc

SEQ ID NO: 3171290 - DNA, 19 bp, Homo sapiens
cagagattgaactccaaga

SEQ ID NO: 3171291 - DNA, 16 bp, Homo sapiens
cagagatttctcattg

SEQ ID NO: 3171292 - DNA, 21 bp, Homo sapiens
cagagatttctcattgacttt

SEQ ID NO: 3171293 - DNA, 16 bp, Homo sapiens
cagagcaaaataattt

SEQ ID NO: 3171294 - DNA, 15 bp, Homo sapiens
cagagcaacctctca

SEQ ID NO: 3171295 - DNA, 21 bp, Homo sapiens
cagagcacccccaagcctggg

SEQ ID NO: 3171296 - DNA, 16 bp, Homo sapiens
cagagcaccccctgct

SEQ ID NO: 3171297 - DNA, 19 bp, Homo sapiens
cagagcagagcaaatgagg

SEQ ID NO: 3171298 - DNA, 21 bp, Homo sapiens
cagagcagagcaaatgaggga

SEQ ID NO: 3171299 - DNA, 14 bp, Homo sapiens
cagagcagatgcag

SEQ ID NO: 3171300 - DNA, 15 bp, Homo sapiens
cagagcagatgcaga

SEQ ID NO: 3171301 - DNA, 19 bp, Homo sapiens
cagagcagatgcagagagc

SEQ ID NO: 3171302 - DNA, 21 bp, Homo sapiens
cagagcaggaagcattcagag

SEQ ID NO: 3171303 - DNA, 18 bp, Homo sapiens
cagagcaggacctccctt

SEQ ID NO: 3171304 - DNA, 14 bp, Homo sapiens
cagagcaggactgc

SEQ ID NO: 3171305 - DNA, 13 bp, Homo sapiens
cagagcaggcaat

SEQ ID NO: 3171306 - DNA, 18 bp, Homo sapiens
cagagcaggggctccagc

SEQ ID NO: 3171307 - DNA, 21 bp, Homo sapiens
cagagcagtctaaacagagtc

SEQ ID NO: 3171308 - DNA, 15 bp, Homo sapiens
cagagcatctggctg

SEQ ID NO: 3171309 - DNA, 22 bp, Homo sapiens
cagagccactctatgagttgga

SEQ ID NO: 3171310 - DNA, 22 bp, Homo sapiens
cagagccagatgcaggacagga

SEQ ID NO: 3171311 - DNA, 12 bp, Homo sapiens
cagagccagcct

SEQ ID NO: 3171312 - DNA, 13 bp, Homo sapiens
cagagccagcctg

SEQ ID NO: 3171313 - DNA, 23 bp, Homo sapiens
cagagccagcctgggactcccag

SEQ ID NO: 3171314 - DNA, 17 bp, Homo sapiens
cagagccatgctgggaa

SEQ ID NO: 3171315 - DNA, 15 bp, Homo sapiens
cagagccatgggcct

SEQ ID NO: 3171316 - DNA, 20 bp, Homo sapiens
cagagccatgggcctgggcc

SEQ ID NO: 3171317 - DNA, 23 bp, Homo sapiens
cagagccccacacggaggcatct

SEQ ID NO: 3171318 - DNA, 15 bp, Homo sapiens
cagagcccccagccc

SEQ ID NO: 3171319 - DNA, 14 bp, Homo sapiens
cagagcccccagga

SEQ ID NO: 3171320 - DNA, 16 bp, Homo sapiens
cagagcccctcctcca

SEQ ID NO: 3171321 - DNA, 17 bp, Homo sapiens
cagagcccctcctccag

SEQ ID NO: 3171322 - DNA, 18 bp, Homo sapiens
cagagcccctcctccagc

SEQ ID NO: 3171323 - DNA, 21 bp, Homo sapiens
cagagcccctcctccagcccc

SEQ ID NO: 3171324 - DNA, 22 bp, Homo sapiens
cagagccctgccctgcaccctt

SEQ ID NO: 3171325 - DNA, 19 bp, Homo sapiens
cagagccctggctgggttc

SEQ ID NO: 3171326 - DNA, 12 bp, Homo sapiens
cagagcctgcag

SEQ ID NO: 3171327 - DNA, 12 bp, Homo sapiens
cagagcctgcct

SEQ ID NO: 3171328 - DNA, 21 bp, Homo sapiens
cagagcctgcctaaccaggcc

SEQ ID NO: 3171329 - DNA, 22 bp, Homo sapiens
cagagcctgcctaaccaggccc

SEQ ID NO: 3171330 - DNA, 17 bp, Homo sapiens
cagagcctggctgccca

SEQ ID NO: 3171331 - DNA, 20 bp, Homo sapiens
cagagccttcaagtgccaaa

SEQ ID NO: 3171332 - DNA, 21 bp, Homo sapiens
cagagccttcaagtgccaaac

SEQ ID NO: 3171333 - DNA, 14 bp, Homo sapiens
cagagcgtccttcc

SEQ ID NO: 3171334 - DNA, 17 bp, Homo sapiens
cagagcgtccttccccc

SEQ ID NO: 3171335 - DNA, 23 bp, Homo sapiens
cagagcgtccttccccctgtaga

SEQ ID NO: 3171336 - DNA, 13 bp, Homo sapiens
cagagctcctctg

SEQ ID NO: 3171337 - DNA, 18 bp, Homo sapiens
cagagctcttcaagctgt

SEQ ID NO: 3171338 - DNA, 20 bp, Homo sapiens
cagagctcttcaagctgtcc

SEQ ID NO: 3171339 - DNA, 23 bp, Homo sapiens
cagagctgacgggaggccccagc

SEQ ID NO: 3171340 - DNA, 13 bp, Homo sapiens
cagagctggaagg

SEQ ID NO: 3171341 - DNA, 16 bp, Homo sapiens
cagagctggaaggcag

SEQ ID NO: 3171342 - DNA, 18 bp, Homo sapiens
cagagctggaaggcaggg

SEQ ID NO: 3171343 - DNA, 19 bp, Homo sapiens
cagagctggaaggcagggc

SEQ ID NO: 3171344 - DNA, 23 bp, Homo sapiens
cagagctggaaggcagggcagag

SEQ ID NO: 3171345 - DNA, 15 bp, Homo sapiens
cagagctgggaggca

SEQ ID NO: 3171346 - DNA, 17 bp, Homo sapiens
cagagctgggtggggac

SEQ ID NO: 3171347 - DNA, 14 bp, Homo sapiens
cagagctgtgccag

SEQ ID NO: 3171348 - DNA, 18 bp, Homo sapiens
cagagctgtgccagcagg

SEQ ID NO: 3171349 - DNA, 21 bp, Homo sapiens
cagagctgtttatggcctcag

SEQ ID NO: 3171350 - DNA, 21 bp, Homo sapiens
cagaggaactgtccagagagc

SEQ ID NO: 3171351 - DNA, 16 bp, Homo sapiens
cagaggaatcctggca

SEQ ID NO: 3171352 - DNA, 22 bp, Homo sapiens
cagaggaatcctggcagcccag

SEQ ID NO: 3171353 - DNA, 21 bp, Homo sapiens
cagaggacagtctggagaagg

SEQ ID NO: 3171354 - DNA, 13 bp, Homo sapiens
cagaggaccacag

SEQ ID NO: 3171355 - DNA, 22 bp, Homo sapiens
cagaggactcccaaccctggct

SEQ ID NO: 3171356 - DNA, 20 bp, Homo sapiens
cagaggagccaccagttctc

SEQ ID NO: 3171357 - DNA, 14 bp, Homo sapiens
cagaggagctctac

SEQ ID NO: 3171358 - DNA, 22 bp, Homo sapiens
cagaggatggccagtgtctgtc

SEQ ID NO: 3171359 - DNA, 11 bp, Homo sapiens
cagaggcagcc

SEQ ID NO: 3171360 - DNA, 14 bp, Homo sapiens
cagaggcagcccca

SEQ ID NO: 3171361 - DNA, 15 bp, Homo sapiens
cagaggcagccccat

SEQ ID NO: 3171362 - DNA, 18 bp, Homo sapiens
cagaggcagccccattct

SEQ ID NO: 3171363 - DNA, 21 bp, Homo sapiens
cagaggcagcccgcacacctg

SEQ ID NO: 3171364 - DNA, 20 bp, Homo sapiens
cagaggccagaggcccccag

SEQ ID NO: 3171365 - DNA, 16 bp, Homo sapiens
cagaggccatgggcct

SEQ ID NO: 3171366 - DNA, 19 bp, Homo sapiens
cagaggccatgggcctcct

SEQ ID NO: 3171367 - DNA, 16 bp, Homo sapiens
cagaggccctggaggt

SEQ ID NO: 3171368 - DNA, 21 bp, Homo sapiens
cagaggcctgctgccagtgca

SEQ ID NO: 3171369 - DNA, 17 bp, Homo sapiens
cagaggctaagatgaga

SEQ ID NO: 3171370 - DNA, 13 bp, Homo sapiens
cagaggctgaggt

SEQ ID NO: 3171371 - DNA, 16 bp, Homo sapiens
cagaggctgggagcat

SEQ ID NO: 3171372 - DNA, 23 bp, Homo sapiens
cagagggaaagtaaatatttcag

SEQ ID NO: 3171373 - DNA, 17 bp, Homo sapiens
cagagggaatgttccct

SEQ ID NO: 3171374 - DNA, 20 bp, Homo sapiens
cagagggaatgttccctgca

SEQ ID NO: 3171375 - DNA, 23 bp, Homo sapiens
cagagggaatgttccctgcaccc

SEQ ID NO: 3171376 - DNA, 19 bp, Homo sapiens
cagagggactttgtataga

SEQ ID NO: 3171377 - DNA, 16 bp, Homo sapiens
cagagggagcaggccg

SEQ ID NO: 3171378 - DNA, 20 bp, Homo sapiens
cagagggagtgacagaggca

SEQ ID NO: 3171379 - DNA, 23 bp, Homo sapiens
cagagggagtgacagaggcagcc

SEQ ID NO: 3171380 - DNA, 15 bp, Homo sapiens
cagagggcccaggca

SEQ ID NO: 3171381 - DNA, 22 bp, Homo sapiens
cagagggcccaggcaggccacc

SEQ ID NO: 3171382 - DNA, 13 bp, Homo sapiens
cagagggctggag

SEQ ID NO: 3171383 - DNA, 23 bp, Homo sapiens
cagaggggaaaccagtgtagcct

SEQ ID NO: 3171384 - DNA, 14 bp, Homo sapiens
cagaggggcagccg

SEQ ID NO: 3171385 - DNA, 15 bp, Homo sapiens
cagaggggcagccgc

SEQ ID NO: 3171386 - DNA, 13 bp, Homo sapiens
cagccgccccagc

SEQ ID NO: 3171387 - DNA, 15 bp, Homo sapiens
cagccgccccagccc

SEQ ID NO: 3171388 - DNA, 16 bp, Homo sapiens
cagccgccctgggctg

SEQ ID NO: 3171389 - DNA, 16 bp, Homo sapiens
cagccgccggaagtgg

SEQ ID NO: 3171390 - DNA, 19 bp, Homo sapiens
cagccgcctgaaagccaca

SEQ ID NO: 3171391 - DNA, 15 bp, Homo sapiens
cagccgcctttgggt

SEQ ID NO: 3171392 - DNA, 23 bp, Homo sapiens
cagccgcctttgggttccatctt

SEQ ID NO: 3171393 - DNA, 15 bp, Homo sapiens
cagccgctaggagag

SEQ ID NO: 3171394 - DNA, 13 bp, Homo sapiens
cagccggcacagg

SEQ ID NO: 3171395 - DNA, 15 bp, Homo sapiens
cagccggcacagggt

SEQ ID NO: 3171396 - DNA, 17 bp, Homo sapiens
cagccggcacagggtct

SEQ ID NO: 3171397 - DNA, 16 bp, Homo sapiens
cagccggccaatggaa

SEQ ID NO: 3171398 - DNA, 19 bp, Homo sapiens
cagccggccaatggaaacc

SEQ ID NO: 3171399 - DNA, 20 bp, Homo sapiens
cagccggccaatggaaacct

SEQ ID NO: 3171400 - DNA, 23 bp, Homo sapiens
cagccggcctctctggcctccca

SEQ ID NO: 3171401 - DNA, 24 bp, Homo sapiens
cagccggcctctctggcctcccac

SEQ ID NO: 3171402 - DNA, 21 bp, Homo sapiens
cagccggcgtggcaaatataa

SEQ ID NO: 3171403 - DNA, 13 bp, Homo sapiens
cagccgtatttta

SEQ ID NO: 3171404 - DNA, 18 bp, Homo sapiens
cagccgtcagccaaatgt

SEQ ID NO: 3171405 - DNA, 19 bp, Homo sapiens
cagccgtgatgctcaggct

SEQ ID NO: 3171406 - DNA, 16 bp, Homo sapiens
cagccgtgccttcagc

SEQ ID NO: 3171407 - DNA, 20 bp, Homo sapiens
cagccgtgccttcagctcta

SEQ ID NO: 3171408 - DNA, 17 bp, Homo sapiens
cagcctacccttcctgc

SEQ ID NO: 3171409 - DNA, 14 bp, Homo sapiens
cagcctagcacagg

SEQ ID NO: 3171410 - DNA, 21 bp, Homo sapiens
cagcctagcccttgtcccttt

SEQ ID NO: 3171411 - DNA, 22 bp, Homo sapiens
cagcctatgagcatcctgagcc

SEQ ID NO: 3171412 - DNA, 21 bp, Homo sapiens
cagcctatgggggctctcgga

SEQ ID NO: 3171413 - DNA, 17 bp, Homo sapiens
cagcctcaacctcctgg

SEQ ID NO: 3171414 - DNA, 20 bp, Homo sapiens
cagcctcaacctcctgggct

SEQ ID NO: 3171415 - DNA, 15 bp, Homo sapiens
cagcctcacccttgc

SEQ ID NO: 3171416 - DNA, 21 bp, Homo sapiens
cagcctcacgcccccaggaat

SEQ ID NO: 3171417 - DNA, 17 bp, Homo sapiens
cagcctcagaggagctc

SEQ ID NO: 3171418 - DNA, 19 bp, Homo sapiens
cagcctcagtcctcccctc

SEQ ID NO: 3171419 - DNA, 21 bp, Homo sapiens
cagcctcagtcctcccctcac

SEQ ID NO: 3171420 - DNA, 12 bp, Homo sapiens
cagcctccagag

SEQ ID NO: 3171421 - DNA, 15 bp, Homo sapiens
cagcctccagagcca

SEQ ID NO: 3171422 - DNA, 20 bp, Homo sapiens
cagcctccagagccagcctg

SEQ ID NO: 3171423 - DNA, 12 bp, Homo sapiens
cagcctccaggg

SEQ ID NO: 3171424 - DNA, 13 bp, Homo sapiens
cagcctccagggc

SEQ ID NO: 3171425 - DNA, 15 bp, Homo sapiens
cagcctccagggccc

SEQ ID NO: 3171426 - DNA, 14 bp, Homo sapiens
cagcctcccacccc

SEQ ID NO: 3171427 - DNA, 16 bp, Homo sapiens
cagcctcccaccccca

SEQ ID NO: 3171428 - DNA, 21 bp, Homo sapiens
cagcctcccgaatagctggga

SEQ ID NO: 3171429 - DNA, 22 bp, Homo sapiens
cagcctcccgaatagctgggac

SEQ ID NO: 3171430 - DNA, 23 bp, Homo sapiens
cagcctcccgaatagctgggact

SEQ ID NO: 3171431 - DNA, 21 bp, Homo sapiens
cagcctcccgagtagctggga

SEQ ID NO: 3171432 - DNA, 14 bp, Homo sapiens
cagcctccctctga

SEQ ID NO: 3171433 - DNA, 21 bp, Homo sapiens
cagcctccctctgacctgcag

SEQ ID NO: 3171434 - DNA, 23 bp, Homo sapiens
cagcctccctctgacctgcaggc

SEQ ID NO: 3171435 - DNA, 18 bp, Homo sapiens
cagcctccgccaagatct

SEQ ID NO: 3171436 - DNA, 20 bp, Homo sapiens
cagcctccgccaagatctac

SEQ ID NO: 3171437 - DNA, 13 bp, Homo sapiens
cagcctcctcctg

SEQ ID NO: 3171438 - DNA, 14 bp, Homo sapiens
cagcctcctctgga

SEQ ID NO: 3171439 - DNA, 22 bp, Homo sapiens
cagcctcctctggacggcaggc

SEQ ID NO: 3171440 - DNA, 16 bp, Homo sapiens
cagcctcctgagcctg

SEQ ID NO: 3171441 - DNA, 22 bp, Homo sapiens
cagcctcgttggaagaggaaca

SEQ ID NO: 3171442 - DNA, 14 bp, Homo sapiens
cagcctctccccag

SEQ ID NO: 3171443 - DNA, 15 bp, Homo sapiens
cagcctctcccggct

SEQ ID NO: 3171444 - DNA, 16 bp, Homo sapiens
cagcctctcccggctg

SEQ ID NO: 3171445 - DNA, 19 bp, Homo sapiens
cagcctctcccggctgcct

SEQ ID NO: 3171446 - DNA, 14 bp, Homo sapiens
cagcctctgacccc

SEQ ID NO: 3171447 - DNA, 16 bp, Homo sapiens
cagcctctgacccctc

SEQ ID NO: 3171448 - DNA, 20 bp, Homo sapiens
cagcctctgacccctcctca

SEQ ID NO: 3171449 - DNA, 21 bp, Homo sapiens
cagcctctgacccctcctcac

SEQ ID NO: 3171450 - DNA, 12 bp, Homo sapiens
cagcctctgtga

SEQ ID NO: 3171451 - DNA, 16 bp, Homo sapiens
cagcctgacctgagac

SEQ ID NO: 3171452 - DNA, 22 bp, Homo sapiens
cagcctgacctgagactgtcgg

SEQ ID NO: 3171453 - DNA, 15 bp, Homo sapiens
cagcctgaccttcct

SEQ ID NO: 3171454 - DNA, 16 bp, Homo sapiens
cagcctgagcctctgc

SEQ ID NO: 3171455 - DNA, 12 bp, Homo sapiens
cagcctgaggct

SEQ ID NO: 3171456 - DNA, 10 bp, Homo sapiens
cagcctgagt

SEQ ID NO: 3171457 - DNA, 15 bp, Homo sapiens
cagcctgagtctcct

SEQ ID NO: 3171458 - DNA, 14 bp, Homo sapiens
cagcctgatggcca

SEQ ID NO: 3171459 - DNA, 20 bp, Homo sapiens
cagcctgccctccagctgct

SEQ ID NO: 3171460 - DNA, 20 bp, Homo sapiens
cagcctgcgctcggcaggaa

SEQ ID NO: 3171461 - DNA, 19 bp, Homo sapiens
cagcctgctaattccccag

SEQ ID NO: 3171462 - DNA, 17 bp, Homo sapiens
cagcctggacccccagc

SEQ ID NO: 3171463 - DNA, 17 bp, Homo sapiens
cagcctggagacccacc

SEQ ID NO: 3171464 - DNA, 17 bp, Homo sapiens
cagcctggatctcctca

SEQ ID NO: 3171465 - DNA, 13 bp, Homo sapiens
cagcctggcacag

SEQ ID NO: 3171466 - DNA, 16 bp, Homo sapiens
cagcctggcttctgga

SEQ ID NO: 3171467 - DNA, 16 bp, Homo sapiens
cagcctgggactccca

SEQ ID NO: 3171468 - DNA, 17 bp, Homo sapiens
cagcctgggactcccag

SEQ ID NO: 3171469 - DNA, 19 bp, Homo sapiens
cagcctgggagcccagagg

SEQ ID NO: 3171470 - DNA, 17 bp, Homo sapiens
cagcctgggcagccagg

SEQ ID NO: 3171471 - DNA, 18 bp, Homo sapiens
cagcctgggcagccaggc

SEQ ID NO: 3171472 - DNA, 19 bp, Homo sapiens
cagcctgggcagccaggct

SEQ ID NO: 3171473 - DNA, 20 bp, Homo sapiens
cagcctgggcagccaggctg

SEQ ID NO: 3171474 - DNA, 13 bp, Homo sapiens
cagcctggggcct

SEQ ID NO: 3171475 - DNA, 17 bp, Homo sapiens
cagcctggggctccctc

SEQ ID NO: 3171476 - DNA, 22 bp, Homo sapiens
cagcctggggctccctctctgg

SEQ ID NO: 3171477 - DNA, 23 bp, Homo sapiens
cagcctgggtgacagagcaagac

SEQ ID NO: 3171478 - DNA, 16 bp, Homo sapiens
cagcctgtgctgtggc

SEQ ID NO: 3171479 - DNA, 12 bp, Homo sapiens
cagcctgtggca

SEQ ID NO: 3171480 - DNA, 12 bp, Homo sapiens
cagcctgtggtt

SEQ ID NO: 3171481 - DNA, 20 bp, Homo sapiens
cagcctgtggttacagtgca

SEQ ID NO: 3171482 - DNA, 14 bp, Homo sapiens
cagccttaagctta

SEQ ID NO: 3171483 - DNA, 14 bp, Homo sapiens
cagccttagctgcc

SEQ ID NO: 3171484 - DNA, 17 bp, Homo sapiens
cagccttagctgccagt

SEQ ID NO: 3171485 - DNA, 18 bp, Homo sapiens
cagccttagctgccagtg

SEQ ID NO: 3171486 - DNA, 21 bp, Homo sapiens
cagccttagctgccagtgctg

SEQ ID NO: 3171487 - DNA, 20 bp, Homo sapiens
cagccttccccctcccaggg

SEQ ID NO: 3171488 - DNA, 19 bp, Homo sapiens
cagccttcggacagacata

SEQ ID NO: 3171489 - DNA, 18 bp, Homo sapiens
cagccttcttccatccca

SEQ ID NO: 3171490 - DNA, 23 bp, Homo sapiens
cagccttcttccatcccaggaca

SEQ ID NO: 3171491 - DNA, 16 bp, Homo sapiens
cagcctttccagcctc

SEQ ID NO: 3171492 - DNA, 18 bp, Homo sapiens
cagcctttttgtttcaat

SEQ ID NO: 3171493 - DNA, 18 bp, Homo sapiens
cagcgaagtagcttgctc

SEQ ID NO: 3171494 - DNA, 22 bp, Homo sapiens
cagcgaagtagcttgctccctg

SEQ ID NO: 3171495 - DNA, 21 bp, Homo sapiens
cagcgaagtctcatgggaagc

SEQ ID NO: 3171496 - DNA, 22 bp, Homo sapiens
cagcgaagtctcatgggaagca

SEQ ID NO: 3171497 - DNA, 16 bp, Homo sapiens
cagcgaccgccccctc

SEQ ID NO: 3171498 - DNA, 17 bp, Homo sapiens
cagcgactccgttggcc

SEQ ID NO: 3171499 - DNA, 17 bp, Homo sapiens
cagcgagccctggtggc

SEQ ID NO: 3171500 - DNA, 14 bp, Homo sapiens
cagcgccaagcaac

SEQ ID NO: 3171501 - DNA, 17 bp, Homo sapiens
cagcgccaagcaacctg

SEQ ID NO: 3171502 - DNA, 21 bp, Homo sapiens
cagcgccaagtaaacagggta

SEQ ID NO: 3171503 - DNA, 18 bp, Homo sapiens
cagcgcccctctgcaccc

SEQ ID NO: 3171504 - DNA, 15 bp, Homo sapiens
cagcgcccctgctgt

SEQ ID NO: 3171505 - DNA, 20 bp, Homo sapiens
cagcgcggaggaggagggag

SEQ ID NO: 3171506 - DNA, 12 bp, Homo sapiens
cagcgcggccag

SEQ ID NO: 3171507 - DNA, 20 bp, Homo sapiens
cagcgcggccagcgtcccag

SEQ ID NO: 3171508 - DNA, 21 bp, Homo sapiens
cagcggagtctgtcctgtgac

SEQ ID NO: 3171509 - DNA, 20 bp, Homo sapiens
cagcggcccctgcatcccct

SEQ ID NO: 3171510 - DNA, 16 bp, Homo sapiens
cagcggctccagctca

SEQ ID NO: 3171511 - DNA, 13 bp, Homo sapiens
cagcgggcacagg

SEQ ID NO: 3171512 - DNA, 17 bp, Homo sapiens
caggccccactccttcc

SEQ ID NO: 3171513 - DNA, 23 bp, Homo sapiens
caggccccactccttcctgattg

SEQ ID NO: 3171514 - DNA, 16 bp, Homo sapiens
caggccccctgcatct

SEQ ID NO: 3171515 - DNA, 19 bp, Homo sapiens
caggcccctgaggactgga

SEQ ID NO: 3171516 - DNA, 21 bp, Homo sapiens
caggcccctgttatgcttagg

SEQ ID NO: 3171517 - DNA, 24 bp, Homo sapiens
caggcccgcaccccggcctcaggg

SEQ ID NO: 3171518 - DNA, 15 bp, Homo sapiens
caggccctccagtgg

SEQ ID NO: 3171519 - DNA, 20 bp, Homo sapiens
caggccctccagtgggctga

SEQ ID NO: 3171520 - DNA, 19 bp, Homo sapiens
caggccctccctgactccc

SEQ ID NO: 3171521 - DNA, 14 bp, Homo sapiens
caggccctcctctc

SEQ ID NO: 3171522 - DNA, 17 bp, Homo sapiens
caggccctgcagtgttc

SEQ ID NO: 3171523 - DNA, 23 bp, Homo sapiens
caggccctgccccctcccactct

SEQ ID NO: 3171524 - DNA, 17 bp, Homo sapiens
caggccctgctcctgca

SEQ ID NO: 3171525 - DNA, 22 bp, Homo sapiens
caggccctgctcctgcagcatg

SEQ ID NO: 3171526 - DNA, 10 bp, Homo sapiens
caggccctgg

SEQ ID NO: 3171527 - DNA, 20 bp, Homo sapiens
caggccctggcctcccctgc

SEQ ID NO: 3171528 - DNA, 15 bp, Homo sapiens
caggcccttcctctc

SEQ ID NO: 3171529 - DNA, 20 bp, Homo sapiens
caggcccttcctctccactg

SEQ ID NO: 3171530 - DNA, 23 bp, Homo sapiens
caggcccttcctctccactgcct

SEQ ID NO: 3171531 - DNA, 20 bp, Homo sapiens
caggccctttgaagcctcag

SEQ ID NO: 3171532 - DNA, 14 bp, Homo sapiens
caggccgcagctct

SEQ ID NO: 3171533 - DNA, 18 bp, Homo sapiens
caggccgcagctcttgcc

SEQ ID NO: 3171534 - DNA, 14 bp, Homo sapiens
caggccggaaccac

SEQ ID NO: 3171535 - DNA, 20 bp, Homo sapiens
caggccggaaccacagggcc

SEQ ID NO: 3171536 - DNA, 14 bp, Homo sapiens
caggccggccagcc

SEQ ID NO: 3171537 - DNA, 15 bp, Homo sapiens
caggccggccagcct

SEQ ID NO: 3171538 - DNA, 19 bp, Homo sapiens
caggccggtgtgggctgtg

SEQ ID NO: 3171539 - DNA, 15 bp, Homo sapiens
caggcctaagacatg

SEQ ID NO: 3171540 - DNA, 14 bp, Homo sapiens
caggcctaggaggc

SEQ ID NO: 3171541 - DNA, 21 bp, Homo sapiens
caggcctcacctctacccaaa

SEQ ID NO: 3171542 - DNA, 20 bp, Homo sapiens
caggcctccaacgcccctgt

SEQ ID NO: 3171543 - DNA, 22 bp, Homo sapiens
caggcctccaacgcccctgtgg

SEQ ID NO: 3171544 - DNA, 16 bp, Homo sapiens
caggcctccagcctct

SEQ ID NO: 3171545 - DNA, 20 bp, Homo sapiens
caggcctccagcctctcccg

SEQ ID NO: 3171546 - DNA, 15 bp, Homo sapiens
caggcctccagcggc

SEQ ID NO: 3171547 - DNA, 18 bp, Homo sapiens
caggcctccctctctctt

SEQ ID NO: 3171548 - DNA, 13 bp, Homo sapiens
caggcctctgtgt

SEQ ID NO: 3171549 - DNA, 14 bp, Homo sapiens
caggcctctgtgtc

SEQ ID NO: 3171550 - DNA, 19 bp, Homo sapiens
caggcctcttggcagtcac

SEQ ID NO: 3171551 - DNA, 23 bp, Homo sapiens
caggcctgaaagaggctgaggcc

SEQ ID NO: 3171552 - DNA, 22 bp, Homo sapiens
caggcctgcagcaggagtggtg

SEQ ID NO: 3171553 - DNA, 16 bp, Homo sapiens
caggcctgcctcccac

SEQ ID NO: 3171554 - DNA, 20 bp, Homo sapiens
caggcctgcctgttcccatt

SEQ ID NO: 3171555 - DNA, 16 bp, Homo sapiens
caggcctgggacccag

SEQ ID NO: 3171556 - DNA, 18 bp, Homo sapiens
caggcctgggtctgtgtc

SEQ ID NO: 3171557 - DNA, 12 bp, Homo sapiens
caggcctgtcca

SEQ ID NO: 3171558 - DNA, 16 bp, Homo sapiens
caggcctgtccaccct

SEQ ID NO: 3171559 - DNA, 21 bp, Homo sapiens
caggcctgtccaccctgccaa

SEQ ID NO: 3171560 - DNA, 13 bp, Homo sapiens
caggcctgttgct

SEQ ID NO: 3171561 - DNA, 23 bp, Homo sapiens
caggcctgttgctatagagccta

SEQ ID NO: 3171562 - DNA, 16 bp, Homo sapiens
caggcgaccgggcctc

SEQ ID NO: 3171563 - DNA, 20 bp, Homo sapiens
caggcgatccacctgtctca

SEQ ID NO: 3171564 - DNA, 15 bp, Homo sapiens
caggcgccccttccc

SEQ ID NO: 3171565 - DNA, 17 bp, Homo sapiens
caggcgccccttccccc

SEQ ID NO: 3171566 - DNA, 15 bp, Homo sapiens
caggcgcctgccatc

SEQ ID NO: 3171567 - DNA, 16 bp, Homo sapiens
caggcgcctggcacat

SEQ ID NO: 3171568 - DNA, 23 bp, Homo sapiens
caggcgggagcggtggccctgtc

SEQ ID NO: 3171569 - DNA, 15 bp, Homo sapiens
caggcggggggggcg

SEQ ID NO: 3171570 - DNA, 23 bp, Homo sapiens
caggcggggggggcgcctggaga

SEQ ID NO: 3171571 - DNA, 18 bp, Homo sapiens
caggcggtccccatcccc

SEQ ID NO: 3171572 - DNA, 18 bp, Homo sapiens
caggcgttggtgccactt

SEQ ID NO: 3171573 - DNA, 18 bp, Homo sapiens
caggctatggttgccacc

SEQ ID NO: 3171574 - DNA, 21 bp, Homo sapiens
caggctatggttgccacccca

SEQ ID NO: 3171575 - DNA, 13 bp, Homo sapiens
caggctcactgcc

SEQ ID NO: 3171576 - DNA, 20 bp, Homo sapiens
caggctcactgccaggccag

SEQ ID NO: 3171577 - DNA, 14 bp, Homo sapiens
caggctcctttagc

SEQ ID NO: 3171578 - DNA, 23 bp, Homo sapiens
caggctctgctggtggaaagcga

SEQ ID NO: 3171579 - DNA, 12 bp, Homo sapiens
caggctctgggc

SEQ ID NO: 3171580 - DNA, 14 bp, Homo sapiens
caggctctgggctc

SEQ ID NO: 3171581 - DNA, 17 bp, Homo sapiens
caggctctgggctcagg

SEQ ID NO: 3171582 - DNA, 23 bp, Homo sapiens
caggctctgggctcagggctgga

SEQ ID NO: 3171583 - DNA, 15 bp, Homo sapiens
caggctcttagcagc

SEQ ID NO: 3171584 - DNA, 18 bp, Homo sapiens
caggctcttagcagcttc

SEQ ID NO: 3171585 - DNA, 21 bp, Homo sapiens
caggctcttagcagcttccag

SEQ ID NO: 3171586 - DNA, 14 bp, Homo sapiens
caggctcttcctgg

SEQ ID NO: 3171587 - DNA, 22 bp, Homo sapiens
caggctcttcctggacctgagt

SEQ ID NO: 3171588 - DNA, 17 bp, Homo sapiens
caggctgaagagaggga

SEQ ID NO: 3171589 - DNA, 14 bp, Homo sapiens
caggctgacatctg

SEQ ID NO: 3171590 - DNA, 17 bp, Homo sapiens
caggctgcactgcagtg

SEQ ID NO: 3171591 - DNA, 15 bp, Homo sapiens
caggctgcagaggca

SEQ ID NO: 3171592 - DNA, 21 bp, Homo sapiens
caggctgccaaggccagagtg

SEQ ID NO: 3171593 - DNA, 22 bp, Homo sapiens
caggctgccaaggccagagtgg

SEQ ID NO: 3171594 - DNA, 21 bp, Homo sapiens
caggctgcccccaacactcca

SEQ ID NO: 3171595 - DNA, 21 bp, Homo sapiens
caggctgctggggcctcagac

SEQ ID NO: 3171596 - DNA, 23 bp, Homo sapiens
caggctgctggggcctcagacga

SEQ ID NO: 3171597 - DNA, 12 bp, Homo sapiens
caggctgcttgg

SEQ ID NO: 3171598 - DNA, 15 bp, Homo sapiens
caggctggcagttgg

SEQ ID NO: 3171599 - DNA, 14 bp, Homo sapiens
caggctggccagtc

SEQ ID NO: 3171600 - DNA, 21 bp, Homo sapiens
caggctggccagtccaggctg

SEQ ID NO: 3171601 - DNA, 16 bp, Homo sapiens
caggctggcgcagcca

SEQ ID NO: 3171602 - DNA, 18 bp, Homo sapiens
caggctggcgtgcagtgg

SEQ ID NO: 3171603 - DNA, 16 bp, Homo sapiens
caggctggcttgcccg

SEQ ID NO: 3171604 - DNA, 18 bp, Homo sapiens
caggctgggaactcatct

SEQ ID NO: 3171605 - DNA, 14 bp, Homo sapiens
caggctgggcagcc

SEQ ID NO: 3171606 - DNA, 18 bp, Homo sapiens
caggctgggcagccccag

SEQ ID NO: 3171607 - DNA, 15 bp, Homo sapiens
caggctgggcttcag

SEQ ID NO: 3171608 - DNA, 19 bp, Homo sapiens
caggctgggcttcagtggc

SEQ ID NO: 3171609 - DNA, 22 bp, Homo sapiens
caggctgggcttcagtggcagc

SEQ ID NO: 3171610 - DNA, 12 bp, Homo sapiens
caggctggtctc

SEQ ID NO: 3171611 - DNA, 19 bp, Homo sapiens
caggctggtctcaaactct

SEQ ID NO: 3171612 - DNA, 15 bp, Homo sapiens
caggctggtgggagg

SEQ ID NO: 3171613 - DNA, 19 bp, Homo sapiens
caggctgtaaattgaactt

SEQ ID NO: 3171614 - DNA, 14 bp, Homo sapiens
caggctgtatccca

SEQ ID NO: 3171615 - DNA, 16 bp, Homo sapiens
caggctgtgggcctca

SEQ ID NO: 3171616 - DNA, 17 bp, Homo sapiens
caggctgtgggcctcaa

SEQ ID NO: 3171617 - DNA, 21 bp, Homo sapiens
caggctgttctgcactgaaaa

SEQ ID NO: 3171618 - DNA, 19 bp, Homo sapiens
caggcttctgtcaatttca

SEQ ID NO: 3171619 - DNA, 18 bp, Homo sapiens
cagggaaaataggcagga

SEQ ID NO: 3171620 - DNA, 16 bp, Homo sapiens
cagggaaagctccacg

SEQ ID NO: 3171621 - DNA, 18 bp, Homo sapiens
cagggaacattggagctg

SEQ ID NO: 3171622 - DNA, 19 bp, Homo sapiens
cagggaacattggagctga

SEQ ID NO: 3171623 - DNA, 20 bp, Homo sapiens
cagggaacattggagctgac

SEQ ID NO: 3171624 - DNA, 16 bp, Homo sapiens
cagggaagagaaagtg

SEQ ID NO: 3171625 - DNA, 15 bp, Homo sapiens
cagggaagagcagaa

SEQ ID NO: 3171626 - DNA, 17 bp, Homo sapiens
cagggaagagggcagta

SEQ ID NO: 3171627 - DNA, 14 bp, Homo sapiens
cagggaaggacagg

SEQ ID NO: 3171628 - DNA, 17 bp, Homo sapiens
cagggaaggacaggacc

SEQ ID NO: 3171629 - DNA, 22 bp, Homo sapiens
cagggaaggtggggccctgccc

SEQ ID NO: 3171630 - DNA, 17 bp, Homo sapiens
cagggaatcagggacca

SEQ ID NO: 3171631 - DNA, 21 bp, Homo sapiens
cagggaatcagggaccagctt

SEQ ID NO: 3171632 - DNA, 17 bp, Homo sapiens
cagggaatccagctccc

SEQ ID NO: 3171633 - DNA, 23 bp, Homo sapiens
cagggaatttcaggaactagaga

SEQ ID NO: 3171634 - DNA, 13 bp, Homo sapiens
cagggacagagcc

SEQ ID NO: 3171635 - DNA, 16 bp, Homo sapiens
cagggacagagccatg

SEQ ID NO: 3171636 - DNA, 18 bp, Homo sapiens
cagggaccactgggtgag

SEQ ID NO: 3171637 - DNA, 19 bp, Homo sapiens
caggtggccagcctggatc

SEQ ID NO: 3171638 - DNA, 16 bp, Homo sapiens
caggtgggccctctga

SEQ ID NO: 3171639 - DNA, 23 bp, Homo sapiens
caggtgggcgtggtcactgctgt

SEQ ID NO: 3171640 - DNA, 12 bp, Homo sapiens
caggtgggctgg

SEQ ID NO: 3171641 - DNA, 15 bp, Homo sapiens
caggtggggcagctt

SEQ ID NO: 3171642 - DNA, 16 bp, Homo sapiens
caggtggggcagcttg

SEQ ID NO: 3171643 - DNA, 17 bp, Homo sapiens
caggtgggggttgctgt

SEQ ID NO: 3171644 - DNA, 19 bp, Homo sapiens
caggtgggtgctgccctgt

SEQ ID NO: 3171645 - DNA, 15 bp, Homo sapiens
caggtggtggcactg

SEQ ID NO: 3171646 - DNA, 16 bp, Homo sapiens
caggtgtccctgcact

SEQ ID NO: 3171647 - DNA, 13 bp, Homo sapiens
caggtgtcctttc

SEQ ID NO: 3171648 - DNA, 17 bp, Homo sapiens
caggtgtcctttcccct

SEQ ID NO: 3171649 - DNA, 21 bp, Homo sapiens
caggtgtcctttcccctctct

SEQ ID NO: 3171650 - DNA, 21 bp, Homo sapiens
caggtgtgagtcaccaagccc

SEQ ID NO: 3171651 - DNA, 13 bp, Homo sapiens
caggtgtgcacgt

SEQ ID NO: 3171652 - DNA, 17 bp, Homo sapiens
caggtgtgcctggaaga

SEQ ID NO: 3171653 - DNA, 20 bp, Homo sapiens
caggtgttaacattccaaga

SEQ ID NO: 3171654 - DNA, 20 bp, Homo sapiens
caggtgttctacactcatct

SEQ ID NO: 3171655 - DNA, 14 bp, Homo sapiens
caggtgttgccaaa

SEQ ID NO: 3171656 - DNA, 20 bp, Homo sapiens
caggttatcgaaataacaat

SEQ ID NO: 3171657 - DNA, 23 bp, Homo sapiens
caggttatcgaaataacaatgtt

SEQ ID NO: 3171658 - DNA, 17 bp, Homo sapiens
caggttcacactcagaa

SEQ ID NO: 3171659 - DNA, 20 bp, Homo sapiens
caggttccccaagggccctg

SEQ ID NO: 3171660 - DNA, 22 bp, Homo sapiens
caggttccccaagggccctggc

SEQ ID NO: 3171661 - DNA, 18 bp, Homo sapiens
caggttcccccagcaagc

SEQ ID NO: 3171662 - DNA, 18 bp, Homo sapiens
caggttccctcccagagg

SEQ ID NO: 3171663 - DNA, 17 bp, Homo sapiens
caggttcctatggctgg

SEQ ID NO: 3171664 - DNA, 15 bp, Homo sapiens
caggttctattttct

SEQ ID NO: 3171665 - DNA, 22 bp, Homo sapiens
caggttctattttcttaaacca

SEQ ID NO: 3171666 - DNA, 20 bp, Homo sapiens
caggttctccgttagctcct

SEQ ID NO: 3171667 - DNA, 24 bp, Homo sapiens
caggttctccgttagctcctgtgg

SEQ ID NO: 3171668 - DNA, 21 bp, Homo sapiens
caggttgctggttgctgtgtg

SEQ ID NO: 3171669 - DNA, 23 bp, Homo sapiens
caggttggaaggggccttgctga

SEQ ID NO: 3171670 - DNA, 23 bp, Homo sapiens
caggttgtctgaagtcactgcac

SEQ ID NO: 3171671 - DNA, 15 bp, Homo sapiens
caggtttaacatttg

SEQ ID NO: 3171672 - DNA, 16 bp, Homo sapiens
caggtttaacatttgc

SEQ ID NO: 3171673 - DNA, 17 bp, Homo sapiens
caggtttaacatttgcc

SEQ ID NO: 3171674 - DNA, 23 bp, Homo sapiens
caggtttggggagggggaagaga

SEQ ID NO: 3171675 - DNA, 14 bp, Homo sapiens
caggtttgttacat

SEQ ID NO: 3171676 - DNA, 18 bp, Homo sapiens
cagtaaaagccttattct

SEQ ID NO: 3171677 - DNA, 23 bp, Homo sapiens
cagtaaaagccttattctaaggt

SEQ ID NO: 3171678 - DNA, 21 bp, Homo sapiens
cagtaaacgggaacatgcccc

SEQ ID NO: 3171679 - DNA, 23 bp, Homo sapiens
cagtaaacgggaacatgccccct

SEQ ID NO: 3171680 - DNA, 17 bp, Homo sapiens
cagtaaagagaaacttt

SEQ ID NO: 3171681 - DNA, 18 bp, Homo sapiens
cagtaacccccttaaatt

SEQ ID NO: 3171682 - DNA, 20 bp, Homo sapiens
cagtaacccccttaaattta

SEQ ID NO: 3171683 - DNA, 18 bp, Homo sapiens
cagtaacgcgtcttcctg

SEQ ID NO: 3171684 - DNA, 20 bp, Homo sapiens
cagtaacgcgtcttcctgag

SEQ ID NO: 3171685 - DNA, 20 bp, Homo sapiens
cagtaacttatgtacaagga

SEQ ID NO: 3171686 - DNA, 17 bp, Homo sapiens
cagtaactttatgtgta

SEQ ID NO: 3171687 - DNA, 18 bp, Homo sapiens
cagtaactttatgtgtaa

SEQ ID NO: 3171688 - DNA, 19 bp, Homo sapiens
cagtaactttatgtgtaaa

SEQ ID NO: 3171689 - DNA, 16 bp, Homo sapiens
cagtaacttttttgtg

SEQ ID NO: 3171690 - DNA, 18 bp, Homo sapiens
cagtaacttttttgtgta

SEQ ID NO: 3171691 - DNA, 19 bp, Homo sapiens
cagtaacttttttgtgtat

SEQ ID NO: 3171692 - DNA, 20 bp, Homo sapiens
cagtaagatatctcaatgaa

SEQ ID NO: 3171693 - DNA, 19 bp, Homo sapiens
cagtaagctgctctattgt

SEQ ID NO: 3171694 - DNA, 13 bp, Homo sapiens
cagtaataaaaca

SEQ ID NO: 3171695 - DNA, 12 bp, Homo sapiens
cagtaataactc

SEQ ID NO: 3171696 - DNA, 13 bp, Homo sapiens
cagtaatatttat

SEQ ID NO: 3171697 - DNA, 14 bp, Homo sapiens
cagtaatctttata

SEQ ID NO: 3171698 - DNA, 22 bp, Homo sapiens
cagtacacatccccagaatcca

SEQ ID NO: 3171699 - DNA, 17 bp, Homo sapiens
cagtacatttaaatttt

SEQ ID NO: 3171700 - DNA, 22 bp, Homo sapiens
cagtacatttaaattttttggc

SEQ ID NO: 3171701 - DNA, 15 bp, Homo sapiens
cagtaccataatctt

SEQ ID NO: 3171702 - DNA, 23 bp, Homo sapiens
cagtaccccatggagctgggcta

SEQ ID NO: 3171703 - DNA, 14 bp, Homo sapiens
cagtaccctctcag

SEQ ID NO: 3171704 - DNA, 13 bp, Homo sapiens
cagtacctccaag

SEQ ID NO: 3171705 - DNA, 14 bp, Homo sapiens
cagtacctgggaaa

SEQ ID NO: 3171706 - DNA, 22 bp, Homo sapiens
cagtacctgggaaaggacccac

SEQ ID NO: 3171707 - DNA, 13 bp, Homo sapiens
cagtaccttgctt

SEQ ID NO: 3171708 - DNA, 15 bp, Homo sapiens
cagtacctttgtcac

SEQ ID NO: 3171709 - DNA, 14 bp, Homo sapiens
cagtactcaaattc

SEQ ID NO: 3171710 - DNA, 23 bp, Homo sapiens
cagtacttgtgaaacacagctgt

SEQ ID NO: 3171711 - DNA, 16 bp, Homo sapiens
cagtactttattgtac

SEQ ID NO: 3171712 - DNA, 18 bp, Homo sapiens
cagtactttgtgcattct

SEQ ID NO: 3171713 - DNA, 23 bp, Homo sapiens
cagtacttttttaaatattttct

SEQ ID NO: 3171714 - DNA, 22 bp, Homo sapiens
cagtagaactccaggccctcct

SEQ ID NO: 3171715 - DNA, 14 bp, Homo sapiens
cagtagaactgtct

SEQ ID NO: 3171716 - DNA, 15 bp, Homo sapiens
cagtagaactgtctg

SEQ ID NO: 3171717 - DNA, 12 bp, Homo sapiens
cagtagagccag

SEQ ID NO: 3171718 - DNA, 17 bp, Homo sapiens
cagtagatgtgcttctg

SEQ ID NO: 3171719 - DNA, 16 bp, Homo sapiens
cagtagattgcagaaa

SEQ ID NO: 3171720 - DNA, 18 bp, Homo sapiens
cagtagattttccaaatg

SEQ ID NO: 3171721 - DNA, 20 bp, Homo sapiens
cagtagctgtggcctcaccc

SEQ ID NO: 3171722 - DNA, 23 bp, Homo sapiens
cagtagctgtggcctcaccctga

SEQ ID NO: 3171723 - DNA, 16 bp, Homo sapiens
cagtaggtccaagggc

SEQ ID NO: 3171724 - DNA, 17 bp, Homo sapiens
cagtaggtccaagggcc

SEQ ID NO: 3171725 - DNA, 15 bp, Homo sapiens
cagtaggttggcagt

SEQ ID NO: 3171726 - DNA, 22 bp, Homo sapiens
cagtagtagcctccaggtttcc

SEQ ID NO: 3171727 - DNA, 23 bp, Homo sapiens
cagtagtcttgatgaccaaagtc

SEQ ID NO: 3171728 - DNA, 14 bp, Homo sapiens
cagtataaacaaag

SEQ ID NO: 3171729 - DNA, 18 bp, Homo sapiens
cagtatacctcatttttc

SEQ ID NO: 3171730 - DNA, 13 bp, Homo sapiens
cagtatactgtgt

SEQ ID NO: 3171731 - DNA, 16 bp, Homo sapiens
cagtatattagtatta

SEQ ID NO: 3171732 - DNA, 16 bp, Homo sapiens
cagtatatttaaactc

SEQ ID NO: 3171733 - DNA, 14 bp, Homo sapiens
cagtatatttggtt

SEQ ID NO: 3171734 - DNA, 16 bp, Homo sapiens
cagtatccactttgca

SEQ ID NO: 3171735 - DNA, 13 bp, Homo sapiens
cagtatcccacat

SEQ ID NO: 3171736 - DNA, 15 bp, Homo sapiens
cagtatcccacatcc

SEQ ID NO: 3171737 - DNA, 16 bp, Homo sapiens
cagtatctatatatgt

SEQ ID NO: 3171738 - DNA, 21 bp, Homo sapiens
cagtatctatatatgtgtatg

SEQ ID NO: 3171739 - DNA, 22 bp, Homo sapiens
cagtatctatatatgtgtatgt

SEQ ID NO: 3171740 - DNA, 14 bp, Homo sapiens
cagtatggccagac

SEQ ID NO: 3171741 - DNA, 15 bp, Homo sapiens
cagtatgtattcttt

SEQ ID NO: 3171742 - DNA, 15 bp, Homo sapiens
cagtatgtgggatat

SEQ ID NO: 3171743 - DNA, 14 bp, Homo sapiens
cagtattaaggttt

SEQ ID NO: 3171744 - DNA, 20 bp, Homo sapiens
cagtattaatactaaaatat

SEQ ID NO: 3171745 - DNA, 16 bp, Homo sapiens
cagtattacttctgct

SEQ ID NO: 3171746 - DNA, 19 bp, Homo sapiens
cagtattcttgtcaaaaaa

SEQ ID NO: 3171747 - DNA, 22 bp, Homo sapiens
cagtattgaaaacttcaaagct

SEQ ID NO: 3171748 - DNA, 23 bp, Homo sapiens
cagtattgctgattttaaaggca

SEQ ID NO: 3171749 - DNA, 15 bp, Homo sapiens
cagtatttaatgaaa

SEQ ID NO: 3171750 - DNA, 15 bp, Homo sapiens
cagtatttcaactgc

SEQ ID NO: 3171751 - DNA, 16 bp, Homo sapiens
cagtatttcaactgct

SEQ ID NO: 3171752 - DNA, 17 bp, Homo sapiens
cagtatttcaactgctg

SEQ ID NO: 3171753 - DNA, 19 bp, Homo sapiens
cagtatttcaactgctgta

SEQ ID NO: 3171754 - DNA, 23 bp, Homo sapiens
cagtatttcaactgctgtaaaat

SEQ ID NO: 3171755 - DNA, 15 bp, Homo sapiens
cagtatttcattgcc

SEQ ID NO: 3171756 - DNA, 17 bp, Homo sapiens
cagtattttggagaaat

SEQ ID NO: 3171757 - DNA, 14 bp, Homo sapiens
cagtatttttaaag

SEQ ID NO: 3171758 - DNA, 17 bp, Homo sapiens
cagtatttttaaaggca

SEQ ID NO: 3171759 - DNA, 18 bp, Homo sapiens
cagtatttttttttaatt

SEQ ID NO: 3171760 - DNA, 15 bp, Homo sapiens
cagtcaaaacagaga

SEQ ID NO: 3171761 - DNA, 13 bp, Homo sapiens
cagtcaagaagaa

SEQ ID NO: 3171762 - DNA, 23 bp, Homo sapiens
cataaggggtttgccatttgata

SEQ ID NO: 3171763 - DNA, 17 bp, Homo sapiens
cataagtaattcaagaa

SEQ ID NO: 3171764 - DNA, 18 bp, Homo sapiens
cataagtgctattgcaga

SEQ ID NO: 3171765 - DNA, 17 bp, Homo sapiens
cataagtttgtttaaac

SEQ ID NO: 3171766 - DNA, 18 bp, Homo sapiens
cataataaaaggctttga

SEQ ID NO: 3171767 - DNA, 18 bp, Homo sapiens
cataataaatatctgtac

SEQ ID NO: 3171768 - DNA, 17 bp, Homo sapiens
cataatagttagccctc

SEQ ID NO: 3171769 - DNA, 22 bp, Homo sapiens
cataatcagtatatttggtttc

SEQ ID NO: 3171770 - DNA, 21 bp, Homo sapiens
cataatctagtttacagaaaa

SEQ ID NO: 3171771 - DNA, 19 bp, Homo sapiens
cataatcttagagacaaac

SEQ ID NO: 3171772 - DNA, 13 bp, Homo sapiens
cataatcttctgc

SEQ ID NO: 3171773 - DNA, 15 bp, Homo sapiens
cataatcttctgcct

SEQ ID NO: 3171774 - DNA, 11 bp, Homo sapiens
cataatgcaat

SEQ ID NO: 3171775 - DNA, 12 bp, Homo sapiens
cataatgcaatc

SEQ ID NO: 3171776 - DNA, 16 bp, Homo sapiens
cataatgcaatcaaaa

SEQ ID NO: 3171777 - DNA, 21 bp, Homo sapiens
cataatgcattcttctctgtt

SEQ ID NO: 3171778 - DNA, 21 bp, Homo sapiens
cataatgctaatttaaagaga

SEQ ID NO: 3171779 - DNA, 18 bp, Homo sapiens
cataatgcttaatttcta

SEQ ID NO: 3171780 - DNA, 16 bp, Homo sapiens
cataatgctttggaaa

SEQ ID NO: 3171781 - DNA, 20 bp, Homo sapiens
cataatgctttggaaaaatg

SEQ ID NO: 3171782 - DNA, 23 bp, Homo sapiens
cataatgctttggaaaaatgggt

SEQ ID NO: 3171783 - DNA, 14 bp, Homo sapiens
cataatgctttgtt

SEQ ID NO: 3171784 - DNA, 17 bp, Homo sapiens
cataatggggattaatt

SEQ ID NO: 3171785 - DNA, 18 bp, Homo sapiens
cataatggggattaatta

SEQ ID NO: 3171786 - DNA, 17 bp, Homo sapiens
cataatgttacattatt

SEQ ID NO: 3171787 - DNA, 22 bp, Homo sapiens
cataatgtttctggatttcata

SEQ ID NO: 3171788 - DNA, 23 bp, Homo sapiens
cataatgtttctggatttcatac

SEQ ID NO: 3171789 - DNA, 16 bp, Homo sapiens
cataattacattccta

SEQ ID NO: 3171790 - DNA, 21 bp, Homo sapiens
cataattacattcctaactag

SEQ ID NO: 3171791 - DNA, 22 bp, Homo sapiens
cataattctaagttatttactt

SEQ ID NO: 3171792 - DNA, 17 bp, Homo sapiens
cataattcttgtatatt

SEQ ID NO: 3171793 - DNA, 14 bp, Homo sapiens
cataattgctttgc

SEQ ID NO: 3171794 - DNA, 19 bp, Homo sapiens
cataatttagttgtttcta

SEQ ID NO: 3171795 - DNA, 14 bp, Homo sapiens
cataatttgtttcc

SEQ ID NO: 3171796 - DNA, 14 bp, Homo sapiens
cataattttgcata

SEQ ID NO: 3171797 - DNA, 17 bp, Homo sapiens
cataattttgtgttgta

SEQ ID NO: 3171798 - DNA, 18 bp, Homo sapiens
cataattttgtgttgtac

SEQ ID NO: 3171799 - DNA, 19 bp, Homo sapiens
cataattttttttaaagaa

SEQ ID NO: 3171800 - DNA, 21 bp, Homo sapiens
cataattttttttaaagaaga

SEQ ID NO: 3171801 - DNA, 18 bp, Homo sapiens
catacacaactgttcccg

SEQ ID NO: 3171802 - DNA, 19 bp, Homo sapiens
catacacacatgccctcct

SEQ ID NO: 3171803 - DNA, 22 bp, Homo sapiens
catacacccccacctcctgcaa

SEQ ID NO: 3171804 - DNA, 20 bp, Homo sapiens
catacaccttgctaacctaa

SEQ ID NO: 3171805 - DNA, 22 bp, Homo sapiens
catacagagtgggccccgggct

SEQ ID NO: 3171806 - DNA, 23 bp, Homo sapiens
catacaggaaggtagaaatatct

SEQ ID NO: 3171807 - DNA, 13 bp, Homo sapiens
catacagttttat

SEQ ID NO: 3171808 - DNA, 23 bp, Homo sapiens
catacataatgtttttcctttct

SEQ ID NO: 3171809 - DNA, 23 bp, Homo sapiens
catacatatgtagaaacatttag

SEQ ID NO: 3171810 - DNA, 12 bp, Homo sapiens
catacattaaaa

SEQ ID NO: 3171811 - DNA, 21 bp, Homo sapiens
catacatttataatgtttgct

SEQ ID NO: 3171812 - DNA, 22 bp, Homo sapiens
cataccactttgacacgcttca

SEQ ID NO: 3171813 - DNA, 23 bp, Homo sapiens
cataccagctcgcacccccctgt

SEQ ID NO: 3171814 - DNA, 13 bp, Homo sapiens
catacctgtctca

SEQ ID NO: 3171815 - DNA, 14 bp, Homo sapiens
catacgtgcacagg

SEQ ID NO: 3171816 - DNA, 20 bp, Homo sapiens
catactactgaaacagattt

SEQ ID NO: 3171817 - DNA, 14 bp, Homo sapiens
catactcagcctgc

SEQ ID NO: 3171818 - DNA, 14 bp, Homo sapiens
catactctcctttt

SEQ ID NO: 3171819 - DNA, 13 bp, Homo sapiens
catactctctgcc

SEQ ID NO: 3171820 - DNA, 11 bp, Homo sapiens
catactctgct

SEQ ID NO: 3171821 - DNA, 17 bp, Homo sapiens
catactgaaaaaaaaag

SEQ ID NO: 3171822 - DNA, 16 bp, Homo sapiens
catactgaaaatccaa

SEQ ID NO: 3171823 - DNA, 17 bp, Homo sapiens
catactgaaaatccaat

SEQ ID NO: 3171824 - DNA, 13 bp, Homo sapiens
catactggcctgg

SEQ ID NO: 3171825 - DNA, 17 bp, Homo sapiens
catactgtaacattcag

SEQ ID NO: 3171826 - DNA, 12 bp, Homo sapiens
catactttctct

SEQ ID NO: 3171827 - DNA, 16 bp, Homo sapiens
catactttgtattttg

SEQ ID NO: 3171828 - DNA, 18 bp, Homo sapiens
catactttgtattttgat

SEQ ID NO: 3171829 - DNA, 18 bp, Homo sapiens
catactttgtctgaaaaa

SEQ ID NO: 3171830 - DNA, 12 bp, Homo sapiens
catacttttgca

SEQ ID NO: 3171831 - DNA, 22 bp, Homo sapiens
catacttttgcaaaataagtaa

SEQ ID NO: 3171832 - DNA, 15 bp, Homo sapiens
catacttttggctcc

SEQ ID NO: 3171833 - DNA, 20 bp, Homo sapiens
catactttttaaatgtaaag

SEQ ID NO: 3171834 - DNA, 17 bp, Homo sapiens
catagaaacatgacact

SEQ ID NO: 3171835 - DNA, 19 bp, Homo sapiens
catagaaacatgacactga

SEQ ID NO: 3171836 - DNA, 18 bp, Homo sapiens
catagaaaccactagaaa

SEQ ID NO: 3171837 - DNA, 23 bp, Homo sapiens
catagaaatgtaacttttgtaag

SEQ ID NO: 3171838 - DNA, 19 bp, Homo sapiens
catagaactgggtaaatgc

SEQ ID NO: 3171839 - DNA, 13 bp, Homo sapiens
catagacatgaaa

SEQ ID NO: 3171840 - DNA, 16 bp, Homo sapiens
catagacatgaaaggt

SEQ ID NO: 3171841 - DNA, 17 bp, Homo sapiens
catagactagagaaacc

SEQ ID NO: 3171842 - DNA, 22 bp, Homo sapiens
catagactgaggtataaagaca

SEQ ID NO: 3171843 - DNA, 17 bp, Homo sapiens
catagagatttgtctaa

SEQ ID NO: 3171844 - DNA, 14 bp, Homo sapiens
catagagccctggc

SEQ ID NO: 3171845 - DNA, 16 bp, Homo sapiens
catagagccctggcca

SEQ ID NO: 3171846 - DNA, 17 bp, Homo sapiens
catagagccctggccag

SEQ ID NO: 3171847 - DNA, 15 bp, Homo sapiens
catagaggcttctcc

SEQ ID NO: 3171848 - DNA, 23 bp, Homo sapiens
catagaggcttctccgccagcct

SEQ ID NO: 3171849 - DNA, 14 bp, Homo sapiens
catagagtttaaca

SEQ ID NO: 3171850 - DNA, 24 bp, Homo sapiens
catagataatattgtttggtaaat

SEQ ID NO: 3171851 - DNA, 13 bp, Homo sapiens
catagatcttctg

SEQ ID NO: 3171852 - DNA, 15 bp, Homo sapiens
catagatcttctgaa

SEQ ID NO: 3171853 - DNA, 23 bp, Homo sapiens
catagatgtccctttcttggcca

SEQ ID NO: 3171854 - DNA, 21 bp, Homo sapiens
catagatttatttttcagttc

SEQ ID NO: 3171855 - DNA, 23 bp, Homo sapiens
catagatttatttttcagttcca

SEQ ID NO: 3171856 - DNA, 16 bp, Homo sapiens
catagcaacaggaaaa

SEQ ID NO: 3171857 - DNA, 23 bp, Homo sapiens
catagcagagaatgaaagggccc

SEQ ID NO: 3171858 - DNA, 17 bp, Homo sapiens
catagcagaggggccag

SEQ ID NO: 3171859 - DNA, 20 bp, Homo sapiens
catagcagaggggccaggcc

SEQ ID NO: 3171860 - DNA, 14 bp, Homo sapiens
catagcagatctgt

SEQ ID NO: 3171861 - DNA, 17 bp, Homo sapiens
catagcagatctgtttt

SEQ ID NO: 3171862 - DNA, 23 bp, Homo sapiens
catagcattaactaatctattgg

SEQ ID NO: 3171863 - DNA, 13 bp, Homo sapiens
catagcccatccc

SEQ ID NO: 3171864 - DNA, 14 bp, Homo sapiens
catagcccttacct

SEQ ID NO: 3171865 - DNA, 17 bp, Homo sapiens
catagcctccacggaga

SEQ ID NO: 3171866 - DNA, 21 bp, Homo sapiens
catagcctccacggagagccc

SEQ ID NO: 3171867 - DNA, 22 bp, Homo sapiens
catagcgccgtgctgtaaataa

SEQ ID NO: 3171868 - DNA, 18 bp, Homo sapiens
catagcgggggcctaaaa

SEQ ID NO: 3171869 - DNA, 15 bp, Homo sapiens
catagctacatcagt

SEQ ID NO: 3171870 - DNA, 17 bp, Homo sapiens
catagctacatcagttt

SEQ ID NO: 3171871 - DNA, 20 bp, Homo sapiens
catagctccttggagcaggc

SEQ ID NO: 3171872 - DNA, 13 bp, Homo sapiens
catagctctcctt

SEQ ID NO: 3171873 - DNA, 13 bp, Homo sapiens
catagctctgggg

SEQ ID NO: 3171874 - DNA, 12 bp, Homo sapiens
cataggaaaagt

SEQ ID NO: 3171875 - DNA, 18 bp, Homo sapiens
cataggaaaagtacattt

SEQ ID NO: 3171876 - DNA, 22 bp, Homo sapiens
cataggaaaagtacatttaata

SEQ ID NO: 3171877 - DNA, 17 bp, Homo sapiens
cataggacatactgcat

SEQ ID NO: 3171878 - DNA, 16 bp, Homo sapiens
cataggacctttccac

SEQ ID NO: 3171879 - DNA, 14 bp, Homo sapiens
cataggagggaagg

SEQ ID NO: 3171880 - DNA, 18 bp, Homo sapiens
cataggcctgggtgctgg

SEQ ID NO: 3171881 - DNA, 19 bp, Homo sapiens
cataggctcttaagcagca

SEQ ID NO: 3171882 - DNA, 14 bp, Homo sapiens
cataggtcactggc

SEQ ID NO: 3171883 - DNA, 16 bp, Homo sapiens
cataggtcactggctc

SEQ ID NO: 3171884 - DNA, 15 bp, Homo sapiens
cataggttaaaaaaa

SEQ ID NO: 3171885 - DNA, 21 bp, Homo sapiens
catagtaacttcttatggaat

SEQ ID NO: 3171886 - DNA, 23 bp, Homo sapiens
catagtaacttcttatggaattg

SEQ ID NO: 3171887 - DNA, 15 bp, Homo sapiens
catctgtggagctgc

SEQ ID NO: 3171888 - DNA, 19 bp, Homo sapiens
catctgtggagctgccaca

SEQ ID NO: 3171889 - DNA, 15 bp, Homo sapiens
catctgtgtgaaaat

SEQ ID NO: 3171890 - DNA, 17 bp, Homo sapiens
catctgtgtttcaagtg

SEQ ID NO: 3171891 - DNA, 17 bp, Homo sapiens
catcttagacctccaca

SEQ ID NO: 3171892 - DNA, 18 bp, Homo sapiens
catcttatagcactttga

SEQ ID NO: 3171893 - DNA, 21 bp, Homo sapiens
catcttatagcactttgaaat

SEQ ID NO: 3171894 - DNA, 22 bp, Homo sapiens
catcttcaatttattactgaaa

SEQ ID NO: 3171895 - DNA, 15 bp, Homo sapiens
catcttcactgcaat

SEQ ID NO: 3171896 - DNA, 15 bp, Homo sapiens
catcttcactggctt

SEQ ID NO: 3171897 - DNA, 13 bp, Homo sapiens
catcttccacctg

SEQ ID NO: 3171898 - DNA, 14 bp, Homo sapiens
catcttccacctgt

SEQ ID NO: 3171899 - DNA, 17 bp, Homo sapiens
catcttcctgctgctgt

SEQ ID NO: 3171900 - DNA, 18 bp, Homo sapiens
catcttcctgctgctgta

SEQ ID NO: 3171901 - DNA, 12 bp, Homo sapiens
catcttctggaa

SEQ ID NO: 3171902 - DNA, 12 bp, Homo sapiens
catcttctggct

SEQ ID NO: 3171903 - DNA, 13 bp, Homo sapiens
catcttctggctt

SEQ ID NO: 3171904 - DNA, 19 bp, Homo sapiens
catcttgctaataaacact

SEQ ID NO: 3171905 - DNA, 12 bp, Homo sapiens
catcttgctacc

SEQ ID NO: 3171906 - DNA, 17 bp, Homo sapiens
catcttgctaccagtat

SEQ ID NO: 3171907 - DNA, 22 bp, Homo sapiens
catcttgctaccagtatttaga

SEQ ID NO: 3171908 - DNA, 14 bp, Homo sapiens
catcttgctctgct

SEQ ID NO: 3171909 - DNA, 20 bp, Homo sapiens
catcttgctctgctgacaga

SEQ ID NO: 3171910 - DNA, 16 bp, Homo sapiens
catcttggagggacca

SEQ ID NO: 3171911 - DNA, 23 bp, Homo sapiens
catcttggttatttctgaaggta

SEQ ID NO: 3171912 - DNA, 19 bp, Homo sapiens
catctttaaacagtatttc

SEQ ID NO: 3171913 - DNA, 17 bp, Homo sapiens
catctttatctgttctt

SEQ ID NO: 3171914 - DNA, 23 bp, Homo sapiens
catctttgccttgggctgctcct

SEQ ID NO: 3171915 - DNA, 11 bp, Homo sapiens
catctttgggg

SEQ ID NO: 3171916 - DNA, 18 bp, Homo sapiens
catctttggggaggtgtt

SEQ ID NO: 3171917 - DNA, 13 bp, Homo sapiens
catcttttacatt

SEQ ID NO: 3171918 - DNA, 14 bp, Homo sapiens
catcttttgtgaga

SEQ ID NO: 3171919 - DNA, 21 bp, Homo sapiens
catgaaaaatcatgggccaga

SEQ ID NO: 3171920 - DNA, 17 bp, Homo sapiens
catgaaaacgttttatt

SEQ ID NO: 3171921 - DNA, 21 bp, Homo sapiens
catgaaaacgttttattgtgt

SEQ ID NO: 3171922 - DNA, 22 bp, Homo sapiens
catgaaaagttatttatgctat

SEQ ID NO: 3171923 - DNA, 13 bp, Homo sapiens
catgaaaatttta

SEQ ID NO: 3171924 - DNA, 18 bp, Homo sapiens
catgaacacccttagaaa

SEQ ID NO: 3171925 - DNA, 12 bp, Homo sapiens
catgaacagctc

SEQ ID NO: 3171926 - DNA, 13 bp, Homo sapiens
catgaacagctct

SEQ ID NO: 3171927 - DNA, 14 bp, Homo sapiens
catgaacagctctg

SEQ ID NO: 3171928 - DNA, 16 bp, Homo sapiens
catgaaccaaatggtt

SEQ ID NO: 3171929 - DNA, 23 bp, Homo sapiens
catgaaccaaatggttcttactt

SEQ ID NO: 3171930 - DNA, 19 bp, Homo sapiens
catgaagaatgcattcaaa

SEQ ID NO: 3171931 - DNA, 14 bp, Homo sapiens
catgaagacaggac

SEQ ID NO: 3171932 - DNA, 15 bp, Homo sapiens
catgaagacaggaca

SEQ ID NO: 3171933 - DNA, 21 bp, Homo sapiens
catgaagagaagcaattttgg

SEQ ID NO: 3171934 - DNA, 15 bp, Homo sapiens
catgaagagcaaaaa

SEQ ID NO: 3171935 - DNA, 17 bp, Homo sapiens
catgaagagcaaaaata

SEQ ID NO: 3171936 - DNA, 16 bp, Homo sapiens
catgaatccagtccag

SEQ ID NO: 3171937 - DNA, 14 bp, Homo sapiens
catgaatctgtctc

SEQ ID NO: 3171938 - DNA, 18 bp, Homo sapiens
catgaatgtatcaggaaa

SEQ ID NO: 3171939 - DNA, 21 bp, Homo sapiens
catgaattacctggatgttct

SEQ ID NO: 3171940 - DNA, 22 bp, Homo sapiens
catgaattacctggatgttctt

SEQ ID NO: 3171941 - DNA, 20 bp, Homo sapiens
catgaattactgtatataaa

SEQ ID NO: 3171942 - DNA, 12 bp, Homo sapiens
catgaattccct

SEQ ID NO: 3171943 - DNA, 14 bp, Homo sapiens
catgaattttaaag

SEQ ID NO: 3171944 - DNA, 13 bp, Homo sapiens
catgacaactttt

SEQ ID NO: 3171945 - DNA, 19 bp, Homo sapiens
catgacaacttttaaagaa

SEQ ID NO: 3171946 - DNA, 13 bp, Homo sapiens
catgacaatcacc

SEQ ID NO: 3171947 - DNA, 14 bp, Homo sapiens
catgacagcctcca

SEQ ID NO: 3171948 - DNA, 18 bp, Homo sapiens
catgacatatgacttgat

SEQ ID NO: 3171949 - DNA, 13 bp, Homo sapiens
catgacccacccc

SEQ ID NO: 3171950 - DNA, 19 bp, Homo sapiens
catgacccacccctgtgct

SEQ ID NO: 3171951 - DNA, 20 bp, Homo sapiens
catgacctaccaggacagaa

SEQ ID NO: 3171952 - DNA, 16 bp, Homo sapiens
catgacctgtgaccag

SEQ ID NO: 3171953 - DNA, 18 bp, Homo sapiens
catgacctgtgaccagca

SEQ ID NO: 3171954 - DNA, 20 bp, Homo sapiens
catgactcgtatatgtctca

SEQ ID NO: 3171955 - DNA, 17 bp, Homo sapiens
catgactgcacccagct

SEQ ID NO: 3171956 - DNA, 20 bp, Homo sapiens
catgactgggcctcccttgg

SEQ ID NO: 3171957 - DNA, 22 bp, Homo sapiens
catgactgggcctcccttgggc

SEQ ID NO: 3171958 - DNA, 20 bp, Homo sapiens
catgactgtgaccaccttct

SEQ ID NO: 3171959 - DNA, 21 bp, Homo sapiens
catgacttgtagcatattctt

SEQ ID NO: 3171960 - DNA, 14 bp, Homo sapiens
catgacttgtgtgt

SEQ ID NO: 3171961 - DNA, 22 bp, Homo sapiens
catgagaagagggcctgtggga

SEQ ID NO: 3171962 - DNA, 12 bp, Homo sapiens
catgagaatcta

SEQ ID NO: 3171963 - DNA, 17 bp, Homo sapiens
catgagaatttgcaaca

SEQ ID NO: 3171964 - DNA, 12 bp, Homo sapiens
catgagcctcag

SEQ ID NO: 3171965 - DNA, 17 bp, Homo sapiens
catgagcctcagcatcc

SEQ ID NO: 3171966 - DNA, 16 bp, Homo sapiens
catgagcctgcccgct

SEQ ID NO: 3171967 - DNA, 15 bp, Homo sapiens
catgaggaaggaaca

SEQ ID NO: 3171968 - DNA, 20 bp, Homo sapiens
catgaggacatgatggagcg

SEQ ID NO: 3171969 - DNA, 15 bp, Homo sapiens
catgaggccatctca

SEQ ID NO: 3171970 - DNA, 16 bp, Homo sapiens
catgaggccatctcag

SEQ ID NO: 3171971 - DNA, 18 bp, Homo sapiens
catgaggccatctcagga

SEQ ID NO: 3171972 - DNA, 17 bp, Homo sapiens
catgagggacagggtct

SEQ ID NO: 3171973 - DNA, 20 bp, Homo sapiens
catgagggatcacagggccc

SEQ ID NO: 3171974 - DNA, 17 bp, Homo sapiens
catgagtccttgaaaat

SEQ ID NO: 3171975 - DNA, 18 bp, Homo sapiens
catgagtccttgaaaata

SEQ ID NO: 3171976 - DNA, 19 bp, Homo sapiens
catgagtccttgaaaatat

SEQ ID NO: 3171977 - DNA, 21 bp, Homo sapiens
catgagtccttgaaaatattt

SEQ ID NO: 3171978 - DNA, 18 bp, Homo sapiens
catgagttatcatgaatt

SEQ ID NO: 3171979 - DNA, 17 bp, Homo sapiens
catgagttattcataaa

SEQ ID NO: 3171980 - DNA, 17 bp, Homo sapiens
catgagttgtcagcttt

SEQ ID NO: 3171981 - DNA, 15 bp, Homo sapiens
catgagtttgccctg

SEQ ID NO: 3171982 - DNA, 19 bp, Homo sapiens
catgataccacctttactg

SEQ ID NO: 3171983 - DNA, 20 bp, Homo sapiens
catgataccacctttactgt

SEQ ID NO: 3171984 - DNA, 16 bp, Homo sapiens
catgatatcttcaagc

SEQ ID NO: 3171985 - DNA, 20 bp, Homo sapiens
catgatcgagccactgcact

SEQ ID NO: 3171986 - DNA, 18 bp, Homo sapiens
catgatgggaaaatattt

SEQ ID NO: 3171987 - DNA, 18 bp, Homo sapiens
catgatggtgagagccca

SEQ ID NO: 3171988 - DNA, 12 bp, Homo sapiens
catgattagcaa

SEQ ID NO: 3171989 - DNA, 21 bp, Homo sapiens
catgattagcagaagaaagga

SEQ ID NO: 3171990 - DNA, 16 bp, Homo sapiens
catgattcatgccaat

SEQ ID NO: 3171991 - DNA, 17 bp, Homo sapiens
catgattctctgagtgg

SEQ ID NO: 3171992 - DNA, 18 bp, Homo sapiens
catgattctctgagtggt

SEQ ID NO: 3171993 - DNA, 16 bp, Homo sapiens
catgatttccttgaat

SEQ ID NO: 3171994 - DNA, 18 bp, Homo sapiens
catgatttccttgaatgt

SEQ ID NO: 3171995 - DNA, 16 bp, Homo sapiens
catgatttgtcccagc

SEQ ID NO: 3171996 - DNA, 17 bp, Homo sapiens
catgatttgtcccagcc

SEQ ID NO: 3171997 - DNA, 15 bp, Homo sapiens
catgcaaacaagaaa

SEQ ID NO: 3171998 - DNA, 16 bp, Homo sapiens
catgcaaacaagaaac

SEQ ID NO: 3171999 - DNA, 15 bp, Homo sapiens
catgcaataaaattt

SEQ ID NO: 3172000 - DNA, 16 bp, Homo sapiens
catgcaatgacatctt

SEQ ID NO: 3172001 - DNA, 17 bp, Homo sapiens
catgcaattcatcccag

SEQ ID NO: 3172002 - DNA, 14 bp, Homo sapiens
catgcacagctgta

SEQ ID NO: 3172003 - DNA, 21 bp, Homo sapiens
catgcacagtagattcaagtt

SEQ ID NO: 3172004 - DNA, 16 bp, Homo sapiens
catgcacgtgtgtgca

SEQ ID NO: 3172005 - DNA, 14 bp, Homo sapiens
catgcactgaccct

SEQ ID NO: 3172006 - DNA, 22 bp, Homo sapiens
catgcactgacccttccagaca

SEQ ID NO: 3172007 - DNA, 22 bp, Homo sapiens
catgcagactcctcagatctga

SEQ ID NO: 3172008 - DNA, 20 bp, Homo sapiens
catgcagcccatgcccacct

SEQ ID NO: 3172009 - DNA, 14 bp, Homo sapiens
catgcagccttggg

SEQ ID NO: 3172010 - DNA, 18 bp, Homo sapiens
catgcaggaaggaaaact

SEQ ID NO: 3172011 - DNA, 19 bp, Homo sapiens
catgcaggaaggaaaacta

SEQ ID NO: 3172012 - DNA, 17 bp, Homo sapiens
catgcagttcattattt

SEQ ID NO: 3172013 - DNA, 19 bp, Homo sapiens
cattatgtccactgtgtat

SEQ ID NO: 3172014 - DNA, 11 bp, Homo sapiens
cattatgtgtg

SEQ ID NO: 3172015 - DNA, 17 bp, Homo sapiens
cattatgtgtgcatgtg

SEQ ID NO: 3172016 - DNA, 20 bp, Homo sapiens
cattatgtgtgcatgtgtgt

SEQ ID NO: 3172017 - DNA, 23 bp, Homo sapiens
cattatgtgtgcatgtgtgtata

SEQ ID NO: 3172018 - DNA, 14 bp, Homo sapiens
cattatgttcatgt

SEQ ID NO: 3172019 - DNA, 15 bp, Homo sapiens
cattatgttcatgta

SEQ ID NO: 3172020 - DNA, 19 bp, Homo sapiens
cattattatcattgaaagt

SEQ ID NO: 3172021 - DNA, 13 bp, Homo sapiens
cattattcattta

SEQ ID NO: 3172022 - DNA, 16 bp, Homo sapiens
cattattcatttagtg

SEQ ID NO: 3172023 - DNA, 12 bp, Homo sapiens
cattattctcat

SEQ ID NO: 3172024 - DNA, 14 bp, Homo sapiens
cattattggaatta

SEQ ID NO: 3172025 - DNA, 23 bp, Homo sapiens
cattattggaattaacctggtgc

SEQ ID NO: 3172026 - DNA, 23 bp, Homo sapiens
cattatttattaaaaatgttctc

SEQ ID NO: 3172027 - DNA, 15 bp, Homo sapiens
cattattttctgtca

SEQ ID NO: 3172028 - DNA, 16 bp, Homo sapiens
cattattttctgtcag

SEQ ID NO: 3172029 - DNA, 20 bp, Homo sapiens
cattatttttgttagcaaag

SEQ ID NO: 3172030 - DNA, 14 bp, Homo sapiens
cattcaaactgcac

SEQ ID NO: 3172031 - DNA, 19 bp, Homo sapiens
cattcaaactgcactttta

SEQ ID NO: 3172032 - DNA, 16 bp, Homo sapiens
cattcaaatcagtgat

SEQ ID NO: 3172033 - DNA, 22 bp, Homo sapiens
cattcaactttagtatttttac

SEQ ID NO: 3172034 - DNA, 12 bp, Homo sapiens
cattcaagctat

SEQ ID NO: 3172035 - DNA, 14 bp, Homo sapiens
cattcaagctattt

SEQ ID NO: 3172036 - DNA, 20 bp, Homo sapiens
cattcacaagcctcctgtac

SEQ ID NO: 3172037 - DNA, 21 bp, Homo sapiens
cattcacaagcctcctgtacc

SEQ ID NO: 3172038 - DNA, 15 bp, Homo sapiens
cattcacatttagaa

SEQ ID NO: 3172039 - DNA, 15 bp, Homo sapiens
cattcactagctttg

SEQ ID NO: 3172040 - DNA, 11 bp, Homo sapiens
cattcacttca

SEQ ID NO: 3172041 - DNA, 14 bp, Homo sapiens
cattcacttcataa

SEQ ID NO: 3172042 - DNA, 22 bp, Homo sapiens
cattcacttctgcattcctgta

SEQ ID NO: 3172043 - DNA, 16 bp, Homo sapiens
cattcagctctggaga

SEQ ID NO: 3172044 - DNA, 21 bp, Homo sapiens
cattcagctctggagaacagt

SEQ ID NO: 3172045 - DNA, 20 bp, Homo sapiens
cattcagtgattactgtcaa

SEQ ID NO: 3172046 - DNA, 21 bp, Homo sapiens
cattcagtgattactgtcaag

SEQ ID NO: 3172047 - DNA, 21 bp, Homo sapiens
cattcattttctgacatgcat

SEQ ID NO: 3172048 - DNA, 11 bp, Homo sapiens
cattcattttt

SEQ ID NO: 3172049 - DNA, 23 bp, Homo sapiens
cattccaacagctcaagtcttcc

SEQ ID NO: 3172050 - DNA, 14 bp, Homo sapiens
cattccaagactct

SEQ ID NO: 3172051 - DNA, 16 bp, Homo sapiens
cattccagacttcaaa

SEQ ID NO: 3172052 - DNA, 16 bp, Homo sapiens
cattccagtaactttt

SEQ ID NO: 3172053 - DNA, 23 bp, Homo sapiens
cattcccagagtcagaggagaag

SEQ ID NO: 3172054 - DNA, 13 bp, Homo sapiens
cattccccatggg

SEQ ID NO: 3172055 - DNA, 23 bp, Homo sapiens
cattcccctcccacctctccttt

SEQ ID NO: 3172056 - DNA, 22 bp, Homo sapiens
cattcctaaagaaaaatatctt

SEQ ID NO: 3172057 - DNA, 19 bp, Homo sapiens
cattcctgcctttaagcca

SEQ ID NO: 3172058 - DNA, 19 bp, Homo sapiens
cattcctggtacccagcca

SEQ ID NO: 3172059 - DNA, 20 bp, Homo sapiens
cattcctggtacccagccat

SEQ ID NO: 3172060 - DNA, 19 bp, Homo sapiens
cattcctgtaacttttaat

SEQ ID NO: 3172061 - DNA, 20 bp, Homo sapiens
cattcctgtaacttttaatc

SEQ ID NO: 3172062 - DNA, 15 bp, Homo sapiens
cattccttctttgat

SEQ ID NO: 3172063 - DNA, 13 bp, Homo sapiens
cattccttctttt

SEQ ID NO: 3172064 - DNA, 16 bp, Homo sapiens
cattcgacctataaga

SEQ ID NO: 3172065 - DNA, 21 bp, Homo sapiens
cattcgacctataagaagcct

SEQ ID NO: 3172066 - DNA, 22 bp, Homo sapiens
cattcgacctataagaagcctt

SEQ ID NO: 3172067 - DNA, 14 bp, Homo sapiens
cattcgggccacag

SEQ ID NO: 3172068 - DNA, 17 bp, Homo sapiens
cattcgggccacagggc

SEQ ID NO: 3172069 - DNA, 18 bp, Homo sapiens
cattcgtgagctggggac

SEQ ID NO: 3172070 - DNA, 19 bp, Homo sapiens
cattcgtggcatgttttga

SEQ ID NO: 3172071 - DNA, 13 bp, Homo sapiens
cattctaatttgc

SEQ ID NO: 3172072 - DNA, 19 bp, Homo sapiens
cattctacacagagcagga

SEQ ID NO: 3172073 - DNA, 17 bp, Homo sapiens
cattctaggctcactgc

SEQ ID NO: 3172074 - DNA, 23 bp, Homo sapiens
cattctaggtaggggcccacttc

SEQ ID NO: 3172075 - DNA, 17 bp, Homo sapiens
cattctatcaagcccag

SEQ ID NO: 3172076 - DNA, 21 bp, Homo sapiens
cattctatccccaatcagctc

SEQ ID NO: 3172077 - DNA, 19 bp, Homo sapiens
cattctcattgcagaataa

SEQ ID NO: 3172078 - DNA, 12 bp, Homo sapiens
cattctccccag

SEQ ID NO: 3172079 - DNA, 15 bp, Homo sapiens
cattctcctgcctca

SEQ ID NO: 3172080 - DNA, 15 bp, Homo sapiens
cattctcctgcctgt

SEQ ID NO: 3172081 - DNA, 23 bp, Homo sapiens
cattctcctgcctgtagcagtga

SEQ ID NO: 3172082 - DNA, 23 bp, Homo sapiens
cattctgactcggtttctccaaa

SEQ ID NO: 3172083 - DNA, 20 bp, Homo sapiens
cattctgatttggaaaaaga

SEQ ID NO: 3172084 - DNA, 21 bp, Homo sapiens
cattctgccgccccctcctga

SEQ ID NO: 3172085 - DNA, 23 bp, Homo sapiens
cattctgccgccccctcctgaac

SEQ ID NO: 3172086 - DNA, 19 bp, Homo sapiens
cattctgcctagagtgtag

SEQ ID NO: 3172087 - DNA, 17 bp, Homo sapiens
cattctgcctctctagg

SEQ ID NO: 3172088 - DNA, 13 bp, Homo sapiens
cattctgcctgcc

SEQ ID NO: 3172089 - DNA, 15 bp, Homo sapiens
cattctgcctgccca

SEQ ID NO: 3172090 - DNA, 20 bp, Homo sapiens
cattctggggaaacaacatt

SEQ ID NO: 3172091 - DNA, 21 bp, Homo sapiens
cattcttacaattgcactgct

SEQ ID NO: 3172092 - DNA, 21 bp, Homo sapiens
cattcttagcctgtggcagta

SEQ ID NO: 3172093 - DNA, 22 bp, Homo sapiens
cattcttagcctgtggcagtaa

SEQ ID NO: 3172094 - DNA, 15 bp, Homo sapiens
cattcttataacata

SEQ ID NO: 3172095 - DNA, 16 bp, Homo sapiens
cattcttctctgttgt

SEQ ID NO: 3172096 - DNA, 20 bp, Homo sapiens
cattcttggcttaatcattt

SEQ ID NO: 3172097 - DNA, 12 bp, Homo sapiens
cattctttgctt

SEQ ID NO: 3172098 - DNA, 21 bp, Homo sapiens
cattctttgcttgaacacagt

SEQ ID NO: 3172099 - DNA, 17 bp, Homo sapiens
cattcttttatagagca

SEQ ID NO: 3172100 - DNA, 17 bp, Homo sapiens
cattgaaagaagagatg

SEQ ID NO: 3172101 - DNA, 14 bp, Homo sapiens
cattgaaagaatta

SEQ ID NO: 3172102 - DNA, 16 bp, Homo sapiens
cattgaaatacttttt

SEQ ID NO: 3172103 - DNA, 16 bp, Homo sapiens
cattgaaatgagcacc

SEQ ID NO: 3172104 - DNA, 16 bp, Homo sapiens
cattgaacacaaactg

SEQ ID NO: 3172105 - DNA, 18 bp, Homo sapiens
cattgaacacaaactgta

SEQ ID NO: 3172106 - DNA, 13 bp, Homo sapiens
cattgaaggctta

SEQ ID NO: 3172107 - DNA, 18 bp, Homo sapiens
cattgaagtaatgaattt

SEQ ID NO: 3172108 - DNA, 13 bp, Homo sapiens
cattgaagtatat

SEQ ID NO: 3172109 - DNA, 20 bp, Homo sapiens
cattgaatgcgctttattgc

SEQ ID NO: 3172110 - DNA, 16 bp, Homo sapiens
cattgacaagaactga

SEQ ID NO: 3172111 - DNA, 16 bp, Homo sapiens
cattgaccaagaactg

SEQ ID NO: 3172112 - DNA, 18 bp, Homo sapiens
cattgaccaagaactgca

SEQ ID NO: 3172113 - DNA, 20 bp, Homo sapiens
cattgaccaagaactgcatg

SEQ ID NO: 3172114 - DNA, 21 bp, Homo sapiens
cattgaccaagaactgcatgg

SEQ ID NO: 3172115 - DNA, 21 bp, Homo sapiens
cattgaccgcgactaatttca

SEQ ID NO: 3172116 - DNA, 20 bp, Homo sapiens
cattgacctctcagggcctg

SEQ ID NO: 3172117 - DNA, 19 bp, Homo sapiens
cattgacttcattttatat

SEQ ID NO: 3172118 - DNA, 19 bp, Homo sapiens
cattgagctgatataaatt

SEQ ID NO: 3172119 - DNA, 21 bp, Homo sapiens
cattgagctgatataaattct

SEQ ID NO: 3172120 - DNA, 15 bp, Homo sapiens
cattgaggaaatatt

SEQ ID NO: 3172121 - DNA, 19 bp, Homo sapiens
cattgaggaaatattaatt

SEQ ID NO: 3172122 - DNA, 16 bp, Homo sapiens
cattgaggaagagtct

SEQ ID NO: 3172123 - DNA, 15 bp, Homo sapiens
cattgagtattgttt

SEQ ID NO: 3172124 - DNA, 17 bp, Homo sapiens
cattgataatcttcagg

SEQ ID NO: 3172125 - DNA, 20 bp, Homo sapiens
cattgataatcttcaggtga

SEQ ID NO: 3172126 - DNA, 15 bp, Homo sapiens
cattgattcagcctg

SEQ ID NO: 3172127 - DNA, 18 bp, Homo sapiens
cattgattgtcagctact

SEQ ID NO: 3172128 - DNA, 18 bp, Homo sapiens
cattgcactctagcctgg

SEQ ID NO: 3172129 - DNA, 22 bp, Homo sapiens
cattgcagaataatgttctatt

SEQ ID NO: 3172130 - DNA, 18 bp, Homo sapiens
cattgcagcagataactt

SEQ ID NO: 3172131 - DNA, 12 bp, Homo sapiens
cattgcagttta

SEQ ID NO: 3172132 - DNA, 14 bp, Homo sapiens
cattgccaccagga

SEQ ID NO: 3172133 - DNA, 16 bp, Homo sapiens
cattgccaccaggaga

SEQ ID NO: 3172134 - DNA, 16 bp, Homo sapiens
cattgccagtgtcttt

SEQ ID NO: 3172135 - DNA, 16 bp, Homo sapiens
cattgccattccctgc

SEQ ID NO: 3172136 - DNA, 20 bp, Homo sapiens
cattgccattccctgcctgg

SEQ ID NO: 3172137 - DNA, 17 bp, Homo sapiens
cattgcccccacctctg

SEQ ID NO: 3172138 - DNA, 18 bp, Homo sapiens
catttccaactcaggtta

SEQ ID NO: 3172139 - DNA, 15 bp, Homo sapiens
catttccattgctta

SEQ ID NO: 3172140 - DNA, 16 bp, Homo sapiens
catttccattgcttat

SEQ ID NO: 3172141 - DNA, 14 bp, Homo sapiens
catttcccacatct

SEQ ID NO: 3172142 - DNA, 16 bp, Homo sapiens
catttcccacatcttt

SEQ ID NO: 3172143 - DNA, 18 bp, Homo sapiens
catttcccacatctttcc

SEQ ID NO: 3172144 - DNA, 17 bp, Homo sapiens
catttccgaataaagta

SEQ ID NO: 3172145 - DNA, 23 bp, Homo sapiens
catttccggctgctgtgtgtgag

SEQ ID NO: 3172146 - DNA, 19 bp, Homo sapiens
catttccgttttgcctgtg

SEQ ID NO: 3172147 - DNA, 18 bp, Homo sapiens
catttcctcacactaaga

SEQ ID NO: 3172148 - DNA, 20 bp, Homo sapiens
catttcctgacagaaggact

SEQ ID NO: 3172149 - DNA, 22 bp, Homo sapiens
catttcctgtacaatcatgaac

SEQ ID NO: 3172150 - DNA, 13 bp, Homo sapiens
catttcctgtgtc

SEQ ID NO: 3172151 - DNA, 14 bp, Homo sapiens
catttctaaaagaa

SEQ ID NO: 3172152 - DNA, 12 bp, Homo sapiens
catttctaaaat

SEQ ID NO: 3172153 - DNA, 21 bp, Homo sapiens
catttctatactttacaggaa

SEQ ID NO: 3172154 - DNA, 15 bp, Homo sapiens
catttctcactgaaa

SEQ ID NO: 3172155 - DNA, 12 bp, Homo sapiens
catttctccgtt

SEQ ID NO: 3172156 - DNA, 20 bp, Homo sapiens
catttctctaactcctgcca

SEQ ID NO: 3172157 - DNA, 18 bp, Homo sapiens
catttctctccaggaagt

SEQ ID NO: 3172158 - DNA, 14 bp, Homo sapiens
catttctctgagca

SEQ ID NO: 3172159 - DNA, 19 bp, Homo sapiens
catttctctgagcagtcag

SEQ ID NO: 3172160 - DNA, 14 bp, Homo sapiens
catttctcttctca

SEQ ID NO: 3172161 - DNA, 19 bp, Homo sapiens
catttctcttctcagctct

SEQ ID NO: 3172162 - DNA, 23 bp, Homo sapiens
catttctcttctcagctcttcca

SEQ ID NO: 3172163 - DNA, 22 bp, Homo sapiens
catttctgagtttcattctcct

SEQ ID NO: 3172164 - DNA, 17 bp, Homo sapiens
catttctgatcagaggt

SEQ ID NO: 3172165 - DNA, 23 bp, Homo sapiens
catttctggattgtggttccatg

SEQ ID NO: 3172166 - DNA, 14 bp, Homo sapiens
catttctgtaaata

SEQ ID NO: 3172167 - DNA, 16 bp, Homo sapiens
catttctgttctcatt

SEQ ID NO: 3172168 - DNA, 22 bp, Homo sapiens
catttcttcagtcagaaaactt

SEQ ID NO: 3172169 - DNA, 15 bp, Homo sapiens
catttcttcctcagc

SEQ ID NO: 3172170 - DNA, 16 bp, Homo sapiens
catttcttcctcagct

SEQ ID NO: 3172171 - DNA, 17 bp, Homo sapiens
catttcttcctcagctg

SEQ ID NO: 3172172 - DNA, 19 bp, Homo sapiens
catttcttcctcagctggt

SEQ ID NO: 3172173 - DNA, 17 bp, Homo sapiens
catttctttcttgctgg

SEQ ID NO: 3172174 - DNA, 18 bp, Homo sapiens
catttctttcttgctggc

SEQ ID NO: 3172175 - DNA, 15 bp, Homo sapiens
catttgaaagaggag

SEQ ID NO: 3172176 - DNA, 23 bp, Homo sapiens
catttgaacctggatccagcact

SEQ ID NO: 3172177 - DNA, 18 bp, Homo sapiens
catttgaagtgtacctgt

SEQ ID NO: 3172178 - DNA, 19 bp, Homo sapiens
catttgactgtctcacttt

SEQ ID NO: 3172179 - DNA, 20 bp, Homo sapiens
catttgactgttcaatgatt

SEQ ID NO: 3172180 - DNA, 23 bp, Homo sapiens
catttgagagaagccacgctgtc

SEQ ID NO: 3172181 - DNA, 14 bp, Homo sapiens
catttgagcagggc

SEQ ID NO: 3172182 - DNA, 16 bp, Homo sapiens
catttgagcagggctc

SEQ ID NO: 3172183 - DNA, 19 bp, Homo sapiens
catttgagggcccagccag

SEQ ID NO: 3172184 - DNA, 11 bp, Homo sapiens
catttgatacc

SEQ ID NO: 3172185 - DNA, 16 bp, Homo sapiens
catttgatacccctgg

SEQ ID NO: 3172186 - DNA, 15 bp, Homo sapiens
catttgatatttttc

SEQ ID NO: 3172187 - DNA, 18 bp, Homo sapiens
catttgatatttttccat

SEQ ID NO: 3172188 - DNA, 16 bp, Homo sapiens
catttgatgcatgtct

SEQ ID NO: 3172189 - DNA, 15 bp, Homo sapiens
catttgatttaaaca

SEQ ID NO: 3172190 - DNA, 14 bp, Homo sapiens
catttgcagggtcc

SEQ ID NO: 3172191 - DNA, 14 bp, Homo sapiens
catttgcctattcc

SEQ ID NO: 3172192 - DNA, 17 bp, Homo sapiens
catttgcctattcccac

SEQ ID NO: 3172193 - DNA, 19 bp, Homo sapiens
catttgcctattcccacac

SEQ ID NO: 3172194 - DNA, 12 bp, Homo sapiens
catttgccttgc

SEQ ID NO: 3172195 - DNA, 19 bp, Homo sapiens
catttgccttgcagaactg

SEQ ID NO: 3172196 - DNA, 20 bp, Homo sapiens
catttgccttgcagaactgc

SEQ ID NO: 3172197 - DNA, 14 bp, Homo sapiens
catttgccttgctg

SEQ ID NO: 3172198 - DNA, 15 bp, Homo sapiens
catttgcctttctgg

SEQ ID NO: 3172199 - DNA, 21 bp, Homo sapiens
catttgcctttctgggagcag

SEQ ID NO: 3172200 - DNA, 15 bp, Homo sapiens
catttgctactgttg

SEQ ID NO: 3172201 - DNA, 16 bp, Homo sapiens
catttgctttttcacc

SEQ ID NO: 3172202 - DNA, 13 bp, Homo sapiens
catttgctttttg

SEQ ID NO: 3172203 - DNA, 21 bp, Homo sapiens
catttggagacacaactattt

SEQ ID NO: 3172204 - DNA, 23 bp, Homo sapiens
catttgggatgttccttttttca

SEQ ID NO: 3172205 - DNA, 23 bp, Homo sapiens
catttggtatattacctcaaatt

SEQ ID NO: 3172206 - DNA, 18 bp, Homo sapiens
catttggtattacacagt

SEQ ID NO: 3172207 - DNA, 20 bp, Homo sapiens
catttggtcaagattttgaa

SEQ ID NO: 3172208 - DNA, 14 bp, Homo sapiens
catttggtcctttc

SEQ ID NO: 3172209 - DNA, 21 bp, Homo sapiens
catttggtgagagtcaaagct

SEQ ID NO: 3172210 - DNA, 23 bp, Homo sapiens
catttggtgtggattttctactg

SEQ ID NO: 3172211 - DNA, 15 bp, Homo sapiens
catttggtgttcctg

SEQ ID NO: 3172212 - DNA, 20 bp, Homo sapiens
catttggtgttcctggaagc

SEQ ID NO: 3172213 - DNA, 16 bp, Homo sapiens
catttggttcattaat

SEQ ID NO: 3172214 - DNA, 13 bp, Homo sapiens
catttgtaaaact

SEQ ID NO: 3172215 - DNA, 18 bp, Homo sapiens
catttgtaataaagtata

SEQ ID NO: 3172216 - DNA, 19 bp, Homo sapiens
catttgtaattaaattatg

SEQ ID NO: 3172217 - DNA, 20 bp, Homo sapiens
catttgtacaaggtaattgt

SEQ ID NO: 3172218 - DNA, 20 bp, Homo sapiens
catttgtacagaattttgga

SEQ ID NO: 3172219 - DNA, 17 bp, Homo sapiens
catttgtattgcttatt

SEQ ID NO: 3172220 - DNA, 19 bp, Homo sapiens
catttgtattgcttatttt

SEQ ID NO: 3172221 - DNA, 23 bp, Homo sapiens
catttgtattgtacataaaattt

SEQ ID NO: 3172222 - DNA, 11 bp, Homo sapiens
catttgtattt

SEQ ID NO: 3172223 - DNA, 15 bp, Homo sapiens
catttgtattttgtg

SEQ ID NO: 3172224 - DNA, 17 bp, Homo sapiens
catttgtcacacacttt

SEQ ID NO: 3172225 - DNA, 16 bp, Homo sapiens
catttgtgccagagga

SEQ ID NO: 3172226 - DNA, 20 bp, Homo sapiens
catttgtgctagaaattttc

SEQ ID NO: 3172227 - DNA, 23 bp, Homo sapiens
catttgtggcagtcccttataat

SEQ ID NO: 3172228 - DNA, 15 bp, Homo sapiens
catttgttaaaatta

SEQ ID NO: 3172229 - DNA, 16 bp, Homo sapiens
catttgttggaatgaa

SEQ ID NO: 3172230 - DNA, 20 bp, Homo sapiens
catttgtttacatttgatgc

SEQ ID NO: 3172231 - DNA, 22 bp, Homo sapiens
catttgtttgaccccagtttct

SEQ ID NO: 3172232 - DNA, 13 bp, Homo sapiens
catttgttttgct

SEQ ID NO: 3172233 - DNA, 15 bp, Homo sapiens
catttgttttgcttt

SEQ ID NO: 3172234 - DNA, 19 bp, Homo sapiens
catttgttttgcttttgtt

SEQ ID NO: 3172235 - DNA, 17 bp, Homo sapiens
cattttaaaaactttat

SEQ ID NO: 3172236 - DNA, 18 bp, Homo sapiens
cattttaaaaactttatt

SEQ ID NO: 3172237 - DNA, 18 bp, Homo sapiens
cattttaaataaaagaaa

SEQ ID NO: 3172238 - DNA, 16 bp, Homo sapiens
cattttaactttatca

SEQ ID NO: 3172239 - DNA, 15 bp, Homo sapiens
cattttaattttaaa

SEQ ID NO: 3172240 - DNA, 16 bp, Homo sapiens
cattttacacagcacc

SEQ ID NO: 3172241 - DNA, 13 bp, Homo sapiens
cattttacagtga

SEQ ID NO: 3172242 - DNA, 23 bp, Homo sapiens
cattttacagtgaccttttcttc

SEQ ID NO: 3172243 - DNA, 21 bp, Homo sapiens
cattttagaaacggacagctt

SEQ ID NO: 3172244 - DNA, 18 bp, Homo sapiens
cattttagttcctttatt

SEQ ID NO: 3172245 - DNA, 19 bp, Homo sapiens
cattttatatttttgtaca

SEQ ID NO: 3172246 - DNA, 20 bp, Homo sapiens
cattttatatttttgtacat

SEQ ID NO: 3172247 - DNA, 20 bp, Homo sapiens
cattttatgaatatcattga

SEQ ID NO: 3172248 - DNA, 19 bp, Homo sapiens
cattttattaaacattttc

SEQ ID NO: 3172249 - DNA, 21 bp, Homo sapiens
cattttattaaacattttcat

SEQ ID NO: 3172250 - DNA, 22 bp, Homo sapiens
cattttattaagctttttggaa

SEQ ID NO: 3172251 - DNA, 17 bp, Homo sapiens
cattttcagtcttgtag

SEQ ID NO: 3172252 - DNA, 14 bp, Homo sapiens
cattttcattccta

SEQ ID NO: 3172253 - DNA, 14 bp, Homo sapiens
cattttcccatcat

SEQ ID NO: 3172254 - DNA, 21 bp, Homo sapiens
cattttcccccactactgcag

SEQ ID NO: 3172255 - DNA, 14 bp, Homo sapiens
cattttccccccac

SEQ ID NO: 3172256 - DNA, 20 bp, Homo sapiens
cattttccccccactctccc

SEQ ID NO: 3172257 - DNA, 15 bp, Homo sapiens
cattttccccttcct

SEQ ID NO: 3172258 - DNA, 17 bp, Homo sapiens
cattttccccttcctca

SEQ ID NO: 3172259 - DNA, 19 bp, Homo sapiens
cattttctataacagatat

SEQ ID NO: 3172260 - DNA, 17 bp, Homo sapiens
cattttctgacatgcat

SEQ ID NO: 3172261 - DNA, 22 bp, Homo sapiens
cattttctgacatgcattgttg

SEQ ID NO: 3172262 - DNA, 20 bp, Homo sapiens
cattttcttattgcgctgct

SEQ ID NO: 3172263 - DNA, 22 bp, Homo sapiens
ccaccatattcagtgctgtggc

SEQ ID NO: 3172264 - DNA, 21 bp, Homo sapiens
ccaccatcaccaccgcctctg

SEQ ID NO: 3172265 - DNA, 18 bp, Homo sapiens
ccaccatcatgtctggct

SEQ ID NO: 3172266 - DNA, 17 bp, Homo sapiens
ccaccatggccagccaa

SEQ ID NO: 3172267 - DNA, 21 bp, Homo sapiens
ccaccatggccagccaacttt

SEQ ID NO: 3172268 - DNA, 12 bp, Homo sapiens
ccaccattcctg

SEQ ID NO: 3172269 - DNA, 16 bp, Homo sapiens
ccaccattcctgcctt

SEQ ID NO: 3172270 - DNA, 16 bp, Homo sapiens
ccaccattcctggaaa

SEQ ID NO: 3172271 - DNA, 19 bp, Homo sapiens
ccacccaaccctatctcct

SEQ ID NO: 3172272 - DNA, 15 bp, Homo sapiens
ccacccaccagggcg

SEQ ID NO: 3172273 - DNA, 12 bp, Homo sapiens
ccacccagcccc

SEQ ID NO: 3172274 - DNA, 14 bp, Homo sapiens
ccacccaggagccc

SEQ ID NO: 3172275 - DNA, 13 bp, Homo sapiens
ccacccaggctgc

SEQ ID NO: 3172276 - DNA, 22 bp, Homo sapiens
ccacccaggctgcactgcagtg

SEQ ID NO: 3172277 - DNA, 14 bp, Homo sapiens
ccacccagtgctgc

SEQ ID NO: 3172278 - DNA, 16 bp, Homo sapiens
ccacccagtgctgcca

SEQ ID NO: 3172279 - DNA, 17 bp, Homo sapiens
ccacccagtgctgccat

SEQ ID NO: 3172280 - DNA, 21 bp, Homo sapiens
ccacccagtgctgccatgcca

SEQ ID NO: 3172281 - DNA, 23 bp, Homo sapiens
ccacccataatcctttctgccga

SEQ ID NO: 3172282 - DNA, 13 bp, Homo sapiens
ccaccccaagaga

SEQ ID NO: 3172283 - DNA, 15 bp, Homo sapiens
ccaccccaagagaac

SEQ ID NO: 3172284 - DNA, 17 bp, Homo sapiens
ccaccccaagagaactc

SEQ ID NO: 3172285 - DNA, 13 bp, Homo sapiens
ccaccccacactt

SEQ ID NO: 3172286 - DNA, 17 bp, Homo sapiens
ccaccccacagactccg

SEQ ID NO: 3172287 - DNA, 13 bp, Homo sapiens
ccaccccacgccc

SEQ ID NO: 3172288 - DNA, 13 bp, Homo sapiens
ccacccccagcca

SEQ ID NO: 3172289 - DNA, 16 bp, Homo sapiens
ccacccccagccaggc

SEQ ID NO: 3172290 - DNA, 17 bp, Homo sapiens
ccacccccagccaggct

SEQ ID NO: 3172291 - DNA, 13 bp, Homo sapiens
ccaccccctgccc

SEQ ID NO: 3172292 - DNA, 16 bp, Homo sapiens
ccaccccctgccctgc

SEQ ID NO: 3172293 - DNA, 16 bp, Homo sapiens
ccaccccgcctgccct

SEQ ID NO: 3172294 - DNA, 18 bp, Homo sapiens
ccaccccgggctctctgc

SEQ ID NO: 3172295 - DNA, 18 bp, Homo sapiens
ccaccccggggaccctgt

SEQ ID NO: 3172296 - DNA, 20 bp, Homo sapiens
ccaccccggggaccctgtga

SEQ ID NO: 3172297 - DNA, 19 bp, Homo sapiens
ccacccctaagtgcccaaa

SEQ ID NO: 3172298 - DNA, 11 bp, Homo sapiens
ccacccctccc

SEQ ID NO: 3172299 - DNA, 14 bp, Homo sapiens
ccacccctccccag

SEQ ID NO: 3172300 - DNA, 13 bp, Homo sapiens
ccacccctgcccc

SEQ ID NO: 3172301 - DNA, 22 bp, Homo sapiens
ccacccctgcccccagccccgg

SEQ ID NO: 3172302 - DNA, 12 bp, Homo sapiens
ccacccctgtgc

SEQ ID NO: 3172303 - DNA, 14 bp, Homo sapiens
ccaccccttcccca

SEQ ID NO: 3172304 - DNA, 16 bp, Homo sapiens
ccaccccttccccagg

SEQ ID NO: 3172305 - DNA, 16 bp, Homo sapiens
ccaccccttggaggag

SEQ ID NO: 3172306 - DNA, 16 bp, Homo sapiens
ccacccgatgctgctt

SEQ ID NO: 3172307 - DNA, 19 bp, Homo sapiens
ccacccgcagatgacacgc

SEQ ID NO: 3172308 - DNA, 18 bp, Homo sapiens
ccacccgggggagcccag

SEQ ID NO: 3172309 - DNA, 18 bp, Homo sapiens
ccacccgtggggtgctgc

SEQ ID NO: 3172310 - DNA, 19 bp, Homo sapiens
ccacccgttctgctggcct

SEQ ID NO: 3172311 - DNA, 17 bp, Homo sapiens
ccaccctcagcacccct

SEQ ID NO: 3172312 - DNA, 15 bp, Homo sapiens
ccaccctccatgctc

SEQ ID NO: 3172313 - DNA, 21 bp, Homo sapiens
ccaccctcccctctcttgcac

SEQ ID NO: 3172314 - DNA, 12 bp, Homo sapiens
ccaccctcctct

SEQ ID NO: 3172315 - DNA, 15 bp, Homo sapiens
ccaccctgctgcctt

SEQ ID NO: 3172316 - DNA, 11 bp, Homo sapiens
ccaccctggaa

SEQ ID NO: 3172317 - DNA, 17 bp, Homo sapiens
ccaccctgggagacaga

SEQ ID NO: 3172318 - DNA, 12 bp, Homo sapiens
ccaccctgggcc

SEQ ID NO: 3172319 - DNA, 17 bp, Homo sapiens
ccaccctgggccctggg

SEQ ID NO: 3172320 - DNA, 19 bp, Homo sapiens
ccaccctgtcccccagctc

SEQ ID NO: 3172321 - DNA, 15 bp, Homo sapiens
ccacccttggcctgt

SEQ ID NO: 3172322 - DNA, 17 bp, Homo sapiens
ccacccttggcctgtct

SEQ ID NO: 3172323 - DNA, 20 bp, Homo sapiens
ccaccgatggagcccccaga

SEQ ID NO: 3172324 - DNA, 15 bp, Homo sapiens
ccaccgcggaggagg

SEQ ID NO: 3172325 - DNA, 15 bp, Homo sapiens
ccaccgctgccagca

SEQ ID NO: 3172326 - DNA, 16 bp, Homo sapiens
ccaccgctgccagcac

SEQ ID NO: 3172327 - DNA, 13 bp, Homo sapiens
ccaccgctgctcc

SEQ ID NO: 3172328 - DNA, 21 bp, Homo sapiens
ccaccggaggtcactccacca

SEQ ID NO: 3172329 - DNA, 17 bp, Homo sapiens
ccaccggcccctggcag

SEQ ID NO: 3172330 - DNA, 22 bp, Homo sapiens
ccaccggcccctggcagcacag

SEQ ID NO: 3172331 - DNA, 20 bp, Homo sapiens
ccaccgggagcctccccctc

SEQ ID NO: 3172332 - DNA, 22 bp, Homo sapiens
ccaccgggctgggagctctgca

SEQ ID NO: 3172333 - DNA, 17 bp, Homo sapiens
ccaccggtccagctggc

SEQ ID NO: 3172334 - DNA, 18 bp, Homo sapiens
ccaccggtccagctggcc

SEQ ID NO: 3172335 - DNA, 16 bp, Homo sapiens
ccaccgtccgccctgc

SEQ ID NO: 3172336 - DNA, 14 bp, Homo sapiens
ccaccgtttcttcc

SEQ ID NO: 3172337 - DNA, 21 bp, Homo sapiens
ccaccgtttcttcctgccagc

SEQ ID NO: 3172338 - DNA, 19 bp, Homo sapiens
ccacctagcccaggagaga

SEQ ID NO: 3172339 - DNA, 20 bp, Homo sapiens
ccacctatctcgtgggagag

SEQ ID NO: 3172340 - DNA, 19 bp, Homo sapiens
ccacctcacctagcctgat

SEQ ID NO: 3172341 - DNA, 16 bp, Homo sapiens
ccacctcactcctgtt

SEQ ID NO: 3172342 - DNA, 15 bp, Homo sapiens
ccacctcagaaagga

SEQ ID NO: 3172343 - DNA, 14 bp, Homo sapiens
ccacctcagggcac

SEQ ID NO: 3172344 - DNA, 20 bp, Homo sapiens
ccacctcagggcacgcagga

SEQ ID NO: 3172345 - DNA, 15 bp, Homo sapiens
ccacctccacccagc

SEQ ID NO: 3172346 - DNA, 17 bp, Homo sapiens
ccacctccacccagccc

SEQ ID NO: 3172347 - DNA, 21 bp, Homo sapiens
ccacctccacccagcccctgg

SEQ ID NO: 3172348 - DNA, 13 bp, Homo sapiens
ccacctccacctg

SEQ ID NO: 3172349 - DNA, 14 bp, Homo sapiens
ccacctccacctgt

SEQ ID NO: 3172350 - DNA, 17 bp, Homo sapiens
ccacctccacctgtgag

SEQ ID NO: 3172351 - DNA, 18 bp, Homo sapiens
ccacctccacctgtgaga

SEQ ID NO: 3172352 - DNA, 19 bp, Homo sapiens
ccacctccagcccgggagc

SEQ ID NO: 3172353 - DNA, 22 bp, Homo sapiens
ccacctccagcccgggagccta

SEQ ID NO: 3172354 - DNA, 24 bp, Homo sapiens
ccacctccagtccccctatccttg

SEQ ID NO: 3172355 - DNA, 23 bp, Homo sapiens
ccacctccccacgccctcccctc

SEQ ID NO: 3172356 - DNA, 13 bp, Homo sapiens
ccacctccctcac

SEQ ID NO: 3172357 - DNA, 13 bp, Homo sapiens
ccacctccctgcc

SEQ ID NO: 3172358 - DNA, 17 bp, Homo sapiens
ccacctccctgcccagg

SEQ ID NO: 3172359 - DNA, 12 bp, Homo sapiens
ccacctcctccc

SEQ ID NO: 3172360 - DNA, 22 bp, Homo sapiens
ccacctcctccccctgttctgt

SEQ ID NO: 3172361 - DNA, 18 bp, Homo sapiens
ccacctcggagcatggtg

SEQ ID NO: 3172362 - DNA, 14 bp, Homo sapiens
ccacctcggtcact

SEQ ID NO: 3172363 - DNA, 13 bp, Homo sapiens
ccacctctccaag

SEQ ID NO: 3172364 - DNA, 17 bp, Homo sapiens
ccacctctccaagggct

SEQ ID NO: 3172365 - DNA, 15 bp, Homo sapiens
ccacctctggccctg

SEQ ID NO: 3172366 - DNA, 17 bp, Homo sapiens
ccacctctggccctgtg

SEQ ID NO: 3172367 - DNA, 19 bp, Homo sapiens
ccacctctggccctgtgta

SEQ ID NO: 3172368 - DNA, 14 bp, Homo sapiens
ccacctctggtcca

SEQ ID NO: 3172369 - DNA, 18 bp, Homo sapiens
ccacctctgtgacctcag

SEQ ID NO: 3172370 - DNA, 19 bp, Homo sapiens
ccacctctgtgacctcagg

SEQ ID NO: 3172371 - DNA, 18 bp, Homo sapiens
ccacctgacaatggcagc

SEQ ID NO: 3172372 - DNA, 21 bp, Homo sapiens
ccacctgacaatggcagctag

SEQ ID NO: 3172373 - DNA, 20 bp, Homo sapiens
ccacctgacacaccaggcgc

SEQ ID NO: 3172374 - DNA, 16 bp, Homo sapiens
ccacctgaggtgggcc

SEQ ID NO: 3172375 - DNA, 20 bp, Homo sapiens
ccacctgaggtgggcccagg

SEQ ID NO: 3172376 - DNA, 21 bp, Homo sapiens
ccacctgaggtgggcccagga

SEQ ID NO: 3172377 - DNA, 14 bp, Homo sapiens
ccacctgcccatca

SEQ ID NO: 3172378 - DNA, 18 bp, Homo sapiens
ccacctggccacctgagg

SEQ ID NO: 3172379 - DNA, 21 bp, Homo sapiens
ccacctgtagccatctgcaca

SEQ ID NO: 3172380 - DNA, 11 bp, Homo sapiens
ccacctgtctc

SEQ ID NO: 3172381 - DNA, 23 bp, Homo sapiens
ccacctgtctcagcctcccagag

SEQ ID NO: 3172382 - DNA, 15 bp, Homo sapiens
ccacctgtgccctca

SEQ ID NO: 3172383 - DNA, 12 bp, Homo sapiens
ccacctgtgggt

SEQ ID NO: 3172384 - DNA, 20 bp, Homo sapiens
ccaccttcaattcctgggcc

SEQ ID NO: 3172385 - DNA, 14 bp, Homo sapiens
ccaccttggctcaa

SEQ ID NO: 3172386 - DNA, 12 bp, Homo sapiens
ccaccttggctg

SEQ ID NO: 3172387 - DNA, 16 bp, Homo sapiens
ccacctttcaccctca

SEQ ID NO: 3172388 - DNA, 15 bp, Homo sapiens
ccacgaatttgctgg

SEQ ID NO: 3172389 - DNA, 13 bp, Homo sapiens
ccacgaccagccc

SEQ ID NO: 3172390 - DNA, 21 bp, Homo sapiens
ccagcaatgacatctcagggg

SEQ ID NO: 3172391 - DNA, 22 bp, Homo sapiens
ccagcaatgacatctcaggggc

SEQ ID NO: 3172392 - DNA, 14 bp, Homo sapiens
ccagcacagagcgt

SEQ ID NO: 3172393 - DNA, 12 bp, Homo sapiens
ccagcacagggg

SEQ ID NO: 3172394 - DNA, 14 bp, Homo sapiens
ccagcacaggggcc

SEQ ID NO: 3172395 - DNA, 23 bp, Homo sapiens
ccagcaccctctcctgggggtgg

SEQ ID NO: 3172396 - DNA, 12 bp, Homo sapiens
ccagcaccgagc

SEQ ID NO: 3172397 - DNA, 15 bp, Homo sapiens
ccagcacctgcctcc

SEQ ID NO: 3172398 - DNA, 16 bp, Homo sapiens
ccagcacctgcctcct

SEQ ID NO: 3172399 - DNA, 22 bp, Homo sapiens
ccagcaccttctttctggactg

SEQ ID NO: 3172400 - DNA, 16 bp, Homo sapiens
ccagcactccccttgc

SEQ ID NO: 3172401 - DNA, 21 bp, Homo sapiens
ccagcactccccttgccttcc

SEQ ID NO: 3172402 - DNA, 23 bp, Homo sapiens
ccagcactccccttgccttcccc

SEQ ID NO: 3172403 - DNA, 15 bp, Homo sapiens
ccagcactttgggag

SEQ ID NO: 3172404 - DNA, 15 bp, Homo sapiens
ccagcagaagacaaa

SEQ ID NO: 3172405 - DNA, 22 bp, Homo sapiens
ccagcagaagacaaaaagacaa

SEQ ID NO: 3172406 - DNA, 15 bp, Homo sapiens
ccagcagcagcaggt

SEQ ID NO: 3172407 - DNA, 19 bp, Homo sapiens
ccagcagcggtaccccagg

SEQ ID NO: 3172408 - DNA, 23 bp, Homo sapiens
ccagcagctgcgggtctgaagga

SEQ ID NO: 3172409 - DNA, 19 bp, Homo sapiens
ccagcaggggggctgtgcc

SEQ ID NO: 3172410 - DNA, 21 bp, Homo sapiens
ccagcaggggggctgtgccaa

SEQ ID NO: 3172411 - DNA, 13 bp, Homo sapiens
ccagcaggtgtgg

SEQ ID NO: 3172412 - DNA, 23 bp, Homo sapiens
ccagcaggtgtggtggctcatgg

SEQ ID NO: 3172413 - DNA, 15 bp, Homo sapiens
ccagcagttttcaag

SEQ ID NO: 3172414 - DNA, 17 bp, Homo sapiens
ccagcatacattttctg

SEQ ID NO: 3172415 - DNA, 17 bp, Homo sapiens
ccagcatcactccccaa

SEQ ID NO: 3172416 - DNA, 23 bp, Homo sapiens
ccagcatccaccttggctctgcc

SEQ ID NO: 3172417 - DNA, 13 bp, Homo sapiens
ccagcatccctgg

SEQ ID NO: 3172418 - DNA, 19 bp, Homo sapiens
ccagcatccttttctgcag

SEQ ID NO: 3172419 - DNA, 20 bp, Homo sapiens
ccagcattccagacttcaaa

SEQ ID NO: 3172420 - DNA, 14 bp, Homo sapiens
ccagcattccagcc

SEQ ID NO: 3172421 - DNA, 18 bp, Homo sapiens
ccagcattccagcccctc

SEQ ID NO: 3172422 - DNA, 19 bp, Homo sapiens
ccagcattccagcccctct

SEQ ID NO: 3172423 - DNA, 13 bp, Homo sapiens
ccagcattgctgg

SEQ ID NO: 3172424 - DNA, 17 bp, Homo sapiens
ccagcattgctggttct

SEQ ID NO: 3172425 - DNA, 18 bp, Homo sapiens
ccagccaaaccctgtctg

SEQ ID NO: 3172426 - DNA, 12 bp, Homo sapiens
ccagccacagac

SEQ ID NO: 3172427 - DNA, 16 bp, Homo sapiens
ccagccacagacccct

SEQ ID NO: 3172428 - DNA, 17 bp, Homo sapiens
ccagccaggcgggctca

SEQ ID NO: 3172429 - DNA, 16 bp, Homo sapiens
ccagccagtcttgcct

SEQ ID NO: 3172430 - DNA, 21 bp, Homo sapiens
ccagccagttggtggggccag

SEQ ID NO: 3172431 - DNA, 16 bp, Homo sapiens
ccagccatcaaaatgc

SEQ ID NO: 3172432 - DNA, 16 bp, Homo sapiens
ccagccatctgcccag

SEQ ID NO: 3172433 - DNA, 17 bp, Homo sapiens
ccagccatgcccaggac

SEQ ID NO: 3172434 - DNA, 21 bp, Homo sapiens
ccagccattaccatggagaca

SEQ ID NO: 3172435 - DNA, 21 bp, Homo sapiens
ccagcccaaaggggacaggcc

SEQ ID NO: 3172436 - DNA, 22 bp, Homo sapiens
ccagcccaaaggggacaggcct

SEQ ID NO: 3172437 - DNA, 23 bp, Homo sapiens
ccagcccaaaggggacaggcctc

SEQ ID NO: 3172438 - DNA, 12 bp, Homo sapiens
ccagcccaagtc

SEQ ID NO: 3172439 - DNA, 14 bp, Homo sapiens
ccagcccaagtcca

SEQ ID NO: 3172440 - DNA, 16 bp, Homo sapiens
ccagcccaccctgctc

SEQ ID NO: 3172441 - DNA, 22 bp, Homo sapiens
ccagcccaccctgctcctcctg

SEQ ID NO: 3172442 - DNA, 14 bp, Homo sapiens
ccagcccagggtgg

SEQ ID NO: 3172443 - DNA, 16 bp, Homo sapiens
ccagcccatctcggag

SEQ ID NO: 3172444 - DNA, 20 bp, Homo sapiens
ccagcccatctcggagcatc

SEQ ID NO: 3172445 - DNA, 21 bp, Homo sapiens
ccagccccacacagctacagc

SEQ ID NO: 3172446 - DNA, 15 bp, Homo sapiens
ccagccccacccagg

SEQ ID NO: 3172447 - DNA, 17 bp, Homo sapiens
ccagccccacccaggag

SEQ ID NO: 3172448 - DNA, 19 bp, Homo sapiens
ccagccccacccccagcca

SEQ ID NO: 3172449 - DNA, 22 bp, Homo sapiens
ccagccccacccccagccaggc

SEQ ID NO: 3172450 - DNA, 16 bp, Homo sapiens
ccagccccactgccag

SEQ ID NO: 3172451 - DNA, 21 bp, Homo sapiens
ccagccccactgccagcagca

SEQ ID NO: 3172452 - DNA, 23 bp, Homo sapiens
ccagccccagacaacagcccagg

SEQ ID NO: 3172453 - DNA, 13 bp, Homo sapiens
ccagccccagtgc

SEQ ID NO: 3172454 - DNA, 17 bp, Homo sapiens
ccagccccagtgcccac

SEQ ID NO: 3172455 - DNA, 14 bp, Homo sapiens
ccagccccctggat

SEQ ID NO: 3172456 - DNA, 16 bp, Homo sapiens
ccagccccgctcaggc

SEQ ID NO: 3172457 - DNA, 17 bp, Homo sapiens
ccagccccgctcaggcc

SEQ ID NO: 3172458 - DNA, 17 bp, Homo sapiens
ccagccccggggtgagt

SEQ ID NO: 3172459 - DNA, 20 bp, Homo sapiens
ccagccccggtggctgggca

SEQ ID NO: 3172460 - DNA, 12 bp, Homo sapiens
ccagcccctaga

SEQ ID NO: 3172461 - DNA, 15 bp, Homo sapiens
ccagcccctagaaac

SEQ ID NO: 3172462 - DNA, 13 bp, Homo sapiens
ccagcccctagcc

SEQ ID NO: 3172463 - DNA, 15 bp, Homo sapiens
ccagcccctagccca

SEQ ID NO: 3172464 - DNA, 19 bp, Homo sapiens
ccagcccctagcccaggag

SEQ ID NO: 3172465 - DNA, 23 bp, Homo sapiens
ccagcccctagcccaggagagag

SEQ ID NO: 3172466 - DNA, 15 bp, Homo sapiens
ccagcccctcttccc

SEQ ID NO: 3172467 - DNA, 15 bp, Homo sapiens
ccagcccctgcccca

SEQ ID NO: 3172468 - DNA, 18 bp, Homo sapiens
ccagcccctgccccagcc

SEQ ID NO: 3172469 - DNA, 22 bp, Homo sapiens
ccagcccctgccccagcccaag

SEQ ID NO: 3172470 - DNA, 14 bp, Homo sapiens
ccagcccctgcctg

SEQ ID NO: 3172471 - DNA, 12 bp, Homo sapiens
ccagcccctgta

SEQ ID NO: 3172472 - DNA, 19 bp, Homo sapiens
ccagcccctgtatggcact

SEQ ID NO: 3172473 - DNA, 13 bp, Homo sapiens
ccagcccctgtcc

SEQ ID NO: 3172474 - DNA, 17 bp, Homo sapiens
ccagcccctgtcccacc

SEQ ID NO: 3172475 - DNA, 14 bp, Homo sapiens
ccagccccttcctg

SEQ ID NO: 3172476 - DNA, 17 bp, Homo sapiens
ccagcccgacagtgcca

SEQ ID NO: 3172477 - DNA, 21 bp, Homo sapiens
ccagcccgacagtgccatccc

SEQ ID NO: 3172478 - DNA, 15 bp, Homo sapiens
ccagcccgcaactct

SEQ ID NO: 3172479 - DNA, 13 bp, Homo sapiens
ccagcccggcctg

SEQ ID NO: 3172480 - DNA, 13 bp, Homo sapiens
ccagcccgggagc

SEQ ID NO: 3172481 - DNA, 15 bp, Homo sapiens
ccagcccgggagcct

SEQ ID NO: 3172482 - DNA, 16 bp, Homo sapiens
ccagccctatggatgt

SEQ ID NO: 3172483 - DNA, 21 bp, Homo sapiens
ccagccctccccatggagcca

SEQ ID NO: 3172484 - DNA, 21 bp, Homo sapiens
ccagccctccccgcagtggga

SEQ ID NO: 3172485 - DNA, 13 bp, Homo sapiens
ccagccctgcagc

SEQ ID NO: 3172486 - DNA, 13 bp, Homo sapiens
ccagccctgctgg

SEQ ID NO: 3172487 - DNA, 17 bp, Homo sapiens
ccagccctgctggggat

SEQ ID NO: 3172488 - DNA, 19 bp, Homo sapiens
ccagccctgctggggatcc

SEQ ID NO: 3172489 - DNA, 22 bp, Homo sapiens
ccagccctgctggggatccccg

SEQ ID NO: 3172490 - DNA, 17 bp, Homo sapiens
ccagccctggctctgca

SEQ ID NO: 3172491 - DNA, 16 bp, Homo sapiens
ccagcccttcaggaag

SEQ ID NO: 3172492 - DNA, 12 bp, Homo sapiens
ccagcccttcct

SEQ ID NO: 3172493 - DNA, 13 bp, Homo sapiens
ccagcccttcctc

SEQ ID NO: 3172494 - DNA, 15 bp, Homo sapiens
ccagcccttcctctc

SEQ ID NO: 3172495 - DNA, 18 bp, Homo sapiens
ccagcccttcctctcact

SEQ ID NO: 3172496 - DNA, 21 bp, Homo sapiens
ccagcccttcctctcactcct

SEQ ID NO: 3172497 - DNA, 17 bp, Homo sapiens
ccagccgaagctgcagg

SEQ ID NO: 3172498 - DNA, 23 bp, Homo sapiens
ccagccgccattgccaccaggag

SEQ ID NO: 3172499 - DNA, 18 bp, Homo sapiens
ccagccgccccagcccct

SEQ ID NO: 3172500 - DNA, 22 bp, Homo sapiens
ccagccggccaatggaaacctc

SEQ ID NO: 3172501 - DNA, 20 bp, Homo sapiens
ccagccggcctctctggcct

SEQ ID NO: 3172502 - DNA, 14 bp, Homo sapiens
ccagccggtgcctg

SEQ ID NO: 3172503 - DNA, 17 bp, Homo sapiens
ccagcctacaagctggc

SEQ ID NO: 3172504 - DNA, 12 bp, Homo sapiens
ccagcctagccc

SEQ ID NO: 3172505 - DNA, 14 bp, Homo sapiens
ccagcctcaccctt

SEQ ID NO: 3172506 - DNA, 15 bp, Homo sapiens
ccagcctcagtcctc

SEQ ID NO: 3172507 - DNA, 19 bp, Homo sapiens
ccagcctccgagagggaga

SEQ ID NO: 3172508 - DNA, 13 bp, Homo sapiens
ccagcctcctctg

SEQ ID NO: 3172509 - DNA, 19 bp, Homo sapiens
ccagcctcgttggaagagg

SEQ ID NO: 3172510 - DNA, 13 bp, Homo sapiens
ccagcctctcccg

SEQ ID NO: 3172511 - DNA, 16 bp, Homo sapiens
ccagcctctcccggct

SEQ ID NO: 3172512 - DNA, 22 bp, Homo sapiens
ccagcctctcccggctgcctgc

SEQ ID NO: 3172513 - DNA, 11 bp, Homo sapiens
ccagcctgagc

SEQ ID NO: 3172514 - DNA, 23 bp, Homo sapiens
ccagcctgcccaagcccaggcca

SEQ ID NO: 3172515 - DNA, 17 bp, Homo sapiens
ccagcctgccctccagc

SEQ ID NO: 3172516 - DNA, 13 bp, Homo sapiens
ccagtattgctga

SEQ ID NO: 3172517 - DNA, 16 bp, Homo sapiens
ccagtcaagaagaaaa

SEQ ID NO: 3172518 - DNA, 12 bp, Homo sapiens
ccagtcacattg

SEQ ID NO: 3172519 - DNA, 19 bp, Homo sapiens
ccagtcaggtagttgcaat

SEQ ID NO: 3172520 - DNA, 21 bp, Homo sapiens
ccagtccaaatgtcctccaga

SEQ ID NO: 3172521 - DNA, 15 bp, Homo sapiens
ccagtccaggctgcc

SEQ ID NO: 3172522 - DNA, 16 bp, Homo sapiens
ccagtccaggctgccg

SEQ ID NO: 3172523 - DNA, 23 bp, Homo sapiens
ccagtcccagggaaggtggggcc

SEQ ID NO: 3172524 - DNA, 19 bp, Homo sapiens
ccagtccccacccctgccc

SEQ ID NO: 3172525 - DNA, 18 bp, Homo sapiens
ccagtccccctgccccag

SEQ ID NO: 3172526 - DNA, 14 bp, Homo sapiens
ccagtcccctttgt

SEQ ID NO: 3172527 - DNA, 16 bp, Homo sapiens
ccagtcctcctgggag

SEQ ID NO: 3172528 - DNA, 17 bp, Homo sapiens
ccagtcctcctgggagc

SEQ ID NO: 3172529 - DNA, 19 bp, Homo sapiens
ccagtcctgcctggccagg

SEQ ID NO: 3172530 - DNA, 17 bp, Homo sapiens
ccagtcggccccatctc

SEQ ID NO: 3172531 - DNA, 18 bp, Homo sapiens
ccagtcggccccatctct

SEQ ID NO: 3172532 - DNA, 21 bp, Homo sapiens
ccagtctcccaggccccctgc

SEQ ID NO: 3172533 - DNA, 22 bp, Homo sapiens
ccagtctcccaggccccctgca

SEQ ID NO: 3172534 - DNA, 13 bp, Homo sapiens
ccagtctcctcac

SEQ ID NO: 3172535 - DNA, 16 bp, Homo sapiens
ccagtctctcttaaag

SEQ ID NO: 3172536 - DNA, 16 bp, Homo sapiens
ccagtctgggctgccg

SEQ ID NO: 3172537 - DNA, 19 bp, Homo sapiens
ccagtctgggctgccgggt

SEQ ID NO: 3172538 - DNA, 13 bp, Homo sapiens
ccagtctgtggat

SEQ ID NO: 3172539 - DNA, 21 bp, Homo sapiens
ccagtctgtggatcagagatg

SEQ ID NO: 3172540 - DNA, 22 bp, Homo sapiens
ccagtctgtgtttacagacaga

SEQ ID NO: 3172541 - DNA, 18 bp, Homo sapiens
ccagtcttccttgtctct

SEQ ID NO: 3172542 - DNA, 13 bp, Homo sapiens
ccagtcttgccta

SEQ ID NO: 3172543 - DNA, 16 bp, Homo sapiens
ccagtcttgcctaggc

SEQ ID NO: 3172544 - DNA, 17 bp, Homo sapiens
ccagtcttgcctaggcc

SEQ ID NO: 3172545 - DNA, 12 bp, Homo sapiens
ccagtcttgtgt

SEQ ID NO: 3172546 - DNA, 20 bp, Homo sapiens
ccagtctttaaaggcccagc

SEQ ID NO: 3172547 - DNA, 23 bp, Homo sapiens
ccagtctttaaaggcccagcccc

SEQ ID NO: 3172548 - DNA, 13 bp, Homo sapiens
ccagtgaaatgtg

SEQ ID NO: 3172549 - DNA, 16 bp, Homo sapiens
ccagtgaaatgtgaag

SEQ ID NO: 3172550 - DNA, 17 bp, Homo sapiens
ccagtgaaatgtgaagg

SEQ ID NO: 3172551 - DNA, 20 bp, Homo sapiens
ccagtgaacttacacttgga

SEQ ID NO: 3172552 - DNA, 23 bp, Homo sapiens
ccagtgaattcttgaaggaaaat

SEQ ID NO: 3172553 - DNA, 16 bp, Homo sapiens
ccagtgacacttcaga

SEQ ID NO: 3172554 - DNA, 23 bp, Homo sapiens
ccagtgacacttcagagagctgg

SEQ ID NO: 3172555 - DNA, 15 bp, Homo sapiens
ccagtgacagacagg

SEQ ID NO: 3172556 - DNA, 18 bp, Homo sapiens
ccagtgacagtcagggaa

SEQ ID NO: 3172557 - DNA, 17 bp, Homo sapiens
ccagtgacccctgacct

SEQ ID NO: 3172558 - DNA, 18 bp, Homo sapiens
ccagtgacctgctgggta

SEQ ID NO: 3172559 - DNA, 22 bp, Homo sapiens
ccagtgacctgctgggtaaact

SEQ ID NO: 3172560 - DNA, 12 bp, Homo sapiens
ccagtgactttt

SEQ ID NO: 3172561 - DNA, 18 bp, Homo sapiens
ccagtgcaacagcactgg

SEQ ID NO: 3172562 - DNA, 12 bp, Homo sapiens
ccagtgcagaaa

SEQ ID NO: 3172563 - DNA, 15 bp, Homo sapiens
ccagtgcagccactg

SEQ ID NO: 3172564 - DNA, 16 bp, Homo sapiens
ccagtgcagccactgg

SEQ ID NO: 3172565 - DNA, 13 bp, Homo sapiens
ccagtgccaagga

SEQ ID NO: 3172566 - DNA, 13 bp, Homo sapiens
ccagtgccactgc

SEQ ID NO: 3172567 - DNA, 17 bp, Homo sapiens
ccagtgccactgccccc

SEQ ID NO: 3172568 - DNA, 21 bp, Homo sapiens
ccagtgccattccactccact

SEQ ID NO: 3172569 - DNA, 24 bp, Homo sapiens
ccagtgccattccactccactcag

SEQ ID NO: 3172570 - DNA, 20 bp, Homo sapiens
ccagtgctccaggcacccag

SEQ ID NO: 3172571 - DNA, 14 bp, Homo sapiens
ccagtgctgccatg

SEQ ID NO: 3172572 - DNA, 16 bp, Homo sapiens
ccagtgctgccatgcc

SEQ ID NO: 3172573 - DNA, 17 bp, Homo sapiens
ccagtgctgccatgcca

SEQ ID NO: 3172574 - DNA, 21 bp, Homo sapiens
ccagtgctgccatgccactgc

SEQ ID NO: 3172575 - DNA, 13 bp, Homo sapiens
ccagtgctgctgt

SEQ ID NO: 3172576 - DNA, 14 bp, Homo sapiens
ccagtgctggattt

SEQ ID NO: 3172577 - DNA, 21 bp, Homo sapiens
ccagtggatgccacagcccag

SEQ ID NO: 3172578 - DNA, 12 bp, Homo sapiens
ccagtgggaggg

SEQ ID NO: 3172579 - DNA, 14 bp, Homo sapiens
ccagtgggaggggc

SEQ ID NO: 3172580 - DNA, 18 bp, Homo sapiens
ccagtgggcgggccatga

SEQ ID NO: 3172581 - DNA, 19 bp, Homo sapiens
ccagtgggcgggccatgag

SEQ ID NO: 3172582 - DNA, 15 bp, Homo sapiens
ccagtggggcctgtg

SEQ ID NO: 3172583 - DNA, 18 bp, Homo sapiens
ccagtggggcctgtggaa

SEQ ID NO: 3172584 - DNA, 22 bp, Homo sapiens
ccagtgtaatcccccaggagaa

SEQ ID NO: 3172585 - DNA, 18 bp, Homo sapiens
ccagtgtatcaggtcagg

SEQ ID NO: 3172586 - DNA, 22 bp, Homo sapiens
ccagtgtcaagttgtgcttgtt

SEQ ID NO: 3172587 - DNA, 16 bp, Homo sapiens
ccagtgtcacctctct

SEQ ID NO: 3172588 - DNA, 21 bp, Homo sapiens
ccagtgtcacctctctcagag

SEQ ID NO: 3172589 - DNA, 16 bp, Homo sapiens
ccagtgtcccctccac

SEQ ID NO: 3172590 - DNA, 22 bp, Homo sapiens
ccagtgtcccctccactgtcac

SEQ ID NO: 3172591 - DNA, 13 bp, Homo sapiens
ccagtgtctttct

SEQ ID NO: 3172592 - DNA, 12 bp, Homo sapiens
ccagtgtggaac

SEQ ID NO: 3172593 - DNA, 15 bp, Homo sapiens
ccagtgttgtttgta

SEQ ID NO: 3172594 - DNA, 21 bp, Homo sapiens
ccagtgtttgggatgaccagg

SEQ ID NO: 3172595 - DNA, 21 bp, Homo sapiens
ccagttaaggaccgtggccct

SEQ ID NO: 3172596 - DNA, 16 bp, Homo sapiens
ccagttaatttttcca

SEQ ID NO: 3172597 - DNA, 12 bp, Homo sapiens
ccagttcaaaaa

SEQ ID NO: 3172598 - DNA, 18 bp, Homo sapiens
ccagttcattgcactttg

SEQ ID NO: 3172599 - DNA, 23 bp, Homo sapiens
ccagttctaggggagaagagccc

SEQ ID NO: 3172600 - DNA, 19 bp, Homo sapiens
ccagttctgctcctctcca

SEQ ID NO: 3172601 - DNA, 22 bp, Homo sapiens
ccagttctgctcctctccaggc

SEQ ID NO: 3172602 - DNA, 18 bp, Homo sapiens
ccagttgatcaatgaata

SEQ ID NO: 3172603 - DNA, 22 bp, Homo sapiens
ccagttgccaaagttttgctgt

SEQ ID NO: 3172604 - DNA, 13 bp, Homo sapiens
ccagttgcccaga

SEQ ID NO: 3172605 - DNA, 17 bp, Homo sapiens
ccagttggatctctggt

SEQ ID NO: 3172606 - DNA, 20 bp, Homo sapiens
ccagttgggagcactggagt

SEQ ID NO: 3172607 - DNA, 15 bp, Homo sapiens
ccagttggtggggcc

SEQ ID NO: 3172608 - DNA, 23 bp, Homo sapiens
ccagttggtggggccaggccagg

SEQ ID NO: 3172609 - DNA, 15 bp, Homo sapiens
ccagttgtatttaat

SEQ ID NO: 3172610 - DNA, 22 bp, Homo sapiens
ccagtttcttcttacacttctt

SEQ ID NO: 3172611 - DNA, 14 bp, Homo sapiens
ccagttttcatttt

SEQ ID NO: 3172612 - DNA, 16 bp, Homo sapiens
ccagtttttgtttttg

SEQ ID NO: 3172613 - DNA, 21 bp, Homo sapiens
ccagtttttgtttttgcatga

SEQ ID NO: 3172614 - DNA, 18 bp, Homo sapiens
ccataaacggttcctggt

SEQ ID NO: 3172615 - DNA, 23 bp, Homo sapiens
ccataaagggtgtaggggccacc

SEQ ID NO: 3172616 - DNA, 22 bp, Homo sapiens
ccataaggtttcgtttctgtat

SEQ ID NO: 3172617 - DNA, 18 bp, Homo sapiens
ccataatagttagccctc

SEQ ID NO: 3172618 - DNA, 19 bp, Homo sapiens
ccataatagttagccctca

SEQ ID NO: 3172619 - DNA, 14 bp, Homo sapiens
ccataatctggact

SEQ ID NO: 3172620 - DNA, 13 bp, Homo sapiens
ccataatcttaga

SEQ ID NO: 3172621 - DNA, 14 bp, Homo sapiens
ccataatcttagag

SEQ ID NO: 3172622 - DNA, 19 bp, Homo sapiens
ccataattgctttgccaaa

SEQ ID NO: 3172623 - DNA, 20 bp, Homo sapiens
ccataattgctttgccaaaa

SEQ ID NO: 3172624 - DNA, 17 bp, Homo sapiens
ccataattttcttcatg

SEQ ID NO: 3172625 - DNA, 22 bp, Homo sapiens
ccatacagggtctcttccttcg

SEQ ID NO: 3172626 - DNA, 14 bp, Homo sapiens
ccatactcagcctg

SEQ ID NO: 3172627 - DNA, 15 bp, Homo sapiens
ccatactcatttcta

SEQ ID NO: 3172628 - DNA, 18 bp, Homo sapiens
ccatacttttgagagggg

SEQ ID NO: 3172629 - DNA, 16 bp, Homo sapiens
ccatacttttggctcc

SEQ ID NO: 3172630 - DNA, 11 bp, Homo sapiens
ccatagaaaag

SEQ ID NO: 3172631 - DNA, 22 bp, Homo sapiens
ccatagagcccctcctggttga

SEQ ID NO: 3172632 - DNA, 14 bp, Homo sapiens
ccatagatcttctg

SEQ ID NO: 3172633 - DNA, 15 bp, Homo sapiens
ccatagatcttctga

SEQ ID NO: 3172634 - DNA, 16 bp, Homo sapiens
ccatagatcttctgaa

SEQ ID NO: 3172635 - DNA, 20 bp, Homo sapiens
ccatagatcttctgaaatga

SEQ ID NO: 3172636 - DNA, 18 bp, Homo sapiens
ccatagccaccccagaaa

SEQ ID NO: 3172637 - DNA, 13 bp, Homo sapiens
ccatagtaactga

SEQ ID NO: 3172638 - DNA, 15 bp, Homo sapiens
ccatagtaactgaca

SEQ ID NO: 3172639 - DNA, 21 bp, Homo sapiens
ccatagtaactgacatgatta

SEQ ID NO: 3172640 - DNA, 17 bp, Homo sapiens
ccatagtcaatccaaga

SEQ ID NO: 3172641 - DNA, 18 bp, Homo sapiens
ccatagtttgggtatttt

SEQ ID NO: 3172642 - DNA, 18 bp, Homo sapiens
cccacgagtcacctgcaa

SEQ ID NO: 3172643 - DNA, 19 bp, Homo sapiens
cccacgagtcacctgcaag

SEQ ID NO: 3172644 - DNA, 20 bp, Homo sapiens
cccacgagtcacctgcaagc

SEQ ID NO: 3172645 - DNA, 13 bp, Homo sapiens
cccacgatcccct

SEQ ID NO: 3172646 - DNA, 15 bp, Homo sapiens
cccacgattggccac

SEQ ID NO: 3172647 - DNA, 21 bp, Homo sapiens
cccacgattttctccagctca

SEQ ID NO: 3172648 - DNA, 14 bp, Homo sapiens
cccacgcagaggac

SEQ ID NO: 3172649 - DNA, 12 bp, Homo sapiens
cccacgcccgca

SEQ ID NO: 3172650 - DNA, 17 bp, Homo sapiens
cccacgcccgcaccccc

SEQ ID NO: 3172651 - DNA, 18 bp, Homo sapiens
cccacgcccgcacccccg

SEQ ID NO: 3172652 - DNA, 17 bp, Homo sapiens
cccacgccctcccctcc

SEQ ID NO: 3172653 - DNA, 22 bp, Homo sapiens
cccacgcctgtcctcctggaag

SEQ ID NO: 3172654 - DNA, 15 bp, Homo sapiens
cccacgctcaccccc

SEQ ID NO: 3172655 - DNA, 14 bp, Homo sapiens
cccacggagccctc

SEQ ID NO: 3172656 - DNA, 17 bp, Homo sapiens
cccacggagccctccct

SEQ ID NO: 3172657 - DNA, 16 bp, Homo sapiens
cccacggccgctccag

SEQ ID NO: 3172658 - DNA, 21 bp, Homo sapiens
cccacggccgctccaggggtg

SEQ ID NO: 3172659 - DNA, 19 bp, Homo sapiens
cccacgtgtcttccacttt

SEQ ID NO: 3172660 - DNA, 16 bp, Homo sapiens
cccacgttctcacacc

SEQ ID NO: 3172661 - DNA, 15 bp, Homo sapiens
cccactcaccagggt

SEQ ID NO: 3172662 - DNA, 16 bp, Homo sapiens
cccactcaccagggtc

SEQ ID NO: 3172663 - DNA, 15 bp, Homo sapiens
cccactccctgctct

SEQ ID NO: 3172664 - DNA, 12 bp, Homo sapiens
cccactctacct

SEQ ID NO: 3172665 - DNA, 20 bp, Homo sapiens
cccactctacctccttagct

SEQ ID NO: 3172666 - DNA, 11 bp, Homo sapiens
cccactctccc

SEQ ID NO: 3172667 - DNA, 15 bp, Homo sapiens
cccactcttgaagag

SEQ ID NO: 3172668 - DNA, 16 bp, Homo sapiens
cccactgacagcctcc

SEQ ID NO: 3172669 - DNA, 12 bp, Homo sapiens
cccactgatgct

SEQ ID NO: 3172670 - DNA, 15 bp, Homo sapiens
cccactgcaatcctg

SEQ ID NO: 3172671 - DNA, 18 bp, Homo sapiens
cccactgcaatcctgtct

SEQ ID NO: 3172672 - DNA, 12 bp, Homo sapiens
cccactgcccac

SEQ ID NO: 3172673 - DNA, 16 bp, Homo sapiens
cccactgcctcaggtt

SEQ ID NO: 3172674 - DNA, 18 bp, Homo sapiens
cccactgcggggagacag

SEQ ID NO: 3172675 - DNA, 12 bp, Homo sapiens
cccactgctctg

SEQ ID NO: 3172676 - DNA, 20 bp, Homo sapiens
cccactgggccagccctgca

SEQ ID NO: 3172677 - DNA, 17 bp, Homo sapiens
cccactgtatgatttat

SEQ ID NO: 3172678 - DNA, 22 bp, Homo sapiens
cccactgtcaggcctctgagcc

SEQ ID NO: 3172679 - DNA, 22 bp, Homo sapiens
cccactgtccccctacccaccg

SEQ ID NO: 3172680 - DNA, 22 bp, Homo sapiens
cccactgtttctcttgagctgg

SEQ ID NO: 3172681 - DNA, 14 bp, Homo sapiens
cccacttagccgca

SEQ ID NO: 3172682 - DNA, 19 bp, Homo sapiens
cccacttagccgcaccctg

SEQ ID NO: 3172683 - DNA, 14 bp, Homo sapiens
cccacttccattcc

SEQ ID NO: 3172684 - DNA, 12 bp, Homo sapiens
cccacttctgcc

SEQ ID NO: 3172685 - DNA, 13 bp, Homo sapiens
cccacttgcctct

SEQ ID NO: 3172686 - DNA, 23 bp, Homo sapiens
cccacttttacgttgtgtccctc

SEQ ID NO: 3172687 - DNA, 20 bp, Homo sapiens
cccagaaaaaaaaaaactta

SEQ ID NO: 3172688 - DNA, 15 bp, Homo sapiens
cccagaaaggagact

SEQ ID NO: 3172689 - DNA, 15 bp, Homo sapiens
cccagaactgccccc

SEQ ID NO: 3172690 - DNA, 19 bp, Homo sapiens
cccagaactgcccccactg

SEQ ID NO: 3172691 - DNA, 16 bp, Homo sapiens
cccagaatcccagccg

SEQ ID NO: 3172692 - DNA, 17 bp, Homo sapiens
cccagacaacagcccag

SEQ ID NO: 3172693 - DNA, 20 bp, Homo sapiens
cccagacaacagcccaggca

SEQ ID NO: 3172694 - DNA, 16 bp, Homo sapiens
cccagacaaccaaaac

SEQ ID NO: 3172695 - DNA, 16 bp, Homo sapiens
cccagaccccagggca

SEQ ID NO: 3172696 - DNA, 18 bp, Homo sapiens
cccagacccctctggcca

SEQ ID NO: 3172697 - DNA, 12 bp, Homo sapiens
cccagactttag

SEQ ID NO: 3172698 - DNA, 20 bp, Homo sapiens
cccagactttagtgccctgc

SEQ ID NO: 3172699 - DNA, 21 bp, Homo sapiens
cccagactttagtgccctgcc

SEQ ID NO: 3172700 - DNA, 22 bp, Homo sapiens
cccagactttagtgccctgccc

SEQ ID NO: 3172701 - DNA, 20 bp, Homo sapiens
cccagagaccaggctgtgtc

SEQ ID NO: 3172702 - DNA, 14 bp, Homo sapiens
cccagagagaggat

SEQ ID NO: 3172703 - DNA, 16 bp, Homo sapiens
cccagagatgccagcc

SEQ ID NO: 3172704 - DNA, 17 bp, Homo sapiens
cccagagattcccaagc

SEQ ID NO: 3172705 - DNA, 16 bp, Homo sapiens
cccagagccacctgga

SEQ ID NO: 3172706 - DNA, 20 bp, Homo sapiens
cccagagcccctcctccagc

SEQ ID NO: 3172707 - DNA, 20 bp, Homo sapiens
cccagagcctggctgcccat

SEQ ID NO: 3172708 - DNA, 20 bp, Homo sapiens
cccagagcgaggaaaggatt

SEQ ID NO: 3172709 - DNA, 22 bp, Homo sapiens
cccagagctgtttatggcctca

SEQ ID NO: 3172710 - DNA, 20 bp, Homo sapiens
cccagaggagccaccagttc

SEQ ID NO: 3172711 - DNA, 14 bp, Homo sapiens
cccagaggccctgg

SEQ ID NO: 3172712 - DNA, 15 bp, Homo sapiens
cccagaggccctgga

SEQ ID NO: 3172713 - DNA, 15 bp, Homo sapiens
cccagaggctgagtt

SEQ ID NO: 3172714 - DNA, 16 bp, Homo sapiens
cccagagggcccaggc

SEQ ID NO: 3172715 - DNA, 18 bp, Homo sapiens
cccagagggcccaggcag

SEQ ID NO: 3172716 - DNA, 23 bp, Homo sapiens
cccagagggcccaggcaggccac

SEQ ID NO: 3172717 - DNA, 13 bp, Homo sapiens
cccagaggtaaca

SEQ ID NO: 3172718 - DNA, 18 bp, Homo sapiens
cccagaggtaacagaaca

SEQ ID NO: 3172719 - DNA, 23 bp, Homo sapiens
cccagaggtaacagaacagcttc

SEQ ID NO: 3172720 - DNA, 16 bp, Homo sapiens
cccagaggtccagccc

SEQ ID NO: 3172721 - DNA, 18 bp, Homo sapiens
cccagaggtccagcccat

SEQ ID NO: 3172722 - DNA, 20 bp, Homo sapiens
cccagaggttatctgcctgg

SEQ ID NO: 3172723 - DNA, 22 bp, Homo sapiens
cccagaggttatctgcctggcc

SEQ ID NO: 3172724 - DNA, 19 bp, Homo sapiens
cccagagtggagtctgagt

SEQ ID NO: 3172725 - DNA, 14 bp, Homo sapiens
cccagataccagcc

SEQ ID NO: 3172726 - DNA, 19 bp, Homo sapiens
cccagatagagctgggtgg

SEQ ID NO: 3172727 - DNA, 17 bp, Homo sapiens
cccagatctcccactgc

SEQ ID NO: 3172728 - DNA, 15 bp, Homo sapiens
cccagatctgcctgg

SEQ ID NO: 3172729 - DNA, 18 bp, Homo sapiens
cccagattttgctgtata

SEQ ID NO: 3172730 - DNA, 15 bp, Homo sapiens
cccagcaagcgggag

SEQ ID NO: 3172731 - DNA, 23 bp, Homo sapiens
cccagcaagtgagagctgggtgt

SEQ ID NO: 3172732 - DNA, 18 bp, Homo sapiens
cccagcacagcttgacct

SEQ ID NO: 3172733 - DNA, 16 bp, Homo sapiens
cccagcacctgcctcc

SEQ ID NO: 3172734 - DNA, 15 bp, Homo sapiens
cccagcactttggga

SEQ ID NO: 3172735 - DNA, 21 bp, Homo sapiens
cccagcactttgggaggctga

SEQ ID NO: 3172736 - DNA, 18 bp, Homo sapiens
cccagcagcccaagctta

SEQ ID NO: 3172737 - DNA, 12 bp, Homo sapiens
cccagcagccct

SEQ ID NO: 3172738 - DNA, 16 bp, Homo sapiens
cccagcagccctcaac

SEQ ID NO: 3172739 - DNA, 17 bp, Homo sapiens
cccagcagccctcaaca

SEQ ID NO: 3172740 - DNA, 22 bp, Homo sapiens
cccagcagccctcaacaggccc

SEQ ID NO: 3172741 - DNA, 12 bp, Homo sapiens
cccagcagttct

SEQ ID NO: 3172742 - DNA, 17 bp, Homo sapiens
cccagcatcactcccca

SEQ ID NO: 3172743 - DNA, 15 bp, Homo sapiens
cccagcatccctgga

SEQ ID NO: 3172744 - DNA, 17 bp, Homo sapiens
cccagcatccctggagc

SEQ ID NO: 3172745 - DNA, 20 bp, Homo sapiens
cccagcatccctggagcagg

SEQ ID NO: 3172746 - DNA, 13 bp, Homo sapiens
cccagcatctccc

SEQ ID NO: 3172747 - DNA, 17 bp, Homo sapiens
cccagcatctcccagca

SEQ ID NO: 3172748 - DNA, 19 bp, Homo sapiens
cccagcatctcccagcaag

SEQ ID NO: 3172749 - DNA, 22 bp, Homo sapiens
cccagccagatggactccagcc

SEQ ID NO: 3172750 - DNA, 12 bp, Homo sapiens
cccagccaggcc

SEQ ID NO: 3172751 - DNA, 14 bp, Homo sapiens
cccagccaggccaa

SEQ ID NO: 3172752 - DNA, 23 bp, Homo sapiens
cccagccagttggtggggccagg

SEQ ID NO: 3172753 - DNA, 13 bp, Homo sapiens
cccagccatctgc

SEQ ID NO: 3172754 - DNA, 23 bp, Homo sapiens
cccagccatctgcccaggggtgc

SEQ ID NO: 3172755 - DNA, 16 bp, Homo sapiens
cccagccatgcccagg

SEQ ID NO: 3172756 - DNA, 10 bp, Homo sapiens
cccagccatt

SEQ ID NO: 3172757 - DNA, 19 bp, Homo sapiens
cccagccattaccatggag

SEQ ID NO: 3172758 - DNA, 12 bp, Homo sapiens
cccagcccaagt

SEQ ID NO: 3172759 - DNA, 14 bp, Homo sapiens
cccagcccaagtcc

SEQ ID NO: 3172760 - DNA, 14 bp, Homo sapiens
cccagcccacttct

SEQ ID NO: 3172761 - DNA, 17 bp, Homo sapiens
cccagcccacttctgcc

SEQ ID NO: 3172762 - DNA, 10 bp, Homo sapiens
cccagcccag

SEQ ID NO: 3172763 - DNA, 11 bp, Homo sapiens
cccagcccaga

SEQ ID NO: 3172764 - DNA, 12 bp, Homo sapiens
cccagcccagag

SEQ ID NO: 3172765 - DNA, 19 bp, Homo sapiens
cccagcccagagccacctg

SEQ ID NO: 3172766 - DNA, 21 bp, Homo sapiens
cccagcccagagccacctgga

SEQ ID NO: 3172767 - DNA, 22 bp, Homo sapiens
cccagcccatccattaggccag

SEQ ID NO: 3172768 - DNA, 13 bp, Homo sapiens
cccagcccctaga

SEQ ID NO: 3172769 - DNA, 22 bp, Homo sapiens
ccccgcctggccagggcagggc

SEQ ID NO: 3172770 - DNA, 16 bp, Homo sapiens
ccccgcggtgctctgg

SEQ ID NO: 3172771 - DNA, 18 bp, Homo sapiens
ccccgcggtgctctggcg

SEQ ID NO: 3172772 - DNA, 17 bp, Homo sapiens
ccccgctcccgctccca

SEQ ID NO: 3172773 - DNA, 20 bp, Homo sapiens
ccccgctgtaagctcctttg

SEQ ID NO: 3172774 - DNA, 19 bp, Homo sapiens
ccccggaggaagcttgggg

SEQ ID NO: 3172775 - DNA, 14 bp, Homo sapiens
ccccggcaccctct

SEQ ID NO: 3172776 - DNA, 13 bp, Homo sapiens
ccccggcaggccc

SEQ ID NO: 3172777 - DNA, 14 bp, Homo sapiens
ccccggcaggccct

SEQ ID NO: 3172778 - DNA, 18 bp, Homo sapiens
ccccggcaggccctgcag

SEQ ID NO: 3172779 - DNA, 12 bp, Homo sapiens
ccccggccacct

SEQ ID NO: 3172780 - DNA, 16 bp, Homo sapiens
ccccggccccagccag

SEQ ID NO: 3172781 - DNA, 18 bp, Homo sapiens
ccccggccccggccccag

SEQ ID NO: 3172782 - DNA, 14 bp, Homo sapiens
ccccggcctcaggg

SEQ ID NO: 3172783 - DNA, 15 bp, Homo sapiens
ccccgggctctctgc

SEQ ID NO: 3172784 - DNA, 16 bp, Homo sapiens
ccccggggctggcaag

SEQ ID NO: 3172785 - DNA, 15 bp, Homo sapiens
ccccggtggctgggc

SEQ ID NO: 3172786 - DNA, 18 bp, Homo sapiens
ccccggtgtgcggtgcat

SEQ ID NO: 3172787 - DNA, 21 bp, Homo sapiens
ccccgtactaggttggacagc

SEQ ID NO: 3172788 - DNA, 22 bp, Homo sapiens
ccccgtgtcctctccctgccaa

SEQ ID NO: 3172789 - DNA, 21 bp, Homo sapiens
ccccgttccctgtcagaggct

SEQ ID NO: 3172790 - DNA, 13 bp, Homo sapiens
ccccgtttccctg

SEQ ID NO: 3172791 - DNA, 21 bp, Homo sapiens
cccctaagtggattggctttg

SEQ ID NO: 3172792 - DNA, 13 bp, Homo sapiens
cccctacccaccg

SEQ ID NO: 3172793 - DNA, 15 bp, Homo sapiens
cccctacgcgccttg

SEQ ID NO: 3172794 - DNA, 13 bp, Homo sapiens
cccctagcccagg

SEQ ID NO: 3172795 - DNA, 18 bp, Homo sapiens
cccctagcccaggagaga

SEQ ID NO: 3172796 - DNA, 19 bp, Homo sapiens
cccctaggatgctgcagca

SEQ ID NO: 3172797 - DNA, 13 bp, Homo sapiens
cccctagttccct

SEQ ID NO: 3172798 - DNA, 15 bp, Homo sapiens
cccctatcctctgag

SEQ ID NO: 3172799 - DNA, 15 bp, Homo sapiens
cccctatccttggca

SEQ ID NO: 3172800 - DNA, 14 bp, Homo sapiens
cccctatttattga

SEQ ID NO: 3172801 - DNA, 12 bp, Homo sapiens
cccctcaacctc

SEQ ID NO: 3172802 - DNA, 21 bp, Homo sapiens
cccctcaacctcctgtggaac

SEQ ID NO: 3172803 - DNA, 15 bp, Homo sapiens
cccctcaagccccag

SEQ ID NO: 3172804 - DNA, 13 bp, Homo sapiens
cccctcacccctc

SEQ ID NO: 3172805 - DNA, 16 bp, Homo sapiens
cccctcaccctgcctt

SEQ ID NO: 3172806 - DNA, 12 bp, Homo sapiens
cccctcactctg

SEQ ID NO: 3172807 - DNA, 20 bp, Homo sapiens
cccctcagatgatctctcca

SEQ ID NO: 3172808 - DNA, 13 bp, Homo sapiens
cccctcagctcca

SEQ ID NO: 3172809 - DNA, 14 bp, Homo sapiens
cccctccaggaaga

SEQ ID NO: 3172810 - DNA, 13 bp, Homo sapiens
cccctccaggaga

SEQ ID NO: 3172811 - DNA, 12 bp, Homo sapiens
cccctccatgtg

SEQ ID NO: 3172812 - DNA, 11 bp, Homo sapiens
cccctcccagc

SEQ ID NO: 3172813 - DNA, 11 bp, Homo sapiens
cccctcccatc

SEQ ID NO: 3172814 - DNA, 18 bp, Homo sapiens
cccctccccgcctggcca

SEQ ID NO: 3172815 - DNA, 15 bp, Homo sapiens
cccctcccctccttg

SEQ ID NO: 3172816 - DNA, 17 bp, Homo sapiens
cccctccctctgcccca

SEQ ID NO: 3172817 - DNA, 15 bp, Homo sapiens
cccctccctggctcc

SEQ ID NO: 3172818 - DNA, 17 bp, Homo sapiens
cccctccgccctgccac

SEQ ID NO: 3172819 - DNA, 12 bp, Homo sapiens
cccctcctagac

SEQ ID NO: 3172820 - DNA, 14 bp, Homo sapiens
cccctcctgctcct

SEQ ID NO: 3172821 - DNA, 19 bp, Homo sapiens
cccctcctgctcctccctg

SEQ ID NO: 3172822 - DNA, 13 bp, Homo sapiens
cccctcctggcaa

SEQ ID NO: 3172823 - DNA, 13 bp, Homo sapiens
cccctccttcaga

SEQ ID NO: 3172824 - DNA, 13 bp, Homo sapiens
cccctcgccagct

SEQ ID NO: 3172825 - DNA, 16 bp, Homo sapiens
cccctcgccagcttct

SEQ ID NO: 3172826 - DNA, 20 bp, Homo sapiens
cccctcgccagcttctcctg

SEQ ID NO: 3172827 - DNA, 18 bp, Homo sapiens
cccctcgtcctgtcccag

SEQ ID NO: 3172828 - DNA, 13 bp, Homo sapiens
cccctctcctgcc

SEQ ID NO: 3172829 - DNA, 19 bp, Homo sapiens
cccctctccttcctgtgtg

SEQ ID NO: 3172830 - DNA, 21 bp, Homo sapiens
cccctctgccggtcgggcagc

SEQ ID NO: 3172831 - DNA, 19 bp, Homo sapiens
cccctctggtcgctcctgc

SEQ ID NO: 3172832 - DNA, 20 bp, Homo sapiens
cccctctggtcgctcctgcc

SEQ ID NO: 3172833 - DNA, 11 bp, Homo sapiens
cccctctgtag

SEQ ID NO: 3172834 - DNA, 19 bp, Homo sapiens
cccctcttcttctttcctt

SEQ ID NO: 3172835 - DNA, 18 bp, Homo sapiens
cccctgacctcactgtga

SEQ ID NO: 3172836 - DNA, 16 bp, Homo sapiens
cccctgaggactggag

SEQ ID NO: 3172837 - DNA, 13 bp, Homo sapiens
cccctgcaaagac

SEQ ID NO: 3172838 - DNA, 22 bp, Homo sapiens
cccctgcaacttccgctgaggg

SEQ ID NO: 3172839 - DNA, 11 bp, Homo sapiens
cccctgcacag

SEQ ID NO: 3172840 - DNA, 13 bp, Homo sapiens
cccctgcagcacg

SEQ ID NO: 3172841 - DNA, 14 bp, Homo sapiens
cccctgcagcacgg

SEQ ID NO: 3172842 - DNA, 22 bp, Homo sapiens
cccctgcagcacggacaataaa

SEQ ID NO: 3172843 - DNA, 24 bp, Homo sapiens
cccctgcatctatcgagtttgcaa

SEQ ID NO: 3172844 - DNA, 14 bp, Homo sapiens
cccctgccccagcc

SEQ ID NO: 3172845 - DNA, 19 bp, Homo sapiens
cccctgcccggctgcggaa

SEQ ID NO: 3172846 - DNA, 23 bp, Homo sapiens
cccctgcccggtggtttgccatg

SEQ ID NO: 3172847 - DNA, 13 bp, Homo sapiens
cccctgccctcgt

SEQ ID NO: 3172848 - DNA, 21 bp, Homo sapiens
cccctgccctcgtggccagcc

SEQ ID NO: 3172849 - DNA, 14 bp, Homo sapiens
cccctgccctgcac

SEQ ID NO: 3172850 - DNA, 15 bp, Homo sapiens
cccctgccctgctgc

SEQ ID NO: 3172851 - DNA, 15 bp, Homo sapiens
cccctgcctggaact

SEQ ID NO: 3172852 - DNA, 14 bp, Homo sapiens
cccctgcctgggtt

SEQ ID NO: 3172853 - DNA, 24 bp, Homo sapiens
cccctgcggtcaggctgggcagcc

SEQ ID NO: 3172854 - DNA, 21 bp, Homo sapiens
cccctgcgtgggggccagtca

SEQ ID NO: 3172855 - DNA, 16 bp, Homo sapiens
cccctgctcccagcct

SEQ ID NO: 3172856 - DNA, 15 bp, Homo sapiens
cccctgctcccattc

SEQ ID NO: 3172857 - DNA, 21 bp, Homo sapiens
cccctgctcccattcctccct

SEQ ID NO: 3172858 - DNA, 12 bp, Homo sapiens
cccctgctgtct

SEQ ID NO: 3172859 - DNA, 18 bp, Homo sapiens
cccctgctgtgctgctca

SEQ ID NO: 3172860 - DNA, 19 bp, Homo sapiens
cccctgctgtgctgctcaa

SEQ ID NO: 3172861 - DNA, 11 bp, Homo sapiens
cccctgcttct

SEQ ID NO: 3172862 - DNA, 15 bp, Homo sapiens
cccctgcttctccag

SEQ ID NO: 3172863 - DNA, 15 bp, Homo sapiens
cccctggactgggag

SEQ ID NO: 3172864 - DNA, 20 bp, Homo sapiens
cccctggcagcacagcccag

SEQ ID NO: 3172865 - DNA, 21 bp, Homo sapiens
cccctggcagcacagcccagg

SEQ ID NO: 3172866 - DNA, 15 bp, Homo sapiens
cccctggcccatctc

SEQ ID NO: 3172867 - DNA, 22 bp, Homo sapiens
cccctggctgactggccagttg

SEQ ID NO: 3172868 - DNA, 18 bp, Homo sapiens
cccctggcttttcactgc

SEQ ID NO: 3172869 - DNA, 18 bp, Homo sapiens
cccctgggcttggcctgc

SEQ ID NO: 3172870 - DNA, 21 bp, Homo sapiens
cccctgggcttggcctgctgt

SEQ ID NO: 3172871 - DNA, 23 bp, Homo sapiens
cccctgggcttggcctgctgtga

SEQ ID NO: 3172872 - DNA, 13 bp, Homo sapiens
cccctggggtggc

SEQ ID NO: 3172873 - DNA, 20 bp, Homo sapiens
cccctgggtgggtggtgggg

SEQ ID NO: 3172874 - DNA, 23 bp, Homo sapiens
cccctgggtgggtggtggggagg

SEQ ID NO: 3172875 - DNA, 20 bp, Homo sapiens
cccctggtggacagtcctgg

SEQ ID NO: 3172876 - DNA, 14 bp, Homo sapiens
cccctgtactccag

SEQ ID NO: 3172877 - DNA, 15 bp, Homo sapiens
cccctgtcctcactg

SEQ ID NO: 3172878 - DNA, 19 bp, Homo sapiens
cccctgtgctccgtgcctc

SEQ ID NO: 3172879 - DNA, 13 bp, Homo sapiens
cccctgtggccaa

SEQ ID NO: 3172880 - DNA, 11 bp, Homo sapiens
cccctgttcta

SEQ ID NO: 3172881 - DNA, 19 bp, Homo sapiens
cccctgtttcaatcactgt

SEQ ID NO: 3172882 - DNA, 17 bp, Homo sapiens
ccccttaggccccgtgg

SEQ ID NO: 3172883 - DNA, 16 bp, Homo sapiens
ccccttccccttctgt

SEQ ID NO: 3172884 - DNA, 19 bp, Homo sapiens
ccccttcctaaatatccaa

SEQ ID NO: 3172885 - DNA, 13 bp, Homo sapiens
ccccttcctgggt

SEQ ID NO: 3172886 - DNA, 19 bp, Homo sapiens
ccccttcctttggtgcctc

SEQ ID NO: 3172887 - DNA, 17 bp, Homo sapiens
ccccttcgctcctgtgt

SEQ ID NO: 3172888 - DNA, 19 bp, Homo sapiens
ccccttcgctcctgtgtct

SEQ ID NO: 3172889 - DNA, 21 bp, Homo sapiens
ccccttctacatttcttagac

SEQ ID NO: 3172890 - DNA, 16 bp, Homo sapiens
ccccttctctccctgc

SEQ ID NO: 3172891 - DNA, 14 bp, Homo sapiens
ccccttctctcctc

SEQ ID NO: 3172892 - DNA, 19 bp, Homo sapiens
ccccttctctcctccccaa

SEQ ID NO: 3172893 - DNA, 13 bp, Homo sapiens
ccccttcttgggc

SEQ ID NO: 3172894 - DNA, 20 bp, Homo sapiens
ccccttgaggattgtggaaa

SEQ ID NO: 3172895 - DNA, 13 bp, Homo sapiens
ccccttgccctcc

SEQ ID NO: 3172896 - DNA, 21 bp, Homo sapiens
ccccttgccctccgcctggga

SEQ ID NO: 3172897 - DNA, 20 bp, Homo sapiens
ccctgtcgagacacttgcct

SEQ ID NO: 3172898 - DNA, 15 bp, Homo sapiens
ccctgtctctgcatc

SEQ ID NO: 3172899 - DNA, 19 bp, Homo sapiens
ccctgtctgctaggcgctg

SEQ ID NO: 3172900 - DNA, 14 bp, Homo sapiens
ccctgtcttcacct

SEQ ID NO: 3172901 - DNA, 16 bp, Homo sapiens
ccctgtcttcacctgc

SEQ ID NO: 3172902 - DNA, 17 bp, Homo sapiens
ccctgtcttcacctgcc

SEQ ID NO: 3172903 - DNA, 18 bp, Homo sapiens
ccctgtcttcacctgcca

SEQ ID NO: 3172904 - DNA, 20 bp, Homo sapiens
ccctgtcttcacctgccacc

SEQ ID NO: 3172905 - DNA, 16 bp, Homo sapiens
ccctgtcttctgggca

SEQ ID NO: 3172906 - DNA, 18 bp, Homo sapiens
ccctgtgacatggtgcct

SEQ ID NO: 3172907 - DNA, 14 bp, Homo sapiens
ccctgtgccctgca

SEQ ID NO: 3172908 - DNA, 21 bp, Homo sapiens
ccctgtgccctgcacgtatac

SEQ ID NO: 3172909 - DNA, 16 bp, Homo sapiens
ccctgtgctggtgtcc

SEQ ID NO: 3172910 - DNA, 20 bp, Homo sapiens
ccctgtgctggtgtcctgac

SEQ ID NO: 3172911 - DNA, 13 bp, Homo sapiens
ccctgtggccaac

SEQ ID NO: 3172912 - DNA, 15 bp, Homo sapiens
ccctgtggccctggc

SEQ ID NO: 3172913 - DNA, 19 bp, Homo sapiens
ccctgtggccgactctgca

SEQ ID NO: 3172914 - DNA, 16 bp, Homo sapiens
ccctgtggccgccacc

SEQ ID NO: 3172915 - DNA, 17 bp, Homo sapiens
ccctgtggccgccacct

SEQ ID NO: 3172916 - DNA, 18 bp, Homo sapiens
ccctgtggccgccacctg

SEQ ID NO: 3172917 - DNA, 23 bp, Homo sapiens
ccctgtggggatctcaggggctg

SEQ ID NO: 3172918 - DNA, 22 bp, Homo sapiens
ccctgtgggggtggccatccct

SEQ ID NO: 3172919 - DNA, 16 bp, Homo sapiens
ccctgtgtcatttcaa

SEQ ID NO: 3172920 - DNA, 18 bp, Homo sapiens
ccctgtgtgtaggctggg

SEQ ID NO: 3172921 - DNA, 13 bp, Homo sapiens
ccctgtgttgtct

SEQ ID NO: 3172922 - DNA, 23 bp, Homo sapiens
ccctgtgttgtctctagagcagg

SEQ ID NO: 3172923 - DNA, 13 bp, Homo sapiens
ccctgttaaacag

SEQ ID NO: 3172924 - DNA, 13 bp, Homo sapiens
ccctgttcactct

SEQ ID NO: 3172925 - DNA, 22 bp, Homo sapiens
ccctgttcactctacttagcat

SEQ ID NO: 3172926 - DNA, 18 bp, Homo sapiens
ccctgttcatgtgcctct

SEQ ID NO: 3172927 - DNA, 11 bp, Homo sapiens
ccctgttctaa

SEQ ID NO: 3172928 - DNA, 23 bp, Homo sapiens
ccctgttctaagggggaggggaa

SEQ ID NO: 3172929 - DNA, 20 bp, Homo sapiens
ccctgttctccctttctctc

SEQ ID NO: 3172930 - DNA, 21 bp, Homo sapiens
ccctgttcttcctccagctgc

SEQ ID NO: 3172931 - DNA, 19 bp, Homo sapiens
ccctgttggcagctctagc

SEQ ID NO: 3172932 - DNA, 11 bp, Homo sapiens
ccctgtttaat

SEQ ID NO: 3172933 - DNA, 14 bp, Homo sapiens
ccctgttttatact

SEQ ID NO: 3172934 - DNA, 20 bp, Homo sapiens
ccctgttttctgagcccggg

SEQ ID NO: 3172935 - DNA, 18 bp, Homo sapiens
ccctgttttctgtttctt

SEQ ID NO: 3172936 - DNA, 11 bp, Homo sapiens
cccttaaaatt

SEQ ID NO: 3172937 - DNA, 14 bp, Homo sapiens
cccttaacccaagg

SEQ ID NO: 3172938 - DNA, 20 bp, Homo sapiens
cccttaagggttgaaggcag

SEQ ID NO: 3172939 - DNA, 17 bp, Homo sapiens
cccttaaggtctccaaa

SEQ ID NO: 3172940 - DNA, 16 bp, Homo sapiens
cccttacacgtacctc

SEQ ID NO: 3172941 - DNA, 17 bp, Homo sapiens
cccttacagtgaagatg

SEQ ID NO: 3172942 - DNA, 16 bp, Homo sapiens
cccttagaaaatgtgt

SEQ ID NO: 3172943 - DNA, 14 bp, Homo sapiens
cccttagcctccct

SEQ ID NO: 3172944 - DNA, 20 bp, Homo sapiens
cccttaggatggggctccca

SEQ ID NO: 3172945 - DNA, 21 bp, Homo sapiens
cccttaggatggggctcccag

SEQ ID NO: 3172946 - DNA, 23 bp, Homo sapiens
cccttaggatggggctcccagct

SEQ ID NO: 3172947 - DNA, 12 bp, Homo sapiens
cccttagtcccc

SEQ ID NO: 3172948 - DNA, 23 bp, Homo sapiens
cccttagtcccccaactctgagc

SEQ ID NO: 3172949 - DNA, 22 bp, Homo sapiens
cccttatgcccggcgccgggca

SEQ ID NO: 3172950 - DNA, 19 bp, Homo sapiens
cccttatgcggttaatttt

SEQ ID NO: 3172951 - DNA, 15 bp, Homo sapiens
cccttcacaccccag

SEQ ID NO: 3172952 - DNA, 20 bp, Homo sapiens
cccttcacaccccaggccct

SEQ ID NO: 3172953 - DNA, 13 bp, Homo sapiens
cccttcaggaact

SEQ ID NO: 3172954 - DNA, 12 bp, Homo sapiens
cccttcagggcc

SEQ ID NO: 3172955 - DNA, 17 bp, Homo sapiens
cccttcagtaccctctc

SEQ ID NO: 3172956 - DNA, 19 bp, Homo sapiens
cccttcagtaccctctcag

SEQ ID NO: 3172957 - DNA, 20 bp, Homo sapiens
cccttcagtaccctctcagc

SEQ ID NO: 3172958 - DNA, 21 bp, Homo sapiens
cccttcagtaccctctcagct

SEQ ID NO: 3172959 - DNA, 18 bp, Homo sapiens
cccttccaaataataaag

SEQ ID NO: 3172960 - DNA, 20 bp, Homo sapiens
cccttccaaataataaagtc

SEQ ID NO: 3172961 - DNA, 18 bp, Homo sapiens
cccttccactgcctctgc

SEQ ID NO: 3172962 - DNA, 20 bp, Homo sapiens
cccttccatgtcgcctctgc

SEQ ID NO: 3172963 - DNA, 19 bp, Homo sapiens
cccttcccaatcagcactg

SEQ ID NO: 3172964 - DNA, 18 bp, Homo sapiens
cccttcccatctcttcct

SEQ ID NO: 3172965 - DNA, 13 bp, Homo sapiens
cccttccccaggc

SEQ ID NO: 3172966 - DNA, 13 bp, Homo sapiens
cccttcccccacc

SEQ ID NO: 3172967 - DNA, 15 bp, Homo sapiens
cccttcccctcccct

SEQ ID NO: 3172968 - DNA, 19 bp, Homo sapiens
cccttcccctcccctcctt

SEQ ID NO: 3172969 - DNA, 17 bp, Homo sapiens
cccttcccctccctggc

SEQ ID NO: 3172970 - DNA, 19 bp, Homo sapiens
cccttccccttctgtgtca

SEQ ID NO: 3172971 - DNA, 16 bp, Homo sapiens
cccttcccgcctccct

SEQ ID NO: 3172972 - DNA, 12 bp, Homo sapiens
cccttccctgca

SEQ ID NO: 3172973 - DNA, 16 bp, Homo sapiens
cccttccctgtccctc

SEQ ID NO: 3172974 - DNA, 14 bp, Homo sapiens
cccttccgaccctc

SEQ ID NO: 3172975 - DNA, 17 bp, Homo sapiens
cccttccgaccctctgg

SEQ ID NO: 3172976 - DNA, 15 bp, Homo sapiens
cccttccggtgcgtg

SEQ ID NO: 3172977 - DNA, 20 bp, Homo sapiens
cccttcctcttgtctgattt

SEQ ID NO: 3172978 - DNA, 21 bp, Homo sapiens
cccttcctgcatttctcttct

SEQ ID NO: 3172979 - DNA, 15 bp, Homo sapiens
cccttcctggaaaca

SEQ ID NO: 3172980 - DNA, 21 bp, Homo sapiens
cccttcctggaaacagcatga

SEQ ID NO: 3172981 - DNA, 22 bp, Homo sapiens
cccttcctggaaacagcatgaa

SEQ ID NO: 3172982 - DNA, 13 bp, Homo sapiens
cccttcctggcct

SEQ ID NO: 3172983 - DNA, 24 bp, Homo sapiens
cccttcctggcctcactggctggg

SEQ ID NO: 3172984 - DNA, 19 bp, Homo sapiens
cccttccttttccctgctt

SEQ ID NO: 3172985 - DNA, 13 bp, Homo sapiens
cccttcgctcctg

SEQ ID NO: 3172986 - DNA, 19 bp, Homo sapiens
cccttctcacagcacatgc

SEQ ID NO: 3172987 - DNA, 23 bp, Homo sapiens
cccttctcattccaacagtgagt

SEQ ID NO: 3172988 - DNA, 21 bp, Homo sapiens
cccttctctccctgccagagg

SEQ ID NO: 3172989 - DNA, 20 bp, Homo sapiens
cccttctctgctccaccaca

SEQ ID NO: 3172990 - DNA, 23 bp, Homo sapiens
cccttctctgctccaccacatcc

SEQ ID NO: 3172991 - DNA, 13 bp, Homo sapiens
cccttctttcctc

SEQ ID NO: 3172992 - DNA, 14 bp, Homo sapiens
cccttctttcctct

SEQ ID NO: 3172993 - DNA, 22 bp, Homo sapiens
cccttcttttatgagcagaagg

SEQ ID NO: 3172994 - DNA, 20 bp, Homo sapiens
cccttgaggattgtggaaaa

SEQ ID NO: 3172995 - DNA, 19 bp, Homo sapiens
cccttgatttaaacacaca

SEQ ID NO: 3172996 - DNA, 22 bp, Homo sapiens
cccttgcactaaagtatgtaaa

SEQ ID NO: 3172997 - DNA, 22 bp, Homo sapiens
cccttgcaggggtcccccctca

SEQ ID NO: 3172998 - DNA, 21 bp, Homo sapiens
cccttgcagttcagcaccacc

SEQ ID NO: 3172999 - DNA, 12 bp, Homo sapiens
cccttgccctcc

SEQ ID NO: 3173000 - DNA, 13 bp, Homo sapiens
cccttgccctccg

SEQ ID NO: 3173001 - DNA, 12 bp, Homo sapiens
cccttgccctga

SEQ ID NO: 3173002 - DNA, 21 bp, Homo sapiens
cccttgccctgacctcccagc

SEQ ID NO: 3173003 - DNA, 19 bp, Homo sapiens
cccttgcctccccatttcc

SEQ ID NO: 3173004 - DNA, 13 bp, Homo sapiens
cccttgccttccc

SEQ ID NO: 3173005 - DNA, 16 bp, Homo sapiens
cccttgccttcccctg

SEQ ID NO: 3173006 - DNA, 19 bp, Homo sapiens
cccttgcctttgtggcctt

SEQ ID NO: 3173007 - DNA, 12 bp, Homo sapiens
cccttgctgccc

SEQ ID NO: 3173008 - DNA, 16 bp, Homo sapiens
cccttgctggccccag

SEQ ID NO: 3173009 - DNA, 21 bp, Homo sapiens
cccttgctggccccagccctg

SEQ ID NO: 3173010 - DNA, 22 bp, Homo sapiens
cccttgctttcctgggcctttg

SEQ ID NO: 3173011 - DNA, 21 bp, Homo sapiens
cccttggaggagagagacccc

SEQ ID NO: 3173012 - DNA, 14 bp, Homo sapiens
cccttggcagtgtc

SEQ ID NO: 3173013 - DNA, 14 bp, Homo sapiens
cccttggcctcaga

SEQ ID NO: 3173014 - DNA, 12 bp, Homo sapiens
cccttggcctgt

SEQ ID NO: 3173015 - DNA, 16 bp, Homo sapiens
cccttggcctgtctca

SEQ ID NO: 3173016 - DNA, 19 bp, Homo sapiens
cccttggctggatcaggga

SEQ ID NO: 3173017 - DNA, 14 bp, Homo sapiens
cccttggctgtgag

SEQ ID NO: 3173018 - DNA, 23 bp, Homo sapiens
cccttggctgtgaggcccctgga

SEQ ID NO: 3173019 - DNA, 14 bp, Homo sapiens
cccttggcttcctc

SEQ ID NO: 3173020 - DNA, 18 bp, Homo sapiens
cccttggcttctgtgatg

SEQ ID NO: 3173021 - DNA, 19 bp, Homo sapiens
cccttgggcatccacccag

SEQ ID NO: 3173022 - DNA, 16 bp, Homo sapiens
cccttggggcctggct

SEQ ID NO: 3173023 - DNA, 23 bp, Homo sapiens
cctaaagagagtatttttataca

SEQ ID NO: 3173024 - DNA, 12 bp, Homo sapiens
cctaaagagata

SEQ ID NO: 3173025 - DNA, 13 bp, Homo sapiens
cctaaagggagaa

SEQ ID NO: 3173026 - DNA, 14 bp, Homo sapiens
cctaaatggcctca

SEQ ID NO: 3173027 - DNA, 18 bp, Homo sapiens
cctaaatggcctcatgtg

SEQ ID NO: 3173028 - DNA, 21 bp, Homo sapiens
cctaacatctgacctggcatc

SEQ ID NO: 3173029 - DNA, 17 bp, Homo sapiens
cctaaccaggcccagcc

SEQ ID NO: 3173030 - DNA, 19 bp, Homo sapiens
cctaaccaggcccagccag

SEQ ID NO: 3173031 - DNA, 15 bp, Homo sapiens
cctaaccccttccag

SEQ ID NO: 3173032 - DNA, 18 bp, Homo sapiens
cctaaccccttccagatc

SEQ ID NO: 3173033 - DNA, 23 bp, Homo sapiens
cctaactagaattagtatgtctg

SEQ ID NO: 3173034 - DNA, 15 bp, Homo sapiens
cctaactccaccgcc

SEQ ID NO: 3173035 - DNA, 16 bp, Homo sapiens
cctaactccaccgcct

SEQ ID NO: 3173036 - DNA, 14 bp, Homo sapiens
cctaagaatcagag

SEQ ID NO: 3173037 - DNA, 22 bp, Homo sapiens
cctaagacatgtgaggaggaaa

SEQ ID NO: 3173038 - DNA, 15 bp, Homo sapiens
cctaagactgtgaca

SEQ ID NO: 3173039 - DNA, 20 bp, Homo sapiens
cctaagagatgggactagga

SEQ ID NO: 3173040 - DNA, 18 bp, Homo sapiens
cctaagagatttatcttt

SEQ ID NO: 3173041 - DNA, 19 bp, Homo sapiens
cctaagatgtgttcttatt

SEQ ID NO: 3173042 - DNA, 16 bp, Homo sapiens
cctaagcattgcctgg

SEQ ID NO: 3173043 - DNA, 14 bp, Homo sapiens
cctaaggacacact

SEQ ID NO: 3173044 - DNA, 16 bp, Homo sapiens
cctaaggatctctcag

SEQ ID NO: 3173045 - DNA, 19 bp, Homo sapiens
cctaaggatctctcaggag

SEQ ID NO: 3173046 - DNA, 24 bp, Homo sapiens
cctaaggatctctcaggagcacag

SEQ ID NO: 3173047 - DNA, 23 bp, Homo sapiens
cctaaggcacccacaaataaatg

SEQ ID NO: 3173048 - DNA, 22 bp, Homo sapiens
cctaagggtcgaaagctctaga

SEQ ID NO: 3173049 - DNA, 23 bp, Homo sapiens
cctaagggtcgaaagctctagaa

SEQ ID NO: 3173050 - DNA, 19 bp, Homo sapiens
cctaagtaagtttcttcct

SEQ ID NO: 3173051 - DNA, 20 bp, Homo sapiens
cctaagtaagtttcttcctg

SEQ ID NO: 3173052 - DNA, 21 bp, Homo sapiens
cctaagtaagtttcttcctgc

SEQ ID NO: 3173053 - DNA, 16 bp, Homo sapiens
cctaagtactgtaata

SEQ ID NO: 3173054 - DNA, 18 bp, Homo sapiens
cctaagtcctttatgtgg

SEQ ID NO: 3173055 - DNA, 12 bp, Homo sapiens
cctaagtgccca

SEQ ID NO: 3173056 - DNA, 17 bp, Homo sapiens
cctaagtgtcaccccgc

SEQ ID NO: 3173057 - DNA, 21 bp, Homo sapiens
cctaataagtttgatcaaatc

SEQ ID NO: 3173058 - DNA, 19 bp, Homo sapiens
cctaatagccttttgtaac

SEQ ID NO: 3173059 - DNA, 19 bp, Homo sapiens
cctaatctcatacctctga

SEQ ID NO: 3173060 - DNA, 13 bp, Homo sapiens
cctaatgagggtg

SEQ ID NO: 3173061 - DNA, 15 bp, Homo sapiens
cctaatgagggtgtg

SEQ ID NO: 3173062 - DNA, 19 bp, Homo sapiens
cctaatggagaagacccac

SEQ ID NO: 3173063 - DNA, 17 bp, Homo sapiens
cctaatgtcttcataaa

SEQ ID NO: 3173064 - DNA, 18 bp, Homo sapiens
cctaatgtttatgagcca

SEQ ID NO: 3173065 - DNA, 13 bp, Homo sapiens
cctaattggaaag

SEQ ID NO: 3173066 - DNA, 20 bp, Homo sapiens
cctaattggaaagtgccagc

SEQ ID NO: 3173067 - DNA, 20 bp, Homo sapiens
cctaatttctcctcccttcc

SEQ ID NO: 3173068 - DNA, 23 bp, Homo sapiens
cctaattttgccaaaatcctgaa

SEQ ID NO: 3173069 - DNA, 18 bp, Homo sapiens
cctacaagatttagaaaa

SEQ ID NO: 3173070 - DNA, 22 bp, Homo sapiens
cctacaagatttagaaaaaagt

SEQ ID NO: 3173071 - DNA, 13 bp, Homo sapiens
cctacaataaact

SEQ ID NO: 3173072 - DNA, 14 bp, Homo sapiens
cctacaataaactg

SEQ ID NO: 3173073 - DNA, 14 bp, Homo sapiens
cctacacactgtca

SEQ ID NO: 3173074 - DNA, 21 bp, Homo sapiens
cctacaccattatcttggaaa

SEQ ID NO: 3173075 - DNA, 19 bp, Homo sapiens
cctacacccagaccccagg

SEQ ID NO: 3173076 - DNA, 14 bp, Homo sapiens
cctacacctccctc

SEQ ID NO: 3173077 - DNA, 15 bp, Homo sapiens
cctacactgatgcaa

SEQ ID NO: 3173078 - DNA, 20 bp, Homo sapiens
cctacagaacttcagaaaga

SEQ ID NO: 3173079 - DNA, 20 bp, Homo sapiens
cctacagctttgatccctga

SEQ ID NO: 3173080 - DNA, 21 bp, Homo sapiens
cctacagctttgatccctgac

SEQ ID NO: 3173081 - DNA, 19 bp, Homo sapiens
cctacagttttaactgtgg

SEQ ID NO: 3173082 - DNA, 15 bp, Homo sapiens
cctacccaaccactc

SEQ ID NO: 3173083 - DNA, 14 bp, Homo sapiens
cctaccctcgggcc

SEQ ID NO: 3173084 - DNA, 13 bp, Homo sapiens
cctacccttcctg

SEQ ID NO: 3173085 - DNA, 21 bp, Homo sapiens
cctaccgagtctcttctccac

SEQ ID NO: 3173086 - DNA, 14 bp, Homo sapiens
cctacctcagccta

SEQ ID NO: 3173087 - DNA, 16 bp, Homo sapiens
cctacctcagcctaga

SEQ ID NO: 3173088 - DNA, 12 bp, Homo sapiens
cctacctcaggt

SEQ ID NO: 3173089 - DNA, 14 bp, Homo sapiens
cctacctgccctgg

SEQ ID NO: 3173090 - DNA, 12 bp, Homo sapiens
cctacctggtaa

SEQ ID NO: 3173091 - DNA, 19 bp, Homo sapiens
cctaccttcatttcaggag

SEQ ID NO: 3173092 - DNA, 16 bp, Homo sapiens
cctaccttttgtctct

SEQ ID NO: 3173093 - DNA, 16 bp, Homo sapiens
cctactatcactgaac

SEQ ID NO: 3173094 - DNA, 14 bp, Homo sapiens
cctactatgtgctg

SEQ ID NO: 3173095 - DNA, 23 bp, Homo sapiens
cctactatgtgctgggtgcctcc

SEQ ID NO: 3173096 - DNA, 17 bp, Homo sapiens
cctactcattggggttc

SEQ ID NO: 3173097 - DNA, 16 bp, Homo sapiens
cctactccactgccct

SEQ ID NO: 3173098 - DNA, 19 bp, Homo sapiens
cctactccactgccctggc

SEQ ID NO: 3173099 - DNA, 14 bp, Homo sapiens
cctactcccctggg

SEQ ID NO: 3173100 - DNA, 11 bp, Homo sapiens
cctactcctga

SEQ ID NO: 3173101 - DNA, 13 bp, Homo sapiens
cctactgaatgct

SEQ ID NO: 3173102 - DNA, 12 bp, Homo sapiens
cctactgtcctc

SEQ ID NO: 3173103 - DNA, 16 bp, Homo sapiens
cctactgttcctttca

SEQ ID NO: 3173104 - DNA, 22 bp, Homo sapiens
cctactgttctaaagctctgac

SEQ ID NO: 3173105 - DNA, 23 bp, Homo sapiens
cctactgttctaaagctctgaca

SEQ ID NO: 3173106 - DNA, 15 bp, Homo sapiens
cctacttcctgtgac

SEQ ID NO: 3173107 - DNA, 21 bp, Homo sapiens
cctacttgataatattagtga

SEQ ID NO: 3173108 - DNA, 14 bp, Homo sapiens
cctacttgtgactg

SEQ ID NO: 3173109 - DNA, 18 bp, Homo sapiens
cctacttgtgactgaagg

SEQ ID NO: 3173110 - DNA, 13 bp, Homo sapiens
cctactttcttca

SEQ ID NO: 3173111 - DNA, 21 bp, Homo sapiens
cctactttgactttttgcatt

SEQ ID NO: 3173112 - DNA, 23 bp, Homo sapiens
cctagaaacccaagctcctcctc

SEQ ID NO: 3173113 - DNA, 20 bp, Homo sapiens
cctagactctgtctacctgg

SEQ ID NO: 3173114 - DNA, 18 bp, Homo sapiens
cctagactgttactttgg

SEQ ID NO: 3173115 - DNA, 13 bp, Homo sapiens
cctagacttgaaa

SEQ ID NO: 3173116 - DNA, 12 bp, Homo sapiens
cctagagccaga

SEQ ID NO: 3173117 - DNA, 15 bp, Homo sapiens
cctagagccagacca

SEQ ID NO: 3173118 - DNA, 18 bp, Homo sapiens
cctagagcgcggctggct

SEQ ID NO: 3173119 - DNA, 21 bp, Homo sapiens
cctagagcgcggctggctctg

SEQ ID NO: 3173120 - DNA, 16 bp, Homo sapiens
cctagaggtgggcagc

SEQ ID NO: 3173121 - DNA, 18 bp, Homo sapiens
cctagaggtgggcagctg

SEQ ID NO: 3173122 - DNA, 19 bp, Homo sapiens
cctagaggtgggcagctgg

SEQ ID NO: 3173123 - DNA, 23 bp, Homo sapiens
cctagaggtgggcagctgggccc

SEQ ID NO: 3173124 - DNA, 22 bp, Homo sapiens
cctagagtctagggcacaaaga

SEQ ID NO: 3173125 - DNA, 17 bp, Homo sapiens
cctagatccacacacag

SEQ ID NO: 3173126 - DNA, 14 bp, Homo sapiens
cctagatcctaagg

SEQ ID NO: 3173127 - DNA, 22 bp, Homo sapiens
cctagatgtttaacaaatctaa

SEQ ID NO: 3173128 - DNA, 15 bp, Homo sapiens
cctagattatatcaa

SEQ ID NO: 3173129 - DNA, 16 bp, Homo sapiens
cctagcaagctggcct

SEQ ID NO: 3173130 - DNA, 17 bp, Homo sapiens
cctagcaagctggcctc

SEQ ID NO: 3173131 - DNA, 12 bp, Homo sapiens
cctagcagtgaa

SEQ ID NO: 3173132 - DNA, 13 bp, Homo sapiens
cctagcagtgaac

SEQ ID NO: 3173133 - DNA, 14 bp, Homo sapiens
cctagccattcctg

SEQ ID NO: 3173134 - DNA, 21 bp, Homo sapiens
cctagccattcctggtaccca

SEQ ID NO: 3173135 - DNA, 13 bp, Homo sapiens
cctagcccaccct

SEQ ID NO: 3173136 - DNA, 14 bp, Homo sapiens
cctagcccaccctg

SEQ ID NO: 3173137 - DNA, 13 bp, Homo sapiens
cctagcccaggag

SEQ ID NO: 3173138 - DNA, 17 bp, Homo sapiens
cctagcccaggagagag

SEQ ID NO: 3173139 - DNA, 23 bp, Homo sapiens
cctagcctgtgcctctgggactg

SEQ ID NO: 3173140 - DNA, 10 bp, Homo sapiens
cctagccttg

SEQ ID NO: 3173141 - DNA, 14 bp, Homo sapiens
cctagccttgcttg

SEQ ID NO: 3173142 - DNA, 15 bp, Homo sapiens
cctagccttgcttgt

SEQ ID NO: 3173143 - DNA, 17 bp, Homo sapiens
cctagcgatctctcctg

SEQ ID NO: 3173144 - DNA, 22 bp, Homo sapiens
cctagcgatctctcctggccta

SEQ ID NO: 3173145 - DNA, 20 bp, Homo sapiens
cctagctcctccccttcctc

SEQ ID NO: 3173146 - DNA, 13 bp, Homo sapiens
cctagctcttaca

SEQ ID NO: 3173147 - DNA, 17 bp, Homo sapiens
cctagctggctctgtga

SEQ ID NO: 3173148 - DNA, 21 bp, Homo sapiens
cctagctttagaccctgggtg

SEQ ID NO: 3173149 - DNA, 20 bp, Homo sapiens
cctccggagagagagagagg

SEQ ID NO: 3173150 - DNA, 18 bp, Homo sapiens
cctccggccatactgcct

SEQ ID NO: 3173151 - DNA, 17 bp, Homo sapiens
cctccgtccacccaggc

SEQ ID NO: 3173152 - DNA, 17 bp, Homo sapiens
cctccgtgatccatcca

SEQ ID NO: 3173153 - DNA, 18 bp, Homo sapiens
cctccgtgatccatccat

SEQ ID NO: 3173154 - DNA, 17 bp, Homo sapiens
cctccgtttatgggcct

SEQ ID NO: 3173155 - DNA, 14 bp, Homo sapiens
cctcctagacccag

SEQ ID NO: 3173156 - DNA, 18 bp, Homo sapiens
cctcctagacccaggtgg

SEQ ID NO: 3173157 - DNA, 19 bp, Homo sapiens
cctcctagaggtgggcagc

SEQ ID NO: 3173158 - DNA, 23 bp, Homo sapiens
cctcctagaggtgggcagctggg

SEQ ID NO: 3173159 - DNA, 19 bp, Homo sapiens
cctcctattctataaaact

SEQ ID NO: 3173160 - DNA, 16 bp, Homo sapiens
cctcctcacccccagc

SEQ ID NO: 3173161 - DNA, 12 bp, Homo sapiens
cctcctcacctc

SEQ ID NO: 3173162 - DNA, 15 bp, Homo sapiens
cctcctcacctcatg

SEQ ID NO: 3173163 - DNA, 21 bp, Homo sapiens
cctcctcacctctggactggc

SEQ ID NO: 3173164 - DNA, 16 bp, Homo sapiens
cctcctcagcccccag

SEQ ID NO: 3173165 - DNA, 17 bp, Homo sapiens
cctcctcaggcacacag

SEQ ID NO: 3173166 - DNA, 19 bp, Homo sapiens
cctcctcaggcacacagct

SEQ ID NO: 3173167 - DNA, 20 bp, Homo sapiens
cctcctcatcccgtgttctc

SEQ ID NO: 3173168 - DNA, 12 bp, Homo sapiens
cctcctcatgta

SEQ ID NO: 3173169 - DNA, 17 bp, Homo sapiens
cctcctccacagtgctg

SEQ ID NO: 3173170 - DNA, 17 bp, Homo sapiens
cctcctccacctcacct

SEQ ID NO: 3173171 - DNA, 18 bp, Homo sapiens
cctcctccagcccctgtc

SEQ ID NO: 3173172 - DNA, 15 bp, Homo sapiens
cctcctccaggcctg

SEQ ID NO: 3173173 - DNA, 12 bp, Homo sapiens
cctcctccaggg

SEQ ID NO: 3173174 - DNA, 20 bp, Homo sapiens
cctcctccagggtgatttta

SEQ ID NO: 3173175 - DNA, 19 bp, Homo sapiens
cctcctcccacccggctgc

SEQ ID NO: 3173176 - DNA, 13 bp, Homo sapiens
cctcctccccact

SEQ ID NO: 3173177 - DNA, 18 bp, Homo sapiens
cctcctcccccacccctt

SEQ ID NO: 3173178 - DNA, 23 bp, Homo sapiens
cctcctcggaaccgctcacctag

SEQ ID NO: 3173179 - DNA, 20 bp, Homo sapiens
cctcctcggagagcagcagc

SEQ ID NO: 3173180 - DNA, 14 bp, Homo sapiens
cctcctcgggccga

SEQ ID NO: 3173181 - DNA, 18 bp, Homo sapiens
cctcctcgggccgaggcc

SEQ ID NO: 3173182 - DNA, 21 bp, Homo sapiens
cctcctcgggccgaggcccag

SEQ ID NO: 3173183 - DNA, 22 bp, Homo sapiens
cctcctcgggccgaggcccagc

SEQ ID NO: 3173184 - DNA, 19 bp, Homo sapiens
cctcctcggggctccaggc

SEQ ID NO: 3173185 - DNA, 19 bp, Homo sapiens
cctcctctaaggttgggca

SEQ ID NO: 3173186 - DNA, 13 bp, Homo sapiens
cctcctctcagtg

SEQ ID NO: 3173187 - DNA, 13 bp, Homo sapiens
cctcctctcccat

SEQ ID NO: 3173188 - DNA, 14 bp, Homo sapiens
cctcctctcccatc

SEQ ID NO: 3173189 - DNA, 16 bp, Homo sapiens
cctcctctcccatccc

SEQ ID NO: 3173190 - DNA, 21 bp, Homo sapiens
cctcctctgcactcccacctg

SEQ ID NO: 3173191 - DNA, 17 bp, Homo sapiens
cctcctcttctgacgtg

SEQ ID NO: 3173192 - DNA, 15 bp, Homo sapiens
cctcctcttggaatt

SEQ ID NO: 3173193 - DNA, 13 bp, Homo sapiens
cctcctgagcctg

SEQ ID NO: 3173194 - DNA, 14 bp, Homo sapiens
cctcctgagcctgt

SEQ ID NO: 3173195 - DNA, 16 bp, Homo sapiens
cctcctgagcctgtgg

SEQ ID NO: 3173196 - DNA, 18 bp, Homo sapiens
cctcctgagcctgtgggt

SEQ ID NO: 3173197 - DNA, 15 bp, Homo sapiens
cctcctgcccagtcc

SEQ ID NO: 3173198 - DNA, 11 bp, Homo sapiens
cctcctgctcc

SEQ ID NO: 3173199 - DNA, 12 bp, Homo sapiens
cctcctgctcct

SEQ ID NO: 3173200 - DNA, 14 bp, Homo sapiens
cctcctgctcctcc

SEQ ID NO: 3173201 - DNA, 15 bp, Homo sapiens
cctcctgctcctccc

SEQ ID NO: 3173202 - DNA, 16 bp, Homo sapiens
cctcctgctcctccct

SEQ ID NO: 3173203 - DNA, 19 bp, Homo sapiens
cctcctgctcctccctgcc

SEQ ID NO: 3173204 - DNA, 13 bp, Homo sapiens
cctcctgctttta

SEQ ID NO: 3173205 - DNA, 22 bp, Homo sapiens
cctcctggaaccttgctgtcct

SEQ ID NO: 3173206 - DNA, 12 bp, Homo sapiens
cctcctggccag

SEQ ID NO: 3173207 - DNA, 22 bp, Homo sapiens
cctcctggccagacgctgccgc

SEQ ID NO: 3173208 - DNA, 14 bp, Homo sapiens
cctcctgggctaag

SEQ ID NO: 3173209 - DNA, 17 bp, Homo sapiens
cctcctgtacctcagtg

SEQ ID NO: 3173210 - DNA, 19 bp, Homo sapiens
cctcctgtacctcagtgga

SEQ ID NO: 3173211 - DNA, 11 bp, Homo sapiens
cctcctgtgga

SEQ ID NO: 3173212 - DNA, 18 bp, Homo sapiens
cctcctgtggggaaaggg

SEQ ID NO: 3173213 - DNA, 17 bp, Homo sapiens
cctcctgtgtactgtgt

SEQ ID NO: 3173214 - DNA, 17 bp, Homo sapiens
cctcctgtgtgactggc

SEQ ID NO: 3173215 - DNA, 23 bp, Homo sapiens
cctcctgtgtgtgcgcctacagg

SEQ ID NO: 3173216 - DNA, 15 bp, Homo sapiens
cctccttcagacacc

SEQ ID NO: 3173217 - DNA, 11 bp, Homo sapiens
cctccttccac

SEQ ID NO: 3173218 - DNA, 19 bp, Homo sapiens
cctccttccacctccctcc

SEQ ID NO: 3173219 - DNA, 15 bp, Homo sapiens
cctccttctcccttt

SEQ ID NO: 3173220 - DNA, 16 bp, Homo sapiens
cctccttctccctttt

SEQ ID NO: 3173221 - DNA, 15 bp, Homo sapiens
cctccttggtgcctg

SEQ ID NO: 3173222 - DNA, 18 bp, Homo sapiens
cctcctttctgtgcccta

SEQ ID NO: 3173223 - DNA, 13 bp, Homo sapiens
cctcctttttcca

SEQ ID NO: 3173224 - DNA, 17 bp, Homo sapiens
cctcgaaccaaggcagc

SEQ ID NO: 3173225 - DNA, 22 bp, Homo sapiens
cctcgaaccaaggcagcctcca

SEQ ID NO: 3173226 - DNA, 15 bp, Homo sapiens
cctcgaactggctgc

SEQ ID NO: 3173227 - DNA, 19 bp, Homo sapiens
cctcgaagcgcgccactcg

SEQ ID NO: 3173228 - DNA, 16 bp, Homo sapiens
cctcgacagcgcccct

SEQ ID NO: 3173229 - DNA, 19 bp, Homo sapiens
cctcgacagggcctggagc

SEQ ID NO: 3173230 - DNA, 23 bp, Homo sapiens
cctcgaggcaccggcgctgcagg

SEQ ID NO: 3173231 - DNA, 17 bp, Homo sapiens
cctcgccagcttctcct

SEQ ID NO: 3173232 - DNA, 18 bp, Homo sapiens
cctcgccagcttctcctg

SEQ ID NO: 3173233 - DNA, 20 bp, Homo sapiens
cctcgccagcttctcctgcg

SEQ ID NO: 3173234 - DNA, 20 bp, Homo sapiens
cctcgcctccccaccctcct

SEQ ID NO: 3173235 - DNA, 12 bp, Homo sapiens
cctcgcctgtgg

SEQ ID NO: 3173236 - DNA, 22 bp, Homo sapiens
cctcgcctgtggagctcagccc

SEQ ID NO: 3173237 - DNA, 14 bp, Homo sapiens
cctcgctcccttca

SEQ ID NO: 3173238 - DNA, 23 bp, Homo sapiens
cctcgctgttggagcaaaccatt

SEQ ID NO: 3173239 - DNA, 19 bp, Homo sapiens
cctcggacagcccatctgc

SEQ ID NO: 3173240 - DNA, 14 bp, Homo sapiens
cctcggagcatggt

SEQ ID NO: 3173241 - DNA, 16 bp, Homo sapiens
cctcggcttgtgggct

SEQ ID NO: 3173242 - DNA, 21 bp, Homo sapiens
cctcggcttgtgggctggtgc

SEQ ID NO: 3173243 - DNA, 13 bp, Homo sapiens
cctcgggaagcag

SEQ ID NO: 3173244 - DNA, 18 bp, Homo sapiens
cctcgggaagcagccagc

SEQ ID NO: 3173245 - DNA, 16 bp, Homo sapiens
cctcgggcccacctgg

SEQ ID NO: 3173246 - DNA, 20 bp, Homo sapiens
cctcgggccgaggcccagcg

SEQ ID NO: 3173247 - DNA, 13 bp, Homo sapiens
cctcgggcctgct

SEQ ID NO: 3173248 - DNA, 15 bp, Homo sapiens
cctcggggacaccag

SEQ ID NO: 3173249 - DNA, 21 bp, Homo sapiens
cctcggtggctgcacagaagg

SEQ ID NO: 3173250 - DNA, 16 bp, Homo sapiens
cctcgtcctgtcccag

SEQ ID NO: 3173251 - DNA, 22 bp, Homo sapiens
cctcgtgatccgcctgcctctg

SEQ ID NO: 3173252 - DNA, 20 bp, Homo sapiens
cctcgtgcctgggggagaga

SEQ ID NO: 3173253 - DNA, 13 bp, Homo sapiens
cctcgtggccagc

SEQ ID NO: 3173254 - DNA, 17 bp, Homo sapiens
cctcgtggccagcccgg

SEQ ID NO: 3173255 - DNA, 18 bp, Homo sapiens
cctcgtggccagcccggc

SEQ ID NO: 3173256 - DNA, 16 bp, Homo sapiens
cctcgtgtcagctcag

SEQ ID NO: 3173257 - DNA, 18 bp, Homo sapiens
cctcgttcaaaacattcc

SEQ ID NO: 3173258 - DNA, 19 bp, Homo sapiens
cctcgttcctttctcctgt

SEQ ID NO: 3173259 - DNA, 20 bp, Homo sapiens
cctcgttggaagaggaacag

SEQ ID NO: 3173260 - DNA, 14 bp, Homo sapiens
cctctaatgagact

SEQ ID NO: 3173261 - DNA, 16 bp, Homo sapiens
cctctacccaaaccct

SEQ ID NO: 3173262 - DNA, 19 bp, Homo sapiens
cctctacccaaaccctagg

SEQ ID NO: 3173263 - DNA, 15 bp, Homo sapiens
cctctaccccaattt

SEQ ID NO: 3173264 - DNA, 20 bp, Homo sapiens
cctctacttaatgagatagt

SEQ ID NO: 3173265 - DNA, 16 bp, Homo sapiens
cctctagaagccaagg

SEQ ID NO: 3173266 - DNA, 21 bp, Homo sapiens
cctctaggcaagcaggacctg

SEQ ID NO: 3173267 - DNA, 21 bp, Homo sapiens
cctctagtaagatgcactgaa

SEQ ID NO: 3173268 - DNA, 14 bp, Homo sapiens
cctctagtgccctc

SEQ ID NO: 3173269 - DNA, 18 bp, Homo sapiens
cctctatacatctctccc

SEQ ID NO: 3173270 - DNA, 20 bp, Homo sapiens
cctctatacatctctcccca

SEQ ID NO: 3173271 - DNA, 20 bp, Homo sapiens
cctctattgatgtacagtct

SEQ ID NO: 3173272 - DNA, 17 bp, Homo sapiens
cctctatttatgtttgc

SEQ ID NO: 3173273 - DNA, 19 bp, Homo sapiens
cctctatttattagccaac

SEQ ID NO: 3173274 - DNA, 12 bp, Homo sapiens
cctctattttgt

SEQ ID NO: 3173275 - DNA, 15 bp, Homo sapiens
cctgccagcctggct

SEQ ID NO: 3173276 - DNA, 12 bp, Homo sapiens
cctgccagctgc

SEQ ID NO: 3173277 - DNA, 17 bp, Homo sapiens
cctgccagctgccttcc

SEQ ID NO: 3173278 - DNA, 21 bp, Homo sapiens
cctgccaggagctttggacct

SEQ ID NO: 3173279 - DNA, 13 bp, Homo sapiens
cctgccaggcagg

SEQ ID NO: 3173280 - DNA, 16 bp, Homo sapiens
cctgccatgggccagc

SEQ ID NO: 3173281 - DNA, 19 bp, Homo sapiens
cctgccatgggccagccta

SEQ ID NO: 3173282 - DNA, 18 bp, Homo sapiens
cctgccattcttctggtg

SEQ ID NO: 3173283 - DNA, 21 bp, Homo sapiens
cctgccattcttctggtgcta

SEQ ID NO: 3173284 - DNA, 17 bp, Homo sapiens
cctgccatttgcaccct

SEQ ID NO: 3173285 - DNA, 21 bp, Homo sapiens
cctgcccaatgctttgggagg

SEQ ID NO: 3173286 - DNA, 19 bp, Homo sapiens
cctgcccacttagccgtcc

SEQ ID NO: 3173287 - DNA, 14 bp, Homo sapiens
cctgcccaggcccc

SEQ ID NO: 3173288 - DNA, 13 bp, Homo sapiens
cctgcccaggccg

SEQ ID NO: 3173289 - DNA, 16 bp, Homo sapiens
cctgcccaggccggcc

SEQ ID NO: 3173290 - DNA, 18 bp, Homo sapiens
cctgcccaggccggccag

SEQ ID NO: 3173291 - DNA, 22 bp, Homo sapiens
cctgcccaggccggccagcctc

SEQ ID NO: 3173292 - DNA, 15 bp, Homo sapiens
cctgcccagtccccc

SEQ ID NO: 3173293 - DNA, 21 bp, Homo sapiens
cctgcccagtcccccaacccc

SEQ ID NO: 3173294 - DNA, 22 bp, Homo sapiens
cctgcccagtcccccaacccca

SEQ ID NO: 3173295 - DNA, 11 bp, Homo sapiens
cctgcccagtg

SEQ ID NO: 3173296 - DNA, 19 bp, Homo sapiens
cctgccccagcccaagtcc

SEQ ID NO: 3173297 - DNA, 14 bp, Homo sapiens
cctgccccaggcct

SEQ ID NO: 3173298 - DNA, 16 bp, Homo sapiens
cctgccccaggcctga

SEQ ID NO: 3173299 - DNA, 14 bp, Homo sapiens
cctgcccccagccc

SEQ ID NO: 3173300 - DNA, 13 bp, Homo sapiens
cctgcccccatct

SEQ ID NO: 3173301 - DNA, 14 bp, Homo sapiens
cctgcccccatctc

SEQ ID NO: 3173302 - DNA, 21 bp, Homo sapiens
cctgcccccatctccccaggc

SEQ ID NO: 3173303 - DNA, 20 bp, Homo sapiens
cctgccccccctaagagaca

SEQ ID NO: 3173304 - DNA, 17 bp, Homo sapiens
cctgccccctggctgac

SEQ ID NO: 3173305 - DNA, 21 bp, Homo sapiens
cctgccccctggctgactggc

SEQ ID NO: 3173306 - DNA, 13 bp, Homo sapiens
cctgccccgcccc

SEQ ID NO: 3173307 - DNA, 24 bp, Homo sapiens
cctgcccctaggatgctgcagcag

SEQ ID NO: 3173308 - DNA, 18 bp, Homo sapiens
cctgcccctcccttcaac

SEQ ID NO: 3173309 - DNA, 17 bp, Homo sapiens
cctgcccctgcaaagac

SEQ ID NO: 3173310 - DNA, 13 bp, Homo sapiens
cctgcccgctccc

SEQ ID NO: 3173311 - DNA, 16 bp, Homo sapiens
cctgcccgctgcaatg

SEQ ID NO: 3173312 - DNA, 23 bp, Homo sapiens
cctgccctacagaggtctctgcc

SEQ ID NO: 3173313 - DNA, 13 bp, Homo sapiens
cctgccctcaagg

SEQ ID NO: 3173314 - DNA, 14 bp, Homo sapiens
cctgccctccccag

SEQ ID NO: 3173315 - DNA, 17 bp, Homo sapiens
cctgccctctatttatt

SEQ ID NO: 3173316 - DNA, 19 bp, Homo sapiens
cctgccctctatttattag

SEQ ID NO: 3173317 - DNA, 12 bp, Homo sapiens
cctgccctgcac

SEQ ID NO: 3173318 - DNA, 13 bp, Homo sapiens
cctgccctgctgc

SEQ ID NO: 3173319 - DNA, 13 bp, Homo sapiens
cctgcccttgtct

SEQ ID NO: 3173320 - DNA, 17 bp, Homo sapiens
cctgcccttgtctgaga

SEQ ID NO: 3173321 - DNA, 14 bp, Homo sapiens
cctgccgcccaaag

SEQ ID NO: 3173322 - DNA, 23 bp, Homo sapiens
cctgcctaaccaggcccagccag

SEQ ID NO: 3173323 - DNA, 19 bp, Homo sapiens
cctgcctattatctgtcag

SEQ ID NO: 3173324 - DNA, 12 bp, Homo sapiens
cctgcctcagcc

SEQ ID NO: 3173325 - DNA, 13 bp, Homo sapiens
cctgcctcagcct

SEQ ID NO: 3173326 - DNA, 16 bp, Homo sapiens
cctgcctcatccacca

SEQ ID NO: 3173327 - DNA, 17 bp, Homo sapiens
cctgcctcccatgcctg

SEQ ID NO: 3173328 - DNA, 15 bp, Homo sapiens
cctgcctccgctggc

SEQ ID NO: 3173329 - DNA, 14 bp, Homo sapiens
cctgcctcctggga

SEQ ID NO: 3173330 - DNA, 19 bp, Homo sapiens
cctgcctcgaactggctgc

SEQ ID NO: 3173331 - DNA, 21 bp, Homo sapiens
cctgcctcgaactggctgcaa

SEQ ID NO: 3173332 - DNA, 22 bp, Homo sapiens
cctgcctggccaggcagatctg

SEQ ID NO: 3173333 - DNA, 10 bp, Homo sapiens
cctgcctggg

SEQ ID NO: 3173334 - DNA, 11 bp, Homo sapiens
cctgcctgggt

SEQ ID NO: 3173335 - DNA, 17 bp, Homo sapiens
cctgcctgggtgggaca

SEQ ID NO: 3173336 - DNA, 23 bp, Homo sapiens
cctgcctgggtgggacagcctct

SEQ ID NO: 3173337 - DNA, 13 bp, Homo sapiens
cctgcctgggttg

SEQ ID NO: 3173338 - DNA, 17 bp, Homo sapiens
cctgccttaggcctacc

SEQ ID NO: 3173339 - DNA, 14 bp, Homo sapiens
cctgccttcgttaa

SEQ ID NO: 3173340 - DNA, 15 bp, Homo sapiens
cctgccttctgtcct

SEQ ID NO: 3173341 - DNA, 16 bp, Homo sapiens
cctgccttctgtcctg

SEQ ID NO: 3173342 - DNA, 19 bp, Homo sapiens
cctgccttctgtcctggtg

SEQ ID NO: 3173343 - DNA, 21 bp, Homo sapiens
cctgccttctgtcctggtgtc

SEQ ID NO: 3173344 - DNA, 13 bp, Homo sapiens
cctgccttgaagc

SEQ ID NO: 3173345 - DNA, 21 bp, Homo sapiens
cctgccttgaagccactgaag

SEQ ID NO: 3173346 - DNA, 22 bp, Homo sapiens
cctgcctttaagccaaagaaac

SEQ ID NO: 3173347 - DNA, 23 bp, Homo sapiens
cctgcgagacgcacacagctgag

SEQ ID NO: 3173348 - DNA, 18 bp, Homo sapiens
cctgcgattttgcctgtg

SEQ ID NO: 3173349 - DNA, 20 bp, Homo sapiens
cctgcgccaccgcccagaga

SEQ ID NO: 3173350 - DNA, 20 bp, Homo sapiens
cctgcgccccgcccacaccc

SEQ ID NO: 3173351 - DNA, 15 bp, Homo sapiens
cctgcgcctgtgatg

SEQ ID NO: 3173352 - DNA, 19 bp, Homo sapiens
cctgcggagtgaagagggg

SEQ ID NO: 3173353 - DNA, 21 bp, Homo sapiens
cctgcgggtggggcttggggc

SEQ ID NO: 3173354 - DNA, 16 bp, Homo sapiens
cctgcgggttttaatt

SEQ ID NO: 3173355 - DNA, 14 bp, Homo sapiens
cctgcggtcaggct

SEQ ID NO: 3173356 - DNA, 20 bp, Homo sapiens
cctgcggtcaggctgggcag

SEQ ID NO: 3173357 - DNA, 19 bp, Homo sapiens
cctgcgtcctcctcacctc

SEQ ID NO: 3173358 - DNA, 22 bp, Homo sapiens
cctgcgtggcctgagtcctggt

SEQ ID NO: 3173359 - DNA, 12 bp, Homo sapiens
cctgcgtggggg

SEQ ID NO: 3173360 - DNA, 13 bp, Homo sapiens
cctgcgtgggggc

SEQ ID NO: 3173361 - DNA, 17 bp, Homo sapiens
cctgcgttggagccact

SEQ ID NO: 3173362 - DNA, 17 bp, Homo sapiens
cctgcgttggtccagag

SEQ ID NO: 3173363 - DNA, 19 bp, Homo sapiens
cctgcgttggtccagagcg

SEQ ID NO: 3173364 - DNA, 16 bp, Homo sapiens
cctgctaaggctcctc

SEQ ID NO: 3173365 - DNA, 17 bp, Homo sapiens
cctgctaattccccaga

SEQ ID NO: 3173366 - DNA, 19 bp, Homo sapiens
cctgctacaacttcagcag

SEQ ID NO: 3173367 - DNA, 19 bp, Homo sapiens
cctgctacaggaggggtct

SEQ ID NO: 3173368 - DNA, 19 bp, Homo sapiens
cctgctagagcaacccctg

SEQ ID NO: 3173369 - DNA, 22 bp, Homo sapiens
cctgctagttagcgccccaccg

SEQ ID NO: 3173370 - DNA, 21 bp, Homo sapiens
cctgctcaactctacccctgc

SEQ ID NO: 3173371 - DNA, 23 bp, Homo sapiens
cctgctcaactctacccctgctc

SEQ ID NO: 3173372 - DNA, 19 bp, Homo sapiens
cctgctcaatccctgagga

SEQ ID NO: 3173373 - DNA, 22 bp, Homo sapiens
cctgctcagtgcttgggctcca

SEQ ID NO: 3173374 - DNA, 16 bp, Homo sapiens
cctgctccaccagcag

SEQ ID NO: 3173375 - DNA, 18 bp, Homo sapiens
cctgctccaccagcagca

SEQ ID NO: 3173376 - DNA, 12 bp, Homo sapiens
cctgctcccagc

SEQ ID NO: 3173377 - DNA, 13 bp, Homo sapiens
cctgctcccagca

SEQ ID NO: 3173378 - DNA, 13 bp, Homo sapiens
cctgctcccagcc

SEQ ID NO: 3173379 - DNA, 20 bp, Homo sapiens
cctgctcccattcctccctc

SEQ ID NO: 3173380 - DNA, 19 bp, Homo sapiens
cctgctccctgctttggct

SEQ ID NO: 3173381 - DNA, 17 bp, Homo sapiens
cctgctccgctgctcct

SEQ ID NO: 3173382 - DNA, 19 bp, Homo sapiens
cctgctcctccctgccccc

SEQ ID NO: 3173383 - DNA, 15 bp, Homo sapiens
cctgctcctccctgg

SEQ ID NO: 3173384 - DNA, 20 bp, Homo sapiens
cctgctcctccctggctgcc

SEQ ID NO: 3173385 - DNA, 12 bp, Homo sapiens
cctgctcctcct

SEQ ID NO: 3173386 - DNA, 13 bp, Homo sapiens
cctgctcctcctg

SEQ ID NO: 3173387 - DNA, 13 bp, Homo sapiens
cctgctcctgcag

SEQ ID NO: 3173388 - DNA, 14 bp, Homo sapiens
cctgctcctgcagc

SEQ ID NO: 3173389 - DNA, 23 bp, Homo sapiens
cctgctccttttgtatcttcctt

SEQ ID NO: 3173390 - DNA, 21 bp, Homo sapiens
cctgctctaacacctgcctag

SEQ ID NO: 3173391 - DNA, 18 bp, Homo sapiens
cctgctctacccatgagc

SEQ ID NO: 3173392 - DNA, 19 bp, Homo sapiens
cctgctctagtgggacagc

SEQ ID NO: 3173393 - DNA, 22 bp, Homo sapiens
cctgctctccgaccagacacct

SEQ ID NO: 3173394 - DNA, 21 bp, Homo sapiens
cctgctctcctcttgccactg

SEQ ID NO: 3173395 - DNA, 22 bp, Homo sapiens
cctgctctcctcttgccactgc

SEQ ID NO: 3173396 - DNA, 21 bp, Homo sapiens
cctgctgaatgcctcgctccc

SEQ ID NO: 3173397 - DNA, 20 bp, Homo sapiens
cctgctgagagcccccacct

SEQ ID NO: 3173398 - DNA, 13 bp, Homo sapiens
cctgctgcagggg

SEQ ID NO: 3173399 - DNA, 17 bp, Homo sapiens
cctgctgcaggggctct

SEQ ID NO: 3173400 - DNA, 13 bp, Homo sapiens
cctgctgccagtg

SEQ ID NO: 3173401 - DNA, 14 bp, Homo sapiens
cctgggctgttggc

SEQ ID NO: 3173402 - DNA, 21 bp, Homo sapiens
cctgggctgttggcactcaca

SEQ ID NO: 3173403 - DNA, 16 bp, Homo sapiens
cctgggcttggcctgc

SEQ ID NO: 3173404 - DNA, 19 bp, Homo sapiens
cctgggcttggcctgctgt

SEQ ID NO: 3173405 - DNA, 17 bp, Homo sapiens
cctggggaccccactcc

SEQ ID NO: 3173406 - DNA, 13 bp, Homo sapiens
cctggggaggccc

SEQ ID NO: 3173407 - DNA, 15 bp, Homo sapiens
cctggggcagcactc

SEQ ID NO: 3173408 - DNA, 13 bp, Homo sapiens
cctggggcctgag

SEQ ID NO: 3173409 - DNA, 16 bp, Homo sapiens
cctggggcctgagaga

SEQ ID NO: 3173410 - DNA, 12 bp, Homo sapiens
cctggggcctgg

SEQ ID NO: 3173411 - DNA, 15 bp, Homo sapiens
cctggggcctggcag

SEQ ID NO: 3173412 - DNA, 15 bp, Homo sapiens
cctggggctcctttc

SEQ ID NO: 3173413 - DNA, 15 bp, Homo sapiens
cctggggctctgtgc

SEQ ID NO: 3173414 - DNA, 18 bp, Homo sapiens
cctggggctctgtgcagg

SEQ ID NO: 3173415 - DNA, 13 bp, Homo sapiens
cctggggctgggc

SEQ ID NO: 3173416 - DNA, 15 bp, Homo sapiens
cctggggctgggccc

SEQ ID NO: 3173417 - DNA, 17 bp, Homo sapiens
cctggggctgggccccc

SEQ ID NO: 3173418 - DNA, 16 bp, Homo sapiens
cctgggggcagtgact

SEQ ID NO: 3173419 - DNA, 18 bp, Homo sapiens
cctgggggcagtgactgg

SEQ ID NO: 3173420 - DNA, 19 bp, Homo sapiens
cctgggggcagtgactggc

SEQ ID NO: 3173421 - DNA, 22 bp, Homo sapiens
cctgggggcagtgactggcagg

SEQ ID NO: 3173422 - DNA, 23 bp, Homo sapiens
cctgggggcagtgactggcaggt

SEQ ID NO: 3173423 - DNA, 19 bp, Homo sapiens
cctgggggccttgggtgag

SEQ ID NO: 3173424 - DNA, 21 bp, Homo sapiens
cctgggggcttttgccactcc

SEQ ID NO: 3173425 - DNA, 15 bp, Homo sapiens
cctgggggtggcagg

SEQ ID NO: 3173426 - DNA, 23 bp, Homo sapiens
cctgggggttctttcttcctctg

SEQ ID NO: 3173427 - DNA, 21 bp, Homo sapiens
cctggggtgaatacttatttt

SEQ ID NO: 3173428 - DNA, 15 bp, Homo sapiens
cctgggtccaaataa

SEQ ID NO: 3173429 - DNA, 16 bp, Homo sapiens
cctgggtctgtgtctc

SEQ ID NO: 3173430 - DNA, 22 bp, Homo sapiens
cctgggtgccattcccagcgtt

SEQ ID NO: 3173431 - DNA, 16 bp, Homo sapiens
cctgggtgctggctgc

SEQ ID NO: 3173432 - DNA, 18 bp, Homo sapiens
cctgggtggatcggcctc

SEQ ID NO: 3173433 - DNA, 17 bp, Homo sapiens
cctgggtgggacagcct

SEQ ID NO: 3173434 - DNA, 19 bp, Homo sapiens
cctgggtgggacagcctct

SEQ ID NO: 3173435 - DNA, 20 bp, Homo sapiens
cctgggtgggacagcctctt

SEQ ID NO: 3173436 - DNA, 17 bp, Homo sapiens
cctgggtgggctctgtg

SEQ ID NO: 3173437 - DNA, 21 bp, Homo sapiens
cctgggtgggtggtggggagg

SEQ ID NO: 3173438 - DNA, 18 bp, Homo sapiens
cctgggttccaatcctgg

SEQ ID NO: 3173439 - DNA, 14 bp, Homo sapiens
cctgggtttcctgc

SEQ ID NO: 3173440 - DNA, 19 bp, Homo sapiens
cctgggtttcctgcaggca

SEQ ID NO: 3173441 - DNA, 13 bp, Homo sapiens
cctggtaaaccaa

SEQ ID NO: 3173442 - DNA, 22 bp, Homo sapiens
cctggtaaccaaatattaaaga

SEQ ID NO: 3173443 - DNA, 20 bp, Homo sapiens
cctggtactccctctcagga

SEQ ID NO: 3173444 - DNA, 19 bp, Homo sapiens
cctggtaggagtgtgtgat

SEQ ID NO: 3173445 - DNA, 18 bp, Homo sapiens
cctggtatatccaaaagc

SEQ ID NO: 3173446 - DNA, 20 bp, Homo sapiens
cctggtatatccaaaagctt

SEQ ID NO: 3173447 - DNA, 14 bp, Homo sapiens
cctggtccagggaa

SEQ ID NO: 3173448 - DNA, 19 bp, Homo sapiens
cctggtccctcgtccacag

SEQ ID NO: 3173449 - DNA, 21 bp, Homo sapiens
cctggtccctcgtccacaggg

SEQ ID NO: 3173450 - DNA, 16 bp, Homo sapiens
cctggtccctctgagg

SEQ ID NO: 3173451 - DNA, 14 bp, Homo sapiens
cctggtccctggga

SEQ ID NO: 3173452 - DNA, 14 bp, Homo sapiens
cctggtcctgaggg

SEQ ID NO: 3173453 - DNA, 23 bp, Homo sapiens
cctggtcctgagggtccccacct

SEQ ID NO: 3173454 - DNA, 18 bp, Homo sapiens
cctggtctccgtggcact

SEQ ID NO: 3173455 - DNA, 22 bp, Homo sapiens
cctggtctggttgggcagccag

SEQ ID NO: 3173456 - DNA, 16 bp, Homo sapiens
cctggtctttcctctg

SEQ ID NO: 3173457 - DNA, 16 bp, Homo sapiens
cctggtgaatggcctt

SEQ ID NO: 3173458 - DNA, 13 bp, Homo sapiens
cctggtgccctga

SEQ ID NO: 3173459 - DNA, 13 bp, Homo sapiens
cctggtgctgctg

SEQ ID NO: 3173460 - DNA, 12 bp, Homo sapiens
cctggtggacag

SEQ ID NO: 3173461 - DNA, 20 bp, Homo sapiens
cctggtggacagtcctggga

SEQ ID NO: 3173462 - DNA, 14 bp, Homo sapiens
cctggtggcaccag

SEQ ID NO: 3173463 - DNA, 17 bp, Homo sapiens
cctggtggcaccagatg

SEQ ID NO: 3173464 - DNA, 16 bp, Homo sapiens
cctggtggcagctgcg

SEQ ID NO: 3173465 - DNA, 17 bp, Homo sapiens
cctggtggcagctgcgg

SEQ ID NO: 3173466 - DNA, 18 bp, Homo sapiens
cctggtggcagctgcggt

SEQ ID NO: 3173467 - DNA, 23 bp, Homo sapiens
cctggtggccttctgctgcccag

SEQ ID NO: 3173468 - DNA, 12 bp, Homo sapiens
cctggttcattg

SEQ ID NO: 3173469 - DNA, 15 bp, Homo sapiens
cctggttgggtggca

SEQ ID NO: 3173470 - DNA, 17 bp, Homo sapiens
cctggtttcactggccc

SEQ ID NO: 3173471 - DNA, 18 bp, Homo sapiens
cctggtttcactggccca

SEQ ID NO: 3173472 - DNA, 19 bp, Homo sapiens
cctggttttgtacactgct

SEQ ID NO: 3173473 - DNA, 21 bp, Homo sapiens
cctggttttgtacactgctgt

SEQ ID NO: 3173474 - DNA, 22 bp, Homo sapiens
cctggtttttggattaaattag

SEQ ID NO: 3173475 - DNA, 13 bp, Homo sapiens
cctgtaaacctga

SEQ ID NO: 3173476 - DNA, 19 bp, Homo sapiens
cctgtaaatggtgtacata

SEQ ID NO: 3173477 - DNA, 19 bp, Homo sapiens
cctgtaacatactggcctg

SEQ ID NO: 3173478 - DNA, 15 bp, Homo sapiens
cctgtaagccaaaga

SEQ ID NO: 3173479 - DNA, 18 bp, Homo sapiens
cctgtaagccaaagaaat

SEQ ID NO: 3173480 - DNA, 23 bp, Homo sapiens
cctgtaagccaaagaaatgaaca

SEQ ID NO: 3173481 - DNA, 19 bp, Homo sapiens
cctgtaagcctgcaagcct

SEQ ID NO: 3173482 - DNA, 14 bp, Homo sapiens
cctgtaatcccagc

SEQ ID NO: 3173483 - DNA, 16 bp, Homo sapiens
cctgtacccagctcct

SEQ ID NO: 3173484 - DNA, 15 bp, Homo sapiens
cctgtactagctttt

SEQ ID NO: 3173485 - DNA, 17 bp, Homo sapiens
cctgtactgttctgtgt

SEQ ID NO: 3173486 - DNA, 18 bp, Homo sapiens
cctgtagacctagggagg

SEQ ID NO: 3173487 - DNA, 14 bp, Homo sapiens
cctgtagactagtg

SEQ ID NO: 3173488 - DNA, 15 bp, Homo sapiens
cctgtagcacttact

SEQ ID NO: 3173489 - DNA, 13 bp, Homo sapiens
cctgtagcagtga

SEQ ID NO: 3173490 - DNA, 13 bp, Homo sapiens
cctgtagccatct

SEQ ID NO: 3173491 - DNA, 20 bp, Homo sapiens
cctgtagctctgcctccctc

SEQ ID NO: 3173492 - DNA, 16 bp, Homo sapiens
cctgtagctttcctgg

SEQ ID NO: 3173493 - DNA, 20 bp, Homo sapiens
cctgtagctttcctggtccc

SEQ ID NO: 3173494 - DNA, 22 bp, Homo sapiens
cctgtagttaggaaataaaacc

SEQ ID NO: 3173495 - DNA, 23 bp, Homo sapiens
cctgtagttaggaaataaaacct

SEQ ID NO: 3173496 - DNA, 20 bp, Homo sapiens
cctgtagttgcgtggactct

SEQ ID NO: 3173497 - DNA, 18 bp, Homo sapiens
cctgtataagtggaggca

SEQ ID NO: 3173498 - DNA, 12 bp, Homo sapiens
cctgtatacttt

SEQ ID NO: 3173499 - DNA, 20 bp, Homo sapiens
cctgtatgttgtacaatcaa

SEQ ID NO: 3173500 - DNA, 13 bp, Homo sapiens
cctgtatgttgtc

SEQ ID NO: 3173501 - DNA, 14 bp, Homo sapiens
cctgtatgttgtcc

SEQ ID NO: 3173502 - DNA, 18 bp, Homo sapiens
cctgtcaagttaacaagg

SEQ ID NO: 3173503 - DNA, 19 bp, Homo sapiens
cctgtcaagttaacaagga

SEQ ID NO: 3173504 - DNA, 13 bp, Homo sapiens
cctgtcagaggct

SEQ ID NO: 3173505 - DNA, 17 bp, Homo sapiens
cctgtcaggctctggcc

SEQ ID NO: 3173506 - DNA, 16 bp, Homo sapiens
cctgtcattgtattca

SEQ ID NO: 3173507 - DNA, 18 bp, Homo sapiens
cctgtccacacccagctc

SEQ ID NO: 3173508 - DNA, 14 bp, Homo sapiens
cctgtccaccctgc

SEQ ID NO: 3173509 - DNA, 17 bp, Homo sapiens
cctgtccaccctgccaa

SEQ ID NO: 3173510 - DNA, 16 bp, Homo sapiens
cctgtccagcctgggc

SEQ ID NO: 3173511 - DNA, 12 bp, Homo sapiens
cctgtcccaccc

SEQ ID NO: 3173512 - DNA, 15 bp, Homo sapiens
cctgtcccaccccca

SEQ ID NO: 3173513 - DNA, 16 bp, Homo sapiens
cctgtcccaccccctt

SEQ ID NO: 3173514 - DNA, 16 bp, Homo sapiens
cctgtcccatgcaggc

SEQ ID NO: 3173515 - DNA, 19 bp, Homo sapiens
cctgtcccatggacactcc

SEQ ID NO: 3173516 - DNA, 14 bp, Homo sapiens
cctgtcccccagct

SEQ ID NO: 3173517 - DNA, 17 bp, Homo sapiens
cctgtccccctcccctc

SEQ ID NO: 3173518 - DNA, 15 bp, Homo sapiens
cctgtcccctcagct

SEQ ID NO: 3173519 - DNA, 13 bp, Homo sapiens
cctgtcccgcctt

SEQ ID NO: 3173520 - DNA, 14 bp, Homo sapiens
cctgtcccgccttc

SEQ ID NO: 3173521 - DNA, 16 bp, Homo sapiens
cctgtcccgccttcct

SEQ ID NO: 3173522 - DNA, 22 bp, Homo sapiens
cctgtcccgccttcctcctcca

SEQ ID NO: 3173523 - DNA, 17 bp, Homo sapiens
cctgtccctcccacctc

SEQ ID NO: 3173524 - DNA, 18 bp, Homo sapiens
cctgtccctcccacctct

SEQ ID NO: 3173525 - DNA, 16 bp, Homo sapiens
cctgtccctgtccccc

SEQ ID NO: 3173526 - DNA, 23 bp, Homo sapiens
cctgtcccttctcttaatttaat

SEQ ID NO: 3173527 - DNA, 21 bp, Homo sapiens
ccttgctttgttttaataaac

SEQ ID NO: 3173528 - DNA, 15 bp, Homo sapiens
ccttggaagtttcat

SEQ ID NO: 3173529 - DNA, 17 bp, Homo sapiens
ccttggacatcctcctc

SEQ ID NO: 3173530 - DNA, 19 bp, Homo sapiens
ccttggaggagagagaccc

SEQ ID NO: 3173531 - DNA, 20 bp, Homo sapiens
ccttggaggagagagacccc

SEQ ID NO: 3173532 - DNA, 22 bp, Homo sapiens
ccttggatcgctaagctggctc

SEQ ID NO: 3173533 - DNA, 16 bp, Homo sapiens
ccttggcagtgtccca

SEQ ID NO: 3173534 - DNA, 22 bp, Homo sapiens
ccttggcatgggcgcaggccca

SEQ ID NO: 3173535 - DNA, 23 bp, Homo sapiens
ccttggcatgggcgcaggcccag

SEQ ID NO: 3173536 - DNA, 13 bp, Homo sapiens
ccttggcccctcg

SEQ ID NO: 3173537 - DNA, 14 bp, Homo sapiens
ccttggcctcagaa

SEQ ID NO: 3173538 - DNA, 19 bp, Homo sapiens
ccttggcctcggcgggctt

SEQ ID NO: 3173539 - DNA, 15 bp, Homo sapiens
ccttggcctgtctca

SEQ ID NO: 3173540 - DNA, 12 bp, Homo sapiens
ccttggctcaga

SEQ ID NO: 3173541 - DNA, 14 bp, Homo sapiens
ccttggctctgcca

SEQ ID NO: 3173542 - DNA, 16 bp, Homo sapiens
ccttggctgcagggag

SEQ ID NO: 3173543 - DNA, 18 bp, Homo sapiens
ccttggcttacctgacct

SEQ ID NO: 3173544 - DNA, 13 bp, Homo sapiens
ccttggcttcctc

SEQ ID NO: 3173545 - DNA, 17 bp, Homo sapiens
ccttggcttctgtgatg

SEQ ID NO: 3173546 - DNA, 12 bp, Homo sapiens
ccttgggacagc

SEQ ID NO: 3173547 - DNA, 19 bp, Homo sapiens
ccttgggacagccagagct

SEQ ID NO: 3173548 - DNA, 15 bp, Homo sapiens
ccttgggctgctcct

SEQ ID NO: 3173549 - DNA, 22 bp, Homo sapiens
ccttggggaatttcctctattg

SEQ ID NO: 3173550 - DNA, 20 bp, Homo sapiens
ccttggggaggacaaaactt

SEQ ID NO: 3173551 - DNA, 15 bp, Homo sapiens
ccttggggcctggct

SEQ ID NO: 3173552 - DNA, 17 bp, Homo sapiens
ccttggggcctggcttg

SEQ ID NO: 3173553 - DNA, 16 bp, Homo sapiens
ccttggggtccctcca

SEQ ID NO: 3173554 - DNA, 19 bp, Homo sapiens
ccttgggttccaaccaggc

SEQ ID NO: 3173555 - DNA, 16 bp, Homo sapiens
ccttggtctttgtatc

SEQ ID NO: 3173556 - DNA, 18 bp, Homo sapiens
ccttggttcatcagtgtt

SEQ ID NO: 3173557 - DNA, 17 bp, Homo sapiens
ccttggttcccttgtgt

SEQ ID NO: 3173558 - DNA, 11 bp, Homo sapiens
ccttgtaaaaa

SEQ ID NO: 3173559 - DNA, 16 bp, Homo sapiens
ccttgtaaaaaaagca

SEQ ID NO: 3173560 - DNA, 18 bp, Homo sapiens
ccttgtaaaaaaagcaaa

SEQ ID NO: 3173561 - DNA, 17 bp, Homo sapiens
ccttgtcctgccagctg

SEQ ID NO: 3173562 - DNA, 20 bp, Homo sapiens
ccttgtctcctactcctgac

SEQ ID NO: 3173563 - DNA, 20 bp, Homo sapiens
ccttgtctctacaaaaaata

SEQ ID NO: 3173564 - DNA, 22 bp, Homo sapiens
ccttgtgcccagggttttgccc

SEQ ID NO: 3173565 - DNA, 18 bp, Homo sapiens
ccttgtgccctgccccca

SEQ ID NO: 3173566 - DNA, 12 bp, Homo sapiens
ccttgtgcttgg

SEQ ID NO: 3173567 - DNA, 18 bp, Homo sapiens
ccttgtgtatatttgtat

SEQ ID NO: 3173568 - DNA, 20 bp, Homo sapiens
ccttgtgtcaagacatttct

SEQ ID NO: 3173569 - DNA, 13 bp, Homo sapiens
ccttgttctattt

SEQ ID NO: 3173570 - DNA, 22 bp, Homo sapiens
ccttgttctatttttcaatcat

SEQ ID NO: 3173571 - DNA, 22 bp, Homo sapiens
ccttgtttatcagatacatcac

SEQ ID NO: 3173572 - DNA, 15 bp, Homo sapiens
ccttgttttctctgt

SEQ ID NO: 3173573 - DNA, 16 bp, Homo sapiens
ccttgttttggacagt

SEQ ID NO: 3173574 - DNA, 20 bp, Homo sapiens
cctttaaaaaaatttaagtg

SEQ ID NO: 3173575 - DNA, 21 bp, Homo sapiens
cctttaaagatgaactctgaa

SEQ ID NO: 3173576 - DNA, 16 bp, Homo sapiens
cctttaacagaaactt

SEQ ID NO: 3173577 - DNA, 19 bp, Homo sapiens
cctttaagaaccttaatga

SEQ ID NO: 3173578 - DNA, 21 bp, Homo sapiens
cctttaagaaccttaatgaca

SEQ ID NO: 3173579 - DNA, 23 bp, Homo sapiens
cctttaagccaaagaaacaagct

SEQ ID NO: 3173580 - DNA, 19 bp, Homo sapiens
cctttactatcattctcag

SEQ ID NO: 3173581 - DNA, 14 bp, Homo sapiens
cctttactgtgctt

SEQ ID NO: 3173582 - DNA, 15 bp, Homo sapiens
cctttacttgacctc

SEQ ID NO: 3173583 - DNA, 23 bp, Homo sapiens
cctttagcacgtttaaagttctg

SEQ ID NO: 3173584 - DNA, 14 bp, Homo sapiens
cctttagcgcccag

SEQ ID NO: 3173585 - DNA, 13 bp, Homo sapiens
cctttagggcagc

SEQ ID NO: 3173586 - DNA, 20 bp, Homo sapiens
cctttagggcagcttgcccc

SEQ ID NO: 3173587 - DNA, 22 bp, Homo sapiens
cctttagggcagcttgccccgg

SEQ ID NO: 3173588 - DNA, 19 bp, Homo sapiens
cctttaggtcaaactccct

SEQ ID NO: 3173589 - DNA, 18 bp, Homo sapiens
cctttagtatcagtgttt

SEQ ID NO: 3173590 - DNA, 21 bp, Homo sapiens
cctttagtatcagtgttttaa

SEQ ID NO: 3173591 - DNA, 23 bp, Homo sapiens
cctttagtccacggacccccaga

SEQ ID NO: 3173592 - DNA, 19 bp, Homo sapiens
cctttatatttagtgaact

SEQ ID NO: 3173593 - DNA, 22 bp, Homo sapiens
cctttatcaaaaaaagactcag

SEQ ID NO: 3173594 - DNA, 16 bp, Homo sapiens
cctttatctttcacct

SEQ ID NO: 3173595 - DNA, 21 bp, Homo sapiens
cctttattgggtatcaagaca

SEQ ID NO: 3173596 - DNA, 15 bp, Homo sapiens
cctttcaaatttcac

SEQ ID NO: 3173597 - DNA, 16 bp, Homo sapiens
cctttcaaatttcaca

SEQ ID NO: 3173598 - DNA, 22 bp, Homo sapiens
cctttcagatgtcttctgcctg

SEQ ID NO: 3173599 - DNA, 16 bp, Homo sapiens
cctttccaaggcttct

SEQ ID NO: 3173600 - DNA, 13 bp, Homo sapiens
cctttccatattt

SEQ ID NO: 3173601 - DNA, 22 bp, Homo sapiens
cctttcccaccattcctgcctt

SEQ ID NO: 3173602 - DNA, 21 bp, Homo sapiens
cctttccccagcatcactccc

SEQ ID NO: 3173603 - DNA, 14 bp, Homo sapiens
cctttccccagccc

SEQ ID NO: 3173604 - DNA, 16 bp, Homo sapiens
cctttccccagcccag

SEQ ID NO: 3173605 - DNA, 13 bp, Homo sapiens
cctttcccctctc

SEQ ID NO: 3173606 - DNA, 14 bp, Homo sapiens
cctttcccctctct

SEQ ID NO: 3173607 - DNA, 15 bp, Homo sapiens
cctttcccctctctg

SEQ ID NO: 3173608 - DNA, 21 bp, Homo sapiens
cctttcccctctctgcccctg

SEQ ID NO: 3173609 - DNA, 16 bp, Homo sapiens
cctttccccttcccct

SEQ ID NO: 3173610 - DNA, 12 bp, Homo sapiens
cctttcccttta

SEQ ID NO: 3173611 - DNA, 17 bp, Homo sapiens
cctttccgcggagccct

SEQ ID NO: 3173612 - DNA, 21 bp, Homo sapiens
cctttccgcggagcccttggc

SEQ ID NO: 3173613 - DNA, 21 bp, Homo sapiens
cctttccgctgtcgccccagg

SEQ ID NO: 3173614 - DNA, 24 bp, Homo sapiens
cctttcctgtgtgtactctgtcca

SEQ ID NO: 3173615 - DNA, 11 bp, Homo sapiens
cctttcctgtt

SEQ ID NO: 3173616 - DNA, 15 bp, Homo sapiens
cctttcctgttcagc

SEQ ID NO: 3173617 - DNA, 18 bp, Homo sapiens
cctttccttccatcccta

SEQ ID NO: 3173618 - DNA, 22 bp, Homo sapiens
cctttctagtcctattctattg

SEQ ID NO: 3173619 - DNA, 18 bp, Homo sapiens
cctttctatcatttttgt

SEQ ID NO: 3173620 - DNA, 18 bp, Homo sapiens
cctttctccagccagcaa

SEQ ID NO: 3173621 - DNA, 12 bp, Homo sapiens
cctttctccagg

SEQ ID NO: 3173622 - DNA, 13 bp, Homo sapiens
cctttctcctgtg

SEQ ID NO: 3173623 - DNA, 23 bp, Homo sapiens
cctttctcctgtgaatggaggca

SEQ ID NO: 3173624 - DNA, 17 bp, Homo sapiens
cctttctctctcctctc

SEQ ID NO: 3173625 - DNA, 21 bp, Homo sapiens
cctttctctctcctctctgct

SEQ ID NO: 3173626 - DNA, 22 bp, Homo sapiens
cctttctctctttatacagctg

SEQ ID NO: 3173627 - DNA, 15 bp, Homo sapiens
cctttctgccgaccc

SEQ ID NO: 3173628 - DNA, 16 bp, Homo sapiens
cctttctgccttggcc

SEQ ID NO: 3173629 - DNA, 18 bp, Homo sapiens
cctttctgccttggcctc

SEQ ID NO: 3173630 - DNA, 14 bp, Homo sapiens
cctttctggctctc

SEQ ID NO: 3173631 - DNA, 14 bp, Homo sapiens
cctttctgggagca

SEQ ID NO: 3173632 - DNA, 13 bp, Homo sapiens
cctttctgtgccc

SEQ ID NO: 3173633 - DNA, 19 bp, Homo sapiens
cctttctgtgccctactca

SEQ ID NO: 3173634 - DNA, 19 bp, Homo sapiens
cctttcttaattttgtctt

SEQ ID NO: 3173635 - DNA, 15 bp, Homo sapiens
cctttcttctgccct

SEQ ID NO: 3173636 - DNA, 16 bp, Homo sapiens
cctttcttctgccctt

SEQ ID NO: 3173637 - DNA, 15 bp, Homo sapiens
cctttcttggccagt

SEQ ID NO: 3173638 - DNA, 16 bp, Homo sapiens
cctttctttttcttct

SEQ ID NO: 3173639 - DNA, 14 bp, Homo sapiens
cctttgacatttaa

SEQ ID NO: 3173640 - DNA, 15 bp, Homo sapiens
cctttgacttcagct

SEQ ID NO: 3173641 - DNA, 19 bp, Homo sapiens
cctttgagacagtttctta

SEQ ID NO: 3173642 - DNA, 18 bp, Homo sapiens
cctttgatcccagaaagt

SEQ ID NO: 3173643 - DNA, 17 bp, Homo sapiens
cctttgcaagatgcttg

SEQ ID NO: 3173644 - DNA, 20 bp, Homo sapiens
cctttgcaagatgcttggtt

SEQ ID NO: 3173645 - DNA, 22 bp, Homo sapiens
cctttgcaatagcagttataac

SEQ ID NO: 3173646 - DNA, 14 bp, Homo sapiens
cctttgcacaggat

SEQ ID NO: 3173647 - DNA, 14 bp, Homo sapiens
cctttgcactgagg

SEQ ID NO: 3173648 - DNA, 16 bp, Homo sapiens
cctttgcactgagggc

SEQ ID NO: 3173649 - DNA, 19 bp, Homo sapiens
cctttgcagatatgatgga

SEQ ID NO: 3173650 - DNA, 14 bp, Homo sapiens
cctttgcagggcag

SEQ ID NO: 3173651 - DNA, 16 bp, Homo sapiens
cctttgcagggcagcc

SEQ ID NO: 3173652 - DNA, 18 bp, Homo sapiens
cctttgcagggcagcccc

SEQ ID NO: 3173653 - DNA, 22 bp, Homo sapiens
cggaagcagtgccttccataat

SEQ ID NO: 3173654 - DNA, 22 bp, Homo sapiens
cggaagccgtctgactccagag

SEQ ID NO: 3173655 - DNA, 13 bp, Homo sapiens
cggaaggaggcca

SEQ ID NO: 3173656 - DNA, 17 bp, Homo sapiens
cggaaggtttttaaaca

SEQ ID NO: 3173657 - DNA, 14 bp, Homo sapiens
cggaatagttggct

SEQ ID NO: 3173658 - DNA, 17 bp, Homo sapiens
cggaatagttggctagg

SEQ ID NO: 3173659 - DNA, 12 bp, Homo sapiens
cggacaaaatat

SEQ ID NO: 3173660 - DNA, 13 bp, Homo sapiens
cggacaataaacc

SEQ ID NO: 3173661 - DNA, 20 bp, Homo sapiens
cggacagccacggccaggcc

SEQ ID NO: 3173662 - DNA, 21 bp, Homo sapiens
cggacagccacggccaggcca

SEQ ID NO: 3173663 - DNA, 14 bp, Homo sapiens
cggacagtcggaaa

SEQ ID NO: 3173664 - DNA, 16 bp, Homo sapiens
cggaccactcgaggcc

SEQ ID NO: 3173665 - DNA, 22 bp, Homo sapiens
cggaccccagctgtgagccttg

SEQ ID NO: 3173666 - DNA, 23 bp, Homo sapiens
cggacccccagagcacccccaag

SEQ ID NO: 3173667 - DNA, 23 bp, Homo sapiens
cggaccgcttgtggggacccagg

SEQ ID NO: 3173668 - DNA, 13 bp, Homo sapiens
cggacgcatctca

SEQ ID NO: 3173669 - DNA, 12 bp, Homo sapiens
cggacgggctgt

SEQ ID NO: 3173670 - DNA, 23 bp, Homo sapiens
cggactcccgggccacgccccag

SEQ ID NO: 3173671 - DNA, 19 bp, Homo sapiens
cggactcctcctttctcct

SEQ ID NO: 3173672 - DNA, 15 bp, Homo sapiens
cggactggtgccctc

SEQ ID NO: 3173673 - DNA, 14 bp, Homo sapiens
cggacttttctgca

SEQ ID NO: 3173674 - DNA, 16 bp, Homo sapiens
cggacttttctgcaaa

SEQ ID NO: 3173675 - DNA, 13 bp, Homo sapiens
cggagagaaaaaa

SEQ ID NO: 3173676 - DNA, 14 bp, Homo sapiens
cggagagcagcagc

SEQ ID NO: 3173677 - DNA, 15 bp, Homo sapiens
cggagagcagcagca

SEQ ID NO: 3173678 - DNA, 12 bp, Homo sapiens
cggagaggctgt

SEQ ID NO: 3173679 - DNA, 20 bp, Homo sapiens
cggagatagatgactttgca

SEQ ID NO: 3173680 - DNA, 19 bp, Homo sapiens
cggagattggacggcctga

SEQ ID NO: 3173681 - DNA, 16 bp, Homo sapiens
cggagcacagccctgg

SEQ ID NO: 3173682 - DNA, 17 bp, Homo sapiens
cggagcacagccctggg

SEQ ID NO: 3173683 - DNA, 21 bp, Homo sapiens
cggagcacagccctgggaggg

SEQ ID NO: 3173684 - DNA, 22 bp, Homo sapiens
cggagcatcccggaggaaatct

SEQ ID NO: 3173685 - DNA, 15 bp, Homo sapiens
cggagcccagcctgg

SEQ ID NO: 3173686 - DNA, 19 bp, Homo sapiens
cggagcccagcctgggagc

SEQ ID NO: 3173687 - DNA, 22 bp, Homo sapiens
cggagccccaggcctctgtgtc

SEQ ID NO: 3173688 - DNA, 12 bp, Homo sapiens
cggaggaaatct

SEQ ID NO: 3173689 - DNA, 21 bp, Homo sapiens
cggaggagctagcctgaagga

SEQ ID NO: 3173690 - DNA, 13 bp, Homo sapiens
cggaggagctgcc

SEQ ID NO: 3173691 - DNA, 19 bp, Homo sapiens
cggaggctgggcccctggg

SEQ ID NO: 3173692 - DNA, 13 bp, Homo sapiens
cggagggatggag

SEQ ID NO: 3173693 - DNA, 16 bp, Homo sapiens
cggagggatggagaaa

SEQ ID NO: 3173694 - DNA, 15 bp, Homo sapiens
cggaggggatccagc

SEQ ID NO: 3173695 - DNA, 17 bp, Homo sapiens
cggaggggatccagcca

SEQ ID NO: 3173696 - DNA, 18 bp, Homo sapiens
cggaggggatccagccac

SEQ ID NO: 3173697 - DNA, 18 bp, Homo sapiens
cggaggggcctggcagcc

SEQ ID NO: 3173698 - DNA, 22 bp, Homo sapiens
cggaggttgcagtgagctgaga

SEQ ID NO: 3173699 - DNA, 18 bp, Homo sapiens
cggagtcccaccttggct

SEQ ID NO: 3173700 - DNA, 21 bp, Homo sapiens
cggagtcccaccttggctgca

SEQ ID NO: 3173701 - DNA, 18 bp, Homo sapiens
cggagtgaagaggggcag

SEQ ID NO: 3173702 - DNA, 19 bp, Homo sapiens
cggagtgaagaggggcagc

SEQ ID NO: 3173703 - DNA, 23 bp, Homo sapiens
cggagtgaagaggggcagccctt

SEQ ID NO: 3173704 - DNA, 18 bp, Homo sapiens
cggagtggggggacagag

SEQ ID NO: 3173705 - DNA, 22 bp, Homo sapiens
cggagtggggggacagagactc

SEQ ID NO: 3173706 - DNA, 16 bp, Homo sapiens
cggagttcctaacagg

SEQ ID NO: 3173707 - DNA, 13 bp, Homo sapiens
cggatcagagcag

SEQ ID NO: 3173708 - DNA, 19 bp, Homo sapiens
cggatcagagcaggacctc

SEQ ID NO: 3173709 - DNA, 15 bp, Homo sapiens
cggatcatcaacaag

SEQ ID NO: 3173710 - DNA, 21 bp, Homo sapiens
cggatcatcaacaagatttcc

SEQ ID NO: 3173711 - DNA, 19 bp, Homo sapiens
cggatcctaagcatctaag

SEQ ID NO: 3173712 - DNA, 20 bp, Homo sapiens
cggatcctaagcatctaagt

SEQ ID NO: 3173713 - DNA, 14 bp, Homo sapiens
cggatcctgctggg

SEQ ID NO: 3173714 - DNA, 15 bp, Homo sapiens
cggatgacaccctgg

SEQ ID NO: 3173715 - DNA, 20 bp, Homo sapiens
cggatgaccaaaccagcctt

SEQ ID NO: 3173716 - DNA, 13 bp, Homo sapiens
cggatgctgcttc

SEQ ID NO: 3173717 - DNA, 14 bp, Homo sapiens
cggatgctgcttcc

SEQ ID NO: 3173718 - DNA, 12 bp, Homo sapiens
cggattccagcc

SEQ ID NO: 3173719 - DNA, 23 bp, Homo sapiens
cggattggcttgtgtgtttcact

SEQ ID NO: 3173720 - DNA, 16 bp, Homo sapiens
cggattttttccaaaa

SEQ ID NO: 3173721 - DNA, 17 bp, Homo sapiens
cggattttttccaaaat

SEQ ID NO: 3173722 - DNA, 18 bp, Homo sapiens
cggcaaaattacctctct

SEQ ID NO: 3173723 - DNA, 14 bp, Homo sapiens
cggcacagggtctg

SEQ ID NO: 3173724 - DNA, 18 bp, Homo sapiens
cggcacagggtctgctct

SEQ ID NO: 3173725 - DNA, 22 bp, Homo sapiens
cggcagaaaacagagcctgcct

SEQ ID NO: 3173726 - DNA, 14 bp, Homo sapiens
cggcagcagccatc

SEQ ID NO: 3173727 - DNA, 14 bp, Homo sapiens
cggcagcgggcgga

SEQ ID NO: 3173728 - DNA, 16 bp, Homo sapiens
cggcaggccctgcagt

SEQ ID NO: 3173729 - DNA, 18 bp, Homo sapiens
cggcaggctcactgccag

SEQ ID NO: 3173730 - DNA, 22 bp, Homo sapiens
cggcaggctcactgccaggcca

SEQ ID NO: 3173731 - DNA, 15 bp, Homo sapiens
cggcagggccaggct

SEQ ID NO: 3173732 - DNA, 17 bp, Homo sapiens
cggcagggccaggctgg

SEQ ID NO: 3173733 - DNA, 20 bp, Homo sapiens
cggcagggcgggcagagggc

SEQ ID NO: 3173734 - DNA, 22 bp, Homo sapiens
cggcagggcgggcagagggctg

SEQ ID NO: 3173735 - DNA, 14 bp, Homo sapiens
cggcaggggcctgg

SEQ ID NO: 3173736 - DNA, 14 bp, Homo sapiens
cggccaaggtgcca

SEQ ID NO: 3173737 - DNA, 23 bp, Homo sapiens
cggccaaggtgccaccaccctgc

SEQ ID NO: 3173738 - DNA, 12 bp, Homo sapiens
cggccaatggaa

SEQ ID NO: 3173739 - DNA, 15 bp, Homo sapiens
cggccaatggaaacc

SEQ ID NO: 3173740 - DNA, 18 bp, Homo sapiens
cggccacacccagcggcc

SEQ ID NO: 3173741 - DNA, 14 bp, Homo sapiens
cggccacctctgcg

SEQ ID NO: 3173742 - DNA, 17 bp, Homo sapiens
cggccacgcactgggcc

SEQ ID NO: 3173743 - DNA, 21 bp, Homo sapiens
cggccacgcactgggccacgg

SEQ ID NO: 3173744 - DNA, 19 bp, Homo sapiens
cggccagcgggcacagggc

SEQ ID NO: 3173745 - DNA, 17 bp, Homo sapiens
cggccagcgtcccaggg

SEQ ID NO: 3173746 - DNA, 11 bp, Homo sapiens
cggccaggcac

SEQ ID NO: 3173747 - DNA, 19 bp, Homo sapiens
cggccaggcacagggcccg

SEQ ID NO: 3173748 - DNA, 20 bp, Homo sapiens
cggccaggcacagggcccgc

SEQ ID NO: 3173749 - DNA, 21 bp, Homo sapiens
cggccaggcattggctcagcc

SEQ ID NO: 3173750 - DNA, 12 bp, Homo sapiens
cggccaggccag

SEQ ID NO: 3173751 - DNA, 21 bp, Homo sapiens
cggcccagaagtttccctcaa

SEQ ID NO: 3173752 - DNA, 15 bp, Homo sapiens
cggcccagtgccact

SEQ ID NO: 3173753 - DNA, 19 bp, Homo sapiens
cggcccagtgccactgccc

SEQ ID NO: 3173754 - DNA, 12 bp, Homo sapiens
cggccccagcca

SEQ ID NO: 3173755 - DNA, 22 bp, Homo sapiens
cggccccagccagagttcctgc

SEQ ID NO: 3173756 - DNA, 17 bp, Homo sapiens
cggccccaggaggggaa

SEQ ID NO: 3173757 - DNA, 21 bp, Homo sapiens
cggccccccgcacagccaccc

SEQ ID NO: 3173758 - DNA, 21 bp, Homo sapiens
cggcccccgaactgtgccttc

SEQ ID NO: 3173759 - DNA, 12 bp, Homo sapiens
cggccctaaggg

SEQ ID NO: 3173760 - DNA, 18 bp, Homo sapiens
cggccctagcccagcgct

SEQ ID NO: 3173761 - DNA, 12 bp, Homo sapiens
cggccctgcaat

SEQ ID NO: 3173762 - DNA, 17 bp, Homo sapiens
cggccctgcagccagct

SEQ ID NO: 3173763 - DNA, 19 bp, Homo sapiens
cggccctgcagccagctca

SEQ ID NO: 3173764 - DNA, 13 bp, Homo sapiens
cggccgctccagg

SEQ ID NO: 3173765 - DNA, 15 bp, Homo sapiens
cggccgctccagggg

SEQ ID NO: 3173766 - DNA, 15 bp, Homo sapiens
cggccggcctggcac

SEQ ID NO: 3173767 - DNA, 21 bp, Homo sapiens
cggcctcagggcgctcagacg

SEQ ID NO: 3173768 - DNA, 12 bp, Homo sapiens
cggcctccatcc

SEQ ID NO: 3173769 - DNA, 16 bp, Homo sapiens
cggcctccatcctgag

SEQ ID NO: 3173770 - DNA, 20 bp, Homo sapiens
cggcctcccaaagtgctggg

SEQ ID NO: 3173771 - DNA, 14 bp, Homo sapiens
cggcctcccgagga

SEQ ID NO: 3173772 - DNA, 17 bp, Homo sapiens
cggcctcctcggagagc

SEQ ID NO: 3173773 - DNA, 22 bp, Homo sapiens
cggcctcctcggagagcagcag

SEQ ID NO: 3173774 - DNA, 23 bp, Homo sapiens
cggcctcctcggagagcagcagc

SEQ ID NO: 3173775 - DNA, 23 bp, Homo sapiens
cggcctcctcttcaccccggcag

SEQ ID NO: 3173776 - DNA, 15 bp, Homo sapiens
cggcctctctggcct

SEQ ID NO: 3173777 - DNA, 18 bp, Homo sapiens
cggcctctctggcctccc

SEQ ID NO: 3173778 - DNA, 20 bp, Homo sapiens
cggcctctctggcctcccac

SEQ ID NO: 3173779 - DNA, 15 bp, Homo sapiens
cggcctgatgctccc

SEQ ID NO: 3173780 - DNA, 18 bp, Homo sapiens
cggcctgctcccagcagc

SEQ ID NO: 3173781 - DNA, 12 bp, Homo sapiens
cggcctggcacc

SEQ ID NO: 3173782 - DNA, 16 bp, Homo sapiens
cggcctggctggtggg

SEQ ID NO: 3173783 - DNA, 20 bp, Homo sapiens
cggcctttatgttttttgta

SEQ ID NO: 3173784 - DNA, 15 bp, Homo sapiens
cggcgccaccatcct

SEQ ID NO: 3173785 - DNA, 15 bp, Homo sapiens
cggcgcccccagtgt

SEQ ID NO: 3173786 - DNA, 14 bp, Homo sapiens
cggcgccctggact

SEQ ID NO: 3173787 - DNA, 18 bp, Homo sapiens
cggcgctgattcctcgtg

SEQ ID NO: 3173788 - DNA, 16 bp, Homo sapiens
cggcgcttcccagcac

SEQ ID NO: 3173789 - DNA, 15 bp, Homo sapiens
cggcggaaagcctgt

SEQ ID NO: 3173790 - DNA, 12 bp, Homo sapiens
cggcggccacgc

SEQ ID NO: 3173791 - DNA, 17 bp, Homo sapiens
cggcggccaggcacagg

SEQ ID NO: 3173792 - DNA, 22 bp, Homo sapiens
cggcggccaggcacagggcccg

SEQ ID NO: 3173793 - DNA, 17 bp, Homo sapiens
cggcgtggagactggca

SEQ ID NO: 3173794 - DNA, 18 bp, Homo sapiens
cggcgtggagactggcag

SEQ ID NO: 3173795 - DNA, 16 bp, Homo sapiens
cggctaagaggctgct

SEQ ID NO: 3173796 - DNA, 16 bp, Homo sapiens
cggctcactgcagcct

SEQ ID NO: 3173797 - DNA, 19 bp, Homo sapiens
cggctcactgcagcctcaa

SEQ ID NO: 3173798 - DNA, 21 bp, Homo sapiens
cggctcgtgtatttattaccg

SEQ ID NO: 3173799 - DNA, 18 bp, Homo sapiens
cggctctttccttgctca

SEQ ID NO: 3173800 - DNA, 16 bp, Homo sapiens
cggctgaccatgctca

SEQ ID NO: 3173801 - DNA, 23 bp, Homo sapiens
cggctgaccatgctcatctgctg

SEQ ID NO: 3173802 - DNA, 12 bp, Homo sapiens
cggctgcagagg

SEQ ID NO: 3173803 - DNA, 15 bp, Homo sapiens
cggctgcctgacact

SEQ ID NO: 3173804 - DNA, 21 bp, Homo sapiens
cggctgcctgacactgagccc

SEQ ID NO: 3173805 - DNA, 21 bp, Homo sapiens
cggctggagaccatgcagagc

SEQ ID NO: 3173806 - DNA, 22 bp, Homo sapiens
cggctggagaccatgcagagcg

SEQ ID NO: 3173807 - DNA, 13 bp, Homo sapiens
cggctggctctgt

SEQ ID NO: 3173808 - DNA, 17 bp, Homo sapiens
cggctggctctgtggag

SEQ ID NO: 3173809 - DNA, 21 bp, Homo sapiens
cggctggctctgtggaggggc

SEQ ID NO: 3173810 - DNA, 18 bp, Homo sapiens
cggctggggactgctacc

SEQ ID NO: 3173811 - DNA, 20 bp, Homo sapiens
cggctgggtcggccctgccc

SEQ ID NO: 3173812 - DNA, 17 bp, Homo sapiens
cggctggttttgtaaga

SEQ ID NO: 3173813 - DNA, 23 bp, Homo sapiens
cggctggttttgtaagatgctgg

SEQ ID NO: 3173814 - DNA, 22 bp, Homo sapiens
cggctgtggaccgtggacaggc

SEQ ID NO: 3173815 - DNA, 12 bp, Homo sapiens
cggctgtggagc

SEQ ID NO: 3173816 - DNA, 13 bp, Homo sapiens
cggctgtggagca

SEQ ID NO: 3173817 - DNA, 15 bp, Homo sapiens
cggcttcatgccagc

SEQ ID NO: 3173818 - DNA, 19 bp, Homo sapiens
cggcttcatgccagctact

SEQ ID NO: 3173819 - DNA, 16 bp, Homo sapiens
cggcttcctgtccact

SEQ ID NO: 3173820 - DNA, 14 bp, Homo sapiens
cggcttgtgggctg

SEQ ID NO: 3173821 - DNA, 17 bp, Homo sapiens
cgggaaagaagaaactc

SEQ ID NO: 3173822 - DNA, 19 bp, Homo sapiens
cgggaaaggaaacgccccg

SEQ ID NO: 3173823 - DNA, 20 bp, Homo sapiens
cgggaacagtgtttcccata

SEQ ID NO: 3173824 - DNA, 14 bp, Homo sapiens
cgggaaccaagcag

SEQ ID NO: 3173825 - DNA, 17 bp, Homo sapiens
cgggaactcctgccaca

SEQ ID NO: 3173826 - DNA, 18 bp, Homo sapiens
cgggacccacggagccct

SEQ ID NO: 3173827 - DNA, 20 bp, Homo sapiens
cgggacccacggagccctcc

SEQ ID NO: 3173828 - DNA, 16 bp, Homo sapiens
cgggagaatcatgtga

SEQ ID NO: 3173829 - DNA, 21 bp, Homo sapiens
cgggagaatcatgtgaacccg

SEQ ID NO: 3173830 - DNA, 12 bp, Homo sapiens
cgggagacagca

SEQ ID NO: 3173831 - DNA, 22 bp, Homo sapiens
cgggagacagcttctctgcagt

SEQ ID NO: 3173832 - DNA, 16 bp, Homo sapiens
cgggagcacccagagc

SEQ ID NO: 3173833 - DNA, 17 bp, Homo sapiens
cgggagcacccagagca

SEQ ID NO: 3173834 - DNA, 20 bp, Homo sapiens
cgggagcagtgtcttccata

SEQ ID NO: 3173835 - DNA, 13 bp, Homo sapiens
cgggagctctgta

SEQ ID NO: 3173836 - DNA, 18 bp, Homo sapiens
cgggagctctgtatggtc

SEQ ID NO: 3173837 - DNA, 20 bp, Homo sapiens
cgggaggatgttctgggaca

SEQ ID NO: 3173838 - DNA, 19 bp, Homo sapiens
cgggaggcaccagctctgt

SEQ ID NO: 3173839 - DNA, 20 bp, Homo sapiens
cgggaggcagaggttgcagt

SEQ ID NO: 3173840 - DNA, 16 bp, Homo sapiens
cgggaggcagagtttg

SEQ ID NO: 3173841 - DNA, 17 bp, Homo sapiens
cgggaggccctggccct

SEQ ID NO: 3173842 - DNA, 13 bp, Homo sapiens
cgggaggctgggc

SEQ ID NO: 3173843 - DNA, 17 bp, Homo sapiens
cgggaggggaaaggctg

SEQ ID NO: 3173844 - DNA, 16 bp, Homo sapiens
cgggatggtcctgggg

SEQ ID NO: 3173845 - DNA, 18 bp, Homo sapiens
cgggatggtcctggggct

SEQ ID NO: 3173846 - DNA, 21 bp, Homo sapiens
cgggattgaagggtcctgccg

SEQ ID NO: 3173847 - DNA, 15 bp, Homo sapiens
cgggcaagaagctgc

SEQ ID NO: 3173848 - DNA, 15 bp, Homo sapiens
cgggcaccagccagc

SEQ ID NO: 3173849 - DNA, 14 bp, Homo sapiens
cgggcactcagaag

SEQ ID NO: 3173850 - DNA, 15 bp, Homo sapiens
cgggcagagggctgg

SEQ ID NO: 3173851 - DNA, 16 bp, Homo sapiens
cgggcagagggctgga

SEQ ID NO: 3173852 - DNA, 18 bp, Homo sapiens
cgggcagagggctggagg

SEQ ID NO: 3173853 - DNA, 23 bp, Homo sapiens
cgggcagagggctggaggcccag

SEQ ID NO: 3173854 - DNA, 13 bp, Homo sapiens
cgggcagccaccc

SEQ ID NO: 3173855 - DNA, 14 bp, Homo sapiens
cgggcagccaccca

SEQ ID NO: 3173856 - DNA, 12 bp, Homo sapiens
cgggcagccagc

SEQ ID NO: 3173857 - DNA, 13 bp, Homo sapiens
cgggcagccagca

SEQ ID NO: 3173858 - DNA, 14 bp, Homo sapiens
cgggcagcgggcca

SEQ ID NO: 3173859 - DNA, 17 bp, Homo sapiens
cgggcagcgggccaggc

SEQ ID NO: 3173860 - DNA, 21 bp, Homo sapiens
cgggcatggtggctcatgcct

SEQ ID NO: 3173861 - DNA, 18 bp, Homo sapiens
cgggccacagggcggtgc

SEQ ID NO: 3173862 - DNA, 16 bp, Homo sapiens
cgggccacgccccagc

SEQ ID NO: 3173863 - DNA, 14 bp, Homo sapiens
cgggccagccaggc

SEQ ID NO: 3173864 - DNA, 18 bp, Homo sapiens
cgggccaggcccgcaccc

SEQ ID NO: 3173865 - DNA, 23 bp, Homo sapiens
cgggccaggcccgcaccccggcc

SEQ ID NO: 3173866 - DNA, 16 bp, Homo sapiens
cgggccatgagggaca

SEQ ID NO: 3173867 - DNA, 22 bp, Homo sapiens
cgggccatgagggacagggtct

SEQ ID NO: 3173868 - DNA, 11 bp, Homo sapiens
cgggcccacct

SEQ ID NO: 3173869 - DNA, 13 bp, Homo sapiens
cgggcccacctgg

SEQ ID NO: 3173870 - DNA, 17 bp, Homo sapiens
cgggcccacctggccac

SEQ ID NO: 3173871 - DNA, 18 bp, Homo sapiens
cgggcccacctggccacc

SEQ ID NO: 3173872 - DNA, 20 bp, Homo sapiens
cgggcccacctggccacctg

SEQ ID NO: 3173873 - DNA, 19 bp, Homo sapiens
cgggcccctccatccaccc

SEQ ID NO: 3173874 - DNA, 15 bp, Homo sapiens
cgggcccctgggctt

SEQ ID NO: 3173875 - DNA, 15 bp, Homo sapiens
cgggccgaggcccag

SEQ ID NO: 3173876 - DNA, 17 bp, Homo sapiens
cgggccgaggcccagcg

SEQ ID NO: 3173877 - DNA, 22 bp, Homo sapiens
cgggccgaggcccagcgggcag

SEQ ID NO: 3173878 - DNA, 16 bp, Homo sapiens
cgggcctggagaacta

SEQ ID NO: 3173879 - DNA, 14 bp, Homo sapiens
cgggcgccatcttc

SEQ ID NO: 3173880 - DNA, 18 bp, Homo sapiens
cgggcgcgggcagccacc

SEQ ID NO: 3173881 - DNA, 16 bp, Homo sapiens
cgggcgcggtggctca

SEQ ID NO: 3173882 - DNA, 23 bp, Homo sapiens
cgggcggaggggatccagccact

SEQ ID NO: 3173883 - DNA, 17 bp, Homo sapiens
cgggcgtggtggcgggc

SEQ ID NO: 3173884 - DNA, 19 bp, Homo sapiens
cgggctaacgggaggctgg

SEQ ID NO: 3173885 - DNA, 20 bp, Homo sapiens
cgggctaacgggaggctggg

SEQ ID NO: 3173886 - DNA, 19 bp, Homo sapiens
cgggctccatgcctctgga

SEQ ID NO: 3173887 - DNA, 16 bp, Homo sapiens
cgggctccctggcagg

SEQ ID NO: 3173888 - DNA, 14 bp, Homo sapiens
cgggctgccctgcc

SEQ ID NO: 3173889 - DNA, 12 bp, Homo sapiens
cgggctggagaa

SEQ ID NO: 3173890 - DNA, 18 bp, Homo sapiens
cgggctggagaaagagct

SEQ ID NO: 3173891 - DNA, 17 bp, Homo sapiens
cgggctggcctgtgcct

SEQ ID NO: 3173892 - DNA, 12 bp, Homo sapiens
cgggctgtgccc

SEQ ID NO: 3173893 - DNA, 20 bp, Homo sapiens
cgggcttttctggggcccag

SEQ ID NO: 3173894 - DNA, 22 bp, Homo sapiens
cggggaagctgccagcccagaa

SEQ ID NO: 3173895 - DNA, 14 bp, Homo sapiens
cggggacagctcct

SEQ ID NO: 3173896 - DNA, 14 bp, Homo sapiens
cggggaccctgtga

SEQ ID NO: 3173897 - DNA, 16 bp, Homo sapiens
cggggaccttggtctg

SEQ ID NO: 3173898 - DNA, 20 bp, Homo sapiens
cggggaccttggtctgatcg

SEQ ID NO: 3173899 - DNA, 17 bp, Homo sapiens
cggggagtttctttcct

SEQ ID NO: 3173900 - DNA, 19 bp, Homo sapiens
cggggagtttctttcctgc

SEQ ID NO: 3173901 - DNA, 16 bp, Homo sapiens
cggggcaggtgcagcc

SEQ ID NO: 3173902 - DNA, 12 bp, Homo sapiens
cggggcccagga

SEQ ID NO: 3173903 - DNA, 20 bp, Homo sapiens
cggggcccttggggcctggc

SEQ ID NO: 3173904 - DNA, 22 bp, Homo sapiens
cggggcctggcgggatgggcca

SEQ ID NO: 3173905 - DNA, 22 bp, Homo sapiens
ctaacaagtcataggttaatat

SEQ ID NO: 3173906 - DNA, 15 bp, Homo sapiens
ctaacaataatattt

SEQ ID NO: 3173907 - DNA, 13 bp, Homo sapiens
ctaacaccagcgt

SEQ ID NO: 3173908 - DNA, 17 bp, Homo sapiens
ctaacagataagcaaga

SEQ ID NO: 3173909 - DNA, 18 bp, Homo sapiens
ctaacagataagcaagag

SEQ ID NO: 3173910 - DNA, 17 bp, Homo sapiens
ctaacagatcagaacat

SEQ ID NO: 3173911 - DNA, 22 bp, Homo sapiens
ctaacagcaacagcaagaaata

SEQ ID NO: 3173912 - DNA, 17 bp, Homo sapiens
ctaacataaaatctgtg

SEQ ID NO: 3173913 - DNA, 18 bp, Homo sapiens
ctaacataaaatctgtga

SEQ ID NO: 3173914 - DNA, 22 bp, Homo sapiens
ctaacatataatgttgttattt

SEQ ID NO: 3173915 - DNA, 22 bp, Homo sapiens
ctaacatggtgaaaccccgtct

SEQ ID NO: 3173916 - DNA, 20 bp, Homo sapiens
ctaacatgttatcaaatctg

SEQ ID NO: 3173917 - DNA, 15 bp, Homo sapiens
ctaacattatattgc

SEQ ID NO: 3173918 - DNA, 22 bp, Homo sapiens
ctaacattatattgcaatgaag

SEQ ID NO: 3173919 - DNA, 21 bp, Homo sapiens
ctaacattttaaataaaagaa

SEQ ID NO: 3173920 - DNA, 21 bp, Homo sapiens
ctaacatttttgataaagcct

SEQ ID NO: 3173921 - DNA, 14 bp, Homo sapiens
ctaaccacgctgga

SEQ ID NO: 3173922 - DNA, 13 bp, Homo sapiens
ctaaccaggccca

SEQ ID NO: 3173923 - DNA, 18 bp, Homo sapiens
ctaaccattaagtcatgt

SEQ ID NO: 3173924 - DNA, 19 bp, Homo sapiens
ctaacccaggtatccaaaa

SEQ ID NO: 3173925 - DNA, 19 bp, Homo sapiens
ctaacctcttttctgcatc

SEQ ID NO: 3173926 - DNA, 18 bp, Homo sapiens
ctaaccttgagtcagaaa

SEQ ID NO: 3173927 - DNA, 16 bp, Homo sapiens
ctaacgggaggctggg

SEQ ID NO: 3173928 - DNA, 22 bp, Homo sapiens
ctaacggtctgttctgtttcaa

SEQ ID NO: 3173929 - DNA, 14 bp, Homo sapiens
ctaactcaccagcc

SEQ ID NO: 3173930 - DNA, 21 bp, Homo sapiens
ctaactcaccagccccactgc

SEQ ID NO: 3173931 - DNA, 15 bp, Homo sapiens
ctaactccaccgcct

SEQ ID NO: 3173932 - DNA, 18 bp, Homo sapiens
ctaactccactggctcca

SEQ ID NO: 3173933 - DNA, 18 bp, Homo sapiens
ctaactcttttctatttt

SEQ ID NO: 3173934 - DNA, 15 bp, Homo sapiens
ctaactgtaaatcat

SEQ ID NO: 3173935 - DNA, 20 bp, Homo sapiens
ctaagaaaagattttaatca

SEQ ID NO: 3173936 - DNA, 16 bp, Homo sapiens
ctaagaaacttttgta

SEQ ID NO: 3173937 - DNA, 15 bp, Homo sapiens
ctaagaaatattcca

SEQ ID NO: 3173938 - DNA, 16 bp, Homo sapiens
ctaagaagcttctaat

SEQ ID NO: 3173939 - DNA, 17 bp, Homo sapiens
ctaagaagcttctaata

SEQ ID NO: 3173940 - DNA, 17 bp, Homo sapiens
ctaagaagttgtttgag

SEQ ID NO: 3173941 - DNA, 22 bp, Homo sapiens
ctaagacacaaatgcatgaaca

SEQ ID NO: 3173942 - DNA, 13 bp, Homo sapiens
ctaagactatata

SEQ ID NO: 3173943 - DNA, 22 bp, Homo sapiens
ctaagactatatatataaatgt

SEQ ID NO: 3173944 - DNA, 19 bp, Homo sapiens
ctaagactcaaatgttcta

SEQ ID NO: 3173945 - DNA, 19 bp, Homo sapiens
ctaagagaaaattgcacta

SEQ ID NO: 3173946 - DNA, 11 bp, Homo sapiens
ctaagagaagt

SEQ ID NO: 3173947 - DNA, 16 bp, Homo sapiens
ctaagagaagttattt

SEQ ID NO: 3173948 - DNA, 22 bp, Homo sapiens
ctaagagaatgataggcttttg

SEQ ID NO: 3173949 - DNA, 12 bp, Homo sapiens
ctaagagattta

SEQ ID NO: 3173950 - DNA, 12 bp, Homo sapiens
ctaagaggctgc

SEQ ID NO: 3173951 - DNA, 16 bp, Homo sapiens
ctaagatagtaacaat

SEQ ID NO: 3173952 - DNA, 19 bp, Homo sapiens
ctaagatgtgatattctaa

SEQ ID NO: 3173953 - DNA, 20 bp, Homo sapiens
ctaagatgtgatattctaag

SEQ ID NO: 3173954 - DNA, 21 bp, Homo sapiens
ctaagatgtgatattctaaga

SEQ ID NO: 3173955 - DNA, 23 bp, Homo sapiens
ctaagatgtgatattctaagact

SEQ ID NO: 3173956 - DNA, 22 bp, Homo sapiens
ctaagattacaaatcagaagtc

SEQ ID NO: 3173957 - DNA, 23 bp, Homo sapiens
ctaagattacaaatcagaagtca

SEQ ID NO: 3173958 - DNA, 13 bp, Homo sapiens
ctaagattctaaa

SEQ ID NO: 3173959 - DNA, 21 bp, Homo sapiens
ctaagattctaatgatgatca

SEQ ID NO: 3173960 - DNA, 12 bp, Homo sapiens
ctaagattctag

SEQ ID NO: 3173961 - DNA, 13 bp, Homo sapiens
ctaagattctaga

SEQ ID NO: 3173962 - DNA, 16 bp, Homo sapiens
ctaagattctagatca

SEQ ID NO: 3173963 - DNA, 18 bp, Homo sapiens
ctaagattctgattttag

SEQ ID NO: 3173964 - DNA, 12 bp, Homo sapiens
ctaagattcttt

SEQ ID NO: 3173965 - DNA, 13 bp, Homo sapiens
ctaagcaatttct

SEQ ID NO: 3173966 - DNA, 21 bp, Homo sapiens
ctaagcatagcaaacagagga

SEQ ID NO: 3173967 - DNA, 15 bp, Homo sapiens
ctaagcattgcctgg

SEQ ID NO: 3173968 - DNA, 17 bp, Homo sapiens
ctaagcctctgcttccg

SEQ ID NO: 3173969 - DNA, 21 bp, Homo sapiens
ctaagctattcagtaataact

SEQ ID NO: 3173970 - DNA, 22 bp, Homo sapiens
ctaagctattcagtaataactc

SEQ ID NO: 3173971 - DNA, 13 bp, Homo sapiens
ctaagctggctct

SEQ ID NO: 3173972 - DNA, 15 bp, Homo sapiens
ctaagctgtgtgcag

SEQ ID NO: 3173973 - DNA, 14 bp, Homo sapiens
ctaaggaaccttcc

SEQ ID NO: 3173974 - DNA, 16 bp, Homo sapiens
ctaaggaatgcacaaa

SEQ ID NO: 3173975 - DNA, 13 bp, Homo sapiens
ctaaggacacact

SEQ ID NO: 3173976 - DNA, 14 bp, Homo sapiens
ctaaggacacacta

SEQ ID NO: 3173977 - DNA, 16 bp, Homo sapiens
ctaaggacacactaat

SEQ ID NO: 3173978 - DNA, 19 bp, Homo sapiens
ctaaggacatttcccaggg

SEQ ID NO: 3173979 - DNA, 20 bp, Homo sapiens
ctaaggacctgaaattccaa

SEQ ID NO: 3173980 - DNA, 22 bp, Homo sapiens
ctaaggacctgaaattccaaag

SEQ ID NO: 3173981 - DNA, 18 bp, Homo sapiens
ctaaggataatgaaataa

SEQ ID NO: 3173982 - DNA, 22 bp, Homo sapiens
ctaaggataatgaaataatcag

SEQ ID NO: 3173983 - DNA, 20 bp, Homo sapiens
ctaaggatagcaccgctttt

SEQ ID NO: 3173984 - DNA, 15 bp, Homo sapiens
ctaaggatctctcag

SEQ ID NO: 3173985 - DNA, 23 bp, Homo sapiens
ctaaggatctctcaggagcacag

SEQ ID NO: 3173986 - DNA, 20 bp, Homo sapiens
ctaaggatgtcacagggcca

SEQ ID NO: 3173987 - DNA, 11 bp, Homo sapiens
ctaaggatttt

SEQ ID NO: 3173988 - DNA, 16 bp, Homo sapiens
ctaaggctcctccttg

SEQ ID NO: 3173989 - DNA, 21 bp, Homo sapiens
ctaaggctctatgagtctaga

SEQ ID NO: 3173990 - DNA, 21 bp, Homo sapiens
ctaaggctctgagagtctaga

SEQ ID NO: 3173991 - DNA, 23 bp, Homo sapiens
ctaaggctctgagagtctagatt

SEQ ID NO: 3173992 - DNA, 14 bp, Homo sapiens
ctaagggaaaggga

SEQ ID NO: 3173993 - DNA, 22 bp, Homo sapiens
ctaagggagtgtttgtgtctga

SEQ ID NO: 3173994 - DNA, 19 bp, Homo sapiens
ctaagggggaggggaagtc

SEQ ID NO: 3173995 - DNA, 19 bp, Homo sapiens
ctaagggtgggtgctcaga

SEQ ID NO: 3173996 - DNA, 22 bp, Homo sapiens
ctaagggtgggtgctcagaata

SEQ ID NO: 3173997 - DNA, 21 bp, Homo sapiens
ctaaggtccggtgttctaaga

SEQ ID NO: 3173998 - DNA, 19 bp, Homo sapiens
ctaaggtctcatgctgttg

SEQ ID NO: 3173999 - DNA, 16 bp, Homo sapiens
ctaaggtgtgctctga

SEQ ID NO: 3174000 - DNA, 14 bp, Homo sapiens
ctaaggttctaagg

SEQ ID NO: 3174001 - DNA, 14 bp, Homo sapiens
ctaaggttctcata

SEQ ID NO: 3174002 - DNA, 13 bp, Homo sapiens
ctaagtactgtaa

SEQ ID NO: 3174003 - DNA, 21 bp, Homo sapiens
ctaagtactgtaataatacct

SEQ ID NO: 3174004 - DNA, 22 bp, Homo sapiens
ctaagtactgtaataatacctc

SEQ ID NO: 3174005 - DNA, 16 bp, Homo sapiens
ctaagtatttaaatgt

SEQ ID NO: 3174006 - DNA, 17 bp, Homo sapiens
ctaagtatttaaatgtt

SEQ ID NO: 3174007 - DNA, 14 bp, Homo sapiens
ctaagtccatcacc

SEQ ID NO: 3174008 - DNA, 14 bp, Homo sapiens
ctaagtgaaaaggt

SEQ ID NO: 3174009 - DNA, 17 bp, Homo sapiens
ctaagtgacatttgtag

SEQ ID NO: 3174010 - DNA, 17 bp, Homo sapiens
ctaagtgcttattacat

SEQ ID NO: 3174011 - DNA, 16 bp, Homo sapiens
ctaagtggattggctt

SEQ ID NO: 3174012 - DNA, 14 bp, Homo sapiens
ctaagttattttat

SEQ ID NO: 3174013 - DNA, 16 bp, Homo sapiens
ctaagttattttatga

SEQ ID NO: 3174014 - DNA, 22 bp, Homo sapiens
ctaagttcatgtttgtaaatta

SEQ ID NO: 3174015 - DNA, 22 bp, Homo sapiens
ctaagtttctaagattctaaag

SEQ ID NO: 3174016 - DNA, 19 bp, Homo sapiens
ctaagtttttttcattttt

SEQ ID NO: 3174017 - DNA, 13 bp, Homo sapiens
ctaataaaagcat

SEQ ID NO: 3174018 - DNA, 15 bp, Homo sapiens
ctaataaacactggc

SEQ ID NO: 3174019 - DNA, 13 bp, Homo sapiens
ctaataaactgta

SEQ ID NO: 3174020 - DNA, 20 bp, Homo sapiens
ctaataaactgtattaaatc

SEQ ID NO: 3174021 - DNA, 21 bp, Homo sapiens
ctaataaactgtattaaatct

SEQ ID NO: 3174022 - DNA, 12 bp, Homo sapiens
ctaataaattat

SEQ ID NO: 3174023 - DNA, 17 bp, Homo sapiens
ctaataaattatacaaa

SEQ ID NO: 3174024 - DNA, 15 bp, Homo sapiens
ctaataatttctaat

SEQ ID NO: 3174025 - DNA, 13 bp, Homo sapiens
ctaatacctctgt

SEQ ID NO: 3174026 - DNA, 15 bp, Homo sapiens
ctaatatatatgaat

SEQ ID NO: 3174027 - DNA, 17 bp, Homo sapiens
ctaatatatatgaataa

SEQ ID NO: 3174028 - DNA, 19 bp, Homo sapiens
ctaatatccaacacaacta

SEQ ID NO: 3174029 - DNA, 18 bp, Homo sapiens
ctaatatgattatacaaa

SEQ ID NO: 3174030 - DNA, 13 bp, Homo sapiens
ctaatattaaaaa

SEQ ID NO: 3174031 - DNA, 15 bp, Homo sapiens
ctaggcaagcaggac

SEQ ID NO: 3174032 - DNA, 17 bp, Homo sapiens
ctaggcaagcaggacct

SEQ ID NO: 3174033 - DNA, 19 bp, Homo sapiens
ctaggcaagcaggacctgg

SEQ ID NO: 3174034 - DNA, 23 bp, Homo sapiens
ctaggcaagcaggacctggcatc

SEQ ID NO: 3174035 - DNA, 19 bp, Homo sapiens
ctaggccaaatgcacaagc

SEQ ID NO: 3174036 - DNA, 20 bp, Homo sapiens
ctaggccaaatgcacaagct

SEQ ID NO: 3174037 - DNA, 20 bp, Homo sapiens
ctaggccccagaggccctgg

SEQ ID NO: 3174038 - DNA, 21 bp, Homo sapiens
ctaggccccagaggccctgga

SEQ ID NO: 3174039 - DNA, 23 bp, Homo sapiens
ctaggccccagaggccctggagg

SEQ ID NO: 3174040 - DNA, 15 bp, Homo sapiens
ctaggcccccacttg

SEQ ID NO: 3174041 - DNA, 17 bp, Homo sapiens
ctaggcccccacttgcc

SEQ ID NO: 3174042 - DNA, 23 bp, Homo sapiens
ctaggcccccacttgcctcttcc

SEQ ID NO: 3174043 - DNA, 19 bp, Homo sapiens
ctaggcctggccagatgca

SEQ ID NO: 3174044 - DNA, 24 bp, Homo sapiens
ctaggcgattttgtctaccatttg

SEQ ID NO: 3174045 - DNA, 15 bp, Homo sapiens
ctaggctcagcggcg

SEQ ID NO: 3174046 - DNA, 23 bp, Homo sapiens
ctaggcttcagcatatttatagc

SEQ ID NO: 3174047 - DNA, 16 bp, Homo sapiens
ctagggccttggaaat

SEQ ID NO: 3174048 - DNA, 16 bp, Homo sapiens
ctaggggaacagacca

SEQ ID NO: 3174049 - DNA, 17 bp, Homo sapiens
ctaggggagaagagccc

SEQ ID NO: 3174050 - DNA, 14 bp, Homo sapiens
ctaggggatgaggg

SEQ ID NO: 3174051 - DNA, 20 bp, Homo sapiens
ctagggtctgataggaacag

SEQ ID NO: 3174052 - DNA, 19 bp, Homo sapiens
ctagggttaggaggtcctt

SEQ ID NO: 3174053 - DNA, 15 bp, Homo sapiens
ctagggttgctggag

SEQ ID NO: 3174054 - DNA, 16 bp, Homo sapiens
ctagggtttcttaaat

SEQ ID NO: 3174055 - DNA, 19 bp, Homo sapiens
ctaggtaatgttttgtata

SEQ ID NO: 3174056 - DNA, 20 bp, Homo sapiens
ctaggtaatgttttgtatat

SEQ ID NO: 3174057 - DNA, 15 bp, Homo sapiens
ctaggtaatttttac

SEQ ID NO: 3174058 - DNA, 14 bp, Homo sapiens
ctaggtacttcagg

SEQ ID NO: 3174059 - DNA, 20 bp, Homo sapiens
ctaggtatcattcaactctc

SEQ ID NO: 3174060 - DNA, 12 bp, Homo sapiens
ctaggtctccag

SEQ ID NO: 3174061 - DNA, 20 bp, Homo sapiens
ctaggtctcctcagggtggg

SEQ ID NO: 3174062 - DNA, 18 bp, Homo sapiens
ctaggtgacagagtgaga

SEQ ID NO: 3174063 - DNA, 24 bp, Homo sapiens
ctaggtgacagagtgagactctgt

SEQ ID NO: 3174064 - DNA, 19 bp, Homo sapiens
ctaggtgcagctcctcagc

SEQ ID NO: 3174065 - DNA, 18 bp, Homo sapiens
ctaggttatacaataacc

SEQ ID NO: 3174066 - DNA, 20 bp, Homo sapiens
ctaggttcccggtcccgagt

SEQ ID NO: 3174067 - DNA, 13 bp, Homo sapiens
ctaggttccctgt

SEQ ID NO: 3174068 - DNA, 18 bp, Homo sapiens
ctaggttggacagccccc

SEQ ID NO: 3174069 - DNA, 13 bp, Homo sapiens
ctaggtttcaaag

SEQ ID NO: 3174070 - DNA, 17 bp, Homo sapiens
ctagtaacaatacatga

SEQ ID NO: 3174071 - DNA, 23 bp, Homo sapiens
ctagtaacaatacatgagaaaga

SEQ ID NO: 3174072 - DNA, 22 bp, Homo sapiens
ctagtaagaagacaaactgctt

SEQ ID NO: 3174073 - DNA, 13 bp, Homo sapiens
ctagtaagatgca

SEQ ID NO: 3174074 - DNA, 22 bp, Homo sapiens
ctagtaagtaattatgcactaa

SEQ ID NO: 3174075 - DNA, 12 bp, Homo sapiens
ctagtacaaatt

SEQ ID NO: 3174076 - DNA, 19 bp, Homo sapiens
ctagtaccctatagagagg

SEQ ID NO: 3174077 - DNA, 18 bp, Homo sapiens
ctagtactctctgctcta

SEQ ID NO: 3174078 - DNA, 13 bp, Homo sapiens
ctagtactgtatt

SEQ ID NO: 3174079 - DNA, 14 bp, Homo sapiens
ctagtactgtattg

SEQ ID NO: 3174080 - DNA, 17 bp, Homo sapiens
ctagtagatttctatga

SEQ ID NO: 3174081 - DNA, 20 bp, Homo sapiens
ctagtcaaaactatttttgt

SEQ ID NO: 3174082 - DNA, 17 bp, Homo sapiens
ctagtcccttcccctcc

SEQ ID NO: 3174083 - DNA, 22 bp, Homo sapiens
ctagtcccttcccctccctggc

SEQ ID NO: 3174084 - DNA, 23 bp, Homo sapiens
ctagtcccttcccctccctggct

SEQ ID NO: 3174085 - DNA, 19 bp, Homo sapiens
ctagtctcctttgcactga

SEQ ID NO: 3174086 - DNA, 23 bp, Homo sapiens
ctagtctgtgtggcaaattaaac

SEQ ID NO: 3174087 - DNA, 20 bp, Homo sapiens
ctagtctgtgtgggactgta

SEQ ID NO: 3174088 - DNA, 16 bp, Homo sapiens
ctagtgaaccacaggt

SEQ ID NO: 3174089 - DNA, 17 bp, Homo sapiens
ctagtgagctgggcatg

SEQ ID NO: 3174090 - DNA, 20 bp, Homo sapiens
ctagtgagtgtgctgacttt

SEQ ID NO: 3174091 - DNA, 15 bp, Homo sapiens
ctagtgatggtcaga

SEQ ID NO: 3174092 - DNA, 23 bp, Homo sapiens
ctagtgcagctgattttaacaat

SEQ ID NO: 3174093 - DNA, 19 bp, Homo sapiens
ctagtgcatttcaaggaat

SEQ ID NO: 3174094 - DNA, 18 bp, Homo sapiens
ctagtgccctccacagcc

SEQ ID NO: 3174095 - DNA, 23 bp, Homo sapiens
ctagtgccctccacagccgcagc

SEQ ID NO: 3174096 - DNA, 21 bp, Homo sapiens
ctagtggctctcagttaaaat

SEQ ID NO: 3174097 - DNA, 15 bp, Homo sapiens
ctagtggcttcaaaa

SEQ ID NO: 3174098 - DNA, 14 bp, Homo sapiens
ctagtggtctttgt

SEQ ID NO: 3174099 - DNA, 19 bp, Homo sapiens
ctagtggtctttgtaagag

SEQ ID NO: 3174100 - DNA, 23 bp, Homo sapiens
ctagtgtacctcctctcagtgtt

SEQ ID NO: 3174101 - DNA, 16 bp, Homo sapiens
ctagtgtgagtggcag

SEQ ID NO: 3174102 - DNA, 18 bp, Homo sapiens
ctagttaaagaaaggaaa

SEQ ID NO: 3174103 - DNA, 13 bp, Homo sapiens
ctagttctttcct

SEQ ID NO: 3174104 - DNA, 23 bp, Homo sapiens
ctagttctttcctccccctgcaa

SEQ ID NO: 3174105 - DNA, 20 bp, Homo sapiens
ctagttgccaaatctggctc

SEQ ID NO: 3174106 - DNA, 14 bp, Homo sapiens
ctagtttacagaaa

SEQ ID NO: 3174107 - DNA, 21 bp, Homo sapiens
ctagtttacagaaaaatcttg

SEQ ID NO: 3174108 - DNA, 16 bp, Homo sapiens
ctagtttgattattat

SEQ ID NO: 3174109 - DNA, 17 bp, Homo sapiens
ctagttttctcctccca

SEQ ID NO: 3174110 - DNA, 18 bp, Homo sapiens
ctagttttctcctcccag

SEQ ID NO: 3174111 - DNA, 19 bp, Homo sapiens
ctagttttctcctcccagg

SEQ ID NO: 3174112 - DNA, 12 bp, Homo sapiens
ctagtttttaat

SEQ ID NO: 3174113 - DNA, 14 bp, Homo sapiens
ctagtttttaattt

SEQ ID NO: 3174114 - DNA, 11 bp, Homo sapiens
ctagtttttta

SEQ ID NO: 3174115 - DNA, 15 bp, Homo sapiens
ctagttttttttgta

SEQ ID NO: 3174116 - DNA, 16 bp, Homo sapiens
ctagttttttttgtaa

SEQ ID NO: 3174117 - DNA, 19 bp, Homo sapiens
ctagttttttttgtaaact

SEQ ID NO: 3174118 - DNA, 13 bp, Homo sapiens
ctataaaactctg

SEQ ID NO: 3174119 - DNA, 23 bp, Homo sapiens
ctataaaatgcagtaacattcta

SEQ ID NO: 3174120 - DNA, 18 bp, Homo sapiens
ctataaaattaaatgcct

SEQ ID NO: 3174121 - DNA, 22 bp, Homo sapiens
ctataaaattaaatgccttgta

SEQ ID NO: 3174122 - DNA, 23 bp, Homo sapiens
ctataaagaagaacttgcatgga

SEQ ID NO: 3174123 - DNA, 15 bp, Homo sapiens
ctataaagtatatat

SEQ ID NO: 3174124 - DNA, 18 bp, Homo sapiens
ctataaatggtgtttttt

SEQ ID NO: 3174125 - DNA, 15 bp, Homo sapiens
ctataaattttttga

SEQ ID NO: 3174126 - DNA, 16 bp, Homo sapiens
ctataaattttttgaa

SEQ ID NO: 3174127 - DNA, 21 bp, Homo sapiens
ctataaattttttgaaacaca

SEQ ID NO: 3174128 - DNA, 22 bp, Homo sapiens
ctataacagaaagtttgtaaaa

SEQ ID NO: 3174129 - DNA, 21 bp, Homo sapiens
ctataacagatcctttcaaaa

SEQ ID NO: 3174130 - DNA, 21 bp, Homo sapiens
ctataacttcttcctgctgga

SEQ ID NO: 3174131 - DNA, 15 bp, Homo sapiens
ctataacttgatgca

SEQ ID NO: 3174132 - DNA, 17 bp, Homo sapiens
ctataagaagccttaat

SEQ ID NO: 3174133 - DNA, 21 bp, Homo sapiens
ctataagaagccttaatttgc

SEQ ID NO: 3174134 - DNA, 21 bp, Homo sapiens
ctataagagaattatatattt

SEQ ID NO: 3174135 - DNA, 21 bp, Homo sapiens
ctataaggagagttcaagcct

SEQ ID NO: 3174136 - DNA, 16 bp, Homo sapiens
ctataagtagttggtt

SEQ ID NO: 3174137 - DNA, 15 bp, Homo sapiens
ctataataaagaagt

SEQ ID NO: 3174138 - DNA, 17 bp, Homo sapiens
ctataatcaaatgattt

SEQ ID NO: 3174139 - DNA, 22 bp, Homo sapiens
ctataatcaaatgatttcatat

SEQ ID NO: 3174140 - DNA, 14 bp, Homo sapiens
ctataatctgtcaa

SEQ ID NO: 3174141 - DNA, 22 bp, Homo sapiens
ctataatctgtcaaaacactgt

SEQ ID NO: 3174142 - DNA, 15 bp, Homo sapiens
ctataatgaagcttt

SEQ ID NO: 3174143 - DNA, 22 bp, Homo sapiens
ctataattccctatcttttagt

SEQ ID NO: 3174144 - DNA, 14 bp, Homo sapiens
ctatacaaatataa

SEQ ID NO: 3174145 - DNA, 14 bp, Homo sapiens
ctatacatagagct

SEQ ID NO: 3174146 - DNA, 20 bp, Homo sapiens
ctatacatatctttattaat

SEQ ID NO: 3174147 - DNA, 22 bp, Homo sapiens
ctatacatatctttattaatca

SEQ ID NO: 3174148 - DNA, 14 bp, Homo sapiens
ctatacatctctcc

SEQ ID NO: 3174149 - DNA, 17 bp, Homo sapiens
ctatactgcatactttt

SEQ ID NO: 3174150 - DNA, 12 bp, Homo sapiens
ctatagactcta

SEQ ID NO: 3174151 - DNA, 21 bp, Homo sapiens
ctatagcctaggtgacagagt

SEQ ID NO: 3174152 - DNA, 13 bp, Homo sapiens
ctatagtcccagc

SEQ ID NO: 3174153 - DNA, 14 bp, Homo sapiens
ctatagttctagac

SEQ ID NO: 3174154 - DNA, 15 bp, Homo sapiens
ctatagttctagaca

SEQ ID NO: 3174155 - DNA, 12 bp, Homo sapiens
ctatataaaata

SEQ ID NO: 3174156 - DNA, 17 bp, Homo sapiens
ctcactgttgcccaggc

SEQ ID NO: 3174157 - DNA, 20 bp, Homo sapiens
ctcactgttgcccaggctgg

SEQ ID NO: 3174158 - DNA, 21 bp, Homo sapiens
ctcactgttgcccaggctggc

SEQ ID NO: 3174159 - DNA, 19 bp, Homo sapiens
ctcactgtttgtttttatt

SEQ ID NO: 3174160 - DNA, 15 bp, Homo sapiens
ctcacttagtccttt

SEQ ID NO: 3174161 - DNA, 21 bp, Homo sapiens
ctcacttatcccaagagaatg

SEQ ID NO: 3174162 - DNA, 18 bp, Homo sapiens
ctcacttcaatgtgtcat

SEQ ID NO: 3174163 - DNA, 14 bp, Homo sapiens
ctcacttcaccctg

SEQ ID NO: 3174164 - DNA, 12 bp, Homo sapiens
ctcacttggggg

SEQ ID NO: 3174165 - DNA, 13 bp, Homo sapiens
ctcactttaaacc

SEQ ID NO: 3174166 - DNA, 11 bp, Homo sapiens
ctcactttcca

SEQ ID NO: 3174167 - DNA, 22 bp, Homo sapiens
ctcactttccaccaagtgtcta

SEQ ID NO: 3174168 - DNA, 20 bp, Homo sapiens
ctcactttcccttgtgtcaa

SEQ ID NO: 3174169 - DNA, 16 bp, Homo sapiens
ctcacttttcatcctt

SEQ ID NO: 3174170 - DNA, 19 bp, Homo sapiens
ctcactttttacccagaac

SEQ ID NO: 3174171 - DNA, 16 bp, Homo sapiens
ctcagaaactcccctg

SEQ ID NO: 3174172 - DNA, 21 bp, Homo sapiens
ctcagaaagaggtctccccat

SEQ ID NO: 3174173 - DNA, 21 bp, Homo sapiens
ctcagaaagtcaccaggactt

SEQ ID NO: 3174174 - DNA, 17 bp, Homo sapiens
ctcagaaagtgcctgac

SEQ ID NO: 3174175 - DNA, 20 bp, Homo sapiens
ctcagaacctgttattttat

SEQ ID NO: 3174176 - DNA, 15 bp, Homo sapiens
ctcagaagacactga

SEQ ID NO: 3174177 - DNA, 22 bp, Homo sapiens
ctcagaagacactgatgggcaa

SEQ ID NO: 3174178 - DNA, 22 bp, Homo sapiens
ctcagaagaggttgggcttcca

SEQ ID NO: 3174179 - DNA, 11 bp, Homo sapiens
ctcagaagcct

SEQ ID NO: 3174180 - DNA, 17 bp, Homo sapiens
ctcagaagcctgaggct

SEQ ID NO: 3174181 - DNA, 16 bp, Homo sapiens
ctcagaaggtattcct

SEQ ID NO: 3174182 - DNA, 19 bp, Homo sapiens
ctcagaataaggcaggcat

SEQ ID NO: 3174183 - DNA, 14 bp, Homo sapiens
ctcagaattatttt

SEQ ID NO: 3174184 - DNA, 22 bp, Homo sapiens
ctcagacactgccgacatcagc

SEQ ID NO: 3174185 - DNA, 19 bp, Homo sapiens
ctcagacatgttttccgtg

SEQ ID NO: 3174186 - DNA, 20 bp, Homo sapiens
ctcagacatgttttccgtga

SEQ ID NO: 3174187 - DNA, 15 bp, Homo sapiens
ctcagacggcggcca

SEQ ID NO: 3174188 - DNA, 16 bp, Homo sapiens
ctcagacggcggccag

SEQ ID NO: 3174189 - DNA, 22 bp, Homo sapiens
ctcagacggcggccaggcacag

SEQ ID NO: 3174190 - DNA, 14 bp, Homo sapiens
ctcagactccgccc

SEQ ID NO: 3174191 - DNA, 15 bp, Homo sapiens
ctcagacttgccagg

SEQ ID NO: 3174192 - DNA, 19 bp, Homo sapiens
ctcagagaaaaatgctccc

SEQ ID NO: 3174193 - DNA, 21 bp, Homo sapiens
ctcagagaaaaatgctcccca

SEQ ID NO: 3174194 - DNA, 20 bp, Homo sapiens
ctcagagaaggaaaagactg

SEQ ID NO: 3174195 - DNA, 14 bp, Homo sapiens
ctcagagcatgtgt

SEQ ID NO: 3174196 - DNA, 13 bp, Homo sapiens
ctcagagccaagt

SEQ ID NO: 3174197 - DNA, 15 bp, Homo sapiens
ctcagagccacccct

SEQ ID NO: 3174198 - DNA, 16 bp, Homo sapiens
ctcagagcttgaagat

SEQ ID NO: 3174199 - DNA, 21 bp, Homo sapiens
ctcagaggcagcttcaagtgc

SEQ ID NO: 3174200 - DNA, 15 bp, Homo sapiens
ctcagaggctgggag

SEQ ID NO: 3174201 - DNA, 16 bp, Homo sapiens
ctcagaggctgggagc

SEQ ID NO: 3174202 - DNA, 19 bp, Homo sapiens
ctcagaggtagggctgcca

SEQ ID NO: 3174203 - DNA, 21 bp, Homo sapiens
ctcagagtccactgtggcact

SEQ ID NO: 3174204 - DNA, 16 bp, Homo sapiens
ctcagatataagagaa

SEQ ID NO: 3174205 - DNA, 13 bp, Homo sapiens
ctcagatgatctc

SEQ ID NO: 3174206 - DNA, 16 bp, Homo sapiens
ctcagatgttaaaata

SEQ ID NO: 3174207 - DNA, 18 bp, Homo sapiens
ctcagcaaggggctctgc

SEQ ID NO: 3174208 - DNA, 21 bp, Homo sapiens
ctcagcaccccttccatgtgg

SEQ ID NO: 3174209 - DNA, 13 bp, Homo sapiens
ctcagcatcctgg

SEQ ID NO: 3174210 - DNA, 22 bp, Homo sapiens
ctcagcatcctggcacccggcc

SEQ ID NO: 3174211 - DNA, 13 bp, Homo sapiens
ctcagcatgcatc

SEQ ID NO: 3174212 - DNA, 16 bp, Homo sapiens
ctcagcatgcatcctt

SEQ ID NO: 3174213 - DNA, 17 bp, Homo sapiens
ctcagccacacccaggc

SEQ ID NO: 3174214 - DNA, 19 bp, Homo sapiens
ctcagccacacccaggcac

SEQ ID NO: 3174215 - DNA, 18 bp, Homo sapiens
ctcagccacgaccagccc

SEQ ID NO: 3174216 - DNA, 20 bp, Homo sapiens
ctcagccacgaccagcccct

SEQ ID NO: 3174217 - DNA, 16 bp, Homo sapiens
ctcagccatttccccc

SEQ ID NO: 3174218 - DNA, 18 bp, Homo sapiens
ctcagccatttccccctc

SEQ ID NO: 3174219 - DNA, 21 bp, Homo sapiens
ctcagccatttccccctcctc

SEQ ID NO: 3174220 - DNA, 19 bp, Homo sapiens
ctcagcccacatagtgatg

SEQ ID NO: 3174221 - DNA, 19 bp, Homo sapiens
ctcagcccacctgcaccca

SEQ ID NO: 3174222 - DNA, 21 bp, Homo sapiens
ctcagcccacctgcacccagg

SEQ ID NO: 3174223 - DNA, 23 bp, Homo sapiens
ctcagcccctaggagtatatttc

SEQ ID NO: 3174224 - DNA, 12 bp, Homo sapiens
ctcagccctcag

SEQ ID NO: 3174225 - DNA, 16 bp, Homo sapiens
ctcagccctcagaaca

SEQ ID NO: 3174226 - DNA, 14 bp, Homo sapiens
ctcagccctccctg

SEQ ID NO: 3174227 - DNA, 11 bp, Homo sapiens
ctcagccctga

SEQ ID NO: 3174228 - DNA, 14 bp, Homo sapiens
ctcagccctgaggt

SEQ ID NO: 3174229 - DNA, 18 bp, Homo sapiens
ctcagcccttgcccccat

SEQ ID NO: 3174230 - DNA, 23 bp, Homo sapiens
ctcagccggcgtggcaaatataa

SEQ ID NO: 3174231 - DNA, 21 bp, Homo sapiens
ctcagcctcagaggagctcta

SEQ ID NO: 3174232 - DNA, 13 bp, Homo sapiens
ctcagcctcccaa

SEQ ID NO: 3174233 - DNA, 16 bp, Homo sapiens
ctcagcctgctgccca

SEQ ID NO: 3174234 - DNA, 15 bp, Homo sapiens
ctcagccttcagaca

SEQ ID NO: 3174235 - DNA, 16 bp, Homo sapiens
ctcagccttcagacag

SEQ ID NO: 3174236 - DNA, 14 bp, Homo sapiens
ctcagcgaatgaat

SEQ ID NO: 3174237 - DNA, 16 bp, Homo sapiens
ctcagcgctcctcctg

SEQ ID NO: 3174238 - DNA, 18 bp, Homo sapiens
ctcagcgctcctcctgtg

SEQ ID NO: 3174239 - DNA, 20 bp, Homo sapiens
ctcagcggcgaccgccctcc

SEQ ID NO: 3174240 - DNA, 23 bp, Homo sapiens
ctcagcggggacagctccttctg

SEQ ID NO: 3174241 - DNA, 23 bp, Homo sapiens
ctcagcgtttttttgtttttaat

SEQ ID NO: 3174242 - DNA, 15 bp, Homo sapiens
ctcagctcagcgcca

SEQ ID NO: 3174243 - DNA, 11 bp, Homo sapiens
ctcagctcccc

SEQ ID NO: 3174244 - DNA, 15 bp, Homo sapiens
ctcagctccccctgt

SEQ ID NO: 3174245 - DNA, 20 bp, Homo sapiens
ctcagctccccctgtcccct

SEQ ID NO: 3174246 - DNA, 15 bp, Homo sapiens
ctcagctctctggga

SEQ ID NO: 3174247 - DNA, 21 bp, Homo sapiens
ctcagctctctgggacctcct

SEQ ID NO: 3174248 - DNA, 13 bp, Homo sapiens
ctcagctctggga

SEQ ID NO: 3174249 - DNA, 22 bp, Homo sapiens
ctcagctctgggagaggatttt

SEQ ID NO: 3174250 - DNA, 14 bp, Homo sapiens
ctcagctcttccat

SEQ ID NO: 3174251 - DNA, 18 bp, Homo sapiens
ctcagctcttccatgatg

SEQ ID NO: 3174252 - DNA, 12 bp, Homo sapiens
ctcagctgcctc

SEQ ID NO: 3174253 - DNA, 14 bp, Homo sapiens
ctcagctgcctcac

SEQ ID NO: 3174254 - DNA, 17 bp, Homo sapiens
ctcagctggaagtctac

SEQ ID NO: 3174255 - DNA, 23 bp, Homo sapiens
ctcagctggaagtctacctgctg

SEQ ID NO: 3174256 - DNA, 13 bp, Homo sapiens
ctcagctggctgt

SEQ ID NO: 3174257 - DNA, 19 bp, Homo sapiens
ctcagctggttactcaggg

SEQ ID NO: 3174258 - DNA, 21 bp, Homo sapiens
ctcagctggttactcagggtt

SEQ ID NO: 3174259 - DNA, 19 bp, Homo sapiens
ctcagctgtcctgcagcaa

SEQ ID NO: 3174260 - DNA, 20 bp, Homo sapiens
ctcagcttatctcttttata

SEQ ID NO: 3174261 - DNA, 14 bp, Homo sapiens
ctcaggaagaagag

SEQ ID NO: 3174262 - DNA, 14 bp, Homo sapiens
ctcaggacccaggc

SEQ ID NO: 3174263 - DNA, 15 bp, Homo sapiens
ctcaggacccaggcc

SEQ ID NO: 3174264 - DNA, 19 bp, Homo sapiens
ctcaggacccaggccctcc

SEQ ID NO: 3174265 - DNA, 18 bp, Homo sapiens
ctcaggagcacaggcagc

SEQ ID NO: 3174266 - DNA, 15 bp, Homo sapiens
ctcaggaggctgagg

SEQ ID NO: 3174267 - DNA, 22 bp, Homo sapiens
ctcaggatatccttatcagagc

SEQ ID NO: 3174268 - DNA, 19 bp, Homo sapiens
ctcaggatttcgtgggtct

SEQ ID NO: 3174269 - DNA, 16 bp, Homo sapiens
ctcaggcaagcccctc

SEQ ID NO: 3174270 - DNA, 19 bp, Homo sapiens
ctcaggcaagcccctcagc

SEQ ID NO: 3174271 - DNA, 13 bp, Homo sapiens
ctcaggcacacag

SEQ ID NO: 3174272 - DNA, 13 bp, Homo sapiens
ctcaggcagctcg

SEQ ID NO: 3174273 - DNA, 20 bp, Homo sapiens
ctcaggcataggcctgggtg

SEQ ID NO: 3174274 - DNA, 23 bp, Homo sapiens
ctcaggcataggcctgggtgctg

SEQ ID NO: 3174275 - DNA, 20 bp, Homo sapiens
ctcaggcgatccacctgtct

SEQ ID NO: 3174276 - DNA, 16 bp, Homo sapiens
ctcaggctctgctggt

SEQ ID NO: 3174277 - DNA, 11 bp, Homo sapiens
ctcagggaccg

SEQ ID NO: 3174278 - DNA, 23 bp, Homo sapiens
ctcagggaccggtgctgcaggag

SEQ ID NO: 3174279 - DNA, 21 bp, Homo sapiens
ctcagggagcagggaaggcct

SEQ ID NO: 3174280 - DNA, 22 bp, Homo sapiens
ctcagggagggagggcggtgga

SEQ ID NO: 3174281 - DNA, 13 bp, Homo sapiens
ctcagggccagga

SEQ ID NO: 3174282 - DNA, 14 bp, Homo sapiens
ctccagctccaaga

SEQ ID NO: 3174283 - DNA, 17 bp, Homo sapiens
ctccagctgcaccagag

SEQ ID NO: 3174284 - DNA, 13 bp, Homo sapiens
ctccagctgcccc

SEQ ID NO: 3174285 - DNA, 14 bp, Homo sapiens
ctccagctgccccg

SEQ ID NO: 3174286 - DNA, 15 bp, Homo sapiens
ctccagctgctgctc

SEQ ID NO: 3174287 - DNA, 21 bp, Homo sapiens
ctccagcttctggtactctcc

SEQ ID NO: 3174288 - DNA, 22 bp, Homo sapiens
ctccagcttctggtactctcct

SEQ ID NO: 3174289 - DNA, 19 bp, Homo sapiens
ctccaggagagagccagga

SEQ ID NO: 3174290 - DNA, 16 bp, Homo sapiens
ctccaggcaccatctc

SEQ ID NO: 3174291 - DNA, 16 bp, Homo sapiens
ctccaggcacccttct

SEQ ID NO: 3174292 - DNA, 15 bp, Homo sapiens
ctccaggcctgcctc

SEQ ID NO: 3174293 - DNA, 20 bp, Homo sapiens
ctccaggcctgcctcccact

SEQ ID NO: 3174294 - DNA, 23 bp, Homo sapiens
ctccaggctcctttagcgcccag

SEQ ID NO: 3174295 - DNA, 20 bp, Homo sapiens
ctccaggctgtatcccatga

SEQ ID NO: 3174296 - DNA, 22 bp, Homo sapiens
ctccaggctgtatcccatgagc

SEQ ID NO: 3174297 - DNA, 18 bp, Homo sapiens
ctccagggagattttgag

SEQ ID NO: 3174298 - DNA, 18 bp, Homo sapiens
ctccagggagcaagacag

SEQ ID NO: 3174299 - DNA, 19 bp, Homo sapiens
ctccagggagcaagacaga

SEQ ID NO: 3174300 - DNA, 22 bp, Homo sapiens
ctccagggagcaagacagagac

SEQ ID NO: 3174301 - DNA, 14 bp, Homo sapiens
ctccaggggcctgc

SEQ ID NO: 3174302 - DNA, 18 bp, Homo sapiens
ctccaggggcctgcagaa

SEQ ID NO: 3174303 - DNA, 19 bp, Homo sapiens
ctccaggggcctgcagaag

SEQ ID NO: 3174304 - DNA, 21 bp, Homo sapiens
ctccaggggcctgcagaagga

SEQ ID NO: 3174305 - DNA, 22 bp, Homo sapiens
ctccaggggcctgcagaaggaa

SEQ ID NO: 3174306 - DNA, 16 bp, Homo sapiens
ctccagggtacatgct

SEQ ID NO: 3174307 - DNA, 15 bp, Homo sapiens
ctccagggtgatttt

SEQ ID NO: 3174308 - DNA, 17 bp, Homo sapiens
ctccaggtcagctgccc

SEQ ID NO: 3174309 - DNA, 14 bp, Homo sapiens
ctccaggtggctct

SEQ ID NO: 3174310 - DNA, 17 bp, Homo sapiens
ctccaggtggctctgag

SEQ ID NO: 3174311 - DNA, 14 bp, Homo sapiens
ctccaggtgtgcac

SEQ ID NO: 3174312 - DNA, 22 bp, Homo sapiens
ctccagtaccataatcttagag

SEQ ID NO: 3174313 - DNA, 15 bp, Homo sapiens
ctccagtatgaaatt

SEQ ID NO: 3174314 - DNA, 20 bp, Homo sapiens
ctccagtattcttgtcaaaa

SEQ ID NO: 3174315 - DNA, 18 bp, Homo sapiens
ctccagtccccctatcct

SEQ ID NO: 3174316 - DNA, 22 bp, Homo sapiens
ctccagtccccctatccttggc

SEQ ID NO: 3174317 - DNA, 17 bp, Homo sapiens
ctccagtgctggatttg

SEQ ID NO: 3174318 - DNA, 18 bp, Homo sapiens
ctccagtgctggatttga

SEQ ID NO: 3174319 - DNA, 14 bp, Homo sapiens
ctccagtgggctga

SEQ ID NO: 3174320 - DNA, 21 bp, Homo sapiens
ctccagtgggctgatgctggg

SEQ ID NO: 3174321 - DNA, 22 bp, Homo sapiens
ctccagtgggctgatgctggga

SEQ ID NO: 3174322 - DNA, 15 bp, Homo sapiens
ctccagttctttata

SEQ ID NO: 3174323 - DNA, 17 bp, Homo sapiens
ctccagtttgcacctgt

SEQ ID NO: 3174324 - DNA, 15 bp, Homo sapiens
ctccataaacagact

SEQ ID NO: 3174325 - DNA, 16 bp, Homo sapiens
ctccatatctccttcc

SEQ ID NO: 3174326 - DNA, 23 bp, Homo sapiens
ctccatattaaaacatatgacca

SEQ ID NO: 3174327 - DNA, 15 bp, Homo sapiens
ctccatcaccctctt

SEQ ID NO: 3174328 - DNA, 22 bp, Homo sapiens
ctccatcaccctcttcctgtga

SEQ ID NO: 3174329 - DNA, 18 bp, Homo sapiens
ctccatcatatgcctgac

SEQ ID NO: 3174330 - DNA, 20 bp, Homo sapiens
ctccatcatatgcctgaccc

SEQ ID NO: 3174331 - DNA, 21 bp, Homo sapiens
ctccatcatatgcctgacccc

SEQ ID NO: 3174332 - DNA, 18 bp, Homo sapiens
ctccatccaaggccaggt

SEQ ID NO: 3174333 - DNA, 13 bp, Homo sapiens
ctccatccctcta

SEQ ID NO: 3174334 - DNA, 11 bp, Homo sapiens
ctccatccctg

SEQ ID NO: 3174335 - DNA, 13 bp, Homo sapiens
ctccatctccact

SEQ ID NO: 3174336 - DNA, 16 bp, Homo sapiens
ctccatctttctacag

SEQ ID NO: 3174337 - DNA, 15 bp, Homo sapiens
ctccatgactggctg

SEQ ID NO: 3174338 - DNA, 18 bp, Homo sapiens
ctccatgactggctgtct

SEQ ID NO: 3174339 - DNA, 13 bp, Homo sapiens
ctccatgagcacc

SEQ ID NO: 3174340 - DNA, 17 bp, Homo sapiens
ctccatgattctctgag

SEQ ID NO: 3174341 - DNA, 19 bp, Homo sapiens
ctccatgattctctgagtg

SEQ ID NO: 3174342 - DNA, 15 bp, Homo sapiens
ctccatgcctctgga

SEQ ID NO: 3174343 - DNA, 13 bp, Homo sapiens
ctccatgctgcct

SEQ ID NO: 3174344 - DNA, 16 bp, Homo sapiens
ctccatgctgcctcca

SEQ ID NO: 3174345 - DNA, 13 bp, Homo sapiens
ctccatgtgggct

SEQ ID NO: 3174346 - DNA, 23 bp, Homo sapiens
ctccatgttagtaatggcagagc

SEQ ID NO: 3174347 - DNA, 22 bp, Homo sapiens
ctccattaggatttgccccttc

SEQ ID NO: 3174348 - DNA, 14 bp, Homo sapiens
ctccattctgacca

SEQ ID NO: 3174349 - DNA, 19 bp, Homo sapiens
ctccatttataaccccagc

SEQ ID NO: 3174350 - DNA, 21 bp, Homo sapiens
ctccatttataaccccagcct

SEQ ID NO: 3174351 - DNA, 22 bp, Homo sapiens
ctccatttataaccccagcctg

SEQ ID NO: 3174352 - DNA, 17 bp, Homo sapiens
ctcccaaagctcagact

SEQ ID NO: 3174353 - DNA, 20 bp, Homo sapiens
ctcccaaagtgctgagatta

SEQ ID NO: 3174354 - DNA, 18 bp, Homo sapiens
ctcccaaagtgctgggat

SEQ ID NO: 3174355 - DNA, 22 bp, Homo sapiens
ctcccaaagtgctgggattaca

SEQ ID NO: 3174356 - DNA, 23 bp, Homo sapiens
ctcccaaagtgctgggattacag

SEQ ID NO: 3174357 - DNA, 17 bp, Homo sapiens
ctcccaacccagccgtc

SEQ ID NO: 3174358 - DNA, 19 bp, Homo sapiens
ctcccaacccccctcctgc

SEQ ID NO: 3174359 - DNA, 18 bp, Homo sapiens
ctcccaaggctgcgtctg

SEQ ID NO: 3174360 - DNA, 16 bp, Homo sapiens
ctcccaagtagctggg

SEQ ID NO: 3174361 - DNA, 22 bp, Homo sapiens
ctcccaagtagctgggattaca

SEQ ID NO: 3174362 - DNA, 17 bp, Homo sapiens
ctcccacactgaaacca

SEQ ID NO: 3174363 - DNA, 15 bp, Homo sapiens
ctcccacacttgctg

SEQ ID NO: 3174364 - DNA, 19 bp, Homo sapiens
ctcccacacttgctggggc

SEQ ID NO: 3174365 - DNA, 16 bp, Homo sapiens
ctcccacagagtgctg

SEQ ID NO: 3174366 - DNA, 20 bp, Homo sapiens
ctcccacagagtgctggact

SEQ ID NO: 3174367 - DNA, 16 bp, Homo sapiens
ctcccacaggcccttc

SEQ ID NO: 3174368 - DNA, 20 bp, Homo sapiens
ctcccacccccatctctccc

SEQ ID NO: 3174369 - DNA, 22 bp, Homo sapiens
ctcccacccccatctctccctc

SEQ ID NO: 3174370 - DNA, 16 bp, Homo sapiens
ctcccaccccggcctc

SEQ ID NO: 3174371 - DNA, 20 bp, Homo sapiens
ctcccacccgatgctgcttt

SEQ ID NO: 3174372 - DNA, 21 bp, Homo sapiens
ctcccacccgatgctgctttc

SEQ ID NO: 3174373 - DNA, 18 bp, Homo sapiens
ctcccaccctgtacctca

SEQ ID NO: 3174374 - DNA, 14 bp, Homo sapiens
ctcccacctcagcc

SEQ ID NO: 3174375 - DNA, 13 bp, Homo sapiens
ctcccacctccag

SEQ ID NO: 3174376 - DNA, 15 bp, Homo sapiens
ctcccacctccagtc

SEQ ID NO: 3174377 - DNA, 13 bp, Homo sapiens
ctcccacctctgt

SEQ ID NO: 3174378 - DNA, 17 bp, Homo sapiens
ctcccacctctgtgacc

SEQ ID NO: 3174379 - DNA, 21 bp, Homo sapiens
ctcccacctctgtgacctcag

SEQ ID NO: 3174380 - DNA, 21 bp, Homo sapiens
ctcccacctgacacaccaggc

SEQ ID NO: 3174381 - DNA, 14 bp, Homo sapiens
ctcccacgtgggag

SEQ ID NO: 3174382 - DNA, 21 bp, Homo sapiens
ctcccacgtgggagacaagaa

SEQ ID NO: 3174383 - DNA, 14 bp, Homo sapiens
ctcccactgagttt

SEQ ID NO: 3174384 - DNA, 13 bp, Homo sapiens
ctcccagaatccc

SEQ ID NO: 3174385 - DNA, 19 bp, Homo sapiens
ctcccagaatcccagccgg

SEQ ID NO: 3174386 - DNA, 21 bp, Homo sapiens
ctcccagaggagccaccagtt

SEQ ID NO: 3174387 - DNA, 18 bp, Homo sapiens
ctcccagaggtccagccc

SEQ ID NO: 3174388 - DNA, 23 bp, Homo sapiens
ctcccagcaagacctcatctgtg

SEQ ID NO: 3174389 - DNA, 17 bp, Homo sapiens
ctcccagcactcccctt

SEQ ID NO: 3174390 - DNA, 20 bp, Homo sapiens
ctcccagcactccccttgcc

SEQ ID NO: 3174391 - DNA, 21 bp, Homo sapiens
ctcccagccctatggatgtgg

SEQ ID NO: 3174392 - DNA, 16 bp, Homo sapiens
ctcccagcctgctgag

SEQ ID NO: 3174393 - DNA, 12 bp, Homo sapiens
ctcccagcgtgt

SEQ ID NO: 3174394 - DNA, 15 bp, Homo sapiens
ctcccagcgtgtgta

SEQ ID NO: 3174395 - DNA, 17 bp, Homo sapiens
ctcccagcgtgtgtatc

SEQ ID NO: 3174396 - DNA, 21 bp, Homo sapiens
ctcccagcgtgtgtatccgac

SEQ ID NO: 3174397 - DNA, 16 bp, Homo sapiens
ctcccagctagggggc

SEQ ID NO: 3174398 - DNA, 20 bp, Homo sapiens
ctcccagctcctttctcctg

SEQ ID NO: 3174399 - DNA, 19 bp, Homo sapiens
ctcccagctgtgctgtgga

SEQ ID NO: 3174400 - DNA, 18 bp, Homo sapiens
ctcccagcttgtaggagc

SEQ ID NO: 3174401 - DNA, 20 bp, Homo sapiens
ctcccagcttgtaggagctg

SEQ ID NO: 3174402 - DNA, 18 bp, Homo sapiens
ctcccaggaactgggcca

SEQ ID NO: 3174403 - DNA, 15 bp, Homo sapiens
ctcccaggccccctg

SEQ ID NO: 3174404 - DNA, 14 bp, Homo sapiens
ctcccaggcgcccc

SEQ ID NO: 3174405 - DNA, 19 bp, Homo sapiens
ctcccaggcgccccttccc

SEQ ID NO: 3174406 - DNA, 19 bp, Homo sapiens
ctcccagggccagggccct

SEQ ID NO: 3174407 - DNA, 16 bp, Homo sapiens
ctccttcagcacggcg

SEQ ID NO: 3174408 - DNA, 22 bp, Homo sapiens
ctccttcattaatgatgatctt

SEQ ID NO: 3174409 - DNA, 20 bp, Homo sapiens
ctccttcccatttctctaca

SEQ ID NO: 3174410 - DNA, 22 bp, Homo sapiens
ctccttcctgattgtttacagt

SEQ ID NO: 3174411 - DNA, 14 bp, Homo sapiens
ctccttccttaccc

SEQ ID NO: 3174412 - DNA, 19 bp, Homo sapiens
ctccttcgcaggcatgtcc

SEQ ID NO: 3174413 - DNA, 14 bp, Homo sapiens
ctccttcgtgtctc

SEQ ID NO: 3174414 - DNA, 14 bp, Homo sapiens
ctccttctgtccta

SEQ ID NO: 3174415 - DNA, 20 bp, Homo sapiens
ctccttctgtcctactctgt

SEQ ID NO: 3174416 - DNA, 14 bp, Homo sapiens
ctccttgagactgg

SEQ ID NO: 3174417 - DNA, 19 bp, Homo sapiens
ctccttgagtgtatgagta

SEQ ID NO: 3174418 - DNA, 10 bp, Homo sapiens
ctccttggcc

SEQ ID NO: 3174419 - DNA, 22 bp, Homo sapiens
ctccttggcctagcccaccctg

SEQ ID NO: 3174420 - DNA, 19 bp, Homo sapiens
ctccttggcttacctgacc

SEQ ID NO: 3174421 - DNA, 13 bp, Homo sapiens
ctccttgggctcc

SEQ ID NO: 3174422 - DNA, 14 bp, Homo sapiens
ctccttgggctcct

SEQ ID NO: 3174423 - DNA, 18 bp, Homo sapiens
ctccttgggctcctggct

SEQ ID NO: 3174424 - DNA, 19 bp, Homo sapiens
ctccttgggctcctggctg

SEQ ID NO: 3174425 - DNA, 20 bp, Homo sapiens
ctccttgggctcctggctgc

SEQ ID NO: 3174426 - DNA, 21 bp, Homo sapiens
ctccttgggctcctggctgcc

SEQ ID NO: 3174427 - DNA, 16 bp, Homo sapiens
ctccttgggctgggac

SEQ ID NO: 3174428 - DNA, 14 bp, Homo sapiens
ctccttggtgcctg

SEQ ID NO: 3174429 - DNA, 16 bp, Homo sapiens
ctcctttcacaacctt

SEQ ID NO: 3174430 - DNA, 17 bp, Homo sapiens
ctcctttcacaaccttc

SEQ ID NO: 3174431 - DNA, 20 bp, Homo sapiens
ctcctttcacaaccttctgt

SEQ ID NO: 3174432 - DNA, 14 bp, Homo sapiens
ctcctttcagggcc

SEQ ID NO: 3174433 - DNA, 12 bp, Homo sapiens
ctcctttctgtg

SEQ ID NO: 3174434 - DNA, 16 bp, Homo sapiens
ctcctttctgtgccct

SEQ ID NO: 3174435 - DNA, 13 bp, Homo sapiens
ctcctttcttttt

SEQ ID NO: 3174436 - DNA, 21 bp, Homo sapiens
ctcctttgcactgagggccac

SEQ ID NO: 3174437 - DNA, 10 bp, Homo sapiens
ctccttttct

SEQ ID NO: 3174438 - DNA, 20 bp, Homo sapiens
ctccttttcttttgttactg

SEQ ID NO: 3174439 - DNA, 20 bp, Homo sapiens
ctccttttgtatcttccttt

SEQ ID NO: 3174440 - DNA, 12 bp, Homo sapiens
ctcgaagcgcgc

SEQ ID NO: 3174441 - DNA, 14 bp, Homo sapiens
ctcgaatctctgtg

SEQ ID NO: 3174442 - DNA, 17 bp, Homo sapiens
ctcgaatctctgtgcct

SEQ ID NO: 3174443 - DNA, 15 bp, Homo sapiens
ctcgacagcgcccct

SEQ ID NO: 3174444 - DNA, 19 bp, Homo sapiens
ctcgacagcgcccctgctg

SEQ ID NO: 3174445 - DNA, 19 bp, Homo sapiens
ctcgacagggcctggagcc

SEQ ID NO: 3174446 - DNA, 21 bp, Homo sapiens
ctcgacccagaatggagcctg

SEQ ID NO: 3174447 - DNA, 20 bp, Homo sapiens
ctcgagatgggtgctggtcc

SEQ ID NO: 3174448 - DNA, 15 bp, Homo sapiens
ctcgagcccagatgg

SEQ ID NO: 3174449 - DNA, 22 bp, Homo sapiens
ctcgaggcaccggcgctgcagg

SEQ ID NO: 3174450 - DNA, 18 bp, Homo sapiens
ctcgagggcagggaccac

SEQ ID NO: 3174451 - DNA, 23 bp, Homo sapiens
ctcgagggcagggaccacaccct

SEQ ID NO: 3174452 - DNA, 16 bp, Homo sapiens
ctcgaggggtgggctg

SEQ ID NO: 3174453 - DNA, 17 bp, Homo sapiens
ctcgaggggtgggctgg

SEQ ID NO: 3174454 - DNA, 22 bp, Homo sapiens
ctcgattttatctttcgcacag

SEQ ID NO: 3174455 - DNA, 21 bp, Homo sapiens
ctcgcacccccctgttctaag

SEQ ID NO: 3174456 - DNA, 23 bp, Homo sapiens
ctcgcacccccctgttctaaggg

SEQ ID NO: 3174457 - DNA, 20 bp, Homo sapiens
ctcgccagcttctcctgcgc

SEQ ID NO: 3174458 - DNA, 13 bp, Homo sapiens
ctcgcccaggaag

SEQ ID NO: 3174459 - DNA, 15 bp, Homo sapiens
ctcgcccaggaaggc

SEQ ID NO: 3174460 - DNA, 21 bp, Homo sapiens
ctcgccccacctccacctgtg

SEQ ID NO: 3174461 - DNA, 20 bp, Homo sapiens
ctcgcctaccaatctctgct

SEQ ID NO: 3174462 - DNA, 23 bp, Homo sapiens
ctcgcctgacaaccactggtctg

SEQ ID NO: 3174463 - DNA, 21 bp, Homo sapiens
ctcgcctgtggacggggaggc

SEQ ID NO: 3174464 - DNA, 14 bp, Homo sapiens
ctcgctcccttcaa

SEQ ID NO: 3174465 - DNA, 12 bp, Homo sapiens
ctcgctgagggc

SEQ ID NO: 3174466 - DNA, 16 bp, Homo sapiens
ctcgcttcccccatag

SEQ ID NO: 3174467 - DNA, 17 bp, Homo sapiens
ctcgctttgttgcccag

SEQ ID NO: 3174468 - DNA, 21 bp, Homo sapiens
ctcggaaccgctcacctagag

SEQ ID NO: 3174469 - DNA, 18 bp, Homo sapiens
ctcggaagccgtctgact

SEQ ID NO: 3174470 - DNA, 13 bp, Homo sapiens
ctcggacccacca

SEQ ID NO: 3174471 - DNA, 18 bp, Homo sapiens
ctcggagactatggcctc

SEQ ID NO: 3174472 - DNA, 19 bp, Homo sapiens
ctcggagactatggcctcg

SEQ ID NO: 3174473 - DNA, 17 bp, Homo sapiens
ctcggagagcagcagca

SEQ ID NO: 3174474 - DNA, 15 bp, Homo sapiens
ctcggaggccccaaa

SEQ ID NO: 3174475 - DNA, 20 bp, Homo sapiens
ctcggatgacaccctggcct

SEQ ID NO: 3174476 - DNA, 21 bp, Homo sapiens
ctcggatgacaccctggcctg

SEQ ID NO: 3174477 - DNA, 23 bp, Homo sapiens
ctcggatgaccaaaccagccttc

SEQ ID NO: 3174478 - DNA, 14 bp, Homo sapiens
ctcggatggggcac

SEQ ID NO: 3174479 - DNA, 16 bp, Homo sapiens
ctcggcaggaaggagc

SEQ ID NO: 3174480 - DNA, 15 bp, Homo sapiens
ctcggcctcccaaag

SEQ ID NO: 3174481 - DNA, 22 bp, Homo sapiens
ctcggcctcccaaagtgctggg

SEQ ID NO: 3174482 - DNA, 22 bp, Homo sapiens
ctcggctccccatgtgtcctgg

SEQ ID NO: 3174483 - DNA, 16 bp, Homo sapiens
ctcgggaagcagccag

SEQ ID NO: 3174484 - DNA, 20 bp, Homo sapiens
ctcgggaggctgaggcagga

SEQ ID NO: 3174485 - DNA, 13 bp, Homo sapiens
ctcgggcccacct

SEQ ID NO: 3174486 - DNA, 16 bp, Homo sapiens
ctcgggcccacctggc

SEQ ID NO: 3174487 - DNA, 21 bp, Homo sapiens
ctcgggcccacctggccacct

SEQ ID NO: 3174488 - DNA, 22 bp, Homo sapiens
ctcgggccgaggcccagcgggc

SEQ ID NO: 3174489 - DNA, 24 bp, Homo sapiens
ctcggggcccttggggcctggctt

SEQ ID NO: 3174490 - DNA, 21 bp, Homo sapiens
ctcggggggtcacaggcccag

SEQ ID NO: 3174491 - DNA, 18 bp, Homo sapiens
ctcgtatatgtctcaggt

SEQ ID NO: 3174492 - DNA, 17 bp, Homo sapiens
ctcgtccacaggggcag

SEQ ID NO: 3174493 - DNA, 19 bp, Homo sapiens
ctcgtccacaggggcaggc

SEQ ID NO: 3174494 - DNA, 15 bp, Homo sapiens
ctcgtcctgtcccag

SEQ ID NO: 3174495 - DNA, 17 bp, Homo sapiens
ctcgtcctgtcccagag

SEQ ID NO: 3174496 - DNA, 14 bp, Homo sapiens
ctcgtgaggggcaa

SEQ ID NO: 3174497 - DNA, 15 bp, Homo sapiens
ctcgtgaggggcaag

SEQ ID NO: 3174498 - DNA, 20 bp, Homo sapiens
ctcgtgaggggcaagctagg

SEQ ID NO: 3174499 - DNA, 17 bp, Homo sapiens
ctcgtgcatccctgaga

SEQ ID NO: 3174500 - DNA, 19 bp, Homo sapiens
ctcgtgcatccctgagaca

SEQ ID NO: 3174501 - DNA, 18 bp, Homo sapiens
ctcgtgcgcatctcagaa

SEQ ID NO: 3174502 - DNA, 12 bp, Homo sapiens
ctcgtggccagc

SEQ ID NO: 3174503 - DNA, 19 bp, Homo sapiens
ctcgtggccagcccggctg

SEQ ID NO: 3174504 - DNA, 23 bp, Homo sapiens
ctcgtggccttccccttttgcct

SEQ ID NO: 3174505 - DNA, 15 bp, Homo sapiens
ctcgtgggagagcca

SEQ ID NO: 3174506 - DNA, 21 bp, Homo sapiens
ctcgtggttattagcaaggct

SEQ ID NO: 3174507 - DNA, 21 bp, Homo sapiens
ctcgtgtacagctcccttccc

SEQ ID NO: 3174508 - DNA, 15 bp, Homo sapiens
ctcgtgtcagctcag

SEQ ID NO: 3174509 - DNA, 16 bp, Homo sapiens
ctcgttcaaaacattc

SEQ ID NO: 3174510 - DNA, 19 bp, Homo sapiens
ctcgttcaaaacattccaa

SEQ ID NO: 3174511 - DNA, 20 bp, Homo sapiens
ctcgttcaaaacattccaag

SEQ ID NO: 3174512 - DNA, 14 bp, Homo sapiens
ctcgttcccaaaga

SEQ ID NO: 3174513 - DNA, 15 bp, Homo sapiens
ctcgttcctttctcc

SEQ ID NO: 3174514 - DNA, 18 bp, Homo sapiens
ctcgttggaagaggaaca

SEQ ID NO: 3174515 - DNA, 16 bp, Homo sapiens
ctcgttttgggccaga

SEQ ID NO: 3174516 - DNA, 21 bp, Homo sapiens
ctcgtttttcttcttaagact

SEQ ID NO: 3174517 - DNA, 13 bp, Homo sapiens
ctctaaaagcacc

SEQ ID NO: 3174518 - DNA, 14 bp, Homo sapiens
ctctaaagaccaaa

SEQ ID NO: 3174519 - DNA, 17 bp, Homo sapiens
ctctaaagaccaaactt

SEQ ID NO: 3174520 - DNA, 23 bp, Homo sapiens
ctctaaagcaataatggtcccat

SEQ ID NO: 3174521 - DNA, 11 bp, Homo sapiens
ctctaaagcac

SEQ ID NO: 3174522 - DNA, 19 bp, Homo sapiens
ctctaaattctttatttct

SEQ ID NO: 3174523 - DNA, 21 bp, Homo sapiens
ctctaacttattttatttcca

SEQ ID NO: 3174524 - DNA, 14 bp, Homo sapiens
ctctaacttctcaa

SEQ ID NO: 3174525 - DNA, 15 bp, Homo sapiens
ctctaacttctcaag

SEQ ID NO: 3174526 - DNA, 22 bp, Homo sapiens
ctctaagatcttagattctctg

SEQ ID NO: 3174527 - DNA, 14 bp, Homo sapiens
ctctaagctgtgtg

SEQ ID NO: 3174528 - DNA, 18 bp, Homo sapiens
ctctaagctgtgtgcagg

SEQ ID NO: 3174529 - DNA, 14 bp, Homo sapiens
ctctaaggttgggc

SEQ ID NO: 3174530 - DNA, 16 bp, Homo sapiens
ctctaattcacagtgc

SEQ ID NO: 3174531 - DNA, 18 bp, Homo sapiens
ctctaattctattaaagt

SEQ ID NO: 3174532 - DNA, 20 bp, Homo sapiens
ctctggctgaaccctgtgct

SEQ ID NO: 3174533 - DNA, 14 bp, Homo sapiens
ctctggcttcccat

SEQ ID NO: 3174534 - DNA, 15 bp, Homo sapiens
ctctgggctcagggc

SEQ ID NO: 3174535 - DNA, 16 bp, Homo sapiens
ctctgggctcagggct

SEQ ID NO: 3174536 - DNA, 22 bp, Homo sapiens
ctctgggctcagggctggagtg

SEQ ID NO: 3174537 - DNA, 17 bp, Homo sapiens
ctctgggctgccatgtg

SEQ ID NO: 3174538 - DNA, 23 bp, Homo sapiens
ctctgggctgtaacgtggcactg

SEQ ID NO: 3174539 - DNA, 17 bp, Homo sapiens
ctctggggccctgggcc

SEQ ID NO: 3174540 - DNA, 22 bp, Homo sapiens
ctctggggctctagggttgctg

SEQ ID NO: 3174541 - DNA, 21 bp, Homo sapiens
ctctggggctgttgaagtcac

SEQ ID NO: 3174542 - DNA, 14 bp, Homo sapiens
ctctggtccacact

SEQ ID NO: 3174543 - DNA, 21 bp, Homo sapiens
ctctggtgagtcttggcggca

SEQ ID NO: 3174544 - DNA, 22 bp, Homo sapiens
ctctggtgagtcttggcggcag

SEQ ID NO: 3174545 - DNA, 18 bp, Homo sapiens
ctctggtgcctccagagg

SEQ ID NO: 3174546 - DNA, 22 bp, Homo sapiens
ctctggttgtttctgttccaaa

SEQ ID NO: 3174547 - DNA, 14 bp, Homo sapiens
ctctggtttctcat

SEQ ID NO: 3174548 - DNA, 23 bp, Homo sapiens
ctctgtaaaaacactgaaaaatt

SEQ ID NO: 3174549 - DNA, 15 bp, Homo sapiens
ctctgtaacatcact

SEQ ID NO: 3174550 - DNA, 17 bp, Homo sapiens
ctctgtagtttatggca

SEQ ID NO: 3174551 - DNA, 18 bp, Homo sapiens
ctctgtagtttatggcag

SEQ ID NO: 3174552 - DNA, 20 bp, Homo sapiens
ctctgtatagaaatctaaaa

SEQ ID NO: 3174553 - DNA, 16 bp, Homo sapiens
ctctgtcacccttgtc

SEQ ID NO: 3174554 - DNA, 13 bp, Homo sapiens
ctctgtcagatgg

SEQ ID NO: 3174555 - DNA, 15 bp, Homo sapiens
ctctgtcagccagcc

SEQ ID NO: 3174556 - DNA, 20 bp, Homo sapiens
ctctgtcagccagccgccct

SEQ ID NO: 3174557 - DNA, 17 bp, Homo sapiens
ctctgtcatcactccct

SEQ ID NO: 3174558 - DNA, 20 bp, Homo sapiens
ctctgtcatcactccctgga

SEQ ID NO: 3174559 - DNA, 16 bp, Homo sapiens
ctctgtccaggccact

SEQ ID NO: 3174560 - DNA, 23 bp, Homo sapiens
ctctgtccaggccactgtggcca

SEQ ID NO: 3174561 - DNA, 17 bp, Homo sapiens
ctctgtccatttatcca

SEQ ID NO: 3174562 - DNA, 15 bp, Homo sapiens
ctctgtcccttgctg

SEQ ID NO: 3174563 - DNA, 14 bp, Homo sapiens
ctctgtcctgcttc

SEQ ID NO: 3174564 - DNA, 16 bp, Homo sapiens
ctctgtcctgcttctg

SEQ ID NO: 3174565 - DNA, 22 bp, Homo sapiens
ctctgtcctgggagtgagctgg

SEQ ID NO: 3174566 - DNA, 16 bp, Homo sapiens
ctctgtctacctggtc

SEQ ID NO: 3174567 - DNA, 22 bp, Homo sapiens
ctctgtctcagacttttgtaca

SEQ ID NO: 3174568 - DNA, 15 bp, Homo sapiens
ctctgtcttgtgttt

SEQ ID NO: 3174569 - DNA, 14 bp, Homo sapiens
ctctgtgacctcag

SEQ ID NO: 3174570 - DNA, 24 bp, Homo sapiens
ctctgtgacctcaggcactagcct

SEQ ID NO: 3174571 - DNA, 15 bp, Homo sapiens
ctctgtgacctgccc

SEQ ID NO: 3174572 - DNA, 23 bp, Homo sapiens
ctctgtgacctgccccgcccagc

SEQ ID NO: 3174573 - DNA, 16 bp, Homo sapiens
ctctgtgcccagcctg

SEQ ID NO: 3174574 - DNA, 16 bp, Homo sapiens
ctctgtgccttctttt

SEQ ID NO: 3174575 - DNA, 19 bp, Homo sapiens
ctctgtggcattgaaatga

SEQ ID NO: 3174576 - DNA, 18 bp, Homo sapiens
ctctgtggcctgtgtcca

SEQ ID NO: 3174577 - DNA, 17 bp, Homo sapiens
ctctgtgggctggcagt

SEQ ID NO: 3174578 - DNA, 15 bp, Homo sapiens
ctctgtgtatatctc

SEQ ID NO: 3174579 - DNA, 23 bp, Homo sapiens
ctctgtgtatatctcttggaaaa

SEQ ID NO: 3174580 - DNA, 19 bp, Homo sapiens
ctctgtgtatttgcttttt

SEQ ID NO: 3174581 - DNA, 15 bp, Homo sapiens
ctctgtgtcaggtgg

SEQ ID NO: 3174582 - DNA, 21 bp, Homo sapiens
ctctgtgtctaagattctaga

SEQ ID NO: 3174583 - DNA, 14 bp, Homo sapiens
ctctgtgtctttct

SEQ ID NO: 3174584 - DNA, 13 bp, Homo sapiens
ctctgtgtgctcc

SEQ ID NO: 3174585 - DNA, 15 bp, Homo sapiens
ctctgtgtgtgtatg

SEQ ID NO: 3174586 - DNA, 16 bp, Homo sapiens
ctctgtgtgtgtatga

SEQ ID NO: 3174587 - DNA, 22 bp, Homo sapiens
ctctgtgttcccagaggcaggc

SEQ ID NO: 3174588 - DNA, 19 bp, Homo sapiens
ctctgttatgtactgtact

SEQ ID NO: 3174589 - DNA, 11 bp, Homo sapiens
ctctgttcaca

SEQ ID NO: 3174590 - DNA, 15 bp, Homo sapiens
ctctgttcatttcac

SEQ ID NO: 3174591 - DNA, 16 bp, Homo sapiens
ctctgttcccccaccc

SEQ ID NO: 3174592 - DNA, 21 bp, Homo sapiens
ctctgttcccccaccctccat

SEQ ID NO: 3174593 - DNA, 16 bp, Homo sapiens
ctctgtttagaacacc

SEQ ID NO: 3174594 - DNA, 18 bp, Homo sapiens
ctcttaaagttggaattt

SEQ ID NO: 3174595 - DNA, 22 bp, Homo sapiens
ctcttaaagttggaatttacca

SEQ ID NO: 3174596 - DNA, 20 bp, Homo sapiens
ctcttaaattatatatttat

SEQ ID NO: 3174597 - DNA, 21 bp, Homo sapiens
ctcttaatctgtgtgtatatt

SEQ ID NO: 3174598 - DNA, 13 bp, Homo sapiens
ctcttaatgttgc

SEQ ID NO: 3174599 - DNA, 16 bp, Homo sapiens
ctcttagaaatgaagg

SEQ ID NO: 3174600 - DNA, 17 bp, Homo sapiens
ctcttagcagcttccag

SEQ ID NO: 3174601 - DNA, 18 bp, Homo sapiens
ctcttagcagcttccaga

SEQ ID NO: 3174602 - DNA, 19 bp, Homo sapiens
ctcttaggaagagaaacca

SEQ ID NO: 3174603 - DNA, 20 bp, Homo sapiens
ctcttagtgattgtgtctgc

SEQ ID NO: 3174604 - DNA, 21 bp, Homo sapiens
ctcttatagaatatttattac

SEQ ID NO: 3174605 - DNA, 15 bp, Homo sapiens
ctcttatctcagtca

SEQ ID NO: 3174606 - DNA, 22 bp, Homo sapiens
ctcttatctcagtcatgcataa

SEQ ID NO: 3174607 - DNA, 13 bp, Homo sapiens
ctcttattgccca

SEQ ID NO: 3174608 - DNA, 21 bp, Homo sapiens
ctcttattgggatatcatttt

SEQ ID NO: 3174609 - DNA, 16 bp, Homo sapiens
ctcttcaactgaccag

SEQ ID NO: 3174610 - DNA, 16 bp, Homo sapiens
ctcttcaccccccact

SEQ ID NO: 3174611 - DNA, 19 bp, Homo sapiens
ctcttcaccccggcaggcc

SEQ ID NO: 3174612 - DNA, 13 bp, Homo sapiens
ctcttcagaacac

SEQ ID NO: 3174613 - DNA, 20 bp, Homo sapiens
ctcttcagactctcagccca

SEQ ID NO: 3174614 - DNA, 19 bp, Homo sapiens
ctcttcagccccttctccc

SEQ ID NO: 3174615 - DNA, 20 bp, Homo sapiens
ctcttcagccccttctcccc

SEQ ID NO: 3174616 - DNA, 14 bp, Homo sapiens
ctcttcaggcctcc

SEQ ID NO: 3174617 - DNA, 15 bp, Homo sapiens
ctcttcaggcctccc

SEQ ID NO: 3174618 - DNA, 18 bp, Homo sapiens
ctcttcaggcctccctct

SEQ ID NO: 3174619 - DNA, 22 bp, Homo sapiens
ctcttcaggttcttagtgtcac

SEQ ID NO: 3174620 - DNA, 21 bp, Homo sapiens
ctcttcagtgactcctgctgg

SEQ ID NO: 3174621 - DNA, 13 bp, Homo sapiens
ctcttcatacttt

SEQ ID NO: 3174622 - DNA, 18 bp, Homo sapiens
ctcttcattcaaactgca

SEQ ID NO: 3174623 - DNA, 11 bp, Homo sapiens
ctcttccaaat

SEQ ID NO: 3174624 - DNA, 21 bp, Homo sapiens
ctcttccagctgcttcaggga

SEQ ID NO: 3174625 - DNA, 23 bp, Homo sapiens
ctcttccagtcttcctgacactt

SEQ ID NO: 3174626 - DNA, 21 bp, Homo sapiens
ctcttcccagaaaaccagtct

SEQ ID NO: 3174627 - DNA, 20 bp, Homo sapiens
ctcttcccatgactgcaccc

SEQ ID NO: 3174628 - DNA, 12 bp, Homo sapiens
ctcttccccaga

SEQ ID NO: 3174629 - DNA, 21 bp, Homo sapiens
ctcttccccagaaaggagact

SEQ ID NO: 3174630 - DNA, 16 bp, Homo sapiens
ctcttcccccttccaa

SEQ ID NO: 3174631 - DNA, 19 bp, Homo sapiens
ctcttccccttgcccttgc

SEQ ID NO: 3174632 - DNA, 14 bp, Homo sapiens
ctcttcccttcaac

SEQ ID NO: 3174633 - DNA, 22 bp, Homo sapiens
ctcttccgaatgggttttctat

SEQ ID NO: 3174634 - DNA, 23 bp, Homo sapiens
ctcttccggagatgtagcaaaac

SEQ ID NO: 3174635 - DNA, 20 bp, Homo sapiens
ctcttccgtgacgtcactgg

SEQ ID NO: 3174636 - DNA, 19 bp, Homo sapiens
ctcttcctacccaaccact

SEQ ID NO: 3174637 - DNA, 20 bp, Homo sapiens
ctcttcctacccaaccactc

SEQ ID NO: 3174638 - DNA, 20 bp, Homo sapiens
ctcttcctaccctccttcca

SEQ ID NO: 3174639 - DNA, 20 bp, Homo sapiens
ctcttcctatccctctccta

SEQ ID NO: 3174640 - DNA, 19 bp, Homo sapiens
ctcttcctggacctgagtc

SEQ ID NO: 3174641 - DNA, 13 bp, Homo sapiens
ctcttcctgtgat

SEQ ID NO: 3174642 - DNA, 16 bp, Homo sapiens
ctcttcgaagccttgc

SEQ ID NO: 3174643 - DNA, 18 bp, Homo sapiens
ctcttcgaagccttgcct

SEQ ID NO: 3174644 - DNA, 15 bp, Homo sapiens
ctcttctaagaggat

SEQ ID NO: 3174645 - DNA, 21 bp, Homo sapiens
ctcttctagatgattttttga

SEQ ID NO: 3174646 - DNA, 21 bp, Homo sapiens
ctcttctatgcaagccttgct

SEQ ID NO: 3174647 - DNA, 14 bp, Homo sapiens
ctcttctccactgg

SEQ ID NO: 3174648 - DNA, 13 bp, Homo sapiens
ctcttctcccaga

SEQ ID NO: 3174649 - DNA, 15 bp, Homo sapiens
ctcttctcccagaat

SEQ ID NO: 3174650 - DNA, 17 bp, Homo sapiens
ctcttctcccagaatcc

SEQ ID NO: 3174651 - DNA, 21 bp, Homo sapiens
ctcttctcccagaatcccagc

SEQ ID NO: 3174652 - DNA, 13 bp, Homo sapiens
ctcttctcctttc

SEQ ID NO: 3174653 - DNA, 14 bp, Homo sapiens
ctcttctcggctca

SEQ ID NO: 3174654 - DNA, 17 bp, Homo sapiens
ctcttctcggctcaggc

SEQ ID NO: 3174655 - DNA, 18 bp, Homo sapiens
ctcttctcggctcaggct

SEQ ID NO: 3174656 - DNA, 19 bp, Homo sapiens
ctcttctcggctcaggctc

SEQ ID NO: 3174657 - DNA, 13 bp, Homo sapiens
ctgagactccaga

SEQ ID NO: 3174658 - DNA, 20 bp, Homo sapiens
ctgagactccagaatctgct

SEQ ID NO: 3174659 - DNA, 17 bp, Homo sapiens
ctgagactctttagagc

SEQ ID NO: 3174660 - DNA, 14 bp, Homo sapiens
ctgagactgcggga

SEQ ID NO: 3174661 - DNA, 18 bp, Homo sapiens
ctgagagaattggctcaa

SEQ ID NO: 3174662 - DNA, 16 bp, Homo sapiens
ctgagagacttttaat

SEQ ID NO: 3174663 - DNA, 13 bp, Homo sapiens
ctgagaggcaggc

SEQ ID NO: 3174664 - DNA, 14 bp, Homo sapiens
ctgagaggcctgga

SEQ ID NO: 3174665 - DNA, 15 bp, Homo sapiens
ctgagaggcctggag

SEQ ID NO: 3174666 - DNA, 19 bp, Homo sapiens
ctgagagtatttaggcaga

SEQ ID NO: 3174667 - DNA, 17 bp, Homo sapiens
ctgagatcccctgagcc

SEQ ID NO: 3174668 - DNA, 15 bp, Homo sapiens
ctgagatttcttaaa

SEQ ID NO: 3174669 - DNA, 20 bp, Homo sapiens
ctgagatttcttaaatcttt

SEQ ID NO: 3174670 - DNA, 16 bp, Homo sapiens
ctgagcaacagagtga

SEQ ID NO: 3174671 - DNA, 24 bp, Homo sapiens
ctgagcaacagagtgagaccctgt

SEQ ID NO: 3174672 - DNA, 18 bp, Homo sapiens
ctgagcaacatctcggga

SEQ ID NO: 3174673 - DNA, 18 bp, Homo sapiens
ctgagcaagaccctgtct

SEQ ID NO: 3174674 - DNA, 17 bp, Homo sapiens
ctgagcaatctgaccct

SEQ ID NO: 3174675 - DNA, 14 bp, Homo sapiens
ctgagcagccgcca

SEQ ID NO: 3174676 - DNA, 15 bp, Homo sapiens
ctgagcagccgccag

SEQ ID NO: 3174677 - DNA, 19 bp, Homo sapiens
ctgagcagccgccagctgg

SEQ ID NO: 3174678 - DNA, 22 bp, Homo sapiens
ctgagcagccgccagctgggag

SEQ ID NO: 3174679 - DNA, 21 bp, Homo sapiens
ctgagcatgatgggaataggg

SEQ ID NO: 3174680 - DNA, 14 bp, Homo sapiens
ctgagcatttgcac

SEQ ID NO: 3174681 - DNA, 15 bp, Homo sapiens
ctgagccaaggaggc

SEQ ID NO: 3174682 - DNA, 16 bp, Homo sapiens
ctgagccaaggaggcc

SEQ ID NO: 3174683 - DNA, 17 bp, Homo sapiens
ctgagccactcgcagtc

SEQ ID NO: 3174684 - DNA, 14 bp, Homo sapiens
ctgagccagattac

SEQ ID NO: 3174685 - DNA, 17 bp, Homo sapiens
ctgagccagattacagg

SEQ ID NO: 3174686 - DNA, 22 bp, Homo sapiens
ctgagccagtgctttaatggca

SEQ ID NO: 3174687 - DNA, 16 bp, Homo sapiens
ctgagcccagctgcct

SEQ ID NO: 3174688 - DNA, 20 bp, Homo sapiens
ctgagcccagctgcctggag

SEQ ID NO: 3174689 - DNA, 16 bp, Homo sapiens
ctgagcccaggccgtt

SEQ ID NO: 3174690 - DNA, 23 bp, Homo sapiens
ctgagcccatgttctgcccccag

SEQ ID NO: 3174691 - DNA, 23 bp, Homo sapiens
ctgagccccacctctccaagtct

SEQ ID NO: 3174692 - DNA, 21 bp, Homo sapiens
ctgagcccccccaacactgtg

SEQ ID NO: 3174693 - DNA, 22 bp, Homo sapiens
ctgagccccgcagacctcccca

SEQ ID NO: 3174694 - DNA, 19 bp, Homo sapiens
ctgagccccgccctcttcc

SEQ ID NO: 3174695 - DNA, 23 bp, Homo sapiens
ctgagccccgccctcttcctgac

SEQ ID NO: 3174696 - DNA, 15 bp, Homo sapiens
ctgagcccgggctgc

SEQ ID NO: 3174697 - DNA, 19 bp, Homo sapiens
ctgagcccgggctgcctgg

SEQ ID NO: 3174698 - DNA, 23 bp, Homo sapiens
ctgagcccgggctgcctgggctg

SEQ ID NO: 3174699 - DNA, 18 bp, Homo sapiens
ctgagccctactccctgc

SEQ ID NO: 3174700 - DNA, 12 bp, Homo sapiens
ctgagccctggc

SEQ ID NO: 3174701 - DNA, 15 bp, Homo sapiens
ctgagccctggcagg

SEQ ID NO: 3174702 - DNA, 14 bp, Homo sapiens
ctgagccctgggga

SEQ ID NO: 3174703 - DNA, 16 bp, Homo sapiens
ctgagcctctgctccc

SEQ ID NO: 3174704 - DNA, 12 bp, Homo sapiens
ctgagcctgtgg

SEQ ID NO: 3174705 - DNA, 13 bp, Homo sapiens
ctgagccttagct

SEQ ID NO: 3174706 - DNA, 20 bp, Homo sapiens
ctgagccttagctcccagct

SEQ ID NO: 3174707 - DNA, 21 bp, Homo sapiens
ctgagccttagctcccagcta

SEQ ID NO: 3174708 - DNA, 17 bp, Homo sapiens
ctgagcgattattatct

SEQ ID NO: 3174709 - DNA, 15 bp, Homo sapiens
ctgagcgcctccatc

SEQ ID NO: 3174710 - DNA, 19 bp, Homo sapiens
ctgagcgcctggatttctg

SEQ ID NO: 3174711 - DNA, 13 bp, Homo sapiens
ctgagcgggaggc

SEQ ID NO: 3174712 - DNA, 16 bp, Homo sapiens
ctgagctatttcatct

SEQ ID NO: 3174713 - DNA, 17 bp, Homo sapiens
ctgagctccccagatct

SEQ ID NO: 3174714 - DNA, 23 bp, Homo sapiens
ctgagctccccagatctcccact

SEQ ID NO: 3174715 - DNA, 15 bp, Homo sapiens
ctgagctgagtggcc

SEQ ID NO: 3174716 - DNA, 13 bp, Homo sapiens
ctgagctgctcac

SEQ ID NO: 3174717 - DNA, 18 bp, Homo sapiens
ctgagctggaaggggcca

SEQ ID NO: 3174718 - DNA, 15 bp, Homo sapiens
ctgagctgggcccag

SEQ ID NO: 3174719 - DNA, 13 bp, Homo sapiens
ctgagctggggcc

SEQ ID NO: 3174720 - DNA, 17 bp, Homo sapiens
ctgagcttagccttgtg

SEQ ID NO: 3174721 - DNA, 22 bp, Homo sapiens
ctgagcttcggttctccagaat

SEQ ID NO: 3174722 - DNA, 16 bp, Homo sapiens
ctgagcttctctgtga

SEQ ID NO: 3174723 - DNA, 22 bp, Homo sapiens
ctgagcttgtcttttctgctga

SEQ ID NO: 3174724 - DNA, 16 bp, Homo sapiens
ctgagctttggggaca

SEQ ID NO: 3174725 - DNA, 17 bp, Homo sapiens
ctgagctttggggacag

SEQ ID NO: 3174726 - DNA, 18 bp, Homo sapiens
ctgagcttttcatggaag

SEQ ID NO: 3174727 - DNA, 19 bp, Homo sapiens
ctgagcttttcatggaagt

SEQ ID NO: 3174728 - DNA, 18 bp, Homo sapiens
ctgaggaagatgggggca

SEQ ID NO: 3174729 - DNA, 23 bp, Homo sapiens
ctgaggaagatgggggcaagaag

SEQ ID NO: 3174730 - DNA, 17 bp, Homo sapiens
ctgaggaatccagaccc

SEQ ID NO: 3174731 - DNA, 20 bp, Homo sapiens
ctgaggacaaagtggaggag

SEQ ID NO: 3174732 - DNA, 22 bp, Homo sapiens
ctgaggacaccagtgaaagaag

SEQ ID NO: 3174733 - DNA, 23 bp, Homo sapiens
ctgaggacaccagtgaaagaagc

SEQ ID NO: 3174734 - DNA, 23 bp, Homo sapiens
ctgaggacactaaccacgctgga

SEQ ID NO: 3174735 - DNA, 15 bp, Homo sapiens
ctgaggactctgcaa

SEQ ID NO: 3174736 - DNA, 22 bp, Homo sapiens
ctgaggactgatttcagagtga

SEQ ID NO: 3174737 - DNA, 22 bp, Homo sapiens
ctgaggacttaaaatattcctg

SEQ ID NO: 3174738 - DNA, 20 bp, Homo sapiens
ctgaggagatgaccagggat

SEQ ID NO: 3174739 - DNA, 22 bp, Homo sapiens
ctgaggagtattaagaatgcag

SEQ ID NO: 3174740 - DNA, 17 bp, Homo sapiens
ctgaggatataagcttt

SEQ ID NO: 3174741 - DNA, 21 bp, Homo sapiens
ctgaggattcaggggctgggg

SEQ ID NO: 3174742 - DNA, 22 bp, Homo sapiens
ctgaggattcaggggctggggg

SEQ ID NO: 3174743 - DNA, 19 bp, Homo sapiens
ctgaggcctagactctgtc

SEQ ID NO: 3174744 - DNA, 11 bp, Homo sapiens
ctgaggcctca

SEQ ID NO: 3174745 - DNA, 13 bp, Homo sapiens
ctgaggcctgagg

SEQ ID NO: 3174746 - DNA, 23 bp, Homo sapiens
ctgaggcctgaggcctgtgcctg

SEQ ID NO: 3174747 - DNA, 20 bp, Homo sapiens
ctgaggcctggactttcctg

SEQ ID NO: 3174748 - DNA, 17 bp, Homo sapiens
ctgaggcgggagaatca

SEQ ID NO: 3174749 - DNA, 21 bp, Homo sapiens
ctgaggctccacttggtctgt

SEQ ID NO: 3174750 - DNA, 22 bp, Homo sapiens
ctgaggctctgacccagtgaga

SEQ ID NO: 3174751 - DNA, 18 bp, Homo sapiens
ctgaggctctttctgggc

SEQ ID NO: 3174752 - DNA, 13 bp, Homo sapiens
ctgaggctgtggt

SEQ ID NO: 3174753 - DNA, 20 bp, Homo sapiens
ctgaggctgtggtcacagcg

SEQ ID NO: 3174754 - DNA, 15 bp, Homo sapiens
ctgaggcttagagag

SEQ ID NO: 3174755 - DNA, 22 bp, Homo sapiens
ctgaggcttagagagaggaggc

SEQ ID NO: 3174756 - DNA, 17 bp, Homo sapiens
ctgaggctttggatttg

SEQ ID NO: 3174757 - DNA, 18 bp, Homo sapiens
ctgaggctttggatttga

SEQ ID NO: 3174758 - DNA, 21 bp, Homo sapiens
ctgaggctttggatttgacat

SEQ ID NO: 3174759 - DNA, 12 bp, Homo sapiens
ctgagggaccaa

SEQ ID NO: 3174760 - DNA, 18 bp, Homo sapiens
ctgagggaccaactgggc

SEQ ID NO: 3174761 - DNA, 19 bp, Homo sapiens
ctgagggaccaactgggcc

SEQ ID NO: 3174762 - DNA, 13 bp, Homo sapiens
ctgagggaggagg

SEQ ID NO: 3174763 - DNA, 15 bp, Homo sapiens
ctgagggaggaggcc

SEQ ID NO: 3174764 - DNA, 16 bp, Homo sapiens
ctgagggaggaggcca

SEQ ID NO: 3174765 - DNA, 23 bp, Homo sapiens
ctgagggaggaggccacctctcc

SEQ ID NO: 3174766 - DNA, 12 bp, Homo sapiens
ctgagggcaaat

SEQ ID NO: 3174767 - DNA, 14 bp, Homo sapiens
ctgagggccacact

SEQ ID NO: 3174768 - DNA, 12 bp, Homo sapiens
ctgaggggaggg

SEQ ID NO: 3174769 - DNA, 21 bp, Homo sapiens
ctgaggggcaacgaagaaaaa

SEQ ID NO: 3174770 - DNA, 22 bp, Homo sapiens
ctgaggggcaacgaagaaaaaa

SEQ ID NO: 3174771 - DNA, 16 bp, Homo sapiens
ctgaggggcatctgcc

SEQ ID NO: 3174772 - DNA, 17 bp, Homo sapiens
ctgaggggcatctgccc

SEQ ID NO: 3174773 - DNA, 19 bp, Homo sapiens
ctgaggggcatctgcccct

SEQ ID NO: 3174774 - DNA, 19 bp, Homo sapiens
ctgagggtccccacctggg

SEQ ID NO: 3174775 - DNA, 16 bp, Homo sapiens
ctgagggtctgggcgg

SEQ ID NO: 3174776 - DNA, 19 bp, Homo sapiens
ctgagggtggagactaagc

SEQ ID NO: 3174777 - DNA, 19 bp, Homo sapiens
ctgagggtgtttcttcctg

SEQ ID NO: 3174778 - DNA, 20 bp, Homo sapiens
ctgagggtgtttcttcctgc

SEQ ID NO: 3174779 - DNA, 14 bp, Homo sapiens
ctgaggtataaaga

SEQ ID NO: 3174780 - DNA, 16 bp, Homo sapiens
ctgaggtataaagaca

SEQ ID NO: 3174781 - DNA, 14 bp, Homo sapiens
ctgaggtcagggag

SEQ ID NO: 3174782 - DNA, 12 bp, Homo sapiens
ctgccagccaca

SEQ ID NO: 3174783 - DNA, 13 bp, Homo sapiens
ctgccagcccaga

SEQ ID NO: 3174784 - DNA, 13 bp, Homo sapiens
ctgccagccccac

SEQ ID NO: 3174785 - DNA, 17 bp, Homo sapiens
ctgccagccccacacag

SEQ ID NO: 3174786 - DNA, 13 bp, Homo sapiens
ctgccagcctggc

SEQ ID NO: 3174787 - DNA, 16 bp, Homo sapiens
ctgccagcctggcttc

SEQ ID NO: 3174788 - DNA, 22 bp, Homo sapiens
ctgccagcctggcttctggagc

SEQ ID NO: 3174789 - DNA, 22 bp, Homo sapiens
ctgccagccttgagccctggct

SEQ ID NO: 3174790 - DNA, 19 bp, Homo sapiens
ctgccagctgccttcctca

SEQ ID NO: 3174791 - DNA, 15 bp, Homo sapiens
ctgccaggagctttg

SEQ ID NO: 3174792 - DNA, 19 bp, Homo sapiens
ctgccaggcaacttttaaa

SEQ ID NO: 3174793 - DNA, 13 bp, Homo sapiens
ctgccaggcacct

SEQ ID NO: 3174794 - DNA, 15 bp, Homo sapiens
ctgccaggcacctgg

SEQ ID NO: 3174795 - DNA, 20 bp, Homo sapiens
ctgccaggcacctggcctgc

SEQ ID NO: 3174796 - DNA, 12 bp, Homo sapiens
ctgccaggcagg

SEQ ID NO: 3174797 - DNA, 13 bp, Homo sapiens
ctgccaggcaggg

SEQ ID NO: 3174798 - DNA, 15 bp, Homo sapiens
ctgccaggccagcct

SEQ ID NO: 3174799 - DNA, 18 bp, Homo sapiens
ctgccaggccagcctccg

SEQ ID NO: 3174800 - DNA, 19 bp, Homo sapiens
ctgccaggccagcctccga

SEQ ID NO: 3174801 - DNA, 13 bp, Homo sapiens
ctgccaggcccat

SEQ ID NO: 3174802 - DNA, 22 bp, Homo sapiens
ctgccaggcgttggtgccactt

SEQ ID NO: 3174803 - DNA, 23 bp, Homo sapiens
ctgccaggcgttggtgccacttc

SEQ ID NO: 3174804 - DNA, 13 bp, Homo sapiens
ctgccagggagct

SEQ ID NO: 3174805 - DNA, 13 bp, Homo sapiens
ctgccagggcagt

SEQ ID NO: 3174806 - DNA, 15 bp, Homo sapiens
ctgccagggcagtgc

SEQ ID NO: 3174807 - DNA, 12 bp, Homo sapiens
ctgccagtgaca

SEQ ID NO: 3174808 - DNA, 19 bp, Homo sapiens
ctgccagtgacagacaggc

SEQ ID NO: 3174809 - DNA, 23 bp, Homo sapiens
ctgccagtgacagacaggctctt

SEQ ID NO: 3174810 - DNA, 14 bp, Homo sapiens
ctgccagtgcagcc

SEQ ID NO: 3174811 - DNA, 16 bp, Homo sapiens
ctgccagtgcagccac

SEQ ID NO: 3174812 - DNA, 17 bp, Homo sapiens
ctgccagtgcagccact

SEQ ID NO: 3174813 - DNA, 18 bp, Homo sapiens
ctgccagtgcagccactg

SEQ ID NO: 3174814 - DNA, 16 bp, Homo sapiens
ctgccagtgctggtca

SEQ ID NO: 3174815 - DNA, 16 bp, Homo sapiens
ctgccatattctgttg

SEQ ID NO: 3174816 - DNA, 22 bp, Homo sapiens
ctgccatattctgttggccagt

SEQ ID NO: 3174817 - DNA, 19 bp, Homo sapiens
ctgccatcaccgctgggtg

SEQ ID NO: 3174818 - DNA, 17 bp, Homo sapiens
ctgccatctagccagcc

SEQ ID NO: 3174819 - DNA, 23 bp, Homo sapiens
ctgccatcttagtttggattctt

SEQ ID NO: 3174820 - DNA, 15 bp, Homo sapiens
ctgccatgatagctg

SEQ ID NO: 3174821 - DNA, 14 bp, Homo sapiens
ctgccatgccactg

SEQ ID NO: 3174822 - DNA, 18 bp, Homo sapiens
ctgccatgccactgccag

SEQ ID NO: 3174823 - DNA, 14 bp, Homo sapiens
ctgccatgccagga

SEQ ID NO: 3174824 - DNA, 15 bp, Homo sapiens
ctgccatgggccagc

SEQ ID NO: 3174825 - DNA, 16 bp, Homo sapiens
ctgccatgggccagcc

SEQ ID NO: 3174826 - DNA, 19 bp, Homo sapiens
ctgccatgggccagcctag

SEQ ID NO: 3174827 - DNA, 23 bp, Homo sapiens
ctgccatgggccagcctagccct

SEQ ID NO: 3174828 - DNA, 19 bp, Homo sapiens
ctgccatgtactagtttta

SEQ ID NO: 3174829 - DNA, 22 bp, Homo sapiens
ctgccatgtccatagccataat

SEQ ID NO: 3174830 - DNA, 23 bp, Homo sapiens
ctgccatgtttagtgaatgactt

SEQ ID NO: 3174831 - DNA, 21 bp, Homo sapiens
ctgccatttcccttctggaca

SEQ ID NO: 3174832 - DNA, 21 bp, Homo sapiens
ctgccatttgcaccctccgcc

SEQ ID NO: 3174833 - DNA, 17 bp, Homo sapiens
ctgcccaaaaatatggt

SEQ ID NO: 3174834 - DNA, 16 bp, Homo sapiens
ctgcccaagcccaggc

SEQ ID NO: 3174835 - DNA, 17 bp, Homo sapiens
ctgcccaagggcctccc

SEQ ID NO: 3174836 - DNA, 16 bp, Homo sapiens
ctgcccaatgctttgg

SEQ ID NO: 3174837 - DNA, 21 bp, Homo sapiens
ctgcccaatgctttgggaggc

SEQ ID NO: 3174838 - DNA, 22 bp, Homo sapiens
ctgcccacaaaaaattgctcct

SEQ ID NO: 3174839 - DNA, 23 bp, Homo sapiens
ctgcccacaaaaaattgctccta

SEQ ID NO: 3174840 - DNA, 21 bp, Homo sapiens
ctgcccacaactcccttgcac

SEQ ID NO: 3174841 - DNA, 15 bp, Homo sapiens
ctgcccaccccctca

SEQ ID NO: 3174842 - DNA, 18 bp, Homo sapiens
ctgcccacgatcccctcc

SEQ ID NO: 3174843 - DNA, 20 bp, Homo sapiens
ctgcccacgatcccctcccc

SEQ ID NO: 3174844 - DNA, 13 bp, Homo sapiens
ctgcccactgttt

SEQ ID NO: 3174845 - DNA, 22 bp, Homo sapiens
ctgcccactgtttctcttgagc

SEQ ID NO: 3174846 - DNA, 23 bp, Homo sapiens
ctgcccagccccgctcaggccta

SEQ ID NO: 3174847 - DNA, 16 bp, Homo sapiens
ctgcccaggccacagc

SEQ ID NO: 3174848 - DNA, 17 bp, Homo sapiens
ctgcccaggccacagcc

SEQ ID NO: 3174849 - DNA, 13 bp, Homo sapiens
ctgcccaggcccc

SEQ ID NO: 3174850 - DNA, 14 bp, Homo sapiens
ctgcccaggcccct

SEQ ID NO: 3174851 - DNA, 20 bp, Homo sapiens
ctgcccaggcccctgccacc

SEQ ID NO: 3174852 - DNA, 17 bp, Homo sapiens
ctgcccaggcctgcctg

SEQ ID NO: 3174853 - DNA, 18 bp, Homo sapiens
ctgcccaggcctgcctgt

SEQ ID NO: 3174854 - DNA, 16 bp, Homo sapiens
ctgcccaggggtgccc

SEQ ID NO: 3174855 - DNA, 12 bp, Homo sapiens
ctgcccagtgtt

SEQ ID NO: 3174856 - DNA, 15 bp, Homo sapiens
ctgcccatcacaggg

SEQ ID NO: 3174857 - DNA, 22 bp, Homo sapiens
ctgcccatcacagggttgggcc

SEQ ID NO: 3174858 - DNA, 18 bp, Homo sapiens
ctgcccatcatgtggccc

SEQ ID NO: 3174859 - DNA, 22 bp, Homo sapiens
ctgcccatgtgtcccctcactc

SEQ ID NO: 3174860 - DNA, 21 bp, Homo sapiens
ctgccccaaataacttcagtc

SEQ ID NO: 3174861 - DNA, 12 bp, Homo sapiens
ctgccccaagca

SEQ ID NO: 3174862 - DNA, 15 bp, Homo sapiens
ctgccccaagcagcc

SEQ ID NO: 3174863 - DNA, 19 bp, Homo sapiens
ctgccccaagcagccagcc

SEQ ID NO: 3174864 - DNA, 16 bp, Homo sapiens
ctgccccaagccccca

SEQ ID NO: 3174865 - DNA, 17 bp, Homo sapiens
ctgccccacacggactc

SEQ ID NO: 3174866 - DNA, 22 bp, Homo sapiens
ctgccccacacggactcccggg

SEQ ID NO: 3174867 - DNA, 21 bp, Homo sapiens
ctgccccacccaccccacaga

SEQ ID NO: 3174868 - DNA, 14 bp, Homo sapiens
ctgccccagccaga

SEQ ID NO: 3174869 - DNA, 16 bp, Homo sapiens
ctgccccagcccaagt

SEQ ID NO: 3174870 - DNA, 18 bp, Homo sapiens
ctgccccagcccaagtcc

SEQ ID NO: 3174871 - DNA, 19 bp, Homo sapiens
ctgccccagcccaagtcca

SEQ ID NO: 3174872 - DNA, 15 bp, Homo sapiens
ctgccccaggcctga

SEQ ID NO: 3174873 - DNA, 21 bp, Homo sapiens
ctgcccccacgagggtcagga

SEQ ID NO: 3174874 - DNA, 14 bp, Homo sapiens
ctgcccccactgtc

SEQ ID NO: 3174875 - DNA, 16 bp, Homo sapiens
ctgcccccagcccaaa

SEQ ID NO: 3174876 - DNA, 18 bp, Homo sapiens
ctgcccccagcccaaagg

SEQ ID NO: 3174877 - DNA, 14 bp, Homo sapiens
ctgcccccatctcc

SEQ ID NO: 3174878 - DNA, 18 bp, Homo sapiens
ctgcccccatctccccag

SEQ ID NO: 3174879 - DNA, 19 bp, Homo sapiens
ctgcccccatctccccagg

SEQ ID NO: 3174880 - DNA, 20 bp, Homo sapiens
ctgcccccatctccccaggc

SEQ ID NO: 3174881 - DNA, 21 bp, Homo sapiens
ctgccccccaaggttctggtt

SEQ ID NO: 3174882 - DNA, 16 bp, Homo sapiens
ctgccccccagcctct

SEQ ID NO: 3174883 - DNA, 19 bp, Homo sapiens
ctgccccccagcctctggc

SEQ ID NO: 3174884 - DNA, 17 bp, Homo sapiens
ctgccccccctaagaga

SEQ ID NO: 3174885 - DNA, 18 bp, Homo sapiens
ctgccccccctaagagac

SEQ ID NO: 3174886 - DNA, 15 bp, Homo sapiens
ctgccccctcccact

SEQ ID NO: 3174887 - DNA, 16 bp, Homo sapiens
ctgccccctcccactc

SEQ ID NO: 3174888 - DNA, 13 bp, Homo sapiens
ctgccccctggct

SEQ ID NO: 3174889 - DNA, 23 bp, Homo sapiens
ctgccccctggctgactggccag

SEQ ID NO: 3174890 - DNA, 22 bp, Homo sapiens
ctgccccctggtggacagtcct

SEQ ID NO: 3174891 - DNA, 16 bp, Homo sapiens
ctgccccgttccctgt

SEQ ID NO: 3174892 - DNA, 20 bp, Homo sapiens
ctgcccctaggatgctgcag

SEQ ID NO: 3174893 - DNA, 16 bp, Homo sapiens
ctgcccctcccaaccc

SEQ ID NO: 3174894 - DNA, 19 bp, Homo sapiens
ctgcccctcccaacccagc

SEQ ID NO: 3174895 - DNA, 14 bp, Homo sapiens
ctgcccctcccttc

SEQ ID NO: 3174896 - DNA, 20 bp, Homo sapiens
ctgcccctgcgtggcctgag

SEQ ID NO: 3174897 - DNA, 16 bp, Homo sapiens
ctgcccctgctgtgct

SEQ ID NO: 3174898 - DNA, 22 bp, Homo sapiens
ctgccccttcctttaaaaaact

SEQ ID NO: 3174899 - DNA, 13 bp, Homo sapiens
ctgccccttgggc

SEQ ID NO: 3174900 - DNA, 13 bp, Homo sapiens
ctgcccgagctgg

SEQ ID NO: 3174901 - DNA, 22 bp, Homo sapiens
ctgcccgcacaccctcactctg

SEQ ID NO: 3174902 - DNA, 13 bp, Homo sapiens
ctgcccgctccca

SEQ ID NO: 3174903 - DNA, 15 bp, Homo sapiens
ctgcccgctgcaatg

SEQ ID NO: 3174904 - DNA, 11 bp, Homo sapiens
ctgcccggctg

SEQ ID NO: 3174905 - DNA, 21 bp, Homo sapiens
ctgcccggtggtttgccatgt

SEQ ID NO: 3174906 - DNA, 22 bp, Homo sapiens
ctgcccggtggtttgccatgtc

SEQ ID NO: 3174907 - DNA, 18 bp, Homo sapiens
ctgccctacagaggtctc

SEQ ID NO: 3174908 - DNA, 17 bp, Homo sapiens
ctgtcatttttaacagc

SEQ ID NO: 3174909 - DNA, 20 bp, Homo sapiens
ctgtccaaaggaggctggca

SEQ ID NO: 3174910 - DNA, 15 bp, Homo sapiens
ctgtccacacccagc

SEQ ID NO: 3174911 - DNA, 16 bp, Homo sapiens
ctgtccaccagcccat

SEQ ID NO: 3174912 - DNA, 13 bp, Homo sapiens
ctgtccaccctgc

SEQ ID NO: 3174913 - DNA, 14 bp, Homo sapiens
ctgtccaccctgcc

SEQ ID NO: 3174914 - DNA, 22 bp, Homo sapiens
ctgtccactctcggggcccttg

SEQ ID NO: 3174915 - DNA, 11 bp, Homo sapiens
ctgtccagaga

SEQ ID NO: 3174916 - DNA, 18 bp, Homo sapiens
ctgtccaggcactgctgc

SEQ ID NO: 3174917 - DNA, 20 bp, Homo sapiens
ctgtccaggcactgctgccc

SEQ ID NO: 3174918 - DNA, 15 bp, Homo sapiens
ctgtccaggccactg

SEQ ID NO: 3174919 - DNA, 20 bp, Homo sapiens
ctgtccaggccactgtggcc

SEQ ID NO: 3174920 - DNA, 20 bp, Homo sapiens
ctgtccagttcctttagaaa

SEQ ID NO: 3174921 - DNA, 14 bp, Homo sapiens
ctgtccatgcttct

SEQ ID NO: 3174922 - DNA, 14 bp, Homo sapiens
ctgtccatggcctt

SEQ ID NO: 3174923 - DNA, 16 bp, Homo sapiens
ctgtcccacccccacc

SEQ ID NO: 3174924 - DNA, 21 bp, Homo sapiens
ctgtcccaccgggagcctccc

SEQ ID NO: 3174925 - DNA, 11 bp, Homo sapiens
ctgtcccagag

SEQ ID NO: 3174926 - DNA, 12 bp, Homo sapiens
ctgtcccagagg

SEQ ID NO: 3174927 - DNA, 23 bp, Homo sapiens
ctgtcccagaggttatctgcctg

SEQ ID NO: 3174928 - DNA, 15 bp, Homo sapiens
ctgtcccatgcaggc

SEQ ID NO: 3174929 - DNA, 18 bp, Homo sapiens
ctgtcccatgcaggccct

SEQ ID NO: 3174930 - DNA, 18 bp, Homo sapiens
ctgtccccaccctccact

SEQ ID NO: 3174931 - DNA, 19 bp, Homo sapiens
ctgtccccaccctccactc

SEQ ID NO: 3174932 - DNA, 20 bp, Homo sapiens
ctgtccccagccctgtcctg

SEQ ID NO: 3174933 - DNA, 14 bp, Homo sapiens
ctgtcccccagctc

SEQ ID NO: 3174934 - DNA, 15 bp, Homo sapiens
ctgtcccccagctct

SEQ ID NO: 3174935 - DNA, 17 bp, Homo sapiens
ctgtcccccagctctgg

SEQ ID NO: 3174936 - DNA, 15 bp, Homo sapiens
ctgtccccctaccca

SEQ ID NO: 3174937 - DNA, 17 bp, Homo sapiens
ctgtccccctacccacc

SEQ ID NO: 3174938 - DNA, 20 bp, Homo sapiens
ctgtccccctcccctcccag

SEQ ID NO: 3174939 - DNA, 22 bp, Homo sapiens
ctgtccccctcccctcccagtc

SEQ ID NO: 3174940 - DNA, 14 bp, Homo sapiens
ctgtcccctcagct

SEQ ID NO: 3174941 - DNA, 15 bp, Homo sapiens
ctgtcccgccttcct

SEQ ID NO: 3174942 - DNA, 21 bp, Homo sapiens
ctgtcccggggtcctgtggca

SEQ ID NO: 3174943 - DNA, 18 bp, Homo sapiens
ctgtccctcccacctctg

SEQ ID NO: 3174944 - DNA, 19 bp, Homo sapiens
ctgtccctcccacctctgt

SEQ ID NO: 3174945 - DNA, 14 bp, Homo sapiens
ctgtccctgcaggg

SEQ ID NO: 3174946 - DNA, 18 bp, Homo sapiens
ctgtccctgtccccctcc

SEQ ID NO: 3174947 - DNA, 14 bp, Homo sapiens
ctgtccctgtcctt

SEQ ID NO: 3174948 - DNA, 15 bp, Homo sapiens
ctgtcccttccactt

SEQ ID NO: 3174949 - DNA, 15 bp, Homo sapiens
ctgtcccttgcctca

SEQ ID NO: 3174950 - DNA, 23 bp, Homo sapiens
ctgtccggcccagtgccactgcc

SEQ ID NO: 3174951 - DNA, 21 bp, Homo sapiens
ctgtcctaccagttgccctag

SEQ ID NO: 3174952 - DNA, 14 bp, Homo sapiens
ctgtcctacccacc

SEQ ID NO: 3174953 - DNA, 18 bp, Homo sapiens
ctgtcctactctgtgtca

SEQ ID NO: 3174954 - DNA, 20 bp, Homo sapiens
ctgtcctactctgtgtcagg

SEQ ID NO: 3174955 - DNA, 21 bp, Homo sapiens
ctgtcctactctgtgtcaggt

SEQ ID NO: 3174956 - DNA, 22 bp, Homo sapiens
ctgtcctacttctgactttact

SEQ ID NO: 3174957 - DNA, 13 bp, Homo sapiens
ctgtcctcactgc

SEQ ID NO: 3174958 - DNA, 21 bp, Homo sapiens
ctgtcctcactgctccctgaa

SEQ ID NO: 3174959 - DNA, 16 bp, Homo sapiens
ctgtcctcccatcccc

SEQ ID NO: 3174960 - DNA, 21 bp, Homo sapiens
ctgtcctcccatcccctggac

SEQ ID NO: 3174961 - DNA, 14 bp, Homo sapiens
ctgtcctccctctg

SEQ ID NO: 3174962 - DNA, 16 bp, Homo sapiens
ctgtcctcctggaagg

SEQ ID NO: 3174963 - DNA, 14 bp, Homo sapiens
ctgtcctctcccct

SEQ ID NO: 3174964 - DNA, 21 bp, Homo sapiens
ctgtcctctcccctccagcct

SEQ ID NO: 3174965 - DNA, 22 bp, Homo sapiens
ctgtcctctcccctccagcctt

SEQ ID NO: 3174966 - DNA, 18 bp, Homo sapiens
ctgtcctctcgagcccag

SEQ ID NO: 3174967 - DNA, 19 bp, Homo sapiens
ctgtcctctcgagcccaga

SEQ ID NO: 3174968 - DNA, 15 bp, Homo sapiens
ctgtcctgcagcaaa

SEQ ID NO: 3174969 - DNA, 14 bp, Homo sapiens
ctgtcctgtgaatg

SEQ ID NO: 3174970 - DNA, 14 bp, Homo sapiens
ctgtccttcagatg

SEQ ID NO: 3174971 - DNA, 19 bp, Homo sapiens
ctgtccttcttagaatgtt

SEQ ID NO: 3174972 - DNA, 12 bp, Homo sapiens
ctgtcctttcct

SEQ ID NO: 3174973 - DNA, 13 bp, Homo sapiens
ctgtcctttcctt

SEQ ID NO: 3174974 - DNA, 22 bp, Homo sapiens
ctgtcgagttcggctctgggtg

SEQ ID NO: 3174975 - DNA, 16 bp, Homo sapiens
ctgtcgcccaggctgg

SEQ ID NO: 3174976 - DNA, 13 bp, Homo sapiens
ctgtcgcccagtc

SEQ ID NO: 3174977 - DNA, 16 bp, Homo sapiens
ctgtcgccccaggccc

SEQ ID NO: 3174978 - DNA, 16 bp, Homo sapiens
ctgtcggagaggctgt

SEQ ID NO: 3174979 - DNA, 23 bp, Homo sapiens
ctgtcggagaggctgtctggggc

SEQ ID NO: 3174980 - DNA, 18 bp, Homo sapiens
ctgtcgggggctgtggat

SEQ ID NO: 3174981 - DNA, 15 bp, Homo sapiens
ctgtcgtgatggggc

SEQ ID NO: 3174982 - DNA, 16 bp, Homo sapiens
ctgtcgtgccagtcct

SEQ ID NO: 3174983 - DNA, 20 bp, Homo sapiens
ctgtctactgtggtgatctg

SEQ ID NO: 3174984 - DNA, 12 bp, Homo sapiens
ctgtctagagta

SEQ ID NO: 3174985 - DNA, 14 bp, Homo sapiens
ctgtctcacctgga

SEQ ID NO: 3174986 - DNA, 15 bp, Homo sapiens
ctgtctcacttttta

SEQ ID NO: 3174987 - DNA, 16 bp, Homo sapiens
ctgtctcactttttac

SEQ ID NO: 3174988 - DNA, 14 bp, Homo sapiens
ctgtctcagacttt

SEQ ID NO: 3174989 - DNA, 15 bp, Homo sapiens
ctgtctcagcctccc

SEQ ID NO: 3174990 - DNA, 17 bp, Homo sapiens
ctgtctcagcctcccag

SEQ ID NO: 3174991 - DNA, 16 bp, Homo sapiens
ctgtctcagtttcact

SEQ ID NO: 3174992 - DNA, 14 bp, Homo sapiens
ctgtctcatcccca

SEQ ID NO: 3174993 - DNA, 15 bp, Homo sapiens
ctgtctcatccccag

SEQ ID NO: 3174994 - DNA, 19 bp, Homo sapiens
ctgtctcatccccaggggt

SEQ ID NO: 3174995 - DNA, 20 bp, Homo sapiens
ctgtctcatccccaggggtc

SEQ ID NO: 3174996 - DNA, 19 bp, Homo sapiens
ctgtctccaagaccttggc

SEQ ID NO: 3174997 - DNA, 18 bp, Homo sapiens
ctgtctccatgtttgatg

SEQ ID NO: 3174998 - DNA, 20 bp, Homo sapiens
ctgtctctaacttattttat

SEQ ID NO: 3174999 - DNA, 15 bp, Homo sapiens
ctgtctctgcatctg

SEQ ID NO: 3175000 - DNA, 17 bp, Homo sapiens
ctgtctctgcctgcggc

SEQ ID NO: 3175001 - DNA, 12 bp, Homo sapiens
ctgtctctgctc

SEQ ID NO: 3175002 - DNA, 13 bp, Homo sapiens
ctgtctctgctcg

SEQ ID NO: 3175003 - DNA, 21 bp, Homo sapiens
ctgtctctgctcgccctcctt

SEQ ID NO: 3175004 - DNA, 17 bp, Homo sapiens
ctgtctctggcatttgt

SEQ ID NO: 3175005 - DNA, 23 bp, Homo sapiens
ctgtctctgttcagatgtgcatt

SEQ ID NO: 3175006 - DNA, 16 bp, Homo sapiens
ctgtctgcctgtattt

SEQ ID NO: 3175007 - DNA, 13 bp, Homo sapiens
ctgtctggggcct

SEQ ID NO: 3175008 - DNA, 23 bp, Homo sapiens
ctgtctggtggccccgtttctgg

SEQ ID NO: 3175009 - DNA, 14 bp, Homo sapiens
ctgtctgtacctaa

SEQ ID NO: 3175010 - DNA, 14 bp, Homo sapiens
ctgtctgtgaacag

SEQ ID NO: 3175011 - DNA, 19 bp, Homo sapiens
ctgtcttactattatagca

SEQ ID NO: 3175012 - DNA, 18 bp, Homo sapiens
ctgtcttcacctgccacc

SEQ ID NO: 3175013 - DNA, 18 bp, Homo sapiens
ctgtcttccacagccgcc

SEQ ID NO: 3175014 - DNA, 14 bp, Homo sapiens
ctgtcttccccacc

SEQ ID NO: 3175015 - DNA, 16 bp, Homo sapiens
ctgtcttctggtctgt

SEQ ID NO: 3175016 - DNA, 14 bp, Homo sapiens
ctgtcttggggcca

SEQ ID NO: 3175017 - DNA, 16 bp, Homo sapiens
ctgtctttaaaagaga

SEQ ID NO: 3175018 - DNA, 18 bp, Homo sapiens
ctgtctttaaaagagaga

SEQ ID NO: 3175019 - DNA, 13 bp, Homo sapiens
ctgtctttaagaa

SEQ ID NO: 3175020 - DNA, 14 bp, Homo sapiens
ctgtctttggaaaa

SEQ ID NO: 3175021 - DNA, 19 bp, Homo sapiens
ctgtcttttctattaatca

SEQ ID NO: 3175022 - DNA, 19 bp, Homo sapiens
ctgtgaaacctgtgaagct

SEQ ID NO: 3175023 - DNA, 15 bp, Homo sapiens
ctgtgaaactggcac

SEQ ID NO: 3175024 - DNA, 13 bp, Homo sapiens
ctgtgaaatacca

SEQ ID NO: 3175025 - DNA, 16 bp, Homo sapiens
ctgtgaaatgctggca

SEQ ID NO: 3175026 - DNA, 23 bp, Homo sapiens
ctgtgaagacccaggagagacag

SEQ ID NO: 3175027 - DNA, 13 bp, Homo sapiens
ctgtgaagtgtta

SEQ ID NO: 3175028 - DNA, 21 bp, Homo sapiens
ctgtgaatgccactgccttcg

SEQ ID NO: 3175029 - DNA, 23 bp, Homo sapiens
ctgtgaatgctaagtccatcacc

SEQ ID NO: 3175030 - DNA, 17 bp, Homo sapiens
ctgtgaatggaggcaga

SEQ ID NO: 3175031 - DNA, 21 bp, Homo sapiens
ctgtgaatggaggcagagacc

SEQ ID NO: 3175032 - DNA, 20 bp, Homo sapiens
ctgtgacaataagtttgaac

SEQ ID NO: 3175033 - DNA, 18 bp, Homo sapiens
ctgtgacatggtgcctga

SEQ ID NO: 3175034 - DNA, 22 bp, Homo sapiens
ctgtgacatggtgcctgagagg

SEQ ID NO: 3175035 - DNA, 15 bp, Homo sapiens
ctgttccaggccctc

SEQ ID NO: 3175036 - DNA, 18 bp, Homo sapiens
ctgttcccattcttgcat

SEQ ID NO: 3175037 - DNA, 22 bp, Homo sapiens
ctgttcccctcactggatgaaa

SEQ ID NO: 3175038 - DNA, 17 bp, Homo sapiens
ctgttcccctgtcctgt

SEQ ID NO: 3175039 - DNA, 17 bp, Homo sapiens
ctgttccctctggcttc

SEQ ID NO: 3175040 - DNA, 21 bp, Homo sapiens
ctgttccctctggcttcccat

SEQ ID NO: 3175041 - DNA, 13 bp, Homo sapiens
ctgttcccttgca

SEQ ID NO: 3175042 - DNA, 21 bp, Homo sapiens
ctgttcctctcttttcctgtt

SEQ ID NO: 3175043 - DNA, 16 bp, Homo sapiens
ctgttcctgctccatg

SEQ ID NO: 3175044 - DNA, 16 bp, Homo sapiens
ctgttcctgttcagta

SEQ ID NO: 3175045 - DNA, 15 bp, Homo sapiens
ctgttccttgtactc

SEQ ID NO: 3175046 - DNA, 19 bp, Homo sapiens
ctgttccttgtactcttag

SEQ ID NO: 3175047 - DNA, 17 bp, Homo sapiens
ctgttcctttcagatga

SEQ ID NO: 3175048 - DNA, 12 bp, Homo sapiens
ctgttctaaagc

SEQ ID NO: 3175049 - DNA, 12 bp, Homo sapiens
ctgttctaaggg

SEQ ID NO: 3175050 - DNA, 20 bp, Homo sapiens
ctgttctacatagatgctta

SEQ ID NO: 3175051 - DNA, 12 bp, Homo sapiens
ctgttctagttt

SEQ ID NO: 3175052 - DNA, 19 bp, Homo sapiens
ctgttctatgcctttagtc

SEQ ID NO: 3175053 - DNA, 14 bp, Homo sapiens
ctgttctccctttc

SEQ ID NO: 3175054 - DNA, 17 bp, Homo sapiens
ctgttctccctttctct

SEQ ID NO: 3175055 - DNA, 22 bp, Homo sapiens
ctgttctccctttctctctcct

SEQ ID NO: 3175056 - DNA, 21 bp, Homo sapiens
ctgttctcttgggaactgaac

SEQ ID NO: 3175057 - DNA, 15 bp, Homo sapiens
ctgttctgagaaggt

SEQ ID NO: 3175058 - DNA, 13 bp, Homo sapiens
ctgttctgcaaag

SEQ ID NO: 3175059 - DNA, 13 bp, Homo sapiens
ctgttctgcactg

SEQ ID NO: 3175060 - DNA, 14 bp, Homo sapiens
ctgttctgcactga

SEQ ID NO: 3175061 - DNA, 18 bp, Homo sapiens
ctgttctgcactgaaaag

SEQ ID NO: 3175062 - DNA, 22 bp, Homo sapiens
ctgttctggaggaaagggagga

SEQ ID NO: 3175063 - DNA, 13 bp, Homo sapiens
ctgttctggggga

SEQ ID NO: 3175064 - DNA, 14 bp, Homo sapiens
ctgttctgtttcaa

SEQ ID NO: 3175065 - DNA, 16 bp, Homo sapiens
ctgttcttagagtgta

SEQ ID NO: 3175066 - DNA, 16 bp, Homo sapiens
ctgttcttgcataggc

SEQ ID NO: 3175067 - DNA, 11 bp, Homo sapiens
ctgttcttgct

SEQ ID NO: 3175068 - DNA, 13 bp, Homo sapiens
ctgttcttgctgc

SEQ ID NO: 3175069 - DNA, 15 bp, Homo sapiens
ctgttcttgctgcta

SEQ ID NO: 3175070 - DNA, 20 bp, Homo sapiens
ctgttcttgggcctcaggct

SEQ ID NO: 3175071 - DNA, 12 bp, Homo sapiens
ctgttgagagaa

SEQ ID NO: 3175072 - DNA, 19 bp, Homo sapiens
ctgttgagatggtaacaga

SEQ ID NO: 3175073 - DNA, 15 bp, Homo sapiens
ctgttgaggcatcaa

SEQ ID NO: 3175074 - DNA, 14 bp, Homo sapiens
ctgttgatcccagt

SEQ ID NO: 3175075 - DNA, 22 bp, Homo sapiens
ctgttgatgtatctgagttgcc

SEQ ID NO: 3175076 - DNA, 23 bp, Homo sapiens
ctgttgatgtatctgagttgcca

SEQ ID NO: 3175077 - DNA, 17 bp, Homo sapiens
ctgttgcactgatgtcc

SEQ ID NO: 3175078 - DNA, 17 bp, Homo sapiens
ctgttgcatttactttt

SEQ ID NO: 3175079 - DNA, 19 bp, Homo sapiens
ctgttgcatttacttttaa

SEQ ID NO: 3175080 - DNA, 18 bp, Homo sapiens
ctgttgccatagccccat

SEQ ID NO: 3175081 - DNA, 12 bp, Homo sapiens
ctgttgcccagg

SEQ ID NO: 3175082 - DNA, 13 bp, Homo sapiens
ctgttgcccaggc

SEQ ID NO: 3175083 - DNA, 17 bp, Homo sapiens
ctgttgcccaggctggc

SEQ ID NO: 3175084 - DNA, 21 bp, Homo sapiens
ctgttgccctttctgtaccat

SEQ ID NO: 3175085 - DNA, 17 bp, Homo sapiens
ctgttgcctaattggaa

SEQ ID NO: 3175086 - DNA, 19 bp, Homo sapiens
ctgttgcctaattggaaag

SEQ ID NO: 3175087 - DNA, 20 bp, Homo sapiens
ctgttgctgtgtttaatttg

SEQ ID NO: 3175088 - DNA, 11 bp, Homo sapiens
ctgttggaagc

SEQ ID NO: 3175089 - DNA, 23 bp, Homo sapiens
ctgttggcactcacagacctgga

SEQ ID NO: 3175090 - DNA, 19 bp, Homo sapiens
ctgttggcaggctggccag

SEQ ID NO: 3175091 - DNA, 14 bp, Homo sapiens
ctgttggctggggg

SEQ ID NO: 3175092 - DNA, 19 bp, Homo sapiens
ctgttggctgggggcctca

SEQ ID NO: 3175093 - DNA, 20 bp, Homo sapiens
ctgttggttccaagccctgg

SEQ ID NO: 3175094 - DNA, 23 bp, Homo sapiens
ctgttgtaaacaacgtgtatagt

SEQ ID NO: 3175095 - DNA, 11 bp, Homo sapiens
ctgttgtaact

SEQ ID NO: 3175096 - DNA, 21 bp, Homo sapiens
ctgttgtaagaattctgattg

SEQ ID NO: 3175097 - DNA, 18 bp, Homo sapiens
ctgttgtacatttatgat

SEQ ID NO: 3175098 - DNA, 16 bp, Homo sapiens
ctgttgtgatcttgca

SEQ ID NO: 3175099 - DNA, 18 bp, Homo sapiens
ctgttgttccaaatgtgt

SEQ ID NO: 3175100 - DNA, 20 bp, Homo sapiens
ctgttgttccattttatgca

SEQ ID NO: 3175101 - DNA, 23 bp, Homo sapiens
ctgtttaaaatttgtgctgggtt

SEQ ID NO: 3175102 - DNA, 21 bp, Homo sapiens
ctgtttaatatttaaacagca

SEQ ID NO: 3175103 - DNA, 21 bp, Homo sapiens
ctgtttagcagaactcattct

SEQ ID NO: 3175104 - DNA, 11 bp, Homo sapiens
ctgtttataat

SEQ ID NO: 3175105 - DNA, 15 bp, Homo sapiens
ctgtttataatctga

SEQ ID NO: 3175106 - DNA, 18 bp, Homo sapiens
ctgtttatataaaggttt

SEQ ID NO: 3175107 - DNA, 19 bp, Homo sapiens
ctgtttatgatctatttgt

SEQ ID NO: 3175108 - DNA, 21 bp, Homo sapiens
ctgtttatggccacatttaat

SEQ ID NO: 3175109 - DNA, 14 bp, Homo sapiens
ctgtttatggcctc

SEQ ID NO: 3175110 - DNA, 19 bp, Homo sapiens
ctgtttatggcctcagctg

SEQ ID NO: 3175111 - DNA, 22 bp, Homo sapiens
ctgtttatggcctcagctgcct

SEQ ID NO: 3175112 - DNA, 14 bp, Homo sapiens
ctgtttattaatct

SEQ ID NO: 3175113 - DNA, 18 bp, Homo sapiens
ctgtttattaatcttagt

SEQ ID NO: 3175114 - DNA, 18 bp, Homo sapiens
ctgtttattttttttggc

SEQ ID NO: 3175115 - DNA, 22 bp, Homo sapiens
ctgtttattttttttggcctgt

SEQ ID NO: 3175116 - DNA, 13 bp, Homo sapiens
ctgtttccctgct

SEQ ID NO: 3175117 - DNA, 16 bp, Homo sapiens
ctgtttccctgctgaa

SEQ ID NO: 3175118 - DNA, 16 bp, Homo sapiens
ctgtttcccttccctt

SEQ ID NO: 3175119 - DNA, 16 bp, Homo sapiens
ctgtttcctagctgtg

SEQ ID NO: 3175120 - DNA, 13 bp, Homo sapiens
ctgtttctctgct

SEQ ID NO: 3175121 - DNA, 21 bp, Homo sapiens
ctgtttctcttgagctggcct

SEQ ID NO: 3175122 - DNA, 16 bp, Homo sapiens
ctgtttctgcagccct

SEQ ID NO: 3175123 - DNA, 19 bp, Homo sapiens
ctgtttcttcctgttaatg

SEQ ID NO: 3175124 - DNA, 22 bp, Homo sapiens
ctgtttgaggatatattttcac

SEQ ID NO: 3175125 - DNA, 18 bp, Homo sapiens
ctgtttgatataccaaat

SEQ ID NO: 3175126 - DNA, 21 bp, Homo sapiens
ctgtttgatataccaaattaa

SEQ ID NO: 3175127 - DNA, 18 bp, Homo sapiens
ctgtttgatgtatgtgtg

SEQ ID NO: 3175128 - DNA, 20 bp, Homo sapiens
ctgtttgatgtatgtgtgaa

SEQ ID NO: 3175129 - DNA, 22 bp, Homo sapiens
ctgtttgatgtatgtgtgaaac

SEQ ID NO: 3175130 - DNA, 18 bp, Homo sapiens
ctgtttgcatttgataca

SEQ ID NO: 3175131 - DNA, 22 bp, Homo sapiens
ctgtttgcatttgatacatttt

SEQ ID NO: 3175132 - DNA, 11 bp, Homo sapiens
ctgtttggaaa

SEQ ID NO: 3175133 - DNA, 12 bp, Homo sapiens
ctgtttggcact

SEQ ID NO: 3175134 - DNA, 13 bp, Homo sapiens
ctgtttggcactt

SEQ ID NO: 3175135 - DNA, 16 bp, Homo sapiens
ctgtttggcacttgta

SEQ ID NO: 3175136 - DNA, 20 bp, Homo sapiens
ctgtttggcacttgtattta

SEQ ID NO: 3175137 - DNA, 13 bp, Homo sapiens
ctgtttgttattg

SEQ ID NO: 3175138 - DNA, 19 bp, Homo sapiens
ctgttttaattgtagttct

SEQ ID NO: 3175139 - DNA, 14 bp, Homo sapiens
ctgttttatactgt

SEQ ID NO: 3175140 - DNA, 14 bp, Homo sapiens
ctgttttatatatt

SEQ ID NO: 3175141 - DNA, 16 bp, Homo sapiens
ctgttttcccacgagg

SEQ ID NO: 3175142 - DNA, 16 bp, Homo sapiens
ctgttttcctttctca

SEQ ID NO: 3175143 - DNA, 13 bp, Homo sapiens
ctgttttctgagc

SEQ ID NO: 3175144 - DNA, 16 bp, Homo sapiens
ctgttttctgtttctt

SEQ ID NO: 3175145 - DNA, 20 bp, Homo sapiens
ctgttttgtacatagattta

SEQ ID NO: 3175146 - DNA, 15 bp, Homo sapiens
ctgttttgtgagaac

SEQ ID NO: 3175147 - DNA, 13 bp, Homo sapiens
ctgtttttcacat

SEQ ID NO: 3175148 - DNA, 15 bp, Homo sapiens
ctgtttttcacattt

SEQ ID NO: 3175149 - DNA, 14 bp, Homo sapiens
ctgtttttgtagtg

SEQ ID NO: 3175150 - DNA, 14 bp, Homo sapiens
ctgtttttgtatct

SEQ ID NO: 3175151 - DNA, 13 bp, Homo sapiens
ctgtttttgttgt

SEQ ID NO: 3175152 - DNA, 14 bp, Homo sapiens
ctgtttttttccca

SEQ ID NO: 3175153 - DNA, 17 bp, Homo sapiens
cttaaaaatgtaaatat

SEQ ID NO: 3175154 - DNA, 18 bp, Homo sapiens
cttaaaaatgtaaatatt

SEQ ID NO: 3175155 - DNA, 11 bp, Homo sapiens
cttaaaacagc

SEQ ID NO: 3175156 - DNA, 14 bp, Homo sapiens
cttaaaacagctgt

SEQ ID NO: 3175157 - DNA, 13 bp, Homo sapiens
cttaaaaccaaag

SEQ ID NO: 3175158 - DNA, 15 bp, Homo sapiens
cttaaaaccaaagag

SEQ ID NO: 3175159 - DNA, 14 bp, Homo sapiens
cttaaaaggggccc

SEQ ID NO: 3175160 - DNA, 15 bp, Homo sapiens
cttaaaaggggccca

SEQ ID NO: 3175161 - DNA, 13 bp, Homo sapiens
cttaaaataagca

SEQ ID NO: 3175162 - DNA, 13 bp, Homo sapiens
cttatttaaaaat

SEQ ID NO: 3175163 - DNA, 15 bp, Homo sapiens
cttatttaatctttt

SEQ ID NO: 3175164 - DNA, 17 bp, Homo sapiens
cttatttaatgaaagac

SEQ ID NO: 3175165 - DNA, 18 bp, Homo sapiens
cttatttaatgaaagact

SEQ ID NO: 3175166 - DNA, 19 bp, Homo sapiens
cttatttctagaagcacat

SEQ ID NO: 3175167 - DNA, 11 bp, Homo sapiens
cttatttctgc

SEQ ID NO: 3175168 - DNA, 18 bp, Homo sapiens
cttatttctgctctggaa

SEQ ID NO: 3175169 - DNA, 12 bp, Homo sapiens
cttattttaatg

SEQ ID NO: 3175170 - DNA, 19 bp, Homo sapiens
cttattttcaagaaactga

SEQ ID NO: 3175171 - DNA, 21 bp, Homo sapiens
cttattttcagtgcatcatta

SEQ ID NO: 3175172 - DNA, 14 bp, Homo sapiens
cttattttctctgt

SEQ ID NO: 3175173 - DNA, 14 bp, Homo sapiens
cttattttgtctta

SEQ ID NO: 3175174 - DNA, 19 bp, Homo sapiens
cttattttgtcttattctt

SEQ ID NO: 3175175 - DNA, 22 bp, Homo sapiens
cttattttgtttcaatctctga

SEQ ID NO: 3175176 - DNA, 16 bp, Homo sapiens
cttcaaaaactaaaat

SEQ ID NO: 3175177 - DNA, 17 bp, Homo sapiens
cttcaaaaactaaaatc

SEQ ID NO: 3175178 - DNA, 20 bp, Homo sapiens
cttcaaaaactaaaatcatt

SEQ ID NO: 3175179 - DNA, 19 bp, Homo sapiens
cttcaaaaagcagagtgga

SEQ ID NO: 3175180 - DNA, 14 bp, Homo sapiens
cttcaaaaataatg

SEQ ID NO: 3175181 - DNA, 22 bp, Homo sapiens
cttcaaaaggaatgaacttgtt

SEQ ID NO: 3175182 - DNA, 23 bp, Homo sapiens
cttcaaaatgttatcttctcaag

SEQ ID NO: 3175183 - DNA, 16 bp, Homo sapiens
cttcaaagcttgaaga

SEQ ID NO: 3175184 - DNA, 15 bp, Homo sapiens
cttcaaatatttccc

SEQ ID NO: 3175185 - DNA, 18 bp, Homo sapiens
cttcaaattaaaacagct

SEQ ID NO: 3175186 - DNA, 24 bp, Homo sapiens
cttcaacagaccccctctagaaat

SEQ ID NO: 3175187 - DNA, 20 bp, Homo sapiens
cttcaacatcaatgttcatt

SEQ ID NO: 3175188 - DNA, 16 bp, Homo sapiens
cttcaacatcctgcca

SEQ ID NO: 3175189 - DNA, 17 bp, Homo sapiens
cttcaacatcctgccag

SEQ ID NO: 3175190 - DNA, 21 bp, Homo sapiens
cttcaacatcctgccagcccc

SEQ ID NO: 3175191 - DNA, 20 bp, Homo sapiens
cttcaaccattccccatggg

SEQ ID NO: 3175192 - DNA, 18 bp, Homo sapiens
cttcaagacgaggggcag

SEQ ID NO: 3175193 - DNA, 15 bp, Homo sapiens
cttcaagctgtcccc

SEQ ID NO: 3175194 - DNA, 16 bp, Homo sapiens
cttcaaggcttccact

SEQ ID NO: 3175195 - DNA, 23 bp, Homo sapiens
cttcaaggtgacagaaggaccag

SEQ ID NO: 3175196 - DNA, 15 bp, Homo sapiens
cttcaagtgcctttt

SEQ ID NO: 3175197 - DNA, 18 bp, Homo sapiens
cttcaagttaaagtgaat

SEQ ID NO: 3175198 - DNA, 17 bp, Homo sapiens
cttcaagttagctcagg

SEQ ID NO: 3175199 - DNA, 12 bp, Homo sapiens
cttcaagttgta

SEQ ID NO: 3175200 - DNA, 15 bp, Homo sapiens
cttcaataaatcttt

SEQ ID NO: 3175201 - DNA, 15 bp, Homo sapiens
cttcaatgatcaaat

SEQ ID NO: 3175202 - DNA, 19 bp, Homo sapiens
cttcaatgggctcttccaa

SEQ ID NO: 3175203 - DNA, 15 bp, Homo sapiens
cttcaatgtgtcatt

SEQ ID NO: 3175204 - DNA, 15 bp, Homo sapiens
cttcaattaataaaa

SEQ ID NO: 3175205 - DNA, 15 bp, Homo sapiens
cttcacaggcagtgc

SEQ ID NO: 3175206 - DNA, 15 bp, Homo sapiens
cttcacagtcccagg

SEQ ID NO: 3175207 - DNA, 13 bp, Homo sapiens
cttcacagtgttt

SEQ ID NO: 3175208 - DNA, 15 bp, Homo sapiens
cttcacattaaaaaa

SEQ ID NO: 3175209 - DNA, 19 bp, Homo sapiens
cttcaccagagcatttcca

SEQ ID NO: 3175210 - DNA, 23 bp, Homo sapiens
cttcaccagtctgtctactgtgg

SEQ ID NO: 3175211 - DNA, 19 bp, Homo sapiens
cttcaccatggccttatga

SEQ ID NO: 3175212 - DNA, 15 bp, Homo sapiens
cttcaccccccactc

SEQ ID NO: 3175213 - DNA, 15 bp, Homo sapiens
cttcaccccggcagg

SEQ ID NO: 3175214 - DNA, 17 bp, Homo sapiens
cttcaccccggcaggcc

SEQ ID NO: 3175215 - DNA, 23 bp, Homo sapiens
cttcaccccggcaggccctgcag

SEQ ID NO: 3175216 - DNA, 15 bp, Homo sapiens
cttcacccctgcact

SEQ ID NO: 3175217 - DNA, 11 bp, Homo sapiens
cttcacctcta

SEQ ID NO: 3175218 - DNA, 15 bp, Homo sapiens
cttcacctgccacca

SEQ ID NO: 3175219 - DNA, 12 bp, Homo sapiens
cttcactacttt

SEQ ID NO: 3175220 - DNA, 15 bp, Homo sapiens
cttcactcactgtca

SEQ ID NO: 3175221 - DNA, 20 bp, Homo sapiens
cttcactctgggcacactct

SEQ ID NO: 3175222 - DNA, 13 bp, Homo sapiens
cttcactgccatg

SEQ ID NO: 3175223 - DNA, 14 bp, Homo sapiens
cttcactgccatga

SEQ ID NO: 3175224 - DNA, 16 bp, Homo sapiens
cttcactgtggccaca

SEQ ID NO: 3175225 - DNA, 21 bp, Homo sapiens
cttcactgtggccacagcccc

SEQ ID NO: 3175226 - DNA, 19 bp, Homo sapiens
cttcactgttccctctggc

SEQ ID NO: 3175227 - DNA, 21 bp, Homo sapiens
cttcactgttccctctggctt

SEQ ID NO: 3175228 - DNA, 15 bp, Homo sapiens
cttcactgttgaaaa

SEQ ID NO: 3175229 - DNA, 11 bp, Homo sapiens
cttcagaaaga

SEQ ID NO: 3175230 - DNA, 18 bp, Homo sapiens
cttcagaactgcccttgc

SEQ ID NO: 3175231 - DNA, 19 bp, Homo sapiens
cttcagaactgcccttgct

SEQ ID NO: 3175232 - DNA, 21 bp, Homo sapiens
cttcagaactgcccttgctgc

SEQ ID NO: 3175233 - DNA, 17 bp, Homo sapiens
cttcagaagacactgca

SEQ ID NO: 3175234 - DNA, 15 bp, Homo sapiens
cttcagaagctagtg

SEQ ID NO: 3175235 - DNA, 20 bp, Homo sapiens
cttcagaaggggacctgttt

SEQ ID NO: 3175236 - DNA, 21 bp, Homo sapiens
cttcagaattccatatcttgc

SEQ ID NO: 3175237 - DNA, 15 bp, Homo sapiens
cttcagactttgctt

SEQ ID NO: 3175238 - DNA, 15 bp, Homo sapiens
cttcagagagctggt

SEQ ID NO: 3175239 - DNA, 21 bp, Homo sapiens
cttcagagctcttcaagctgt

SEQ ID NO: 3175240 - DNA, 13 bp, Homo sapiens
cttcagagtttgt

SEQ ID NO: 3175241 - DNA, 21 bp, Homo sapiens
cttcagagtttgtgtgtattt

SEQ ID NO: 3175242 - DNA, 15 bp, Homo sapiens
cttcagatctgaggt

SEQ ID NO: 3175243 - DNA, 18 bp, Homo sapiens
cttcagatggaaactctt

SEQ ID NO: 3175244 - DNA, 18 bp, Homo sapiens
cttcagcatatttatagc

SEQ ID NO: 3175245 - DNA, 15 bp, Homo sapiens
cttcagcattccctc

SEQ ID NO: 3175246 - DNA, 21 bp, Homo sapiens
cttcagcccccagcccctccc

SEQ ID NO: 3175247 - DNA, 19 bp, Homo sapiens
cttcagccccttctcccct

SEQ ID NO: 3175248 - DNA, 21 bp, Homo sapiens
cttcagctagcttttaggaaa

SEQ ID NO: 3175249 - DNA, 19 bp, Homo sapiens
cttcagctgcctgaaacag

SEQ ID NO: 3175250 - DNA, 19 bp, Homo sapiens
cttcagctgtacttcgtct

SEQ ID NO: 3175251 - DNA, 23 bp, Homo sapiens
cttcaggaacaagtaatgtatta

SEQ ID NO: 3175252 - DNA, 20 bp, Homo sapiens
cttcaggaagcaggtgtcct

SEQ ID NO: 3175253 - DNA, 17 bp, Homo sapiens
cttcaggctcttctcct

SEQ ID NO: 3175254 - DNA, 21 bp, Homo sapiens
cttcaggcttcctgcaatttt

SEQ ID NO: 3175255 - DNA, 19 bp, Homo sapiens
cttcagggaggtagtttca

SEQ ID NO: 3175256 - DNA, 21 bp, Homo sapiens
cttcagggccagaaggagggc

SEQ ID NO: 3175257 - DNA, 22 bp, Homo sapiens
cttcagggccagaaggagggca

SEQ ID NO: 3175258 - DNA, 22 bp, Homo sapiens
cttcaggggatgggtgtggatg

SEQ ID NO: 3175259 - DNA, 17 bp, Homo sapiens
cttcaggggcacttcat

SEQ ID NO: 3175260 - DNA, 18 bp, Homo sapiens
cttcaggttggtttaatc

SEQ ID NO: 3175261 - DNA, 15 bp, Homo sapiens
cttcagtactcaaat

SEQ ID NO: 3175262 - DNA, 11 bp, Homo sapiens
cttcagtcctg

SEQ ID NO: 3175263 - DNA, 15 bp, Homo sapiens
cttcagtcctgctcc

SEQ ID NO: 3175264 - DNA, 13 bp, Homo sapiens
cttcagtcctggg

SEQ ID NO: 3175265 - DNA, 15 bp, Homo sapiens
cttcagtcctgggag

SEQ ID NO: 3175266 - DNA, 18 bp, Homo sapiens
cttcagtcctgggagacc

SEQ ID NO: 3175267 - DNA, 21 bp, Homo sapiens
cttcagtgactcctgctggta

SEQ ID NO: 3175268 - DNA, 17 bp, Homo sapiens
cttcagtggagaattat

SEQ ID NO: 3175269 - DNA, 16 bp, Homo sapiens
cttcagtggcagctgc

SEQ ID NO: 3175270 - DNA, 19 bp, Homo sapiens
cttcagtgtcccaccttga

SEQ ID NO: 3175271 - DNA, 17 bp, Homo sapiens
cttcagttatgattttt

SEQ ID NO: 3175272 - DNA, 15 bp, Homo sapiens
cttcagttgcttgtc

SEQ ID NO: 3175273 - DNA, 23 bp, Homo sapiens
cttcagttgcttgtcttctggta

SEQ ID NO: 3175274 - DNA, 18 bp, Homo sapiens
cttcagtttaatgtctcc

SEQ ID NO: 3175275 - DNA, 14 bp, Homo sapiens
cttcataaatgaag

SEQ ID NO: 3175276 - DNA, 21 bp, Homo sapiens
cttcatactttttttcacagt

SEQ ID NO: 3175277 - DNA, 16 bp, Homo sapiens
cttcatagctccttgg

SEQ ID NO: 3175278 - DNA, 23 bp, Homo sapiens
cttcatatagcattgataatctt

SEQ ID NO: 3175279 - DNA, 20 bp, Homo sapiens
cttcatattctaaaaccatt

SEQ ID NO: 3175280 - DNA, 15 bp, Homo sapiens
cttcatattgctgag

SEQ ID NO: 3175281 - DNA, 18 bp, Homo sapiens
cttcatatttttgatcat

SEQ ID NO: 3175282 - DNA, 18 bp, Homo sapiens
cttcatcattccctctca

SEQ ID NO: 3175283 - DNA, 17 bp, Homo sapiens
cttcatccaacttccaa

SEQ ID NO: 3175284 - DNA, 24 bp, Homo sapiens
cttcatccagattgggtgccagca

SEQ ID NO: 3175285 - DNA, 14 bp, Homo sapiens
cttcatccctttcc

SEQ ID NO: 3175286 - DNA, 19 bp, Homo sapiens
cttcatctggcaacatctt

SEQ ID NO: 3175287 - DNA, 22 bp, Homo sapiens
cttcatctggggttggcaacag

SEQ ID NO: 3175288 - DNA, 16 bp, Homo sapiens
cttctttctagaaaga

SEQ ID NO: 3175289 - DNA, 13 bp, Homo sapiens
cttctttctggac

SEQ ID NO: 3175290 - DNA, 17 bp, Homo sapiens
cttctttgataatgtta

SEQ ID NO: 3175291 - DNA, 12 bp, Homo sapiens
cttctttgtaat

SEQ ID NO: 3175292 - DNA, 16 bp, Homo sapiens
cttcttttctcttcta

SEQ ID NO: 3175293 - DNA, 14 bp, Homo sapiens
cttcttttgattat

SEQ ID NO: 3175294 - DNA, 15 bp, Homo sapiens
cttcttttggcttcc

SEQ ID NO: 3175295 - DNA, 14 bp, Homo sapiens
cttcttttgtctcc

SEQ ID NO: 3175296 - DNA, 14 bp, Homo sapiens
cttctttttgctgt

SEQ ID NO: 3175297 - DNA, 18 bp, Homo sapiens
cttgaaaaaaaacagtgg

SEQ ID NO: 3175298 - DNA, 20 bp, Homo sapiens
cttgaaaaaaaacagtggat

SEQ ID NO: 3175299 - DNA, 12 bp, Homo sapiens
cttgaaaagatt

SEQ ID NO: 3175300 - DNA, 16 bp, Homo sapiens
cttgaaaataagaata

SEQ ID NO: 3175301 - DNA, 16 bp, Homo sapiens
cttgaaactttgggaa

SEQ ID NO: 3175302 - DNA, 18 bp, Homo sapiens
cttgaaactttgggaaaa

SEQ ID NO: 3175303 - DNA, 23 bp, Homo sapiens
cttgaaactttgggaaaacatgt

SEQ ID NO: 3175304 - DNA, 13 bp, Homo sapiens
cttgaaagatttt

SEQ ID NO: 3175305 - DNA, 20 bp, Homo sapiens
cttgaaagattttattgtat

SEQ ID NO: 3175306 - DNA, 16 bp, Homo sapiens
cttgaaagcatccatg

SEQ ID NO: 3175307 - DNA, 20 bp, Homo sapiens
cttgaaagcatccatgtgtg

SEQ ID NO: 3175308 - DNA, 23 bp, Homo sapiens
cttgaaagttttccagtattgaa

SEQ ID NO: 3175309 - DNA, 21 bp, Homo sapiens
cttgaaattaagaaggcaaaa

SEQ ID NO: 3175310 - DNA, 17 bp, Homo sapiens
cttgaaattactgtgta

SEQ ID NO: 3175311 - DNA, 19 bp, Homo sapiens
cttgaaattactgtgtaaa

SEQ ID NO: 3175312 - DNA, 20 bp, Homo sapiens
cttgaaattactgtgtaaat

SEQ ID NO: 3175313 - DNA, 19 bp, Homo sapiens
cttgaaattttaaactata

SEQ ID NO: 3175314 - DNA, 20 bp, Homo sapiens
cttgaacacagtattttccc

SEQ ID NO: 3175315 - DNA, 18 bp, Homo sapiens
cttgaactcctggactca

SEQ ID NO: 3175316 - DNA, 18 bp, Homo sapiens
cttgaactcctggcctca

SEQ ID NO: 3175317 - DNA, 19 bp, Homo sapiens
cttgaactcctggcctcaa

SEQ ID NO: 3175318 - DNA, 12 bp, Homo sapiens
cttgaagaactg

SEQ ID NO: 3175319 - DNA, 18 bp, Homo sapiens
cttgaagaactgcaggcc

SEQ ID NO: 3175320 - DNA, 15 bp, Homo sapiens
cttgaagaaggaaag

SEQ ID NO: 3175321 - DNA, 16 bp, Homo sapiens
cttgaagccaaagaaa

SEQ ID NO: 3175322 - DNA, 17 bp, Homo sapiens
cttgaagccactgaagc

SEQ ID NO: 3175323 - DNA, 18 bp, Homo sapiens
cttgaagccactgaagct

SEQ ID NO: 3175324 - DNA, 11 bp, Homo sapiens
cttgaagctgt

SEQ ID NO: 3175325 - DNA, 15 bp, Homo sapiens
cttgaaggaagaggg

SEQ ID NO: 3175326 - DNA, 13 bp, Homo sapiens
cttgaagggccca

SEQ ID NO: 3175327 - DNA, 19 bp, Homo sapiens
cttgaagtgactgttgtac

SEQ ID NO: 3175328 - DNA, 15 bp, Homo sapiens
cttgaatataaaaaa

SEQ ID NO: 3175329 - DNA, 16 bp, Homo sapiens
cttgaatataaaaaat

SEQ ID NO: 3175330 - DNA, 21 bp, Homo sapiens
cttgaatggttaataaaactg

SEQ ID NO: 3175331 - DNA, 23 bp, Homo sapiens
cttgaatggttaataaaactgca

SEQ ID NO: 3175332 - DNA, 19 bp, Homo sapiens
cttgaatgtggcttgagaa

SEQ ID NO: 3175333 - DNA, 18 bp, Homo sapiens
cttgaatgtggtctcagg

SEQ ID NO: 3175334 - DNA, 15 bp, Homo sapiens
cttgaatgtgtcagg

SEQ ID NO: 3175335 - DNA, 13 bp, Homo sapiens
cttgaatttctgc

SEQ ID NO: 3175336 - DNA, 19 bp, Homo sapiens
cttgacaaatattttcatg

SEQ ID NO: 3175337 - DNA, 21 bp, Homo sapiens
cttgacaaatattttcatgta

SEQ ID NO: 3175338 - DNA, 22 bp, Homo sapiens
cttgacaagctgacttggcact

SEQ ID NO: 3175339 - DNA, 17 bp, Homo sapiens
cttgacacagtcagcat

SEQ ID NO: 3175340 - DNA, 13 bp, Homo sapiens
cttgacacctgct

SEQ ID NO: 3175341 - DNA, 15 bp, Homo sapiens
cttgacacctgctga

SEQ ID NO: 3175342 - DNA, 12 bp, Homo sapiens
cttgacagggca

SEQ ID NO: 3175343 - DNA, 13 bp, Homo sapiens
cttgacagggcac

SEQ ID NO: 3175344 - DNA, 14 bp, Homo sapiens
cttgacattcaagg

SEQ ID NO: 3175345 - DNA, 13 bp, Homo sapiens
cttgacctcaggt

SEQ ID NO: 3175346 - DNA, 23 bp, Homo sapiens
cttgacctgaggctgtggtcaca

SEQ ID NO: 3175347 - DNA, 18 bp, Homo sapiens
cttgacctgtttctctgc

SEQ ID NO: 3175348 - DNA, 14 bp, Homo sapiens
cttgaccttcctct

SEQ ID NO: 3175349 - DNA, 17 bp, Homo sapiens
cttgaccttcctctggg

SEQ ID NO: 3175350 - DNA, 20 bp, Homo sapiens
cttgactaaaaaaaaaagaa

SEQ ID NO: 3175351 - DNA, 12 bp, Homo sapiens
cttgactctaat

SEQ ID NO: 3175352 - DNA, 17 bp, Homo sapiens
cttgacttgattagtgc

SEQ ID NO: 3175353 - DNA, 21 bp, Homo sapiens
cttgagaaccagtctcctcac

SEQ ID NO: 3175354 - DNA, 23 bp, Homo sapiens
cttgagaagacctcacctagaaa

SEQ ID NO: 3175355 - DNA, 13 bp, Homo sapiens
cttgagactggag

SEQ ID NO: 3175356 - DNA, 18 bp, Homo sapiens
cttgagatggtgaggctg

SEQ ID NO: 3175357 - DNA, 21 bp, Homo sapiens
cttgagcagtggctggtccag

SEQ ID NO: 3175358 - DNA, 18 bp, Homo sapiens
cttgagccaggaggcctg

SEQ ID NO: 3175359 - DNA, 16 bp, Homo sapiens
cttgagccagtaattg

SEQ ID NO: 3175360 - DNA, 16 bp, Homo sapiens
cttgagcccaggagtt

SEQ ID NO: 3175361 - DNA, 13 bp, Homo sapiens
cttgagccctggc

SEQ ID NO: 3175362 - DNA, 17 bp, Homo sapiens
cttgagccgggcccctg

SEQ ID NO: 3175363 - DNA, 12 bp, Homo sapiens
cttgagcctccc

SEQ ID NO: 3175364 - DNA, 14 bp, Homo sapiens
cttgagctggcctc

SEQ ID NO: 3175365 - DNA, 20 bp, Homo sapiens
cttgaggaataaatgccttt

SEQ ID NO: 3175366 - DNA, 16 bp, Homo sapiens
cttgaggattgtggaa

SEQ ID NO: 3175367 - DNA, 17 bp, Homo sapiens
cttgaggattgtggaaa

SEQ ID NO: 3175368 - DNA, 16 bp, Homo sapiens
cttgagggagcttagc

SEQ ID NO: 3175369 - DNA, 17 bp, Homo sapiens
cttgagggcccagagca

SEQ ID NO: 3175370 - DNA, 18 bp, Homo sapiens
cttgagggcccagagcag

SEQ ID NO: 3175371 - DNA, 15 bp, Homo sapiens
cttgagggttgggct

SEQ ID NO: 3175372 - DNA, 17 bp, Homo sapiens
cttgagggttgggctgg

SEQ ID NO: 3175373 - DNA, 21 bp, Homo sapiens
cttgagggttgggctggtgtc

SEQ ID NO: 3175374 - DNA, 23 bp, Homo sapiens
cttgaggtcttttgacatgtgga

SEQ ID NO: 3175375 - DNA, 15 bp, Homo sapiens
cttgagtaaaaaggt

SEQ ID NO: 3175376 - DNA, 23 bp, Homo sapiens
cttgagtcagaaaacagagaaag

SEQ ID NO: 3175377 - DNA, 23 bp, Homo sapiens
cttgagtggggttatctctgtgt

SEQ ID NO: 3175378 - DNA, 19 bp, Homo sapiens
cttgagttcaccatctctt

SEQ ID NO: 3175379 - DNA, 16 bp, Homo sapiens
cttgagtttgtcgctc

SEQ ID NO: 3175380 - DNA, 16 bp, Homo sapiens
cttgataaatatatat

SEQ ID NO: 3175381 - DNA, 21 bp, Homo sapiens
cttgataatattagtgattct

SEQ ID NO: 3175382 - DNA, 23 bp, Homo sapiens
cttgataatattagtgattctga

SEQ ID NO: 3175383 - DNA, 21 bp, Homo sapiens
cttgatacccccctctgtctt

SEQ ID NO: 3175384 - DNA, 22 bp, Homo sapiens
cttgatactaaaagttcttctc

SEQ ID NO: 3175385 - DNA, 18 bp, Homo sapiens
cttgatactgaatgcata

SEQ ID NO: 3175386 - DNA, 17 bp, Homo sapiens
cttgatcatgctgcagt

SEQ ID NO: 3175387 - DNA, 16 bp, Homo sapiens
cttgatcattttggga

SEQ ID NO: 3175388 - DNA, 13 bp, Homo sapiens
cttgatcttaaag

SEQ ID NO: 3175389 - DNA, 18 bp, Homo sapiens
cttgatgaccaaagtcct

SEQ ID NO: 3175390 - DNA, 15 bp, Homo sapiens
cttgatgactgctga

SEQ ID NO: 3175391 - DNA, 18 bp, Homo sapiens
cttgatgactgctgattt

SEQ ID NO: 3175392 - DNA, 13 bp, Homo sapiens
cttgatgcatgtg

SEQ ID NO: 3175393 - DNA, 22 bp, Homo sapiens
cttgatgtacagattttatttg

SEQ ID NO: 3175394 - DNA, 12 bp, Homo sapiens
cttgatgtgaag

SEQ ID NO: 3175395 - DNA, 22 bp, Homo sapiens
cttgattaagattttacaaaag

SEQ ID NO: 3175396 - DNA, 17 bp, Homo sapiens
cttgattctgcagtaaa

SEQ ID NO: 3175397 - DNA, 22 bp, Homo sapiens
cttgattctgcagtaaatcttt

SEQ ID NO: 3175398 - DNA, 19 bp, Homo sapiens
cttgatttaaacacacaga

SEQ ID NO: 3175399 - DNA, 21 bp, Homo sapiens
cttgatttcttctagaagata

SEQ ID NO: 3175400 - DNA, 13 bp, Homo sapiens
cttgatttgatgt

SEQ ID NO: 3175401 - DNA, 20 bp, Homo sapiens
cttgatttgatgtgactttt

SEQ ID NO: 3175402 - DNA, 12 bp, Homo sapiens
cttgatttttgc

SEQ ID NO: 3175403 - DNA, 22 bp, Homo sapiens
cttgcaaagacctacctccaga

SEQ ID NO: 3175404 - DNA, 20 bp, Homo sapiens
cttgcaacttcatgtcaact

SEQ ID NO: 3175405 - DNA, 15 bp, Homo sapiens
cttgcaatggcagcc

SEQ ID NO: 3175406 - DNA, 23 bp, Homo sapiens
cttgcaccccaaagctttcctgc

SEQ ID NO: 3175407 - DNA, 15 bp, Homo sapiens
cttgcacccgcctct

SEQ ID NO: 3175408 - DNA, 17 bp, Homo sapiens
cttgcacccgcctctcc

SEQ ID NO: 3175409 - DNA, 15 bp, Homo sapiens
cttgcagaactgcca

SEQ ID NO: 3175410 - DNA, 18 bp, Homo sapiens
cttgcagaactgccatta

SEQ ID NO: 3175411 - DNA, 13 bp, Homo sapiens
cttgcagccacat

SEQ ID NO: 3175412 - DNA, 17 bp, Homo sapiens
cttgcaggggtccctgc

SEQ ID NO: 3175413 - DNA, 20 bp, Homo sapiens
cttgcagtacatcaaaggaa

SEQ ID NO: 3175414 - DNA, 17 bp, Homo sapiens
cttgtcacaataaatgt

SEQ ID NO: 3175415 - DNA, 18 bp, Homo sapiens
cttgtcactgacacaaag

SEQ ID NO: 3175416 - DNA, 23 bp, Homo sapiens
cttgtcactggtagaccaaaata

SEQ ID NO: 3175417 - DNA, 18 bp, Homo sapiens
cttgtcagacataaagcc

SEQ ID NO: 3175418 - DNA, 14 bp, Homo sapiens
cttgtcatgtgaca

SEQ ID NO: 3175419 - DNA, 20 bp, Homo sapiens
cttgtccctctcactcccca

SEQ ID NO: 3175420 - DNA, 21 bp, Homo sapiens
cttgtcccttttaatataaaa

SEQ ID NO: 3175421 - DNA, 18 bp, Homo sapiens
cttgtcctgccagctgcc

SEQ ID NO: 3175422 - DNA, 19 bp, Homo sapiens
cttgtctagtttcccacat

SEQ ID NO: 3175423 - DNA, 20 bp, Homo sapiens
cttgtctcctactcctgact

SEQ ID NO: 3175424 - DNA, 22 bp, Homo sapiens
cttgtctgaatgtatttatgtg

SEQ ID NO: 3175425 - DNA, 15 bp, Homo sapiens
cttgtctgaggcctc

SEQ ID NO: 3175426 - DNA, 19 bp, Homo sapiens
cttgtctgaggcctcatcc

SEQ ID NO: 3175427 - DNA, 23 bp, Homo sapiens
cttgtcttctggtactttctgtt

SEQ ID NO: 3175428 - DNA, 17 bp, Homo sapiens
cttgtctttactgacaa

SEQ ID NO: 3175429 - DNA, 20 bp, Homo sapiens
cttgtcttttctgctgagga

SEQ ID NO: 3175430 - DNA, 17 bp, Homo sapiens
cttgtgaaacacagctg

SEQ ID NO: 3175431 - DNA, 19 bp, Homo sapiens
cttgtgaaacacagctgtt

SEQ ID NO: 3175432 - DNA, 13 bp, Homo sapiens
cttgtgaactgct

SEQ ID NO: 3175433 - DNA, 15 bp, Homo sapiens
cttgtgaatgcttct

SEQ ID NO: 3175434 - DNA, 17 bp, Homo sapiens
cttgtgaatgcttctca

SEQ ID NO: 3175435 - DNA, 22 bp, Homo sapiens
cttgtgacgtcgggcattcata

SEQ ID NO: 3175436 - DNA, 15 bp, Homo sapiens
cttgtgactgaaggg

SEQ ID NO: 3175437 - DNA, 18 bp, Homo sapiens
cttgtgactgaaggggca

SEQ ID NO: 3175438 - DNA, 22 bp, Homo sapiens
cttgtgagagcccattcccacc

SEQ ID NO: 3175439 - DNA, 15 bp, Homo sapiens
cttgtgattatttat

SEQ ID NO: 3175440 - DNA, 17 bp, Homo sapiens
cttgtgattatttatta

SEQ ID NO: 3175441 - DNA, 16 bp, Homo sapiens
cttgtgattgctgcca

SEQ ID NO: 3175442 - DNA, 15 bp, Homo sapiens
cttgtgatttccatt

SEQ ID NO: 3175443 - DNA, 20 bp, Homo sapiens
cttgtgatttccatttctga

SEQ ID NO: 3175444 - DNA, 21 bp, Homo sapiens
cttgtgatttccatttctgat

SEQ ID NO: 3175445 - DNA, 16 bp, Homo sapiens
cttgtgatttctttaa

SEQ ID NO: 3175446 - DNA, 21 bp, Homo sapiens
cttgtgcaaaatatttgacta

SEQ ID NO: 3175447 - DNA, 15 bp, Homo sapiens
cttgtgcagtgttga

SEQ ID NO: 3175448 - DNA, 13 bp, Homo sapiens
cttgtgccctgcc

SEQ ID NO: 3175449 - DNA, 14 bp, Homo sapiens
cttgtgccctgccc

SEQ ID NO: 3175450 - DNA, 16 bp, Homo sapiens
cttgtgctcacgctcc

SEQ ID NO: 3175451 - DNA, 20 bp, Homo sapiens
cttgtgctgatcgtgctaaa

SEQ ID NO: 3175452 - DNA, 22 bp, Homo sapiens
cttgtgctggatggagcccagg

SEQ ID NO: 3175453 - DNA, 22 bp, Homo sapiens
cttgtgcttggtggggctcgtg

SEQ ID NO: 3175454 - DNA, 17 bp, Homo sapiens
cttgtgctttgctcttg

SEQ ID NO: 3175455 - DNA, 20 bp, Homo sapiens
cttgtgcttttcctatttgt

SEQ ID NO: 3175456 - DNA, 15 bp, Homo sapiens
cttgtggacacagct

SEQ ID NO: 3175457 - DNA, 17 bp, Homo sapiens
cttgtggacacagctct

SEQ ID NO: 3175458 - DNA, 21 bp, Homo sapiens
cttgtggacacagctcttctc

SEQ ID NO: 3175459 - DNA, 12 bp, Homo sapiens
cttgtgggctgg

SEQ ID NO: 3175460 - DNA, 21 bp, Homo sapiens
cttgtgggctggtgccccaca

SEQ ID NO: 3175461 - DNA, 20 bp, Homo sapiens
cttgtggggacccaggctcc

SEQ ID NO: 3175462 - DNA, 14 bp, Homo sapiens
cttgtgggtccatg

SEQ ID NO: 3175463 - DNA, 16 bp, Homo sapiens
cttgtgggtccatgct

SEQ ID NO: 3175464 - DNA, 23 bp, Homo sapiens
cttgtggtgtaaagctggccctg

SEQ ID NO: 3175465 - DNA, 21 bp, Homo sapiens
cttgtggtgtgaccatgttca

SEQ ID NO: 3175466 - DNA, 22 bp, Homo sapiens
cttgtggtgtgaccatgttcat

SEQ ID NO: 3175467 - DNA, 24 bp, Homo sapiens
cttgtggtgtgaccatgttcatta

SEQ ID NO: 3175468 - DNA, 20 bp, Homo sapiens
cttgtgtactgataaaatac

SEQ ID NO: 3175469 - DNA, 22 bp, Homo sapiens
cttgtgtcaaccactaaagtat

SEQ ID NO: 3175470 - DNA, 21 bp, Homo sapiens
cttgtgtcaagacatttctct

SEQ ID NO: 3175471 - DNA, 12 bp, Homo sapiens
cttgtgtctgta

SEQ ID NO: 3175472 - DNA, 20 bp, Homo sapiens
cttgtgtgtgggctgtgagt

SEQ ID NO: 3175473 - DNA, 20 bp, Homo sapiens
cttgtgttgtccttttgtct

SEQ ID NO: 3175474 - DNA, 14 bp, Homo sapiens
cttgttacttctga

SEQ ID NO: 3175475 - DNA, 23 bp, Homo sapiens
cttgttagaaaacaaaattttat

SEQ ID NO: 3175476 - DNA, 16 bp, Homo sapiens
cttgttagagagaaag

SEQ ID NO: 3175477 - DNA, 18 bp, Homo sapiens
cttgttagagagaaagag

SEQ ID NO: 3175478 - DNA, 14 bp, Homo sapiens
cttgttattgtgaa

SEQ ID NO: 3175479 - DNA, 14 bp, Homo sapiens
cttgttccctctcc

SEQ ID NO: 3175480 - DNA, 18 bp, Homo sapiens
cttgttctgtcccttcca

SEQ ID NO: 3175481 - DNA, 22 bp, Homo sapiens
cttgttctgtcccttccacttc

SEQ ID NO: 3175482 - DNA, 20 bp, Homo sapiens
cttgttgggattcctgaccc

SEQ ID NO: 3175483 - DNA, 22 bp, Homo sapiens
cttgttgggattcctgacccag

SEQ ID NO: 3175484 - DNA, 20 bp, Homo sapiens
cttgttgttggttgtttttt

SEQ ID NO: 3175485 - DNA, 23 bp, Homo sapiens
cttgtttaaaaaaacaaataaat

SEQ ID NO: 3175486 - DNA, 19 bp, Homo sapiens
cttgtttacagcactactc

SEQ ID NO: 3175487 - DNA, 22 bp, Homo sapiens
cttgtttacagcactactctgt

SEQ ID NO: 3175488 - DNA, 19 bp, Homo sapiens
cttgtttacctttctctct

SEQ ID NO: 3175489 - DNA, 18 bp, Homo sapiens
cttgtttatcagatacat

SEQ ID NO: 3175490 - DNA, 21 bp, Homo sapiens
cttgtttatcagatacatcac

SEQ ID NO: 3175491 - DNA, 23 bp, Homo sapiens
cttgtttatgatatttcttgctt

SEQ ID NO: 3175492 - DNA, 14 bp, Homo sapiens
cttgtttattaaat

SEQ ID NO: 3175493 - DNA, 19 bp, Homo sapiens
cttgtttggtagttagcca

SEQ ID NO: 3175494 - DNA, 15 bp, Homo sapiens
cttgtttgtcttcca

SEQ ID NO: 3175495 - DNA, 19 bp, Homo sapiens
cttgtttgtgcatcctgtg

SEQ ID NO: 3175496 - DNA, 22 bp, Homo sapiens
cttgttttccagtctcttgtac

SEQ ID NO: 3175497 - DNA, 14 bp, Homo sapiens
cttgttttctctgt

SEQ ID NO: 3175498 - DNA, 14 bp, Homo sapiens
cttgttttcttgcc

SEQ ID NO: 3175499 - DNA, 18 bp, Homo sapiens
cttgttttcttgccaatg

SEQ ID NO: 3175500 - DNA, 14 bp, Homo sapiens
cttgttttggacag

SEQ ID NO: 3175501 - DNA, 16 bp, Homo sapiens
cttgttttgtttgtct

SEQ ID NO: 3175502 - DNA, 16 bp, Homo sapiens
cttgtttttgcacatg

SEQ ID NO: 3175503 - DNA, 21 bp, Homo sapiens
ctttaaaaaagactgaacatg

SEQ ID NO: 3175504 - DNA, 22 bp, Homo sapiens
ctttaaaaaagactgaacatgt

SEQ ID NO: 3175505 - DNA, 23 bp, Homo sapiens
ctttaaaaaagactgaacatgtt

SEQ ID NO: 3175506 - DNA, 17 bp, Homo sapiens
ctttaaaaaatatttat

SEQ ID NO: 3175507 - DNA, 14 bp, Homo sapiens
ctttaaaaactgtt

SEQ ID NO: 3175508 - DNA, 21 bp, Homo sapiens
ctttaaaaaggaaatttgttt

SEQ ID NO: 3175509 - DNA, 15 bp, Homo sapiens
ctttaaaagaatgac

SEQ ID NO: 3175510 - DNA, 16 bp, Homo sapiens
ctttaaaagaatgact

SEQ ID NO: 3175511 - DNA, 16 bp, Homo sapiens
ctttaaaagagagaga

SEQ ID NO: 3175512 - DNA, 21 bp, Homo sapiens
ctttaaaagagagagagagaa

SEQ ID NO: 3175513 - DNA, 22 bp, Homo sapiens
ctttaaaagagagagagagaaa

SEQ ID NO: 3175514 - DNA, 13 bp, Homo sapiens
ctttaaactcagg

SEQ ID NO: 3175515 - DNA, 15 bp, Homo sapiens
ctttaaactcaggga

SEQ ID NO: 3175516 - DNA, 10 bp, Homo sapiens
ctttaaagaa

SEQ ID NO: 3175517 - DNA, 20 bp, Homo sapiens
ctttaaagatgaactctgaa

SEQ ID NO: 3175518 - DNA, 15 bp, Homo sapiens
ctttaaaggcccagc

SEQ ID NO: 3175519 - DNA, 20 bp, Homo sapiens
ctttaaaggcccagccccta

SEQ ID NO: 3175520 - DNA, 19 bp, Homo sapiens
ctttaaagggcctgcctgg

SEQ ID NO: 3175521 - DNA, 19 bp, Homo sapiens
ctttaaagtgtaataatat

SEQ ID NO: 3175522 - DNA, 12 bp, Homo sapiens
ctttaaatcatt

SEQ ID NO: 3175523 - DNA, 18 bp, Homo sapiens
ctttaaatgttttataag

SEQ ID NO: 3175524 - DNA, 13 bp, Homo sapiens
ctttaaattgtgt

SEQ ID NO: 3175525 - DNA, 17 bp, Homo sapiens
ctttaacagcttacact

SEQ ID NO: 3175526 - DNA, 19 bp, Homo sapiens
ctttaagcactacataaac

SEQ ID NO: 3175527 - DNA, 20 bp, Homo sapiens
ctttaagcactacataaact

SEQ ID NO: 3175528 - DNA, 16 bp, Homo sapiens
ctttaagcagctcttg

SEQ ID NO: 3175529 - DNA, 19 bp, Homo sapiens
ctttaagcagctcttgcta

SEQ ID NO: 3175530 - DNA, 19 bp, Homo sapiens
ctttaagccaaagaaacaa

SEQ ID NO: 3175531 - DNA, 20 bp, Homo sapiens
ctttaagccttcaaaactat

SEQ ID NO: 3175532 - DNA, 16 bp, Homo sapiens
ctttaagtattgtttt

SEQ ID NO: 3175533 - DNA, 22 bp, Homo sapiens
ctttaataacaatatatagaat

SEQ ID NO: 3175534 - DNA, 17 bp, Homo sapiens
ctttaatcactgcattt

SEQ ID NO: 3175535 - DNA, 17 bp, Homo sapiens
ctttaatcttcagtttt

SEQ ID NO: 3175536 - DNA, 18 bp, Homo sapiens
ctttaatgattataatca

SEQ ID NO: 3175537 - DNA, 12 bp, Homo sapiens
ctttaatgcatc

SEQ ID NO: 3175538 - DNA, 19 bp, Homo sapiens
cttttggcagttctgataa

SEQ ID NO: 3175539 - DNA, 15 bp, Homo sapiens
cttttggcttccatg

SEQ ID NO: 3175540 - DNA, 17 bp, Homo sapiens
cttttggtgtgttggac

SEQ ID NO: 3175541 - DNA, 20 bp, Homo sapiens
cttttggtgtgttggacaga

SEQ ID NO: 3175542 - DNA, 21 bp, Homo sapiens
cttttggtttgggggcgccct

SEQ ID NO: 3175543 - DNA, 21 bp, Homo sapiens
cttttgtaaagaaatttacta

SEQ ID NO: 3175544 - DNA, 14 bp, Homo sapiens
cttttgtaaattaa

SEQ ID NO: 3175545 - DNA, 15 bp, Homo sapiens
cttttgtaaattaaa

SEQ ID NO: 3175546 - DNA, 10 bp, Homo sapiens
cttttgtaag

SEQ ID NO: 3175547 - DNA, 14 bp, Homo sapiens
cttttgtaattgtg

SEQ ID NO: 3175548 - DNA, 13 bp, Homo sapiens
cttttgtacatct

SEQ ID NO: 3175549 - DNA, 14 bp, Homo sapiens
cttttgtacatctg

SEQ ID NO: 3175550 - DNA, 19 bp, Homo sapiens
cttttgtatacatcctggg

SEQ ID NO: 3175551 - DNA, 17 bp, Homo sapiens
cttttgtatcttccttt

SEQ ID NO: 3175552 - DNA, 20 bp, Homo sapiens
cttttgtatcttcctttctt

SEQ ID NO: 3175553 - DNA, 15 bp, Homo sapiens
cttttgtccccaggg

SEQ ID NO: 3175554 - DNA, 14 bp, Homo sapiens
cttttgtgaacttt

SEQ ID NO: 3175555 - DNA, 16 bp, Homo sapiens
cttttgtggtgtcttc

SEQ ID NO: 3175556 - DNA, 14 bp, Homo sapiens
cttttgtgtacagt

SEQ ID NO: 3175557 - DNA, 17 bp, Homo sapiens
cttttgtgtgaattgac

SEQ ID NO: 3175558 - DNA, 18 bp, Homo sapiens
cttttgttaaaagttatt

SEQ ID NO: 3175559 - DNA, 15 bp, Homo sapiens
cttttgttaaataat

SEQ ID NO: 3175560 - DNA, 18 bp, Homo sapiens
cttttgttaaataatatg

SEQ ID NO: 3175561 - DNA, 13 bp, Homo sapiens
cttttgttactgt

SEQ ID NO: 3175562 - DNA, 14 bp, Homo sapiens
cttttgttactgtt

SEQ ID NO: 3175563 - DNA, 16 bp, Homo sapiens
cttttgttactgttct

SEQ ID NO: 3175564 - DNA, 17 bp, Homo sapiens
cttttgttactgttctt

SEQ ID NO: 3175565 - DNA, 16 bp, Homo sapiens
cttttgttctgcttta

SEQ ID NO: 3175566 - DNA, 13 bp, Homo sapiens
cttttgttgtgac

SEQ ID NO: 3175567 - DNA, 21 bp, Homo sapiens
cttttgtttaaatataaatgt

SEQ ID NO: 3175568 - DNA, 13 bp, Homo sapiens
cttttgtttattt

SEQ ID NO: 3175569 - DNA, 16 bp, Homo sapiens
cttttgtttggtaaat

SEQ ID NO: 3175570 - DNA, 18 bp, Homo sapiens
cttttgtttggtaaatgt

SEQ ID NO: 3175571 - DNA, 15 bp, Homo sapiens
cttttgtttttttcc

SEQ ID NO: 3175572 - DNA, 19 bp, Homo sapiens
cttttgtttttttcctcat

SEQ ID NO: 3175573 - DNA, 22 bp, Homo sapiens
ctttttaaaaactcttcagtgc

SEQ ID NO: 3175574 - DNA, 22 bp, Homo sapiens
ctttttaaaaagtactctttaa

SEQ ID NO: 3175575 - DNA, 19 bp, Homo sapiens
ctttttaaaaatagacact

SEQ ID NO: 3175576 - DNA, 14 bp, Homo sapiens
ctttttaaaaatga

SEQ ID NO: 3175577 - DNA, 16 bp, Homo sapiens
ctttttaaagtgtttc

SEQ ID NO: 3175578 - DNA, 15 bp, Homo sapiens
ctttttaaatgtgaa

SEQ ID NO: 3175579 - DNA, 18 bp, Homo sapiens
ctttttaagtaatgtgga

SEQ ID NO: 3175580 - DNA, 14 bp, Homo sapiens
ctttttaattattt

SEQ ID NO: 3175581 - DNA, 22 bp, Homo sapiens
ctttttaattattttaaaatat

SEQ ID NO: 3175582 - DNA, 15 bp, Homo sapiens
ctttttaattgttgt

SEQ ID NO: 3175583 - DNA, 22 bp, Homo sapiens
ctttttaattgttgtttctttc

SEQ ID NO: 3175584 - DNA, 19 bp, Homo sapiens
ctttttacagcattgtctt

SEQ ID NO: 3175585 - DNA, 21 bp, Homo sapiens
ctttttacagcattgtctttg

SEQ ID NO: 3175586 - DNA, 19 bp, Homo sapiens
ctttttagggccaggcagg

SEQ ID NO: 3175587 - DNA, 13 bp, Homo sapiens
ctttttagttttt

SEQ ID NO: 3175588 - DNA, 18 bp, Homo sapiens
ctttttataaaaagataa

SEQ ID NO: 3175589 - DNA, 12 bp, Homo sapiens
ctttttatttct

SEQ ID NO: 3175590 - DNA, 17 bp, Homo sapiens
ctttttcatatgttgct

SEQ ID NO: 3175591 - DNA, 15 bp, Homo sapiens
ctttttcatttatct

SEQ ID NO: 3175592 - DNA, 12 bp, Homo sapiens
ctttttcatttg

SEQ ID NO: 3175593 - DNA, 15 bp, Homo sapiens
ctttttcatttgcct

SEQ ID NO: 3175594 - DNA, 18 bp, Homo sapiens
ctttttcctagcctgttt

SEQ ID NO: 3175595 - DNA, 23 bp, Homo sapiens
ctttttcctagcctgtttcttcc

SEQ ID NO: 3175596 - DNA, 12 bp, Homo sapiens
ctttttcctcct

SEQ ID NO: 3175597 - DNA, 13 bp, Homo sapiens
ctttttcctctga

SEQ ID NO: 3175598 - DNA, 20 bp, Homo sapiens
ctttttcctctgagcccagc

SEQ ID NO: 3175599 - DNA, 19 bp, Homo sapiens
ctttttcgtgtggatcttg

SEQ ID NO: 3175600 - DNA, 20 bp, Homo sapiens
ctttttctaaagtgttggtc

SEQ ID NO: 3175601 - DNA, 22 bp, Homo sapiens
ctttttctggactgaagcctgc

SEQ ID NO: 3175602 - DNA, 15 bp, Homo sapiens
ctttttcttcttccc

SEQ ID NO: 3175603 - DNA, 14 bp, Homo sapiens
ctttttcttgatct

SEQ ID NO: 3175604 - DNA, 22 bp, Homo sapiens
ctttttcttgatcttaaagatc

SEQ ID NO: 3175605 - DNA, 12 bp, Homo sapiens
ctttttctttat

SEQ ID NO: 3175606 - DNA, 22 bp, Homo sapiens
ctttttgaaatgaaatttaaac

SEQ ID NO: 3175607 - DNA, 12 bp, Homo sapiens
ctttttggaatc

SEQ ID NO: 3175608 - DNA, 21 bp, Homo sapiens
ctttttggaggtgcttaagca

SEQ ID NO: 3175609 - DNA, 17 bp, Homo sapiens
ctttttggctgacttca

SEQ ID NO: 3175610 - DNA, 15 bp, Homo sapiens
ctttttggtggatgt

SEQ ID NO: 3175611 - DNA, 19 bp, Homo sapiens
ctttttggtggatgtaaat

SEQ ID NO: 3175612 - DNA, 23 bp, Homo sapiens
ctttttggtgtatagaagtttgt

SEQ ID NO: 3175613 - DNA, 18 bp, Homo sapiens
ctttttgtaaatactgct

SEQ ID NO: 3175614 - DNA, 18 bp, Homo sapiens
ctttttgtataaaataga

SEQ ID NO: 3175615 - DNA, 15 bp, Homo sapiens
ctttttgtatgtgaa

SEQ ID NO: 3175616 - DNA, 21 bp, Homo sapiens
ctttttgttctggtccttttt

SEQ ID NO: 3175617 - DNA, 23 bp, Homo sapiens
ctttttgtttgggatcagcttct

SEQ ID NO: 3175618 - DNA, 17 bp, Homo sapiens
cttttttaaaaaagcaa

SEQ ID NO: 3175619 - DNA, 22 bp, Homo sapiens
cttttttaaatattttctattt

SEQ ID NO: 3175620 - DNA, 15 bp, Homo sapiens
cttttttaaattaat

SEQ ID NO: 3175621 - DNA, 16 bp, Homo sapiens
cttttttaaattaata

SEQ ID NO: 3175622 - DNA, 15 bp, Homo sapiens
cttttttaaattttc

SEQ ID NO: 3175623 - DNA, 20 bp, Homo sapiens
cttttttaaattttcttcag

SEQ ID NO: 3175624 - DNA, 11 bp, Homo sapiens
cttttttactc

SEQ ID NO: 3175625 - DNA, 13 bp, Homo sapiens
cttttttactcat

SEQ ID NO: 3175626 - DNA, 20 bp, Homo sapiens
cttttttactcattgaaatg

SEQ ID NO: 3175627 - DNA, 17 bp, Homo sapiens
cttttttgagtcattga

SEQ ID NO: 3175628 - DNA, 19 bp, Homo sapiens
cttttttgagtcattgact

SEQ ID NO: 3175629 - DNA, 11 bp, Homo sapiens
cttttttgatt

SEQ ID NO: 3175630 - DNA, 11 bp, Homo sapiens
cttttttgtct

SEQ ID NO: 3175631 - DNA, 12 bp, Homo sapiens
cttttttgtcta

SEQ ID NO: 3175632 - DNA, 16 bp, Homo sapiens
cttttttgtctatgaa

SEQ ID NO: 3175633 - DNA, 23 bp, Homo sapiens
cttttttgtctatgaagttgctg

SEQ ID NO: 3175634 - DNA, 16 bp, Homo sapiens
ctttttttctgtacca

SEQ ID NO: 3175635 - DNA, 14 bp, Homo sapiens
ctttttttcttaaa

SEQ ID NO: 3175636 - DNA, 22 bp, Homo sapiens
ctttttttgcctaccatttcac

SEQ ID NO: 3175637 - DNA, 20 bp, Homo sapiens
ctttttttgtgactagaaat

SEQ ID NO: 3175638 - DNA, 15 bp, Homo sapiens
ctttttttttctctt

SEQ ID NO: 3175639 - DNA, 17 bp, Homo sapiens
ctttttttttctctttc

SEQ ID NO: 3175640 - DNA, 21 bp, Homo sapiens
ctttttttttgaaacagcagt

SEQ ID NO: 3175641 - DNA, 23 bp, Homo sapiens
ctttttttttttgtttgatgcag

SEQ ID NO: 3175642 - DNA, 22 bp, Homo sapiens
ctttttttttttttttttggtc

SEQ ID NO: 3175643 - DNA, 16 bp, Homo sapiens
gaaaaaaaacagtgga

SEQ ID NO: 3175644 - DNA, 16 bp, Homo sapiens
gaaaaaaaaccttgta

SEQ ID NO: 3175645 - DNA, 20 bp, Homo sapiens
gaaaaaaaatgttctttggg

SEQ ID NO: 3175646 - DNA, 18 bp, Homo sapiens
gaaaaaaacataaaaagc

SEQ ID NO: 3175647 - DNA, 16 bp, Homo sapiens
gaaaaaaaccacacaa

SEQ ID NO: 3175648 - DNA, 19 bp, Homo sapiens
gaaaaaaacttggcacttt

SEQ ID NO: 3175649 - DNA, 22 bp, Homo sapiens
gaaaaaaagaggtttaagtttg

SEQ ID NO: 3175650 - DNA, 13 bp, Homo sapiens
gaaaaaagaacca

SEQ ID NO: 3175651 - DNA, 19 bp, Homo sapiens
gaaaaaagaaccaaaactt

SEQ ID NO: 3175652 - DNA, 13 bp, Homo sapiens
gaaaaaagcacat

SEQ ID NO: 3175653 - DNA, 16 bp, Homo sapiens
gaaaaaataattattt

SEQ ID NO: 3175654 - DNA, 11 bp, Homo sapiens
gaaaaacaggt

SEQ ID NO: 3175655 - DNA, 23 bp, Homo sapiens
gaaaaactctgggaaataagaga

SEQ ID NO: 3175656 - DNA, 16 bp, Homo sapiens
gaaaaagcacaagaag

SEQ ID NO: 3175657 - DNA, 18 bp, Homo sapiens
gaaaaagcatgatgggaa

SEQ ID NO: 3175658 - DNA, 19 bp, Homo sapiens
gaaaaagcatgatgggaaa

SEQ ID NO: 3175659 - DNA, 17 bp, Homo sapiens
gaaaaatataaaattat

SEQ ID NO: 3175660 - DNA, 11 bp, Homo sapiens
gaaaaatcttg

SEQ ID NO: 3175661 - DNA, 22 bp, Homo sapiens
gaaaaatcttgtgctagaatac

SEQ ID NO: 3175662 - DNA, 17 bp, Homo sapiens
gaaaaatgctccccaca

SEQ ID NO: 3175663 - DNA, 22 bp, Homo sapiens
gaaaaatgggtcttttatagga

SEQ ID NO: 3175664 - DNA, 19 bp, Homo sapiens
gaacaaaactgttcttttg

SEQ ID NO: 3175665 - DNA, 22 bp, Homo sapiens
gaacaaaactgttcttttgcat

SEQ ID NO: 3175666 - DNA, 18 bp, Homo sapiens
gaacaaacaaaacttaaa

SEQ ID NO: 3175667 - DNA, 20 bp, Homo sapiens
gaacaaacaaaacttaaaag

SEQ ID NO: 3175668 - DNA, 19 bp, Homo sapiens
gaacaaagctgttaaactg

SEQ ID NO: 3175669 - DNA, 21 bp, Homo sapiens
gaacaaagctgttaaactgtt

SEQ ID NO: 3175670 - DNA, 22 bp, Homo sapiens
gaacaaagctgttaaactgtta

SEQ ID NO: 3175671 - DNA, 16 bp, Homo sapiens
gaacaagtcacagctg

SEQ ID NO: 3175672 - DNA, 14 bp, Homo sapiens
gaacaatcaaagca

SEQ ID NO: 3175673 - DNA, 13 bp, Homo sapiens
gaacaattgaagt

SEQ ID NO: 3175674 - DNA, 17 bp, Homo sapiens
gaacaattgaagtaaac

SEQ ID NO: 3175675 - DNA, 19 bp, Homo sapiens
gaacacaggcagctttcta

SEQ ID NO: 3175676 - DNA, 20 bp, Homo sapiens
gaacacagtttagtgcttta

SEQ ID NO: 3175677 - DNA, 19 bp, Homo sapiens
gaacaccattgaaggctta

SEQ ID NO: 3175678 - DNA, 21 bp, Homo sapiens
gaacacccgactcctcaaaag

SEQ ID NO: 3175679 - DNA, 23 bp, Homo sapiens
gaacacccttagaaaatgtgtcc

SEQ ID NO: 3175680 - DNA, 15 bp, Homo sapiens
gaacacgtttttaca

SEQ ID NO: 3175681 - DNA, 15 bp, Homo sapiens
gaacactaattcata

SEQ ID NO: 3175682 - DNA, 18 bp, Homo sapiens
gaacactaattcataatc

SEQ ID NO: 3175683 - DNA, 17 bp, Homo sapiens
gaacactattttcagaa

SEQ ID NO: 3175684 - DNA, 17 bp, Homo sapiens
gaacacttagtgatcat

SEQ ID NO: 3175685 - DNA, 14 bp, Homo sapiens
gaacagaatgtttt

SEQ ID NO: 3175686 - DNA, 15 bp, Homo sapiens
gaacagaccagtgac

SEQ ID NO: 3175687 - DNA, 19 bp, Homo sapiens
gaacagaccggagaggaca

SEQ ID NO: 3175688 - DNA, 13 bp, Homo sapiens
gaacagacctgag

SEQ ID NO: 3175689 - DNA, 17 bp, Homo sapiens
gaacagataatccctgt

SEQ ID NO: 3175690 - DNA, 14 bp, Homo sapiens
gaacagcgggagac

SEQ ID NO: 3175691 - DNA, 16 bp, Homo sapiens
gaacagcgggagacct

SEQ ID NO: 3175692 - DNA, 19 bp, Homo sapiens
gaacagcgggagacctgtg

SEQ ID NO: 3175693 - DNA, 22 bp, Homo sapiens
gaacagcgggagacctgtgcta

SEQ ID NO: 3175694 - DNA, 23 bp, Homo sapiens
gaacagctatgggagccccaggg

SEQ ID NO: 3175695 - DNA, 17 bp, Homo sapiens
gaacagcttcaggttat

SEQ ID NO: 3175696 - DNA, 21 bp, Homo sapiens
gaacaggaggtgtgaatgcac

SEQ ID NO: 3175697 - DNA, 13 bp, Homo sapiens
gaacagtggctgg

SEQ ID NO: 3175698 - DNA, 15 bp, Homo sapiens
gaacatacttcaaaa

SEQ ID NO: 3175699 - DNA, 19 bp, Homo sapiens
gaacatacttcaaaaataa

SEQ ID NO: 3175700 - DNA, 21 bp, Homo sapiens
gaacatacttcaaaaataatg

SEQ ID NO: 3175701 - DNA, 23 bp, Homo sapiens
gaacatcaccgacgcgtctcctg

SEQ ID NO: 3175702 - DNA, 15 bp, Homo sapiens
gaacatcattagaac

SEQ ID NO: 3175703 - DNA, 22 bp, Homo sapiens
gaacatcctttgcagggcagcc

SEQ ID NO: 3175704 - DNA, 23 bp, Homo sapiens
gaacatcctttgcagggcagccc

SEQ ID NO: 3175705 - DNA, 22 bp, Homo sapiens
gaacatgtcctaattcttctgt

SEQ ID NO: 3175706 - DNA, 19 bp, Homo sapiens
gaacatgtgagaggtttga

SEQ ID NO: 3175707 - DNA, 18 bp, Homo sapiens
gaacatgtgccttttctg

SEQ ID NO: 3175708 - DNA, 22 bp, Homo sapiens
gaacatgtttacaggtttgaat

SEQ ID NO: 3175709 - DNA, 14 bp, Homo sapiens
gaacattcagctct

SEQ ID NO: 3175710 - DNA, 17 bp, Homo sapiens
gaacattcagctctgga

SEQ ID NO: 3175711 - DNA, 12 bp, Homo sapiens
gaacattggaat

SEQ ID NO: 3175712 - DNA, 16 bp, Homo sapiens
gaacattggagctgac

SEQ ID NO: 3175713 - DNA, 19 bp, Homo sapiens
gaacattggagctgactgt

SEQ ID NO: 3175714 - DNA, 20 bp, Homo sapiens
gaacatttaataatgtatgt

SEQ ID NO: 3175715 - DNA, 19 bp, Homo sapiens
gaacatttgatatttttcc

SEQ ID NO: 3175716 - DNA, 22 bp, Homo sapiens
gaacatttgatatttttccatt

SEQ ID NO: 3175717 - DNA, 23 bp, Homo sapiens
gaacatttgatatttttccattt

SEQ ID NO: 3175718 - DNA, 17 bp, Homo sapiens
gaaccaaattgcactga

SEQ ID NO: 3175719 - DNA, 21 bp, Homo sapiens
gaaccaaattgcactgaagtt

SEQ ID NO: 3175720 - DNA, 18 bp, Homo sapiens
gaaccaaggcagcctcca

SEQ ID NO: 3175721 - DNA, 23 bp, Homo sapiens
gaaccaaggcagcctccagagcc

SEQ ID NO: 3175722 - DNA, 24 bp, Homo sapiens
gaaccaagtggaccttgagaccac

SEQ ID NO: 3175723 - DNA, 14 bp, Homo sapiens
gaaccacaactttg

SEQ ID NO: 3175724 - DNA, 14 bp, Homo sapiens
gaaccacagggcca

SEQ ID NO: 3175725 - DNA, 17 bp, Homo sapiens
gaaccacagggccagag

SEQ ID NO: 3175726 - DNA, 16 bp, Homo sapiens
gaaccaccacacccag

SEQ ID NO: 3175727 - DNA, 20 bp, Homo sapiens
gaaccaccacacccagccca

SEQ ID NO: 3175728 - DNA, 21 bp, Homo sapiens
gaaccacgcgggggccttgag

SEQ ID NO: 3175729 - DNA, 19 bp, Homo sapiens
gaaccactacatgcagccc

SEQ ID NO: 3175730 - DNA, 15 bp, Homo sapiens
gaaccactcccacca

SEQ ID NO: 3175731 - DNA, 20 bp, Homo sapiens
gaaccacttcctgctacagg

SEQ ID NO: 3175732 - DNA, 20 bp, Homo sapiens
gaaccagcatctcagcgcca

SEQ ID NO: 3175733 - DNA, 20 bp, Homo sapiens
gaaccagtctcctcactctg

SEQ ID NO: 3175734 - DNA, 22 bp, Homo sapiens
gaaccatgcaggaaggaaaact

SEQ ID NO: 3175735 - DNA, 16 bp, Homo sapiens
gaaccattatacttta

SEQ ID NO: 3175736 - DNA, 14 bp, Homo sapiens
gaacccagggctct

SEQ ID NO: 3175737 - DNA, 17 bp, Homo sapiens
gaacccagggctctgcc

SEQ ID NO: 3175738 - DNA, 20 bp, Homo sapiens
gaacccagggctctgcccca

SEQ ID NO: 3175739 - DNA, 19 bp, Homo sapiens
gaaccccatgggcttggac

SEQ ID NO: 3175740 - DNA, 19 bp, Homo sapiens
gaaccccgtcgaggggctc

SEQ ID NO: 3175741 - DNA, 13 bp, Homo sapiens
gaacccctgtgtc

SEQ ID NO: 3175742 - DNA, 19 bp, Homo sapiens
gaacccctgtgtccctttt

SEQ ID NO: 3175743 - DNA, 17 bp, Homo sapiens
gaaccccttcatcctct

SEQ ID NO: 3175744 - DNA, 17 bp, Homo sapiens
gaaccctgtgctggtgt

SEQ ID NO: 3175745 - DNA, 17 bp, Homo sapiens
gaacccttgtgcttggt

SEQ ID NO: 3175746 - DNA, 13 bp, Homo sapiens
gaaccgcacagct

SEQ ID NO: 3175747 - DNA, 15 bp, Homo sapiens
gaaccgcacagctca

SEQ ID NO: 3175748 - DNA, 16 bp, Homo sapiens
gaaccgcacagctcag

SEQ ID NO: 3175749 - DNA, 20 bp, Homo sapiens
gaaccgctcacctagagcca

SEQ ID NO: 3175750 - DNA, 22 bp, Homo sapiens
gaaccgctcacctagagccaga

SEQ ID NO: 3175751 - DNA, 15 bp, Homo sapiens
gaacctattttcatt

SEQ ID NO: 3175752 - DNA, 11 bp, Homo sapiens
gaacctcaggc

SEQ ID NO: 3175753 - DNA, 12 bp, Homo sapiens
gaacctcccaga

SEQ ID NO: 3175754 - DNA, 13 bp, Homo sapiens
gaacctcccagag

SEQ ID NO: 3175755 - DNA, 12 bp, Homo sapiens
gaacctctgtct

SEQ ID NO: 3175756 - DNA, 11 bp, Homo sapiens
gaacctggatc

SEQ ID NO: 3175757 - DNA, 13 bp, Homo sapiens
gaacctgggctgt

SEQ ID NO: 3175758 - DNA, 18 bp, Homo sapiens
gaacctgggctgtgctgc

SEQ ID NO: 3175759 - DNA, 12 bp, Homo sapiens
gaacctgtgtcc

SEQ ID NO: 3175760 - DNA, 15 bp, Homo sapiens
gaaccttccttcctg

SEQ ID NO: 3175761 - DNA, 17 bp, Homo sapiens
gaaccttctagaacctg

SEQ ID NO: 3175762 - DNA, 17 bp, Homo sapiens
gaaccttgctgtcctga

SEQ ID NO: 3175763 - DNA, 22 bp, Homo sapiens
gaacgagcactggccagagagg

SEQ ID NO: 3175764 - DNA, 21 bp, Homo sapiens
gaacgccagtctcccaggccc

SEQ ID NO: 3175765 - DNA, 20 bp, Homo sapiens
gaacgcggtgtgtaacactg

SEQ ID NO: 3175766 - DNA, 13 bp, Homo sapiens
gaacgtttctggc

SEQ ID NO: 3175767 - DNA, 21 bp, Homo sapiens
gaacgtttctggcctgggttt

SEQ ID NO: 3175768 - DNA, 23 bp, Homo sapiens
gaactaaactagtttttcctatc

SEQ ID NO: 3175769 - DNA, 13 bp, Homo sapiens
gaactaaagcaaa

SEQ ID NO: 3175770 - DNA, 13 bp, Homo sapiens
gaactaaatgttc

SEQ ID NO: 3175771 - DNA, 15 bp, Homo sapiens
gaactaaatgttcta

SEQ ID NO: 3175772 - DNA, 22 bp, Homo sapiens
gaactaatgataatcccaccac

SEQ ID NO: 3175773 - DNA, 16 bp, Homo sapiens
gaactactaaggaaaa

SEQ ID NO: 3175774 - DNA, 18 bp, Homo sapiens
gaactagccaaaccagga

SEQ ID NO: 3175775 - DNA, 15 bp, Homo sapiens
gaactaggctgagca

SEQ ID NO: 3175776 - DNA, 16 bp, Homo sapiens
gaactagggaagctca

SEQ ID NO: 3175777 - DNA, 15 bp, Homo sapiens
gaactatagtaactt

SEQ ID NO: 3175778 - DNA, 20 bp, Homo sapiens
gaactatgtcgatgcacagt

SEQ ID NO: 3175779 - DNA, 15 bp, Homo sapiens
gaactcaactttgac

SEQ ID NO: 3175780 - DNA, 16 bp, Homo sapiens
gaactcaccctgggag

SEQ ID NO: 3175781 - DNA, 13 bp, Homo sapiens
gaactcactctgg

SEQ ID NO: 3175782 - DNA, 14 bp, Homo sapiens
gaactcactctggg

SEQ ID NO: 3175783 - DNA, 15 bp, Homo sapiens
gaactcactctgggc

SEQ ID NO: 3175784 - DNA, 18 bp, Homo sapiens
gaactccactctccttcg

SEQ ID NO: 3175785 - DNA, 15 bp, Homo sapiens
gaactccctttcaac

SEQ ID NO: 3175786 - DNA, 16 bp, Homo sapiens
gaactccctttcaaca

SEQ ID NO: 3175787 - DNA, 23 bp, Homo sapiens
gaactcctaaacctttgcccctg

SEQ ID NO: 3175788 - DNA, 13 bp, Homo sapiens
gaactcctgccac

SEQ ID NO: 3175789 - DNA, 14 bp, Homo sapiens
gaactcctggcctc

SEQ ID NO: 3175790 - DNA, 24 bp, Homo sapiens
gacaatggacctctcagcagaaac

SEQ ID NO: 3175791 - DNA, 23 bp, Homo sapiens
gacaattcctagataaaaagatg

SEQ ID NO: 3175792 - DNA, 21 bp, Homo sapiens
gacaattgttttaatctgaaa

SEQ ID NO: 3175793 - DNA, 13 bp, Homo sapiens
gacacaaatgcat

SEQ ID NO: 3175794 - DNA, 20 bp, Homo sapiens
gacacaataggtctttctct

SEQ ID NO: 3175795 - DNA, 21 bp, Homo sapiens
gacacaataggtctttctctc

SEQ ID NO: 3175796 - DNA, 21 bp, Homo sapiens
gacacaatatgtatgcttttt

SEQ ID NO: 3175797 - DNA, 12 bp, Homo sapiens
gacacacacaca

SEQ ID NO: 3175798 - DNA, 19 bp, Homo sapiens
gacacacacacgcacgcac

SEQ ID NO: 3175799 - DNA, 20 bp, Homo sapiens
gacacacacacgcacgcaca

SEQ ID NO: 3175800 - DNA, 21 bp, Homo sapiens
gacacacacacgcacgcacac

SEQ ID NO: 3175801 - DNA, 23 bp, Homo sapiens
gacacacacacgcacgcacacac

SEQ ID NO: 3175802 - DNA, 15 bp, Homo sapiens
gacacacagaaatgt

SEQ ID NO: 3175803 - DNA, 13 bp, Homo sapiens
gacacacagctct

SEQ ID NO: 3175804 - DNA, 15 bp, Homo sapiens
gacacacagctctgt

SEQ ID NO: 3175805 - DNA, 17 bp, Homo sapiens
gacacacagctctgtcc

SEQ ID NO: 3175806 - DNA, 18 bp, Homo sapiens
gacacacagctctgtcct

SEQ ID NO: 3175807 - DNA, 15 bp, Homo sapiens
gacacaccaggcgct

SEQ ID NO: 3175808 - DNA, 21 bp, Homo sapiens
gacacaccccacaccccagcc

SEQ ID NO: 3175809 - DNA, 19 bp, Homo sapiens
gacacactaaccaagctga

SEQ ID NO: 3175810 - DNA, 15 bp, Homo sapiens
gacacagaacacaga

SEQ ID NO: 3175811 - DNA, 17 bp, Homo sapiens
gacacagactggcaata

SEQ ID NO: 3175812 - DNA, 19 bp, Homo sapiens
gacacagactggcaataaa

SEQ ID NO: 3175813 - DNA, 11 bp, Homo sapiens
gacacagcagc

SEQ ID NO: 3175814 - DNA, 18 bp, Homo sapiens
gacacagcagcttcacca

SEQ ID NO: 3175815 - DNA, 22 bp, Homo sapiens
gacacagcagcttcaccagagc

SEQ ID NO: 3175816 - DNA, 21 bp, Homo sapiens
gacacagcgtccctagcagtg

SEQ ID NO: 3175817 - DNA, 22 bp, Homo sapiens
gacacagcgtccctagcagtga

SEQ ID NO: 3175818 - DNA, 23 bp, Homo sapiens
gacacagctcttcattccattga

SEQ ID NO: 3175819 - DNA, 14 bp, Homo sapiens
gacacagctcttct

SEQ ID NO: 3175820 - DNA, 20 bp, Homo sapiens
gacacagctcttctccaggc

SEQ ID NO: 3175821 - DNA, 22 bp, Homo sapiens
gacacagctcttctccaggctg

SEQ ID NO: 3175822 - DNA, 23 bp, Homo sapiens
gacacagctcttctccaggctgt

SEQ ID NO: 3175823 - DNA, 12 bp, Homo sapiens
gacacaggcccg

SEQ ID NO: 3175824 - DNA, 22 bp, Homo sapiens
gacacatatgcaccttgtgtct

SEQ ID NO: 3175825 - DNA, 18 bp, Homo sapiens
gacacatcaagcttttct

SEQ ID NO: 3175826 - DNA, 22 bp, Homo sapiens
gacacatcaagcttttctgtag

SEQ ID NO: 3175827 - DNA, 23 bp, Homo sapiens
gacacatccgccttttgtataca

SEQ ID NO: 3175828 - DNA, 17 bp, Homo sapiens
gacaccaaccagacagc

SEQ ID NO: 3175829 - DNA, 23 bp, Homo sapiens
gacaccaaccgacaggccctggc

SEQ ID NO: 3175830 - DNA, 19 bp, Homo sapiens
gacaccagagcagatgcag

SEQ ID NO: 3175831 - DNA, 22 bp, Homo sapiens
gacaccagagcagatgcagaga

SEQ ID NO: 3175832 - DNA, 15 bp, Homo sapiens
gacaccagagctgcc

SEQ ID NO: 3175833 - DNA, 22 bp, Homo sapiens
gacaccatcttttgtgagatgt

SEQ ID NO: 3175834 - DNA, 23 bp, Homo sapiens
gacaccattaccaaaataataaa

SEQ ID NO: 3175835 - DNA, 14 bp, Homo sapiens
gacacccaaagggt

SEQ ID NO: 3175836 - DNA, 18 bp, Homo sapiens
gacacccaccctgtgcca

SEQ ID NO: 3175837 - DNA, 23 bp, Homo sapiens
gacacccaccctgtgccatcacc

SEQ ID NO: 3175838 - DNA, 14 bp, Homo sapiens
gacacccctgctct

SEQ ID NO: 3175839 - DNA, 19 bp, Homo sapiens
gacacccctgctctaccca

SEQ ID NO: 3175840 - DNA, 19 bp, Homo sapiens
gacacccgtgagcgcctgt

SEQ ID NO: 3175841 - DNA, 21 bp, Homo sapiens
gacaccctggcctgaactgag

SEQ ID NO: 3175842 - DNA, 22 bp, Homo sapiens
gacaccgggccagtatctatat

SEQ ID NO: 3175843 - DNA, 17 bp, Homo sapiens
gacaccgtttgtccccc

SEQ ID NO: 3175844 - DNA, 23 bp, Homo sapiens
gacacctaactcttttctatttt

SEQ ID NO: 3175845 - DNA, 19 bp, Homo sapiens
gacacctaccatgctgctt

SEQ ID NO: 3175846 - DNA, 13 bp, Homo sapiens
gacacctgccctg

SEQ ID NO: 3175847 - DNA, 21 bp, Homo sapiens
gacaccttctgagtattctca

SEQ ID NO: 3175848 - DNA, 14 bp, Homo sapiens
gacacctttaggtt

SEQ ID NO: 3175849 - DNA, 19 bp, Homo sapiens
gacacgctcgcgggcagcg

SEQ ID NO: 3175850 - DNA, 23 bp, Homo sapiens
gacacgtggcctcgtgaggggca

SEQ ID NO: 3175851 - DNA, 14 bp, Homo sapiens
gacacgtggcctgc

SEQ ID NO: 3175852 - DNA, 16 bp, Homo sapiens
gacacgtggcctgcac

SEQ ID NO: 3175853 - DNA, 18 bp, Homo sapiens
gacactaaccacgctgga

SEQ ID NO: 3175854 - DNA, 15 bp, Homo sapiens
gacactaacgacttc

SEQ ID NO: 3175855 - DNA, 18 bp, Homo sapiens
gacactaagttatagtat

SEQ ID NO: 3175856 - DNA, 15 bp, Homo sapiens
gacactcagacctga

SEQ ID NO: 3175857 - DNA, 19 bp, Homo sapiens
gacactccagtgccagcaa

SEQ ID NO: 3175858 - DNA, 15 bp, Homo sapiens
gacactcctagactt

SEQ ID NO: 3175859 - DNA, 17 bp, Homo sapiens
gacactctctggaagcc

SEQ ID NO: 3175860 - DNA, 12 bp, Homo sapiens
gacactgagccc

SEQ ID NO: 3175861 - DNA, 11 bp, Homo sapiens
gacactgcagt

SEQ ID NO: 3175862 - DNA, 16 bp, Homo sapiens
gacactgccacacagg

SEQ ID NO: 3175863 - DNA, 21 bp, Homo sapiens
gacactgctctaacagccctc

SEQ ID NO: 3175864 - DNA, 12 bp, Homo sapiens
gacactgctgca

SEQ ID NO: 3175865 - DNA, 15 bp, Homo sapiens
gacactgctgcacca

SEQ ID NO: 3175866 - DNA, 19 bp, Homo sapiens
gacactgctgcaccagagt

SEQ ID NO: 3175867 - DNA, 21 bp, Homo sapiens
gacactgctgcaccagagtga

SEQ ID NO: 3175868 - DNA, 12 bp, Homo sapiens
gacactggcatg

SEQ ID NO: 3175869 - DNA, 13 bp, Homo sapiens
gacactggcccct

SEQ ID NO: 3175870 - DNA, 12 bp, Homo sapiens
gacactgtacaa

SEQ ID NO: 3175871 - DNA, 20 bp, Homo sapiens
gacacttaatactaccttga

SEQ ID NO: 3175872 - DNA, 19 bp, Homo sapiens
gacacttcaaggtgacaga

SEQ ID NO: 3175873 - DNA, 21 bp, Homo sapiens
gacacttcaaggtgacagaag

SEQ ID NO: 3175874 - DNA, 19 bp, Homo sapiens
gacacttcacgcccttggc

SEQ ID NO: 3175875 - DNA, 14 bp, Homo sapiens
gacacttcagatct

SEQ ID NO: 3175876 - DNA, 22 bp, Homo sapiens
gacagaaaggagagtggccatt

SEQ ID NO: 3175877 - DNA, 13 bp, Homo sapiens
gacagaacattta

SEQ ID NO: 3175878 - DNA, 20 bp, Homo sapiens
gacagaacccctacatgaaa

SEQ ID NO: 3175879 - DNA, 15 bp, Homo sapiens
gacagaagcaggctg

SEQ ID NO: 3175880 - DNA, 15 bp, Homo sapiens
gacagaaggaccagc

SEQ ID NO: 3175881 - DNA, 16 bp, Homo sapiens
gacagaaggaccagcc

SEQ ID NO: 3175882 - DNA, 17 bp, Homo sapiens
gacagaagtctcctcaa

SEQ ID NO: 3175883 - DNA, 20 bp, Homo sapiens
gacagaatgtatctgtgaag

SEQ ID NO: 3175884 - DNA, 12 bp, Homo sapiens
gacagacacagg

SEQ ID NO: 3175885 - DNA, 16 bp, Homo sapiens
gacagacacaggcccg

SEQ ID NO: 3175886 - DNA, 17 bp, Homo sapiens
gacagacacaggcccgg

SEQ ID NO: 3175887 - DNA, 14 bp, Homo sapiens
gacagacccaggtc

SEQ ID NO: 3175888 - DNA, 16 bp, Homo sapiens
gacagacccaggtctt

SEQ ID NO: 3175889 - DNA, 16 bp, Homo sapiens
gacagactggccgggc

SEQ ID NO: 3175890 - DNA, 15 bp, Homo sapiens
gacagacttgagaac

SEQ ID NO: 3175891 - DNA, 18 bp, Homo sapiens
gacagagacgcaggaatg

SEQ ID NO: 3175892 - DNA, 23 bp, Homo sapiens
gacagagactcagcgctcctcct

SEQ ID NO: 3175893 - DNA, 24 bp, Homo sapiens
gacagagactcagcgctcctcctg

SEQ ID NO: 3175894 - DNA, 19 bp, Homo sapiens
gacagagcaggggctccag

SEQ ID NO: 3175895 - DNA, 17 bp, Homo sapiens
gacagaggcagccccat

SEQ ID NO: 3175896 - DNA, 23 bp, Homo sapiens
gacagaggcagccccattctgcc

SEQ ID NO: 3175897 - DNA, 16 bp, Homo sapiens
gacagagtgagactct

SEQ ID NO: 3175898 - DNA, 19 bp, Homo sapiens
gacagagtgagactctgtc

SEQ ID NO: 3175899 - DNA, 21 bp, Homo sapiens
gacagagttcactataaatgg

SEQ ID NO: 3175900 - DNA, 16 bp, Homo sapiens
gacagagttgattttt

SEQ ID NO: 3175901 - DNA, 14 bp, Homo sapiens
gacagatgccccag

SEQ ID NO: 3175902 - DNA, 17 bp, Homo sapiens
gacagatgtcagcttcc

SEQ ID NO: 3175903 - DNA, 18 bp, Homo sapiens
gacagattctgacattta

SEQ ID NO: 3175904 - DNA, 17 bp, Homo sapiens
gacagcaggcagcgcca

SEQ ID NO: 3175905 - DNA, 13 bp, Homo sapiens
gacagccagagct

SEQ ID NO: 3175906 - DNA, 15 bp, Homo sapiens
gacagccagagctgg

SEQ ID NO: 3175907 - DNA, 16 bp, Homo sapiens
gacagccagagctggg

SEQ ID NO: 3175908 - DNA, 11 bp, Homo sapiens
gacagccaggt

SEQ ID NO: 3175909 - DNA, 17 bp, Homo sapiens
gacagcccactgagaag

SEQ ID NO: 3175910 - DNA, 21 bp, Homo sapiens
gacagcccaggatactggcac

SEQ ID NO: 3175911 - DNA, 16 bp, Homo sapiens
gacagccccagagcag

SEQ ID NO: 3175912 - DNA, 19 bp, Homo sapiens
gacagccccagagcagggt

SEQ ID NO: 3175913 - DNA, 18 bp, Homo sapiens
gacagcctccccctgtcc

SEQ ID NO: 3175914 - DNA, 16 bp, Homo sapiens
gacagcctccgccaag

SEQ ID NO: 3175915 - DNA, 18 bp, Homo sapiens
gacgcctccggtgagcag

SEQ ID NO: 3175916 - DNA, 17 bp, Homo sapiens
gacgcctgagctcactc

SEQ ID NO: 3175917 - DNA, 20 bp, Homo sapiens
gacgccttcatctgggacaa

SEQ ID NO: 3175918 - DNA, 17 bp, Homo sapiens
gacgccttccaggtcag

SEQ ID NO: 3175919 - DNA, 18 bp, Homo sapiens
gacgccttccaggtcagg

SEQ ID NO: 3175920 - DNA, 22 bp, Homo sapiens
gacgccttccaggtcaggatgc

SEQ ID NO: 3175921 - DNA, 14 bp, Homo sapiens
gacgcgtctcctgt

SEQ ID NO: 3175922 - DNA, 15 bp, Homo sapiens
gacgcgtctcctgtt

SEQ ID NO: 3175923 - DNA, 16 bp, Homo sapiens
gacgctctctggcctt

SEQ ID NO: 3175924 - DNA, 15 bp, Homo sapiens
gacgctgatacataa

SEQ ID NO: 3175925 - DNA, 22 bp, Homo sapiens
gacgctgatacataactaaatt

SEQ ID NO: 3175926 - DNA, 19 bp, Homo sapiens
gacgctgcacttgacacca

SEQ ID NO: 3175927 - DNA, 23 bp, Homo sapiens
gacgctgcacttgacaccaacca

SEQ ID NO: 3175928 - DNA, 15 bp, Homo sapiens
gacggagtgggggga

SEQ ID NO: 3175929 - DNA, 23 bp, Homo sapiens
gacggcagaaaacagagcctgcc

SEQ ID NO: 3175930 - DNA, 19 bp, Homo sapiens
gacggcaggctcactgcca

SEQ ID NO: 3175931 - DNA, 20 bp, Homo sapiens
gacggcaggctcactgccag

SEQ ID NO: 3175932 - DNA, 12 bp, Homo sapiens
gacggccctgca

SEQ ID NO: 3175933 - DNA, 13 bp, Homo sapiens
gacggccctgcaa

SEQ ID NO: 3175934 - DNA, 22 bp, Homo sapiens
gacggcctgatgctccctcccc

SEQ ID NO: 3175935 - DNA, 23 bp, Homo sapiens
gacggcctgatgctccctcccct

SEQ ID NO: 3175936 - DNA, 13 bp, Homo sapiens
gacggcggccagg

SEQ ID NO: 3175937 - DNA, 15 bp, Homo sapiens
gacggcggccaggca

SEQ ID NO: 3175938 - DNA, 19 bp, Homo sapiens
gacggcggccaggcacagg

SEQ ID NO: 3175939 - DNA, 23 bp, Homo sapiens
gacggctgtggaccgtggacagg

SEQ ID NO: 3175940 - DNA, 13 bp, Homo sapiens
gacgggaggcccc

SEQ ID NO: 3175941 - DNA, 19 bp, Homo sapiens
gacgggaggggaaaggctg

SEQ ID NO: 3175942 - DNA, 18 bp, Homo sapiens
gacgggcaagaagctgct

SEQ ID NO: 3175943 - DNA, 12 bp, Homo sapiens
gacgggcacaga

SEQ ID NO: 3175944 - DNA, 19 bp, Homo sapiens
gacgggttggggccgggca

SEQ ID NO: 3175945 - DNA, 18 bp, Homo sapiens
gacggtgcccaagccaga

SEQ ID NO: 3175946 - DNA, 21 bp, Homo sapiens
gacggtgggcatttgtgaggc

SEQ ID NO: 3175947 - DNA, 14 bp, Homo sapiens
gacggttttgcttt

SEQ ID NO: 3175948 - DNA, 14 bp, Homo sapiens
gacggttttttatt

SEQ ID NO: 3175949 - DNA, 18 bp, Homo sapiens
gacgtcaagtctccttcc

SEQ ID NO: 3175950 - DNA, 21 bp, Homo sapiens
gacgtcatcggaggctgggcc

SEQ ID NO: 3175951 - DNA, 16 bp, Homo sapiens
gacgtccatagctcct

SEQ ID NO: 3175952 - DNA, 17 bp, Homo sapiens
gacgtcctatctccccc

SEQ ID NO: 3175953 - DNA, 22 bp, Homo sapiens
gacgtctttctttttttccccc

SEQ ID NO: 3175954 - DNA, 18 bp, Homo sapiens
gacgtggaacctctgtct

SEQ ID NO: 3175955 - DNA, 22 bp, Homo sapiens
gacgtggaacctctgtctcatc

SEQ ID NO: 3175956 - DNA, 18 bp, Homo sapiens
gacgtgggaatttcaatg

SEQ ID NO: 3175957 - DNA, 20 bp, Homo sapiens
gacgttcatttgtgtgctca

SEQ ID NO: 3175958 - DNA, 20 bp, Homo sapiens
gacgttggcctcagggccag

SEQ ID NO: 3175959 - DNA, 19 bp, Homo sapiens
gacgtttataaacagaaat

SEQ ID NO: 3175960 - DNA, 17 bp, Homo sapiens
gacgtttttgtgctgtg

SEQ ID NO: 3175961 - DNA, 17 bp, Homo sapiens
gactaaactatctgtat

SEQ ID NO: 3175962 - DNA, 14 bp, Homo sapiens
gactaaagagagaa

SEQ ID NO: 3175963 - DNA, 13 bp, Homo sapiens
gactaacaagaat

SEQ ID NO: 3175964 - DNA, 18 bp, Homo sapiens
gactaacataaaatctgt

SEQ ID NO: 3175965 - DNA, 23 bp, Homo sapiens
gactaaccccaacgcacaggaaa

SEQ ID NO: 3175966 - DNA, 18 bp, Homo sapiens
gactaaccttgagtcaga

SEQ ID NO: 3175967 - DNA, 23 bp, Homo sapiens
gactaagccctgtcgagacactt

SEQ ID NO: 3175968 - DNA, 15 bp, Homo sapiens
gactaattaggcaag

SEQ ID NO: 3175969 - DNA, 12 bp, Homo sapiens
gactaattgact

SEQ ID NO: 3175970 - DNA, 18 bp, Homo sapiens
gactaattgacttgcaaa

SEQ ID NO: 3175971 - DNA, 22 bp, Homo sapiens
gactaatttcaaaatgcttttt

SEQ ID NO: 3175972 - DNA, 18 bp, Homo sapiens
gactaattttacatgttt

SEQ ID NO: 3175973 - DNA, 23 bp, Homo sapiens
gactaattttacatgtttataaa

SEQ ID NO: 3175974 - DNA, 21 bp, Homo sapiens
gactacaaaatacaatcctgt

SEQ ID NO: 3175975 - DNA, 12 bp, Homo sapiens
gactacaggcac

SEQ ID NO: 3175976 - DNA, 13 bp, Homo sapiens
gactacaggcacc

SEQ ID NO: 3175977 - DNA, 18 bp, Homo sapiens
gactacaggcacccacca

SEQ ID NO: 3175978 - DNA, 13 bp, Homo sapiens
gactacagggctt

SEQ ID NO: 3175979 - DNA, 13 bp, Homo sapiens
gactacaggtgtg

SEQ ID NO: 3175980 - DNA, 14 bp, Homo sapiens
gactaccccagtcc

SEQ ID NO: 3175981 - DNA, 20 bp, Homo sapiens
gactacttgggagcaccgcc

SEQ ID NO: 3175982 - DNA, 15 bp, Homo sapiens
gactagaagggccag

SEQ ID NO: 3175983 - DNA, 18 bp, Homo sapiens
gactagactactcaatat

SEQ ID NO: 3175984 - DNA, 22 bp, Homo sapiens
gactagaggcagggaggggact

SEQ ID NO: 3175985 - DNA, 18 bp, Homo sapiens
gactagatgtagtatttt

SEQ ID NO: 3175986 - DNA, 20 bp, Homo sapiens
gactagcactagacatgtca

SEQ ID NO: 3175987 - DNA, 14 bp, Homo sapiens
gactagtacaaatt

SEQ ID NO: 3175988 - DNA, 16 bp, Homo sapiens
gactatataatttatt

SEQ ID NO: 3175989 - DNA, 22 bp, Homo sapiens
gactatatacatgtgtgtatat

SEQ ID NO: 3175990 - DNA, 20 bp, Homo sapiens
gactatttaaacttataaat

SEQ ID NO: 3175991 - DNA, 23 bp, Homo sapiens
gactatttaaacttataaatcat

SEQ ID NO: 3175992 - DNA, 15 bp, Homo sapiens
gactattttatatga

SEQ ID NO: 3175993 - DNA, 19 bp, Homo sapiens
gactcacaggttggaagag

SEQ ID NO: 3175994 - DNA, 17 bp, Homo sapiens
gactcagaggctgggag

SEQ ID NO: 3175995 - DNA, 18 bp, Homo sapiens
gactcagaggctgggagc

SEQ ID NO: 3175996 - DNA, 13 bp, Homo sapiens
gactcagcagtga

SEQ ID NO: 3175997 - DNA, 10 bp, Homo sapiens
gactcagcca

SEQ ID NO: 3175998 - DNA, 11 bp, Homo sapiens
gactcagccca

SEQ ID NO: 3175999 - DNA, 15 bp, Homo sapiens
gactcagccctgagg

SEQ ID NO: 3176000 - DNA, 12 bp, Homo sapiens
gactcagccttc

SEQ ID NO: 3176001 - DNA, 15 bp, Homo sapiens
gactcagccttcaga

SEQ ID NO: 3176002 - DNA, 20 bp, Homo sapiens
gactcagccttcagacagag

SEQ ID NO: 3176003 - DNA, 15 bp, Homo sapiens
gactcagcgctcctc

SEQ ID NO: 3176004 - DNA, 17 bp, Homo sapiens
gactcaggatccagtcc

SEQ ID NO: 3176005 - DNA, 22 bp, Homo sapiens
gactcaggcgcctggcacattt

SEQ ID NO: 3176006 - DNA, 22 bp, Homo sapiens
gactcagggaccggtgctgcag

SEQ ID NO: 3176007 - DNA, 23 bp, Homo sapiens
gactcagggaccggtgctgcagg

SEQ ID NO: 3176008 - DNA, 24 bp, Homo sapiens
gactcagggaccggtgctgcagga

SEQ ID NO: 3176009 - DNA, 15 bp, Homo sapiens
gactcagtttgtcag

SEQ ID NO: 3176010 - DNA, 14 bp, Homo sapiens
gactcattcttctg

SEQ ID NO: 3176011 - DNA, 17 bp, Homo sapiens
gactccaagaacaattg

SEQ ID NO: 3176012 - DNA, 18 bp, Homo sapiens
gactccacgatcctgcca

SEQ ID NO: 3176013 - DNA, 13 bp, Homo sapiens
gactccactggac

SEQ ID NO: 3176014 - DNA, 15 bp, Homo sapiens
gactccactggacag

SEQ ID NO: 3176015 - DNA, 16 bp, Homo sapiens
gactccactggacaga

SEQ ID NO: 3176016 - DNA, 17 bp, Homo sapiens
gactccagaatctgctg

SEQ ID NO: 3176017 - DNA, 18 bp, Homo sapiens
gactccagaatctgctgt

SEQ ID NO: 3176018 - DNA, 18 bp, Homo sapiens
gactccagagtctgagcc

SEQ ID NO: 3176019 - DNA, 19 bp, Homo sapiens
gactccaggcccaaggctc

SEQ ID NO: 3176020 - DNA, 17 bp, Homo sapiens
gactccatctctcatcc

SEQ ID NO: 3176021 - DNA, 22 bp, Homo sapiens
gactcccaagtttccatagcaa

SEQ ID NO: 3176022 - DNA, 16 bp, Homo sapiens
gactcccagtgaactt

SEQ ID NO: 3176023 - DNA, 17 bp, Homo sapiens
gactcccgggccacgcc

SEQ ID NO: 3176024 - DNA, 22 bp, Homo sapiens
gactcccgggccacgccccagc

SEQ ID NO: 3176025 - DNA, 12 bp, Homo sapiens
gactccctcctc

SEQ ID NO: 3176026 - DNA, 13 bp, Homo sapiens
gactccctcctca

SEQ ID NO: 3176027 - DNA, 16 bp, Homo sapiens
gactccctcctcacct

SEQ ID NO: 3176028 - DNA, 23 bp, Homo sapiens
gactccctcctcacctctggact

SEQ ID NO: 3176029 - DNA, 24 bp, Homo sapiens
gactccctgtgggggtggccatcc

SEQ ID NO: 3176030 - DNA, 15 bp, Homo sapiens
gactccgccctcctc

SEQ ID NO: 3176031 - DNA, 19 bp, Homo sapiens
gactccgccctcctcgggc

SEQ ID NO: 3176032 - DNA, 12 bp, Homo sapiens
gactccggcctg

SEQ ID NO: 3176033 - DNA, 14 bp, Homo sapiens
gactccggcctgta

SEQ ID NO: 3176034 - DNA, 16 bp, Homo sapiens
gactcctacctgccct

SEQ ID NO: 3176035 - DNA, 17 bp, Homo sapiens
gactcctacctgccctg

SEQ ID NO: 3176036 - DNA, 17 bp, Homo sapiens
gactcctcctttttcca

SEQ ID NO: 3176037 - DNA, 14 bp, Homo sapiens
gactcctctgtcca

SEQ ID NO: 3176038 - DNA, 14 bp, Homo sapiens
gactcctgccctgt

SEQ ID NO: 3176039 - DNA, 17 bp, Homo sapiens
gactcctggtctgtgaa

SEQ ID NO: 3176040 - DNA, 16 bp, Homo sapiens
gactcctggtgcccct

SEQ ID NO: 3176041 - DNA, 23 bp, Homo sapiens
gagagcccaagttatctttccct

SEQ ID NO: 3176042 - DNA, 14 bp, Homo sapiens
gagagccctgaggc

SEQ ID NO: 3176043 - DNA, 12 bp, Homo sapiens
gagagccctgct

SEQ ID NO: 3176044 - DNA, 19 bp, Homo sapiens
gagagccctgctgtgggag

SEQ ID NO: 3176045 - DNA, 14 bp, Homo sapiens
gagagcctgctggc

SEQ ID NO: 3176046 - DNA, 13 bp, Homo sapiens
gagagcctggtgc

SEQ ID NO: 3176047 - DNA, 21 bp, Homo sapiens
gagagcggtctcaggctggtg

SEQ ID NO: 3176048 - DNA, 13 bp, Homo sapiens
gagagctgggtgt

SEQ ID NO: 3176049 - DNA, 23 bp, Homo sapiens
gagagctttctgtccttttggca

SEQ ID NO: 3176050 - DNA, 20 bp, Homo sapiens
gagaggaaaagtaaggtgca

SEQ ID NO: 3176051 - DNA, 18 bp, Homo sapiens
gagaggacagcttgagcc

SEQ ID NO: 3176052 - DNA, 14 bp, Homo sapiens
gagaggagaaacac

SEQ ID NO: 3176053 - DNA, 15 bp, Homo sapiens
gagaggagaaacaca

SEQ ID NO: 3176054 - DNA, 18 bp, Homo sapiens
gagaggagcacctgaacc

SEQ ID NO: 3176055 - DNA, 13 bp, Homo sapiens
gagaggagccaga

SEQ ID NO: 3176056 - DNA, 17 bp, Homo sapiens
gagaggagccagacaga

SEQ ID NO: 3176057 - DNA, 19 bp, Homo sapiens
gagaggagccagacagacc

SEQ ID NO: 3176058 - DNA, 18 bp, Homo sapiens
gagaggagggttcctctt

SEQ ID NO: 3176059 - DNA, 12 bp, Homo sapiens
gagaggatgaat

SEQ ID NO: 3176060 - DNA, 14 bp, Homo sapiens
gagaggatgagagc

SEQ ID NO: 3176061 - DNA, 18 bp, Homo sapiens
gagaggatgagagcccag

SEQ ID NO: 3176062 - DNA, 19 bp, Homo sapiens
gagaggatgagagcccaga

SEQ ID NO: 3176063 - DNA, 21 bp, Homo sapiens
gagaggatgtggaaagcactt

SEQ ID NO: 3176064 - DNA, 11 bp, Homo sapiens
gagaggcaggc

SEQ ID NO: 3176065 - DNA, 15 bp, Homo sapiens
gagaggcccgcccgc

SEQ ID NO: 3176066 - DNA, 18 bp, Homo sapiens
gagaggccttttggaatg

SEQ ID NO: 3176067 - DNA, 18 bp, Homo sapiens
gagaggccttttgtttaa

SEQ ID NO: 3176068 - DNA, 15 bp, Homo sapiens
gagaggcggcctcgt

SEQ ID NO: 3176069 - DNA, 19 bp, Homo sapiens
gagagggacagcccactga

SEQ ID NO: 3176070 - DNA, 15 bp, Homo sapiens
gagagggacaggcac

SEQ ID NO: 3176071 - DNA, 14 bp, Homo sapiens
gagagggcccagct

SEQ ID NO: 3176072 - DNA, 18 bp, Homo sapiens
gagaggggaacagactgg

SEQ ID NO: 3176073 - DNA, 19 bp, Homo sapiens
gagaggggaacagactgga

SEQ ID NO: 3176074 - DNA, 14 bp, Homo sapiens
gagaggggagagag

SEQ ID NO: 3176075 - DNA, 20 bp, Homo sapiens
gagaggggctgctctccaga

SEQ ID NO: 3176076 - DNA, 16 bp, Homo sapiens
gagagggggctctcca

SEQ ID NO: 3176077 - DNA, 14 bp, Homo sapiens
gagaggtgggccag

SEQ ID NO: 3176078 - DNA, 22 bp, Homo sapiens
gagaggtgggccagtctgtgga

SEQ ID NO: 3176079 - DNA, 16 bp, Homo sapiens
gagaggttaaggtgca

SEQ ID NO: 3176080 - DNA, 15 bp, Homo sapiens
gagagtagaacagat

SEQ ID NO: 3176081 - DNA, 17 bp, Homo sapiens
gagagtatttttataca

SEQ ID NO: 3176082 - DNA, 17 bp, Homo sapiens
gagagtcatattttgat

SEQ ID NO: 3176083 - DNA, 15 bp, Homo sapiens
gagagtcccactgcc

SEQ ID NO: 3176084 - DNA, 21 bp, Homo sapiens
gagagtcccactgcctcaggt

SEQ ID NO: 3176085 - DNA, 12 bp, Homo sapiens
gagagtctgaga

SEQ ID NO: 3176086 - DNA, 17 bp, Homo sapiens
gagagtgagctacagag

SEQ ID NO: 3176087 - DNA, 15 bp, Homo sapiens
gagagttttgtcttg

SEQ ID NO: 3176088 - DNA, 20 bp, Homo sapiens
gagataaaccaataaatcca

SEQ ID NO: 3176089 - DNA, 18 bp, Homo sapiens
gagatatctgagggagga

SEQ ID NO: 3176090 - DNA, 17 bp, Homo sapiens
gagatatggcattgcac

SEQ ID NO: 3176091 - DNA, 14 bp, Homo sapiens
gagatattataagg

SEQ ID NO: 3176092 - DNA, 22 bp, Homo sapiens
gagatatttacatgaattgcat

SEQ ID NO: 3176093 - DNA, 20 bp, Homo sapiens
gagatcaaccccttcgctcc

SEQ ID NO: 3176094 - DNA, 23 bp, Homo sapiens
gagatcaaccccttcgctcctgt

SEQ ID NO: 3176095 - DNA, 16 bp, Homo sapiens
gagatcacagcctcca

SEQ ID NO: 3176096 - DNA, 16 bp, Homo sapiens
gagatcacgccactgc

SEQ ID NO: 3176097 - DNA, 15 bp, Homo sapiens
gagatcccctgagcc

SEQ ID NO: 3176098 - DNA, 18 bp, Homo sapiens
gagatcccttaagaagtt

SEQ ID NO: 3176099 - DNA, 14 bp, Homo sapiens
gagatcctcctgca

SEQ ID NO: 3176100 - DNA, 19 bp, Homo sapiens
gagatcgagaccatcctgg

SEQ ID NO: 3176101 - DNA, 21 bp, Homo sapiens
gagatcgagaccatcctggct

SEQ ID NO: 3176102 - DNA, 21 bp, Homo sapiens
gagatctaagcctttccataa

SEQ ID NO: 3176103 - DNA, 22 bp, Homo sapiens
gagatgagaaatgatgaaaagg

SEQ ID NO: 3176104 - DNA, 23 bp, Homo sapiens
gagatgcactatatgtttacaca

SEQ ID NO: 3176105 - DNA, 12 bp, Homo sapiens
gagatgccagcc

SEQ ID NO: 3176106 - DNA, 17 bp, Homo sapiens
gagatgccagcccttca

SEQ ID NO: 3176107 - DNA, 16 bp, Homo sapiens
gagatgctggagaaga

SEQ ID NO: 3176108 - DNA, 16 bp, Homo sapiens
gagatggagggcttgg

SEQ ID NO: 3176109 - DNA, 17 bp, Homo sapiens
gagatggagggcttggc

SEQ ID NO: 3176110 - DNA, 18 bp, Homo sapiens
gagatggagttcttgtgc

SEQ ID NO: 3176111 - DNA, 12 bp, Homo sapiens
gagatggccata

SEQ ID NO: 3176112 - DNA, 20 bp, Homo sapiens
gagatggtaatctacagctc

SEQ ID NO: 3176113 - DNA, 15 bp, Homo sapiens
gagatggtcagtgtg

SEQ ID NO: 3176114 - DNA, 23 bp, Homo sapiens
gagatggtcagtgtggagagggg

SEQ ID NO: 3176115 - DNA, 13 bp, Homo sapiens
gagatggtgaggc

SEQ ID NO: 3176116 - DNA, 15 bp, Homo sapiens
gagatgtagcaaaac

SEQ ID NO: 3176117 - DNA, 21 bp, Homo sapiens
gagatgtcatcagagctcctc

SEQ ID NO: 3176118 - DNA, 20 bp, Homo sapiens
gagatgtgacccaccagtgc

SEQ ID NO: 3176119 - DNA, 18 bp, Homo sapiens
gagatgtgttcctcctgc

SEQ ID NO: 3176120 - DNA, 21 bp, Homo sapiens
gagatgtttttaaaagtttca

SEQ ID NO: 3176121 - DNA, 14 bp, Homo sapiens
gagattacaggcat

SEQ ID NO: 3176122 - DNA, 15 bp, Homo sapiens
gagattatgttcttt

SEQ ID NO: 3176123 - DNA, 13 bp, Homo sapiens
gagattccacaca

SEQ ID NO: 3176124 - DNA, 17 bp, Homo sapiens
gagattgagaaggagag

SEQ ID NO: 3176125 - DNA, 14 bp, Homo sapiens
gagattgggagaaa

SEQ ID NO: 3176126 - DNA, 23 bp, Homo sapiens
gagattgttgtttgccatacttt

SEQ ID NO: 3176127 - DNA, 22 bp, Homo sapiens
gagatttaaatgcaaccagaat

SEQ ID NO: 3176128 - DNA, 22 bp, Homo sapiens
gagatttaccagggatgtagat

SEQ ID NO: 3176129 - DNA, 16 bp, Homo sapiens
gagatttcctcctggc

SEQ ID NO: 3176130 - DNA, 16 bp, Homo sapiens
gagatttcttaaatct

SEQ ID NO: 3176131 - DNA, 19 bp, Homo sapiens
gagatttgccagcacaggg

SEQ ID NO: 3176132 - DNA, 19 bp, Homo sapiens
gagatttttaaaaaatatt

SEQ ID NO: 3176133 - DNA, 15 bp, Homo sapiens
gagcaaaaggcagct

SEQ ID NO: 3176134 - DNA, 17 bp, Homo sapiens
gagcaaaaggcagctca

SEQ ID NO: 3176135 - DNA, 24 bp, Homo sapiens
gagcaaaaggcagctcacccctgg

SEQ ID NO: 3176136 - DNA, 14 bp, Homo sapiens
gagcaaaataagga

SEQ ID NO: 3176137 - DNA, 22 bp, Homo sapiens
gagcaaaatatgccccttcttg

SEQ ID NO: 3176138 - DNA, 23 bp, Homo sapiens
gagcaaaccagcttgttctgggc

SEQ ID NO: 3176139 - DNA, 14 bp, Homo sapiens
gagcaaagatcaaa

SEQ ID NO: 3176140 - DNA, 17 bp, Homo sapiens
gagcaaatgagggaggg

SEQ ID NO: 3176141 - DNA, 16 bp, Homo sapiens
gagcaacccctgtacc

SEQ ID NO: 3176142 - DNA, 20 bp, Homo sapiens
gagcaacccctgtacccagc

SEQ ID NO: 3176143 - DNA, 22 bp, Homo sapiens
gagcaacccctgtacccagctc

SEQ ID NO: 3176144 - DNA, 14 bp, Homo sapiens
gagcaagaaggaaa

SEQ ID NO: 3176145 - DNA, 15 bp, Homo sapiens
gagcaagacagagac

SEQ ID NO: 3176146 - DNA, 22 bp, Homo sapiens
gagcaagaccctgtcttaaaaa

SEQ ID NO: 3176147 - DNA, 14 bp, Homo sapiens
gagcaagccctact

SEQ ID NO: 3176148 - DNA, 23 bp, Homo sapiens
gagcaatatttatggatgcaaca

SEQ ID NO: 3176149 - DNA, 16 bp, Homo sapiens
gagcacaaaattcaaa

SEQ ID NO: 3176150 - DNA, 21 bp, Homo sapiens
gagcacaaaattcaaagcatg

SEQ ID NO: 3176151 - DNA, 15 bp, Homo sapiens
gagcacagccctggg

SEQ ID NO: 3176152 - DNA, 16 bp, Homo sapiens
gagcacagccctggga

SEQ ID NO: 3176153 - DNA, 14 bp, Homo sapiens
gagcacaggcagct

SEQ ID NO: 3176154 - DNA, 14 bp, Homo sapiens
gagcacaggtccca

SEQ ID NO: 3176155 - DNA, 22 bp, Homo sapiens
gagcacaggtcccacctccagc

SEQ ID NO: 3176156 - DNA, 23 bp, Homo sapiens
gagcacaggtcccacctccagcc

SEQ ID NO: 3176157 - DNA, 19 bp, Homo sapiens
gagcacccccaagcctggg

SEQ ID NO: 3176158 - DNA, 14 bp, Homo sapiens
gagcaccccctgct

SEQ ID NO: 3176159 - DNA, 16 bp, Homo sapiens
gagcaccccctgctcc

SEQ ID NO: 3176160 - DNA, 20 bp, Homo sapiens
gagcacctgaaccccatggg

SEQ ID NO: 3176161 - DNA, 23 bp, Homo sapiens
gagcacctgaaccccatgggctt

SEQ ID NO: 3176162 - DNA, 17 bp, Homo sapiens
gagcaccttcctcactt

SEQ ID NO: 3176163 - DNA, 19 bp, Homo sapiens
gagcaccttcctcacttcc

SEQ ID NO: 3176164 - DNA, 20 bp, Homo sapiens
gagcaccttcctcacttcca

SEQ ID NO: 3176165 - DNA, 20 bp, Homo sapiens
gagcactggagtgcagggag

SEQ ID NO: 3176166 - DNA, 16 bp, Homo sapiens
gagcactggccagaga

SEQ ID NO: 3176167 - DNA, 19 bp, Homo sapiens
gaggccaaaggctggtggc

SEQ ID NO: 3176168 - DNA, 17 bp, Homo sapiens
gaggccaaccagcccga

SEQ ID NO: 3176169 - DNA, 20 bp, Homo sapiens
gaggccaaccagcccgacag

SEQ ID NO: 3176170 - DNA, 15 bp, Homo sapiens
gaggccaaggcaggt

SEQ ID NO: 3176171 - DNA, 15 bp, Homo sapiens
gaggccaataaaaag

SEQ ID NO: 3176172 - DNA, 16 bp, Homo sapiens
gaggccacttagggaa

SEQ ID NO: 3176173 - DNA, 18 bp, Homo sapiens
gaggccagccccacccag

SEQ ID NO: 3176174 - DNA, 20 bp, Homo sapiens
gaggccagccccacccagga

SEQ ID NO: 3176175 - DNA, 17 bp, Homo sapiens
gaggccatctcaggaga

SEQ ID NO: 3176176 - DNA, 18 bp, Homo sapiens
gaggccatctcaggagat

SEQ ID NO: 3176177 - DNA, 17 bp, Homo sapiens
gaggccatgggcctcct

SEQ ID NO: 3176178 - DNA, 20 bp, Homo sapiens
gaggccatgggcctcctgtg

SEQ ID NO: 3176179 - DNA, 21 bp, Homo sapiens
gaggccatgggcctcctgtgt

SEQ ID NO: 3176180 - DNA, 18 bp, Homo sapiens
gaggcccaagagccctgt

SEQ ID NO: 3176181 - DNA, 16 bp, Homo sapiens
gaggcccagcgggcag

SEQ ID NO: 3176182 - DNA, 14 bp, Homo sapiens
gaggccccaaagga

SEQ ID NO: 3176183 - DNA, 15 bp, Homo sapiens
gaggccccactgatg

SEQ ID NO: 3176184 - DNA, 18 bp, Homo sapiens
gaggccccactgatgctg

SEQ ID NO: 3176185 - DNA, 18 bp, Homo sapiens
gaggccccagctctgagg

SEQ ID NO: 3176186 - DNA, 14 bp, Homo sapiens
gaggcccccagccc

SEQ ID NO: 3176187 - DNA, 15 bp, Homo sapiens
gaggcccccagccca

SEQ ID NO: 3176188 - DNA, 14 bp, Homo sapiens
gaggccctcctgtg

SEQ ID NO: 3176189 - DNA, 16 bp, Homo sapiens
gaggccctcctgtgct

SEQ ID NO: 3176190 - DNA, 21 bp, Homo sapiens
gaggccctcctgtgctggggg

SEQ ID NO: 3176191 - DNA, 18 bp, Homo sapiens
gaggccctgcccaatgag

SEQ ID NO: 3176192 - DNA, 11 bp, Homo sapiens
gaggccctgga

SEQ ID NO: 3176193 - DNA, 12 bp, Homo sapiens
gaggccctggag

SEQ ID NO: 3176194 - DNA, 14 bp, Homo sapiens
gaggccctggaggt

SEQ ID NO: 3176195 - DNA, 19 bp, Homo sapiens
gaggccctggaggtctcca

SEQ ID NO: 3176196 - DNA, 14 bp, Homo sapiens
gaggccctggccct

SEQ ID NO: 3176197 - DNA, 14 bp, Homo sapiens
gaggccgaggcggg

SEQ ID NO: 3176198 - DNA, 18 bp, Homo sapiens
gaggcctaccccgcagac

SEQ ID NO: 3176199 - DNA, 14 bp, Homo sapiens
gaggcctcatccct

SEQ ID NO: 3176200 - DNA, 19 bp, Homo sapiens
gaggcctcatgcctgctga

SEQ ID NO: 3176201 - DNA, 20 bp, Homo sapiens
gaggcctcatgcctgctgag

SEQ ID NO: 3176202 - DNA, 18 bp, Homo sapiens
gaggcctcgagcagagag

SEQ ID NO: 3176203 - DNA, 12 bp, Homo sapiens
gaggcctctggc

SEQ ID NO: 3176204 - DNA, 15 bp, Homo sapiens
gaggcctctggccct

SEQ ID NO: 3176205 - DNA, 17 bp, Homo sapiens
gaggcctctggccctcg

SEQ ID NO: 3176206 - DNA, 13 bp, Homo sapiens
gaggcctgaggcc

SEQ ID NO: 3176207 - DNA, 15 bp, Homo sapiens
gaggcctgaggcctg

SEQ ID NO: 3176208 - DNA, 17 bp, Homo sapiens
gaggcctgaggcctgtg

SEQ ID NO: 3176209 - DNA, 13 bp, Homo sapiens
gaggcctgatgct

SEQ ID NO: 3176210 - DNA, 14 bp, Homo sapiens
gaggcctgatgctg

SEQ ID NO: 3176211 - DNA, 20 bp, Homo sapiens
gaggcctgcaaaccttcctg

SEQ ID NO: 3176212 - DNA, 20 bp, Homo sapiens
gaggcctgggccgctgccac

SEQ ID NO: 3176213 - DNA, 21 bp, Homo sapiens
gaggcctgggccgctgccacg

SEQ ID NO: 3176214 - DNA, 15 bp, Homo sapiens
gaggcctggggccgg

SEQ ID NO: 3176215 - DNA, 22 bp, Homo sapiens
gaggcctggggccggtagaggc

SEQ ID NO: 3176216 - DNA, 19 bp, Homo sapiens
gaggccttctctgaaggac

SEQ ID NO: 3176217 - DNA, 22 bp, Homo sapiens
gaggcgcccttggcttctgtga

SEQ ID NO: 3176218 - DNA, 13 bp, Homo sapiens
gaggcgctgctgg

SEQ ID NO: 3176219 - DNA, 16 bp, Homo sapiens
gaggcggcccggccag

SEQ ID NO: 3176220 - DNA, 23 bp, Homo sapiens
gaggcggcccggccagcgggcac

SEQ ID NO: 3176221 - DNA, 20 bp, Homo sapiens
gaggcgggagaatcatgtga

SEQ ID NO: 3176222 - DNA, 16 bp, Homo sapiens
gaggcgggccagccag

SEQ ID NO: 3176223 - DNA, 19 bp, Homo sapiens
gaggcgggccagccaggcg

SEQ ID NO: 3176224 - DNA, 19 bp, Homo sapiens
gaggcgggtggatcacttg

SEQ ID NO: 3176225 - DNA, 18 bp, Homo sapiens
gaggctccaggactccac

SEQ ID NO: 3176226 - DNA, 22 bp, Homo sapiens
gaggctccaggactccactgga

SEQ ID NO: 3176227 - DNA, 16 bp, Homo sapiens
gaggctccccagggct

SEQ ID NO: 3176228 - DNA, 20 bp, Homo sapiens
gaggctgaaagaggccaatg

SEQ ID NO: 3176229 - DNA, 19 bp, Homo sapiens
gaggctgaggcctggactt

SEQ ID NO: 3176230 - DNA, 16 bp, Homo sapiens
gaggctgcagcgagct

SEQ ID NO: 3176231 - DNA, 15 bp, Homo sapiens
gaggctgcccctctc

SEQ ID NO: 3176232 - DNA, 18 bp, Homo sapiens
gaggctgcccctctcacc

SEQ ID NO: 3176233 - DNA, 13 bp, Homo sapiens
gaggctggcaggt

SEQ ID NO: 3176234 - DNA, 13 bp, Homo sapiens
gaggctgggagca

SEQ ID NO: 3176235 - DNA, 19 bp, Homo sapiens
gaggctgggcacagaggtc

SEQ ID NO: 3176236 - DNA, 15 bp, Homo sapiens
gaggctgggcccctg

SEQ ID NO: 3176237 - DNA, 19 bp, Homo sapiens
gaggctgggcccctgggat

SEQ ID NO: 3176238 - DNA, 17 bp, Homo sapiens
gaggctgggctgggtgg

SEQ ID NO: 3176239 - DNA, 12 bp, Homo sapiens
gaggctggtgcc

SEQ ID NO: 3176240 - DNA, 15 bp, Homo sapiens
gaggctggtgccagg

SEQ ID NO: 3176241 - DNA, 23 bp, Homo sapiens
gaggctgtcagtgtatggggcag

SEQ ID NO: 3176242 - DNA, 14 bp, Homo sapiens
gaggctgtcctgta

SEQ ID NO: 3176243 - DNA, 23 bp, Homo sapiens
gaggctgtggtcacagcggaggt

SEQ ID NO: 3176244 - DNA, 17 bp, Homo sapiens
gaggctgtgtgcctggg

SEQ ID NO: 3176245 - DNA, 20 bp, Homo sapiens
gaggctgtgtgcctggggga

SEQ ID NO: 3176246 - DNA, 16 bp, Homo sapiens
gaggcttagagagagg

SEQ ID NO: 3176247 - DNA, 16 bp, Homo sapiens
gaggcttccaggctct

SEQ ID NO: 3176248 - DNA, 20 bp, Homo sapiens
gaggcttccaggctcttcct

SEQ ID NO: 3176249 - DNA, 15 bp, Homo sapiens
gaggcttctccgcca

SEQ ID NO: 3176250 - DNA, 22 bp, Homo sapiens
gaggcttctccgccagcctcct

SEQ ID NO: 3176251 - DNA, 23 bp, Homo sapiens
gaggctttatgataatagattct

SEQ ID NO: 3176252 - DNA, 14 bp, Homo sapiens
gaggctttggattt

SEQ ID NO: 3176253 - DNA, 14 bp, Homo sapiens
gaggcttttcactg

SEQ ID NO: 3176254 - DNA, 23 bp, Homo sapiens
gagggaagtgtgagcgccttggt

SEQ ID NO: 3176255 - DNA, 19 bp, Homo sapiens
gagggaatgttccctgcac

SEQ ID NO: 3176256 - DNA, 20 bp, Homo sapiens
gagggaatgttccctgcacc

SEQ ID NO: 3176257 - DNA, 14 bp, Homo sapiens
gagggacaggctga

SEQ ID NO: 3176258 - DNA, 16 bp, Homo sapiens
gagggaccatgtgtca

SEQ ID NO: 3176259 - DNA, 16 bp, Homo sapiens
gagggactgcctctgc

SEQ ID NO: 3176260 - DNA, 13 bp, Homo sapiens
gagggagagagag

SEQ ID NO: 3176261 - DNA, 15 bp, Homo sapiens
gagggagagagagag

SEQ ID NO: 3176262 - DNA, 22 bp, Homo sapiens
gagggagagagagagagagagg

SEQ ID NO: 3176263 - DNA, 17 bp, Homo sapiens
gagggagccttgtgaga

SEQ ID NO: 3176264 - DNA, 12 bp, Homo sapiens
gagggaggaggc

SEQ ID NO: 3176265 - DNA, 13 bp, Homo sapiens
gagggagggggaa

SEQ ID NO: 3176266 - DNA, 20 bp, Homo sapiens
gagggagggggcgctcagga

SEQ ID NO: 3176267 - DNA, 23 bp, Homo sapiens
gagggaggtgtttaaagagaggt

SEQ ID NO: 3176268 - DNA, 14 bp, Homo sapiens
gagggatcacaggg

SEQ ID NO: 3176269 - DNA, 20 bp, Homo sapiens
gagggatgctgcctgagtca

SEQ ID NO: 3176270 - DNA, 15 bp, Homo sapiens
gagggatgctgctcc

SEQ ID NO: 3176271 - DNA, 19 bp, Homo sapiens
gagggatgctgctccgccc

SEQ ID NO: 3176272 - DNA, 18 bp, Homo sapiens
gagggatggagaaagaag

SEQ ID NO: 3176273 - DNA, 13 bp, Homo sapiens
gagggcacagccc

SEQ ID NO: 3176274 - DNA, 15 bp, Homo sapiens
gagggcacagccctc

SEQ ID NO: 3176275 - DNA, 14 bp, Homo sapiens
gagggcagagccat

SEQ ID NO: 3176276 - DNA, 17 bp, Homo sapiens
gagggcagtacctggga

SEQ ID NO: 3176277 - DNA, 18 bp, Homo sapiens
gagggcatccataccagc

SEQ ID NO: 3176278 - DNA, 22 bp, Homo sapiens
gagggcatgcgcacaaggctga

SEQ ID NO: 3176279 - DNA, 15 bp, Homo sapiens
gagggcccagagcag

SEQ ID NO: 3176280 - DNA, 16 bp, Homo sapiens
gagggcccagagcagg

SEQ ID NO: 3176281 - DNA, 15 bp, Homo sapiens
gagggcccagccagg

SEQ ID NO: 3176282 - DNA, 19 bp, Homo sapiens
gagggcccagccaggagca

SEQ ID NO: 3176283 - DNA, 16 bp, Homo sapiens
gagggcccagcccaga

SEQ ID NO: 3176284 - DNA, 18 bp, Homo sapiens
gagggcccagcccagagc

SEQ ID NO: 3176285 - DNA, 19 bp, Homo sapiens
gagggcccagcccagagcc

SEQ ID NO: 3176286 - DNA, 22 bp, Homo sapiens
gagggcccagctgtagccatgg

SEQ ID NO: 3176287 - DNA, 13 bp, Homo sapiens
gagggcccaggca

SEQ ID NO: 3176288 - DNA, 17 bp, Homo sapiens
gagggccgtaccccacc

SEQ ID NO: 3176289 - DNA, 22 bp, Homo sapiens
gagggcctcaaaggcccgctct

SEQ ID NO: 3176290 - DNA, 19 bp, Homo sapiens
gagggcctgtgggagcctg

SEQ ID NO: 3176291 - DNA, 17 bp, Homo sapiens
gagggcggtggacaata

SEQ ID NO: 3176292 - DNA, 14 bp, Homo sapiens
gagggctctgtgct

SEQ ID NO: 3176293 - DNA, 17 bp, Homo sapiens
gatagcatttttgattt

SEQ ID NO: 3176294 - DNA, 23 bp, Homo sapiens
gatagcatttttgatttatgcat

SEQ ID NO: 3176295 - DNA, 23 bp, Homo sapiens
gatagcccagaacaaaaagaaat

SEQ ID NO: 3176296 - DNA, 22 bp, Homo sapiens
gatagctaacattttaaataaa

SEQ ID NO: 3176297 - DNA, 16 bp, Homo sapiens
gatagctattaagata

SEQ ID NO: 3176298 - DNA, 16 bp, Homo sapiens
gatagctggggcttca

SEQ ID NO: 3176299 - DNA, 15 bp, Homo sapiens
gataggcccaaggtc

SEQ ID NO: 3176300 - DNA, 13 bp, Homo sapiens
gataggctctgca

SEQ ID NO: 3176301 - DNA, 14 bp, Homo sapiens
gataggctctgcac

SEQ ID NO: 3176302 - DNA, 17 bp, Homo sapiens
gataggctctgcacaga

SEQ ID NO: 3176303 - DNA, 15 bp, Homo sapiens
gatagtaacaatgaa

SEQ ID NO: 3176304 - DNA, 18 bp, Homo sapiens
gatagtagcatacattta

SEQ ID NO: 3176305 - DNA, 14 bp, Homo sapiens
gatagtctttcagt

SEQ ID NO: 3176306 - DNA, 23 bp, Homo sapiens
gatagtcttttgcttttggcaaa

SEQ ID NO: 3176307 - DNA, 17 bp, Homo sapiens
gatagtgggatttccag

SEQ ID NO: 3176308 - DNA, 21 bp, Homo sapiens
gatagttgaatgttgcaatgt

SEQ ID NO: 3176309 - DNA, 14 bp, Homo sapiens
gatagttttctcct

SEQ ID NO: 3176310 - DNA, 12 bp, Homo sapiens
gatataaattct

SEQ ID NO: 3176311 - DNA, 22 bp, Homo sapiens
gatataagagaagtctcattcg

SEQ ID NO: 3176312 - DNA, 14 bp, Homo sapiens
gatataatgaacaa

SEQ ID NO: 3176313 - DNA, 16 bp, Homo sapiens
gatatacaaagtgtac

SEQ ID NO: 3176314 - DNA, 17 bp, Homo sapiens
gatatacagatgaaaat

SEQ ID NO: 3176315 - DNA, 16 bp, Homo sapiens
gatataccaaattaaa

SEQ ID NO: 3176316 - DNA, 21 bp, Homo sapiens
gatataggtttttctcatgta

SEQ ID NO: 3176317 - DNA, 15 bp, Homo sapiens
gatatataagtgtac

SEQ ID NO: 3176318 - DNA, 17 bp, Homo sapiens
gatatataagtgtacat

SEQ ID NO: 3176319 - DNA, 23 bp, Homo sapiens
gatatatattataaatatatata

SEQ ID NO: 3176320 - DNA, 18 bp, Homo sapiens
gatatatgctctgcatgt

SEQ ID NO: 3176321 - DNA, 15 bp, Homo sapiens
gatatatttaaaaat

SEQ ID NO: 3176322 - DNA, 19 bp, Homo sapiens
gatatatttaaaaatattt

SEQ ID NO: 3176323 - DNA, 18 bp, Homo sapiens
gatatatttcacttttgt

SEQ ID NO: 3176324 - DNA, 21 bp, Homo sapiens
gatatatttcacttttgttct

SEQ ID NO: 3176325 - DNA, 23 bp, Homo sapiens
gatatattttacaattttttatc

SEQ ID NO: 3176326 - DNA, 15 bp, Homo sapiens
gatatatttttcaca

SEQ ID NO: 3176327 - DNA, 14 bp, Homo sapiens
gatatcaaaattct

SEQ ID NO: 3176328 - DNA, 12 bp, Homo sapiens
gatatcatttta

SEQ ID NO: 3176329 - DNA, 22 bp, Homo sapiens
gatatcattttaaaaactttat

SEQ ID NO: 3176330 - DNA, 14 bp, Homo sapiens
gatatccatctttt

SEQ ID NO: 3176331 - DNA, 23 bp, Homo sapiens
gatatctatatttttatttctac

SEQ ID NO: 3176332 - DNA, 16 bp, Homo sapiens
gatatctgagggagga

SEQ ID NO: 3176333 - DNA, 18 bp, Homo sapiens
gatatctttttcattatt

SEQ ID NO: 3176334 - DNA, 13 bp, Homo sapiens
gatatgatccaga

SEQ ID NO: 3176335 - DNA, 17 bp, Homo sapiens
gatatggcagaagacac

SEQ ID NO: 3176336 - DNA, 21 bp, Homo sapiens
gatatggcattgcactgctta

SEQ ID NO: 3176337 - DNA, 18 bp, Homo sapiens
gatatggctgcccaggag

SEQ ID NO: 3176338 - DNA, 20 bp, Homo sapiens
gatatgggactgagcctggc

SEQ ID NO: 3176339 - DNA, 22 bp, Homo sapiens
gatatgggactgagcctggccc

SEQ ID NO: 3176340 - DNA, 13 bp, Homo sapiens
gatatgtggtgta

SEQ ID NO: 3176341 - DNA, 14 bp, Homo sapiens
gatatgtggtgtat

SEQ ID NO: 3176342 - DNA, 12 bp, Homo sapiens
gatattaatcaa

SEQ ID NO: 3176343 - DNA, 12 bp, Homo sapiens
gatattacttta

SEQ ID NO: 3176344 - DNA, 18 bp, Homo sapiens
gatattccatgaatgtat

SEQ ID NO: 3176345 - DNA, 19 bp, Homo sapiens
gatattccatgaatgtatc

SEQ ID NO: 3176346 - DNA, 20 bp, Homo sapiens
gatattccccccacttaaga

SEQ ID NO: 3176347 - DNA, 17 bp, Homo sapiens
gatattgctactataat

SEQ ID NO: 3176348 - DNA, 22 bp, Homo sapiens
gatattgttcaaacaatatcat

SEQ ID NO: 3176349 - DNA, 21 bp, Homo sapiens
gatattgtttaaaattcagtt

SEQ ID NO: 3176350 - DNA, 23 bp, Homo sapiens
gatatttatatttttattttatt

SEQ ID NO: 3176351 - DNA, 13 bp, Homo sapiens
gatatttcttgct

SEQ ID NO: 3176352 - DNA, 18 bp, Homo sapiens
gatatttgcacttatgta

SEQ ID NO: 3176353 - DNA, 18 bp, Homo sapiens
gatatttgcagtttttca

SEQ ID NO: 3176354 - DNA, 13 bp, Homo sapiens
gatatttggctta

SEQ ID NO: 3176355 - DNA, 14 bp, Homo sapiens
gatatttggcttaa

SEQ ID NO: 3176356 - DNA, 18 bp, Homo sapiens
gatatttggcttaaatat

SEQ ID NO: 3176357 - DNA, 22 bp, Homo sapiens
gatatttgtcatgctgggattt

SEQ ID NO: 3176358 - DNA, 21 bp, Homo sapiens
gatattttcaacgcagccctg

SEQ ID NO: 3176359 - DNA, 18 bp, Homo sapiens
gatatttttccatttatt

SEQ ID NO: 3176360 - DNA, 21 bp, Homo sapiens
gatatttttgtacttgatttg

SEQ ID NO: 3176361 - DNA, 21 bp, Homo sapiens
gatcaaaacatgcttgaataa

SEQ ID NO: 3176362 - DNA, 21 bp, Homo sapiens
gatcaaaacctgtgccaggct

SEQ ID NO: 3176363 - DNA, 23 bp, Homo sapiens
gatcaaaacctgtgccaggctga

SEQ ID NO: 3176364 - DNA, 22 bp, Homo sapiens
gatcaaaataaaaagtgacaca

SEQ ID NO: 3176365 - DNA, 12 bp, Homo sapiens
gatcaaagatga

SEQ ID NO: 3176366 - DNA, 16 bp, Homo sapiens
gatcaaatagttgcat

SEQ ID NO: 3176367 - DNA, 22 bp, Homo sapiens
gatcaaccccttcgctcctgtg

SEQ ID NO: 3176368 - DNA, 16 bp, Homo sapiens
gatcaacgcctcactg

SEQ ID NO: 3176369 - DNA, 14 bp, Homo sapiens
gatcaagaaagtgt

SEQ ID NO: 3176370 - DNA, 19 bp, Homo sapiens
gatcaaggcaaaaatatca

SEQ ID NO: 3176371 - DNA, 19 bp, Homo sapiens
gatcaataaaatgtgattt

SEQ ID NO: 3176372 - DNA, 19 bp, Homo sapiens
gatcaattatagtttctga

SEQ ID NO: 3176373 - DNA, 20 bp, Homo sapiens
gatcaattatagtttctgag

SEQ ID NO: 3176374 - DNA, 19 bp, Homo sapiens
gatcaattttcattaaact

SEQ ID NO: 3176375 - DNA, 19 bp, Homo sapiens
gatcacagagacattcctc

SEQ ID NO: 3176376 - DNA, 16 bp, Homo sapiens
gatcacagcctccagg

SEQ ID NO: 3176377 - DNA, 13 bp, Homo sapiens
gatcacagggccc

SEQ ID NO: 3176378 - DNA, 18 bp, Homo sapiens
gatcaccagcccggcctg

SEQ ID NO: 3176379 - DNA, 13 bp, Homo sapiens
gatcacgccactg

SEQ ID NO: 3176380 - DNA, 20 bp, Homo sapiens
gatcacggctcactgcagcc

SEQ ID NO: 3176381 - DNA, 13 bp, Homo sapiens
gatcactgaattt

SEQ ID NO: 3176382 - DNA, 17 bp, Homo sapiens
gatcactgaatttataa

SEQ ID NO: 3176383 - DNA, 18 bp, Homo sapiens
gatcactggctggcctga

SEQ ID NO: 3176384 - DNA, 21 bp, Homo sapiens
gatcactggctggcctgagca

SEQ ID NO: 3176385 - DNA, 15 bp, Homo sapiens
gatcagaacagcaga

SEQ ID NO: 3176386 - DNA, 20 bp, Homo sapiens
gatcagaacattcagctctg

SEQ ID NO: 3176387 - DNA, 16 bp, Homo sapiens
gatcagaccataatgt

SEQ ID NO: 3176388 - DNA, 22 bp, Homo sapiens
gatcagaccttggatcagatga

SEQ ID NO: 3176389 - DNA, 15 bp, Homo sapiens
gatcagagcaggacc

SEQ ID NO: 3176390 - DNA, 14 bp, Homo sapiens
gatcagaggtgtac

SEQ ID NO: 3176391 - DNA, 23 bp, Homo sapiens
gatcagtgggcctccaaggaggg

SEQ ID NO: 3176392 - DNA, 20 bp, Homo sapiens
gatcagtgtaccatttgcct

SEQ ID NO: 3176393 - DNA, 13 bp, Homo sapiens
gatcataaggctt

SEQ ID NO: 3176394 - DNA, 15 bp, Homo sapiens
gatcataagtgaatt

SEQ ID NO: 3176395 - DNA, 17 bp, Homo sapiens
gatcataagtgaattta

SEQ ID NO: 3176396 - DNA, 15 bp, Homo sapiens
gatcatcaacaagat

SEQ ID NO: 3176397 - DNA, 19 bp, Homo sapiens
gatcatccactgtgccatg

SEQ ID NO: 3176398 - DNA, 16 bp, Homo sapiens
gatcatcgccagaggt

SEQ ID NO: 3176399 - DNA, 14 bp, Homo sapiens
gatcatgcattgtt

SEQ ID NO: 3176400 - DNA, 15 bp, Homo sapiens
gatcatgcattgttg

SEQ ID NO: 3176401 - DNA, 16 bp, Homo sapiens
gatcatgctgcagtgg

SEQ ID NO: 3176402 - DNA, 15 bp, Homo sapiens
gatcatggtgtaata

SEQ ID NO: 3176403 - DNA, 20 bp, Homo sapiens
gatcatggtgtaataagaca

SEQ ID NO: 3176404 - DNA, 13 bp, Homo sapiens
gatcatgtacttt

SEQ ID NO: 3176405 - DNA, 22 bp, Homo sapiens
gatcatgttatgatttgtaaca

SEQ ID NO: 3176406 - DNA, 21 bp, Homo sapiens
gatcatttgcccttaaggaca

SEQ ID NO: 3176407 - DNA, 18 bp, Homo sapiens
gatcatttgttggaatga

SEQ ID NO: 3176408 - DNA, 19 bp, Homo sapiens
gatcattttccccccactc

SEQ ID NO: 3176409 - DNA, 19 bp, Homo sapiens
gatccaactaatgccttac

SEQ ID NO: 3176410 - DNA, 21 bp, Homo sapiens
gatccaagctggtcccactca

SEQ ID NO: 3176411 - DNA, 18 bp, Homo sapiens
gatccacccacctcagcc

SEQ ID NO: 3176412 - DNA, 22 bp, Homo sapiens
gatccacccacctcagcctccc

SEQ ID NO: 3176413 - DNA, 19 bp, Homo sapiens
gatccacctgtctcagcct

SEQ ID NO: 3176414 - DNA, 12 bp, Homo sapiens
gatccagccact

SEQ ID NO: 3176415 - DNA, 13 bp, Homo sapiens
gatccagccactt

SEQ ID NO: 3176416 - DNA, 14 bp, Homo sapiens
gatccagccacttc

SEQ ID NO: 3176417 - DNA, 16 bp, Homo sapiens
gatccagtataagact

SEQ ID NO: 3176418 - DNA, 22 bp, Homo sapiens
gattcatctaccctgctgacct

SEQ ID NO: 3176419 - DNA, 21 bp, Homo sapiens
gattcatgccaattagcaatt

SEQ ID NO: 3176420 - DNA, 20 bp, Homo sapiens
gattccactacacctggctg

SEQ ID NO: 3176421 - DNA, 21 bp, Homo sapiens
gattccactacacctggctga

SEQ ID NO: 3176422 - DNA, 18 bp, Homo sapiens
gattccagcccacattgg

SEQ ID NO: 3176423 - DNA, 18 bp, Homo sapiens
gattccattggtccaaga

SEQ ID NO: 3176424 - DNA, 15 bp, Homo sapiens
gattcccaagctctg

SEQ ID NO: 3176425 - DNA, 19 bp, Homo sapiens
gattcccaagctctgctcc

SEQ ID NO: 3176426 - DNA, 19 bp, Homo sapiens
gattcccagagcaaaataa

SEQ ID NO: 3176427 - DNA, 13 bp, Homo sapiens
gattcccctccac

SEQ ID NO: 3176428 - DNA, 12 bp, Homo sapiens
gattcctgaccc

SEQ ID NO: 3176429 - DNA, 16 bp, Homo sapiens
gattcctgacccaggc

SEQ ID NO: 3176430 - DNA, 12 bp, Homo sapiens
gattcctgggcc

SEQ ID NO: 3176431 - DNA, 14 bp, Homo sapiens
gattcctgggcctg

SEQ ID NO: 3176432 - DNA, 15 bp, Homo sapiens
gattccttctctgaa

SEQ ID NO: 3176433 - DNA, 13 bp, Homo sapiens
gattcctttccct

SEQ ID NO: 3176434 - DNA, 22 bp, Homo sapiens
gattctaaaatgtgatgttcta

SEQ ID NO: 3176435 - DNA, 15 bp, Homo sapiens
gattctaaagattct

SEQ ID NO: 3176436 - DNA, 20 bp, Homo sapiens
gattctaaagattctatagt

SEQ ID NO: 3176437 - DNA, 13 bp, Homo sapiens
gattctaaataca

SEQ ID NO: 3176438 - DNA, 14 bp, Homo sapiens
gattctaaatacat

SEQ ID NO: 3176439 - DNA, 15 bp, Homo sapiens
gattctaatgatgat

SEQ ID NO: 3176440 - DNA, 14 bp, Homo sapiens
gattctactttaag

SEQ ID NO: 3176441 - DNA, 18 bp, Homo sapiens
gattctagatcagatgct

SEQ ID NO: 3176442 - DNA, 21 bp, Homo sapiens
gattctatattattatatata

SEQ ID NO: 3176443 - DNA, 15 bp, Homo sapiens
gattctatttatatg

SEQ ID NO: 3176444 - DNA, 21 bp, Homo sapiens
gattctatttatatgtacatg

SEQ ID NO: 3176445 - DNA, 20 bp, Homo sapiens
gattctcctgcctcagcctc

SEQ ID NO: 3176446 - DNA, 18 bp, Homo sapiens
gattctctacatgctctt

SEQ ID NO: 3176447 - DNA, 13 bp, Homo sapiens
gattctctattgg

SEQ ID NO: 3176448 - DNA, 22 bp, Homo sapiens
gattctctggctgtaaggctct

SEQ ID NO: 3176449 - DNA, 19 bp, Homo sapiens
gattctcttagctactgta

SEQ ID NO: 3176450 - DNA, 20 bp, Homo sapiens
gattctcttagctactgtat

SEQ ID NO: 3176451 - DNA, 19 bp, Homo sapiens
gattctgaaaccacagttt

SEQ ID NO: 3176452 - DNA, 21 bp, Homo sapiens
gattctgaaatttttttccta

SEQ ID NO: 3176453 - DNA, 20 bp, Homo sapiens
gattctgatttcagtttttc

SEQ ID NO: 3176454 - DNA, 23 bp, Homo sapiens
gattctgatttcagtttttcatt

SEQ ID NO: 3176455 - DNA, 21 bp, Homo sapiens
gattctgcagtaaatctttta

SEQ ID NO: 3176456 - DNA, 21 bp, Homo sapiens
gattcttccttttattaaaac

SEQ ID NO: 3176457 - DNA, 15 bp, Homo sapiens
gattcttctgcttca

SEQ ID NO: 3176458 - DNA, 21 bp, Homo sapiens
gattcttgtatttattacaac

SEQ ID NO: 3176459 - DNA, 15 bp, Homo sapiens
gattgaactccaaga

SEQ ID NO: 3176460 - DNA, 23 bp, Homo sapiens
gattgaagtattttgctggaata

SEQ ID NO: 3176461 - DNA, 22 bp, Homo sapiens
gattgatcggagcctcctctct

SEQ ID NO: 3176462 - DNA, 11 bp, Homo sapiens
gattgcacaga

SEQ ID NO: 3176463 - DNA, 19 bp, Homo sapiens
gattgcaccactgcactcc

SEQ ID NO: 3176464 - DNA, 22 bp, Homo sapiens
gattgcattagaaatagacagt

SEQ ID NO: 3176465 - DNA, 13 bp, Homo sapiens
gattgcctctgaa

SEQ ID NO: 3176466 - DNA, 14 bp, Homo sapiens
gattgcctctgaaa

SEQ ID NO: 3176467 - DNA, 11 bp, Homo sapiens
gattggattat

SEQ ID NO: 3176468 - DNA, 13 bp, Homo sapiens
gattggattattt

SEQ ID NO: 3176469 - DNA, 20 bp, Homo sapiens
gattggattatttaataaca

SEQ ID NO: 3176470 - DNA, 18 bp, Homo sapiens
gattggcacccctttcta

SEQ ID NO: 3176471 - DNA, 11 bp, Homo sapiens
gattggctttg

SEQ ID NO: 3176472 - DNA, 23 bp, Homo sapiens
gattggctttgtgcttggggcta

SEQ ID NO: 3176473 - DNA, 22 bp, Homo sapiens
gattgtaaaaaaaaatgccttt

SEQ ID NO: 3176474 - DNA, 22 bp, Homo sapiens
gattgtcattcttacaaaacat

SEQ ID NO: 3176475 - DNA, 21 bp, Homo sapiens
gattgtgaatatttccatatg

SEQ ID NO: 3176476 - DNA, 18 bp, Homo sapiens
gattgtttcctcttccaa

SEQ ID NO: 3176477 - DNA, 18 bp, Homo sapiens
gatttaaaagcctgctca

SEQ ID NO: 3176478 - DNA, 16 bp, Homo sapiens
gatttaaacacacaga

SEQ ID NO: 3176479 - DNA, 17 bp, Homo sapiens
gatttaacagtcattta

SEQ ID NO: 3176480 - DNA, 23 bp, Homo sapiens
gatttaataaaataattctaaag

SEQ ID NO: 3176481 - DNA, 14 bp, Homo sapiens
gatttaatttccag

SEQ ID NO: 3176482 - DNA, 21 bp, Homo sapiens
gatttacagcaagtagataaa

SEQ ID NO: 3176483 - DNA, 19 bp, Homo sapiens
gatttacagcctcacttga

SEQ ID NO: 3176484 - DNA, 16 bp, Homo sapiens
gatttaccttttctgt

SEQ ID NO: 3176485 - DNA, 14 bp, Homo sapiens
gatttagtttcagt

SEQ ID NO: 3176486 - DNA, 17 bp, Homo sapiens
gatttatagtttgtaca

SEQ ID NO: 3176487 - DNA, 21 bp, Homo sapiens
gatttatggtttttttaagta

SEQ ID NO: 3176488 - DNA, 17 bp, Homo sapiens
gatttatttttcagttc

SEQ ID NO: 3176489 - DNA, 14 bp, Homo sapiens
gatttcaacatatc

SEQ ID NO: 3176490 - DNA, 17 bp, Homo sapiens
gatttcaacatatcatt

SEQ ID NO: 3176491 - DNA, 22 bp, Homo sapiens
gatttcagacctagcagggaag

SEQ ID NO: 3176492 - DNA, 16 bp, Homo sapiens
gatttcagtttttcat

SEQ ID NO: 3176493 - DNA, 17 bp, Homo sapiens
gatttcatagttcagaa

SEQ ID NO: 3176494 - DNA, 15 bp, Homo sapiens
gatttcatattgatc

SEQ ID NO: 3176495 - DNA, 17 bp, Homo sapiens
gatttcatattgatctt

SEQ ID NO: 3176496 - DNA, 22 bp, Homo sapiens
gatttcatattgatctttttat

SEQ ID NO: 3176497 - DNA, 18 bp, Homo sapiens
gatttcatgctatctctg

SEQ ID NO: 3176498 - DNA, 20 bp, Homo sapiens
gatttcatgctatctctgtg

SEQ ID NO: 3176499 - DNA, 15 bp, Homo sapiens
gatttccaagtaata

SEQ ID NO: 3176500 - DNA, 18 bp, Homo sapiens
gatttccaagtaatataa

SEQ ID NO: 3176501 - DNA, 12 bp, Homo sapiens
gatttccaggcc

SEQ ID NO: 3176502 - DNA, 18 bp, Homo sapiens
gatttccaggcccctgag

SEQ ID NO: 3176503 - DNA, 13 bp, Homo sapiens
gatttccttgaat

SEQ ID NO: 3176504 - DNA, 15 bp, Homo sapiens
gatttccttgtgcaa

SEQ ID NO: 3176505 - DNA, 20 bp, Homo sapiens
gatttcgtgggtctgttttc

SEQ ID NO: 3176506 - DNA, 13 bp, Homo sapiens
gatttctacctca

SEQ ID NO: 3176507 - DNA, 15 bp, Homo sapiens
gatttctacctcagc

SEQ ID NO: 3176508 - DNA, 23 bp, Homo sapiens
gatttctagaaagcctgttcccc

SEQ ID NO: 3176509 - DNA, 15 bp, Homo sapiens
gatttctatggcttt

SEQ ID NO: 3176510 - DNA, 16 bp, Homo sapiens
gatttctggttctgat

SEQ ID NO: 3176511 - DNA, 13 bp, Homo sapiens
gatttcttaaata

SEQ ID NO: 3176512 - DNA, 11 bp, Homo sapiens
gatttcttagg

SEQ ID NO: 3176513 - DNA, 17 bp, Homo sapiens
gatttcttcagaattag

SEQ ID NO: 3176514 - DNA, 24 bp, Homo sapiens
gatttcttcgctgctctagctggc

SEQ ID NO: 3176515 - DNA, 19 bp, Homo sapiens
gatttgaagaacatgtgag

SEQ ID NO: 3176516 - DNA, 20 bp, Homo sapiens
gatttgaagaacatgtgaga

SEQ ID NO: 3176517 - DNA, 14 bp, Homo sapiens
gatttgatgtgact

SEQ ID NO: 3176518 - DNA, 17 bp, Homo sapiens
gatttgatgtgactttt

SEQ ID NO: 3176519 - DNA, 18 bp, Homo sapiens
gatttgcatggattttgg

SEQ ID NO: 3176520 - DNA, 15 bp, Homo sapiens
gatttgcattgaaca

SEQ ID NO: 3176521 - DNA, 14 bp, Homo sapiens
gatttgccagcaca

SEQ ID NO: 3176522 - DNA, 15 bp, Homo sapiens
gatttgcctgtgcca

SEQ ID NO: 3176523 - DNA, 12 bp, Homo sapiens
gatttggaaaaa

SEQ ID NO: 3176524 - DNA, 16 bp, Homo sapiens
gatttgtaattacagg

SEQ ID NO: 3176525 - DNA, 21 bp, Homo sapiens
gatttgtaattacaggaggga

SEQ ID NO: 3176526 - DNA, 19 bp, Homo sapiens
gatttgtagcactgagggt

SEQ ID NO: 3176527 - DNA, 18 bp, Homo sapiens
gatttgtagcataactgt

SEQ ID NO: 3176528 - DNA, 22 bp, Homo sapiens
gatttgtagcataactgtagct

SEQ ID NO: 3176529 - DNA, 14 bp, Homo sapiens
gatttgtattaaaa

SEQ ID NO: 3176530 - DNA, 20 bp, Homo sapiens
gatttgtcttatccccccca

SEQ ID NO: 3176531 - DNA, 18 bp, Homo sapiens
gatttgtgaaataaaaca

SEQ ID NO: 3176532 - DNA, 18 bp, Homo sapiens
gatttgtgtttctttata

SEQ ID NO: 3176533 - DNA, 18 bp, Homo sapiens
gatttgtgtttttctttt

SEQ ID NO: 3176534 - DNA, 22 bp, Homo sapiens
gatttgttgacagcaaaatgtt

SEQ ID NO: 3176535 - DNA, 22 bp, Homo sapiens
gatttgttgccatgtgcacctt

SEQ ID NO: 3176536 - DNA, 16 bp, Homo sapiens
gatttgttttgaattt

SEQ ID NO: 3176537 - DNA, 19 bp, Homo sapiens
gattttaaaagttttgttc

SEQ ID NO: 3176538 - DNA, 21 bp, Homo sapiens
gattttaaaagttttgttctt

SEQ ID NO: 3176539 - DNA, 14 bp, Homo sapiens
gattttaacaataa

SEQ ID NO: 3176540 - DNA, 22 bp, Homo sapiens
gattttaatagggaatatatct

SEQ ID NO: 3176541 - DNA, 18 bp, Homo sapiens
gattttaatttatttgtt

SEQ ID NO: 3176542 - DNA, 13 bp, Homo sapiens
gattttaattttg

SEQ ID NO: 3176543 - DNA, 15 bp, Homo sapiens
gattttaattttgaa

SEQ ID NO: 3176544 - DNA, 18 bp, Homo sapiens
gcactgtcactttgctct

SEQ ID NO: 3176545 - DNA, 18 bp, Homo sapiens
gcactgtcccttgcctca

SEQ ID NO: 3176546 - DNA, 23 bp, Homo sapiens
gcactgtcccttgcctcaatgcc

SEQ ID NO: 3176547 - DNA, 15 bp, Homo sapiens
gcactgttcaatact

SEQ ID NO: 3176548 - DNA, 17 bp, Homo sapiens
gcactgttgatgtatct

SEQ ID NO: 3176549 - DNA, 18 bp, Homo sapiens
gcacttaagtgcactttt

SEQ ID NO: 3176550 - DNA, 17 bp, Homo sapiens
gcacttaatttgtaaac

SEQ ID NO: 3176551 - DNA, 13 bp, Homo sapiens
gcacttatgtact

SEQ ID NO: 3176552 - DNA, 21 bp, Homo sapiens
gcacttatgtacttgatactg

SEQ ID NO: 3176553 - DNA, 14 bp, Homo sapiens
gcacttattgtaaa

SEQ ID NO: 3176554 - DNA, 17 bp, Homo sapiens
gcacttcacagctggac

SEQ ID NO: 3176555 - DNA, 21 bp, Homo sapiens
gcacttcagaattccatatct

SEQ ID NO: 3176556 - DNA, 22 bp, Homo sapiens
gcacttcctgttttataatgaa

SEQ ID NO: 3176557 - DNA, 16 bp, Homo sapiens
gcacttgacaccaacc

SEQ ID NO: 3176558 - DNA, 23 bp, Homo sapiens
gcacttgacaccaaccagacagc

SEQ ID NO: 3176559 - DNA, 23 bp, Homo sapiens
gcacttgagaaccagtctcctca

SEQ ID NO: 3176560 - DNA, 18 bp, Homo sapiens
gcacttggactcttgctc

SEQ ID NO: 3176561 - DNA, 18 bp, Homo sapiens
gcacttggcctcagctgg

SEQ ID NO: 3176562 - DNA, 19 bp, Homo sapiens
gcacttggcctcagctggc

SEQ ID NO: 3176563 - DNA, 22 bp, Homo sapiens
gcacttggcctcagctggctgt

SEQ ID NO: 3176564 - DNA, 22 bp, Homo sapiens
gcacttgggggttcaggcccgg

SEQ ID NO: 3176565 - DNA, 11 bp, Homo sapiens
gcacttgtatt

SEQ ID NO: 3176566 - DNA, 21 bp, Homo sapiens
gcacttgtgattatttattat

SEQ ID NO: 3176567 - DNA, 16 bp, Homo sapiens
gcactttaagctcctt

SEQ ID NO: 3176568 - DNA, 20 bp, Homo sapiens
gcactttagggctgtaaaat

SEQ ID NO: 3176569 - DNA, 13 bp, Homo sapiens
gcactttcattgc

SEQ ID NO: 3176570 - DNA, 16 bp, Homo sapiens
gcactttgaaatacct

SEQ ID NO: 3176571 - DNA, 18 bp, Homo sapiens
gcactttgaaatacctca

SEQ ID NO: 3176572 - DNA, 21 bp, Homo sapiens
gcactttgaaatacctcatgt

SEQ ID NO: 3176573 - DNA, 22 bp, Homo sapiens
gcactttgaaatacctcatgtt

SEQ ID NO: 3176574 - DNA, 12 bp, Homo sapiens
gcactttgcact

SEQ ID NO: 3176575 - DNA, 13 bp, Homo sapiens
gcactttgcactt

SEQ ID NO: 3176576 - DNA, 16 bp, Homo sapiens
gcactttgggaggctg

SEQ ID NO: 3176577 - DNA, 17 bp, Homo sapiens
gcacttttagccagaga

SEQ ID NO: 3176578 - DNA, 21 bp, Homo sapiens
gcacttttagccagagatgca

SEQ ID NO: 3176579 - DNA, 22 bp, Homo sapiens
gcacttttagccagagatgcaa

SEQ ID NO: 3176580 - DNA, 20 bp, Homo sapiens
gcactttttcatttgcctat

SEQ ID NO: 3176581 - DNA, 16 bp, Homo sapiens
gcactttttggctgac

SEQ ID NO: 3176582 - DNA, 21 bp, Homo sapiens
gcacttttttatgaagaaaaa

SEQ ID NO: 3176583 - DNA, 17 bp, Homo sapiens
gcagaaaacagagcctg

SEQ ID NO: 3176584 - DNA, 15 bp, Homo sapiens
gcagaaaagaggaga

SEQ ID NO: 3176585 - DNA, 19 bp, Homo sapiens
gcagaaaagaggagaccct

SEQ ID NO: 3176586 - DNA, 21 bp, Homo sapiens
gcagaaaagaggagaccctgg

SEQ ID NO: 3176587 - DNA, 20 bp, Homo sapiens
gcagaaacacacagtcacat

SEQ ID NO: 3176588 - DNA, 14 bp, Homo sapiens
gcagaaacagccat

SEQ ID NO: 3176589 - DNA, 21 bp, Homo sapiens
gcagaaaggaaaacctgaaga

SEQ ID NO: 3176590 - DNA, 13 bp, Homo sapiens
gcagaaatgaaat

SEQ ID NO: 3176591 - DNA, 18 bp, Homo sapiens
gcagaacatcgatatgta

SEQ ID NO: 3176592 - DNA, 24 bp, Homo sapiens
gcagaacggagccccaggcctctg

SEQ ID NO: 3176593 - DNA, 14 bp, Homo sapiens
gcagaagacaccag

SEQ ID NO: 3176594 - DNA, 12 bp, Homo sapiens
gcagaagagggt

SEQ ID NO: 3176595 - DNA, 16 bp, Homo sapiens
gcagaagagggtgtgt

SEQ ID NO: 3176596 - DNA, 21 bp, Homo sapiens
gcagaagcaagggggtgatgt

SEQ ID NO: 3176597 - DNA, 18 bp, Homo sapiens
gcagaagcagggtaccct

SEQ ID NO: 3176598 - DNA, 12 bp, Homo sapiens
gcagaaggaaac

SEQ ID NO: 3176599 - DNA, 21 bp, Homo sapiens
gcagaaggaaagaagggggcc

SEQ ID NO: 3176600 - DNA, 19 bp, Homo sapiens
gcagaaggattttttaaag

SEQ ID NO: 3176601 - DNA, 13 bp, Homo sapiens
gcagaagggaatt

SEQ ID NO: 3176602 - DNA, 11 bp, Homo sapiens
gcagaataatg

SEQ ID NO: 3176603 - DNA, 16 bp, Homo sapiens
gcagaataatggaaac

SEQ ID NO: 3176604 - DNA, 14 bp, Homo sapiens
gcagaatggaaaaa

SEQ ID NO: 3176605 - DNA, 17 bp, Homo sapiens
gcagaatgtttttaaaa

SEQ ID NO: 3176606 - DNA, 11 bp, Homo sapiens
gcagaatttta

SEQ ID NO: 3176607 - DNA, 13 bp, Homo sapiens
gcagaattttaat

SEQ ID NO: 3176608 - DNA, 17 bp, Homo sapiens
gcagaattttaatgtga

SEQ ID NO: 3176609 - DNA, 20 bp, Homo sapiens
gcagaattttaatgtgaaga

SEQ ID NO: 3176610 - DNA, 17 bp, Homo sapiens
gcagacacctggactga

SEQ ID NO: 3176611 - DNA, 20 bp, Homo sapiens
gcagacacctggactgagcc

SEQ ID NO: 3176612 - DNA, 17 bp, Homo sapiens
gcagacagaaactggat

SEQ ID NO: 3176613 - DNA, 18 bp, Homo sapiens
gcagacagaaactggatt

SEQ ID NO: 3176614 - DNA, 20 bp, Homo sapiens
gcagacagaagtctcctcaa

SEQ ID NO: 3176615 - DNA, 14 bp, Homo sapiens
gcagacagagggga

SEQ ID NO: 3176616 - DNA, 13 bp, Homo sapiens
gcagacaggcaag

SEQ ID NO: 3176617 - DNA, 23 bp, Homo sapiens
gcagacaggcaagcacctcctgc

SEQ ID NO: 3176618 - DNA, 22 bp, Homo sapiens
gcagacattatgtaaaagaaag

SEQ ID NO: 3176619 - DNA, 17 bp, Homo sapiens
gcagaccacattgcttt

SEQ ID NO: 3176620 - DNA, 21 bp, Homo sapiens
gcagaccaccccgcctgccct

SEQ ID NO: 3176621 - DNA, 20 bp, Homo sapiens
gcagaccacgcccgtcctgc

SEQ ID NO: 3176622 - DNA, 23 bp, Homo sapiens
gcagaccacgcccgtcctgcctg

SEQ ID NO: 3176623 - DNA, 13 bp, Homo sapiens
gcagacctcccca

SEQ ID NO: 3176624 - DNA, 19 bp, Homo sapiens
gcagacctccccagcccct

SEQ ID NO: 3176625 - DNA, 20 bp, Homo sapiens
gcagacgggaggggaaaggc

SEQ ID NO: 3176626 - DNA, 22 bp, Homo sapiens
gcagacgggaggggaaaggctg

SEQ ID NO: 3176627 - DNA, 18 bp, Homo sapiens
gcagacgggcacagacac

SEQ ID NO: 3176628 - DNA, 19 bp, Homo sapiens
gcagacgggcacagacacg

SEQ ID NO: 3176629 - DNA, 17 bp, Homo sapiens
gcagacgtccatagctc

SEQ ID NO: 3176630 - DNA, 15 bp, Homo sapiens
gcagactatgcaaac

SEQ ID NO: 3176631 - DNA, 16 bp, Homo sapiens
gcagactcctcagatc

SEQ ID NO: 3176632 - DNA, 17 bp, Homo sapiens
gcagactctacagaggc

SEQ ID NO: 3176633 - DNA, 19 bp, Homo sapiens
gcagactctacagaggcca

SEQ ID NO: 3176634 - DNA, 12 bp, Homo sapiens
gcagactgtgaa

SEQ ID NO: 3176635 - DNA, 22 bp, Homo sapiens
gcagactgtgaacttgactggg

SEQ ID NO: 3176636 - DNA, 20 bp, Homo sapiens
gcagagaagcatcctccaca

SEQ ID NO: 3176637 - DNA, 22 bp, Homo sapiens
gcagagaagcatcctccacatc

SEQ ID NO: 3176638 - DNA, 22 bp, Homo sapiens
gcagagaagggcataaaacagc

SEQ ID NO: 3176639 - DNA, 21 bp, Homo sapiens
gcagagaatgaaagggcccag

SEQ ID NO: 3176640 - DNA, 23 bp, Homo sapiens
gcagagaatgaaagggcccagag

SEQ ID NO: 3176641 - DNA, 13 bp, Homo sapiens
gcagagacctcca

SEQ ID NO: 3176642 - DNA, 10 bp, Homo sapiens
gcagagagag

SEQ ID NO: 3176643 - DNA, 17 bp, Homo sapiens
gcagagagagagaaaga

SEQ ID NO: 3176644 - DNA, 16 bp, Homo sapiens
gcagagatttctcatt

SEQ ID NO: 3176645 - DNA, 17 bp, Homo sapiens
gcagagcaaatgaggga

SEQ ID NO: 3176646 - DNA, 22 bp, Homo sapiens
gcagagcacctttgcacaggat

SEQ ID NO: 3176647 - DNA, 15 bp, Homo sapiens
gcagagccatgggcc

SEQ ID NO: 3176648 - DNA, 17 bp, Homo sapiens
gcagagccatgggcctg

SEQ ID NO: 3176649 - DNA, 22 bp, Homo sapiens
gcagagccatgggcctgggcct

SEQ ID NO: 3176650 - DNA, 15 bp, Homo sapiens
gcagagcccccagga

SEQ ID NO: 3176651 - DNA, 13 bp, Homo sapiens
gcagagcctgagt

SEQ ID NO: 3176652 - DNA, 22 bp, Homo sapiens
gcagagcgccgtgagttctcag

SEQ ID NO: 3176653 - DNA, 13 bp, Homo sapiens
gcagagctgacgg

SEQ ID NO: 3176654 - DNA, 20 bp, Homo sapiens
gcagagctgacgggaggccc

SEQ ID NO: 3176655 - DNA, 13 bp, Homo sapiens
gcagagctggctc

SEQ ID NO: 3176656 - DNA, 23 bp, Homo sapiens
gcagagctggctctgagcgcctc

SEQ ID NO: 3176657 - DNA, 21 bp, Homo sapiens
gcagaggacagtctggagaag

SEQ ID NO: 3176658 - DNA, 21 bp, Homo sapiens
gcagaggaccacagtgggtgg

SEQ ID NO: 3176659 - DNA, 16 bp, Homo sapiens
gcagaggatgttcata

SEQ ID NO: 3176660 - DNA, 16 bp, Homo sapiens
gcagagggctggaggc

SEQ ID NO: 3176661 - DNA, 17 bp, Homo sapiens
gcagagggctggaggcc

SEQ ID NO: 3176662 - DNA, 21 bp, Homo sapiens
gcagagggctggaggcccagg

SEQ ID NO: 3176663 - DNA, 23 bp, Homo sapiens
gcagagggctggaggcccaggct

SEQ ID NO: 3176664 - DNA, 24 bp, Homo sapiens
gcagagggctggaggcccaggctg

SEQ ID NO: 3176665 - DNA, 18 bp, Homo sapiens
gcagaggggcagccgcta

SEQ ID NO: 3176666 - DNA, 21 bp, Homo sapiens
gcagaggggcagccgctagga

SEQ ID NO: 3176667 - DNA, 22 bp, Homo sapiens
gcagaggggcagccgctaggag

SEQ ID NO: 3176668 - DNA, 14 bp, Homo sapiens
gcagaggggccagg

SEQ ID NO: 3176669 - DNA, 22 bp, Homo sapiens
gcatggtgttttcattccccct

SEQ ID NO: 3176670 - DNA, 17 bp, Homo sapiens
gcatggttccttccctg

SEQ ID NO: 3176671 - DNA, 21 bp, Homo sapiens
gcatggttccttccctgggaa

SEQ ID NO: 3176672 - DNA, 14 bp, Homo sapiens
gcatgtaggaccct

SEQ ID NO: 3176673 - DNA, 15 bp, Homo sapiens
gcatgtcccacccac

SEQ ID NO: 3176674 - DNA, 17 bp, Homo sapiens
gcatgtcccacccaccc

SEQ ID NO: 3176675 - DNA, 17 bp, Homo sapiens
gcatgtcctcatccttt

SEQ ID NO: 3176676 - DNA, 16 bp, Homo sapiens
gcatgtcgcacaatgt

SEQ ID NO: 3176677 - DNA, 15 bp, Homo sapiens
gcatgtcttttaaaa

SEQ ID NO: 3176678 - DNA, 20 bp, Homo sapiens
gcatgtgatcacgcctggct

SEQ ID NO: 3176679 - DNA, 13 bp, Homo sapiens
gcatgtgccaaga

SEQ ID NO: 3176680 - DNA, 21 bp, Homo sapiens
gcatgtgccaagattctactc

SEQ ID NO: 3176681 - DNA, 20 bp, Homo sapiens
gcatgtgtatttccagtgca

SEQ ID NO: 3176682 - DNA, 13 bp, Homo sapiens
gcatgtgtcagag

SEQ ID NO: 3176683 - DNA, 18 bp, Homo sapiens
gcatgtgtcagagtgttg

SEQ ID NO: 3176684 - DNA, 15 bp, Homo sapiens
gcatgttaactttat

SEQ ID NO: 3176685 - DNA, 13 bp, Homo sapiens
gcatgttacataa

SEQ ID NO: 3176686 - DNA, 14 bp, Homo sapiens
gcatgttctctgag

SEQ ID NO: 3176687 - DNA, 21 bp, Homo sapiens
gcatgttctctgaggacacta

SEQ ID NO: 3176688 - DNA, 14 bp, Homo sapiens
gcatgttttgtata

SEQ ID NO: 3176689 - DNA, 15 bp, Homo sapiens
gcattaaacctgtct

SEQ ID NO: 3176690 - DNA, 22 bp, Homo sapiens
gcattaaacctgtctccactgt

SEQ ID NO: 3176691 - DNA, 18 bp, Homo sapiens
gcattaaattcacaaact

SEQ ID NO: 3176692 - DNA, 15 bp, Homo sapiens
gcattacccccaacc

SEQ ID NO: 3176693 - DNA, 16 bp, Homo sapiens
gcattagaaatagaca

SEQ ID NO: 3176694 - DNA, 13 bp, Homo sapiens
gcattagaaatta

SEQ ID NO: 3176695 - DNA, 17 bp, Homo sapiens
gcattagaattatttaa

SEQ ID NO: 3176696 - DNA, 14 bp, Homo sapiens
gcattagcacagat

SEQ ID NO: 3176697 - DNA, 19 bp, Homo sapiens
gcattagcacagattttaa

SEQ ID NO: 3176698 - DNA, 20 bp, Homo sapiens
gcattagcacagattttaat

SEQ ID NO: 3176699 - DNA, 21 bp, Homo sapiens
gcattagcacagattttaatt

SEQ ID NO: 3176700 - DNA, 15 bp, Homo sapiens
gcattatataccatt

SEQ ID NO: 3176701 - DNA, 19 bp, Homo sapiens
gcattatgtccactgtgta

SEQ ID NO: 3176702 - DNA, 22 bp, Homo sapiens
gcattatgtccactgtgtatag

SEQ ID NO: 3176703 - DNA, 15 bp, Homo sapiens
gcattattatcattg

SEQ ID NO: 3176704 - DNA, 18 bp, Homo sapiens
gcattattcatttagtga

SEQ ID NO: 3176705 - DNA, 14 bp, Homo sapiens
gcattattgcatta

SEQ ID NO: 3176706 - DNA, 20 bp, Homo sapiens
gcattcatttgttttttcaa

SEQ ID NO: 3176707 - DNA, 17 bp, Homo sapiens
gcattcatttttatagc

SEQ ID NO: 3176708 - DNA, 19 bp, Homo sapiens
gcattcatttttatagcaa

SEQ ID NO: 3176709 - DNA, 20 bp, Homo sapiens
gcattcctgtaacttttaat

SEQ ID NO: 3176710 - DNA, 13 bp, Homo sapiens
gcattccttcttt

SEQ ID NO: 3176711 - DNA, 17 bp, Homo sapiens
gcattcgggccacaggg

SEQ ID NO: 3176712 - DNA, 13 bp, Homo sapiens
gcattctcactcc

SEQ ID NO: 3176713 - DNA, 17 bp, Homo sapiens
gcattctctcccatcct

SEQ ID NO: 3176714 - DNA, 21 bp, Homo sapiens
gcattctctcccatcctgggg

SEQ ID NO: 3176715 - DNA, 13 bp, Homo sapiens
gcattctttggta

SEQ ID NO: 3176716 - DNA, 21 bp, Homo sapiens
gcattgaaagaagagatgaga

SEQ ID NO: 3176717 - DNA, 15 bp, Homo sapiens
gcattgacaaatctg

SEQ ID NO: 3176718 - DNA, 19 bp, Homo sapiens
gcattgacaaatctgtgta

SEQ ID NO: 3176719 - DNA, 22 bp, Homo sapiens
gcattgaccgcgactaatttca

SEQ ID NO: 3176720 - DNA, 23 bp, Homo sapiens
gcattgaccgcgactaatttcaa

SEQ ID NO: 3176721 - DNA, 22 bp, Homo sapiens
gcattgactggtttacaggccc

SEQ ID NO: 3176722 - DNA, 10 bp, Homo sapiens
gcattgagta

SEQ ID NO: 3176723 - DNA, 15 bp, Homo sapiens
gcattgagtattgtt

SEQ ID NO: 3176724 - DNA, 12 bp, Homo sapiens
gcattgctttcc

SEQ ID NO: 3176725 - DNA, 21 bp, Homo sapiens
gcattggaaaccctatttccc

SEQ ID NO: 3176726 - DNA, 16 bp, Homo sapiens
gcattgggctgacacc

SEQ ID NO: 3176727 - DNA, 15 bp, Homo sapiens
gcattggtgactcac

SEQ ID NO: 3176728 - DNA, 21 bp, Homo sapiens
gcattgtatagatataatgaa

SEQ ID NO: 3176729 - DNA, 14 bp, Homo sapiens
gcattgtcttgtgg

SEQ ID NO: 3176730 - DNA, 16 bp, Homo sapiens
gcattgtcttgttctg

SEQ ID NO: 3176731 - DNA, 16 bp, Homo sapiens
gcattgtctttgctgt

SEQ ID NO: 3176732 - DNA, 17 bp, Homo sapiens
gcattgtctttgctgta

SEQ ID NO: 3176733 - DNA, 15 bp, Homo sapiens
gcattgttgaggtgg

SEQ ID NO: 3176734 - DNA, 21 bp, Homo sapiens
gcattgttggctatttgaaat

SEQ ID NO: 3176735 - DNA, 17 bp, Homo sapiens
gcattgtttgcttattg

SEQ ID NO: 3176736 - DNA, 21 bp, Homo sapiens
gcattgtttgcttattgttcc

SEQ ID NO: 3176737 - DNA, 23 bp, Homo sapiens
gcattgtttgcttattgttccaa

SEQ ID NO: 3176738 - DNA, 20 bp, Homo sapiens
gcatttaataaagatgagtt

SEQ ID NO: 3176739 - DNA, 17 bp, Homo sapiens
gcatttaatggcagcta

SEQ ID NO: 3176740 - DNA, 16 bp, Homo sapiens
gcatttagcacaaaaa

SEQ ID NO: 3176741 - DNA, 17 bp, Homo sapiens
gcatttatcattcttgt

SEQ ID NO: 3176742 - DNA, 23 bp, Homo sapiens
gcatttatttatacagtgccttg

SEQ ID NO: 3176743 - DNA, 22 bp, Homo sapiens
gcatttcattcaaatcagtgat

SEQ ID NO: 3176744 - DNA, 13 bp, Homo sapiens
gcatttcattctt

SEQ ID NO: 3176745 - DNA, 21 bp, Homo sapiens
gcatttccaacaccacagaca

SEQ ID NO: 3176746 - DNA, 23 bp, Homo sapiens
gcatttccaacaccacagacaca

SEQ ID NO: 3176747 - DNA, 22 bp, Homo sapiens
gcatttcggttgagaatggaaa

SEQ ID NO: 3176748 - DNA, 17 bp, Homo sapiens
gcatttctcttctcagc

SEQ ID NO: 3176749 - DNA, 12 bp, Homo sapiens
gcatttgcacct

SEQ ID NO: 3176750 - DNA, 15 bp, Homo sapiens
gcatttgcacctctg

SEQ ID NO: 3176751 - DNA, 21 bp, Homo sapiens
gcatttggtgagagtcaaagc

SEQ ID NO: 3176752 - DNA, 12 bp, Homo sapiens
gcatttgtattt

SEQ ID NO: 3176753 - DNA, 18 bp, Homo sapiens
gcatttgtcaatgacagt

SEQ ID NO: 3176754 - DNA, 17 bp, Homo sapiens
gcatttgtgctagaaat

SEQ ID NO: 3176755 - DNA, 21 bp, Homo sapiens
gcatttgtgctagaaattttc

SEQ ID NO: 3176756 - DNA, 18 bp, Homo sapiens
gcattttcaccccaccct

SEQ ID NO: 3176757 - DNA, 18 bp, Homo sapiens
gcatttttgtgaaatgaa

SEQ ID NO: 3176758 - DNA, 21 bp, Homo sapiens
gcatttttgtgaaatgaaaac

SEQ ID NO: 3176759 - DNA, 23 bp, Homo sapiens
gccaaaaaaaaaagaagttactt

SEQ ID NO: 3176760 - DNA, 18 bp, Homo sapiens
gccaaaataccagagcct

SEQ ID NO: 3176761 - DNA, 11 bp, Homo sapiens
gccaaacaaaa

SEQ ID NO: 3176762 - DNA, 20 bp, Homo sapiens
gccaaacccttgctttcctg

SEQ ID NO: 3176763 - DNA, 14 bp, Homo sapiens
gccaaactgctgga

SEQ ID NO: 3176764 - DNA, 23 bp, Homo sapiens
gccaaactgctggacgtctttct

SEQ ID NO: 3176765 - DNA, 16 bp, Homo sapiens
gccaaagaaacaagct

SEQ ID NO: 3176766 - DNA, 18 bp, Homo sapiens
gccaaagaaatgaacatt

SEQ ID NO: 3176767 - DNA, 13 bp, Homo sapiens
gccaaagataaaa

SEQ ID NO: 3176768 - DNA, 20 bp, Homo sapiens
gccaaagccaaagctaggcc

SEQ ID NO: 3176769 - DNA, 16 bp, Homo sapiens
gccaaagctagggtgg

SEQ ID NO: 3176770 - DNA, 19 bp, Homo sapiens
gccaaagggaaatatcatt

SEQ ID NO: 3176771 - DNA, 17 bp, Homo sapiens
gccaaagtacagaattt

SEQ ID NO: 3176772 - DNA, 14 bp, Homo sapiens
gccaaataaacagc

SEQ ID NO: 3176773 - DNA, 15 bp, Homo sapiens
gccaaataaacagct

SEQ ID NO: 3176774 - DNA, 14 bp, Homo sapiens
gccaaatgcacaag

SEQ ID NO: 3176775 - DNA, 16 bp, Homo sapiens
gccaaatgtaattgaa

SEQ ID NO: 3176776 - DNA, 14 bp, Homo sapiens
gccaaatgttcatc

SEQ ID NO: 3176777 - DNA, 18 bp, Homo sapiens
gccaaatgttcatcctca

SEQ ID NO: 3176778 - DNA, 21 bp, Homo sapiens
gccaaatttaaaactgttgga

SEQ ID NO: 3176779 - DNA, 13 bp, Homo sapiens
gccaaatttatca

SEQ ID NO: 3176780 - DNA, 20 bp, Homo sapiens
gccaacagtcaaaacagaga

SEQ ID NO: 3176781 - DNA, 21 bp, Homo sapiens
gccaacctcggcttgtgggct

SEQ ID NO: 3176782 - DNA, 18 bp, Homo sapiens
gccaaccttcaaagaaac

SEQ ID NO: 3176783 - DNA, 23 bp, Homo sapiens
gccaacgacaaagccaaactctg

SEQ ID NO: 3176784 - DNA, 20 bp, Homo sapiens
gccaacgttcgatttctacc

SEQ ID NO: 3176785 - DNA, 23 bp, Homo sapiens
gccaacgttcgatttctacctca

SEQ ID NO: 3176786 - DNA, 16 bp, Homo sapiens
gccaactagcccctgg

SEQ ID NO: 3176787 - DNA, 13 bp, Homo sapiens
gccaactcctcac

SEQ ID NO: 3176788 - DNA, 19 bp, Homo sapiens
gccaactgtttccctgctg

SEQ ID NO: 3176789 - DNA, 22 bp, Homo sapiens
gccaacttgagggcccagagca

SEQ ID NO: 3176790 - DNA, 20 bp, Homo sapiens
gccaacttgtaaatacacca

SEQ ID NO: 3176791 - DNA, 18 bp, Homo sapiens
gccaagaaaatgaaggga

SEQ ID NO: 3176792 - DNA, 15 bp, Homo sapiens
gccaagaaacgtctt

SEQ ID NO: 3176793 - DNA, 22 bp, Homo sapiens
gccaagaaacgtcttctaaact

SEQ ID NO: 3176794 - DNA, 14 bp, Homo sapiens
gccatgccaccctg

SEQ ID NO: 3176795 - DNA, 16 bp, Homo sapiens
gccatgccactgccag

SEQ ID NO: 3176796 - DNA, 18 bp, Homo sapiens
gccatgccactgccaggc

SEQ ID NO: 3176797 - DNA, 20 bp, Homo sapiens
gccatgccactgccaggcac

SEQ ID NO: 3176798 - DNA, 13 bp, Homo sapiens
gccatgcccagga

SEQ ID NO: 3176799 - DNA, 15 bp, Homo sapiens
gccatgcccaggacg

SEQ ID NO: 3176800 - DNA, 15 bp, Homo sapiens
gccatgcctcatgcc

SEQ ID NO: 3176801 - DNA, 17 bp, Homo sapiens
gccatgcctcatgccac

SEQ ID NO: 3176802 - DNA, 20 bp, Homo sapiens
gccatgcgccccctccgccc

SEQ ID NO: 3176803 - DNA, 20 bp, Homo sapiens
gccatgctgaggcctgggcc

SEQ ID NO: 3176804 - DNA, 16 bp, Homo sapiens
gccatgctgggccact

SEQ ID NO: 3176805 - DNA, 17 bp, Homo sapiens
gccatgctgggccactg

SEQ ID NO: 3176806 - DNA, 15 bp, Homo sapiens
gccatggctcaggca

SEQ ID NO: 3176807 - DNA, 18 bp, Homo sapiens
gccatggctcaggcaagc

SEQ ID NO: 3176808 - DNA, 22 bp, Homo sapiens
gccatggctcaggcaagcccct

SEQ ID NO: 3176809 - DNA, 23 bp, Homo sapiens
gccatggctcaggcaagcccctc

SEQ ID NO: 3176810 - DNA, 12 bp, Homo sapiens
gccatgggccag

SEQ ID NO: 3176811 - DNA, 13 bp, Homo sapiens
gccatgggccagc

SEQ ID NO: 3176812 - DNA, 12 bp, Homo sapiens
gccatgggcctg

SEQ ID NO: 3176813 - DNA, 15 bp, Homo sapiens
gccatgggcctgggc

SEQ ID NO: 3176814 - DNA, 20 bp, Homo sapiens
gccatgggcctgggcctgct

SEQ ID NO: 3176815 - DNA, 17 bp, Homo sapiens
gccatggtacccccttc

SEQ ID NO: 3176816 - DNA, 19 bp, Homo sapiens
gccatggtacccccttctg

SEQ ID NO: 3176817 - DNA, 20 bp, Homo sapiens
gccatggtacccccttctgg

SEQ ID NO: 3176818 - DNA, 21 bp, Homo sapiens
gccatggtacccccttctggg

SEQ ID NO: 3176819 - DNA, 19 bp, Homo sapiens
gccatgtactcaagtacca

SEQ ID NO: 3176820 - DNA, 19 bp, Homo sapiens
gccatgtccaaagaggctg

SEQ ID NO: 3176821 - DNA, 24 bp, Homo sapiens
gccatgttggccaggctggtctca

SEQ ID NO: 3176822 - DNA, 13 bp, Homo sapiens
gccattaccatgg

SEQ ID NO: 3176823 - DNA, 16 bp, Homo sapiens
gccattaccatggaga

SEQ ID NO: 3176824 - DNA, 12 bp, Homo sapiens
gccattattttc

SEQ ID NO: 3176825 - DNA, 16 bp, Homo sapiens
gccattattttctgtc

SEQ ID NO: 3176826 - DNA, 17 bp, Homo sapiens
gccattattttctgtca

SEQ ID NO: 3176827 - DNA, 21 bp, Homo sapiens
gccattcacttcataatccag

SEQ ID NO: 3176828 - DNA, 22 bp, Homo sapiens
gccattcacttcataatccagt

SEQ ID NO: 3176829 - DNA, 16 bp, Homo sapiens
gccattccaaaatatt

SEQ ID NO: 3176830 - DNA, 14 bp, Homo sapiens
gccattccaacagc

SEQ ID NO: 3176831 - DNA, 15 bp, Homo sapiens
gccattctgattatt

SEQ ID NO: 3176832 - DNA, 22 bp, Homo sapiens
gccattctgccgccccctcctg

SEQ ID NO: 3176833 - DNA, 20 bp, Homo sapiens
gccattctttttttcttggc

SEQ ID NO: 3176834 - DNA, 17 bp, Homo sapiens
gccattgccaccaggag

SEQ ID NO: 3176835 - DNA, 18 bp, Homo sapiens
gccattgcggccccagga

SEQ ID NO: 3176836 - DNA, 16 bp, Homo sapiens
gccattgggaccctcc

SEQ ID NO: 3176837 - DNA, 18 bp, Homo sapiens
gccattgggaccctccag

SEQ ID NO: 3176838 - DNA, 18 bp, Homo sapiens
gccattgtctttatatga

SEQ ID NO: 3176839 - DNA, 13 bp, Homo sapiens
gccatttccccct

SEQ ID NO: 3176840 - DNA, 14 bp, Homo sapiens
gccatttccccctc

SEQ ID NO: 3176841 - DNA, 17 bp, Homo sapiens
gccatttccccctcctc

SEQ ID NO: 3176842 - DNA, 11 bp, Homo sapiens
gccatttgaga

SEQ ID NO: 3176843 - DNA, 23 bp, Homo sapiens
gccatttgcaccctccgccttca

SEQ ID NO: 3176844 - DNA, 17 bp, Homo sapiens
gccattttgtaaactaa

SEQ ID NO: 3176845 - DNA, 19 bp, Homo sapiens
gccattttgtgaatggatt

SEQ ID NO: 3176846 - DNA, 21 bp, Homo sapiens
gcccaaaggggacaggcctca

SEQ ID NO: 3176847 - DNA, 17 bp, Homo sapiens
gcccaaagtctgtgtga

SEQ ID NO: 3176848 - DNA, 18 bp, Homo sapiens
gcccaacaccagcccctg

SEQ ID NO: 3176849 - DNA, 22 bp, Homo sapiens
gcccaacaccagcccctgcccc

SEQ ID NO: 3176850 - DNA, 24 bp, Homo sapiens
gcccaacctgctctcctcttgcca

SEQ ID NO: 3176851 - DNA, 21 bp, Homo sapiens
gcccaagaatagatgctgact

SEQ ID NO: 3176852 - DNA, 13 bp, Homo sapiens
gcccaagagcaga

SEQ ID NO: 3176853 - DNA, 19 bp, Homo sapiens
gcccaagagcagagtctgg

SEQ ID NO: 3176854 - DNA, 15 bp, Homo sapiens
gcccaagagccctgt

SEQ ID NO: 3176855 - DNA, 17 bp, Homo sapiens
gcccaagaggtctgagc

SEQ ID NO: 3176856 - DNA, 16 bp, Homo sapiens
gcccaagccccatctc

SEQ ID NO: 3176857 - DNA, 18 bp, Homo sapiens
gcccaagctaagccatca

SEQ ID NO: 3176858 - DNA, 20 bp, Homo sapiens
gcccaagcttaatagccctc

SEQ ID NO: 3176859 - DNA, 22 bp, Homo sapiens
gcccaagcttaatagccctccc

SEQ ID NO: 3176860 - DNA, 23 bp, Homo sapiens
gcccaagcttaatagccctcccc

SEQ ID NO: 3176861 - DNA, 13 bp, Homo sapiens
gcccaagtccctg

SEQ ID NO: 3176862 - DNA, 15 bp, Homo sapiens
gcccaagttatcttt

SEQ ID NO: 3176863 - DNA, 19 bp, Homo sapiens
gcccaagttcatgcagctg

SEQ ID NO: 3176864 - DNA, 14 bp, Homo sapiens
gcccaatgaataat

SEQ ID NO: 3176865 - DNA, 14 bp, Homo sapiens
gcccaatgaattat

SEQ ID NO: 3176866 - DNA, 22 bp, Homo sapiens
gcccaatgcatagagccctggc

SEQ ID NO: 3176867 - DNA, 22 bp, Homo sapiens
gcccaatgctttgggaggccaa

SEQ ID NO: 3176868 - DNA, 19 bp, Homo sapiens
gcccacaaccttcggctcc

SEQ ID NO: 3176869 - DNA, 15 bp, Homo sapiens
gcccacactatgcac

SEQ ID NO: 3176870 - DNA, 18 bp, Homo sapiens
gcccacactatgcacaga

SEQ ID NO: 3176871 - DNA, 20 bp, Homo sapiens
gcccacagcacagctccctg

SEQ ID NO: 3176872 - DNA, 13 bp, Homo sapiens
gcccacaggatca

SEQ ID NO: 3176873 - DNA, 18 bp, Homo sapiens
gcccaccaccccctcaag

SEQ ID NO: 3176874 - DNA, 19 bp, Homo sapiens
gcccaccaccccctcaagc

SEQ ID NO: 3176875 - DNA, 16 bp, Homo sapiens
gcccaccatcaccacc

SEQ ID NO: 3176876 - DNA, 18 bp, Homo sapiens
gcccaccccctgccctgc

SEQ ID NO: 3176877 - DNA, 10 bp, Homo sapiens
gcccaccctg

SEQ ID NO: 3176878 - DNA, 19 bp, Homo sapiens
gcccaccctgctcctcctg

SEQ ID NO: 3176879 - DNA, 23 bp, Homo sapiens
gcccaccctgctcctcctgccct

SEQ ID NO: 3176880 - DNA, 12 bp, Homo sapiens
gcccacctcccc

SEQ ID NO: 3176881 - DNA, 18 bp, Homo sapiens
gcccacctccccacgccc

SEQ ID NO: 3176882 - DNA, 13 bp, Homo sapiens
gcccacctgcacc

SEQ ID NO: 3176883 - DNA, 14 bp, Homo sapiens
gcccacctgcccat

SEQ ID NO: 3176884 - DNA, 13 bp, Homo sapiens
gcccacctggcca

SEQ ID NO: 3176885 - DNA, 14 bp, Homo sapiens
gcccacctggccac

SEQ ID NO: 3176886 - DNA, 18 bp, Homo sapiens
gcccacctggccacctga

SEQ ID NO: 3176887 - DNA, 18 bp, Homo sapiens
gcccaccttggctcaagt

SEQ ID NO: 3176888 - DNA, 17 bp, Homo sapiens
gcccacgatcccctccc

SEQ ID NO: 3176889 - DNA, 20 bp, Homo sapiens
gcccacgatcccctccccca

SEQ ID NO: 3176890 - DNA, 13 bp, Homo sapiens
gcccacgcagagg

SEQ ID NO: 3176891 - DNA, 14 bp, Homo sapiens
gcccacgcagagga

SEQ ID NO: 3176892 - DNA, 15 bp, Homo sapiens
gcccacgcagaggac

SEQ ID NO: 3176893 - DNA, 19 bp, Homo sapiens
gcccacgcagaggacgcac

SEQ ID NO: 3176894 - DNA, 21 bp, Homo sapiens
gcccacgccctccctctccca

SEQ ID NO: 3176895 - DNA, 15 bp, Homo sapiens
gcccacgctggagtg

SEQ ID NO: 3176896 - DNA, 16 bp, Homo sapiens
gcccacgctggagtgc

SEQ ID NO: 3176897 - DNA, 17 bp, Homo sapiens
gcccacgctggagtgca

SEQ ID NO: 3176898 - DNA, 23 bp, Homo sapiens
gcccacgctggagtgcagtgagc

SEQ ID NO: 3176899 - DNA, 19 bp, Homo sapiens
gcccacggctaagaggctg

SEQ ID NO: 3176900 - DNA, 21 bp, Homo sapiens
gcccacggctaagaggctgct

SEQ ID NO: 3176901 - DNA, 23 bp, Homo sapiens
gcccacggctaagaggctgctga

SEQ ID NO: 3176902 - DNA, 16 bp, Homo sapiens
gcccagaacaaaaaga

SEQ ID NO: 3176903 - DNA, 23 bp, Homo sapiens
gcccagaacacccctaatgaggg

SEQ ID NO: 3176904 - DNA, 18 bp, Homo sapiens
gcccagaactgcccccac

SEQ ID NO: 3176905 - DNA, 20 bp, Homo sapiens
gcccagaactgcccccactg

SEQ ID NO: 3176906 - DNA, 11 bp, Homo sapiens
gcccagaagag

SEQ ID NO: 3176907 - DNA, 19 bp, Homo sapiens
gcccagaagggtagctggg

SEQ ID NO: 3176908 - DNA, 23 bp, Homo sapiens
gcccagacacagactggcaataa

SEQ ID NO: 3176909 - DNA, 23 bp, Homo sapiens
gcccagactctgagctgctcacc

SEQ ID NO: 3176910 - DNA, 15 bp, Homo sapiens
gcccagactttagtg

SEQ ID NO: 3176911 - DNA, 15 bp, Homo sapiens
gcccagagagggtgg

SEQ ID NO: 3176912 - DNA, 12 bp, Homo sapiens
gcccagagccac

SEQ ID NO: 3176913 - DNA, 17 bp, Homo sapiens
gcccagagccacctgga

SEQ ID NO: 3176914 - DNA, 21 bp, Homo sapiens
gcccagaggactcccaaccct

SEQ ID NO: 3176915 - DNA, 13 bp, Homo sapiens
gcccagagggccc

SEQ ID NO: 3176916 - DNA, 15 bp, Homo sapiens
gcccagagggcccag

SEQ ID NO: 3176917 - DNA, 16 bp, Homo sapiens
gcccagagggcccagg

SEQ ID NO: 3176918 - DNA, 21 bp, Homo sapiens
gcccagagggcccaggcaggc

SEQ ID NO: 3176919 - DNA, 22 bp, Homo sapiens
gcccagaggtaacagaacagct

SEQ ID NO: 3176920 - DNA, 19 bp, Homo sapiens
gccctcaccaccacactac

SEQ ID NO: 3176921 - DNA, 12 bp, Homo sapiens
gccctcagaaca

SEQ ID NO: 3176922 - DNA, 16 bp, Homo sapiens
gccctcagctcctggg

SEQ ID NO: 3176923 - DNA, 21 bp, Homo sapiens
gccctcagtcagttcccggag

SEQ ID NO: 3176924 - DNA, 22 bp, Homo sapiens
gccctcagtcagttcccggagc

SEQ ID NO: 3176925 - DNA, 22 bp, Homo sapiens
gccctcatggcccctctgacct

SEQ ID NO: 3176926 - DNA, 14 bp, Homo sapiens
gccctccaaaagca

SEQ ID NO: 3176927 - DNA, 15 bp, Homo sapiens
gccctccaaaagcac

SEQ ID NO: 3176928 - DNA, 14 bp, Homo sapiens
gccctccacagccg

SEQ ID NO: 3176929 - DNA, 14 bp, Homo sapiens
gccctccagctgct

SEQ ID NO: 3176930 - DNA, 18 bp, Homo sapiens
gccctccagctgctgctc

SEQ ID NO: 3176931 - DNA, 21 bp, Homo sapiens
gccctccagtgggctgatgct

SEQ ID NO: 3176932 - DNA, 14 bp, Homo sapiens
gccctccatgggct

SEQ ID NO: 3176933 - DNA, 16 bp, Homo sapiens
gccctccatgggctag

SEQ ID NO: 3176934 - DNA, 16 bp, Homo sapiens
gccctccccagagcac

SEQ ID NO: 3176935 - DNA, 17 bp, Homo sapiens
gccctccccatcccatg

SEQ ID NO: 3176936 - DNA, 13 bp, Homo sapiens
gccctccccctca

SEQ ID NO: 3176937 - DNA, 15 bp, Homo sapiens
gccctcccccttccc

SEQ ID NO: 3176938 - DNA, 20 bp, Homo sapiens
gccctcccccttccccttct

SEQ ID NO: 3176939 - DNA, 16 bp, Homo sapiens
gccctcccctcccctg

SEQ ID NO: 3176940 - DNA, 19 bp, Homo sapiens
gccctcccctcccctgctg

SEQ ID NO: 3176941 - DNA, 21 bp, Homo sapiens
gccctccctatgtctgcaaag

SEQ ID NO: 3176942 - DNA, 16 bp, Homo sapiens
gccctccctctcccag

SEQ ID NO: 3176943 - DNA, 20 bp, Homo sapiens
gccctccctgactccctgtg

SEQ ID NO: 3176944 - DNA, 18 bp, Homo sapiens
gccctccgacagccccct

SEQ ID NO: 3176945 - DNA, 15 bp, Homo sapiens
gccctccgcctggga

SEQ ID NO: 3176946 - DNA, 13 bp, Homo sapiens
gccctcctcgggc

SEQ ID NO: 3176947 - DNA, 18 bp, Homo sapiens
gccctcctcgggccgagg

SEQ ID NO: 3176948 - DNA, 16 bp, Homo sapiens
gccctcctctgcactc

SEQ ID NO: 3176949 - DNA, 12 bp, Homo sapiens
gccctcctgtgc

SEQ ID NO: 3176950 - DNA, 16 bp, Homo sapiens
gccctcgaaccaaggc

SEQ ID NO: 3176951 - DNA, 21 bp, Homo sapiens
gccctcgaaccaaggcagcct

SEQ ID NO: 3176952 - DNA, 21 bp, Homo sapiens
gccctcgtgcctgggggagag

SEQ ID NO: 3176953 - DNA, 22 bp, Homo sapiens
gccctcgtgcctgggggagaga

SEQ ID NO: 3176954 - DNA, 15 bp, Homo sapiens
gccctcgtggccagc

SEQ ID NO: 3176955 - DNA, 19 bp, Homo sapiens
gccctcgtggccagcccgg

SEQ ID NO: 3176956 - DNA, 21 bp, Homo sapiens
gccctctatttattagccaac

SEQ ID NO: 3176957 - DNA, 13 bp, Homo sapiens
gccctctctctgg

SEQ ID NO: 3176958 - DNA, 21 bp, Homo sapiens
gccctctctgctccttcactg

SEQ ID NO: 3176959 - DNA, 11 bp, Homo sapiens
gccctctcttc

SEQ ID NO: 3176960 - DNA, 12 bp, Homo sapiens
gccctcttcctg

SEQ ID NO: 3176961 - DNA, 13 bp, Homo sapiens
gccctcttcctga

SEQ ID NO: 3176962 - DNA, 13 bp, Homo sapiens
gccctctttccct

SEQ ID NO: 3176963 - DNA, 17 bp, Homo sapiens
gccctctttccctgcga

SEQ ID NO: 3176964 - DNA, 19 bp, Homo sapiens
gccctctttccctgcgaga

SEQ ID NO: 3176965 - DNA, 20 bp, Homo sapiens
gccctctttccctgcgagac

SEQ ID NO: 3176966 - DNA, 16 bp, Homo sapiens
gccctgaggaaggagg

SEQ ID NO: 3176967 - DNA, 19 bp, Homo sapiens
gccctgaggcctgaggcct

SEQ ID NO: 3176968 - DNA, 14 bp, Homo sapiens
gccctgaggtgtgg

SEQ ID NO: 3176969 - DNA, 21 bp, Homo sapiens
gccctgaggtgtgggggctgc

SEQ ID NO: 3176970 - DNA, 22 bp, Homo sapiens
gccctgaggtgtgggggctgca

SEQ ID NO: 3176971 - DNA, 23 bp, Homo sapiens
gccctgaggtgtgggggctgcag

SEQ ID NO: 3176972 - DNA, 23 bp, Homo sapiens
gccctgcaatgtatcccttctca

SEQ ID NO: 3176973 - DNA, 22 bp, Homo sapiens
gccctgcacgtatacacccaga

SEQ ID NO: 3176974 - DNA, 21 bp, Homo sapiens
gccctgcagaggggaaaccag

SEQ ID NO: 3176975 - DNA, 11 bp, Homo sapiens
gccctgcagca

SEQ ID NO: 3176976 - DNA, 13 bp, Homo sapiens
gccctgcagtgtt

SEQ ID NO: 3176977 - DNA, 22 bp, Homo sapiens
gccctgcagtgttcgcttggct

SEQ ID NO: 3176978 - DNA, 12 bp, Homo sapiens
gccctgccactc

SEQ ID NO: 3176979 - DNA, 11 bp, Homo sapiens
gccctgcccaa

SEQ ID NO: 3176980 - DNA, 17 bp, Homo sapiens
gccctgccccctggctg

SEQ ID NO: 3176981 - DNA, 18 bp, Homo sapiens
gccctgccccctggctga

SEQ ID NO: 3176982 - DNA, 22 bp, Homo sapiens
gccctgcccctaggatgctgca

SEQ ID NO: 3176983 - DNA, 10 bp, Homo sapiens
gccctgccct

SEQ ID NO: 3176984 - DNA, 13 bp, Homo sapiens
gccctgccctgag

SEQ ID NO: 3176985 - DNA, 11 bp, Homo sapiens
gccctgcctcc

SEQ ID NO: 3176986 - DNA, 12 bp, Homo sapiens
gccctgcctgcc

SEQ ID NO: 3176987 - DNA, 14 bp, Homo sapiens
gccctgcctgccca

SEQ ID NO: 3176988 - DNA, 15 bp, Homo sapiens
gccctgcctgcccac

SEQ ID NO: 3176989 - DNA, 16 bp, Homo sapiens
gccctgcgttggagcc

SEQ ID NO: 3176990 - DNA, 15 bp, Homo sapiens
gccctgctcctccct

SEQ ID NO: 3176991 - DNA, 17 bp, Homo sapiens
gccctgctcctccctgg

SEQ ID NO: 3176992 - DNA, 22 bp, Homo sapiens
gccctgctgccgcctcccagcc

SEQ ID NO: 3176993 - DNA, 16 bp, Homo sapiens
gccctgctttgggctg

SEQ ID NO: 3176994 - DNA, 20 bp, Homo sapiens
gccctgctttgggctgccct

SEQ ID NO: 3176995 - DNA, 15 bp, Homo sapiens
gccctgcttttgcat

SEQ ID NO: 3176996 - DNA, 12 bp, Homo sapiens
gccctgcttttt

SEQ ID NO: 3176997 - DNA, 18 bp, Homo sapiens
gccctggacacccctgct

SEQ ID NO: 3176998 - DNA, 18 bp, Homo sapiens
gccctggagccaactgct

SEQ ID NO: 3176999 - DNA, 23 bp, Homo sapiens
gccctggagccaactgctgcttt

SEQ ID NO: 3177000 - DNA, 13 bp, Homo sapiens
gccctggaggaag

SEQ ID NO: 3177001 - DNA, 16 bp, Homo sapiens
gccctggcagcagcag

SEQ ID NO: 3177002 - DNA, 12 bp, Homo sapiens
gccctggcagga

SEQ ID NO: 3177003 - DNA, 21 bp, Homo sapiens
gccctggcagggtcatcctgt

SEQ ID NO: 3177004 - DNA, 13 bp, Homo sapiens
gccctggccagga

SEQ ID NO: 3177005 - DNA, 12 bp, Homo sapiens
gccctggccctg

SEQ ID NO: 3177006 - DNA, 23 bp, Homo sapiens
gccctggccctttccccttcccc

SEQ ID NO: 3177007 - DNA, 14 bp, Homo sapiens
gccctggcctcccc

SEQ ID NO: 3177008 - DNA, 16 bp, Homo sapiens
gccctggcctcccctg

SEQ ID NO: 3177009 - DNA, 20 bp, Homo sapiens
gccctggctcccacaggccc

SEQ ID NO: 3177010 - DNA, 17 bp, Homo sapiens
gccctggctctgctgtc

SEQ ID NO: 3177011 - DNA, 12 bp, Homo sapiens
gccctggctgct

SEQ ID NO: 3177012 - DNA, 17 bp, Homo sapiens
gccctggctgctgcccc

SEQ ID NO: 3177013 - DNA, 17 bp, Homo sapiens
gccctgggccacactga

SEQ ID NO: 3177014 - DNA, 16 bp, Homo sapiens
gccctgggctggaatc

SEQ ID NO: 3177015 - DNA, 14 bp, Homo sapiens
gccctgggctggac

SEQ ID NO: 3177016 - DNA, 21 bp, Homo sapiens
gccctgggctggactggaggt

SEQ ID NO: 3177017 - DNA, 20 bp, Homo sapiens
gccctgggctgtctgtcacc

SEQ ID NO: 3177018 - DNA, 21 bp, Homo sapiens
gccctgggctgtctgtcacca

SEQ ID NO: 3177019 - DNA, 23 bp, Homo sapiens
gccctgggctgtctgtcaccagc

SEQ ID NO: 3177020 - DNA, 13 bp, Homo sapiens
gccctggtccagg

SEQ ID NO: 3177021 - DNA, 17 bp, Homo sapiens
gccctggtggcagtggg

SEQ ID NO: 3177022 - DNA, 18 bp, Homo sapiens
gccctggtggcagtggga

SEQ ID NO: 3177023 - DNA, 19 bp, Homo sapiens
gccctggtggcagtgggag

SEQ ID NO: 3177024 - DNA, 16 bp, Homo sapiens
gccctggtgtgtttcc

SEQ ID NO: 3177025 - DNA, 22 bp, Homo sapiens
gccctggtttcactggcccaag

SEQ ID NO: 3177026 - DNA, 15 bp, Homo sapiens
gccctgtccctccca

SEQ ID NO: 3177027 - DNA, 16 bp, Homo sapiens
gccctgtccctcccac

SEQ ID NO: 3177028 - DNA, 17 bp, Homo sapiens
gccctgtccctcccacc

SEQ ID NO: 3177029 - DNA, 21 bp, Homo sapiens
gccctgtccctcccacctctg

SEQ ID NO: 3177030 - DNA, 23 bp, Homo sapiens
gccctgtggccgactctgcactc

SEQ ID NO: 3177031 - DNA, 13 bp, Homo sapiens
gccctgtggccgc

SEQ ID NO: 3177032 - DNA, 14 bp, Homo sapiens
gccctgtggccgcc

SEQ ID NO: 3177033 - DNA, 18 bp, Homo sapiens
gccctgtggccgccacct

SEQ ID NO: 3177034 - DNA, 15 bp, Homo sapiens
gcccttagtccccca

SEQ ID NO: 3177035 - DNA, 18 bp, Homo sapiens
gcccttagtcccccaact

SEQ ID NO: 3177036 - DNA, 20 bp, Homo sapiens
gcccttagtcccccaactct

SEQ ID NO: 3177037 - DNA, 17 bp, Homo sapiens
gcccttattttcaagaa

SEQ ID NO: 3177038 - DNA, 16 bp, Homo sapiens
gcccttcacagtgttt

SEQ ID NO: 3177039 - DNA, 17 bp, Homo sapiens
gcccttcactgccatga

SEQ ID NO: 3177040 - DNA, 21 bp, Homo sapiens
gcccttcaggaagcaggtgtc

SEQ ID NO: 3177041 - DNA, 13 bp, Homo sapiens
gcccttccctgtc

SEQ ID NO: 3177042 - DNA, 22 bp, Homo sapiens
gcccttcctctcactcctgcct

SEQ ID NO: 3177043 - DNA, 24 bp, Homo sapiens
gcccttcctctcactcctgcctcc

SEQ ID NO: 3177044 - DNA, 15 bp, Homo sapiens
gcccttcctctccac

SEQ ID NO: 3177045 - DNA, 18 bp, Homo sapiens
gcccttcctctccactgc

SEQ ID NO: 3177046 - DNA, 12 bp, Homo sapiens
gcccttctgcct

SEQ ID NO: 3177047 - DNA, 14 bp, Homo sapiens
gcccttgagggaga

SEQ ID NO: 3177048 - DNA, 22 bp, Homo sapiens
gcccttgcagttcagcaccacc

SEQ ID NO: 3177049 - DNA, 19 bp, Homo sapiens
gcccttgcccccatccctc

SEQ ID NO: 3177050 - DNA, 14 bp, Homo sapiens
gcccttgccctgac

SEQ ID NO: 3177051 - DNA, 15 bp, Homo sapiens
gcccttgccctgacc

SEQ ID NO: 3177052 - DNA, 20 bp, Homo sapiens
gcccttgcctttgtggcctt

SEQ ID NO: 3177053 - DNA, 22 bp, Homo sapiens
gcccttgcctttgtggccttcc

SEQ ID NO: 3177054 - DNA, 15 bp, Homo sapiens
gcccttggcttctgt

SEQ ID NO: 3177055 - DNA, 13 bp, Homo sapiens
gcccttgggcagt

SEQ ID NO: 3177056 - DNA, 15 bp, Homo sapiens
gcccttgggcagttc

SEQ ID NO: 3177057 - DNA, 14 bp, Homo sapiens
gcccttggggcctg

SEQ ID NO: 3177058 - DNA, 15 bp, Homo sapiens
gcccttggggcctgg

SEQ ID NO: 3177059 - DNA, 19 bp, Homo sapiens
gcccttggggcctggcttg

SEQ ID NO: 3177060 - DNA, 14 bp, Homo sapiens
gcccttggggctgg

SEQ ID NO: 3177061 - DNA, 21 bp, Homo sapiens
gcccttggggtaagccagagc

SEQ ID NO: 3177062 - DNA, 14 bp, Homo sapiens
gcccttgtcctgcc

SEQ ID NO: 3177063 - DNA, 19 bp, Homo sapiens
gcccttgtcctgccagctg

SEQ ID NO: 3177064 - DNA, 21 bp, Homo sapiens
gcccttgtcctgccagctgcc

SEQ ID NO: 3177065 - DNA, 13 bp, Homo sapiens
gcccttgtctgag

SEQ ID NO: 3177066 - DNA, 11 bp, Homo sapiens
gccctttaaaa

SEQ ID NO: 3177067 - DNA, 13 bp, Homo sapiens
gccctttcccctt

SEQ ID NO: 3177068 - DNA, 14 bp, Homo sapiens
gccctttccccttc

SEQ ID NO: 3177069 - DNA, 17 bp, Homo sapiens
gccctttccccttcccc

SEQ ID NO: 3177070 - DNA, 22 bp, Homo sapiens
gccctttctgtaccatttattt

SEQ ID NO: 3177071 - DNA, 19 bp, Homo sapiens
gccctttgaagcctcagct

SEQ ID NO: 3177072 - DNA, 14 bp, Homo sapiens
gccgaagctctggc

SEQ ID NO: 3177073 - DNA, 18 bp, Homo sapiens
gccgaaggtgcctcagac

SEQ ID NO: 3177074 - DNA, 21 bp, Homo sapiens
gccgaaggtgcctcagactcc

SEQ ID NO: 3177075 - DNA, 14 bp, Homo sapiens
gccgaccagagccc

SEQ ID NO: 3177076 - DNA, 14 bp, Homo sapiens
gccgactctggccc

SEQ ID NO: 3177077 - DNA, 18 bp, Homo sapiens
gccgactctggccctggc

SEQ ID NO: 3177078 - DNA, 14 bp, Homo sapiens
gccgactgcgctgc

SEQ ID NO: 3177079 - DNA, 15 bp, Homo sapiens
gccgacttggagact

SEQ ID NO: 3177080 - DNA, 14 bp, Homo sapiens
gccgagacctcaag

SEQ ID NO: 3177081 - DNA, 21 bp, Homo sapiens
gccgagacctcaagccctgag

SEQ ID NO: 3177082 - DNA, 18 bp, Homo sapiens
gccgagatcacgccactg

SEQ ID NO: 3177083 - DNA, 20 bp, Homo sapiens
gccgagatcacgccactgca

SEQ ID NO: 3177084 - DNA, 21 bp, Homo sapiens
gccgagatcacgccactgcac

SEQ ID NO: 3177085 - DNA, 19 bp, Homo sapiens
gccgagattgcaccactgc

SEQ ID NO: 3177086 - DNA, 15 bp, Homo sapiens
gccgagccgggcctg

SEQ ID NO: 3177087 - DNA, 13 bp, Homo sapiens
gccgagcctaatg

SEQ ID NO: 3177088 - DNA, 18 bp, Homo sapiens
gccgaggaggtgcctgga

SEQ ID NO: 3177089 - DNA, 19 bp, Homo sapiens
gccgaggcccagcgggcag

SEQ ID NO: 3177090 - DNA, 17 bp, Homo sapiens
gccgcagacgggcacag

SEQ ID NO: 3177091 - DNA, 19 bp, Homo sapiens
gccgcagacgggcacagac

SEQ ID NO: 3177092 - DNA, 23 bp, Homo sapiens
gccgcagacgggcacagacacgc

SEQ ID NO: 3177093 - DNA, 18 bp, Homo sapiens
gccgcagcctccctctga

SEQ ID NO: 3177094 - DNA, 14 bp, Homo sapiens
gccgcattggtgac

SEQ ID NO: 3177095 - DNA, 15 bp, Homo sapiens
gccgccaccagcccg

SEQ ID NO: 3177096 - DNA, 17 bp, Homo sapiens
gccgccaccagcccgca

SEQ ID NO: 3177097 - DNA, 12 bp, Homo sapiens
gccgccaccccc

SEQ ID NO: 3177098 - DNA, 15 bp, Homo sapiens
gccgccacccccatc

SEQ ID NO: 3177099 - DNA, 23 bp, Homo sapiens
gccgccccctgccccccagcctc

SEQ ID NO: 3177100 - DNA, 15 bp, Homo sapiens
gccgccctgggctgt

SEQ ID NO: 3177101 - DNA, 13 bp, Homo sapiens
gccgccgcctctt

SEQ ID NO: 3177102 - DNA, 21 bp, Homo sapiens
gccgccgtgacctattcaccc

SEQ ID NO: 3177103 - DNA, 13 bp, Homo sapiens
gccgcctcccagc

SEQ ID NO: 3177104 - DNA, 16 bp, Homo sapiens
gccgcctcccagcctg

SEQ ID NO: 3177105 - DNA, 20 bp, Homo sapiens
gccgcctgagaccctcgcgc

SEQ ID NO: 3177106 - DNA, 12 bp, Homo sapiens
gccgcctgctcc

SEQ ID NO: 3177107 - DNA, 18 bp, Homo sapiens
gccgcctgctcctcactg

SEQ ID NO: 3177108 - DNA, 19 bp, Homo sapiens
gccgcgtttagaccaagga

SEQ ID NO: 3177109 - DNA, 16 bp, Homo sapiens
gccgctacctccctcc

SEQ ID NO: 3177110 - DNA, 13 bp, Homo sapiens
gccgctaggagag

SEQ ID NO: 3177111 - DNA, 19 bp, Homo sapiens
gccgctaggagagactgaa

SEQ ID NO: 3177112 - DNA, 17 bp, Homo sapiens
gccgctcggaggcccca

SEQ ID NO: 3177113 - DNA, 22 bp, Homo sapiens
gccgctcggaggccccaaagga

SEQ ID NO: 3177114 - DNA, 16 bp, Homo sapiens
gccgctgcagggctcc

SEQ ID NO: 3177115 - DNA, 15 bp, Homo sapiens
gccggacgcatctca

SEQ ID NO: 3177116 - DNA, 18 bp, Homo sapiens
gccggcaaccccagttct

SEQ ID NO: 3177117 - DNA, 15 bp, Homo sapiens
gccggcctctctggc

SEQ ID NO: 3177118 - DNA, 16 bp, Homo sapiens
gccggcctctctggcc

SEQ ID NO: 3177119 - DNA, 15 bp, Homo sapiens
gccggcctggcaccg

SEQ ID NO: 3177120 - DNA, 12 bp, Homo sapiens
gccggctggtga

SEQ ID NO: 3177121 - DNA, 20 bp, Homo sapiens
gccgggcacagccctcagcg

SEQ ID NO: 3177122 - DNA, 13 bp, Homo sapiens
gccgggcaggcgt

SEQ ID NO: 3177123 - DNA, 22 bp, Homo sapiens
gccgggcgcggtggctcacgcc

SEQ ID NO: 3177124 - DNA, 16 bp, Homo sapiens
gccgggcggtcacagc

SEQ ID NO: 3177125 - DNA, 18 bp, Homo sapiens
gccggggaagctgccagc

SEQ ID NO: 3177126 - DNA, 15 bp, Homo sapiens
gccgggggaggtggg

SEQ ID NO: 3177127 - DNA, 14 bp, Homo sapiens
gccggtcgggcagc

SEQ ID NO: 3177128 - DNA, 18 bp, Homo sapiens
gccggtcgggcagccagc

SEQ ID NO: 3177129 - DNA, 19 bp, Homo sapiens
gccggtcgggcagccagca

SEQ ID NO: 3177130 - DNA, 13 bp, Homo sapiens
gccggtgcctggc

SEQ ID NO: 3177131 - DNA, 13 bp, Homo sapiens
gccggtgggaccc

SEQ ID NO: 3177132 - DNA, 22 bp, Homo sapiens
gccgtaccccaccctcagcacc

SEQ ID NO: 3177133 - DNA, 21 bp, Homo sapiens
gccgtagggagtacctgctgc

SEQ ID NO: 3177134 - DNA, 22 bp, Homo sapiens
gccgtccatggcaccagccccc

SEQ ID NO: 3177135 - DNA, 21 bp, Homo sapiens
gccgtctaggattgggcctcc

SEQ ID NO: 3177136 - DNA, 17 bp, Homo sapiens
gccgtctcatcttctct

SEQ ID NO: 3177137 - DNA, 16 bp, Homo sapiens
gccgtctccaggggct

SEQ ID NO: 3177138 - DNA, 13 bp, Homo sapiens
gccgtctcctccc

SEQ ID NO: 3177139 - DNA, 14 bp, Homo sapiens
gccgtctcctccct

SEQ ID NO: 3177140 - DNA, 14 bp, Homo sapiens
gccgtctgactcca

SEQ ID NO: 3177141 - DNA, 13 bp, Homo sapiens
gccgtgacctatt

SEQ ID NO: 3177142 - DNA, 21 bp, Homo sapiens
gccgtgacctattcaccctcc

SEQ ID NO: 3177143 - DNA, 18 bp, Homo sapiens
gccgtgagttctcagggc

SEQ ID NO: 3177144 - DNA, 20 bp, Homo sapiens
gccgtgagttctcagggctc

SEQ ID NO: 3177145 - DNA, 17 bp, Homo sapiens
gccgtgatgctcaggct

SEQ ID NO: 3177146 - DNA, 19 bp, Homo sapiens
gccgtgcattagcacagat

SEQ ID NO: 3177147 - DNA, 15 bp, Homo sapiens
gccgtgccttcagct

SEQ ID NO: 3177148 - DNA, 17 bp, Homo sapiens
gccgtgccttcagctct

SEQ ID NO: 3177149 - DNA, 22 bp, Homo sapiens
gccgtggattgcacgtggcctc

SEQ ID NO: 3177150 - DNA, 23 bp, Homo sapiens
gccgtggggccgccgcctctttc

SEQ ID NO: 3177151 - DNA, 18 bp, Homo sapiens
gcctaaaactggcctgac

SEQ ID NO: 3177152 - DNA, 16 bp, Homo sapiens
gcctaaaagtaaacat

SEQ ID NO: 3177153 - DNA, 22 bp, Homo sapiens
gcctaaaagtgggcttgattct

SEQ ID NO: 3177154 - DNA, 13 bp, Homo sapiens
gcctaaaatcttg

SEQ ID NO: 3177155 - DNA, 18 bp, Homo sapiens
gcctaaaattgtatgaaa

SEQ ID NO: 3177156 - DNA, 16 bp, Homo sapiens
gcctaaagggcagggc

SEQ ID NO: 3177157 - DNA, 21 bp, Homo sapiens
gcctaaagggcagggcccacg

SEQ ID NO: 3177158 - DNA, 15 bp, Homo sapiens
gcctaaatttcttct

SEQ ID NO: 3177159 - DNA, 13 bp, Homo sapiens
gcctaaccaggcc

SEQ ID NO: 3177160 - DNA, 15 bp, Homo sapiens
gcctaaccaggccca

SEQ ID NO: 3177161 - DNA, 20 bp, Homo sapiens
gcctaaccaggcccagccag

SEQ ID NO: 3177162 - DNA, 23 bp, Homo sapiens
gcctaaccaggcccagccagttg

SEQ ID NO: 3177163 - DNA, 22 bp, Homo sapiens
gcctaatccctgggcattgctt

SEQ ID NO: 3177164 - DNA, 22 bp, Homo sapiens
gcctaatctcatacctctgacc

SEQ ID NO: 3177165 - DNA, 16 bp, Homo sapiens
gcctaatggagaagac

SEQ ID NO: 3177166 - DNA, 15 bp, Homo sapiens
gcctaattggaaagt

SEQ ID NO: 3177167 - DNA, 20 bp, Homo sapiens
gcctaattggaaagtgccag

SEQ ID NO: 3177168 - DNA, 16 bp, Homo sapiens
gcctacaaccatccct

SEQ ID NO: 3177169 - DNA, 19 bp, Homo sapiens
gcctacaaccatccctgcc

SEQ ID NO: 3177170 - DNA, 22 bp, Homo sapiens
gcctacaagctggcacttgcta

SEQ ID NO: 3177171 - DNA, 16 bp, Homo sapiens
gcctaccaatctctgc

SEQ ID NO: 3177172 - DNA, 17 bp, Homo sapiens
gcctaccaatctctgct

SEQ ID NO: 3177173 - DNA, 21 bp, Homo sapiens
gcctttgagacagtttcttag

SEQ ID NO: 3177174 - DNA, 18 bp, Homo sapiens
gcctttgagcccacaaag

SEQ ID NO: 3177175 - DNA, 21 bp, Homo sapiens
gcctttgcagttggactctca

SEQ ID NO: 3177176 - DNA, 23 bp, Homo sapiens
gcctttgcagttggactctcagg

SEQ ID NO: 3177177 - DNA, 15 bp, Homo sapiens
gcctttggggctggt

SEQ ID NO: 3177178 - DNA, 14 bp, Homo sapiens
gcctttgtggcctt

SEQ ID NO: 3177179 - DNA, 21 bp, Homo sapiens
gccttttaacattttgttctt

SEQ ID NO: 3177180 - DNA, 19 bp, Homo sapiens
gccttttagaaacctcatt

SEQ ID NO: 3177181 - DNA, 17 bp, Homo sapiens
gccttttgcacccctcc

SEQ ID NO: 3177182 - DNA, 19 bp, Homo sapiens
gccttttgcacccctccca

SEQ ID NO: 3177183 - DNA, 20 bp, Homo sapiens
gccttttgcacccctcccat

SEQ ID NO: 3177184 - DNA, 16 bp, Homo sapiens
gccttttgcagaagag

SEQ ID NO: 3177185 - DNA, 12 bp, Homo sapiens
gccttttgctgc

SEQ ID NO: 3177186 - DNA, 15 bp, Homo sapiens
gccttttgctgcgca

SEQ ID NO: 3177187 - DNA, 16 bp, Homo sapiens
gccttttgctgcgcac

SEQ ID NO: 3177188 - DNA, 22 bp, Homo sapiens
gccttttgtatacatcctgggt

SEQ ID NO: 3177189 - DNA, 15 bp, Homo sapiens
gccttttgtgtgatg

SEQ ID NO: 3177190 - DNA, 17 bp, Homo sapiens
gccttttgtttctagaa

SEQ ID NO: 3177191 - DNA, 21 bp, Homo sapiens
gcctttttcctagcctgtttc

SEQ ID NO: 3177192 - DNA, 15 bp, Homo sapiens
gcgaaccacccaaaa

SEQ ID NO: 3177193 - DNA, 15 bp, Homo sapiens
gcgaaggggccctgg

SEQ ID NO: 3177194 - DNA, 16 bp, Homo sapiens
gcgaagtagcttgctc

SEQ ID NO: 3177195 - DNA, 19 bp, Homo sapiens
gcgacagagcgagagtctg

SEQ ID NO: 3177196 - DNA, 18 bp, Homo sapiens
gcgacaggagtatttttt

SEQ ID NO: 3177197 - DNA, 16 bp, Homo sapiens
gcgacatagcccatcc

SEQ ID NO: 3177198 - DNA, 14 bp, Homo sapiens
gcgaccgccccctc

SEQ ID NO: 3177199 - DNA, 15 bp, Homo sapiens
gcgaccgccccctcc

SEQ ID NO: 3177200 - DNA, 22 bp, Homo sapiens
gcgaccgccctccgcgaaaata

SEQ ID NO: 3177201 - DNA, 23 bp, Homo sapiens
gcgaccttcctcatccaccccat

SEQ ID NO: 3177202 - DNA, 16 bp, Homo sapiens
gcgacggagagaaaaa

SEQ ID NO: 3177203 - DNA, 17 bp, Homo sapiens
gcgactttctgcctgga

SEQ ID NO: 3177204 - DNA, 14 bp, Homo sapiens
gcgagactccgtct

SEQ ID NO: 3177205 - DNA, 13 bp, Homo sapiens
gcgaggaggcgcg

SEQ ID NO: 3177206 - DNA, 16 bp, Homo sapiens
gcgagggcagctgcta

SEQ ID NO: 3177207 - DNA, 14 bp, Homo sapiens
gcgagtcccctgcc

SEQ ID NO: 3177208 - DNA, 22 bp, Homo sapiens
gcgagttcctcgctctgggatg

SEQ ID NO: 3177209 - DNA, 17 bp, Homo sapiens
gcgagttgtggaaagcc

SEQ ID NO: 3177210 - DNA, 13 bp, Homo sapiens
gcgatatacagat

SEQ ID NO: 3177211 - DNA, 14 bp, Homo sapiens
gcgatatacagatg

SEQ ID NO: 3177212 - DNA, 19 bp, Homo sapiens
gcgatatacagatgaaaat

SEQ ID NO: 3177213 - DNA, 21 bp, Homo sapiens
gcgatccacctgtctcagcct

SEQ ID NO: 3177214 - DNA, 14 bp, Homo sapiens
gcgattcttctgct

SEQ ID NO: 3177215 - DNA, 19 bp, Homo sapiens
gcgcaatctcggctcactg

SEQ ID NO: 3177216 - DNA, 13 bp, Homo sapiens
gcgcacacacaca

SEQ ID NO: 3177217 - DNA, 18 bp, Homo sapiens
gcgcagctggactctgca

SEQ ID NO: 3177218 - DNA, 22 bp, Homo sapiens
gcgcagtgcttctctacagact

SEQ ID NO: 3177219 - DNA, 11 bp, Homo sapiens
gcgcatctaac

SEQ ID NO: 3177220 - DNA, 21 bp, Homo sapiens
gcgccaacgttcgatttctac

SEQ ID NO: 3177221 - DNA, 18 bp, Homo sapiens
gcgccactcgcttccccc

SEQ ID NO: 3177222 - DNA, 15 bp, Homo sapiens
gcgccacttcctttg

SEQ ID NO: 3177223 - DNA, 23 bp, Homo sapiens
gcgccacttcctttgtgtttata

SEQ ID NO: 3177224 - DNA, 19 bp, Homo sapiens
gcgccagtgtaatccccca

SEQ ID NO: 3177225 - DNA, 23 bp, Homo sapiens
gcgccagtgtaatcccccaggag

SEQ ID NO: 3177226 - DNA, 12 bp, Homo sapiens
gcgcccacctcc

SEQ ID NO: 3177227 - DNA, 23 bp, Homo sapiens
gcgcccagttgggtggatgcctg

SEQ ID NO: 3177228 - DNA, 13 bp, Homo sapiens
gcgcccccagtgt

SEQ ID NO: 3177229 - DNA, 22 bp, Homo sapiens
gcgccccctccgccctgccact

SEQ ID NO: 3177230 - DNA, 17 bp, Homo sapiens
gcgccccgcccacaccc

SEQ ID NO: 3177231 - DNA, 12 bp, Homo sapiens
gcgcccctggga

SEQ ID NO: 3177232 - DNA, 13 bp, Homo sapiens
gcgccccttcccc

SEQ ID NO: 3177233 - DNA, 20 bp, Homo sapiens
gcgcccttggcttctgtgat

SEQ ID NO: 3177234 - DNA, 22 bp, Homo sapiens
gcgccgtctccaggggctgctt

SEQ ID NO: 3177235 - DNA, 13 bp, Homo sapiens
gcgcctagagcgc

SEQ ID NO: 3177236 - DNA, 20 bp, Homo sapiens
gcgcctagagcgcggctggc

SEQ ID NO: 3177237 - DNA, 20 bp, Homo sapiens
gcgcctcaggctgctggggc

SEQ ID NO: 3177238 - DNA, 19 bp, Homo sapiens
gcgcctccatccaaggcca

SEQ ID NO: 3177239 - DNA, 16 bp, Homo sapiens
gcgcctggcacatttc

SEQ ID NO: 3177240 - DNA, 20 bp, Homo sapiens
gcgcgccctcccttggcgtg

SEQ ID NO: 3177241 - DNA, 17 bp, Homo sapiens
gcgcgctcttcgcgccc

SEQ ID NO: 3177242 - DNA, 14 bp, Homo sapiens
gcgcgggaggcacc

SEQ ID NO: 3177243 - DNA, 16 bp, Homo sapiens
gcgcgggaggcaccag

SEQ ID NO: 3177244 - DNA, 22 bp, Homo sapiens
gcgcgggaggcaccagctctgt

SEQ ID NO: 3177245 - DNA, 15 bp, Homo sapiens
gcgcgggagggggcg

SEQ ID NO: 3177246 - DNA, 16 bp, Homo sapiens
gcgcgggcagccaccc

SEQ ID NO: 3177247 - DNA, 20 bp, Homo sapiens
gcgcggtggcgggcacctgt

SEQ ID NO: 3177248 - DNA, 20 bp, Homo sapiens
gcgcggtggctcacgcctgt

SEQ ID NO: 3177249 - DNA, 19 bp, Homo sapiens
gcgcgtgcatgtgtgcgtg

SEQ ID NO: 3177250 - DNA, 12 bp, Homo sapiens
gcgctcaggacc

SEQ ID NO: 3177251 - DNA, 13 bp, Homo sapiens
gcgctcagggcca

SEQ ID NO: 3177252 - DNA, 16 bp, Homo sapiens
gcgctcagggccatgc

SEQ ID NO: 3177253 - DNA, 14 bp, Homo sapiens
gcgctcagtaaacg

SEQ ID NO: 3177254 - DNA, 15 bp, Homo sapiens
gcgctcccagcctgc

SEQ ID NO: 3177255 - DNA, 11 bp, Homo sapiens
gcgctcctcct

SEQ ID NO: 3177256 - DNA, 16 bp, Homo sapiens
gcgctcgcccagcagg

SEQ ID NO: 3177257 - DNA, 13 bp, Homo sapiens
gcgctctccacca

SEQ ID NO: 3177258 - DNA, 16 bp, Homo sapiens
gcgctctccaccaccc

SEQ ID NO: 3177259 - DNA, 17 bp, Homo sapiens
gcgctcttggtccctgg

SEQ ID NO: 3177260 - DNA, 18 bp, Homo sapiens
gcgctcttggtccctggt

SEQ ID NO: 3177261 - DNA, 13 bp, Homo sapiens
gcgctgctggtgt

SEQ ID NO: 3177262 - DNA, 22 bp, Homo sapiens
gcgctggacgatagcttggagg

SEQ ID NO: 3177263 - DNA, 11 bp, Homo sapiens
gcgctggccca

SEQ ID NO: 3177264 - DNA, 13 bp, Homo sapiens
gcgctggcccagc

SEQ ID NO: 3177265 - DNA, 14 bp, Homo sapiens
gcgctggcccagcc

SEQ ID NO: 3177266 - DNA, 15 bp, Homo sapiens
gcgctggcccagccg

SEQ ID NO: 3177267 - DNA, 16 bp, Homo sapiens
gcgctggcccagccgg

SEQ ID NO: 3177268 - DNA, 17 bp, Homo sapiens
gcgctgggtattggaaa

SEQ ID NO: 3177269 - DNA, 18 bp, Homo sapiens
gcgcttcgcttggtgagt

SEQ ID NO: 3177270 - DNA, 21 bp, Homo sapiens
gcggaagtacttccctcaggc

SEQ ID NO: 3177271 - DNA, 11 bp, Homo sapiens
gcggacagcca

SEQ ID NO: 3177272 - DNA, 13 bp, Homo sapiens
gcggacagccacg

SEQ ID NO: 3177273 - DNA, 23 bp, Homo sapiens
gcggacagccacggccaggccag

SEQ ID NO: 3177274 - DNA, 21 bp, Homo sapiens
gcggaccccagctgtgagcct

SEQ ID NO: 3177275 - DNA, 17 bp, Homo sapiens
gcggacggctgtggacc

SEQ ID NO: 3177276 - DNA, 14 bp, Homo sapiens
gcggacgggctgtc

SEQ ID NO: 3177277 - DNA, 13 bp, Homo sapiens
gcggagcccagcc

SEQ ID NO: 3177278 - DNA, 14 bp, Homo sapiens
gcggagcccagcct

SEQ ID NO: 3177279 - DNA, 19 bp, Homo sapiens
gcggagcccagcctgggag

SEQ ID NO: 3177280 - DNA, 22 bp, Homo sapiens
gcggaggagctgcctgcttggc

SEQ ID NO: 3177281 - DNA, 17 bp, Homo sapiens
gcggaggaggagggagg

SEQ ID NO: 3177282 - DNA, 16 bp, Homo sapiens
gcggaggaggctggtg

SEQ ID NO: 3177283 - DNA, 16 bp, Homo sapiens
gcggaggctgtgtgcc

SEQ ID NO: 3177284 - DNA, 17 bp, Homo sapiens
gcggaggggatccagcc

SEQ ID NO: 3177285 - DNA, 18 bp, Homo sapiens
gcggaggggatccagcca

SEQ ID NO: 3177286 - DNA, 19 bp, Homo sapiens
gcggaggggatccagccac

SEQ ID NO: 3177287 - DNA, 20 bp, Homo sapiens
gcggaggggatccagccact

SEQ ID NO: 3177288 - DNA, 16 bp, Homo sapiens
gcggaggttgcaggga

SEQ ID NO: 3177289 - DNA, 20 bp, Homo sapiens
gcggagtgaagaggggcagc

SEQ ID NO: 3177290 - DNA, 22 bp, Homo sapiens
gcggagtgaagaggggcagccc

SEQ ID NO: 3177291 - DNA, 20 bp, Homo sapiens
gcggatactcttggagagtt

SEQ ID NO: 3177292 - DNA, 14 bp, Homo sapiens
gcggatcctgctgg

SEQ ID NO: 3177293 - DNA, 14 bp, Homo sapiens
gcggcaaaaggaaa

SEQ ID NO: 3177294 - DNA, 15 bp, Homo sapiens
gcggcagggccaggc

SEQ ID NO: 3177295 - DNA, 23 bp, Homo sapiens
gcggccacgcactgggccacgga

SEQ ID NO: 3177296 - DNA, 22 bp, Homo sapiens
gcggccagcgtcccagggtacc

SEQ ID NO: 3177297 - DNA, 12 bp, Homo sapiens
gcggccaggcac

SEQ ID NO: 3177298 - DNA, 15 bp, Homo sapiens
gcggccaggcacagg

SEQ ID NO: 3177299 - DNA, 22 bp, Homo sapiens
gctcgctccctgtagctctgcc

SEQ ID NO: 3177300 - DNA, 14 bp, Homo sapiens
gctcggaggcccca

SEQ ID NO: 3177301 - DNA, 13 bp, Homo sapiens
gctcgtggccttc

SEQ ID NO: 3177302 - DNA, 18 bp, Homo sapiens
gctcgtttttcagcaccc

SEQ ID NO: 3177303 - DNA, 21 bp, Homo sapiens
gctcgtttttcagcaccccca

SEQ ID NO: 3177304 - DNA, 23 bp, Homo sapiens
gctcgtttttcagcacccccacc

SEQ ID NO: 3177305 - DNA, 23 bp, Homo sapiens
gctctaaaaggtaatgtgtggat

SEQ ID NO: 3177306 - DNA, 22 bp, Homo sapiens
gctctacagctaatcagcattc

SEQ ID NO: 3177307 - DNA, 16 bp, Homo sapiens
gctctacatcttctgc

SEQ ID NO: 3177308 - DNA, 18 bp, Homo sapiens
gctctacatcttctgcct

SEQ ID NO: 3177309 - DNA, 20 bp, Homo sapiens
gctctacatcttctgcctta

SEQ ID NO: 3177310 - DNA, 13 bp, Homo sapiens
gctctacccatga

SEQ ID NO: 3177311 - DNA, 16 bp, Homo sapiens
gctctacccatgagcc

SEQ ID NO: 3177312 - DNA, 19 bp, Homo sapiens
gctctacccatgagcctgc

SEQ ID NO: 3177313 - DNA, 20 bp, Homo sapiens
gctctacccatgagcctgcc

SEQ ID NO: 3177314 - DNA, 19 bp, Homo sapiens
gctctactgaggtgctatg

SEQ ID NO: 3177315 - DNA, 22 bp, Homo sapiens
gctctagatcataaggcttcaa

SEQ ID NO: 3177316 - DNA, 13 bp, Homo sapiens
gctctagccagga

SEQ ID NO: 3177317 - DNA, 24 bp, Homo sapiens
gctctagccaggagtctgtgctct

SEQ ID NO: 3177318 - DNA, 13 bp, Homo sapiens
gctctagctggca

SEQ ID NO: 3177319 - DNA, 14 bp, Homo sapiens
gctctagctggcag

SEQ ID NO: 3177320 - DNA, 18 bp, Homo sapiens
gctctagctggcaggaca

SEQ ID NO: 3177321 - DNA, 14 bp, Homo sapiens
gctctagtgggaca

SEQ ID NO: 3177322 - DNA, 15 bp, Homo sapiens
gctctagtgggacag

SEQ ID NO: 3177323 - DNA, 19 bp, Homo sapiens
gctctagttttcagccttg

SEQ ID NO: 3177324 - DNA, 21 bp, Homo sapiens
gctctatgagtctagatgttt

SEQ ID NO: 3177325 - DNA, 12 bp, Homo sapiens
gctctcagttct

SEQ ID NO: 3177326 - DNA, 16 bp, Homo sapiens
gctctccaaaggggct

SEQ ID NO: 3177327 - DNA, 16 bp, Homo sapiens
gctctccaagtgccag

SEQ ID NO: 3177328 - DNA, 18 bp, Homo sapiens
gctctccaagtgccagag

SEQ ID NO: 3177329 - DNA, 20 bp, Homo sapiens
gctctccaagtgccagaggt

SEQ ID NO: 3177330 - DNA, 11 bp, Homo sapiens
gctctccacca

SEQ ID NO: 3177331 - DNA, 13 bp, Homo sapiens
gctctccagctcc

SEQ ID NO: 3177332 - DNA, 19 bp, Homo sapiens
gctctccagtcaggaggca

SEQ ID NO: 3177333 - DNA, 17 bp, Homo sapiens
gctctcccatttcctga

SEQ ID NO: 3177334 - DNA, 17 bp, Homo sapiens
gctctcccctcccagtc

SEQ ID NO: 3177335 - DNA, 23 bp, Homo sapiens
gctctccctcttctcaagtgcct

SEQ ID NO: 3177336 - DNA, 24 bp, Homo sapiens
gctctccctcttctcaagtgcctt

SEQ ID NO: 3177337 - DNA, 19 bp, Homo sapiens
gctctcctcttgccactgc

SEQ ID NO: 3177338 - DNA, 14 bp, Homo sapiens
gctctcctggctcc

SEQ ID NO: 3177339 - DNA, 15 bp, Homo sapiens
gctctcctggctccc

SEQ ID NO: 3177340 - DNA, 18 bp, Homo sapiens
gctctcctggctccctcc

SEQ ID NO: 3177341 - DNA, 12 bp, Homo sapiens
gctctctccagg

SEQ ID NO: 3177342 - DNA, 13 bp, Homo sapiens
gctctctgagact

SEQ ID NO: 3177343 - DNA, 13 bp, Homo sapiens
gctctctggcctt

SEQ ID NO: 3177344 - DNA, 17 bp, Homo sapiens
gctctctgggacctcct

SEQ ID NO: 3177345 - DNA, 20 bp, Homo sapiens
gctctctgtgggctggcagt

SEQ ID NO: 3177346 - DNA, 14 bp, Homo sapiens
gctctcttcttact

SEQ ID NO: 3177347 - DNA, 18 bp, Homo sapiens
gctctcttttctgtactt

SEQ ID NO: 3177348 - DNA, 17 bp, Homo sapiens
gctctgacatcccttcc

SEQ ID NO: 3177349 - DNA, 18 bp, Homo sapiens
gctctgacatcccttcct

SEQ ID NO: 3177350 - DNA, 19 bp, Homo sapiens
gctctgacatcccttcctg

SEQ ID NO: 3177351 - DNA, 11 bp, Homo sapiens
gctctgagaat

SEQ ID NO: 3177352 - DNA, 14 bp, Homo sapiens
gctctgagaatcac

SEQ ID NO: 3177353 - DNA, 13 bp, Homo sapiens
gctctgagagtct

SEQ ID NO: 3177354 - DNA, 21 bp, Homo sapiens
gctctgagagtctagattctc

SEQ ID NO: 3177355 - DNA, 17 bp, Homo sapiens
gctctgagatcctggag

SEQ ID NO: 3177356 - DNA, 15 bp, Homo sapiens
gctctgaggggaggg

SEQ ID NO: 3177357 - DNA, 20 bp, Homo sapiens
gctctgatcatccactgtgc

SEQ ID NO: 3177358 - DNA, 23 bp, Homo sapiens
gctctgatcatccactgtgccat

SEQ ID NO: 3177359 - DNA, 11 bp, Homo sapiens
gctctgcacag

SEQ ID NO: 3177360 - DNA, 23 bp, Homo sapiens
gctctgcacagacaagcagccct

SEQ ID NO: 3177361 - DNA, 14 bp, Homo sapiens
gctctgccccaagc

SEQ ID NO: 3177362 - DNA, 16 bp, Homo sapiens
gctctgccccaagccc

SEQ ID NO: 3177363 - DNA, 18 bp, Homo sapiens
gctctgccccagctctgg

SEQ ID NO: 3177364 - DNA, 13 bp, Homo sapiens
gctctgccccagt

SEQ ID NO: 3177365 - DNA, 13 bp, Homo sapiens
gctctgcctcccg

SEQ ID NO: 3177366 - DNA, 14 bp, Homo sapiens
gctctgctcctctc

SEQ ID NO: 3177367 - DNA, 19 bp, Homo sapiens
gctctgctcctctccccag

SEQ ID NO: 3177368 - DNA, 18 bp, Homo sapiens
gctctgctgacagacaca

SEQ ID NO: 3177369 - DNA, 19 bp, Homo sapiens
gctctgctgacagacacag

SEQ ID NO: 3177370 - DNA, 23 bp, Homo sapiens
gctctgctgacagacacaggccc

SEQ ID NO: 3177371 - DNA, 15 bp, Homo sapiens
gctctgctggcctgg

SEQ ID NO: 3177372 - DNA, 21 bp, Homo sapiens
gctctgctggcctggccggca

SEQ ID NO: 3177373 - DNA, 11 bp, Homo sapiens
gctctgctggt

SEQ ID NO: 3177374 - DNA, 20 bp, Homo sapiens
gctctgctggtggaaagcga

SEQ ID NO: 3177375 - DNA, 15 bp, Homo sapiens
gctctggaagagagg

SEQ ID NO: 3177376 - DNA, 22 bp, Homo sapiens
gctctggaataaagttgcagat

SEQ ID NO: 3177377 - DNA, 13 bp, Homo sapiens
gctctggagaaca

SEQ ID NO: 3177378 - DNA, 15 bp, Homo sapiens
gctctggagaacagt

SEQ ID NO: 3177379 - DNA, 20 bp, Homo sapiens
gctctggagacagccccaga

SEQ ID NO: 3177380 - DNA, 14 bp, Homo sapiens
gctctggagagaaa

SEQ ID NO: 3177381 - DNA, 15 bp, Homo sapiens
gctctggagagaaac

SEQ ID NO: 3177382 - DNA, 13 bp, Homo sapiens
gctctggagggga

SEQ ID NO: 3177383 - DNA, 15 bp, Homo sapiens
gctctggaggggagg

SEQ ID NO: 3177384 - DNA, 16 bp, Homo sapiens
gctctggaggggaggg

SEQ ID NO: 3177385 - DNA, 23 bp, Homo sapiens
gctctggcggcttcctgtccact

SEQ ID NO: 3177386 - DNA, 19 bp, Homo sapiens
gctctggctgaaccctgtg

SEQ ID NO: 3177387 - DNA, 11 bp, Homo sapiens
gctctgggctc

SEQ ID NO: 3177388 - DNA, 16 bp, Homo sapiens
gctctgggctcagggc

SEQ ID NO: 3177389 - DNA, 19 bp, Homo sapiens
gctctgggctcagggctgg

SEQ ID NO: 3177390 - DNA, 23 bp, Homo sapiens
gctctgggctcagggctggagtg

SEQ ID NO: 3177391 - DNA, 19 bp, Homo sapiens
gctctggggtgggcagttt

SEQ ID NO: 3177392 - DNA, 22 bp, Homo sapiens
gctctggttgtttctgttccaa

SEQ ID NO: 3177393 - DNA, 16 bp, Homo sapiens
gctctgtcctgggagt

SEQ ID NO: 3177394 - DNA, 14 bp, Homo sapiens
gctctgtgcagtca

SEQ ID NO: 3177395 - DNA, 11 bp, Homo sapiens
gctctgtggcc

SEQ ID NO: 3177396 - DNA, 15 bp, Homo sapiens
gctctgtggcctgtg

SEQ ID NO: 3177397 - DNA, 19 bp, Homo sapiens
gctctgtggcctgtgtcca

SEQ ID NO: 3177398 - DNA, 15 bp, Homo sapiens
gctctgtgtatatct

SEQ ID NO: 3177399 - DNA, 21 bp, Homo sapiens
gctctgtgtatatctcttgga

SEQ ID NO: 3177400 - DNA, 17 bp, Homo sapiens
gctctgtgttgccatgt

SEQ ID NO: 3177401 - DNA, 19 bp, Homo sapiens
gctcttagcagcttccaga

SEQ ID NO: 3177402 - DNA, 19 bp, Homo sapiens
gctcttagctttctcaggg

SEQ ID NO: 3177403 - DNA, 16 bp, Homo sapiens
gctcttagtgcccgcc

SEQ ID NO: 3177404 - DNA, 17 bp, Homo sapiens
gctcttatgtgtgcctt

SEQ ID NO: 3177405 - DNA, 17 bp, Homo sapiens
gctcttatttctgaatt

SEQ ID NO: 3177406 - DNA, 16 bp, Homo sapiens
gctcttcaagctgtcc

SEQ ID NO: 3177407 - DNA, 12 bp, Homo sapiens
gctcttcacagt

SEQ ID NO: 3177408 - DNA, 18 bp, Homo sapiens
gctcttcaggcctccctc

SEQ ID NO: 3177409 - DNA, 15 bp, Homo sapiens
gctcttcctggacct

SEQ ID NO: 3177410 - DNA, 14 bp, Homo sapiens
gctcttctccaggc

SEQ ID NO: 3177411 - DNA, 23 bp, Homo sapiens
gctcttctcctttcacaaccttc

SEQ ID NO: 3177412 - DNA, 19 bp, Homo sapiens
gctcttgcccttccctgtc

SEQ ID NO: 3177413 - DNA, 19 bp, Homo sapiens
gctcttggtccctggtccc

SEQ ID NO: 3177414 - DNA, 21 bp, Homo sapiens
gctcttggtccctggtccctc

SEQ ID NO: 3177415 - DNA, 14 bp, Homo sapiens
gctcttgtcccacg

SEQ ID NO: 3177416 - DNA, 15 bp, Homo sapiens
gctcttgtcccacgt

SEQ ID NO: 3177417 - DNA, 21 bp, Homo sapiens
gctctttatgaatgaaaaaac

SEQ ID NO: 3177418 - DNA, 13 bp, Homo sapiens
gctctttcccttt

SEQ ID NO: 3177419 - DNA, 16 bp, Homo sapiens
gctctttcccttttct

SEQ ID NO: 3177420 - DNA, 22 bp, Homo sapiens
gctctttcccttttctgtttag

SEQ ID NO: 3177421 - DNA, 19 bp, Homo sapiens
gctctttctacatgactgg

SEQ ID NO: 3177422 - DNA, 20 bp, Homo sapiens
gctctttctacatgactggg

SEQ ID NO: 3177423 - DNA, 17 bp, Homo sapiens
gctctttctactctgaa

SEQ ID NO: 3177424 - DNA, 14 bp, Homo sapiens
gctctttctgggcc

SEQ ID NO: 3177425 - DNA, 20 bp, Homo sapiens
gctggagaccatgcagagcg

SEQ ID NO: 3177426 - DNA, 13 bp, Homo sapiens
gctggagcctgag

SEQ ID NO: 3177427 - DNA, 14 bp, Homo sapiens
gctggaggcccagg

SEQ ID NO: 3177428 - DNA, 18 bp, Homo sapiens
gctggaggctccaggact

SEQ ID NO: 3177429 - DNA, 19 bp, Homo sapiens
gctggaggtgggagcagga

SEQ ID NO: 3177430 - DNA, 21 bp, Homo sapiens
gctggaggtgggagcaggaga

SEQ ID NO: 3177431 - DNA, 23 bp, Homo sapiens
gctggaggtggggcgaggcaggc

SEQ ID NO: 3177432 - DNA, 16 bp, Homo sapiens
gctggagtctggcttt

SEQ ID NO: 3177433 - DNA, 14 bp, Homo sapiens
gctggagtgcagtg

SEQ ID NO: 3177434 - DNA, 15 bp, Homo sapiens
gctggagtgcagtga

SEQ ID NO: 3177435 - DNA, 18 bp, Homo sapiens
gctggagtgcagtgagcc

SEQ ID NO: 3177436 - DNA, 19 bp, Homo sapiens
gctggagtgcagtggtgca

SEQ ID NO: 3177437 - DNA, 14 bp, Homo sapiens
gctggataaaatga

SEQ ID NO: 3177438 - DNA, 18 bp, Homo sapiens
gctggatataatgtattt

SEQ ID NO: 3177439 - DNA, 14 bp, Homo sapiens
gctggatggagccc

SEQ ID NO: 3177440 - DNA, 16 bp, Homo sapiens
gctggatggagcccag

SEQ ID NO: 3177441 - DNA, 18 bp, Homo sapiens
gctggattaatgttttgt

SEQ ID NO: 3177442 - DNA, 16 bp, Homo sapiens
gctggcacccaccgtg

SEQ ID NO: 3177443 - DNA, 21 bp, Homo sapiens
gctggcacccaccgtggagga

SEQ ID NO: 3177444 - DNA, 20 bp, Homo sapiens
gctggcagctgagagccctg

SEQ ID NO: 3177445 - DNA, 15 bp, Homo sapiens
gctggcatgttttct

SEQ ID NO: 3177446 - DNA, 22 bp, Homo sapiens
gctggcattaccctctgcagaa

SEQ ID NO: 3177447 - DNA, 12 bp, Homo sapiens
gctggccactgc

SEQ ID NO: 3177448 - DNA, 19 bp, Homo sapiens
gctggccagcaaggcaggt

SEQ ID NO: 3177449 - DNA, 21 bp, Homo sapiens
gctggccagcaaggcaggttg

SEQ ID NO: 3177450 - DNA, 21 bp, Homo sapiens
gctggccagcaccctctcctg

SEQ ID NO: 3177451 - DNA, 12 bp, Homo sapiens
gctggccagcct

SEQ ID NO: 3177452 - DNA, 15 bp, Homo sapiens
gctggccagtccagg

SEQ ID NO: 3177453 - DNA, 17 bp, Homo sapiens
gctggccagtccaggct

SEQ ID NO: 3177454 - DNA, 18 bp, Homo sapiens
gctggcccagccggcctc

SEQ ID NO: 3177455 - DNA, 18 bp, Homo sapiens
gctggccccagccctgct

SEQ ID NO: 3177456 - DNA, 20 bp, Homo sapiens
gctggccccagggcaccctg

SEQ ID NO: 3177457 - DNA, 12 bp, Homo sapiens
gctggccctgcc

SEQ ID NO: 3177458 - DNA, 16 bp, Homo sapiens
gctggccctgcctcct

SEQ ID NO: 3177459 - DNA, 21 bp, Homo sapiens
gctggccctgcctcctgggaa

SEQ ID NO: 3177460 - DNA, 24 bp, Homo sapiens
gctggccgagggtcctggctcctg

SEQ ID NO: 3177461 - DNA, 21 bp, Homo sapiens
gctggcctcacccacccctgc

SEQ ID NO: 3177462 - DNA, 23 bp, Homo sapiens
gctggcctctggctctcatgggg

SEQ ID NO: 3177463 - DNA, 15 bp, Homo sapiens
gctggcctggatctc

SEQ ID NO: 3177464 - DNA, 12 bp, Homo sapiens
gctggccttcct

SEQ ID NO: 3177465 - DNA, 15 bp, Homo sapiens
gctggccttcctgcc

SEQ ID NO: 3177466 - DNA, 13 bp, Homo sapiens
gctggcgcagcca

SEQ ID NO: 3177467 - DNA, 16 bp, Homo sapiens
gctggcgcagccaagg

SEQ ID NO: 3177468 - DNA, 17 bp, Homo sapiens
gctggcgcagccaaggc

SEQ ID NO: 3177469 - DNA, 20 bp, Homo sapiens
gctggcgcagccaaggccga

SEQ ID NO: 3177470 - DNA, 20 bp, Homo sapiens
gctggcgcatattaagcact

SEQ ID NO: 3177471 - DNA, 20 bp, Homo sapiens
gctggcgtgcagtggtgcga

SEQ ID NO: 3177472 - DNA, 18 bp, Homo sapiens
gctggctcacagtacagc

SEQ ID NO: 3177473 - DNA, 13 bp, Homo sapiens
gctggctcctagg

SEQ ID NO: 3177474 - DNA, 13 bp, Homo sapiens
gctggctctgaga

SEQ ID NO: 3177475 - DNA, 15 bp, Homo sapiens
gctggctctgcacta

SEQ ID NO: 3177476 - DNA, 20 bp, Homo sapiens
gctggctctgcactaagaga

SEQ ID NO: 3177477 - DNA, 22 bp, Homo sapiens
gctggctctgcactaagagaaa

SEQ ID NO: 3177478 - DNA, 19 bp, Homo sapiens
gctggctctgtggaggggc

SEQ ID NO: 3177479 - DNA, 13 bp, Homo sapiens
gctggctgcagtg

SEQ ID NO: 3177480 - DNA, 14 bp, Homo sapiens
gctggctgcagtga

SEQ ID NO: 3177481 - DNA, 16 bp, Homo sapiens
gctggctgggcatgga

SEQ ID NO: 3177482 - DNA, 19 bp, Homo sapiens
gctggctgttggctggggg

SEQ ID NO: 3177483 - DNA, 16 bp, Homo sapiens
gctggcttccagcttc

SEQ ID NO: 3177484 - DNA, 19 bp, Homo sapiens
gctggcttccagcttcagg

SEQ ID NO: 3177485 - DNA, 20 bp, Homo sapiens
gctggcttccagcttcaggc

SEQ ID NO: 3177486 - DNA, 18 bp, Homo sapiens
gctggcttgtttgatttc

SEQ ID NO: 3177487 - DNA, 17 bp, Homo sapiens
gctggctttgggaaagc

SEQ ID NO: 3177488 - DNA, 23 bp, Homo sapiens
gctggctttgggaaagcccagac

SEQ ID NO: 3177489 - DNA, 19 bp, Homo sapiens
gctgggaaccccgcagccc

SEQ ID NO: 3177490 - DNA, 20 bp, Homo sapiens
gctgggaagagaagagggcc

SEQ ID NO: 3177491 - DNA, 20 bp, Homo sapiens
gctgggaccagagccagatg

SEQ ID NO: 3177492 - DNA, 23 bp, Homo sapiens
gctgggactcagccttcagacag

SEQ ID NO: 3177493 - DNA, 15 bp, Homo sapiens
gctgggactcctggt

SEQ ID NO: 3177494 - DNA, 14 bp, Homo sapiens
gctgggactggcca

SEQ ID NO: 3177495 - DNA, 17 bp, Homo sapiens
gctgggacttcttaccc

SEQ ID NO: 3177496 - DNA, 19 bp, Homo sapiens
gctgggacttcttacccaa

SEQ ID NO: 3177497 - DNA, 23 bp, Homo sapiens
gctgggacttcttacccaaagca

SEQ ID NO: 3177498 - DNA, 14 bp, Homo sapiens
gctgggagcactgg

SEQ ID NO: 3177499 - DNA, 14 bp, Homo sapiens
gctgggagctccac

SEQ ID NO: 3177500 - DNA, 22 bp, Homo sapiens
gctgggagctccactctgcttc

SEQ ID NO: 3177501 - DNA, 15 bp, Homo sapiens
gctgggagctctgca

SEQ ID NO: 3177502 - DNA, 14 bp, Homo sapiens
gctgggaggaaggg

SEQ ID NO: 3177503 - DNA, 18 bp, Homo sapiens
gctgggaggagggagagg

SEQ ID NO: 3177504 - DNA, 22 bp, Homo sapiens
gctgggaggagggagagggagg

SEQ ID NO: 3177505 - DNA, 20 bp, Homo sapiens
gctgggaggcatggccctgg

SEQ ID NO: 3177506 - DNA, 13 bp, Homo sapiens
gctgggagttcta

SEQ ID NO: 3177507 - DNA, 19 bp, Homo sapiens
gctgggagttctagaacca

SEQ ID NO: 3177508 - DNA, 15 bp, Homo sapiens
gctgggcaaagccac

SEQ ID NO: 3177509 - DNA, 16 bp, Homo sapiens
gctgggcagccccaga

SEQ ID NO: 3177510 - DNA, 17 bp, Homo sapiens
gctgggccactggggac

SEQ ID NO: 3177511 - DNA, 19 bp, Homo sapiens
gctgggccatgtccaaaga

SEQ ID NO: 3177512 - DNA, 20 bp, Homo sapiens
gctgggccatgtccaaagag

SEQ ID NO: 3177513 - DNA, 17 bp, Homo sapiens
gctgggcccagcccctc

SEQ ID NO: 3177514 - DNA, 14 bp, Homo sapiens
gctgggccccatgc

SEQ ID NO: 3177515 - DNA, 16 bp, Homo sapiens
gctgggccccatgctc

SEQ ID NO: 3177516 - DNA, 20 bp, Homo sapiens
gctgggccccatgctctgcc

SEQ ID NO: 3177517 - DNA, 21 bp, Homo sapiens
gctgggccccatgctctgccc

SEQ ID NO: 3177518 - DNA, 21 bp, Homo sapiens
gctgggccccccagctcaggg

SEQ ID NO: 3177519 - DNA, 12 bp, Homo sapiens
gctgggcccctg

SEQ ID NO: 3177520 - DNA, 18 bp, Homo sapiens
gctgggcccctgggatgg

SEQ ID NO: 3177521 - DNA, 23 bp, Homo sapiens
gctgggcccctgggatgggacca

SEQ ID NO: 3177522 - DNA, 17 bp, Homo sapiens
gctgggccctctcttct

SEQ ID NO: 3177523 - DNA, 21 bp, Homo sapiens
gctgggccctctttccctgcg

SEQ ID NO: 3177524 - DNA, 19 bp, Homo sapiens
gctgggctcacaggcctct

SEQ ID NO: 3177525 - DNA, 23 bp, Homo sapiens
gctgggctcacaggcctctcttt

SEQ ID NO: 3177526 - DNA, 20 bp, Homo sapiens
gctgggctgggtggcacacc

SEQ ID NO: 3177527 - DNA, 21 bp, Homo sapiens
gctgggcttcagtggcagctg

SEQ ID NO: 3177528 - DNA, 22 bp, Homo sapiens
gctgggcttcagtggcagctgc

SEQ ID NO: 3177529 - DNA, 13 bp, Homo sapiens
gctggggacagag

SEQ ID NO: 3177530 - DNA, 16 bp, Homo sapiens
gctggggactcaggga

SEQ ID NO: 3177531 - DNA, 14 bp, Homo sapiens
gctggggcagaggg

SEQ ID NO: 3177532 - DNA, 21 bp, Homo sapiens
gctggggccgccacggcctgg

SEQ ID NO: 3177533 - DNA, 23 bp, Homo sapiens
gctggggccgccacggcctggct

SEQ ID NO: 3177534 - DNA, 17 bp, Homo sapiens
gctggggcctcagacga

SEQ ID NO: 3177535 - DNA, 17 bp, Homo sapiens
gctggggcggggcccag

SEQ ID NO: 3177536 - DNA, 18 bp, Homo sapiens
gctggggcggggcccagg

SEQ ID NO: 3177537 - DNA, 17 bp, Homo sapiens
gctggggcgtggggagg

SEQ ID NO: 3177538 - DNA, 12 bp, Homo sapiens
gctggggctctc

SEQ ID NO: 3177539 - DNA, 13 bp, Homo sapiens
gctgggggagcct

SEQ ID NO: 3177540 - DNA, 13 bp, Homo sapiens
gctgggggcagga

SEQ ID NO: 3177541 - DNA, 23 bp, Homo sapiens
gctgggggcaggagggccctacc

SEQ ID NO: 3177542 - DNA, 13 bp, Homo sapiens
gctgggggcctca

SEQ ID NO: 3177543 - DNA, 14 bp, Homo sapiens
gctgggggcctcag

SEQ ID NO: 3177544 - DNA, 15 bp, Homo sapiens
gctgggggtgctgga

SEQ ID NO: 3177545 - DNA, 16 bp, Homo sapiens
gctggggtgagagagg

SEQ ID NO: 3177546 - DNA, 17 bp, Homo sapiens
gctgggtcggccctgcc

SEQ ID NO: 3177547 - DNA, 15 bp, Homo sapiens
gctgggtggcacacc

SEQ ID NO: 3177548 - DNA, 15 bp, Homo sapiens
gctgggtggggacag

SEQ ID NO: 3177549 - DNA, 14 bp, Homo sapiens
gctgggttggaggg

SEQ ID NO: 3177550 - DNA, 16 bp, Homo sapiens
gctgggttggtgcaca

SEQ ID NO: 3177551 - DNA, 15 bp, Homo sapiens
gctttagaccctggg

SEQ ID NO: 3177552 - DNA, 15 bp, Homo sapiens
gctttataacaaatg

SEQ ID NO: 3177553 - DNA, 17 bp, Homo sapiens
gctttattatggcttgt

SEQ ID NO: 3177554 - DNA, 21 bp, Homo sapiens
gctttattatggcttgtgaac

SEQ ID NO: 3177555 - DNA, 22 bp, Homo sapiens
gctttattatggcttgtgaact

SEQ ID NO: 3177556 - DNA, 13 bp, Homo sapiens
gctttattcttca

SEQ ID NO: 3177557 - DNA, 13 bp, Homo sapiens
gctttatttttta

SEQ ID NO: 3177558 - DNA, 17 bp, Homo sapiens
gctttattttttaagta

SEQ ID NO: 3177559 - DNA, 21 bp, Homo sapiens
gctttattttttaagtattta

SEQ ID NO: 3177560 - DNA, 22 bp, Homo sapiens
gctttcaaagctaaaatatata

SEQ ID NO: 3177561 - DNA, 22 bp, Homo sapiens
gctttcactaggaaaatcatgt

SEQ ID NO: 3177562 - DNA, 15 bp, Homo sapiens
gctttcagagccagt

SEQ ID NO: 3177563 - DNA, 12 bp, Homo sapiens
gctttcatgatt

SEQ ID NO: 3177564 - DNA, 19 bp, Homo sapiens
gctttcccccaggcgcctg

SEQ ID NO: 3177565 - DNA, 20 bp, Homo sapiens
gctttcccccaggcgcctgc

SEQ ID NO: 3177566 - DNA, 21 bp, Homo sapiens
gctttccccgggggaggaagg

SEQ ID NO: 3177567 - DNA, 14 bp, Homo sapiens
gctttcccctgtgg

SEQ ID NO: 3177568 - DNA, 17 bp, Homo sapiens
gctttcccctgtgggga

SEQ ID NO: 3177569 - DNA, 14 bp, Homo sapiens
gctttccctgtgcc

SEQ ID NO: 3177570 - DNA, 22 bp, Homo sapiens
gctttcctgaatccaaactaat

SEQ ID NO: 3177571 - DNA, 14 bp, Homo sapiens
gctttcctgcccca

SEQ ID NO: 3177572 - DNA, 17 bp, Homo sapiens
gctttcctgccccaggc

SEQ ID NO: 3177573 - DNA, 16 bp, Homo sapiens
gctttcctggtccctc

SEQ ID NO: 3177574 - DNA, 15 bp, Homo sapiens
gctttcctgtttcca

SEQ ID NO: 3177575 - DNA, 18 bp, Homo sapiens
gctttccttctccaggaa

SEQ ID NO: 3177576 - DNA, 18 bp, Homo sapiens
gctttccttgtggcagag

SEQ ID NO: 3177577 - DNA, 22 bp, Homo sapiens
gctttcctttttcccaataaat

SEQ ID NO: 3177578 - DNA, 23 bp, Homo sapiens
gctttctacccagcgagccctgg

SEQ ID NO: 3177579 - DNA, 18 bp, Homo sapiens
gctttctccggggtctgt

SEQ ID NO: 3177580 - DNA, 14 bp, Homo sapiens
gctttctcttttct

SEQ ID NO: 3177581 - DNA, 13 bp, Homo sapiens
gctttctggagag

SEQ ID NO: 3177582 - DNA, 23 bp, Homo sapiens
gctttctggggcctagcgatctc

SEQ ID NO: 3177583 - DNA, 19 bp, Homo sapiens
gctttcttattttgtttga

SEQ ID NO: 3177584 - DNA, 19 bp, Homo sapiens
gctttgactctataagcaa

SEQ ID NO: 3177585 - DNA, 22 bp, Homo sapiens
gctttgaggttgacctgtttct

SEQ ID NO: 3177586 - DNA, 14 bp, Homo sapiens
gctttgcaggctct

SEQ ID NO: 3177587 - DNA, 17 bp, Homo sapiens
gctttgcaggctctggg

SEQ ID NO: 3177588 - DNA, 19 bp, Homo sapiens
gctttgcaggctctgggct

SEQ ID NO: 3177589 - DNA, 12 bp, Homo sapiens
gctttgccaaaa

SEQ ID NO: 3177590 - DNA, 23 bp, Homo sapiens
gctttgccaaaataccagagcct

SEQ ID NO: 3177591 - DNA, 23 bp, Homo sapiens
gctttgcccaacaccagcccctg

SEQ ID NO: 3177592 - DNA, 23 bp, Homo sapiens
gctttgctacaaatttatgcatt

SEQ ID NO: 3177593 - DNA, 19 bp, Homo sapiens
gctttgctgctaccgccct

SEQ ID NO: 3177594 - DNA, 22 bp, Homo sapiens
gctttgctgctaccgccctggg

SEQ ID NO: 3177595 - DNA, 13 bp, Homo sapiens
gctttgctgctat

SEQ ID NO: 3177596 - DNA, 17 bp, Homo sapiens
gctttggacctaatcca

SEQ ID NO: 3177597 - DNA, 18 bp, Homo sapiens
gctttggcagtgttttgg

SEQ ID NO: 3177598 - DNA, 13 bp, Homo sapiens
gctttggctgagg

SEQ ID NO: 3177599 - DNA, 20 bp, Homo sapiens
gctttggctgaggggcttgg

SEQ ID NO: 3177600 - DNA, 22 bp, Homo sapiens
gctttggctgaggggcttggga

SEQ ID NO: 3177601 - DNA, 21 bp, Homo sapiens
gctttgggaggccaaggcagg

SEQ ID NO: 3177602 - DNA, 18 bp, Homo sapiens
gctttgggatcccaccct

SEQ ID NO: 3177603 - DNA, 22 bp, Homo sapiens
gctttgggccgaatcccccagg

SEQ ID NO: 3177604 - DNA, 19 bp, Homo sapiens
gctttgggctgccctggtg

SEQ ID NO: 3177605 - DNA, 20 bp, Homo sapiens
gctttgggctttgcaggctc

SEQ ID NO: 3177606 - DNA, 20 bp, Homo sapiens
gctttggggacagttggcag

SEQ ID NO: 3177607 - DNA, 20 bp, Homo sapiens
gctttggtctcttctttcat

SEQ ID NO: 3177608 - DNA, 21 bp, Homo sapiens
gctttgtaagatccaccccct

SEQ ID NO: 3177609 - DNA, 15 bp, Homo sapiens
gctttgtgtgattga

SEQ ID NO: 3177610 - DNA, 16 bp, Homo sapiens
gctttgtgtgattgaa

SEQ ID NO: 3177611 - DNA, 14 bp, Homo sapiens
gctttgttttaata

SEQ ID NO: 3177612 - DNA, 14 bp, Homo sapiens
gctttgttttatat

SEQ ID NO: 3177613 - DNA, 12 bp, Homo sapiens
gcttttaagaaa

SEQ ID NO: 3177614 - DNA, 19 bp, Homo sapiens
gcttttaagaaacacaggg

SEQ ID NO: 3177615 - DNA, 15 bp, Homo sapiens
gcttttaattaaata

SEQ ID NO: 3177616 - DNA, 21 bp, Homo sapiens
gcttttacgtagtaaaagtca

SEQ ID NO: 3177617 - DNA, 22 bp, Homo sapiens
gcttttacgtagtaaaagtcat

SEQ ID NO: 3177618 - DNA, 17 bp, Homo sapiens
gcttttaggagaattca

SEQ ID NO: 3177619 - DNA, 19 bp, Homo sapiens
gcttttatagaggctagct

SEQ ID NO: 3177620 - DNA, 22 bp, Homo sapiens
gcttttatagaggctagcttct

SEQ ID NO: 3177621 - DNA, 13 bp, Homo sapiens
gcttttatggatg

SEQ ID NO: 3177622 - DNA, 17 bp, Homo sapiens
gcttttattaaatttgt

SEQ ID NO: 3177623 - DNA, 15 bp, Homo sapiens
gcttttattgtataa

SEQ ID NO: 3177624 - DNA, 21 bp, Homo sapiens
gcttttattttaatattgatg

SEQ ID NO: 3177625 - DNA, 16 bp, Homo sapiens
gcttttattttgaaaa

SEQ ID NO: 3177626 - DNA, 22 bp, Homo sapiens
gcttttcactgctggctgcctt

SEQ ID NO: 3177627 - DNA, 22 bp, Homo sapiens
gcttttcatgtagaactcagca

SEQ ID NO: 3177628 - DNA, 22 bp, Homo sapiens
gcttttcctatttgttttcatg

SEQ ID NO: 3177629 - DNA, 17 bp, Homo sapiens
gcttttcctcaagcaat

SEQ ID NO: 3177630 - DNA, 16 bp, Homo sapiens
gcttttctcctctttc

SEQ ID NO: 3177631 - DNA, 17 bp, Homo sapiens
gcttttctcctctttcc

SEQ ID NO: 3177632 - DNA, 17 bp, Homo sapiens
gcttttctcttgctaat

SEQ ID NO: 3177633 - DNA, 17 bp, Homo sapiens
gcttttctgccctggct

SEQ ID NO: 3177634 - DNA, 18 bp, Homo sapiens
gcttttctgccctggctg

SEQ ID NO: 3177635 - DNA, 22 bp, Homo sapiens
gcttttctggggcccaggaagc

SEQ ID NO: 3177636 - DNA, 15 bp, Homo sapiens
gcttttcttagtgtg

SEQ ID NO: 3177637 - DNA, 15 bp, Homo sapiens
gcttttctttttctg

SEQ ID NO: 3177638 - DNA, 15 bp, Homo sapiens
gcttttgagcctcag

SEQ ID NO: 3177639 - DNA, 18 bp, Homo sapiens
gcttttgttgtgactttt

SEQ ID NO: 3177640 - DNA, 19 bp, Homo sapiens
gcttttgtttgctctttta

SEQ ID NO: 3177641 - DNA, 19 bp, Homo sapiens
gctttttattcctcctgct

SEQ ID NO: 3177642 - DNA, 15 bp, Homo sapiens
gctttttcctctgag

SEQ ID NO: 3177643 - DNA, 19 bp, Homo sapiens
gctttttcctctgagccca

SEQ ID NO: 3177644 - DNA, 18 bp, Homo sapiens
gctttttgatcctctact

SEQ ID NO: 3177645 - DNA, 15 bp, Homo sapiens
gctttttggcacagt

SEQ ID NO: 3177646 - DNA, 14 bp, Homo sapiens
gctttttggtgtat

SEQ ID NO: 3177647 - DNA, 15 bp, Homo sapiens
gctttttttcttaaa

SEQ ID NO: 3177648 - DNA, 19 bp, Homo sapiens
gctttttttcttgctagta

SEQ ID NO: 3177649 - DNA, 22 bp, Homo sapiens
gctttttttgcctaccatttca

SEQ ID NO: 3177650 - DNA, 17 bp, Homo sapiens
ggaaaaaaatgaatgag

SEQ ID NO: 3177651 - DNA, 15 bp, Homo sapiens
ggaaaaaagttttga

SEQ ID NO: 3177652 - DNA, 15 bp, Homo sapiens
ggaaaaatccagaaa

SEQ ID NO: 3177653 - DNA, 13 bp, Homo sapiens
ggaaaaatggttg

SEQ ID NO: 3177654 - DNA, 15 bp, Homo sapiens
ggaaaaatgtatcca

SEQ ID NO: 3177655 - DNA, 14 bp, Homo sapiens
ggaaaaatgtttgt

SEQ ID NO: 3177656 - DNA, 22 bp, Homo sapiens
ggaaaacagaacatcattagaa

SEQ ID NO: 3177657 - DNA, 22 bp, Homo sapiens
ggaaaaccagactacttgggag

SEQ ID NO: 3177658 - DNA, 12 bp, Homo sapiens
ggaaaaccagga

SEQ ID NO: 3177659 - DNA, 13 bp, Homo sapiens
ggaaaactgtgtt

SEQ ID NO: 3177660 - DNA, 14 bp, Homo sapiens
ggaaaagaatacag

SEQ ID NO: 3177661 - DNA, 18 bp, Homo sapiens
ggaaaagaatacagaaag

SEQ ID NO: 3177662 - DNA, 18 bp, Homo sapiens
ggaaaagataaagaccag

SEQ ID NO: 3177663 - DNA, 21 bp, Homo sapiens
ggaaaagcgtctttaagagac

SEQ ID NO: 3177664 - DNA, 14 bp, Homo sapiens
ggaaaagctgctga

SEQ ID NO: 3177665 - DNA, 18 bp, Homo sapiens
ggaaaagctgctgacagt

SEQ ID NO: 3177666 - DNA, 17 bp, Homo sapiens
ggaaaagggagaaaaag

SEQ ID NO: 3177667 - DNA, 15 bp, Homo sapiens
ggaaaaggttgaata

SEQ ID NO: 3177668 - DNA, 21 bp, Homo sapiens
ggaaaataaacatcagtttct

SEQ ID NO: 3177669 - DNA, 19 bp, Homo sapiens
ggaaaataggctttttaat

SEQ ID NO: 3177670 - DNA, 15 bp, Homo sapiens
ggaaaatatttcctg

SEQ ID NO: 3177671 - DNA, 18 bp, Homo sapiens
ggaaaattttaaaaatac

SEQ ID NO: 3177672 - DNA, 15 bp, Homo sapiens
ggaaacaacatttat

SEQ ID NO: 3177673 - DNA, 22 bp, Homo sapiens
ggaaacagagtccaatttaagg

SEQ ID NO: 3177674 - DNA, 11 bp, Homo sapiens
ggaaacagcat

SEQ ID NO: 3177675 - DNA, 16 bp, Homo sapiens
ggaaacagcatgaata

SEQ ID NO: 3177676 - DNA, 14 bp, Homo sapiens
ggagccaccagttc

SEQ ID NO: 3177677 - DNA, 11 bp, Homo sapiens
ggagccactcc

SEQ ID NO: 3177678 - DNA, 17 bp, Homo sapiens
ggagccactcctgtccc

SEQ ID NO: 3177679 - DNA, 12 bp, Homo sapiens
ggagccagctgc

SEQ ID NO: 3177680 - DNA, 16 bp, Homo sapiens
ggagccagctgctttt

SEQ ID NO: 3177681 - DNA, 15 bp, Homo sapiens
ggagccagtcctcca

SEQ ID NO: 3177682 - DNA, 22 bp, Homo sapiens
ggagccatgcgccccctccgcc

SEQ ID NO: 3177683 - DNA, 23 bp, Homo sapiens
ggagccatgcgccccctccgccc

SEQ ID NO: 3177684 - DNA, 19 bp, Homo sapiens
ggagcccaggcgggagcgg

SEQ ID NO: 3177685 - DNA, 21 bp, Homo sapiens
ggagcccatactcagcctgct

SEQ ID NO: 3177686 - DNA, 18 bp, Homo sapiens
ggagccccagctaccctt

SEQ ID NO: 3177687 - DNA, 22 bp, Homo sapiens
ggagccccaggcctctgtgtcc

SEQ ID NO: 3177688 - DNA, 23 bp, Homo sapiens
ggagccccaggcctctgtgtcct

SEQ ID NO: 3177689 - DNA, 13 bp, Homo sapiens
ggagcccccacca

SEQ ID NO: 3177690 - DNA, 14 bp, Homo sapiens
ggagcccccagata

SEQ ID NO: 3177691 - DNA, 16 bp, Homo sapiens
ggagccccgaggcctt

SEQ ID NO: 3177692 - DNA, 22 bp, Homo sapiens
ggagccccgaggccttctctga

SEQ ID NO: 3177693 - DNA, 16 bp, Homo sapiens
ggagccccgccacagc

SEQ ID NO: 3177694 - DNA, 15 bp, Homo sapiens
ggagcccgtgcagta

SEQ ID NO: 3177695 - DNA, 13 bp, Homo sapiens
ggagcccttgggt

SEQ ID NO: 3177696 - DNA, 21 bp, Homo sapiens
ggagccgaggcctaccccgca

SEQ ID NO: 3177697 - DNA, 21 bp, Homo sapiens
ggagcctagcggagcccagcc

SEQ ID NO: 3177698 - DNA, 22 bp, Homo sapiens
ggagcctagcggagcccagcct

SEQ ID NO: 3177699 - DNA, 23 bp, Homo sapiens
ggagcctagcggagcccagcctg

SEQ ID NO: 3177700 - DNA, 14 bp, Homo sapiens
ggagcctagctcct

SEQ ID NO: 3177701 - DNA, 20 bp, Homo sapiens
ggagcctccactgcctctgg

SEQ ID NO: 3177702 - DNA, 17 bp, Homo sapiens
ggagcctccccctcaga

SEQ ID NO: 3177703 - DNA, 11 bp, Homo sapiens
ggagcctcctg

SEQ ID NO: 3177704 - DNA, 12 bp, Homo sapiens
ggagcctcctgc

SEQ ID NO: 3177705 - DNA, 22 bp, Homo sapiens
ggagcctgagtcagggcccaga

SEQ ID NO: 3177706 - DNA, 23 bp, Homo sapiens
ggagcctgagtcagggcccagag

SEQ ID NO: 3177707 - DNA, 14 bp, Homo sapiens
ggagcctgctctcc

SEQ ID NO: 3177708 - DNA, 20 bp, Homo sapiens
ggagcctggcacaggactga

SEQ ID NO: 3177709 - DNA, 13 bp, Homo sapiens
ggagccttcccaa

SEQ ID NO: 3177710 - DNA, 21 bp, Homo sapiens
ggagccttcccaagttgtgct

SEQ ID NO: 3177711 - DNA, 23 bp, Homo sapiens
ggagccttcccaagttgtgcttg

SEQ ID NO: 3177712 - DNA, 20 bp, Homo sapiens
ggagcctttggttctggcca

SEQ ID NO: 3177713 - DNA, 22 bp, Homo sapiens
ggagcgaagccttctgcagcag

SEQ ID NO: 3177714 - DNA, 19 bp, Homo sapiens
ggagcgcacctgccccctg

SEQ ID NO: 3177715 - DNA, 21 bp, Homo sapiens
ggagcgcacctgccccctggt

SEQ ID NO: 3177716 - DNA, 20 bp, Homo sapiens
ggagcggcgccctggacttg

SEQ ID NO: 3177717 - DNA, 21 bp, Homo sapiens
ggagcggcgccctggacttgg

SEQ ID NO: 3177718 - DNA, 16 bp, Homo sapiens
ggagcgtcagggttgg

SEQ ID NO: 3177719 - DNA, 20 bp, Homo sapiens
ggagctaaggctctatgagt

SEQ ID NO: 3177720 - DNA, 20 bp, Homo sapiens
ggagctagcctgaaggattc

SEQ ID NO: 3177721 - DNA, 14 bp, Homo sapiens
ggagctcaccctgc

SEQ ID NO: 3177722 - DNA, 20 bp, Homo sapiens
ggagctcaccctgcccgctc

SEQ ID NO: 3177723 - DNA, 21 bp, Homo sapiens
ggagctcaccctgcccgctcc

SEQ ID NO: 3177724 - DNA, 17 bp, Homo sapiens
ggagctctaccctgctc

SEQ ID NO: 3177725 - DNA, 23 bp, Homo sapiens
ggagctctgggaatttggagtga

SEQ ID NO: 3177726 - DNA, 17 bp, Homo sapiens
ggagctcttcaggcctc

SEQ ID NO: 3177727 - DNA, 18 bp, Homo sapiens
ggagctgatttccaggcc

SEQ ID NO: 3177728 - DNA, 19 bp, Homo sapiens
ggagctgccacagagaagt

SEQ ID NO: 3177729 - DNA, 18 bp, Homo sapiens
ggagctgccttggctcag

SEQ ID NO: 3177730 - DNA, 13 bp, Homo sapiens
ggagctgctggct

SEQ ID NO: 3177731 - DNA, 15 bp, Homo sapiens
ggagctgctggcttg

SEQ ID NO: 3177732 - DNA, 16 bp, Homo sapiens
ggagctgggcccctgc

SEQ ID NO: 3177733 - DNA, 19 bp, Homo sapiens
ggagctgtcaccaaggaaa

SEQ ID NO: 3177734 - DNA, 21 bp, Homo sapiens
ggagcttagccaatgtgggag

SEQ ID NO: 3177735 - DNA, 13 bp, Homo sapiens
ggagcttgcagtg

SEQ ID NO: 3177736 - DNA, 14 bp, Homo sapiens
ggagcttgcagtga

SEQ ID NO: 3177737 - DNA, 13 bp, Homo sapiens
ggaggaaaaaaga

SEQ ID NO: 3177738 - DNA, 22 bp, Homo sapiens
ggaggaaaaccaagccgtggct

SEQ ID NO: 3177739 - DNA, 13 bp, Homo sapiens
ggaggaaaaggaa

SEQ ID NO: 3177740 - DNA, 13 bp, Homo sapiens
ggaggaacacctg

SEQ ID NO: 3177741 - DNA, 14 bp, Homo sapiens
ggaggaagcttggg

SEQ ID NO: 3177742 - DNA, 14 bp, Homo sapiens
ggaggaaggcaaga

SEQ ID NO: 3177743 - DNA, 15 bp, Homo sapiens
ggaggaaggtgctga

SEQ ID NO: 3177744 - DNA, 16 bp, Homo sapiens
ggaggacaggcaggcc

SEQ ID NO: 3177745 - DNA, 21 bp, Homo sapiens
ggaggacgctctctggccttc

SEQ ID NO: 3177746 - DNA, 13 bp, Homo sapiens
ggaggagaatgag

SEQ ID NO: 3177747 - DNA, 12 bp, Homo sapiens
ggaggagagaga

SEQ ID NO: 3177748 - DNA, 16 bp, Homo sapiens
ggaggagcagcttcct

SEQ ID NO: 3177749 - DNA, 22 bp, Homo sapiens
ggaggagcctgtgcgtcccagc

SEQ ID NO: 3177750 - DNA, 21 bp, Homo sapiens
ggaggagcgaaatctaaattt

SEQ ID NO: 3177751 - DNA, 12 bp, Homo sapiens
ggaggagctgcc

SEQ ID NO: 3177752 - DNA, 15 bp, Homo sapiens
ggaggaggaaggcaa

SEQ ID NO: 3177753 - DNA, 15 bp, Homo sapiens
ggaggaggagggagg

SEQ ID NO: 3177754 - DNA, 13 bp, Homo sapiens
ggaggaggccacc

SEQ ID NO: 3177755 - DNA, 16 bp, Homo sapiens
ggaggaggccacctct

SEQ ID NO: 3177756 - DNA, 12 bp, Homo sapiens
ggaggagggaga

SEQ ID NO: 3177757 - DNA, 15 bp, Homo sapiens
ggaggagggagaaga

SEQ ID NO: 3177758 - DNA, 13 bp, Homo sapiens
ggaggagggagag

SEQ ID NO: 3177759 - DNA, 17 bp, Homo sapiens
ggaggagggatgctgct

SEQ ID NO: 3177760 - DNA, 15 bp, Homo sapiens
ggaggagggttgtgc

SEQ ID NO: 3177761 - DNA, 21 bp, Homo sapiens
ggaggagggtttgggcagagc

SEQ ID NO: 3177762 - DNA, 20 bp, Homo sapiens
ggaggaggtggcagccctgt

SEQ ID NO: 3177763 - DNA, 17 bp, Homo sapiens
ggaggatcactggagcc

SEQ ID NO: 3177764 - DNA, 21 bp, Homo sapiens
ggaggatcactggagcccagg

SEQ ID NO: 3177765 - DNA, 22 bp, Homo sapiens
ggaggatcactggagcccagga

SEQ ID NO: 3177766 - DNA, 12 bp, Homo sapiens
ggaggatggaga

SEQ ID NO: 3177767 - DNA, 13 bp, Homo sapiens
ggaggatggagag

SEQ ID NO: 3177768 - DNA, 20 bp, Homo sapiens
ggaggatgtccctgggccag

SEQ ID NO: 3177769 - DNA, 15 bp, Homo sapiens
ggaggatgttctggg

SEQ ID NO: 3177770 - DNA, 20 bp, Homo sapiens
ggaggcaagagactgggagc

SEQ ID NO: 3177771 - DNA, 23 bp, Homo sapiens
ggaggcaagaggggtggagactg

SEQ ID NO: 3177772 - DNA, 12 bp, Homo sapiens
ggaggcaagcaa

SEQ ID NO: 3177773 - DNA, 14 bp, Homo sapiens
ggaggcagagacct

SEQ ID NO: 3177774 - DNA, 12 bp, Homo sapiens
ggaggcagagtt

SEQ ID NO: 3177775 - DNA, 13 bp, Homo sapiens
ggaggcagccccc

SEQ ID NO: 3177776 - DNA, 11 bp, Homo sapiens
ggaggcagcct

SEQ ID NO: 3177777 - DNA, 14 bp, Homo sapiens
ggaggcatctgcac

SEQ ID NO: 3177778 - DNA, 15 bp, Homo sapiens
ggaggcatggccctg

SEQ ID NO: 3177779 - DNA, 16 bp, Homo sapiens
ggaggcatggccctgg

SEQ ID NO: 3177780 - DNA, 14 bp, Homo sapiens
ggaggccaaccagc

SEQ ID NO: 3177781 - DNA, 18 bp, Homo sapiens
ggaggccaaccagcccga

SEQ ID NO: 3177782 - DNA, 13 bp, Homo sapiens
ggaggccaaggca

SEQ ID NO: 3177783 - DNA, 17 bp, Homo sapiens
ggaggccaataaaaagt

SEQ ID NO: 3177784 - DNA, 19 bp, Homo sapiens
ggaggccaataaaaagttc

SEQ ID NO: 3177785 - DNA, 12 bp, Homo sapiens
ggaggccacctc

SEQ ID NO: 3177786 - DNA, 21 bp, Homo sapiens
ggaggccacctctccaagggc

SEQ ID NO: 3177787 - DNA, 17 bp, Homo sapiens
ggaggccagtgggcggg

SEQ ID NO: 3177788 - DNA, 22 bp, Homo sapiens
ggaggcccaggctgggaactca

SEQ ID NO: 3177789 - DNA, 15 bp, Homo sapiens
ggaggccccaaagga

SEQ ID NO: 3177790 - DNA, 16 bp, Homo sapiens
ggaggccccactgatg

SEQ ID NO: 3177791 - DNA, 22 bp, Homo sapiens
ggaggccccagctctgagggga

SEQ ID NO: 3177792 - DNA, 15 bp, Homo sapiens
ggaggcccctggagc

SEQ ID NO: 3177793 - DNA, 23 bp, Homo sapiens
ggaggccctcctgtgctggggga

SEQ ID NO: 3177794 - DNA, 11 bp, Homo sapiens
ggaggccctgg

SEQ ID NO: 3177795 - DNA, 12 bp, Homo sapiens
ggaggccctggc

SEQ ID NO: 3177796 - DNA, 14 bp, Homo sapiens
ggaggccctggccc

SEQ ID NO: 3177797 - DNA, 16 bp, Homo sapiens
ggaggccctggccctt

SEQ ID NO: 3177798 - DNA, 12 bp, Homo sapiens
ggaggcctctgg

SEQ ID NO: 3177799 - DNA, 14 bp, Homo sapiens
ggaggcctctggcc

SEQ ID NO: 3177800 - DNA, 13 bp, Homo sapiens
ggaggcgcccttg

SEQ ID NO: 3177801 - DNA, 17 bp, Homo sapiens
ggaggcgcggcctcccg

SEQ ID NO: 3177802 - DNA, 18 bp, Homo sapiens
ggaggcgtctcgggagag

SEQ ID NO: 3177803 - DNA, 18 bp, Homo sapiens
ggcagaggatgtctcaaa

SEQ ID NO: 3177804 - DNA, 22 bp, Homo sapiens
ggcagagggaatgttccctgca

SEQ ID NO: 3177805 - DNA, 21 bp, Homo sapiens
ggcagagggctggaggcccag

SEQ ID NO: 3177806 - DNA, 16 bp, Homo sapiens
ggcagaggggcagccg

SEQ ID NO: 3177807 - DNA, 17 bp, Homo sapiens
ggcagaggggcagccgc

SEQ ID NO: 3177808 - DNA, 22 bp, Homo sapiens
ggcagagggttgcagtgagccg

SEQ ID NO: 3177809 - DNA, 15 bp, Homo sapiens
ggcagaggtggcgcc

SEQ ID NO: 3177810 - DNA, 20 bp, Homo sapiens
ggcagagtcgttggagactg

SEQ ID NO: 3177811 - DNA, 13 bp, Homo sapiens
ggcagagttacag

SEQ ID NO: 3177812 - DNA, 20 bp, Homo sapiens
ggcagataatcagcctctta

SEQ ID NO: 3177813 - DNA, 16 bp, Homo sapiens
ggcagatcgctcactg

SEQ ID NO: 3177814 - DNA, 17 bp, Homo sapiens
ggcagatctgtgcccca

SEQ ID NO: 3177815 - DNA, 13 bp, Homo sapiens
ggcagatggagcc

SEQ ID NO: 3177816 - DNA, 16 bp, Homo sapiens
ggcagattttacaaaa

SEQ ID NO: 3177817 - DNA, 21 bp, Homo sapiens
ggcagattttacaaaagatgt

SEQ ID NO: 3177818 - DNA, 18 bp, Homo sapiens
ggcagcacagcccagggc

SEQ ID NO: 3177819 - DNA, 21 bp, Homo sapiens
ggcagcacagcccagggcctg

SEQ ID NO: 3177820 - DNA, 20 bp, Homo sapiens
ggcagcaccctcccccgcag

SEQ ID NO: 3177821 - DNA, 23 bp, Homo sapiens
ggcagcactccccagagctgtgc

SEQ ID NO: 3177822 - DNA, 13 bp, Homo sapiens
ggcagcagccatc

SEQ ID NO: 3177823 - DNA, 17 bp, Homo sapiens
ggcagcatcctccaaaa

SEQ ID NO: 3177824 - DNA, 18 bp, Homo sapiens
ggcagcatgcttgggctg

SEQ ID NO: 3177825 - DNA, 17 bp, Homo sapiens
ggcagccacccaagcct

SEQ ID NO: 3177826 - DNA, 14 bp, Homo sapiens
ggcagccagaccag

SEQ ID NO: 3177827 - DNA, 19 bp, Homo sapiens
ggcagccaggctgccaagg

SEQ ID NO: 3177828 - DNA, 12 bp, Homo sapiens
ggcagccatgcc

SEQ ID NO: 3177829 - DNA, 15 bp, Homo sapiens
ggcagcccagagact

SEQ ID NO: 3177830 - DNA, 13 bp, Homo sapiens
ggcagccccagag

SEQ ID NO: 3177831 - DNA, 14 bp, Homo sapiens
ggcagccccagaga

SEQ ID NO: 3177832 - DNA, 15 bp, Homo sapiens
ggcagccccagagag

SEQ ID NO: 3177833 - DNA, 16 bp, Homo sapiens
ggcagccccattctgc

SEQ ID NO: 3177834 - DNA, 20 bp, Homo sapiens
ggcagccccattctgcctgc

SEQ ID NO: 3177835 - DNA, 16 bp, Homo sapiens
ggcagccccctccaca

SEQ ID NO: 3177836 - DNA, 13 bp, Homo sapiens
ggcagccctgtag

SEQ ID NO: 3177837 - DNA, 14 bp, Homo sapiens
ggcagcctccagag

SEQ ID NO: 3177838 - DNA, 21 bp, Homo sapiens
ggcagcctccagagccagcct

SEQ ID NO: 3177839 - DNA, 24 bp, Homo sapiens
ggcagcctccagagccagcctggg

SEQ ID NO: 3177840 - DNA, 16 bp, Homo sapiens
ggcagcctccagcctg

SEQ ID NO: 3177841 - DNA, 14 bp, Homo sapiens
ggcagcctttccag

SEQ ID NO: 3177842 - DNA, 15 bp, Homo sapiens
ggcagcgggccaggc

SEQ ID NO: 3177843 - DNA, 17 bp, Homo sapiens
ggcagcgggccaggccc

SEQ ID NO: 3177844 - DNA, 23 bp, Homo sapiens
ggcagcgggcggaggggatccag

SEQ ID NO: 3177845 - DNA, 15 bp, Homo sapiens
ggcagctcacccctg

SEQ ID NO: 3177846 - DNA, 17 bp, Homo sapiens
ggcagctcacccctggg

SEQ ID NO: 3177847 - DNA, 18 bp, Homo sapiens
ggcagctcacccctgggc

SEQ ID NO: 3177848 - DNA, 23 bp, Homo sapiens
ggcagctcatagagtcccccctc

SEQ ID NO: 3177849 - DNA, 16 bp, Homo sapiens
ggcagctcgaggcccc

SEQ ID NO: 3177850 - DNA, 22 bp, Homo sapiens
ggcagctcggattcaactacct

SEQ ID NO: 3177851 - DNA, 14 bp, Homo sapiens
ggcagctctccagt

SEQ ID NO: 3177852 - DNA, 22 bp, Homo sapiens
ggcagctgagagccctgctgtg

SEQ ID NO: 3177853 - DNA, 11 bp, Homo sapiens
ggcagctgcct

SEQ ID NO: 3177854 - DNA, 16 bp, Homo sapiens
ggcagctgcctctgct

SEQ ID NO: 3177855 - DNA, 18 bp, Homo sapiens
ggcagctgcctctgctcc

SEQ ID NO: 3177856 - DNA, 12 bp, Homo sapiens
ggcagctgctct

SEQ ID NO: 3177857 - DNA, 15 bp, Homo sapiens
ggcagctgctcttag

SEQ ID NO: 3177858 - DNA, 16 bp, Homo sapiens
ggcagctggatgagac

SEQ ID NO: 3177859 - DNA, 12 bp, Homo sapiens
ggcagctgggcc

SEQ ID NO: 3177860 - DNA, 17 bp, Homo sapiens
ggcagcttgagggttgg

SEQ ID NO: 3177861 - DNA, 21 bp, Homo sapiens
ggcagcttgagggttgggctg

SEQ ID NO: 3177862 - DNA, 14 bp, Homo sapiens
ggcagctttctaga

SEQ ID NO: 3177863 - DNA, 15 bp, Homo sapiens
ggcaggaacaaacag

SEQ ID NO: 3177864 - DNA, 15 bp, Homo sapiens
ggcaggaaggagagc

SEQ ID NO: 3177865 - DNA, 14 bp, Homo sapiens
ggcaggaaggagcg

SEQ ID NO: 3177866 - DNA, 22 bp, Homo sapiens
ggcaggcacacagcagcccccc

SEQ ID NO: 3177867 - DNA, 14 bp, Homo sapiens
ggcaggcagcgcca

SEQ ID NO: 3177868 - DNA, 20 bp, Homo sapiens
ggcaggccagtgtctgggtt

SEQ ID NO: 3177869 - DNA, 10 bp, Homo sapiens
ggcaggccct

SEQ ID NO: 3177870 - DNA, 11 bp, Homo sapiens
ggcaggccctg

SEQ ID NO: 3177871 - DNA, 12 bp, Homo sapiens
ggcaggcctggg

SEQ ID NO: 3177872 - DNA, 14 bp, Homo sapiens
ggcaggcctgggac

SEQ ID NO: 3177873 - DNA, 23 bp, Homo sapiens
ggcaggcggggggggcgcctgga

SEQ ID NO: 3177874 - DNA, 23 bp, Homo sapiens
ggcaggcggtccccatccccacc

SEQ ID NO: 3177875 - DNA, 15 bp, Homo sapiens
ggcaggctcactgcc

SEQ ID NO: 3177876 - DNA, 10 bp, Homo sapiens
ggcaggctgg

SEQ ID NO: 3177877 - DNA, 11 bp, Homo sapiens
ggcaggctggc

SEQ ID NO: 3177878 - DNA, 16 bp, Homo sapiens
ggcaggctggctggcc

SEQ ID NO: 3177879 - DNA, 18 bp, Homo sapiens
ggcagggaaggacaggac

SEQ ID NO: 3177880 - DNA, 22 bp, Homo sapiens
ggcagggaggtcaggccctgga

SEQ ID NO: 3177881 - DNA, 20 bp, Homo sapiens
ggcagggatgggggtggctg

SEQ ID NO: 3177882 - DNA, 13 bp, Homo sapiens
ggcagggcagagg

SEQ ID NO: 3177883 - DNA, 19 bp, Homo sapiens
ggcagggccaccccactct

SEQ ID NO: 3177884 - DNA, 21 bp, Homo sapiens
ggcagggcgggcagagggctg

SEQ ID NO: 3177885 - DNA, 14 bp, Homo sapiens
ggcaggggacagga

SEQ ID NO: 3177886 - DNA, 23 bp, Homo sapiens
ggcaggggagacaggagcctagc

SEQ ID NO: 3177887 - DNA, 16 bp, Homo sapiens
ggcaggggcctggaga

SEQ ID NO: 3177888 - DNA, 18 bp, Homo sapiens
ggcaggggtcagagcact

SEQ ID NO: 3177889 - DNA, 21 bp, Homo sapiens
ggcaggggtggtggagggggc

SEQ ID NO: 3177890 - DNA, 20 bp, Homo sapiens
ggcagggtctcactctgtcg

SEQ ID NO: 3177891 - DNA, 23 bp, Homo sapiens
ggcaggtcttgaactcctggcct

SEQ ID NO: 3177892 - DNA, 15 bp, Homo sapiens
ggcaggtgcctccag

SEQ ID NO: 3177893 - DNA, 16 bp, Homo sapiens
ggcaggtgcctccagg

SEQ ID NO: 3177894 - DNA, 18 bp, Homo sapiens
ggcaggtgcctccaggtg

SEQ ID NO: 3177895 - DNA, 14 bp, Homo sapiens
ggcaggtggtggca

SEQ ID NO: 3177896 - DNA, 21 bp, Homo sapiens
ggcaggtggtggcactgagcc

SEQ ID NO: 3177897 - DNA, 16 bp, Homo sapiens
ggcagtaaagagaaac

SEQ ID NO: 3177898 - DNA, 14 bp, Homo sapiens
ggcagtaataaaaa

SEQ ID NO: 3177899 - DNA, 23 bp, Homo sapiens
ggcagtacctgggaaaggaccca

SEQ ID NO: 3177900 - DNA, 21 bp, Homo sapiens
ggcagtagaactccaggccct

SEQ ID NO: 3177901 - DNA, 15 bp, Homo sapiens
ggcagtcgggggctg

SEQ ID NO: 3177902 - DNA, 19 bp, Homo sapiens
ggcagtcgggggctggcct

SEQ ID NO: 3177903 - DNA, 22 bp, Homo sapiens
ggcagtctctatattatgtctt

SEQ ID NO: 3177904 - DNA, 19 bp, Homo sapiens
ggcagtctgaatttttaaa

SEQ ID NO: 3177905 - DNA, 17 bp, Homo sapiens
ggcagtgactggcaggt

SEQ ID NO: 3177906 - DNA, 11 bp, Homo sapiens
ggcagtgactt

SEQ ID NO: 3177907 - DNA, 15 bp, Homo sapiens
ggcagtgagtgagcc

SEQ ID NO: 3177908 - DNA, 19 bp, Homo sapiens
ggcagtgagtgagcctggc

SEQ ID NO: 3177909 - DNA, 20 bp, Homo sapiens
ggcagtgcccatgtgtacat

SEQ ID NO: 3177910 - DNA, 24 bp, Homo sapiens
ggcagtgctagtgagctgggcatg

SEQ ID NO: 3177911 - DNA, 21 bp, Homo sapiens
ggcagtgggacagggcatggc

SEQ ID NO: 3177912 - DNA, 14 bp, Homo sapiens
ggcagtgggagctg

SEQ ID NO: 3177913 - DNA, 17 bp, Homo sapiens
ggcagtgggagctgcct

SEQ ID NO: 3177914 - DNA, 19 bp, Homo sapiens
ggcagtgggagctgcctgt

SEQ ID NO: 3177915 - DNA, 18 bp, Homo sapiens
ggcagttctcactcctag

SEQ ID NO: 3177916 - DNA, 15 bp, Homo sapiens
ggcagttgcttgtgt

SEQ ID NO: 3177917 - DNA, 10 bp, Homo sapiens
ggcagttttt

SEQ ID NO: 3177918 - DNA, 16 bp, Homo sapiens
ggcataaaacagcttt

SEQ ID NO: 3177919 - DNA, 13 bp, Homo sapiens
ggcataaactgtt

SEQ ID NO: 3177920 - DNA, 22 bp, Homo sapiens
ggcatacgagagcagaggtctc

SEQ ID NO: 3177921 - DNA, 16 bp, Homo sapiens
ggcatagaggcttctc

SEQ ID NO: 3177922 - DNA, 16 bp, Homo sapiens
ggcataggcctgggtg

SEQ ID NO: 3177923 - DNA, 22 bp, Homo sapiens
ggcatataattttcacttctgt

SEQ ID NO: 3177924 - DNA, 22 bp, Homo sapiens
ggcatatccaccacctccctca

SEQ ID NO: 3177925 - DNA, 13 bp, Homo sapiens
ggcatcaaccacc

SEQ ID NO: 3177926 - DNA, 16 bp, Homo sapiens
ggcatcacagggcaga

SEQ ID NO: 3177927 - DNA, 16 bp, Homo sapiens
ggcatcaggcactggt

SEQ ID NO: 3177928 - DNA, 14 bp, Homo sapiens
ggcatcatggtgga

SEQ ID NO: 3177929 - DNA, 18 bp, Homo sapiens
ggccccccgcacagccac

SEQ ID NO: 3177930 - DNA, 19 bp, Homo sapiens
ggccccccgcacagccacc

SEQ ID NO: 3177931 - DNA, 21 bp, Homo sapiens
ggccccccgcacagccacccg

SEQ ID NO: 3177932 - DNA, 15 bp, Homo sapiens
ggccccctccatcgg

SEQ ID NO: 3177933 - DNA, 18 bp, Homo sapiens
ggccccgccagggctggg

SEQ ID NO: 3177934 - DNA, 21 bp, Homo sapiens
ggccccgccagggctggggac

SEQ ID NO: 3177935 - DNA, 16 bp, Homo sapiens
ggccccgccctcaggc

SEQ ID NO: 3177936 - DNA, 16 bp, Homo sapiens
ggccccggccccagcc

SEQ ID NO: 3177937 - DNA, 18 bp, Homo sapiens
ggccccggccccagccag

SEQ ID NO: 3177938 - DNA, 14 bp, Homo sapiens
ggccccgggctgga

SEQ ID NO: 3177939 - DNA, 14 bp, Homo sapiens
ggccccggggctgg

SEQ ID NO: 3177940 - DNA, 18 bp, Homo sapiens
ggccccgtttctggtggt

SEQ ID NO: 3177941 - DNA, 20 bp, Homo sapiens
ggcccctaggctgctgctgt

SEQ ID NO: 3177942 - DNA, 22 bp, Homo sapiens
ggcccctcaccctgccttatct

SEQ ID NO: 3177943 - DNA, 13 bp, Homo sapiens
ggcccctccatcc

SEQ ID NO: 3177944 - DNA, 18 bp, Homo sapiens
ggcccctccctctgcccc

SEQ ID NO: 3177945 - DNA, 19 bp, Homo sapiens
ggcccctccctctgcccca

SEQ ID NO: 3177946 - DNA, 14 bp, Homo sapiens
ggcccctcctagac

SEQ ID NO: 3177947 - DNA, 23 bp, Homo sapiens
ggcccctcctagacccaggtgga

SEQ ID NO: 3177948 - DNA, 12 bp, Homo sapiens
ggcccctgccac

SEQ ID NO: 3177949 - DNA, 16 bp, Homo sapiens
ggcccctgcccggctg

SEQ ID NO: 3177950 - DNA, 20 bp, Homo sapiens
ggcccctgcccggctgcgga

SEQ ID NO: 3177951 - DNA, 14 bp, Homo sapiens
ggcccctgccttgg

SEQ ID NO: 3177952 - DNA, 17 bp, Homo sapiens
ggcccctgcgtgggggc

SEQ ID NO: 3177953 - DNA, 13 bp, Homo sapiens
ggcccctgctggt

SEQ ID NO: 3177954 - DNA, 14 bp, Homo sapiens
ggcccctgctggtt

SEQ ID NO: 3177955 - DNA, 13 bp, Homo sapiens
ggcccctggagcc

SEQ ID NO: 3177956 - DNA, 22 bp, Homo sapiens
ggcccctggcagcacagcccag

SEQ ID NO: 3177957 - DNA, 12 bp, Homo sapiens
ggcccctgggat

SEQ ID NO: 3177958 - DNA, 22 bp, Homo sapiens
ggcccctgggatgggaccaggg

SEQ ID NO: 3177959 - DNA, 13 bp, Homo sapiens
ggcccctgggccc

SEQ ID NO: 3177960 - DNA, 21 bp, Homo sapiens
ggcccctgggcttggcctgct

SEQ ID NO: 3177961 - DNA, 16 bp, Homo sapiens
ggcccgacagcctggc

SEQ ID NO: 3177962 - DNA, 21 bp, Homo sapiens
ggcccgcaccccggcctcagg

SEQ ID NO: 3177963 - DNA, 16 bp, Homo sapiens
ggcccgcagtgctggg

SEQ ID NO: 3177964 - DNA, 17 bp, Homo sapiens
ggcccggatgctgcttc

SEQ ID NO: 3177965 - DNA, 13 bp, Homo sapiens
ggcccggcagggc

SEQ ID NO: 3177966 - DNA, 23 bp, Homo sapiens
ggcccggccagcgggcacagggc

SEQ ID NO: 3177967 - DNA, 21 bp, Homo sapiens
ggcccggccggcctggcaccg

SEQ ID NO: 3177968 - DNA, 13 bp, Homo sapiens
ggcccggctccag

SEQ ID NO: 3177969 - DNA, 18 bp, Homo sapiens
ggcccggtggcggcaggg

SEQ ID NO: 3177970 - DNA, 21 bp, Homo sapiens
ggccctagcccagcgctctgc

SEQ ID NO: 3177971 - DNA, 22 bp, Homo sapiens
ggccctccagtgggctgatgct

SEQ ID NO: 3177972 - DNA, 14 bp, Homo sapiens
ggccctccatgggc

SEQ ID NO: 3177973 - DNA, 17 bp, Homo sapiens
ggccctccatgggctag

SEQ ID NO: 3177974 - DNA, 13 bp, Homo sapiens
ggccctccctgac

SEQ ID NO: 3177975 - DNA, 22 bp, Homo sapiens
ggccctccctgactccctgtgg

SEQ ID NO: 3177976 - DNA, 15 bp, Homo sapiens
ggccctccgacagcc

SEQ ID NO: 3177977 - DNA, 22 bp, Homo sapiens
ggccctccgaccacttccaggg

SEQ ID NO: 3177978 - DNA, 20 bp, Homo sapiens
ggccctcctgtgctggggga

SEQ ID NO: 3177979 - DNA, 16 bp, Homo sapiens
ggccctctctctgggc

SEQ ID NO: 3177980 - DNA, 12 bp, Homo sapiens
ggccctctcttc

SEQ ID NO: 3177981 - DNA, 16 bp, Homo sapiens
ggccctctttccctgc

SEQ ID NO: 3177982 - DNA, 19 bp, Homo sapiens
ggccctctttccctgcgag

SEQ ID NO: 3177983 - DNA, 21 bp, Homo sapiens
ggccctgccccctcccactct

SEQ ID NO: 3177984 - DNA, 22 bp, Homo sapiens
ggccctgcccctaggatgctgc

SEQ ID NO: 3177985 - DNA, 11 bp, Homo sapiens
ggccctgccct

SEQ ID NO: 3177986 - DNA, 21 bp, Homo sapiens
ggccctgccctctccttcctt

SEQ ID NO: 3177987 - DNA, 17 bp, Homo sapiens
ggccctgccctggcagg

SEQ ID NO: 3177988 - DNA, 16 bp, Homo sapiens
ggccctgcctcctggg

SEQ ID NO: 3177989 - DNA, 17 bp, Homo sapiens
ggccctgcctcctggga

SEQ ID NO: 3177990 - DNA, 15 bp, Homo sapiens
ggccctgctcctgca

SEQ ID NO: 3177991 - DNA, 17 bp, Homo sapiens
ggccctgctcctgcagc

SEQ ID NO: 3177992 - DNA, 14 bp, Homo sapiens
ggccctgctgccca

SEQ ID NO: 3177993 - DNA, 17 bp, Homo sapiens
ggccctgctttttttct

SEQ ID NO: 3177994 - DNA, 15 bp, Homo sapiens
ggccctggaactcta

SEQ ID NO: 3177995 - DNA, 19 bp, Homo sapiens
ggccctggaggtctccagg

SEQ ID NO: 3177996 - DNA, 13 bp, Homo sapiens
ggccctggccctt

SEQ ID NO: 3177997 - DNA, 13 bp, Homo sapiens
ggccctggcctcc

SEQ ID NO: 3177998 - DNA, 17 bp, Homo sapiens
ggccctggcctcccctg

SEQ ID NO: 3177999 - DNA, 15 bp, Homo sapiens
ggccctggctctgct

SEQ ID NO: 3178000 - DNA, 18 bp, Homo sapiens
ggccctggctctgctgtc

SEQ ID NO: 3178001 - DNA, 15 bp, Homo sapiens
ggccctgggcctcag

SEQ ID NO: 3178002 - DNA, 18 bp, Homo sapiens
ggccctgtccctcccacc

SEQ ID NO: 3178003 - DNA, 21 bp, Homo sapiens
ggccctgtccctcccacctct

SEQ ID NO: 3178004 - DNA, 23 bp, Homo sapiens
ggcccttcctctccactgccttc

SEQ ID NO: 3178005 - DNA, 21 bp, Homo sapiens
ggcccttgcagttcagcacca

SEQ ID NO: 3178006 - DNA, 14 bp, Homo sapiens
ggcccttggaataa

SEQ ID NO: 3178007 - DNA, 15 bp, Homo sapiens
ggcccttggaataaa

SEQ ID NO: 3178008 - DNA, 17 bp, Homo sapiens
ggcccttgggacagcca

SEQ ID NO: 3178009 - DNA, 17 bp, Homo sapiens
ggcccttggggctgggg

SEQ ID NO: 3178010 - DNA, 14 bp, Homo sapiens
ggcccttgtcctgc

SEQ ID NO: 3178011 - DNA, 17 bp, Homo sapiens
ggcccttgtcctgccag

SEQ ID NO: 3178012 - DNA, 21 bp, Homo sapiens
ggcccttgtcctgccagctgc

SEQ ID NO: 3178013 - DNA, 22 bp, Homo sapiens
ggcccttgtcctgccagctgcc

SEQ ID NO: 3178014 - DNA, 18 bp, Homo sapiens
ggccctttccccttcccc

SEQ ID NO: 3178015 - DNA, 18 bp, Homo sapiens
ggccctttgaagcctcag

SEQ ID NO: 3178016 - DNA, 20 bp, Homo sapiens
ggccctttgaagcctcagct

SEQ ID NO: 3178017 - DNA, 15 bp, Homo sapiens
ggccgaagctctggc

SEQ ID NO: 3178018 - DNA, 17 bp, Homo sapiens
ggccgaagctctggctg

SEQ ID NO: 3178019 - DNA, 18 bp, Homo sapiens
ggccgaagctctggctga

SEQ ID NO: 3178020 - DNA, 16 bp, Homo sapiens
ggccgaaggtgcctca

SEQ ID NO: 3178021 - DNA, 18 bp, Homo sapiens
ggccgaaggtgcctcaga

SEQ ID NO: 3178022 - DNA, 20 bp, Homo sapiens
ggccgaaggtgcctcagact

SEQ ID NO: 3178023 - DNA, 14 bp, Homo sapiens
ggccgaatccccca

SEQ ID NO: 3178024 - DNA, 18 bp, Homo sapiens
ggccgacgttccacctgg

SEQ ID NO: 3178025 - DNA, 19 bp, Homo sapiens
ggccgagcgttcccagcag

SEQ ID NO: 3178026 - DNA, 16 bp, Homo sapiens
ggccgaggcccagcgg

SEQ ID NO: 3178027 - DNA, 16 bp, Homo sapiens
ggccgagggtcctggc

SEQ ID NO: 3178028 - DNA, 18 bp, Homo sapiens
ggccgagggtcctggctc

SEQ ID NO: 3178029 - DNA, 14 bp, Homo sapiens
ggccgatggagaca

SEQ ID NO: 3178030 - DNA, 14 bp, Homo sapiens
ggccgcagagactg

SEQ ID NO: 3178031 - DNA, 13 bp, Homo sapiens
ggccgccaccccc

SEQ ID NO: 3178032 - DNA, 15 bp, Homo sapiens
ggccgcctcctcggg

SEQ ID NO: 3178033 - DNA, 23 bp, Homo sapiens
ggccgcctcctcggggctccagg

SEQ ID NO: 3178034 - DNA, 16 bp, Homo sapiens
ggccgctccaggggtg

SEQ ID NO: 3178035 - DNA, 17 bp, Homo sapiens
ggccgctgagtggcagg

SEQ ID NO: 3178036 - DNA, 12 bp, Homo sapiens
ggccgctgccac

SEQ ID NO: 3178037 - DNA, 23 bp, Homo sapiens
ggccggaaccacagggccagagg

SEQ ID NO: 3178038 - DNA, 13 bp, Homo sapiens
ggccggccagcct

SEQ ID NO: 3178039 - DNA, 13 bp, Homo sapiens
ggccgggggaggg

SEQ ID NO: 3178040 - DNA, 17 bp, Homo sapiens
ggccgggggaggggcgc

SEQ ID NO: 3178041 - DNA, 18 bp, Homo sapiens
ggccgggggaggtgggtg

SEQ ID NO: 3178042 - DNA, 21 bp, Homo sapiens
ggccggtagaggctccccagg

SEQ ID NO: 3178043 - DNA, 18 bp, Homo sapiens
ggccggtctgcaagtcag

SEQ ID NO: 3178044 - DNA, 17 bp, Homo sapiens
ggccgtaccccaccctc

SEQ ID NO: 3178045 - DNA, 13 bp, Homo sapiens
ggccgtctcctcc

SEQ ID NO: 3178046 - DNA, 18 bp, Homo sapiens
ggccgttccccttggctt

SEQ ID NO: 3178047 - DNA, 20 bp, Homo sapiens
ggcctacagctttgatccct

SEQ ID NO: 3178048 - DNA, 16 bp, Homo sapiens
ggcctaccccgcagac

SEQ ID NO: 3178049 - DNA, 23 bp, Homo sapiens
ggcctagatccacacacagagga

SEQ ID NO: 3178050 - DNA, 16 bp, Homo sapiens
ggcctagcccaccctg

SEQ ID NO: 3178051 - DNA, 17 bp, Homo sapiens
ggcctagcccaccctgc

SEQ ID NO: 3178052 - DNA, 19 bp, Homo sapiens
ggcctagcgatctctcctg

SEQ ID NO: 3178053 - DNA, 22 bp, Homo sapiens
ggcctagcgatctctcctggcc

SEQ ID NO: 3178054 - DNA, 13 bp, Homo sapiens
ggcctaggattct

SEQ ID NO: 3178055 - DNA, 23 bp, Homo sapiens
ggctggccactgcacagagctct

SEQ ID NO: 3178056 - DNA, 19 bp, Homo sapiens
ggctggccagcaaggcagg

SEQ ID NO: 3178057 - DNA, 20 bp, Homo sapiens
ggctggccagcaaggcaggt

SEQ ID NO: 3178058 - DNA, 20 bp, Homo sapiens
ggctggccagtccaggctgc

SEQ ID NO: 3178059 - DNA, 14 bp, Homo sapiens
ggctggcgtgcagt

SEQ ID NO: 3178060 - DNA, 16 bp, Homo sapiens
ggctggcgtgcagtgg

SEQ ID NO: 3178061 - DNA, 20 bp, Homo sapiens
ggctggctctgtggaggggc

SEQ ID NO: 3178062 - DNA, 13 bp, Homo sapiens
ggctggctgggca

SEQ ID NO: 3178063 - DNA, 23 bp, Homo sapiens
ggctgggacttcttacccaaagc

SEQ ID NO: 3178064 - DNA, 23 bp, Homo sapiens
ggctgggagtagttgtctttcct

SEQ ID NO: 3178065 - DNA, 22 bp, Homo sapiens
ggctgggatcagagcaggagca

SEQ ID NO: 3178066 - DNA, 17 bp, Homo sapiens
ggctgggcacagaggtc

SEQ ID NO: 3178067 - DNA, 18 bp, Homo sapiens
ggctgggcagccccagag

SEQ ID NO: 3178068 - DNA, 19 bp, Homo sapiens
ggctgggcagccccagaga

SEQ ID NO: 3178069 - DNA, 11 bp, Homo sapiens
ggctgggccat

SEQ ID NO: 3178070 - DNA, 20 bp, Homo sapiens
ggctgggccatgtccaaaga

SEQ ID NO: 3178071 - DNA, 19 bp, Homo sapiens
ggctgggccccccagctca

SEQ ID NO: 3178072 - DNA, 21 bp, Homo sapiens
ggctgggcccctgggatggga

SEQ ID NO: 3178073 - DNA, 21 bp, Homo sapiens
ggctgggccctctttccctgc

SEQ ID NO: 3178074 - DNA, 11 bp, Homo sapiens
ggctgggctac

SEQ ID NO: 3178075 - DNA, 19 bp, Homo sapiens
ggctgggctcacaggcctc

SEQ ID NO: 3178076 - DNA, 15 bp, Homo sapiens
ggctggggcagaggg

SEQ ID NO: 3178077 - DNA, 17 bp, Homo sapiens
ggctggggcggggccca

SEQ ID NO: 3178078 - DNA, 19 bp, Homo sapiens
ggctggggcggggcccagg

SEQ ID NO: 3178079 - DNA, 17 bp, Homo sapiens
ggctggggctgctcccc

SEQ ID NO: 3178080 - DNA, 14 bp, Homo sapiens
ggctgggggcagga

SEQ ID NO: 3178081 - DNA, 17 bp, Homo sapiens
ggctgggggcaggaggg

SEQ ID NO: 3178082 - DNA, 14 bp, Homo sapiens
ggctgggggcctca

SEQ ID NO: 3178083 - DNA, 17 bp, Homo sapiens
ggctgggggcctcagtg

SEQ ID NO: 3178084 - DNA, 19 bp, Homo sapiens
ggctggggggcaccccagc

SEQ ID NO: 3178085 - DNA, 14 bp, Homo sapiens
ggctgggggtgctg

SEQ ID NO: 3178086 - DNA, 17 bp, Homo sapiens
ggctggggtgagagagg

SEQ ID NO: 3178087 - DNA, 22 bp, Homo sapiens
ggctgggtaatgtgaaggccca

SEQ ID NO: 3178088 - DNA, 12 bp, Homo sapiens
ggctgggtcagg

SEQ ID NO: 3178089 - DNA, 18 bp, Homo sapiens
ggctgggtcggccctgcc

SEQ ID NO: 3178090 - DNA, 17 bp, Homo sapiens
ggctgggtgggcccaga

SEQ ID NO: 3178091 - DNA, 18 bp, Homo sapiens
ggctgggtgggcccagaa

SEQ ID NO: 3178092 - DNA, 16 bp, Homo sapiens
ggctggtatctcagaa

SEQ ID NO: 3178093 - DNA, 18 bp, Homo sapiens
ggctggtatctcagaaag

SEQ ID NO: 3178094 - DNA, 14 bp, Homo sapiens
ggctggtgccaggc

SEQ ID NO: 3178095 - DNA, 16 bp, Homo sapiens
ggctggtgccaggcgc

SEQ ID NO: 3178096 - DNA, 13 bp, Homo sapiens
ggctggtgcccca

SEQ ID NO: 3178097 - DNA, 15 bp, Homo sapiens
ggctggtgccccaca

SEQ ID NO: 3178098 - DNA, 18 bp, Homo sapiens
ggctggtgccccacagct

SEQ ID NO: 3178099 - DNA, 16 bp, Homo sapiens
ggctggtgggaaggcc

SEQ ID NO: 3178100 - DNA, 22 bp, Homo sapiens
ggctggtttaaccattggaatg

SEQ ID NO: 3178101 - DNA, 16 bp, Homo sapiens
ggctgtaaaatgcatg

SEQ ID NO: 3178102 - DNA, 13 bp, Homo sapiens
ggctgtaaattga

SEQ ID NO: 3178103 - DNA, 18 bp, Homo sapiens
ggctgtaaattgaacttc

SEQ ID NO: 3178104 - DNA, 14 bp, Homo sapiens
ggctgtaaggctct

SEQ ID NO: 3178105 - DNA, 18 bp, Homo sapiens
ggctgtatcccatgagcc

SEQ ID NO: 3178106 - DNA, 18 bp, Homo sapiens
ggctgtcagtatgacatt

SEQ ID NO: 3178107 - DNA, 21 bp, Homo sapiens
ggctgtcgggggctgtggatg

SEQ ID NO: 3178108 - DNA, 20 bp, Homo sapiens
ggctgtctgcctgtattttc

SEQ ID NO: 3178109 - DNA, 13 bp, Homo sapiens
ggctgtctggggc

SEQ ID NO: 3178110 - DNA, 13 bp, Homo sapiens
ggctgtctgtcac

SEQ ID NO: 3178111 - DNA, 13 bp, Homo sapiens
ggctgtgaggccc

SEQ ID NO: 3178112 - DNA, 14 bp, Homo sapiens
ggctgtgctcagag

SEQ ID NO: 3178113 - DNA, 12 bp, Homo sapiens
ggctgtgctgct

SEQ ID NO: 3178114 - DNA, 16 bp, Homo sapiens
ggctgtggaggcctga

SEQ ID NO: 3178115 - DNA, 22 bp, Homo sapiens
ggctgtggaggcctgatgctgc

SEQ ID NO: 3178116 - DNA, 21 bp, Homo sapiens
ggctgtggccgtctcctccct

SEQ ID NO: 3178117 - DNA, 18 bp, Homo sapiens
ggctgtgtttccatctca

SEQ ID NO: 3178118 - DNA, 20 bp, Homo sapiens
ggctgtgtttgcagcctgct

SEQ ID NO: 3178119 - DNA, 14 bp, Homo sapiens
ggctgttaccattt

SEQ ID NO: 3178120 - DNA, 16 bp, Homo sapiens
ggctgttccttgtact

SEQ ID NO: 3178121 - DNA, 17 bp, Homo sapiens
ggctgttccttgtactc

SEQ ID NO: 3178122 - DNA, 18 bp, Homo sapiens
ggctgttccttgtactct

SEQ ID NO: 3178123 - DNA, 13 bp, Homo sapiens
ggctgttctgcac

SEQ ID NO: 3178124 - DNA, 17 bp, Homo sapiens
ggctgttctgcactgaa

SEQ ID NO: 3178125 - DNA, 21 bp, Homo sapiens
ggctgttgagggccacttttt

SEQ ID NO: 3178126 - DNA, 14 bp, Homo sapiens
ggctgttggctggg

SEQ ID NO: 3178127 - DNA, 15 bp, Homo sapiens
ggctgttggctgggg

SEQ ID NO: 3178128 - DNA, 16 bp, Homo sapiens
ggctgtttagcagaac

SEQ ID NO: 3178129 - DNA, 23 bp, Homo sapiens
ggcttaaacccatattgtaaaac

SEQ ID NO: 3178130 - DNA, 19 bp, Homo sapiens
ggcttaagaaatctagtat

SEQ ID NO: 3178131 - DNA, 14 bp, Homo sapiens
ggcttaagaactgc

SEQ ID NO: 3178132 - DNA, 13 bp, Homo sapiens
ggcttaataaaaa

SEQ ID NO: 3178133 - DNA, 16 bp, Homo sapiens
ggcttaatgtttattc

SEQ ID NO: 3178134 - DNA, 13 bp, Homo sapiens
ggcttacaggagc

SEQ ID NO: 3178135 - DNA, 19 bp, Homo sapiens
ggcttacctgacctcttgc

SEQ ID NO: 3178136 - DNA, 21 bp, Homo sapiens
ggcttagacttcgactcagga

SEQ ID NO: 3178137 - DNA, 19 bp, Homo sapiens
ggcttataaacacattgaa

SEQ ID NO: 3178138 - DNA, 15 bp, Homo sapiens
ggcttatgaaagagg

SEQ ID NO: 3178139 - DNA, 12 bp, Homo sapiens
ggcttattttaa

SEQ ID NO: 3178140 - DNA, 17 bp, Homo sapiens
ggcttattttaatgtga

SEQ ID NO: 3178141 - DNA, 21 bp, Homo sapiens
ggcttcactgtataaatagga

SEQ ID NO: 3178142 - DNA, 23 bp, Homo sapiens
ggcttcaggccgagccaggttca

SEQ ID NO: 3178143 - DNA, 18 bp, Homo sapiens
ggcttcagtggcagctgc

SEQ ID NO: 3178144 - DNA, 20 bp, Homo sapiens
ggcttcagtggcagctgctt

SEQ ID NO: 3178145 - DNA, 15 bp, Homo sapiens
ggcttcatgccagct

SEQ ID NO: 3178146 - DNA, 16 bp, Homo sapiens
ggcttcatgccagcta

SEQ ID NO: 3178147 - DNA, 14 bp, Homo sapiens
ggcttccagcttca

SEQ ID NO: 3178148 - DNA, 16 bp, Homo sapiens
ggcttccagcttcagg

SEQ ID NO: 3178149 - DNA, 12 bp, Homo sapiens
ggcttccaggct

SEQ ID NO: 3178150 - DNA, 13 bp, Homo sapiens
ggcttccaggctc

SEQ ID NO: 3178151 - DNA, 14 bp, Homo sapiens
ggcttccaggctct

SEQ ID NO: 3178152 - DNA, 18 bp, Homo sapiens
ggcttccaggctcttcct

SEQ ID NO: 3178153 - DNA, 22 bp, Homo sapiens
ggcttcctataacttcttcctg

SEQ ID NO: 3178154 - DNA, 13 bp, Homo sapiens
ggcttcctcctga

SEQ ID NO: 3178155 - DNA, 19 bp, Homo sapiens
ggcttcctgcgtcctcctc

SEQ ID NO: 3178156 - DNA, 11 bp, Homo sapiens
ggcttcctggg

SEQ ID NO: 3178157 - DNA, 10 bp, Homo sapiens
ggcttcctgt

SEQ ID NO: 3178158 - DNA, 18 bp, Homo sapiens
ggcttcctgtccactctc

SEQ ID NO: 3178159 - DNA, 18 bp, Homo sapiens
ggcttctccgccagcctc

SEQ ID NO: 3178160 - DNA, 22 bp, Homo sapiens
ggcttctcctgttttatatatt

SEQ ID NO: 3178161 - DNA, 21 bp, Homo sapiens
ggcttctccttctccttccca

SEQ ID NO: 3178162 - DNA, 20 bp, Homo sapiens
ggcttctgcaccctccaccc

SEQ ID NO: 3178163 - DNA, 22 bp, Homo sapiens
ggcttctgcaccctccaccctg

SEQ ID NO: 3178164 - DNA, 15 bp, Homo sapiens
ggcttctgtttctag

SEQ ID NO: 3178165 - DNA, 20 bp, Homo sapiens
ggcttctgtttctagttgag

SEQ ID NO: 3178166 - DNA, 16 bp, Homo sapiens
ggcttgaagccaaaga

SEQ ID NO: 3178167 - DNA, 13 bp, Homo sapiens
ggcttgaagctgt

SEQ ID NO: 3178168 - DNA, 14 bp, Homo sapiens
ggcttgaagctgtg

SEQ ID NO: 3178169 - DNA, 14 bp, Homo sapiens
ggcttgacatgtgc

SEQ ID NO: 3178170 - DNA, 20 bp, Homo sapiens
ggcttgagttcaccatctct

SEQ ID NO: 3178171 - DNA, 17 bp, Homo sapiens
ggcttgcttgccgagcc

SEQ ID NO: 3178172 - DNA, 22 bp, Homo sapiens
ggcttggccacaacctgaaaga

SEQ ID NO: 3178173 - DNA, 12 bp, Homo sapiens
ggcttggcctgc

SEQ ID NO: 3178174 - DNA, 13 bp, Homo sapiens
ggcttggcctgct

SEQ ID NO: 3178175 - DNA, 12 bp, Homo sapiens
ggcttgggattt

SEQ ID NO: 3178176 - DNA, 16 bp, Homo sapiens
ggcttggggtgtgggg

SEQ ID NO: 3178177 - DNA, 21 bp, Homo sapiens
ggcttggtggctcacgcctgt

SEQ ID NO: 3178178 - DNA, 19 bp, Homo sapiens
ggcttgtagaattgttata

SEQ ID NO: 3178179 - DNA, 22 bp, Homo sapiens
ggcttgtgaactgctggagtct

SEQ ID NO: 3178180 - DNA, 22 bp, Homo sapiens
ggcttgtgatttccatttctga

SEQ ID NO: 3178181 - DNA, 22 bp, Homo sapiens
gggagcagttttcccctggcct

SEQ ID NO: 3178182 - DNA, 23 bp, Homo sapiens
gggagcatagcagaggggccagg

SEQ ID NO: 3178183 - DNA, 19 bp, Homo sapiens
gggagccacttctccccag

SEQ ID NO: 3178184 - DNA, 12 bp, Homo sapiens
gggagccccagg

SEQ ID NO: 3178185 - DNA, 21 bp, Homo sapiens
gggagccccagggtcttccct

SEQ ID NO: 3178186 - DNA, 16 bp, Homo sapiens
gggagcctaggaccac

SEQ ID NO: 3178187 - DNA, 17 bp, Homo sapiens
gggagcctcctgcccag

SEQ ID NO: 3178188 - DNA, 21 bp, Homo sapiens
gggagcctcctgcccagtccc

SEQ ID NO: 3178189 - DNA, 13 bp, Homo sapiens
gggagcggaggtt

SEQ ID NO: 3178190 - DNA, 11 bp, Homo sapiens
gggagctcctg

SEQ ID NO: 3178191 - DNA, 12 bp, Homo sapiens
gggagctctgca

SEQ ID NO: 3178192 - DNA, 12 bp, Homo sapiens
gggagctgccaa

SEQ ID NO: 3178193 - DNA, 22 bp, Homo sapiens
gggagctgcctgttcagctcca

SEQ ID NO: 3178194 - DNA, 16 bp, Homo sapiens
gggaggaaagagagca

SEQ ID NO: 3178195 - DNA, 23 bp, Homo sapiens
gggaggaagcaggttgaggggct

SEQ ID NO: 3178196 - DNA, 12 bp, Homo sapiens
gggaggacaggc

SEQ ID NO: 3178197 - DNA, 16 bp, Homo sapiens
gggaggacaggcaggc

SEQ ID NO: 3178198 - DNA, 22 bp, Homo sapiens
gggaggagcctgtgcgtcccag

SEQ ID NO: 3178199 - DNA, 17 bp, Homo sapiens
gggaggaggccacctct

SEQ ID NO: 3178200 - DNA, 17 bp, Homo sapiens
gggaggatcactggagc

SEQ ID NO: 3178201 - DNA, 16 bp, Homo sapiens
gggaggcaagaaaagg

SEQ ID NO: 3178202 - DNA, 18 bp, Homo sapiens
gggaggcaagaggggtgg

SEQ ID NO: 3178203 - DNA, 15 bp, Homo sapiens
gggaggcaccagctc

SEQ ID NO: 3178204 - DNA, 23 bp, Homo sapiens
gggaggcaccagctctgtggcct

SEQ ID NO: 3178205 - DNA, 19 bp, Homo sapiens
gggaggcagatggagccca

SEQ ID NO: 3178206 - DNA, 12 bp, Homo sapiens
gggaggcagcct

SEQ ID NO: 3178207 - DNA, 16 bp, Homo sapiens
gggaggcatggccctg

SEQ ID NO: 3178208 - DNA, 16 bp, Homo sapiens
gggaggccaggcgggc

SEQ ID NO: 3178209 - DNA, 18 bp, Homo sapiens
gggaggccccagctctga

SEQ ID NO: 3178210 - DNA, 19 bp, Homo sapiens
gggaggctgaggcaggaga

SEQ ID NO: 3178211 - DNA, 16 bp, Homo sapiens
gggaggctgggcacag

SEQ ID NO: 3178212 - DNA, 11 bp, Homo sapiens
gggagggagca

SEQ ID NO: 3178213 - DNA, 22 bp, Homo sapiens
gggagggattctggttccaggg

SEQ ID NO: 3178214 - DNA, 21 bp, Homo sapiens
gggagggcggtggacaataaa

SEQ ID NO: 3178215 - DNA, 12 bp, Homo sapiens
gggaggggaagt

SEQ ID NO: 3178216 - DNA, 13 bp, Homo sapiens
gggaggggcaggc

SEQ ID NO: 3178217 - DNA, 14 bp, Homo sapiens
gggaggggcaggct

SEQ ID NO: 3178218 - DNA, 18 bp, Homo sapiens
gggaggggcgcccacctc

SEQ ID NO: 3178219 - DNA, 19 bp, Homo sapiens
gggaggggcgctggcccag

SEQ ID NO: 3178220 - DNA, 23 bp, Homo sapiens
gggaggggcggcaggagggaggt

SEQ ID NO: 3178221 - DNA, 19 bp, Homo sapiens
gggaggggttgccacaggc

SEQ ID NO: 3178222 - DNA, 17 bp, Homo sapiens
gggaggggttgttttgg

SEQ ID NO: 3178223 - DNA, 19 bp, Homo sapiens
gggagggttcccctggcct

SEQ ID NO: 3178224 - DNA, 14 bp, Homo sapiens
gggaggtcattttg

SEQ ID NO: 3178225 - DNA, 22 bp, Homo sapiens
gggaggtgtttaaagagaggtt

SEQ ID NO: 3178226 - DNA, 13 bp, Homo sapiens
gggagtacctgct

SEQ ID NO: 3178227 - DNA, 17 bp, Homo sapiens
gggagtacctgctgccc

SEQ ID NO: 3178228 - DNA, 14 bp, Homo sapiens
gggagtagccaagc

SEQ ID NO: 3178229 - DNA, 12 bp, Homo sapiens
gggagtcagagc

SEQ ID NO: 3178230 - DNA, 18 bp, Homo sapiens
gggagtgacagaggcagc

SEQ ID NO: 3178231 - DNA, 19 bp, Homo sapiens
gggagtgagacagaagtaa

SEQ ID NO: 3178232 - DNA, 19 bp, Homo sapiens
gggagtgctggctcacagt

SEQ ID NO: 3178233 - DNA, 15 bp, Homo sapiens
gggagtgggcacctc

SEQ ID NO: 3178234 - DNA, 20 bp, Homo sapiens
gggataaccctacacccaga

SEQ ID NO: 3178235 - DNA, 23 bp, Homo sapiens
gggataactgatttctatggctt

SEQ ID NO: 3178236 - DNA, 23 bp, Homo sapiens
gggatacttagtggtatgtctct

SEQ ID NO: 3178237 - DNA, 13 bp, Homo sapiens
gggatagagagag

SEQ ID NO: 3178238 - DNA, 22 bp, Homo sapiens
gggatcaaccagctaagaaaag

SEQ ID NO: 3178239 - DNA, 13 bp, Homo sapiens
gggatcacagaga

SEQ ID NO: 3178240 - DNA, 14 bp, Homo sapiens
gggatcacagggcc

SEQ ID NO: 3178241 - DNA, 12 bp, Homo sapiens
gggatcactggc

SEQ ID NO: 3178242 - DNA, 22 bp, Homo sapiens
gggatcactggctggcctgagc

SEQ ID NO: 3178243 - DNA, 22 bp, Homo sapiens
gggatcagcttcttgcactcct

SEQ ID NO: 3178244 - DNA, 19 bp, Homo sapiens
gggatcccaccctggggac

SEQ ID NO: 3178245 - DNA, 17 bp, Homo sapiens
gggatcccaggccaggg

SEQ ID NO: 3178246 - DNA, 20 bp, Homo sapiens
gggatgagctcaagcaggaa

SEQ ID NO: 3178247 - DNA, 20 bp, Homo sapiens
gggatgccactcctccctcc

SEQ ID NO: 3178248 - DNA, 16 bp, Homo sapiens
gggatgcggatcctgc

SEQ ID NO: 3178249 - DNA, 19 bp, Homo sapiens
gggatgctagccccagaga

SEQ ID NO: 3178250 - DNA, 22 bp, Homo sapiens
gggatgctgctccgcccgctcc

SEQ ID NO: 3178251 - DNA, 16 bp, Homo sapiens
gggatgctgggctggg

SEQ ID NO: 3178252 - DNA, 17 bp, Homo sapiens
gggatgctgggctgggc

SEQ ID NO: 3178253 - DNA, 13 bp, Homo sapiens
gggatgggccacc

SEQ ID NO: 3178254 - DNA, 14 bp, Homo sapiens
gggatgggccaccg

SEQ ID NO: 3178255 - DNA, 21 bp, Homo sapiens
gggatggggcctccctccttg

SEQ ID NO: 3178256 - DNA, 22 bp, Homo sapiens
gggatggggcctccctccttgg

SEQ ID NO: 3178257 - DNA, 20 bp, Homo sapiens
gggatgggggatgggccagg

SEQ ID NO: 3178258 - DNA, 19 bp, Homo sapiens
gggatggtaagagaaaaga

SEQ ID NO: 3178259 - DNA, 15 bp, Homo sapiens
gggatggtcctgggg

SEQ ID NO: 3178260 - DNA, 12 bp, Homo sapiens
gggatgtagaac

SEQ ID NO: 3178261 - DNA, 13 bp, Homo sapiens
gggatgtgagccc

SEQ ID NO: 3178262 - DNA, 16 bp, Homo sapiens
gggatgtgagccccag

SEQ ID NO: 3178263 - DNA, 15 bp, Homo sapiens
gggattaagggcaaa

SEQ ID NO: 3178264 - DNA, 15 bp, Homo sapiens
gggattacaggtgtg

SEQ ID NO: 3178265 - DNA, 14 bp, Homo sapiens
gggattcaggctgc

SEQ ID NO: 3178266 - DNA, 21 bp, Homo sapiens
gggattcctgacccaggccgc

SEQ ID NO: 3178267 - DNA, 21 bp, Homo sapiens
gggattctactttaagcacta

SEQ ID NO: 3178268 - DNA, 19 bp, Homo sapiens
gggattctggttccagggt

SEQ ID NO: 3178269 - DNA, 18 bp, Homo sapiens
gggattgaagggtcctgc

SEQ ID NO: 3178270 - DNA, 18 bp, Homo sapiens
gggattgaggggccctgg

SEQ ID NO: 3178271 - DNA, 19 bp, Homo sapiens
gggatttcttcgctgctct

SEQ ID NO: 3178272 - DNA, 14 bp, Homo sapiens
gggcaaacaggcag

SEQ ID NO: 3178273 - DNA, 15 bp, Homo sapiens
gggcaaacaggcagt

SEQ ID NO: 3178274 - DNA, 13 bp, Homo sapiens
gggcaaagggtct

SEQ ID NO: 3178275 - DNA, 15 bp, Homo sapiens
gggcaaatggctgag

SEQ ID NO: 3178276 - DNA, 15 bp, Homo sapiens
gggcaacgaagaaaa

SEQ ID NO: 3178277 - DNA, 16 bp, Homo sapiens
gggcaagaagctgctt

SEQ ID NO: 3178278 - DNA, 21 bp, Homo sapiens
gggcaagcctaagggatcctg

SEQ ID NO: 3178279 - DNA, 16 bp, Homo sapiens
gggcaagctaggcccc

SEQ ID NO: 3178280 - DNA, 20 bp, Homo sapiens
gggcaagctaggccccagag

SEQ ID NO: 3178281 - DNA, 24 bp, Homo sapiens
gggcaagtccctgactctctgtga

SEQ ID NO: 3178282 - DNA, 11 bp, Homo sapiens
gggcacaccac

SEQ ID NO: 3178283 - DNA, 17 bp, Homo sapiens
gggcacaccactgccct

SEQ ID NO: 3178284 - DNA, 18 bp, Homo sapiens
gggcacaccactgccctg

SEQ ID NO: 3178285 - DNA, 22 bp, Homo sapiens
gggcacactctgccagcaaaga

SEQ ID NO: 3178286 - DNA, 19 bp, Homo sapiens
gggcacagccctccgaccc

SEQ ID NO: 3178287 - DNA, 19 bp, Homo sapiens
gggcacagggcaccagagg

SEQ ID NO: 3178288 - DNA, 20 bp, Homo sapiens
gggcacatgctgagtctccc

SEQ ID NO: 3178289 - DNA, 12 bp, Homo sapiens
gggcaccagagg

SEQ ID NO: 3178290 - DNA, 20 bp, Homo sapiens
gggcaccctgtggccctggc

SEQ ID NO: 3178291 - DNA, 19 bp, Homo sapiens
gggcacctatagtcccagc

SEQ ID NO: 3178292 - DNA, 16 bp, Homo sapiens
gggcacggactgtcca

SEQ ID NO: 3178293 - DNA, 23 bp, Homo sapiens
gggcactcagccacgaccagccc

SEQ ID NO: 3178294 - DNA, 14 bp, Homo sapiens
gggcactggcccag

SEQ ID NO: 3178295 - DNA, 15 bp, Homo sapiens
gggcactggcccagg

SEQ ID NO: 3178296 - DNA, 20 bp, Homo sapiens
gggcacttaatttgtaaact

SEQ ID NO: 3178297 - DNA, 23 bp, Homo sapiens
gggcactttttaattcaccaaag

SEQ ID NO: 3178298 - DNA, 15 bp, Homo sapiens
gggcagaaagtggcc

SEQ ID NO: 3178299 - DNA, 22 bp, Homo sapiens
gggcagactgtgaacttgactg

SEQ ID NO: 3178300 - DNA, 20 bp, Homo sapiens
gggcagagccatgggcctgg

SEQ ID NO: 3178301 - DNA, 21 bp, Homo sapiens
gggcagagcccccaggaagcc

SEQ ID NO: 3178302 - DNA, 17 bp, Homo sapiens
gggcagagccgggaagc

SEQ ID NO: 3178303 - DNA, 17 bp, Homo sapiens
gggcagagctggctctg

SEQ ID NO: 3178304 - DNA, 12 bp, Homo sapiens
gggcagagggaa

SEQ ID NO: 3178305 - DNA, 13 bp, Homo sapiens
gggcagagggctg

SEQ ID NO: 3178306 - DNA, 15 bp, Homo sapiens
gggcagagggctgga

SEQ ID NO: 3178307 - DNA, 15 bp, Homo sapiens
gggctttctggagag

SEQ ID NO: 3178308 - DNA, 16 bp, Homo sapiens
gggctttgcaggctct

SEQ ID NO: 3178309 - DNA, 19 bp, Homo sapiens
gggctttgcaggctctggg

SEQ ID NO: 3178310 - DNA, 20 bp, Homo sapiens
gggctttgcaggctctgggc

SEQ ID NO: 3178311 - DNA, 15 bp, Homo sapiens
gggctttgccttgca

SEQ ID NO: 3178312 - DNA, 18 bp, Homo sapiens
gggcttttctggggccca

SEQ ID NO: 3178313 - DNA, 22 bp, Homo sapiens
ggggaaaaaaaatctctcagag

SEQ ID NO: 3178314 - DNA, 17 bp, Homo sapiens
ggggaaaggcaaggtcc

SEQ ID NO: 3178315 - DNA, 22 bp, Homo sapiens
ggggaaaggcaaggtccggccc

SEQ ID NO: 3178316 - DNA, 22 bp, Homo sapiens
ggggaacctgccatgccaggaa

SEQ ID NO: 3178317 - DNA, 15 bp, Homo sapiens
ggggaaggagccagt

SEQ ID NO: 3178318 - DNA, 22 bp, Homo sapiens
ggggaaggagggtacagctggg

SEQ ID NO: 3178319 - DNA, 22 bp, Homo sapiens
ggggaagggccagtctgggctg

SEQ ID NO: 3178320 - DNA, 23 bp, Homo sapiens
ggggaagggccagtctgggctgc

SEQ ID NO: 3178321 - DNA, 22 bp, Homo sapiens
ggggacagagactcagatgagg

SEQ ID NO: 3178322 - DNA, 12 bp, Homo sapiens
ggggacagctcc

SEQ ID NO: 3178323 - DNA, 20 bp, Homo sapiens
ggggacagctccttctgtcc

SEQ ID NO: 3178324 - DNA, 12 bp, Homo sapiens
ggggacaggcct

SEQ ID NO: 3178325 - DNA, 13 bp, Homo sapiens
ggggacaggcctc

SEQ ID NO: 3178326 - DNA, 21 bp, Homo sapiens
ggggacccaatgtaggagctg

SEQ ID NO: 3178327 - DNA, 14 bp, Homo sapiens
ggggacccaggctc

SEQ ID NO: 3178328 - DNA, 11 bp, Homo sapiens
ggggaccctgt

SEQ ID NO: 3178329 - DNA, 23 bp, Homo sapiens
ggggaccgttcagtgtcccaggc

SEQ ID NO: 3178330 - DNA, 15 bp, Homo sapiens
ggggactagacagtt

SEQ ID NO: 3178331 - DNA, 15 bp, Homo sapiens
ggggactcagccctg

SEQ ID NO: 3178332 - DNA, 20 bp, Homo sapiens
ggggactctgagcgggaggc

SEQ ID NO: 3178333 - DNA, 18 bp, Homo sapiens
ggggactgggggactggg

SEQ ID NO: 3178334 - DNA, 18 bp, Homo sapiens
ggggagagcaggctggca

SEQ ID NO: 3178335 - DNA, 14 bp, Homo sapiens
ggggagagcctgct

SEQ ID NO: 3178336 - DNA, 22 bp, Homo sapiens
ggggagcaggaggccaataaaa

SEQ ID NO: 3178337 - DNA, 10 bp, Homo sapiens
ggggagctcc

SEQ ID NO: 3178338 - DNA, 12 bp, Homo sapiens
ggggagctcctg

SEQ ID NO: 3178339 - DNA, 13 bp, Homo sapiens
ggggagctcctgg

SEQ ID NO: 3178340 - DNA, 11 bp, Homo sapiens
ggggaggaagg

SEQ ID NO: 3178341 - DNA, 12 bp, Homo sapiens
ggggaggaaggg

SEQ ID NO: 3178342 - DNA, 16 bp, Homo sapiens
ggggaggcccaaatga

SEQ ID NO: 3178343 - DNA, 22 bp, Homo sapiens
ggggaggcctctttgccccgac

SEQ ID NO: 3178344 - DNA, 11 bp, Homo sapiens
ggggaggcttt

SEQ ID NO: 3178345 - DNA, 14 bp, Homo sapiens
ggggagggattctg

SEQ ID NO: 3178346 - DNA, 15 bp, Homo sapiens
ggggagggggatccg

SEQ ID NO: 3178347 - DNA, 13 bp, Homo sapiens
ggggatccagcca

SEQ ID NO: 3178348 - DNA, 14 bp, Homo sapiens
ggggatccagccac

SEQ ID NO: 3178349 - DNA, 15 bp, Homo sapiens
ggggatccagccact

SEQ ID NO: 3178350 - DNA, 21 bp, Homo sapiens
ggggatccccgcctggccagg

SEQ ID NO: 3178351 - DNA, 13 bp, Homo sapiens
ggggatctcaggg

SEQ ID NO: 3178352 - DNA, 13 bp, Homo sapiens
ggggatgggccag

SEQ ID NO: 3178353 - DNA, 14 bp, Homo sapiens
ggggatgggccagg

SEQ ID NO: 3178354 - DNA, 16 bp, Homo sapiens
ggggatggggcctccc

SEQ ID NO: 3178355 - DNA, 22 bp, Homo sapiens
ggggcaagaagatcacgctccc

SEQ ID NO: 3178356 - DNA, 15 bp, Homo sapiens
ggggcacaccactgc

SEQ ID NO: 3178357 - DNA, 19 bp, Homo sapiens
ggggcacaccactgccctg

SEQ ID NO: 3178358 - DNA, 22 bp, Homo sapiens
ggggcacaccactgccctgcct

SEQ ID NO: 3178359 - DNA, 15 bp, Homo sapiens
ggggcactcagccac

SEQ ID NO: 3178360 - DNA, 22 bp, Homo sapiens
ggggcagagtcgttggagactg

SEQ ID NO: 3178361 - DNA, 13 bp, Homo sapiens
ggggcagcactcc

SEQ ID NO: 3178362 - DNA, 21 bp, Homo sapiens
ggggcaggagaggctgggctg

SEQ ID NO: 3178363 - DNA, 12 bp, Homo sapiens
ggggcaggcctg

SEQ ID NO: 3178364 - DNA, 13 bp, Homo sapiens
ggggcaggctggg

SEQ ID NO: 3178365 - DNA, 17 bp, Homo sapiens
ggggcagggccttcctg

SEQ ID NO: 3178366 - DNA, 15 bp, Homo sapiens
ggggcagttgggtag

SEQ ID NO: 3178367 - DNA, 18 bp, Homo sapiens
ggggcatggttccttccc

SEQ ID NO: 3178368 - DNA, 14 bp, Homo sapiens
ggggccaccaaagc

SEQ ID NO: 3178369 - DNA, 19 bp, Homo sapiens
ggggccaccaaagctgccc

SEQ ID NO: 3178370 - DNA, 18 bp, Homo sapiens
ggggccacctcctccccc

SEQ ID NO: 3178371 - DNA, 23 bp, Homo sapiens
ggggccactttcagagcccccag

SEQ ID NO: 3178372 - DNA, 14 bp, Homo sapiens
ggggccagagacat

SEQ ID NO: 3178373 - DNA, 12 bp, Homo sapiens
ggggccaggcca

SEQ ID NO: 3178374 - DNA, 14 bp, Homo sapiens
ggggccaggccagg

SEQ ID NO: 3178375 - DNA, 19 bp, Homo sapiens
ggggccaggcccaggcaga

SEQ ID NO: 3178376 - DNA, 22 bp, Homo sapiens
ggggccatcacaggatgccagc

SEQ ID NO: 3178377 - DNA, 14 bp, Homo sapiens
ggggccccagatct

SEQ ID NO: 3178378 - DNA, 18 bp, Homo sapiens
ggggccccagatctgcct

SEQ ID NO: 3178379 - DNA, 17 bp, Homo sapiens
ggggccccgccagggct

SEQ ID NO: 3178380 - DNA, 14 bp, Homo sapiens
ggggccctgccctg

SEQ ID NO: 3178381 - DNA, 16 bp, Homo sapiens
ggggccctggccagga

SEQ ID NO: 3178382 - DNA, 21 bp, Homo sapiens
ggggccctggtccttccaggc

SEQ ID NO: 3178383 - DNA, 11 bp, Homo sapiens
ggggccctgtg

SEQ ID NO: 3178384 - DNA, 18 bp, Homo sapiens
ggggcccttggggcctgg

SEQ ID NO: 3178385 - DNA, 18 bp, Homo sapiens
ggggccgccacggcctgg

SEQ ID NO: 3178386 - DNA, 18 bp, Homo sapiens
ggggccgtgggggttgag

SEQ ID NO: 3178387 - DNA, 23 bp, Homo sapiens
ggggcctacagctttgatccctg

SEQ ID NO: 3178388 - DNA, 14 bp, Homo sapiens
ggggcctcagacga

SEQ ID NO: 3178389 - DNA, 15 bp, Homo sapiens
ggggcctgagagaat

SEQ ID NO: 3178390 - DNA, 12 bp, Homo sapiens
ggggcctggcag

SEQ ID NO: 3178391 - DNA, 11 bp, Homo sapiens
ggggcctggct

SEQ ID NO: 3178392 - DNA, 19 bp, Homo sapiens
ggggcctggcttgctccag

SEQ ID NO: 3178393 - DNA, 15 bp, Homo sapiens
ggggcgctggcccag

SEQ ID NO: 3178394 - DNA, 23 bp, Homo sapiens
ggggcgctggcccagccggcctc

SEQ ID NO: 3178395 - DNA, 15 bp, Homo sapiens
ggggcgtggggaggg

SEQ ID NO: 3178396 - DNA, 21 bp, Homo sapiens
ggggctaaaggggagaaactg

SEQ ID NO: 3178397 - DNA, 15 bp, Homo sapiens
ggggctacaagaggg

SEQ ID NO: 3178398 - DNA, 16 bp, Homo sapiens
ggggctacaagaggga

SEQ ID NO: 3178399 - DNA, 12 bp, Homo sapiens
ggggctccaggc

SEQ ID NO: 3178400 - DNA, 11 bp, Homo sapiens
ggggctcctgg

SEQ ID NO: 3178401 - DNA, 12 bp, Homo sapiens
ggggctcctgga

SEQ ID NO: 3178402 - DNA, 13 bp, Homo sapiens
ggggctcctggaa

SEQ ID NO: 3178403 - DNA, 21 bp, Homo sapiens
ggggctcctggaaaggctcag

SEQ ID NO: 3178404 - DNA, 14 bp, Homo sapiens
ggggctctctgaga

SEQ ID NO: 3178405 - DNA, 12 bp, Homo sapiens
ggggctgctccc

SEQ ID NO: 3178406 - DNA, 12 bp, Homo sapiens
ggggctgctggg

SEQ ID NO: 3178407 - DNA, 16 bp, Homo sapiens
ggggctgcttcctcct

SEQ ID NO: 3178408 - DNA, 17 bp, Homo sapiens
ggggctggcactgactg

SEQ ID NO: 3178409 - DNA, 19 bp, Homo sapiens
ggggctggccttcctgccc

SEQ ID NO: 3178410 - DNA, 12 bp, Homo sapiens
ggggctgtggat

SEQ ID NO: 3178411 - DNA, 21 bp, Homo sapiens
ggggcttcaccagtctgtcta

SEQ ID NO: 3178412 - DNA, 17 bp, Homo sapiens
ggggcttgaagccaaag

SEQ ID NO: 3178413 - DNA, 15 bp, Homo sapiens
ggggctttctggaga

SEQ ID NO: 3178414 - DNA, 16 bp, Homo sapiens
gggggaatgagcccag

SEQ ID NO: 3178415 - DNA, 16 bp, Homo sapiens
gggggactagcccctg

SEQ ID NO: 3178416 - DNA, 12 bp, Homo sapiens
gggggaggtggg

SEQ ID NO: 3178417 - DNA, 21 bp, Homo sapiens
gggggatgccactcctccctc

SEQ ID NO: 3178418 - DNA, 22 bp, Homo sapiens
gggggatgccactcctccctcc

SEQ ID NO: 3178419 - DNA, 23 bp, Homo sapiens
gggggcaagaagatcacgctccc

SEQ ID NO: 3178420 - DNA, 20 bp, Homo sapiens
gggggcaagaagtagcagtg

SEQ ID NO: 3178421 - DNA, 17 bp, Homo sapiens
gggggccaaggtcctgc

SEQ ID NO: 3178422 - DNA, 23 bp, Homo sapiens
gggggccgggcaggtcctgccca

SEQ ID NO: 3178423 - DNA, 18 bp, Homo sapiens
gggggcctcagtgccact

SEQ ID NO: 3178424 - DNA, 14 bp, Homo sapiens
gggggcgccctctc

SEQ ID NO: 3178425 - DNA, 22 bp, Homo sapiens
gggggcgctcaggacccaggcc

SEQ ID NO: 3178426 - DNA, 14 bp, Homo sapiens
gggggtcacaggcc

SEQ ID NO: 3178427 - DNA, 21 bp, Homo sapiens
gggggtcaccggccgatggag

SEQ ID NO: 3178428 - DNA, 18 bp, Homo sapiens
gggggtcccagtgggagg

SEQ ID NO: 3178429 - DNA, 22 bp, Homo sapiens
gggggtcccagtgggaggggca

SEQ ID NO: 3178430 - DNA, 13 bp, Homo sapiens
gggggtggccgct

SEQ ID NO: 3178431 - DNA, 19 bp, Homo sapiens
gggggttgcagtggagagg

SEQ ID NO: 3178432 - DNA, 22 bp, Homo sapiens
gggggtttcacctgggccctgg

SEQ ID NO: 3178433 - DNA, 15 bp, Homo sapiens
ggggtaagccagagc

SEQ ID NO: 3178434 - DNA, 17 bp, Homo sapiens
ggtgatcctctattttg

SEQ ID NO: 3178435 - DNA, 18 bp, Homo sapiens
ggtgatcctctattttgt

SEQ ID NO: 3178436 - DNA, 17 bp, Homo sapiens
ggtgcaaagtattgtaa

SEQ ID NO: 3178437 - DNA, 13 bp, Homo sapiens
ggtgcaatttcaa

SEQ ID NO: 3178438 - DNA, 19 bp, Homo sapiens
ggtgcacccactcaccagg

SEQ ID NO: 3178439 - DNA, 20 bp, Homo sapiens
ggtgcacccactcaccaggg

SEQ ID NO: 3178440 - DNA, 23 bp, Homo sapiens
ggtgcagacagaagtctcctcaa

SEQ ID NO: 3178441 - DNA, 19 bp, Homo sapiens
ggtgcagagaagctggact

SEQ ID NO: 3178442 - DNA, 15 bp, Homo sapiens
ggtgcagcagtgagg

SEQ ID NO: 3178443 - DNA, 15 bp, Homo sapiens
ggtgcatagaactgg

SEQ ID NO: 3178444 - DNA, 12 bp, Homo sapiens
ggtgcatcctcc

SEQ ID NO: 3178445 - DNA, 21 bp, Homo sapiens
ggtgcatcctcctcagccccc

SEQ ID NO: 3178446 - DNA, 19 bp, Homo sapiens
ggtgcatttgagagaagcc

SEQ ID NO: 3178447 - DNA, 17 bp, Homo sapiens
ggtgccaccaccctgcc

SEQ ID NO: 3178448 - DNA, 19 bp, Homo sapiens
ggtgccaccaccctgcccc

SEQ ID NO: 3178449 - DNA, 13 bp, Homo sapiens
ggtgccactccct

SEQ ID NO: 3178450 - DNA, 15 bp, Homo sapiens
ggtgccactccctga

SEQ ID NO: 3178451 - DNA, 16 bp, Homo sapiens
ggtgccactttaccca

SEQ ID NO: 3178452 - DNA, 14 bp, Homo sapiens
ggtgccagagaggg

SEQ ID NO: 3178453 - DNA, 17 bp, Homo sapiens
ggtgccagcctgaggca

SEQ ID NO: 3178454 - DNA, 20 bp, Homo sapiens
ggtgccaggcgcgtgtaaat

SEQ ID NO: 3178455 - DNA, 15 bp, Homo sapiens
ggtgccattcccagc

SEQ ID NO: 3178456 - DNA, 22 bp, Homo sapiens
ggtgccatttctgaactgttac

SEQ ID NO: 3178457 - DNA, 12 bp, Homo sapiens
ggtgccccctcc

SEQ ID NO: 3178458 - DNA, 23 bp, Homo sapiens
ggtgcccctcgccagcttctcct

SEQ ID NO: 3178459 - DNA, 22 bp, Homo sapiens
ggtgcctcagactccgccctcc

SEQ ID NO: 3178460 - DNA, 19 bp, Homo sapiens
ggtgcctcccacacttgct

SEQ ID NO: 3178461 - DNA, 18 bp, Homo sapiens
ggtgcctgagaggcaggc

SEQ ID NO: 3178462 - DNA, 14 bp, Homo sapiens
ggtgcctgaggtct

SEQ ID NO: 3178463 - DNA, 13 bp, Homo sapiens
ggtgcctgtccca

SEQ ID NO: 3178464 - DNA, 17 bp, Homo sapiens
ggtgcctgtcccacccc

SEQ ID NO: 3178465 - DNA, 16 bp, Homo sapiens
ggtgcctttcctgttc

SEQ ID NO: 3178466 - DNA, 17 bp, Homo sapiens
ggtgcctttcctgttca

SEQ ID NO: 3178467 - DNA, 18 bp, Homo sapiens
ggtgcctttcctgttcag

SEQ ID NO: 3178468 - DNA, 22 bp, Homo sapiens
ggtgcctttcctgttcagcatt

SEQ ID NO: 3178469 - DNA, 23 bp, Homo sapiens
ggtgctagtgggccctctctctg

SEQ ID NO: 3178470 - DNA, 24 bp, Homo sapiens
ggtgctagtgggccctctctctgg

SEQ ID NO: 3178471 - DNA, 19 bp, Homo sapiens
ggtgctcacaccccattgg

SEQ ID NO: 3178472 - DNA, 19 bp, Homo sapiens
ggtgctctggcggcttcct

SEQ ID NO: 3178473 - DNA, 20 bp, Homo sapiens
ggtgctctggcggcttcctg

SEQ ID NO: 3178474 - DNA, 23 bp, Homo sapiens
ggtgctctgtgttcccagaggca

SEQ ID NO: 3178475 - DNA, 19 bp, Homo sapiens
ggtgctgactggcttcagc

SEQ ID NO: 3178476 - DNA, 12 bp, Homo sapiens
ggtgctgagctt

SEQ ID NO: 3178477 - DNA, 17 bp, Homo sapiens
ggtgctgcagatttgat

SEQ ID NO: 3178478 - DNA, 21 bp, Homo sapiens
ggtgctgccatccaggttcag

SEQ ID NO: 3178479 - DNA, 20 bp, Homo sapiens
ggtgctgggaggagggagag

SEQ ID NO: 3178480 - DNA, 15 bp, Homo sapiens
ggtgcttctggaaac

SEQ ID NO: 3178481 - DNA, 21 bp, Homo sapiens
ggtgcttgttccctctccctg

SEQ ID NO: 3178482 - DNA, 19 bp, Homo sapiens
ggtgcttttatagaggcta

SEQ ID NO: 3178483 - DNA, 17 bp, Homo sapiens
ggtggactgcgctggac

SEQ ID NO: 3178484 - DNA, 23 bp, Homo sapiens
ggtggacttagaaagcaggggct

SEQ ID NO: 3178485 - DNA, 21 bp, Homo sapiens
ggtggagaaagcactgacctg

SEQ ID NO: 3178486 - DNA, 22 bp, Homo sapiens
ggtggaggaaggtgctgagctt

SEQ ID NO: 3178487 - DNA, 14 bp, Homo sapiens
ggtggagggcacag

SEQ ID NO: 3178488 - DNA, 17 bp, Homo sapiens
ggtggagggcacagccc

SEQ ID NO: 3178489 - DNA, 13 bp, Homo sapiens
ggtggcaagagcc

SEQ ID NO: 3178490 - DNA, 19 bp, Homo sapiens
ggtggcacaccacccgagg

SEQ ID NO: 3178491 - DNA, 12 bp, Homo sapiens
ggtggcaccaga

SEQ ID NO: 3178492 - DNA, 20 bp, Homo sapiens
ggtggcaccagatgcaacct

SEQ ID NO: 3178493 - DNA, 11 bp, Homo sapiens
ggtggcagctg

SEQ ID NO: 3178494 - DNA, 23 bp, Homo sapiens
ggtggcagctgcggtccacccag

SEQ ID NO: 3178495 - DNA, 18 bp, Homo sapiens
ggtggcagtggaggtggg

SEQ ID NO: 3178496 - DNA, 22 bp, Homo sapiens
ggtggcagtgggagctgcctgt

SEQ ID NO: 3178497 - DNA, 22 bp, Homo sapiens
ggtggcatcctccggagagaga

SEQ ID NO: 3178498 - DNA, 21 bp, Homo sapiens
ggtggccactccagacccctg

SEQ ID NO: 3178499 - DNA, 16 bp, Homo sapiens
ggtggccatccctggg

SEQ ID NO: 3178500 - DNA, 23 bp, Homo sapiens
ggtggccatccctgggcccctcc

SEQ ID NO: 3178501 - DNA, 17 bp, Homo sapiens
ggtggcccgacagcctg

SEQ ID NO: 3178502 - DNA, 20 bp, Homo sapiens
ggtggcccgacagcctggca

SEQ ID NO: 3178503 - DNA, 20 bp, Homo sapiens
ggtggccgctgagtggcagg

SEQ ID NO: 3178504 - DNA, 12 bp, Homo sapiens
ggtggcctcggg

SEQ ID NO: 3178505 - DNA, 14 bp, Homo sapiens
ggtggcggcagggc

SEQ ID NO: 3178506 - DNA, 21 bp, Homo sapiens
ggtggcgggcgcctgtaatcc

SEQ ID NO: 3178507 - DNA, 14 bp, Homo sapiens
ggtggctcacgcct

SEQ ID NO: 3178508 - DNA, 19 bp, Homo sapiens
ggtggctcacgcctgtaat

SEQ ID NO: 3178509 - DNA, 20 bp, Homo sapiens
ggtggctgccccggcctcct

SEQ ID NO: 3178510 - DNA, 16 bp, Homo sapiens
ggtgggacagcctctt

SEQ ID NO: 3178511 - DNA, 22 bp, Homo sapiens
ggtgggaccctgtccggcccag

SEQ ID NO: 3178512 - DNA, 15 bp, Homo sapiens
ggtgggagagcccag

SEQ ID NO: 3178513 - DNA, 16 bp, Homo sapiens
ggtgggagagcccagc

SEQ ID NO: 3178514 - DNA, 14 bp, Homo sapiens
ggtgggcaggtggt

SEQ ID NO: 3178515 - DNA, 22 bp, Homo sapiens
ggtgggcccaggaccagctggg

SEQ ID NO: 3178516 - DNA, 12 bp, Homo sapiens
ggtgggcctggc

SEQ ID NO: 3178517 - DNA, 16 bp, Homo sapiens
ggtgggctctgtgcag

SEQ ID NO: 3178518 - DNA, 15 bp, Homo sapiens
ggtgggctgagccct

SEQ ID NO: 3178519 - DNA, 19 bp, Homo sapiens
ggtgggctggggctgctcc

SEQ ID NO: 3178520 - DNA, 23 bp, Homo sapiens
ggtggggacattgctctctgggc

SEQ ID NO: 3178521 - DNA, 12 bp, Homo sapiens
ggtggggagaaa

SEQ ID NO: 3178522 - DNA, 12 bp, Homo sapiens
ggtggggccagg

SEQ ID NO: 3178523 - DNA, 16 bp, Homo sapiens
ggtggggccaggccag

SEQ ID NO: 3178524 - DNA, 23 bp, Homo sapiens
ggtggggccataaacggttcctg

SEQ ID NO: 3178525 - DNA, 13 bp, Homo sapiens
ggtggggccctgc

SEQ ID NO: 3178526 - DNA, 15 bp, Homo sapiens
ggtggggcgaggcag

SEQ ID NO: 3178527 - DNA, 20 bp, Homo sapiens
ggtgggggctcctggtggcc

SEQ ID NO: 3178528 - DNA, 14 bp, Homo sapiens
ggtggggtcctgga

SEQ ID NO: 3178529 - DNA, 12 bp, Homo sapiens
ggtgggtgctca

SEQ ID NO: 3178530 - DNA, 13 bp, Homo sapiens
ggtgggtgctcag

SEQ ID NO: 3178531 - DNA, 21 bp, Homo sapiens
ggtgggttgaatatagcctgc

SEQ ID NO: 3178532 - DNA, 23 bp, Homo sapiens
ggtgggttgaatatagcctgcct

SEQ ID NO: 3178533 - DNA, 18 bp, Homo sapiens
ggtggtctgaatgttctg

SEQ ID NO: 3178534 - DNA, 20 bp, Homo sapiens
ggtggtgggaaccatgaaga

SEQ ID NO: 3178535 - DNA, 14 bp, Homo sapiens
ggtggtggggaggg

SEQ ID NO: 3178536 - DNA, 13 bp, Homo sapiens
ggtggttcctaag

SEQ ID NO: 3178537 - DNA, 13 bp, Homo sapiens
ggtggttcctttg

SEQ ID NO: 3178538 - DNA, 17 bp, Homo sapiens
ggtgtaaagctggccct

SEQ ID NO: 3178539 - DNA, 15 bp, Homo sapiens
ggtgtaataagacat

SEQ ID NO: 3178540 - DNA, 18 bp, Homo sapiens
ggtgtacactaacatttc

SEQ ID NO: 3178541 - DNA, 20 bp, Homo sapiens
ggtgtactgggttaatggct

SEQ ID NO: 3178542 - DNA, 21 bp, Homo sapiens
ggtgtaggggccacctcctcc

SEQ ID NO: 3178543 - DNA, 13 bp, Homo sapiens
ggtgtcaactaaa

SEQ ID NO: 3178544 - DNA, 17 bp, Homo sapiens
ggtgtcaagagggtctg

SEQ ID NO: 3178545 - DNA, 23 bp, Homo sapiens
ggtgtcacatggggcctggccca

SEQ ID NO: 3178546 - DNA, 15 bp, Homo sapiens
ggtgtcatctgagga

SEQ ID NO: 3178547 - DNA, 18 bp, Homo sapiens
ggtgtcctgaccaccctc

SEQ ID NO: 3178548 - DNA, 18 bp, Homo sapiens
ggtgtcctttcccctctc

SEQ ID NO: 3178549 - DNA, 20 bp, Homo sapiens
ggtgtcctttcccctctctg

SEQ ID NO: 3178550 - DNA, 15 bp, Homo sapiens
ggtgtctccttaagc

SEQ ID NO: 3178551 - DNA, 20 bp, Homo sapiens
ggtgtgaactcaccctggga

SEQ ID NO: 3178552 - DNA, 17 bp, Homo sapiens
ggtgtgaccatgttcat

SEQ ID NO: 3178553 - DNA, 13 bp, Homo sapiens
ggtgtggcctcag

SEQ ID NO: 3178554 - DNA, 14 bp, Homo sapiens
ggtgtggcctcagc

SEQ ID NO: 3178555 - DNA, 18 bp, Homo sapiens
ggtgtggcctcagccctc

SEQ ID NO: 3178556 - DNA, 18 bp, Homo sapiens
ggtgtggtggctcatggc

SEQ ID NO: 3178557 - DNA, 19 bp, Homo sapiens
ggtgtgtccctggacacag

SEQ ID NO: 3178558 - DNA, 18 bp, Homo sapiens
ggtgtgttccaactgccc

SEQ ID NO: 3178559 - DNA, 15 bp, Homo sapiens
gtacccactgctctg

SEQ ID NO: 3178560 - DNA, 15 bp, Homo sapiens
gtacccagatgccta

SEQ ID NO: 3178561 - DNA, 16 bp, Homo sapiens
gtacccagatgcctac

SEQ ID NO: 3178562 - DNA, 20 bp, Homo sapiens
gtacccagccatctgcccag

SEQ ID NO: 3178563 - DNA, 21 bp, Homo sapiens
gtacccagccatctgcccagg

SEQ ID NO: 3178564 - DNA, 14 bp, Homo sapiens
gtaccccaccctca

SEQ ID NO: 3178565 - DNA, 19 bp, Homo sapiens
gtaccccaccctcagcacc

SEQ ID NO: 3178566 - DNA, 12 bp, Homo sapiens
gtacccccttct

SEQ ID NO: 3178567 - DNA, 20 bp, Homo sapiens
gtacccgcctgagctcctgc

SEQ ID NO: 3178568 - DNA, 14 bp, Homo sapiens
gtacccttccacct

SEQ ID NO: 3178569 - DNA, 20 bp, Homo sapiens
gtacccttccacctcctaga

SEQ ID NO: 3178570 - DNA, 13 bp, Homo sapiens
gtaccctttaaga

SEQ ID NO: 3178571 - DNA, 22 bp, Homo sapiens
gtaccctttaagatatccatct

SEQ ID NO: 3178572 - DNA, 17 bp, Homo sapiens
gtacctagctggctctg

SEQ ID NO: 3178573 - DNA, 21 bp, Homo sapiens
gtacctataaagtaaagctaa

SEQ ID NO: 3178574 - DNA, 14 bp, Homo sapiens
gtacctcaaatgaa

SEQ ID NO: 3178575 - DNA, 20 bp, Homo sapiens
gtacctcagtggatcttcag

SEQ ID NO: 3178576 - DNA, 14 bp, Homo sapiens
gtacctcatcccat

SEQ ID NO: 3178577 - DNA, 18 bp, Homo sapiens
gtacctcctctcagtgtt

SEQ ID NO: 3178578 - DNA, 19 bp, Homo sapiens
gtacctgctgccccagctg

SEQ ID NO: 3178579 - DNA, 12 bp, Homo sapiens
gtacctgggaaa

SEQ ID NO: 3178580 - DNA, 13 bp, Homo sapiens
gtacctttgtcac

SEQ ID NO: 3178581 - DNA, 15 bp, Homo sapiens
gtacgatgacagtgt

SEQ ID NO: 3178582 - DNA, 17 bp, Homo sapiens
gtacggattttcagtta

SEQ ID NO: 3178583 - DNA, 16 bp, Homo sapiens
gtacgggttgttttgg

SEQ ID NO: 3178584 - DNA, 17 bp, Homo sapiens
gtacgtctgacaggcaa

SEQ ID NO: 3178585 - DNA, 14 bp, Homo sapiens
gtacgtttgtatgt

SEQ ID NO: 3178586 - DNA, 17 bp, Homo sapiens
gtactaaatttaaattt

SEQ ID NO: 3178587 - DNA, 15 bp, Homo sapiens
gtactaaggaatctt

SEQ ID NO: 3178588 - DNA, 23 bp, Homo sapiens
gtactaaggaatctttctgcttt

SEQ ID NO: 3178589 - DNA, 20 bp, Homo sapiens
gtactaagggaacaatccat

SEQ ID NO: 3178590 - DNA, 19 bp, Homo sapiens
gtactagatgcatcactgg

SEQ ID NO: 3178591 - DNA, 21 bp, Homo sapiens
gtactaggttggacagccccc

SEQ ID NO: 3178592 - DNA, 14 bp, Homo sapiens
gtactagtgtggtg

SEQ ID NO: 3178593 - DNA, 17 bp, Homo sapiens
gtactagtgttctgttt

SEQ ID NO: 3178594 - DNA, 16 bp, Homo sapiens
gtactagttacacatc

SEQ ID NO: 3178595 - DNA, 17 bp, Homo sapiens
gtactagttacacatct

SEQ ID NO: 3178596 - DNA, 13 bp, Homo sapiens
gtactagttttag

SEQ ID NO: 3178597 - DNA, 16 bp, Homo sapiens
gtactatctgttcccc

SEQ ID NO: 3178598 - DNA, 13 bp, Homo sapiens
gtactatgtatca

SEQ ID NO: 3178599 - DNA, 16 bp, Homo sapiens
gtactcagagcagagc

SEQ ID NO: 3178600 - DNA, 17 bp, Homo sapiens
gtactcagagcagagca

SEQ ID NO: 3178601 - DNA, 17 bp, Homo sapiens
gtactcaggaggctgag

SEQ ID NO: 3178602 - DNA, 23 bp, Homo sapiens
gtactcaggaggctgaggggagg

SEQ ID NO: 3178603 - DNA, 16 bp, Homo sapiens
gtactccctctcagga

SEQ ID NO: 3178604 - DNA, 20 bp, Homo sapiens
gtactccctctcaggatcca

SEQ ID NO: 3178605 - DNA, 11 bp, Homo sapiens
gtactctccta

SEQ ID NO: 3178606 - DNA, 23 bp, Homo sapiens
gtactctcctagagacagaagca

SEQ ID NO: 3178607 - DNA, 22 bp, Homo sapiens
gtactctctgctctagccagga

SEQ ID NO: 3178608 - DNA, 14 bp, Homo sapiens
gtactctgaaacac

SEQ ID NO: 3178609 - DNA, 21 bp, Homo sapiens
gtactctgaaacacactgaaa

SEQ ID NO: 3178610 - DNA, 16 bp, Homo sapiens
gtactcttaggatatt

SEQ ID NO: 3178611 - DNA, 14 bp, Homo sapiens
gtactgaaagcctt

SEQ ID NO: 3178612 - DNA, 22 bp, Homo sapiens
gtactgaaagccttagggaagc

SEQ ID NO: 3178613 - DNA, 18 bp, Homo sapiens
gtactgaagccaaatgaa

SEQ ID NO: 3178614 - DNA, 19 bp, Homo sapiens
gtactgaagccaaatgaaa

SEQ ID NO: 3178615 - DNA, 20 bp, Homo sapiens
gtactgactttctgattact

SEQ ID NO: 3178616 - DNA, 17 bp, Homo sapiens
gtactgactttgcttgc

SEQ ID NO: 3178617 - DNA, 18 bp, Homo sapiens
gtactgactttgcttgct

SEQ ID NO: 3178618 - DNA, 20 bp, Homo sapiens
gtactgcattctctcccatc

SEQ ID NO: 3178619 - DNA, 23 bp, Homo sapiens
gtactgccccccatgaggaagga

SEQ ID NO: 3178620 - DNA, 18 bp, Homo sapiens
gtactgggagaatcacta

SEQ ID NO: 3178621 - DNA, 20 bp, Homo sapiens
gtactgggttaatggctagt

SEQ ID NO: 3178622 - DNA, 12 bp, Homo sapiens
gtactgtaataa

SEQ ID NO: 3178623 - DNA, 14 bp, Homo sapiens
gtactgtactaatt

SEQ ID NO: 3178624 - DNA, 18 bp, Homo sapiens
gtactgtctgattggctt

SEQ ID NO: 3178625 - DNA, 19 bp, Homo sapiens
gtacttaaatgaaagcatg

SEQ ID NO: 3178626 - DNA, 23 bp, Homo sapiens
gtacttaaatggtaataagcact

SEQ ID NO: 3178627 - DNA, 19 bp, Homo sapiens
gtacttagccagttcaaag

SEQ ID NO: 3178628 - DNA, 18 bp, Homo sapiens
gtacttcaggggcacttc

SEQ ID NO: 3178629 - DNA, 14 bp, Homo sapiens
gtacttcctcctga

SEQ ID NO: 3178630 - DNA, 15 bp, Homo sapiens
gtacttcctcctgat

SEQ ID NO: 3178631 - DNA, 16 bp, Homo sapiens
gtacttctccaccctg

SEQ ID NO: 3178632 - DNA, 18 bp, Homo sapiens
gtacttctccaccctgct

SEQ ID NO: 3178633 - DNA, 20 bp, Homo sapiens
gtacttctccaccctgctct

SEQ ID NO: 3178634 - DNA, 12 bp, Homo sapiens
gtacttctgtgt

SEQ ID NO: 3178635 - DNA, 13 bp, Homo sapiens
gtacttctgtgtt

SEQ ID NO: 3178636 - DNA, 15 bp, Homo sapiens
gtacttctgtgttca

SEQ ID NO: 3178637 - DNA, 14 bp, Homo sapiens
gtacttgatactga

SEQ ID NO: 3178638 - DNA, 17 bp, Homo sapiens
gtacttgatactgaatg

SEQ ID NO: 3178639 - DNA, 13 bp, Homo sapiens
gtacttgatttga

SEQ ID NO: 3178640 - DNA, 22 bp, Homo sapiens
gtacttgtgaaacacagctgtt

SEQ ID NO: 3178641 - DNA, 16 bp, Homo sapiens
gtacttgtggacacag

SEQ ID NO: 3178642 - DNA, 15 bp, Homo sapiens
gtacttgtgtttgct

SEQ ID NO: 3178643 - DNA, 12 bp, Homo sapiens
gtacttgtttgc

SEQ ID NO: 3178644 - DNA, 18 bp, Homo sapiens
gtactttattcttgctgg

SEQ ID NO: 3178645 - DNA, 16 bp, Homo sapiens
gtactttattgtacag

SEQ ID NO: 3178646 - DNA, 16 bp, Homo sapiens
gtacttttcattctct

SEQ ID NO: 3178647 - DNA, 20 bp, Homo sapiens
gtacttttcattctctttta

SEQ ID NO: 3178648 - DNA, 20 bp, Homo sapiens
gtagaaaaaaaaacagctct

SEQ ID NO: 3178649 - DNA, 12 bp, Homo sapiens
gtagaaacattg

SEQ ID NO: 3178650 - DNA, 17 bp, Homo sapiens
gtagaaattcttcatga

SEQ ID NO: 3178651 - DNA, 17 bp, Homo sapiens
gtagaacactaattcat

SEQ ID NO: 3178652 - DNA, 18 bp, Homo sapiens
gtagaacactaattcata

SEQ ID NO: 3178653 - DNA, 20 bp, Homo sapiens
gtagaactcactctgggctg

SEQ ID NO: 3178654 - DNA, 22 bp, Homo sapiens
gtagaactcactctgggctgta

SEQ ID NO: 3178655 - DNA, 15 bp, Homo sapiens
gtagaactcagcagt

SEQ ID NO: 3178656 - DNA, 21 bp, Homo sapiens
gtagaagcattccttctttga

SEQ ID NO: 3178657 - DNA, 15 bp, Homo sapiens
gtagaaggagccttg

SEQ ID NO: 3178658 - DNA, 18 bp, Homo sapiens
gtagaattaccattaatt

SEQ ID NO: 3178659 - DNA, 16 bp, Homo sapiens
gtagaattgttataga

SEQ ID NO: 3178660 - DNA, 18 bp, Homo sapiens
gtagacaatcattgtttt

SEQ ID NO: 3178661 - DNA, 18 bp, Homo sapiens
gtagacacgctcttctat

SEQ ID NO: 3178662 - DNA, 13 bp, Homo sapiens
gtagacacttact

SEQ ID NO: 3178663 - DNA, 15 bp, Homo sapiens
gtagacatttataac

SEQ ID NO: 3178664 - DNA, 16 bp, Homo sapiens
gtagacctagggagga

SEQ ID NO: 3178665 - DNA, 20 bp, Homo sapiens
gtagacctagggaggacctt

SEQ ID NO: 3178666 - DNA, 20 bp, Homo sapiens
gtagaccttgttacttctga

SEQ ID NO: 3178667 - DNA, 22 bp, Homo sapiens
gtagaccttgttacttctgagg

SEQ ID NO: 3178668 - DNA, 10 bp, Homo sapiens
gtagactagt

SEQ ID NO: 3178669 - DNA, 16 bp, Homo sapiens
gtagagcaaaactata

SEQ ID NO: 3178670 - DNA, 10 bp, Homo sapiens
gtagagccag

SEQ ID NO: 3178671 - DNA, 12 bp, Homo sapiens
gtagagccagct

SEQ ID NO: 3178672 - DNA, 11 bp, Homo sapiens
gtagagccagg

SEQ ID NO: 3178673 - DNA, 12 bp, Homo sapiens
gtagaggcctgg

SEQ ID NO: 3178674 - DNA, 19 bp, Homo sapiens
gtagaggctccccagggct

SEQ ID NO: 3178675 - DNA, 23 bp, Homo sapiens
gtagagttgctgagagggctcga

SEQ ID NO: 3178676 - DNA, 15 bp, Homo sapiens
gtagataaatatttg

SEQ ID NO: 3178677 - DNA, 13 bp, Homo sapiens
gtagatagaaata

SEQ ID NO: 3178678 - DNA, 17 bp, Homo sapiens
gtagatatgtattcttt

SEQ ID NO: 3178679 - DNA, 15 bp, Homo sapiens
gtagatattacttta

SEQ ID NO: 3178680 - DNA, 21 bp, Homo sapiens
gtagatatttggcttaaatat

SEQ ID NO: 3178681 - DNA, 17 bp, Homo sapiens
gtagatcgcttgagccc

SEQ ID NO: 3178682 - DNA, 12 bp, Homo sapiens
gtagatgggtgg

SEQ ID NO: 3178683 - DNA, 17 bp, Homo sapiens
gtagatgggtgggggct

SEQ ID NO: 3178684 - DNA, 16 bp, Homo sapiens
gtagatgttctaggat

SEQ ID NO: 3178685 - DNA, 15 bp, Homo sapiens
gtagatgttgtcttg

SEQ ID NO: 3178686 - DNA, 17 bp, Homo sapiens
gtattgcttattttatt

SEQ ID NO: 3178687 - DNA, 17 bp, Homo sapiens
gtattggtggctttcct

SEQ ID NO: 3178688 - DNA, 13 bp, Homo sapiens
gtattgtaatctt

SEQ ID NO: 3178689 - DNA, 18 bp, Homo sapiens
gtattgtttaaaatgtaa

SEQ ID NO: 3178690 - DNA, 18 bp, Homo sapiens
gtatttaattgtaaactg

SEQ ID NO: 3178691 - DNA, 19 bp, Homo sapiens
gtatttaattgtaaactgt

SEQ ID NO: 3178692 - DNA, 21 bp, Homo sapiens
gtatttaattgtaaactgtac

SEQ ID NO: 3178693 - DNA, 16 bp, Homo sapiens
gtatttacgctttgat

SEQ ID NO: 3178694 - DNA, 20 bp, Homo sapiens
gtatttactgtactaattag

SEQ ID NO: 3178695 - DNA, 13 bp, Homo sapiens
gtatttataaata

SEQ ID NO: 3178696 - DNA, 15 bp, Homo sapiens
gtatttatatattta

SEQ ID NO: 3178697 - DNA, 19 bp, Homo sapiens
gtatttatatttggaaaga

SEQ ID NO: 3178698 - DNA, 23 bp, Homo sapiens
gtatttatatttggaaagagacc

SEQ ID NO: 3178699 - DNA, 19 bp, Homo sapiens
gtatttatgtaatgaagta

SEQ ID NO: 3178700 - DNA, 22 bp, Homo sapiens
gtatttatgtaatgaagtaaag

SEQ ID NO: 3178701 - DNA, 13 bp, Homo sapiens
gtatttattaatt

SEQ ID NO: 3178702 - DNA, 16 bp, Homo sapiens
gtatttattatttgaa

SEQ ID NO: 3178703 - DNA, 19 bp, Homo sapiens
gtatttattttttcttttc

SEQ ID NO: 3178704 - DNA, 18 bp, Homo sapiens
gtatttcaactgctgtaa

SEQ ID NO: 3178705 - DNA, 15 bp, Homo sapiens
gtatttcatgtggct

SEQ ID NO: 3178706 - DNA, 19 bp, Homo sapiens
gtatttgagagttctaaat

SEQ ID NO: 3178707 - DNA, 22 bp, Homo sapiens
gtatttgcttttttgttttggc

SEQ ID NO: 3178708 - DNA, 20 bp, Homo sapiens
gtatttggaaataaagtcag

SEQ ID NO: 3178709 - DNA, 18 bp, Homo sapiens
gtatttggaatatttgaa

SEQ ID NO: 3178710 - DNA, 20 bp, Homo sapiens
gtatttgggaagtgaagact

SEQ ID NO: 3178711 - DNA, 14 bp, Homo sapiens
gtatttgtattaat

SEQ ID NO: 3178712 - DNA, 16 bp, Homo sapiens
gtatttgtattaataa

SEQ ID NO: 3178713 - DNA, 20 bp, Homo sapiens
gtatttgtattaataaagca

SEQ ID NO: 3178714 - DNA, 22 bp, Homo sapiens
gtatttgtattaataaagcatt

SEQ ID NO: 3178715 - DNA, 18 bp, Homo sapiens
gtattttaacactttgta

SEQ ID NO: 3178716 - DNA, 15 bp, Homo sapiens
gtattttaatcctgt

SEQ ID NO: 3178717 - DNA, 16 bp, Homo sapiens
gtattttgtcccattt

SEQ ID NO: 3178718 - DNA, 18 bp, Homo sapiens
gtattttgtgtgaccaac

SEQ ID NO: 3178719 - DNA, 23 bp, Homo sapiens
gtattttgtgtgaccaactgtgt

SEQ ID NO: 3178720 - DNA, 13 bp, Homo sapiens
gtatttttatcca

SEQ ID NO: 3178721 - DNA, 21 bp, Homo sapiens
gtatttttgattgttatgtaa

SEQ ID NO: 3178722 - DNA, 20 bp, Homo sapiens
gtatttttgtgaagtattca

SEQ ID NO: 3178723 - DNA, 15 bp, Homo sapiens
gtattttttatttac

SEQ ID NO: 3178724 - DNA, 16 bp, Homo sapiens
gtatttttttttctaa

SEQ ID NO: 3178725 - DNA, 22 bp, Homo sapiens
gtatttttttttctaagagaag

SEQ ID NO: 3178726 - DNA, 14 bp, Homo sapiens
gtcaaaacactgtg

SEQ ID NO: 3178727 - DNA, 15 bp, Homo sapiens
gtcaaaacactgtgg

SEQ ID NO: 3178728 - DNA, 16 bp, Homo sapiens
gtcaaaacactgtgga

SEQ ID NO: 3178729 - DNA, 15 bp, Homo sapiens
gtcaaaagctggatt

SEQ ID NO: 3178730 - DNA, 15 bp, Homo sapiens
gtcaaaagttggact

SEQ ID NO: 3178731 - DNA, 19 bp, Homo sapiens
gtcaaaagttggactaaat

SEQ ID NO: 3178732 - DNA, 12 bp, Homo sapiens
gtcaaaattaat

SEQ ID NO: 3178733 - DNA, 17 bp, Homo sapiens
gtcaaacattcgtgagc

SEQ ID NO: 3178734 - DNA, 20 bp, Homo sapiens
gtcaaacattcgtgagctgg

SEQ ID NO: 3178735 - DNA, 13 bp, Homo sapiens
gtcaaacttggat

SEQ ID NO: 3178736 - DNA, 18 bp, Homo sapiens
gtcaaaggcatctccctt

SEQ ID NO: 3178737 - DNA, 22 bp, Homo sapiens
gtcaaatggtaggcatttccta

SEQ ID NO: 3178738 - DNA, 21 bp, Homo sapiens
gtcaaccactaaagtatagag

SEQ ID NO: 3178739 - DNA, 17 bp, Homo sapiens
gtcaaccctcaggggaa

SEQ ID NO: 3178740 - DNA, 21 bp, Homo sapiens
gtcaactaaatgagattatat

SEQ ID NO: 3178741 - DNA, 14 bp, Homo sapiens
gtcaagattttgaa

SEQ ID NO: 3178742 - DNA, 23 bp, Homo sapiens
gtcaagcacatgtaataaattca

SEQ ID NO: 3178743 - DNA, 17 bp, Homo sapiens
gtcaagtctctgctggc

SEQ ID NO: 3178744 - DNA, 17 bp, Homo sapiens
gtcaataaacaacagct

SEQ ID NO: 3178745 - DNA, 18 bp, Homo sapiens
gtcaataaacaacagctg

SEQ ID NO: 3178746 - DNA, 21 bp, Homo sapiens
gtcaataaacttagaggaaaa

SEQ ID NO: 3178747 - DNA, 23 bp, Homo sapiens
gtcaataaacttagaggaaaatg

SEQ ID NO: 3178748 - DNA, 14 bp, Homo sapiens
gtcaatattaaata

SEQ ID NO: 3178749 - DNA, 16 bp, Homo sapiens
gtcaatattaaataca

SEQ ID NO: 3178750 - DNA, 17 bp, Homo sapiens
gtcaatattaaatacag

SEQ ID NO: 3178751 - DNA, 13 bp, Homo sapiens
gtcacacactgat

SEQ ID NO: 3178752 - DNA, 20 bp, Homo sapiens
gtcacacagtattacttctg

SEQ ID NO: 3178753 - DNA, 19 bp, Homo sapiens
gtcacacagtgttggaggt

SEQ ID NO: 3178754 - DNA, 18 bp, Homo sapiens
gtcacactcttcagtgac

SEQ ID NO: 3178755 - DNA, 22 bp, Homo sapiens
gtcacagcatggaggaggaggg

SEQ ID NO: 3178756 - DNA, 12 bp, Homo sapiens
gtcacagctgca

SEQ ID NO: 3178757 - DNA, 19 bp, Homo sapiens
gtcacagctgcagctgggc

SEQ ID NO: 3178758 - DNA, 19 bp, Homo sapiens
gtcacaggactctgcctcc

SEQ ID NO: 3178759 - DNA, 12 bp, Homo sapiens
gtcacaggcagg

SEQ ID NO: 3178760 - DNA, 15 bp, Homo sapiens
gtcacaggcaggtcc

SEQ ID NO: 3178761 - DNA, 16 bp, Homo sapiens
gtcacaggcccagaag

SEQ ID NO: 3178762 - DNA, 22 bp, Homo sapiens
gtcacaggcccagaagggtagc

SEQ ID NO: 3178763 - DNA, 12 bp, Homo sapiens
gtcacagggcca

SEQ ID NO: 3178764 - DNA, 18 bp, Homo sapiens
gtcacagggcctggggag

SEQ ID NO: 3178765 - DNA, 16 bp, Homo sapiens
gtcacagtaaaaataa

SEQ ID NO: 3178766 - DNA, 20 bp, Homo sapiens
gtcacagtaaaaataaaata

SEQ ID NO: 3178767 - DNA, 17 bp, Homo sapiens
gtcacatcagataagac

SEQ ID NO: 3178768 - DNA, 23 bp, Homo sapiens
gtcacatggcctatgcacatatg

SEQ ID NO: 3178769 - DNA, 20 bp, Homo sapiens
gtcacatggggcctggccca

SEQ ID NO: 3178770 - DNA, 22 bp, Homo sapiens
gtcaccaaatagtgtgaaatat

SEQ ID NO: 3178771 - DNA, 13 bp, Homo sapiens
gtcaccacctctc

SEQ ID NO: 3178772 - DNA, 21 bp, Homo sapiens
gtcaccacgactggccagggc

SEQ ID NO: 3178773 - DNA, 18 bp, Homo sapiens
gtcaccagctatctgtca

SEQ ID NO: 3178774 - DNA, 15 bp, Homo sapiens
gtcaccaggacttgg

SEQ ID NO: 3178775 - DNA, 17 bp, Homo sapiens
gtcaccaggggaggagc

SEQ ID NO: 3178776 - DNA, 16 bp, Homo sapiens
gtcaccccaagtagtc

SEQ ID NO: 3178777 - DNA, 22 bp, Homo sapiens
gtcaccgggatgaacctatcct

SEQ ID NO: 3178778 - DNA, 16 bp, Homo sapiens
gtcacctagcaagctg

SEQ ID NO: 3178779 - DNA, 13 bp, Homo sapiens
gtcacctctctca

SEQ ID NO: 3178780 - DNA, 16 bp, Homo sapiens
gtcacctctctcagag

SEQ ID NO: 3178781 - DNA, 17 bp, Homo sapiens
gtcacctctctcagagc

SEQ ID NO: 3178782 - DNA, 19 bp, Homo sapiens
gtcacctctctcagagcat

SEQ ID NO: 3178783 - DNA, 20 bp, Homo sapiens
gtcacctgaagactcattct

SEQ ID NO: 3178784 - DNA, 12 bp, Homo sapiens
gtcacctgcaag

SEQ ID NO: 3178785 - DNA, 24 bp, Homo sapiens
gtcacctgcaagccccagggcctg

SEQ ID NO: 3178786 - DNA, 19 bp, Homo sapiens
gtcaccttccaggacccct

SEQ ID NO: 3178787 - DNA, 19 bp, Homo sapiens
gtcactaaccaacaaggtt

SEQ ID NO: 3178788 - DNA, 21 bp, Homo sapiens
gtcactcattgctgagcctct

SEQ ID NO: 3178789 - DNA, 21 bp, Homo sapiens
gtcactccaccatccccaccc

SEQ ID NO: 3178790 - DNA, 12 bp, Homo sapiens
gtcactgctgtc

SEQ ID NO: 3178791 - DNA, 18 bp, Homo sapiens
gtcactggaaaggggaga

SEQ ID NO: 3178792 - DNA, 20 bp, Homo sapiens
gtcactggaaaggggagagc

SEQ ID NO: 3178793 - DNA, 15 bp, Homo sapiens
gtcactggctctcca

SEQ ID NO: 3178794 - DNA, 14 bp, Homo sapiens
gtcactggctggct

SEQ ID NO: 3178795 - DNA, 15 bp, Homo sapiens
gtcactggctggctc

SEQ ID NO: 3178796 - DNA, 17 bp, Homo sapiens
gtcactggctggctcct

SEQ ID NO: 3178797 - DNA, 19 bp, Homo sapiens
gtcactggctggctcctag

SEQ ID NO: 3178798 - DNA, 18 bp, Homo sapiens
gtcactgtgcactgccct

SEQ ID NO: 3178799 - DNA, 17 bp, Homo sapiens
gtcactgttccttgtca

SEQ ID NO: 3178800 - DNA, 20 bp, Homo sapiens
gtcacttacctagatttaca

SEQ ID NO: 3178801 - DNA, 21 bp, Homo sapiens
gtcacttgatcatgctgcagt

SEQ ID NO: 3178802 - DNA, 24 bp, Homo sapiens
gtcacttgtgctttgctcttgtcc

SEQ ID NO: 3178803 - DNA, 13 bp, Homo sapiens
gtcagaatcagaa

SEQ ID NO: 3178804 - DNA, 24 bp, Homo sapiens
gtcagactgctgggactggccagg

SEQ ID NO: 3178805 - DNA, 16 bp, Homo sapiens
gtcagagcctgcagtt

SEQ ID NO: 3178806 - DNA, 13 bp, Homo sapiens
gtcagaggagaag

SEQ ID NO: 3178807 - DNA, 14 bp, Homo sapiens
gtcagaggagaaga

SEQ ID NO: 3178808 - DNA, 13 bp, Homo sapiens
gtcagaggatggc

SEQ ID NO: 3178809 - DNA, 19 bp, Homo sapiens
gtcagaggctaagatgaga

SEQ ID NO: 3178810 - DNA, 15 bp, Homo sapiens
gtcagagtgccactg

SEQ ID NO: 3178811 - DNA, 21 bp, Homo sapiens
gtctagattcaaaggttctag

SEQ ID NO: 3178812 - DNA, 15 bp, Homo sapiens
gtctaggtctcctca

SEQ ID NO: 3178813 - DNA, 16 bp, Homo sapiens
gtctaggtctcctcag

SEQ ID NO: 3178814 - DNA, 14 bp, Homo sapiens
gtctagtctctcct

SEQ ID NO: 3178815 - DNA, 18 bp, Homo sapiens
gtctagtctctcctgtaa

SEQ ID NO: 3178816 - DNA, 13 bp, Homo sapiens
gtctatccacaga

SEQ ID NO: 3178817 - DNA, 21 bp, Homo sapiens
gtctatgacttatttccttca

SEQ ID NO: 3178818 - DNA, 14 bp, Homo sapiens
gtctatgcagcctg

SEQ ID NO: 3178819 - DNA, 15 bp, Homo sapiens
gtctatgggactcaa

SEQ ID NO: 3178820 - DNA, 22 bp, Homo sapiens
gtctatgggactcaatgcactg

SEQ ID NO: 3178821 - DNA, 16 bp, Homo sapiens
gtctatttaagcctca

SEQ ID NO: 3178822 - DNA, 23 bp, Homo sapiens
gtctattttattatgagctttct

SEQ ID NO: 3178823 - DNA, 16 bp, Homo sapiens
gtctattttctgcaga

SEQ ID NO: 3178824 - DNA, 17 bp, Homo sapiens
gtctcaaaaatacaaaa

SEQ ID NO: 3178825 - DNA, 18 bp, Homo sapiens
gtctcaaaataaagcaat

SEQ ID NO: 3178826 - DNA, 13 bp, Homo sapiens
gtctcaaacaagg

SEQ ID NO: 3178827 - DNA, 16 bp, Homo sapiens
gtctcaaactcctggg

SEQ ID NO: 3178828 - DNA, 20 bp, Homo sapiens
gtctcaaactcctgggctca

SEQ ID NO: 3178829 - DNA, 17 bp, Homo sapiens
gtctcaagagggcactg

SEQ ID NO: 3178830 - DNA, 11 bp, Homo sapiens
gtctcactctg

SEQ ID NO: 3178831 - DNA, 15 bp, Homo sapiens
gtctcactctgtcgc

SEQ ID NO: 3178832 - DNA, 15 bp, Homo sapiens
gtctcactgaaacat

SEQ ID NO: 3178833 - DNA, 14 bp, Homo sapiens
gtctcactgcttga

SEQ ID NO: 3178834 - DNA, 15 bp, Homo sapiens
gtctcactgcttgaa

SEQ ID NO: 3178835 - DNA, 22 bp, Homo sapiens
gtctcactgtgggaaggccagc

SEQ ID NO: 3178836 - DNA, 19 bp, Homo sapiens
gtctcactgttgcccaggc

SEQ ID NO: 3178837 - DNA, 21 bp, Homo sapiens
gtctcactgttgcccaggctg

SEQ ID NO: 3178838 - DNA, 23 bp, Homo sapiens
gtctcactgttgcccaggctggc

SEQ ID NO: 3178839 - DNA, 17 bp, Homo sapiens
gtctcagaaactcccct

SEQ ID NO: 3178840 - DNA, 13 bp, Homo sapiens
gtctcagaagagg

SEQ ID NO: 3178841 - DNA, 13 bp, Homo sapiens
gtctcagaatcta

SEQ ID NO: 3178842 - DNA, 19 bp, Homo sapiens
gtctcagacttttgtacat

SEQ ID NO: 3178843 - DNA, 17 bp, Homo sapiens
gtctcaggctggtggga

SEQ ID NO: 3178844 - DNA, 15 bp, Homo sapiens
gtctcaggtccctgc

SEQ ID NO: 3178845 - DNA, 15 bp, Homo sapiens
gtctcagttggaaat

SEQ ID NO: 3178846 - DNA, 19 bp, Homo sapiens
gtctcagtttgtgtgtctt

SEQ ID NO: 3178847 - DNA, 14 bp, Homo sapiens
gtctcatccccagg

SEQ ID NO: 3178848 - DNA, 16 bp, Homo sapiens
gtctcatccccagggg

SEQ ID NO: 3178849 - DNA, 18 bp, Homo sapiens
gtctcatctcttcaggtt

SEQ ID NO: 3178850 - DNA, 14 bp, Homo sapiens
gtctcatgtcctgc

SEQ ID NO: 3178851 - DNA, 16 bp, Homo sapiens
gtctcatgtcctgctg

SEQ ID NO: 3178852 - DNA, 22 bp, Homo sapiens
gtctcatgtcctgctggcttcc

SEQ ID NO: 3178853 - DNA, 22 bp, Homo sapiens
gtctccaaaaaaaaaaaaaata

SEQ ID NO: 3178854 - DNA, 14 bp, Homo sapiens
gtctccaggggcct

SEQ ID NO: 3178855 - DNA, 19 bp, Homo sapiens
gtctccaggggcctgcaga

SEQ ID NO: 3178856 - DNA, 20 bp, Homo sapiens
gtctccaggggcctgcagaa

SEQ ID NO: 3178857 - DNA, 17 bp, Homo sapiens
gtctccctcgacagcgc

SEQ ID NO: 3178858 - DNA, 11 bp, Homo sapiens
gtctccctggc

SEQ ID NO: 3178859 - DNA, 14 bp, Homo sapiens
gtctccctggctcc

SEQ ID NO: 3178860 - DNA, 15 bp, Homo sapiens
gtctcctactcctga

SEQ ID NO: 3178861 - DNA, 14 bp, Homo sapiens
gtctcctcactctg

SEQ ID NO: 3178862 - DNA, 22 bp, Homo sapiens
gtctcctcagggtggggggtga

SEQ ID NO: 3178863 - DNA, 22 bp, Homo sapiens
gtctccttactctgagcccagg

SEQ ID NO: 3178864 - DNA, 18 bp, Homo sapiens
gtctccttcagcacggcg

SEQ ID NO: 3178865 - DNA, 15 bp, Homo sapiens
gtctcctttgcactg

SEQ ID NO: 3178866 - DNA, 16 bp, Homo sapiens
gtctcctttgcactga

SEQ ID NO: 3178867 - DNA, 18 bp, Homo sapiens
gtctcctttgcactgagg

SEQ ID NO: 3178868 - DNA, 13 bp, Homo sapiens
gtctcctttgctc

SEQ ID NO: 3178869 - DNA, 20 bp, Homo sapiens
gtctcgaactcctggcctca

SEQ ID NO: 3178870 - DNA, 14 bp, Homo sapiens
gtctcgctgtcact

SEQ ID NO: 3178871 - DNA, 18 bp, Homo sapiens
gtctcgctgtcactggct

SEQ ID NO: 3178872 - DNA, 23 bp, Homo sapiens
gtctcgctgtcactggctggctc

SEQ ID NO: 3178873 - DNA, 16 bp, Homo sapiens
gtctcgctttgttgcc

SEQ ID NO: 3178874 - DNA, 19 bp, Homo sapiens
gtctcgtggttggaagcct

SEQ ID NO: 3178875 - DNA, 23 bp, Homo sapiens
gtctcgtgtacagctcccttccc

SEQ ID NO: 3178876 - DNA, 17 bp, Homo sapiens
gtctctacaaaaaataa

SEQ ID NO: 3178877 - DNA, 12 bp, Homo sapiens
gtctctagagca

SEQ ID NO: 3178878 - DNA, 18 bp, Homo sapiens
gtctctagagcagggatt

SEQ ID NO: 3178879 - DNA, 16 bp, Homo sapiens
gtctctcacagatgtg

SEQ ID NO: 3178880 - DNA, 14 bp, Homo sapiens
gtctctcccacccc

SEQ ID NO: 3178881 - DNA, 16 bp, Homo sapiens
gtctctcccaccccgg

SEQ ID NO: 3178882 - DNA, 14 bp, Homo sapiens
gtctctccctcagg

SEQ ID NO: 3178883 - DNA, 14 bp, Homo sapiens
gtctctccttttct

SEQ ID NO: 3178884 - DNA, 22 bp, Homo sapiens
gtctctccttttcttttgttac

SEQ ID NO: 3178885 - DNA, 14 bp, Homo sapiens
gtctctctctctct

SEQ ID NO: 3178886 - DNA, 19 bp, Homo sapiens
gtctctcttctctccagct

SEQ ID NO: 3178887 - DNA, 23 bp, Homo sapiens
gtctctcttctctccagctgact

SEQ ID NO: 3178888 - DNA, 19 bp, Homo sapiens
gtctctgaagtactaacac

SEQ ID NO: 3178889 - DNA, 15 bp, Homo sapiens
gtctctgccacccac

SEQ ID NO: 3178890 - DNA, 18 bp, Homo sapiens
gtctctgccggctctttc

SEQ ID NO: 3178891 - DNA, 13 bp, Homo sapiens
gtctctgctggcc

SEQ ID NO: 3178892 - DNA, 17 bp, Homo sapiens
gtctctggggcagatcc

SEQ ID NO: 3178893 - DNA, 12 bp, Homo sapiens
gtctcttccttc

SEQ ID NO: 3178894 - DNA, 15 bp, Homo sapiens
gtctcttctccactg

SEQ ID NO: 3178895 - DNA, 18 bp, Homo sapiens
gtctcttctccactggat

SEQ ID NO: 3178896 - DNA, 16 bp, Homo sapiens
gtctcttctcccagaa

SEQ ID NO: 3178897 - DNA, 14 bp, Homo sapiens
gtctcttctgagct

SEQ ID NO: 3178898 - DNA, 14 bp, Homo sapiens
gtctcttgtagaag

SEQ ID NO: 3178899 - DNA, 16 bp, Homo sapiens
gtctcttgtattaaac

SEQ ID NO: 3178900 - DNA, 17 bp, Homo sapiens
gtctctttaagggcatg

SEQ ID NO: 3178901 - DNA, 22 bp, Homo sapiens
gtctctttaatgtcacaggcag

SEQ ID NO: 3178902 - DNA, 23 bp, Homo sapiens
gtctctttaatgtcacaggcagg

SEQ ID NO: 3178903 - DNA, 16 bp, Homo sapiens
gtctctttcttccttt

SEQ ID NO: 3178904 - DNA, 19 bp, Homo sapiens
gtctctttcttcctttcta

SEQ ID NO: 3178905 - DNA, 19 bp, Homo sapiens
gtctcttttgtaaattaaa

SEQ ID NO: 3178906 - DNA, 17 bp, Homo sapiens
gtctgaaacatttcata

SEQ ID NO: 3178907 - DNA, 18 bp, Homo sapiens
gtctgaacccttgtgctt

SEQ ID NO: 3178908 - DNA, 19 bp, Homo sapiens
gtctgaaggaatagccaga

SEQ ID NO: 3178909 - DNA, 22 bp, Homo sapiens
gtctgaaggaatagccagagag

SEQ ID NO: 3178910 - DNA, 16 bp, Homo sapiens
gtctgaagtcactgca

SEQ ID NO: 3178911 - DNA, 14 bp, Homo sapiens
gtctgaatttattt

SEQ ID NO: 3178912 - DNA, 20 bp, Homo sapiens
gtctgacaggcaatgctggc

SEQ ID NO: 3178913 - DNA, 22 bp, Homo sapiens
gtctgacaggcaatgctggctg

SEQ ID NO: 3178914 - DNA, 23 bp, Homo sapiens
gtctgacaggcaatgctggctgt

SEQ ID NO: 3178915 - DNA, 13 bp, Homo sapiens
gtctgacccactg

SEQ ID NO: 3178916 - DNA, 15 bp, Homo sapiens
gtctgacccactgct

SEQ ID NO: 3178917 - DNA, 16 bp, Homo sapiens
gtctgactcaggcgcc

SEQ ID NO: 3178918 - DNA, 17 bp, Homo sapiens
gtctgactccagagtct

SEQ ID NO: 3178919 - DNA, 20 bp, Homo sapiens
gtctgactccagagtctgag

SEQ ID NO: 3178920 - DNA, 17 bp, Homo sapiens
gtctgagccaaagagaa

SEQ ID NO: 3178921 - DNA, 12 bp, Homo sapiens
gtctgagccctg

SEQ ID NO: 3178922 - DNA, 15 bp, Homo sapiens
gtctgagccctggtg

SEQ ID NO: 3178923 - DNA, 14 bp, Homo sapiens
gtctgaggcctcat

SEQ ID NO: 3178924 - DNA, 17 bp, Homo sapiens
gtctgagtcctgtctct

SEQ ID NO: 3178925 - DNA, 14 bp, Homo sapiens
gtctgagtgaacct

SEQ ID NO: 3178926 - DNA, 21 bp, Homo sapiens
gtctgatcgacgtggtgacgc

SEQ ID NO: 3178927 - DNA, 18 bp, Homo sapiens
gtctgatggatcccgaag

SEQ ID NO: 3178928 - DNA, 18 bp, Homo sapiens
gtctgattcccaagctct

SEQ ID NO: 3178929 - DNA, 19 bp, Homo sapiens
gtctgattcccaagctctg

SEQ ID NO: 3178930 - DNA, 20 bp, Homo sapiens
gtctgattcccaagctctgc

SEQ ID NO: 3178931 - DNA, 22 bp, Homo sapiens
gtctgatttcaggatactctgt

SEQ ID NO: 3178932 - DNA, 13 bp, Homo sapiens
gtctgatttctta

SEQ ID NO: 3178933 - DNA, 20 bp, Homo sapiens
gtctgcaactttaagcagct

SEQ ID NO: 3178934 - DNA, 15 bp, Homo sapiens
gtctgcaagtcagag

SEQ ID NO: 3178935 - DNA, 17 bp, Homo sapiens
gtctgcaagtcagagga

SEQ ID NO: 3178936 - DNA, 16 bp, Homo sapiens
gtctgcacagggtcct

SEQ ID NO: 3178937 - DNA, 19 bp, Homo sapiens
gtgcagatgcaattgtttg

SEQ ID NO: 3178938 - DNA, 15 bp, Homo sapiens
gtgcagcagcccagc

SEQ ID NO: 3178939 - DNA, 14 bp, Homo sapiens
gtgcagctcctcag

SEQ ID NO: 3178940 - DNA, 14 bp, Homo sapiens
gtgcagctgatttt

SEQ ID NO: 3178941 - DNA, 23 bp, Homo sapiens
gtgcagctgattttaacaataac

SEQ ID NO: 3178942 - DNA, 16 bp, Homo sapiens
gtgcaggtgggcactg

SEQ ID NO: 3178943 - DNA, 23 bp, Homo sapiens
gtgcaggtgggcactggagcatg

SEQ ID NO: 3178944 - DNA, 15 bp, Homo sapiens
gtgcagtacaggcaa

SEQ ID NO: 3178945 - DNA, 19 bp, Homo sapiens
gtgcatagaactgggtaaa

SEQ ID NO: 3178946 - DNA, 14 bp, Homo sapiens
gtgcatagtgctgg

SEQ ID NO: 3178947 - DNA, 20 bp, Homo sapiens
gtgcatagttgtagacaaag

SEQ ID NO: 3178948 - DNA, 23 bp, Homo sapiens
gtgcatcctcctcagcccccagg

SEQ ID NO: 3178949 - DNA, 14 bp, Homo sapiens
gtgcatctcagccc

SEQ ID NO: 3178950 - DNA, 18 bp, Homo sapiens
gtgcatctcagcccacat

SEQ ID NO: 3178951 - DNA, 14 bp, Homo sapiens
gtgcatgatggtga

SEQ ID NO: 3178952 - DNA, 18 bp, Homo sapiens
gtgcatgatggtgagagc

SEQ ID NO: 3178953 - DNA, 21 bp, Homo sapiens
gtgcatggaggccctcctgtg

SEQ ID NO: 3178954 - DNA, 13 bp, Homo sapiens
gtgcatgggtgaa

SEQ ID NO: 3178955 - DNA, 16 bp, Homo sapiens
gtgcatgtatgtcttg

SEQ ID NO: 3178956 - DNA, 14 bp, Homo sapiens
gtgcattacagaga

SEQ ID NO: 3178957 - DNA, 23 bp, Homo sapiens
gtgcattacagagaggagaaaca

SEQ ID NO: 3178958 - DNA, 18 bp, Homo sapiens
gtgcattagcacagattt

SEQ ID NO: 3178959 - DNA, 22 bp, Homo sapiens
gtgcatttgagagaagccacgc

SEQ ID NO: 3178960 - DNA, 20 bp, Homo sapiens
gtgcatttttggatcatttt

SEQ ID NO: 3178961 - DNA, 20 bp, Homo sapiens
gtgccaaggacctcctcttc

SEQ ID NO: 3178962 - DNA, 21 bp, Homo sapiens
gtgccaatttcaagttccaag

SEQ ID NO: 3178963 - DNA, 22 bp, Homo sapiens
gtgccacatactgcggaccaag

SEQ ID NO: 3178964 - DNA, 15 bp, Homo sapiens
gtgccaccaccctgc

SEQ ID NO: 3178965 - DNA, 16 bp, Homo sapiens
gtgccaccatgcctca

SEQ ID NO: 3178966 - DNA, 19 bp, Homo sapiens
gtgccacccacctttgcca

SEQ ID NO: 3178967 - DNA, 13 bp, Homo sapiens
gtgccactccctg

SEQ ID NO: 3178968 - DNA, 16 bp, Homo sapiens
gtgccactccctgagc

SEQ ID NO: 3178969 - DNA, 18 bp, Homo sapiens
gtgccactccctgagctt

SEQ ID NO: 3178970 - DNA, 17 bp, Homo sapiens
gtgccactgccccccga

SEQ ID NO: 3178971 - DNA, 21 bp, Homo sapiens
gtgccactgcccgagctggtg

SEQ ID NO: 3178972 - DNA, 22 bp, Homo sapiens
gtgccactgcccgagctggtgc

SEQ ID NO: 3178973 - DNA, 23 bp, Homo sapiens
gtgccactgcccgagctggtgca

SEQ ID NO: 3178974 - DNA, 15 bp, Homo sapiens
gtgccacttaatgta

SEQ ID NO: 3178975 - DNA, 22 bp, Homo sapiens
gtgccactttgactcagaggct

SEQ ID NO: 3178976 - DNA, 15 bp, Homo sapiens
gtgccagagaggggc

SEQ ID NO: 3178977 - DNA, 22 bp, Homo sapiens
gtgccagaggaatcctggcagc

SEQ ID NO: 3178978 - DNA, 22 bp, Homo sapiens
gtgccagaggtgggcaggtggt

SEQ ID NO: 3178979 - DNA, 23 bp, Homo sapiens
gtgccagcatacattttctggtg

SEQ ID NO: 3178980 - DNA, 14 bp, Homo sapiens
gtgccagcattcca

SEQ ID NO: 3178981 - DNA, 21 bp, Homo sapiens
gtgccagcattccagacttca

SEQ ID NO: 3178982 - DNA, 22 bp, Homo sapiens
gtgccagccgtgatgctcaggc

SEQ ID NO: 3178983 - DNA, 17 bp, Homo sapiens
gtgccagtcaagaagaa

SEQ ID NO: 3178984 - DNA, 18 bp, Homo sapiens
gtgccagtcttgtgtctg

SEQ ID NO: 3178985 - DNA, 21 bp, Homo sapiens
gtgccatcaccataacctctg

SEQ ID NO: 3178986 - DNA, 14 bp, Homo sapiens
gtgccatgctgggc

SEQ ID NO: 3178987 - DNA, 15 bp, Homo sapiens
gtgccatgctgggcc

SEQ ID NO: 3178988 - DNA, 12 bp, Homo sapiens
gtgccatgtctg

SEQ ID NO: 3178989 - DNA, 14 bp, Homo sapiens
gtgccatgtgccag

SEQ ID NO: 3178990 - DNA, 14 bp, Homo sapiens
gtgccattcccagc

SEQ ID NO: 3178991 - DNA, 14 bp, Homo sapiens
gtgccattgtcttt

SEQ ID NO: 3178992 - DNA, 23 bp, Homo sapiens
gtgcccaagaatagatgctgact

SEQ ID NO: 3178993 - DNA, 19 bp, Homo sapiens
gtgcccaagccagaggctg

SEQ ID NO: 3178994 - DNA, 23 bp, Homo sapiens
gtgcccaccctgggagacagacc

SEQ ID NO: 3178995 - DNA, 15 bp, Homo sapiens
gtgcccagcctggaa

SEQ ID NO: 3178996 - DNA, 13 bp, Homo sapiens
gtgccccacagct

SEQ ID NO: 3178997 - DNA, 21 bp, Homo sapiens
gtgccccatgcctgtccagcc

SEQ ID NO: 3178998 - DNA, 18 bp, Homo sapiens
gtgccccctcctctccca

SEQ ID NO: 3178999 - DNA, 21 bp, Homo sapiens
gtgcccccttcaagcctgtgc

SEQ ID NO: 3179000 - DNA, 17 bp, Homo sapiens
gtgccccgcctccccga

SEQ ID NO: 3179001 - DNA, 16 bp, Homo sapiens
gtgcccctcgccagct

SEQ ID NO: 3179002 - DNA, 19 bp, Homo sapiens
gtgcccctcgccagcttct

SEQ ID NO: 3179003 - DNA, 23 bp, Homo sapiens
gtgccccttaagggttgaaggca

SEQ ID NO: 3179004 - DNA, 12 bp, Homo sapiens
gtgccctgcacg

SEQ ID NO: 3179005 - DNA, 12 bp, Homo sapiens
gtgccctgcccc

SEQ ID NO: 3179006 - DNA, 18 bp, Homo sapiens
gtgccctgccccctggct

SEQ ID NO: 3179007 - DNA, 15 bp, Homo sapiens
gtgccctggtggaga

SEQ ID NO: 3179008 - DNA, 13 bp, Homo sapiens
gtgccggctgtgg

SEQ ID NO: 3179009 - DNA, 15 bp, Homo sapiens
gtgcctaaaattgta

SEQ ID NO: 3179010 - DNA, 17 bp, Homo sapiens
gtgcctaatggagaaga

SEQ ID NO: 3179011 - DNA, 20 bp, Homo sapiens
gtgcctaatggagaagaccc

SEQ ID NO: 3179012 - DNA, 16 bp, Homo sapiens
gtgcctagactgttac

SEQ ID NO: 3179013 - DNA, 17 bp, Homo sapiens
gtgcctagactgttact

SEQ ID NO: 3179014 - DNA, 13 bp, Homo sapiens
gtgcctcagactc

SEQ ID NO: 3179015 - DNA, 15 bp, Homo sapiens
gtgcctccaccacca

SEQ ID NO: 3179016 - DNA, 13 bp, Homo sapiens
gtgcctccaggtg

SEQ ID NO: 3179017 - DNA, 21 bp, Homo sapiens
gtgcctcctcaaacccagtct

SEQ ID NO: 3179018 - DNA, 16 bp, Homo sapiens
gtgcctcgaggcaccg

SEQ ID NO: 3179019 - DNA, 13 bp, Homo sapiens
gtgcctctgcctg

SEQ ID NO: 3179020 - DNA, 14 bp, Homo sapiens
gtgcctctgggact

SEQ ID NO: 3179021 - DNA, 16 bp, Homo sapiens
gtgcctgagaggcagg

SEQ ID NO: 3179022 - DNA, 17 bp, Homo sapiens
gtgcctgagaggcaggc

SEQ ID NO: 3179023 - DNA, 21 bp, Homo sapiens
gtgcctgcaccaggagacaga

SEQ ID NO: 3179024 - DNA, 14 bp, Homo sapiens
gtgcctgctagagc

SEQ ID NO: 3179025 - DNA, 22 bp, Homo sapiens
gtgcctgctagagcaacccctg

SEQ ID NO: 3179026 - DNA, 23 bp, Homo sapiens
gtgcctgctagagcaacccctgt

SEQ ID NO: 3179027 - DNA, 19 bp, Homo sapiens
gtgcctggcctggcacaca

SEQ ID NO: 3179028 - DNA, 16 bp, Homo sapiens
gtgcctgggaatgtat

SEQ ID NO: 3179029 - DNA, 16 bp, Homo sapiens
gtgcctgggggagttt

SEQ ID NO: 3179030 - DNA, 17 bp, Homo sapiens
gtgcctgtcaggctctg

SEQ ID NO: 3179031 - DNA, 22 bp, Homo sapiens
gtgcctgtcaggctctggccct

SEQ ID NO: 3179032 - DNA, 20 bp, Homo sapiens
gtgcctgtcccacccccacc

SEQ ID NO: 3179033 - DNA, 14 bp, Homo sapiens
gtgcctgtggcaga

SEQ ID NO: 3179034 - DNA, 13 bp, Homo sapiens
gtgcctgtgtcca

SEQ ID NO: 3179035 - DNA, 18 bp, Homo sapiens
gtgccttatgttgaaaaa

SEQ ID NO: 3179036 - DNA, 15 bp, Homo sapiens
gtgccttcagctcta

SEQ ID NO: 3179037 - DNA, 22 bp, Homo sapiens
gtgccttccataattatgacag

SEQ ID NO: 3179038 - DNA, 22 bp, Homo sapiens
gtgccttctccttccccaggat

SEQ ID NO: 3179039 - DNA, 12 bp, Homo sapiens
gtgccttctggg

SEQ ID NO: 3179040 - DNA, 21 bp, Homo sapiens
gtgccttggggaatttcctct

SEQ ID NO: 3179041 - DNA, 20 bp, Homo sapiens
gtgcctttcctgttcagcat

SEQ ID NO: 3179042 - DNA, 17 bp, Homo sapiens
gtgcctttgcaaatcag

SEQ ID NO: 3179043 - DNA, 14 bp, Homo sapiens
gtgccttttatagc

SEQ ID NO: 3179044 - DNA, 14 bp, Homo sapiens
gtgccttttctgaa

SEQ ID NO: 3179045 - DNA, 22 bp, Homo sapiens
gtgccttttgcacccctcccat

SEQ ID NO: 3179046 - DNA, 23 bp, Homo sapiens
gtgccttttgcagaagagggtgt

SEQ ID NO: 3179047 - DNA, 14 bp, Homo sapiens
gtgccttttggaac

SEQ ID NO: 3179048 - DNA, 12 bp, Homo sapiens
gtgcgacagaga

SEQ ID NO: 3179049 - DNA, 23 bp, Homo sapiens
gtgcgacagagagaggggagaga

SEQ ID NO: 3179050 - DNA, 14 bp, Homo sapiens
gtgcgagcacacac

SEQ ID NO: 3179051 - DNA, 12 bp, Homo sapiens
gtgcgcccgtgg

SEQ ID NO: 3179052 - DNA, 18 bp, Homo sapiens
gtgcgctcttggtccctg

SEQ ID NO: 3179053 - DNA, 17 bp, Homo sapiens
gtgcggcgtggagactg

SEQ ID NO: 3179054 - DNA, 19 bp, Homo sapiens
gtgcggcgtggagactggc

SEQ ID NO: 3179055 - DNA, 13 bp, Homo sapiens
gtgcgtctgaggg

SEQ ID NO: 3179056 - DNA, 13 bp, Homo sapiens
gtgcgtgaatgta

SEQ ID NO: 3179057 - DNA, 16 bp, Homo sapiens
gtgcgtgcgagcacac

SEQ ID NO: 3179058 - DNA, 14 bp, Homo sapiens
gtgcgtggctgtgg

SEQ ID NO: 3179059 - DNA, 15 bp, Homo sapiens
gtgcgtggctgtggc

SEQ ID NO: 3179060 - DNA, 15 bp, Homo sapiens
gtgcgtgtgtagagt

SEQ ID NO: 3179061 - DNA, 13 bp, Homo sapiens
gtgctaaattttc

SEQ ID NO: 3179062 - DNA, 23 bp, Homo sapiens
gtgctaaccacgtctgtcttcac

SEQ ID NO: 3179063 - DNA, 13 bp, Homo sapiens
gtgggctgagccc

SEQ ID NO: 3179064 - DNA, 16 bp, Homo sapiens
gtgggctgagccctgg

SEQ ID NO: 3179065 - DNA, 18 bp, Homo sapiens
gtgggctgagccctggca

SEQ ID NO: 3179066 - DNA, 14 bp, Homo sapiens
gtgggctgatttac

SEQ ID NO: 3179067 - DNA, 20 bp, Homo sapiens
gtgggctgggccctctcttc

SEQ ID NO: 3179068 - DNA, 18 bp, Homo sapiens
gtgggctggggctgctcc

SEQ ID NO: 3179069 - DNA, 21 bp, Homo sapiens
gtgggctggggctgctcccct

SEQ ID NO: 3179070 - DNA, 21 bp, Homo sapiens
gtgggctttctccggggtctg

SEQ ID NO: 3179071 - DNA, 13 bp, Homo sapiens
gtggggacccagg

SEQ ID NO: 3179072 - DNA, 18 bp, Homo sapiens
gtggggacccaggctccg

SEQ ID NO: 3179073 - DNA, 21 bp, Homo sapiens
gtggggacccaggctccgccc

SEQ ID NO: 3179074 - DNA, 22 bp, Homo sapiens
gtggggagcacttgcgtcctgc

SEQ ID NO: 3179075 - DNA, 22 bp, Homo sapiens
gtggggagcagttttcccctgg

SEQ ID NO: 3179076 - DNA, 18 bp, Homo sapiens
gtggggagggacaaggga

SEQ ID NO: 3179077 - DNA, 11 bp, Homo sapiens
gtggggagggg

SEQ ID NO: 3179078 - DNA, 13 bp, Homo sapiens
gtggggccaggcc

SEQ ID NO: 3179079 - DNA, 23 bp, Homo sapiens
gtggggccaggccaggaccacac

SEQ ID NO: 3179080 - DNA, 22 bp, Homo sapiens
gtggggccataaacggttcctg

SEQ ID NO: 3179081 - DNA, 15 bp, Homo sapiens
gtggggcctagatcc

SEQ ID NO: 3179082 - DNA, 13 bp, Homo sapiens
gtggggccttggt

SEQ ID NO: 3179083 - DNA, 23 bp, Homo sapiens
gtgggggccacatttcacctcct

SEQ ID NO: 3179084 - DNA, 12 bp, Homo sapiens
gtgggggctgca

SEQ ID NO: 3179085 - DNA, 20 bp, Homo sapiens
gtgggggtggaggcttcctg

SEQ ID NO: 3179086 - DNA, 22 bp, Homo sapiens
gtggggtacatttctctgagca

SEQ ID NO: 3179087 - DNA, 16 bp, Homo sapiens
gtggggtggggagaaa

SEQ ID NO: 3179088 - DNA, 13 bp, Homo sapiens
gtggggtgtgctg

SEQ ID NO: 3179089 - DNA, 19 bp, Homo sapiens
gtggggtgtgctgggagct

SEQ ID NO: 3179090 - DNA, 22 bp, Homo sapiens
gtggggtgtgttccaactgccc

SEQ ID NO: 3179091 - DNA, 23 bp, Homo sapiens
gtgggtccaggaaggcagctgct

SEQ ID NO: 3179092 - DNA, 16 bp, Homo sapiens
gtgggtgaaggcctgg

SEQ ID NO: 3179093 - DNA, 14 bp, Homo sapiens
gtgggtgagagaga

SEQ ID NO: 3179094 - DNA, 15 bp, Homo sapiens
gtgggtgagagagac

SEQ ID NO: 3179095 - DNA, 12 bp, Homo sapiens
gtgggtgagcca

SEQ ID NO: 3179096 - DNA, 13 bp, Homo sapiens
gtgggtgctcaga

SEQ ID NO: 3179097 - DNA, 16 bp, Homo sapiens
gtgggtggtggggagg

SEQ ID NO: 3179098 - DNA, 22 bp, Homo sapiens
gtgggttttattgtccttcaga

SEQ ID NO: 3179099 - DNA, 13 bp, Homo sapiens
gtggtaaagaaag

SEQ ID NO: 3179100 - DNA, 14 bp, Homo sapiens
gtggtaccctctgg

SEQ ID NO: 3179101 - DNA, 21 bp, Homo sapiens
gtggtaggcctataaaattaa

SEQ ID NO: 3179102 - DNA, 13 bp, Homo sapiens
gtggtatgtctct

SEQ ID NO: 3179103 - DNA, 18 bp, Homo sapiens
gtggtcacagcggaggtg

SEQ ID NO: 3179104 - DNA, 22 bp, Homo sapiens
gtggtcacagcggaggtgtgga

SEQ ID NO: 3179105 - DNA, 17 bp, Homo sapiens
gtggtcaccttcgagta

SEQ ID NO: 3179106 - DNA, 19 bp, Homo sapiens
gtggtcactgtgcactgcc

SEQ ID NO: 3179107 - DNA, 15 bp, Homo sapiens
gtggtcagagtgcca

SEQ ID NO: 3179108 - DNA, 11 bp, Homo sapiens
gtggtctcagg

SEQ ID NO: 3179109 - DNA, 12 bp, Homo sapiens
gtggtctcagga

SEQ ID NO: 3179110 - DNA, 14 bp, Homo sapiens
gtggtctgaatgtt

SEQ ID NO: 3179111 - DNA, 17 bp, Homo sapiens
gtggtctgaatgttctg

SEQ ID NO: 3179112 - DNA, 13 bp, Homo sapiens
gtggtctgttggc

SEQ ID NO: 3179113 - DNA, 19 bp, Homo sapiens
gtggtctgttggcaggctg

SEQ ID NO: 3179114 - DNA, 23 bp, Homo sapiens
gtggtctgttggcaggctggcca

SEQ ID NO: 3179115 - DNA, 19 bp, Homo sapiens
gtggtgacatttcccaagt

SEQ ID NO: 3179116 - DNA, 13 bp, Homo sapiens
gtggtgagatcat

SEQ ID NO: 3179117 - DNA, 21 bp, Homo sapiens
gtggtgatttgaaaaatataa

SEQ ID NO: 3179118 - DNA, 14 bp, Homo sapiens
gtggtgcagacaga

SEQ ID NO: 3179119 - DNA, 19 bp, Homo sapiens
gtggtgcgatctgggttca

SEQ ID NO: 3179120 - DNA, 17 bp, Homo sapiens
gtggtggagtggagtga

SEQ ID NO: 3179121 - DNA, 16 bp, Homo sapiens
gtggtggcacaggccc

SEQ ID NO: 3179122 - DNA, 13 bp, Homo sapiens
gtggtggcctggt

SEQ ID NO: 3179123 - DNA, 18 bp, Homo sapiens
gtggtggcctggtccctg

SEQ ID NO: 3179124 - DNA, 12 bp, Homo sapiens
gtggtggggagg

SEQ ID NO: 3179125 - DNA, 20 bp, Homo sapiens
gtggtggggaggggcgctgg

SEQ ID NO: 3179126 - DNA, 15 bp, Homo sapiens
gtggtgtaaagctgg

SEQ ID NO: 3179127 - DNA, 18 bp, Homo sapiens
gtggtgtaaagctggccc

SEQ ID NO: 3179128 - DNA, 19 bp, Homo sapiens
gtggtgtcgtctgtgaatg

SEQ ID NO: 3179129 - DNA, 20 bp, Homo sapiens
gtggttacagtgcagacagg

SEQ ID NO: 3179130 - DNA, 21 bp, Homo sapiens
gtggttccatgcagccttggg

SEQ ID NO: 3179131 - DNA, 16 bp, Homo sapiens
gtggttcctctgctca

SEQ ID NO: 3179132 - DNA, 19 bp, Homo sapiens
gtggttcctttgcaccctg

SEQ ID NO: 3179133 - DNA, 22 bp, Homo sapiens
gtggtttcaaagtaaaggcctc

SEQ ID NO: 3179134 - DNA, 14 bp, Homo sapiens
gtggtttgccatgt

SEQ ID NO: 3179135 - DNA, 20 bp, Homo sapiens
gtggttttatactgaaggaa

SEQ ID NO: 3179136 - DNA, 15 bp, Homo sapiens
gtgtaaaaaatggaa

SEQ ID NO: 3179137 - DNA, 18 bp, Homo sapiens
gtgtaaaaaatggaaaaa

SEQ ID NO: 3179138 - DNA, 22 bp, Homo sapiens
gtgtaaagctggccctgcctcc

SEQ ID NO: 3179139 - DNA, 19 bp, Homo sapiens
gtgtaacactgtgtacacc

SEQ ID NO: 3179140 - DNA, 12 bp, Homo sapiens
gtgtaacagctg

SEQ ID NO: 3179141 - DNA, 12 bp, Homo sapiens
gtgtaagagaat

SEQ ID NO: 3179142 - DNA, 21 bp, Homo sapiens
gtgtaagtattcttatttaat

SEQ ID NO: 3179143 - DNA, 18 bp, Homo sapiens
gtgtaataaagtgttttc

SEQ ID NO: 3179144 - DNA, 21 bp, Homo sapiens
gtgtaataaagtgttttcaga

SEQ ID NO: 3179145 - DNA, 15 bp, Homo sapiens
gtgtaataagacata

SEQ ID NO: 3179146 - DNA, 14 bp, Homo sapiens
gtgtacaaaactgt

SEQ ID NO: 3179147 - DNA, 22 bp, Homo sapiens
gtgtacaaattgtcgtttttat

SEQ ID NO: 3179148 - DNA, 19 bp, Homo sapiens
gtgtacacgtctggacccc

SEQ ID NO: 3179149 - DNA, 12 bp, Homo sapiens
gtgtacaggtac

SEQ ID NO: 3179150 - DNA, 20 bp, Homo sapiens
gtgtacagtgaattgtcttt

SEQ ID NO: 3179151 - DNA, 12 bp, Homo sapiens
gtgtacatatgt

SEQ ID NO: 3179152 - DNA, 22 bp, Homo sapiens
gtgtactctgtgtgtgtatgag

SEQ ID NO: 3179153 - DNA, 19 bp, Homo sapiens
gtgtactgggttaatggct

SEQ ID NO: 3179154 - DNA, 20 bp, Homo sapiens
gtgtactgggttaatggcta

SEQ ID NO: 3179155 - DNA, 13 bp, Homo sapiens
gtgtactgtgtca

SEQ ID NO: 3179156 - DNA, 15 bp, Homo sapiens
gtgtagaacactaat

SEQ ID NO: 3179157 - DNA, 19 bp, Homo sapiens
gtgtagaagcattccttct

SEQ ID NO: 3179158 - DNA, 17 bp, Homo sapiens
gtgtagagttaagaagc

SEQ ID NO: 3179159 - DNA, 20 bp, Homo sapiens
gtgtagagttaagaagctgt

SEQ ID NO: 3179160 - DNA, 14 bp, Homo sapiens
gtgtagccaaggtc

SEQ ID NO: 3179161 - DNA, 23 bp, Homo sapiens
gtgtagccaggtatggctctgca

SEQ ID NO: 3179162 - DNA, 16 bp, Homo sapiens
gtgtagccttgcccgg

SEQ ID NO: 3179163 - DNA, 11 bp, Homo sapiens
gtgtagccttt

SEQ ID NO: 3179164 - DNA, 13 bp, Homo sapiens
gtgtagccttttt

SEQ ID NO: 3179165 - DNA, 23 bp, Homo sapiens
gtgtagctgtaagggcagtgccc

SEQ ID NO: 3179166 - DNA, 13 bp, Homo sapiens
gtgtaggctgggg

SEQ ID NO: 3179167 - DNA, 19 bp, Homo sapiens
gtgtagtggaagagcagcc

SEQ ID NO: 3179168 - DNA, 21 bp, Homo sapiens
gtgtagtggaagagcagcctg

SEQ ID NO: 3179169 - DNA, 14 bp, Homo sapiens
gtgtagttaattta

SEQ ID NO: 3179170 - DNA, 14 bp, Homo sapiens
gtgtatagtgccta

SEQ ID NO: 3179171 - DNA, 13 bp, Homo sapiens
gtgtatatataca

SEQ ID NO: 3179172 - DNA, 16 bp, Homo sapiens
gtgtatatatacatac

SEQ ID NO: 3179173 - DNA, 22 bp, Homo sapiens
gtgtatatatgtgtatatatac

SEQ ID NO: 3179174 - DNA, 13 bp, Homo sapiens
gtgtatatcagaa

SEQ ID NO: 3179175 - DNA, 23 bp, Homo sapiens
gtgtatatccttccaaaaaatta

SEQ ID NO: 3179176 - DNA, 15 bp, Homo sapiens
gtgtatatctcttgg

SEQ ID NO: 3179177 - DNA, 14 bp, Homo sapiens
gtgtatattatttg

SEQ ID NO: 3179178 - DNA, 15 bp, Homo sapiens
gtgtatattatttgg

SEQ ID NO: 3179179 - DNA, 21 bp, Homo sapiens
gtgtatcaggtcagggacttg

SEQ ID NO: 3179180 - DNA, 22 bp, Homo sapiens
gtgtatcccccccctgtatagt

SEQ ID NO: 3179181 - DNA, 22 bp, Homo sapiens
gtgtatccgactctaagctgtg

SEQ ID NO: 3179182 - DNA, 16 bp, Homo sapiens
gtgtatgactaaagag

SEQ ID NO: 3179183 - DNA, 19 bp, Homo sapiens
gtgtatgccacacctggcc

SEQ ID NO: 3179184 - DNA, 17 bp, Homo sapiens
gtgtatgtacatatata

SEQ ID NO: 3179185 - DNA, 18 bp, Homo sapiens
gtgtatgtttgcacactt

SEQ ID NO: 3179186 - DNA, 22 bp, Homo sapiens
gtgtatgtttgcacacttgtgt

SEQ ID NO: 3179187 - DNA, 12 bp, Homo sapiens
gtgtattgttcc

SEQ ID NO: 3179188 - DNA, 20 bp, Homo sapiens
gtgtatttgtattaataaag

SEQ ID NO: 3179189 - DNA, 21 bp, Homo sapiens
gttcacaggaggccagtgggc

SEQ ID NO: 3179190 - DNA, 18 bp, Homo sapiens
gttcacctccctgctcag

SEQ ID NO: 3179191 - DNA, 18 bp, Homo sapiens
gttcacgtaagatacaag

SEQ ID NO: 3179192 - DNA, 15 bp, Homo sapiens
gttcactaaagcagt

SEQ ID NO: 3179193 - DNA, 13 bp, Homo sapiens
gttcactccattt

SEQ ID NO: 3179194 - DNA, 22 bp, Homo sapiens
gttcactgagctccccagatct

SEQ ID NO: 3179195 - DNA, 12 bp, Homo sapiens
gttcagaattta

SEQ ID NO: 3179196 - DNA, 15 bp, Homo sapiens
gttcagacccctgcc

SEQ ID NO: 3179197 - DNA, 17 bp, Homo sapiens
gttcagacccctgcctg

SEQ ID NO: 3179198 - DNA, 17 bp, Homo sapiens
gttcagcaccaccctag

SEQ ID NO: 3179199 - DNA, 16 bp, Homo sapiens
gttcagcattcttagc

SEQ ID NO: 3179200 - DNA, 17 bp, Homo sapiens
gttcagctactttccat

SEQ ID NO: 3179201 - DNA, 21 bp, Homo sapiens
gttcagctactttccatttgg

SEQ ID NO: 3179202 - DNA, 23 bp, Homo sapiens
gttcagctactttccatttggta

SEQ ID NO: 3179203 - DNA, 13 bp, Homo sapiens
gttcagctccagc

SEQ ID NO: 3179204 - DNA, 15 bp, Homo sapiens
gttcagctccagctc

SEQ ID NO: 3179205 - DNA, 17 bp, Homo sapiens
gttcagctccagctcac

SEQ ID NO: 3179206 - DNA, 18 bp, Homo sapiens
gttcagctgtcctccctc

SEQ ID NO: 3179207 - DNA, 21 bp, Homo sapiens
gttcagctgtcctccctccac

SEQ ID NO: 3179208 - DNA, 23 bp, Homo sapiens
gttcagcttgtaaatagctcagg

SEQ ID NO: 3179209 - DNA, 15 bp, Homo sapiens
gttcaggggactcag

SEQ ID NO: 3179210 - DNA, 18 bp, Homo sapiens
gttcagggttggcccctg

SEQ ID NO: 3179211 - DNA, 20 bp, Homo sapiens
gttcagggttggcccctgcc

SEQ ID NO: 3179212 - DNA, 21 bp, Homo sapiens
gttcagggttggcccctgccc

SEQ ID NO: 3179213 - DNA, 17 bp, Homo sapiens
gttcaggtaacaggcag

SEQ ID NO: 3179214 - DNA, 23 bp, Homo sapiens
gttcagtctgaatgctgccacaa

SEQ ID NO: 3179215 - DNA, 22 bp, Homo sapiens
gttcataacagtgccattgtct

SEQ ID NO: 3179216 - DNA, 24 bp, Homo sapiens
gttcataacagtgccattgtcttt

SEQ ID NO: 3179217 - DNA, 19 bp, Homo sapiens
gttcatacctaagtactgt

SEQ ID NO: 3179218 - DNA, 14 bp, Homo sapiens
gttcatagcccagt

SEQ ID NO: 3179219 - DNA, 17 bp, Homo sapiens
gttcatagggtctcttc

SEQ ID NO: 3179220 - DNA, 18 bp, Homo sapiens
gttcatagggtctcttca

SEQ ID NO: 3179221 - DNA, 22 bp, Homo sapiens
gttcatatgtaccatgtacatg

SEQ ID NO: 3179222 - DNA, 19 bp, Homo sapiens
gttcatatttatactttgc

SEQ ID NO: 3179223 - DNA, 14 bp, Homo sapiens
gttcatcagtgtta

SEQ ID NO: 3179224 - DNA, 19 bp, Homo sapiens
gttcatccaatcctcactg

SEQ ID NO: 3179225 - DNA, 20 bp, Homo sapiens
gttcatccaatcctcactgg

SEQ ID NO: 3179226 - DNA, 22 bp, Homo sapiens
gttcatccaatcctcactgggt

SEQ ID NO: 3179227 - DNA, 18 bp, Homo sapiens
gttcatcctattgttgat

SEQ ID NO: 3179228 - DNA, 12 bp, Homo sapiens
gttcatgagaat

SEQ ID NO: 3179229 - DNA, 19 bp, Homo sapiens
gttcatgagaatctatatt

SEQ ID NO: 3179230 - DNA, 15 bp, Homo sapiens
gttcatgcagctgtg

SEQ ID NO: 3179231 - DNA, 16 bp, Homo sapiens
gttcatgccaccatgg

SEQ ID NO: 3179232 - DNA, 13 bp, Homo sapiens
gttcatgctgaat

SEQ ID NO: 3179233 - DNA, 16 bp, Homo sapiens
gttcatggtgatcagt

SEQ ID NO: 3179234 - DNA, 12 bp, Homo sapiens
gttcatgtagag

SEQ ID NO: 3179235 - DNA, 15 bp, Homo sapiens
gttcatgtagagaaa

SEQ ID NO: 3179236 - DNA, 16 bp, Homo sapiens
gttcatgtagagaaaa

SEQ ID NO: 3179237 - DNA, 16 bp, Homo sapiens
gttcatgtgcctctgc

SEQ ID NO: 3179238 - DNA, 10 bp, Homo sapiens
gttcatgttt

SEQ ID NO: 3179239 - DNA, 19 bp, Homo sapiens
gttcattataatctcaaag

SEQ ID NO: 3179240 - DNA, 15 bp, Homo sapiens
gttcattattggaat

SEQ ID NO: 3179241 - DNA, 22 bp, Homo sapiens
gttcattattggaattaacctg

SEQ ID NO: 3179242 - DNA, 16 bp, Homo sapiens
gttcattcaagctatt

SEQ ID NO: 3179243 - DNA, 19 bp, Homo sapiens
gttcattgatggatgtctt

SEQ ID NO: 3179244 - DNA, 14 bp, Homo sapiens
gttcattgtaatgt

SEQ ID NO: 3179245 - DNA, 18 bp, Homo sapiens
gttcattgtaatgttact

SEQ ID NO: 3179246 - DNA, 21 bp, Homo sapiens
gttcattgtaatgttactgat

SEQ ID NO: 3179247 - DNA, 18 bp, Homo sapiens
gttcatttcacacagtga

SEQ ID NO: 3179248 - DNA, 23 bp, Homo sapiens
gttcatttggtgttcctggaagc

SEQ ID NO: 3179249 - DNA, 16 bp, Homo sapiens
gttcatttgtgtgctc

SEQ ID NO: 3179250 - DNA, 15 bp, Homo sapiens
gttccaaagccagtg

SEQ ID NO: 3179251 - DNA, 23 bp, Homo sapiens
gttccaaagccagtgaaatgtga

SEQ ID NO: 3179252 - DNA, 14 bp, Homo sapiens
gttccaagacattg

SEQ ID NO: 3179253 - DNA, 17 bp, Homo sapiens
gttccaagacattgtca

SEQ ID NO: 3179254 - DNA, 16 bp, Homo sapiens
gttccaagagtctaaa

SEQ ID NO: 3179255 - DNA, 14 bp, Homo sapiens
gttccaatgaaata

SEQ ID NO: 3179256 - DNA, 16 bp, Homo sapiens
gttccacgtgttttat

SEQ ID NO: 3179257 - DNA, 21 bp, Homo sapiens
gttccactgcaaataaagcct

SEQ ID NO: 3179258 - DNA, 16 bp, Homo sapiens
gttccagctctttgaa

SEQ ID NO: 3179259 - DNA, 18 bp, Homo sapiens
gttccaggccctccagtg

SEQ ID NO: 3179260 - DNA, 14 bp, Homo sapiens
gttccatcttgcta

SEQ ID NO: 3179261 - DNA, 15 bp, Homo sapiens
gttccatgcctgagg

SEQ ID NO: 3179262 - DNA, 21 bp, Homo sapiens
gttccattgaagccgactctg

SEQ ID NO: 3179263 - DNA, 13 bp, Homo sapiens
gttcccagcaggg

SEQ ID NO: 3179264 - DNA, 13 bp, Homo sapiens
gttcccagctccc

SEQ ID NO: 3179265 - DNA, 16 bp, Homo sapiens
gttcccaggctgcccc

SEQ ID NO: 3179266 - DNA, 21 bp, Homo sapiens
gttcccagtgacacttcagag

SEQ ID NO: 3179267 - DNA, 19 bp, Homo sapiens
gttcccatgtagccccctg

SEQ ID NO: 3179268 - DNA, 22 bp, Homo sapiens
gttccccatccctgtcattttt

SEQ ID NO: 3179269 - DNA, 18 bp, Homo sapiens
gttccccatctgggtcct

SEQ ID NO: 3179270 - DNA, 19 bp, Homo sapiens
gttcccccagtacctccaa

SEQ ID NO: 3179271 - DNA, 13 bp, Homo sapiens
gttcccctcactg

SEQ ID NO: 3179272 - DNA, 18 bp, Homo sapiens
gttcccctgtcctgtgaa

SEQ ID NO: 3179273 - DNA, 20 bp, Homo sapiens
gttcccctgtcctgtgaatg

SEQ ID NO: 3179274 - DNA, 17 bp, Homo sapiens
gttcccctgttcactct

SEQ ID NO: 3179275 - DNA, 15 bp, Homo sapiens
gttcccggagcacag

SEQ ID NO: 3179276 - DNA, 18 bp, Homo sapiens
gttcccggagcacagccc

SEQ ID NO: 3179277 - DNA, 14 bp, Homo sapiens
gttcccgtttctcc

SEQ ID NO: 3179278 - DNA, 16 bp, Homo sapiens
gttcccgtttctccac

SEQ ID NO: 3179279 - DNA, 19 bp, Homo sapiens
gttcccgtttctccaccta

SEQ ID NO: 3179280 - DNA, 20 bp, Homo sapiens
gttccctacttcctgtgact

SEQ ID NO: 3179281 - DNA, 23 bp, Homo sapiens
gttccctatgaaagattccacag

SEQ ID NO: 3179282 - DNA, 13 bp, Homo sapiens
gttccctcccaga

SEQ ID NO: 3179283 - DNA, 17 bp, Homo sapiens
gttccctctccctgttg

SEQ ID NO: 3179284 - DNA, 21 bp, Homo sapiens
gttccctctgctcctggagcc

SEQ ID NO: 3179285 - DNA, 14 bp, Homo sapiens
gttccctgcaccct

SEQ ID NO: 3179286 - DNA, 16 bp, Homo sapiens
gttccctgtcagaggc

SEQ ID NO: 3179287 - DNA, 16 bp, Homo sapiens
gttccctgttcttcct

SEQ ID NO: 3179288 - DNA, 21 bp, Homo sapiens
gttcccttgaaactttgggaa

SEQ ID NO: 3179289 - DNA, 16 bp, Homo sapiens
gttcccttggcctcag

SEQ ID NO: 3179290 - DNA, 19 bp, Homo sapiens
gttcccttggcctcagaat

SEQ ID NO: 3179291 - DNA, 18 bp, Homo sapiens
gttccctttatttcacat

SEQ ID NO: 3179292 - DNA, 17 bp, Homo sapiens
gttcctaagaagcttct

SEQ ID NO: 3179293 - DNA, 15 bp, Homo sapiens
gttcctaagggaaag

SEQ ID NO: 3179294 - DNA, 14 bp, Homo sapiens
gttcctcctgctgt

SEQ ID NO: 3179295 - DNA, 23 bp, Homo sapiens
gttcctcctgctgtagtcctttc

SEQ ID NO: 3179296 - DNA, 20 bp, Homo sapiens
gttcctgacatcacagcagc

SEQ ID NO: 3179297 - DNA, 21 bp, Homo sapiens
gttcctgacatcacagcagcc

SEQ ID NO: 3179298 - DNA, 12 bp, Homo sapiens
gttcctggaagc

SEQ ID NO: 3179299 - DNA, 18 bp, Homo sapiens
gttcctggaagcaggtgc

SEQ ID NO: 3179300 - DNA, 15 bp, Homo sapiens
gttcctggtgactcc

SEQ ID NO: 3179301 - DNA, 17 bp, Homo sapiens
gttcctgtggccaggag

SEQ ID NO: 3179302 - DNA, 20 bp, Homo sapiens
gttcctgttcagtaataaaa

SEQ ID NO: 3179303 - DNA, 14 bp, Homo sapiens
gttccttccctggg

SEQ ID NO: 3179304 - DNA, 17 bp, Homo sapiens
gttccttgtactcttag

SEQ ID NO: 3179305 - DNA, 18 bp, Homo sapiens
gttcctttgcaccctgta

SEQ ID NO: 3179306 - DNA, 19 bp, Homo sapiens
gttcctttgttaaatttag

SEQ ID NO: 3179307 - DNA, 16 bp, Homo sapiens
gttcctttttaaatgt

SEQ ID NO: 3179308 - DNA, 17 bp, Homo sapiens
gttcctttttaaatgtg

SEQ ID NO: 3179309 - DNA, 22 bp, Homo sapiens
gttccttttttcaatatgcaag

SEQ ID NO: 3179310 - DNA, 15 bp, Homo sapiens
gttcgagaccagcct

SEQ ID NO: 3179311 - DNA, 12 bp, Homo sapiens
gttcgcttggct

SEQ ID NO: 3179312 - DNA, 16 bp, Homo sapiens
gttctaaagctctgac

SEQ ID NO: 3179313 - DNA, 21 bp, Homo sapiens
gttctaaagttctaagattct

SEQ ID NO: 3179314 - DNA, 14 bp, Homo sapiens
gttctaagaaaccc

SEQ ID NO: 3179315 - DNA, 21 bp, Homo sapiens
gtttaagtgactgatggctaa

SEQ ID NO: 3179316 - DNA, 17 bp, Homo sapiens
gtttaatattgagaaag

SEQ ID NO: 3179317 - DNA, 14 bp, Homo sapiens
gtttaatttcttca

SEQ ID NO: 3179318 - DNA, 18 bp, Homo sapiens
gtttaatttttatttctt

SEQ ID NO: 3179319 - DNA, 20 bp, Homo sapiens
gtttaatttttatttcttcc

SEQ ID NO: 3179320 - DNA, 16 bp, Homo sapiens
gtttacaagtgtatat

SEQ ID NO: 3179321 - DNA, 23 bp, Homo sapiens
gtttacaagtgtatatcagaaaa

SEQ ID NO: 3179322 - DNA, 20 bp, Homo sapiens
gtttacaatattatgtttcc

SEQ ID NO: 3179323 - DNA, 19 bp, Homo sapiens
gtttacaggccctgctcct

SEQ ID NO: 3179324 - DNA, 11 bp, Homo sapiens
gtttacatgta

SEQ ID NO: 3179325 - DNA, 13 bp, Homo sapiens
gtttacatgtgta

SEQ ID NO: 3179326 - DNA, 16 bp, Homo sapiens
gtttaccatttgtaat

SEQ ID NO: 3179327 - DNA, 18 bp, Homo sapiens
gtttaccatttgtaataa

SEQ ID NO: 3179328 - DNA, 17 bp, Homo sapiens
gtttaccatttttcatt

SEQ ID NO: 3179329 - DNA, 23 bp, Homo sapiens
gtttacctagaagaagctatgtc

SEQ ID NO: 3179330 - DNA, 13 bp, Homo sapiens
gtttactttcaaa

SEQ ID NO: 3179331 - DNA, 14 bp, Homo sapiens
gtttactttcaaat

SEQ ID NO: 3179332 - DNA, 15 bp, Homo sapiens
gtttactttcaaatc

SEQ ID NO: 3179333 - DNA, 15 bp, Homo sapiens
gtttagaccaaggaa

SEQ ID NO: 3179334 - DNA, 19 bp, Homo sapiens
gtttagagtaaataaactg

SEQ ID NO: 3179335 - DNA, 20 bp, Homo sapiens
gtttagatttatggttgtta

SEQ ID NO: 3179336 - DNA, 17 bp, Homo sapiens
gtttagcagcagccttt

SEQ ID NO: 3179337 - DNA, 23 bp, Homo sapiens
gtttagcagcagcctttaatgca

SEQ ID NO: 3179338 - DNA, 15 bp, Homo sapiens
gtttaggctatttgt

SEQ ID NO: 3179339 - DNA, 22 bp, Homo sapiens
gtttatatacagtacacagata

SEQ ID NO: 3179340 - DNA, 12 bp, Homo sapiens
gtttatatactg

SEQ ID NO: 3179341 - DNA, 23 bp, Homo sapiens
gtttatatggcgttttgtctgtg

SEQ ID NO: 3179342 - DNA, 15 bp, Homo sapiens
gtttatcagatacat

SEQ ID NO: 3179343 - DNA, 19 bp, Homo sapiens
gtttatcagatacatcact

SEQ ID NO: 3179344 - DNA, 18 bp, Homo sapiens
gtttatgatctatttgta

SEQ ID NO: 3179345 - DNA, 13 bp, Homo sapiens
gtttatggcctca

SEQ ID NO: 3179346 - DNA, 14 bp, Homo sapiens
gtttatggcctcag

SEQ ID NO: 3179347 - DNA, 18 bp, Homo sapiens
gtttatgtaaatgtttgt

SEQ ID NO: 3179348 - DNA, 21 bp, Homo sapiens
gtttattgagtttgtaggtaa

SEQ ID NO: 3179349 - DNA, 14 bp, Homo sapiens
gtttattggaagtg

SEQ ID NO: 3179350 - DNA, 14 bp, Homo sapiens
gtttatttctctct

SEQ ID NO: 3179351 - DNA, 19 bp, Homo sapiens
gtttatttctgtttctcat

SEQ ID NO: 3179352 - DNA, 18 bp, Homo sapiens
gtttattttttttggcct

SEQ ID NO: 3179353 - DNA, 22 bp, Homo sapiens
gtttcaaagtaaaggcctcctc

SEQ ID NO: 3179354 - DNA, 23 bp, Homo sapiens
gtttcaaccaagtcatgtgcatt

SEQ ID NO: 3179355 - DNA, 15 bp, Homo sapiens
gtttcaagaaaatct

SEQ ID NO: 3179356 - DNA, 16 bp, Homo sapiens
gtttcaagaaaatctt

SEQ ID NO: 3179357 - DNA, 16 bp, Homo sapiens
gtttcaagttattcaa

SEQ ID NO: 3179358 - DNA, 17 bp, Homo sapiens
gtttcaagttattcaaa

SEQ ID NO: 3179359 - DNA, 19 bp, Homo sapiens
gtttcaagttattcaaatt

SEQ ID NO: 3179360 - DNA, 20 bp, Homo sapiens
gtttcaagttattcaaattt

SEQ ID NO: 3179361 - DNA, 14 bp, Homo sapiens
gtttcaatcactgt

SEQ ID NO: 3179362 - DNA, 21 bp, Homo sapiens
gtttcacaggtcaataaactt

SEQ ID NO: 3179363 - DNA, 12 bp, Homo sapiens
gtttcagacagg

SEQ ID NO: 3179364 - DNA, 22 bp, Homo sapiens
gtttcagacagggtctgaagga

SEQ ID NO: 3179365 - DNA, 17 bp, Homo sapiens
gtttcagatatatatca

SEQ ID NO: 3179366 - DNA, 19 bp, Homo sapiens
gtttcaggatacatgtgcc

SEQ ID NO: 3179367 - DNA, 16 bp, Homo sapiens
gtttcaggtgacatgt

SEQ ID NO: 3179368 - DNA, 15 bp, Homo sapiens
gtttcaggtttccat

SEQ ID NO: 3179369 - DNA, 16 bp, Homo sapiens
gtttcaggtttccatt

SEQ ID NO: 3179370 - DNA, 16 bp, Homo sapiens
gtttcagtaataaaac

SEQ ID NO: 3179371 - DNA, 16 bp, Homo sapiens
gtttcagttctgtgta

SEQ ID NO: 3179372 - DNA, 18 bp, Homo sapiens
gtttcagtttgttggaaa

SEQ ID NO: 3179373 - DNA, 20 bp, Homo sapiens
gtttcattgcgaatcttttt

SEQ ID NO: 3179374 - DNA, 19 bp, Homo sapiens
gtttcatttagtcatgtga

SEQ ID NO: 3179375 - DNA, 20 bp, Homo sapiens
gtttccagacttccttgaga

SEQ ID NO: 3179376 - DNA, 17 bp, Homo sapiens
gtttccagagtttgtca

SEQ ID NO: 3179377 - DNA, 13 bp, Homo sapiens
gtttccatttact

SEQ ID NO: 3179378 - DNA, 20 bp, Homo sapiens
gtttcccataattttcttca

SEQ ID NO: 3179379 - DNA, 22 bp, Homo sapiens
gtttccccagggaaggaaaaat

SEQ ID NO: 3179380 - DNA, 15 bp, Homo sapiens
gtttcccttgccctt

SEQ ID NO: 3179381 - DNA, 18 bp, Homo sapiens
gtttcccttgctttgttt

SEQ ID NO: 3179382 - DNA, 23 bp, Homo sapiens
gtttccttgtttatcagatacat

SEQ ID NO: 3179383 - DNA, 18 bp, Homo sapiens
gtttcgactggtccagct

SEQ ID NO: 3179384 - DNA, 15 bp, Homo sapiens
gtttcgtggggaggt

SEQ ID NO: 3179385 - DNA, 23 bp, Homo sapiens
gtttcgtggggaggtctaatcta

SEQ ID NO: 3179386 - DNA, 14 bp, Homo sapiens
gtttctaagattct

SEQ ID NO: 3179387 - DNA, 11 bp, Homo sapiens
gtttctaaggt

SEQ ID NO: 3179388 - DNA, 22 bp, Homo sapiens
gtttctaaggtccggtgttcta

SEQ ID NO: 3179389 - DNA, 18 bp, Homo sapiens
gtttctaataaacttgga

SEQ ID NO: 3179390 - DNA, 16 bp, Homo sapiens
gtttctagactataaa

SEQ ID NO: 3179391 - DNA, 13 bp, Homo sapiens
gtttctatacaaa

SEQ ID NO: 3179392 - DNA, 19 bp, Homo sapiens
gtttctatgtgtagggcgg

SEQ ID NO: 3179393 - DNA, 16 bp, Homo sapiens
gtttctattctgtcag

SEQ ID NO: 3179394 - DNA, 14 bp, Homo sapiens
gtttctcatttgtt

SEQ ID NO: 3179395 - DNA, 15 bp, Homo sapiens
gtttctccccctggg

SEQ ID NO: 3179396 - DNA, 22 bp, Homo sapiens
gtttctccccctgggctctgcc

SEQ ID NO: 3179397 - DNA, 19 bp, Homo sapiens
gtttctctctacagtgcca

SEQ ID NO: 3179398 - DNA, 13 bp, Homo sapiens
gtttctctgctgt

SEQ ID NO: 3179399 - DNA, 15 bp, Homo sapiens
gtttctctgctgttg

SEQ ID NO: 3179400 - DNA, 20 bp, Homo sapiens
gtttctcttgagctggcctc

SEQ ID NO: 3179401 - DNA, 16 bp, Homo sapiens
gtttctgaaaattcca

SEQ ID NO: 3179402 - DNA, 19 bp, Homo sapiens
gtttctgaaaattccagaa

SEQ ID NO: 3179403 - DNA, 13 bp, Homo sapiens
gtttctgactctg

SEQ ID NO: 3179404 - DNA, 13 bp, Homo sapiens
gtttctgagaaaa

SEQ ID NO: 3179405 - DNA, 22 bp, Homo sapiens
gtttctgaggctttatgataat

SEQ ID NO: 3179406 - DNA, 19 bp, Homo sapiens
gtttctgcagcccttgggc

SEQ ID NO: 3179407 - DNA, 22 bp, Homo sapiens
gtttctgcatgaatatcataca

SEQ ID NO: 3179408 - DNA, 20 bp, Homo sapiens
gtttctgcattcatttttat

SEQ ID NO: 3179409 - DNA, 14 bp, Homo sapiens
gtttctggatttca

SEQ ID NO: 3179410 - DNA, 23 bp, Homo sapiens
gtttctgggtcctgaagaattaa

SEQ ID NO: 3179411 - DNA, 21 bp, Homo sapiens
gtttctgtcaggagagcagcg

SEQ ID NO: 3179412 - DNA, 15 bp, Homo sapiens
gtttctgttccaaat

SEQ ID NO: 3179413 - DNA, 11 bp, Homo sapiens
gtttcttcctg

SEQ ID NO: 3179414 - DNA, 16 bp, Homo sapiens
gtttcttcctgccagc

SEQ ID NO: 3179415 - DNA, 17 bp, Homo sapiens
gtttcttcctgccagca

SEQ ID NO: 3179416 - DNA, 14 bp, Homo sapiens
gtttcttcctgtta

SEQ ID NO: 3179417 - DNA, 23 bp, Homo sapiens
gtttcttcttcatgcttttgctt

SEQ ID NO: 3179418 - DNA, 20 bp, Homo sapiens
gtttcttgccccagtgtggt

SEQ ID NO: 3179419 - DNA, 19 bp, Homo sapiens
gtttcttgcttggaagcca

SEQ ID NO: 3179420 - DNA, 23 bp, Homo sapiens
gtttcttgcttggaagccaggta

SEQ ID NO: 3179421 - DNA, 14 bp, Homo sapiens
gtttctttacttct

SEQ ID NO: 3179422 - DNA, 19 bp, Homo sapiens
gtttctttcctgccttctt

SEQ ID NO: 3179423 - DNA, 18 bp, Homo sapiens
gtttctttctagtggtct

SEQ ID NO: 3179424 - DNA, 19 bp, Homo sapiens
gtttctttttaagtaatgt

SEQ ID NO: 3179425 - DNA, 15 bp, Homo sapiens
gtttctttttacagc

SEQ ID NO: 3179426 - DNA, 18 bp, Homo sapiens
gtttctttttacagcatt

SEQ ID NO: 3179427 - DNA, 23 bp, Homo sapiens
gtttctttttacagcattgtctt

SEQ ID NO: 3179428 - DNA, 15 bp, Homo sapiens
gtttgaaagattatg

SEQ ID NO: 3179429 - DNA, 14 bp, Homo sapiens
gtttgaaatctttt

SEQ ID NO: 3179430 - DNA, 22 bp, Homo sapiens
gtttgaacctttttttttgaaa

SEQ ID NO: 3179431 - DNA, 20 bp, Homo sapiens
gtttgaagcacaactccctt

SEQ ID NO: 3179432 - DNA, 15 bp, Homo sapiens
gtttgaagcctgccc

SEQ ID NO: 3179433 - DNA, 21 bp, Homo sapiens
gtttgaagcctgcccttgtct

SEQ ID NO: 3179434 - DNA, 14 bp, Homo sapiens
gtttgaattaggct

SEQ ID NO: 3179435 - DNA, 16 bp, Homo sapiens
gtttgactagatgatg

SEQ ID NO: 3179436 - DNA, 18 bp, Homo sapiens
gtttgactagatgatgga

SEQ ID NO: 3179437 - DNA, 18 bp, Homo sapiens
gtttgagacaagccctgg

SEQ ID NO: 3179438 - DNA, 13 bp, Homo sapiens
gtttgagctgcct

SEQ ID NO: 3179439 - DNA, 15 bp, Homo sapiens
gtttgagctgccttc

SEQ ID NO: 3179440 - DNA, 16 bp, Homo sapiens
gtttgcaaataggcag

SEQ ID NO: 3179441 - DNA, 21 bp, Homo sapiens
taaagattttgttttgttgga

SEQ ID NO: 3179442 - DNA, 16 bp, Homo sapiens
taaagcaaaaaatgaa

SEQ ID NO: 3179443 - DNA, 19 bp, Homo sapiens
taaagcaaaaaatgaatgt

SEQ ID NO: 3179444 - DNA, 20 bp, Homo sapiens
taaagcaactgttatgaaat

SEQ ID NO: 3179445 - DNA, 15 bp, Homo sapiens
taaagcacattttaa

SEQ ID NO: 3179446 - DNA, 20 bp, Homo sapiens
taaagcagagggactttgta

SEQ ID NO: 3179447 - DNA, 15 bp, Homo sapiens
taaagcagcctgatt

SEQ ID NO: 3179448 - DNA, 22 bp, Homo sapiens
taaagcagtttattataatggt

SEQ ID NO: 3179449 - DNA, 13 bp, Homo sapiens
taaagcattgctt

SEQ ID NO: 3179450 - DNA, 12 bp, Homo sapiens
taaagcatttat

SEQ ID NO: 3179451 - DNA, 11 bp, Homo sapiens
taaagccaagg

SEQ ID NO: 3179452 - DNA, 21 bp, Homo sapiens
taaagcctcaaggttttaggt

SEQ ID NO: 3179453 - DNA, 17 bp, Homo sapiens
taaagccttgttttctc

SEQ ID NO: 3179454 - DNA, 17 bp, Homo sapiens
taaagccttttaaatca

SEQ ID NO: 3179455 - DNA, 19 bp, Homo sapiens
taaagccttttaaatcatc

SEQ ID NO: 3179456 - DNA, 14 bp, Homo sapiens
taaagctcaaatga

SEQ ID NO: 3179457 - DNA, 15 bp, Homo sapiens
taaagctcaaatgaa

SEQ ID NO: 3179458 - DNA, 17 bp, Homo sapiens
taaagctcaaatgaaat

SEQ ID NO: 3179459 - DNA, 14 bp, Homo sapiens
taaagctctgacat

SEQ ID NO: 3179460 - DNA, 12 bp, Homo sapiens
taaagctggccc

SEQ ID NO: 3179461 - DNA, 15 bp, Homo sapiens
taaagctggccctgc

SEQ ID NO: 3179462 - DNA, 16 bp, Homo sapiens
taaaggatgtgattgt

SEQ ID NO: 3179463 - DNA, 22 bp, Homo sapiens
taaaggattgatcactttgtta

SEQ ID NO: 3179464 - DNA, 11 bp, Homo sapiens
taaaggcagct

SEQ ID NO: 3179465 - DNA, 14 bp, Homo sapiens
taaaggcagctgcc

SEQ ID NO: 3179466 - DNA, 22 bp, Homo sapiens
taaaggcagctgcctctgctcc

SEQ ID NO: 3179467 - DNA, 24 bp, Homo sapiens
taaaggcagctgcctctgctccct

SEQ ID NO: 3179468 - DNA, 14 bp, Homo sapiens
taaaggcagttttc

SEQ ID NO: 3179469 - DNA, 17 bp, Homo sapiens
taaaggcagttttctaa

SEQ ID NO: 3179470 - DNA, 17 bp, Homo sapiens
taaaggcctcctccccc

SEQ ID NO: 3179471 - DNA, 23 bp, Homo sapiens
taaaggcctggaaccagggagga

SEQ ID NO: 3179472 - DNA, 17 bp, Homo sapiens
taaagggcaaataatga

SEQ ID NO: 3179473 - DNA, 13 bp, Homo sapiens
taaagggcagggc

SEQ ID NO: 3179474 - DNA, 20 bp, Homo sapiens
taaagggcaggtggttctaa

SEQ ID NO: 3179475 - DNA, 18 bp, Homo sapiens
taaagggcccaatgaatt

SEQ ID NO: 3179476 - DNA, 20 bp, Homo sapiens
taaagggcccaatgaattat

SEQ ID NO: 3179477 - DNA, 20 bp, Homo sapiens
taaaggtccacaggtctaga

SEQ ID NO: 3179478 - DNA, 14 bp, Homo sapiens
taaaggtgtattta

SEQ ID NO: 3179479 - DNA, 15 bp, Homo sapiens
taaagtaaatctctt

SEQ ID NO: 3179480 - DNA, 21 bp, Homo sapiens
taaagtacttgagtgtaatgt

SEQ ID NO: 3179481 - DNA, 17 bp, Homo sapiens
taaagtagtcctgtgaa

SEQ ID NO: 3179482 - DNA, 18 bp, Homo sapiens
taaagtatagagagaagt

SEQ ID NO: 3179483 - DNA, 20 bp, Homo sapiens
taaagtatagagagaagttc

SEQ ID NO: 3179484 - DNA, 19 bp, Homo sapiens
taaagtatatatagaatct

SEQ ID NO: 3179485 - DNA, 14 bp, Homo sapiens
taaagtatatattt

SEQ ID NO: 3179486 - DNA, 16 bp, Homo sapiens
taaagtatgtaaacag

SEQ ID NO: 3179487 - DNA, 21 bp, Homo sapiens
taaagtatttttataaatata

SEQ ID NO: 3179488 - DNA, 21 bp, Homo sapiens
taaagtcagttgctcaaaaag

SEQ ID NO: 3179489 - DNA, 14 bp, Homo sapiens
taaagtctgaatca

SEQ ID NO: 3179490 - DNA, 19 bp, Homo sapiens
taaagtgacaaaagctcat

SEQ ID NO: 3179491 - DNA, 18 bp, Homo sapiens
taaagtgattaaacgtgc

SEQ ID NO: 3179492 - DNA, 15 bp, Homo sapiens
taaagtgccttctgg

SEQ ID NO: 3179493 - DNA, 15 bp, Homo sapiens
taaagtgctaaggtt

SEQ ID NO: 3179494 - DNA, 16 bp, Homo sapiens
taaagtgctaaggttc

SEQ ID NO: 3179495 - DNA, 18 bp, Homo sapiens
taaagtgctaaggttcta

SEQ ID NO: 3179496 - DNA, 19 bp, Homo sapiens
taaagtgctaaggttctaa

SEQ ID NO: 3179497 - DNA, 19 bp, Homo sapiens
taaagtgtaacaattgtgt

SEQ ID NO: 3179498 - DNA, 18 bp, Homo sapiens
taaagtgtaagttcacaa

SEQ ID NO: 3179499 - DNA, 12 bp, Homo sapiens
taaagtgtaata

SEQ ID NO: 3179500 - DNA, 20 bp, Homo sapiens
taaagtgttggtctttctaa

SEQ ID NO: 3179501 - DNA, 16 bp, Homo sapiens
taaagttactttgtca

SEQ ID NO: 3179502 - DNA, 12 bp, Homo sapiens
taaagttctaag

SEQ ID NO: 3179503 - DNA, 20 bp, Homo sapiens
taaagttgaagctaagattt

SEQ ID NO: 3179504 - DNA, 22 bp, Homo sapiens
taaagttgcctttatttgctgt

SEQ ID NO: 3179505 - DNA, 14 bp, Homo sapiens
taaagttttgtaca

SEQ ID NO: 3179506 - DNA, 19 bp, Homo sapiens
taaataaaaactaattaag

SEQ ID NO: 3179507 - DNA, 12 bp, Homo sapiens
taaataaaactg

SEQ ID NO: 3179508 - DNA, 13 bp, Homo sapiens
taaataaaactga

SEQ ID NO: 3179509 - DNA, 17 bp, Homo sapiens
taaataaaagtgatcaa

SEQ ID NO: 3179510 - DNA, 15 bp, Homo sapiens
taaataaaataaaag

SEQ ID NO: 3179511 - DNA, 16 bp, Homo sapiens
taaataaaataaaagc

SEQ ID NO: 3179512 - DNA, 14 bp, Homo sapiens
taaataaaatcaat

SEQ ID NO: 3179513 - DNA, 15 bp, Homo sapiens
taaataaaatcaatt

SEQ ID NO: 3179514 - DNA, 15 bp, Homo sapiens
taaataaaatgtgta

SEQ ID NO: 3179515 - DNA, 18 bp, Homo sapiens
taaataaaatgtgtacag

SEQ ID NO: 3179516 - DNA, 21 bp, Homo sapiens
taaataaaatgtgtacagtga

SEQ ID NO: 3179517 - DNA, 14 bp, Homo sapiens
taaataaactgttt

SEQ ID NO: 3179518 - DNA, 13 bp, Homo sapiens
taaataaactttt

SEQ ID NO: 3179519 - DNA, 14 bp, Homo sapiens
taaataacctctgg

SEQ ID NO: 3179520 - DNA, 19 bp, Homo sapiens
taaataacctctggccctt

SEQ ID NO: 3179521 - DNA, 12 bp, Homo sapiens
taaataagcaaa

SEQ ID NO: 3179522 - DNA, 18 bp, Homo sapiens
taaataagcaaataaaca

SEQ ID NO: 3179523 - DNA, 13 bp, Homo sapiens
taaataatgaaaa

SEQ ID NO: 3179524 - DNA, 23 bp, Homo sapiens
taaataattttaaataacctctg

SEQ ID NO: 3179525 - DNA, 16 bp, Homo sapiens
taaatacaagactgtt

SEQ ID NO: 3179526 - DNA, 20 bp, Homo sapiens
taaatacaagactgttgtga

SEQ ID NO: 3179527 - DNA, 18 bp, Homo sapiens
taaatacagacactaagt

SEQ ID NO: 3179528 - DNA, 22 bp, Homo sapiens
taaatacagacactaagttata

SEQ ID NO: 3179529 - DNA, 19 bp, Homo sapiens
taaatacagataattcatt

SEQ ID NO: 3179530 - DNA, 21 bp, Homo sapiens
taaatacatacggtcaggttt

SEQ ID NO: 3179531 - DNA, 20 bp, Homo sapiens
taaatacatgccacatcaaa

SEQ ID NO: 3179532 - DNA, 12 bp, Homo sapiens
taaataccattg

SEQ ID NO: 3179533 - DNA, 17 bp, Homo sapiens
taaatactgtgtggaac

SEQ ID NO: 3179534 - DNA, 14 bp, Homo sapiens
taaatagctatatc

SEQ ID NO: 3179535 - DNA, 21 bp, Homo sapiens
taaataggaatcattcagaaa

SEQ ID NO: 3179536 - DNA, 15 bp, Homo sapiens
taaatataaatagct

SEQ ID NO: 3179537 - DNA, 17 bp, Homo sapiens
taaatataaatagctaa

SEQ ID NO: 3179538 - DNA, 22 bp, Homo sapiens
taaatataagccttttatactg

SEQ ID NO: 3179539 - DNA, 15 bp, Homo sapiens
taaatataattctgt

SEQ ID NO: 3179540 - DNA, 16 bp, Homo sapiens
taaatataattctgta

SEQ ID NO: 3179541 - DNA, 16 bp, Homo sapiens
taaatatagattagaa

SEQ ID NO: 3179542 - DNA, 20 bp, Homo sapiens
taaatatagattagaaaaat

SEQ ID NO: 3179543 - DNA, 15 bp, Homo sapiens
taaatatagttccta

SEQ ID NO: 3179544 - DNA, 14 bp, Homo sapiens
taaatatataaaaa

SEQ ID NO: 3179545 - DNA, 17 bp, Homo sapiens
taaatatatatttctaa

SEQ ID NO: 3179546 - DNA, 17 bp, Homo sapiens
taaatatatgtctgata

SEQ ID NO: 3179547 - DNA, 21 bp, Homo sapiens
taaatatccaaagactgtact

SEQ ID NO: 3179548 - DNA, 18 bp, Homo sapiens
taaatatcttctgatttg

SEQ ID NO: 3179549 - DNA, 22 bp, Homo sapiens
taaatatgaaccctttgtttct

SEQ ID NO: 3179550 - DNA, 23 bp, Homo sapiens
taaatatgaaccctttgtttctt

SEQ ID NO: 3179551 - DNA, 22 bp, Homo sapiens
taaatatgaatctgctcacttt

SEQ ID NO: 3179552 - DNA, 14 bp, Homo sapiens
taaatatgtacatt

SEQ ID NO: 3179553 - DNA, 19 bp, Homo sapiens
taaatattctatatgaatt

SEQ ID NO: 3179554 - DNA, 13 bp, Homo sapiens
taaatatttactc

SEQ ID NO: 3179555 - DNA, 16 bp, Homo sapiens
taaatatttactcttt

SEQ ID NO: 3179556 - DNA, 21 bp, Homo sapiens
taaatatttactctttgcaaa

SEQ ID NO: 3179557 - DNA, 16 bp, Homo sapiens
taaatatttatgtaga

SEQ ID NO: 3179558 - DNA, 17 bp, Homo sapiens
taaatatttatgtagat

SEQ ID NO: 3179559 - DNA, 18 bp, Homo sapiens
taaatatttgacttgcat

SEQ ID NO: 3179560 - DNA, 22 bp, Homo sapiens
taaatatttggtctctatttca

SEQ ID NO: 3179561 - DNA, 18 bp, Homo sapiens
taaatattttcaaagaga

SEQ ID NO: 3179562 - DNA, 13 bp, Homo sapiens
taaatattttcca

SEQ ID NO: 3179563 - DNA, 14 bp, Homo sapiens
taaatcaatgtcac

SEQ ID NO: 3179564 - DNA, 14 bp, Homo sapiens
taaatcacacattc

SEQ ID NO: 3179565 - DNA, 23 bp, Homo sapiens
taaatcatgtatgttatgatatt

SEQ ID NO: 3179566 - DNA, 15 bp, Homo sapiens
taaatcatttcagta

SEQ ID NO: 3179567 - DNA, 20 bp, Homo sapiens
taagacctactgttctaaag

SEQ ID NO: 3179568 - DNA, 22 bp, Homo sapiens
taagacctactgttctaaagct

SEQ ID NO: 3179569 - DNA, 18 bp, Homo sapiens
taagactaaatctgtaag

SEQ ID NO: 3179570 - DNA, 19 bp, Homo sapiens
taagactatatatataaat

SEQ ID NO: 3179571 - DNA, 20 bp, Homo sapiens
taagactatatatataaatg

SEQ ID NO: 3179572 - DNA, 23 bp, Homo sapiens
taagactatatatataaatgtat

SEQ ID NO: 3179573 - DNA, 21 bp, Homo sapiens
taagactcaaatgttctaagt

SEQ ID NO: 3179574 - DNA, 18 bp, Homo sapiens
taagactcattccctaga

SEQ ID NO: 3179575 - DNA, 21 bp, Homo sapiens
taagactggacatttaacttt

SEQ ID NO: 3179576 - DNA, 17 bp, Homo sapiens
taagactgtagatatgt

SEQ ID NO: 3179577 - DNA, 21 bp, Homo sapiens
taagactgtttttaagtaact

SEQ ID NO: 3179578 - DNA, 18 bp, Homo sapiens
taagacttactctaagat

SEQ ID NO: 3179579 - DNA, 20 bp, Homo sapiens
taagagaaaagagagaaaca

SEQ ID NO: 3179580 - DNA, 12 bp, Homo sapiens
taagagaaatgg

SEQ ID NO: 3179581 - DNA, 23 bp, Homo sapiens
taagagactcactggttttactt

SEQ ID NO: 3179582 - DNA, 14 bp, Homo sapiens
taagagagaaatct

SEQ ID NO: 3179583 - DNA, 19 bp, Homo sapiens
taagagcaccttcctcact

SEQ ID NO: 3179584 - DNA, 20 bp, Homo sapiens
taagagcaccttcctcactt

SEQ ID NO: 3179585 - DNA, 14 bp, Homo sapiens
taagagctggtgtc

SEQ ID NO: 3179586 - DNA, 16 bp, Homo sapiens
taagaggatgagcaga

SEQ ID NO: 3179587 - DNA, 22 bp, Homo sapiens
taagaggcagggtctcactctg

SEQ ID NO: 3179588 - DNA, 18 bp, Homo sapiens
taagaggtgttatttgga

SEQ ID NO: 3179589 - DNA, 14 bp, Homo sapiens
taagagtactggga

SEQ ID NO: 3179590 - DNA, 23 bp, Homo sapiens
taagagtgtagaagcattccttc

SEQ ID NO: 3179591 - DNA, 18 bp, Homo sapiens
taagataatagtttacat

SEQ ID NO: 3179592 - DNA, 14 bp, Homo sapiens
taagatacaaatta

SEQ ID NO: 3179593 - DNA, 22 bp, Homo sapiens
taagatacttagattagaccta

SEQ ID NO: 3179594 - DNA, 14 bp, Homo sapiens
taagatagacttat

SEQ ID NO: 3179595 - DNA, 19 bp, Homo sapiens
taagatagacttattcttt

SEQ ID NO: 3179596 - DNA, 22 bp, Homo sapiens
taagatatttgcagtttttcat

SEQ ID NO: 3179597 - DNA, 14 bp, Homo sapiens
taagatcttagatt

SEQ ID NO: 3179598 - DNA, 19 bp, Homo sapiens
taagatgagatttgccagc

SEQ ID NO: 3179599 - DNA, 20 bp, Homo sapiens
taagatgagatttgccagca

SEQ ID NO: 3179600 - DNA, 11 bp, Homo sapiens
taagatgctgg

SEQ ID NO: 3179601 - DNA, 20 bp, Homo sapiens
taagatggattctcagatat

SEQ ID NO: 3179602 - DNA, 20 bp, Homo sapiens
taagatgtgatattctaaga

SEQ ID NO: 3179603 - DNA, 16 bp, Homo sapiens
taagattatagattct

SEQ ID NO: 3179604 - DNA, 14 bp, Homo sapiens
taagattctaaagg

SEQ ID NO: 3179605 - DNA, 16 bp, Homo sapiens
taagattctaaaggtc

SEQ ID NO: 3179606 - DNA, 12 bp, Homo sapiens
taagattctaac

SEQ ID NO: 3179607 - DNA, 13 bp, Homo sapiens
taagattctaacg

SEQ ID NO: 3179608 - DNA, 15 bp, Homo sapiens
taagattctaatgat

SEQ ID NO: 3179609 - DNA, 23 bp, Homo sapiens
taagatttgtgtttttctttttc

SEQ ID NO: 3179610 - DNA, 15 bp, Homo sapiens
taagatttttctcaa

SEQ ID NO: 3179611 - DNA, 16 bp, Homo sapiens
taagatttttctcaaa

SEQ ID NO: 3179612 - DNA, 21 bp, Homo sapiens
taagatttttctcaaagtttt

SEQ ID NO: 3179613 - DNA, 15 bp, Homo sapiens
taagcaaaagaaaaa

SEQ ID NO: 3179614 - DNA, 21 bp, Homo sapiens
taagcaaagcacccatttcaa

SEQ ID NO: 3179615 - DNA, 17 bp, Homo sapiens
taagcaacatggctttg

SEQ ID NO: 3179616 - DNA, 13 bp, Homo sapiens
taagcactgtgct

SEQ ID NO: 3179617 - DNA, 17 bp, Homo sapiens
taagcactgtgctaata

SEQ ID NO: 3179618 - DNA, 21 bp, Homo sapiens
taagcagatttaacaattcca

SEQ ID NO: 3179619 - DNA, 12 bp, Homo sapiens
taagcagctctt

SEQ ID NO: 3179620 - DNA, 21 bp, Homo sapiens
taagcagtatattagtattat

SEQ ID NO: 3179621 - DNA, 12 bp, Homo sapiens
taagcagtccct

SEQ ID NO: 3179622 - DNA, 18 bp, Homo sapiens
taagcattgggtgggtaa

SEQ ID NO: 3179623 - DNA, 12 bp, Homo sapiens
taagcattgttt

SEQ ID NO: 3179624 - DNA, 15 bp, Homo sapiens
taagcattgtttgct

SEQ ID NO: 3179625 - DNA, 18 bp, Homo sapiens
taagcattgtttgcttat

SEQ ID NO: 3179626 - DNA, 12 bp, Homo sapiens
taagccaaagaa

SEQ ID NO: 3179627 - DNA, 15 bp, Homo sapiens
taagccaaagaaaca

SEQ ID NO: 3179628 - DNA, 23 bp, Homo sapiens
taagccaaagaaacaagctgtgc

SEQ ID NO: 3179629 - DNA, 13 bp, Homo sapiens
taagccagagcct

SEQ ID NO: 3179630 - DNA, 16 bp, Homo sapiens
taagccagttggatct

SEQ ID NO: 3179631 - DNA, 19 bp, Homo sapiens
taagcccagtgctgctgta

SEQ ID NO: 3179632 - DNA, 20 bp, Homo sapiens
taagcccagtgctgctgtaa

SEQ ID NO: 3179633 - DNA, 19 bp, Homo sapiens
taagccctcgaaccaaggc

SEQ ID NO: 3179634 - DNA, 17 bp, Homo sapiens
taagcctcatatttaaa

SEQ ID NO: 3179635 - DNA, 17 bp, Homo sapiens
taagcctccatttagtt

SEQ ID NO: 3179636 - DNA, 19 bp, Homo sapiens
taagcctccatttagttct

SEQ ID NO: 3179637 - DNA, 16 bp, Homo sapiens
taagccttataaacca

SEQ ID NO: 3179638 - DNA, 17 bp, Homo sapiens
taagccttataaaccaa

SEQ ID NO: 3179639 - DNA, 16 bp, Homo sapiens
taagcctttccataag

SEQ ID NO: 3179640 - DNA, 20 bp, Homo sapiens
taagccttttatactgatta

SEQ ID NO: 3179641 - DNA, 19 bp, Homo sapiens
taagcgttaagggcagagt

SEQ ID NO: 3179642 - DNA, 22 bp, Homo sapiens
taagctatcacctagcagcctc

SEQ ID NO: 3179643 - DNA, 21 bp, Homo sapiens
taagctccttgagtaaaaagg

SEQ ID NO: 3179644 - DNA, 12 bp, Homo sapiens
taagctggctct

SEQ ID NO: 3179645 - DNA, 20 bp, Homo sapiens
taagctggctctgtttgatg

SEQ ID NO: 3179646 - DNA, 21 bp, Homo sapiens
taagctgggaaaaaagttttg

SEQ ID NO: 3179647 - DNA, 12 bp, Homo sapiens
taagctgtgtgc

SEQ ID NO: 3179648 - DNA, 11 bp, Homo sapiens
taagctgtttc

SEQ ID NO: 3179649 - DNA, 17 bp, Homo sapiens
taagcttcagttgcttg

SEQ ID NO: 3179650 - DNA, 16 bp, Homo sapiens
taagcttccattttaa

SEQ ID NO: 3179651 - DNA, 16 bp, Homo sapiens
taagctttctctcaga

SEQ ID NO: 3179652 - DNA, 18 bp, Homo sapiens
taagctttctctcagaaa

SEQ ID NO: 3179653 - DNA, 13 bp, Homo sapiens
taagctttttgga

SEQ ID NO: 3179654 - DNA, 13 bp, Homo sapiens
taaggaaactaga

SEQ ID NO: 3179655 - DNA, 17 bp, Homo sapiens
taaggaaactcttatct

SEQ ID NO: 3179656 - DNA, 16 bp, Homo sapiens
taaggaaagcaataaa

SEQ ID NO: 3179657 - DNA, 15 bp, Homo sapiens
taaggaagagggctg

SEQ ID NO: 3179658 - DNA, 19 bp, Homo sapiens
taaggaatgtagctggttt

SEQ ID NO: 3179659 - DNA, 14 bp, Homo sapiens
taaggacacactaa

SEQ ID NO: 3179660 - DNA, 15 bp, Homo sapiens
taaggacacactaat

SEQ ID NO: 3179661 - DNA, 15 bp, Homo sapiens
taaggacctgaaatt

SEQ ID NO: 3179662 - DNA, 21 bp, Homo sapiens
taaggacctgaaattccaaag

SEQ ID NO: 3179663 - DNA, 22 bp, Homo sapiens
taaggacctgaaattccaaagt

SEQ ID NO: 3179664 - DNA, 16 bp, Homo sapiens
taaggagactgaggct

SEQ ID NO: 3179665 - DNA, 20 bp, Homo sapiens
taaggagcatcagccagtga

SEQ ID NO: 3179666 - DNA, 23 bp, Homo sapiens
taaggaggaggagggagaagaga

SEQ ID NO: 3179667 - DNA, 19 bp, Homo sapiens
taaggatcagaacagcaga

SEQ ID NO: 3179668 - DNA, 18 bp, Homo sapiens
taaggatccggaaagaag

SEQ ID NO: 3179669 - DNA, 15 bp, Homo sapiens
taaggattgtgatat

SEQ ID NO: 3179670 - DNA, 22 bp, Homo sapiens
taaggattttggactgagattt

SEQ ID NO: 3179671 - DNA, 17 bp, Homo sapiens
taagggaaaagataaag

SEQ ID NO: 3179672 - DNA, 12 bp, Homo sapiens
taagggagagct

SEQ ID NO: 3179673 - DNA, 22 bp, Homo sapiens
taagggagtggcctcatttcac

SEQ ID NO: 3179674 - DNA, 22 bp, Homo sapiens
taagggagtgtttgtgtctgac

SEQ ID NO: 3179675 - DNA, 11 bp, Homo sapiens
taagggcagag

SEQ ID NO: 3179676 - DNA, 12 bp, Homo sapiens
taagggcagagt

SEQ ID NO: 3179677 - DNA, 16 bp, Homo sapiens
taaggggaagaatgaa

SEQ ID NO: 3179678 - DNA, 20 bp, Homo sapiens
taaggggaagaatgaaagct

SEQ ID NO: 3179679 - DNA, 23 bp, Homo sapiens
taaggggtgggtcagaacatgtt

SEQ ID NO: 3179680 - DNA, 20 bp, Homo sapiens
taagggtctttggtgttttt

SEQ ID NO: 3179681 - DNA, 13 bp, Homo sapiens
taagggttttaga

SEQ ID NO: 3179682 - DNA, 16 bp, Homo sapiens
taaggtatatgtttta

SEQ ID NO: 3179683 - DNA, 15 bp, Homo sapiens
taaggtcaagggaaa

SEQ ID NO: 3179684 - DNA, 17 bp, Homo sapiens
taaggtccggtgttcta

SEQ ID NO: 3179685 - DNA, 22 bp, Homo sapiens
taaggtctcatgctgttgctgc

SEQ ID NO: 3179686 - DNA, 16 bp, Homo sapiens
taaggtgggtccagga

SEQ ID NO: 3179687 - DNA, 22 bp, Homo sapiens
taaggtgggtccaggaaggcag

SEQ ID NO: 3179688 - DNA, 15 bp, Homo sapiens
taaggtgtgctctga

SEQ ID NO: 3179689 - DNA, 18 bp, Homo sapiens
taagtaaattgcctgatt

SEQ ID NO: 3179690 - DNA, 19 bp, Homo sapiens
taagtaacttaaggacctt

SEQ ID NO: 3179691 - DNA, 22 bp, Homo sapiens
taagtaaggtgcaatgaagaag

SEQ ID NO: 3179692 - DNA, 21 bp, Homo sapiens
taagtaattatcgggaacagt

SEQ ID NO: 3179693 - DNA, 20 bp, Homo sapiens
taattcaaggaatttcttaa

SEQ ID NO: 3179694 - DNA, 20 bp, Homo sapiens
taattcaaggagaatatgat

SEQ ID NO: 3179695 - DNA, 21 bp, Homo sapiens
taattcacagaatagcacaaa

SEQ ID NO: 3179696 - DNA, 17 bp, Homo sapiens
taattcaccaaagtatt

SEQ ID NO: 3179697 - DNA, 18 bp, Homo sapiens
taattcaccaaagtattt

SEQ ID NO: 3179698 - DNA, 23 bp, Homo sapiens
taattcacctatgttattttgtg

SEQ ID NO: 3179699 - DNA, 14 bp, Homo sapiens
taattcagatggat

SEQ ID NO: 3179700 - DNA, 15 bp, Homo sapiens
taattcagctttgtc

SEQ ID NO: 3179701 - DNA, 19 bp, Homo sapiens
taattcaggcatattttaa

SEQ ID NO: 3179702 - DNA, 16 bp, Homo sapiens
taattccaatatgatg

SEQ ID NO: 3179703 - DNA, 19 bp, Homo sapiens
taattccaatatgatgact

SEQ ID NO: 3179704 - DNA, 16 bp, Homo sapiens
taattcccattttgca

SEQ ID NO: 3179705 - DNA, 20 bp, Homo sapiens
taattcccattttgcaaaat

SEQ ID NO: 3179706 - DNA, 15 bp, Homo sapiens
taattccctatcttt

SEQ ID NO: 3179707 - DNA, 18 bp, Homo sapiens
taattctaaatgaatgtt

SEQ ID NO: 3179708 - DNA, 19 bp, Homo sapiens
taattctaagttatttact

SEQ ID NO: 3179709 - DNA, 10 bp, Homo sapiens
taattctgta

SEQ ID NO: 3179710 - DNA, 12 bp, Homo sapiens
taattctgtaaa

SEQ ID NO: 3179711 - DNA, 12 bp, Homo sapiens
taattctgtaca

SEQ ID NO: 3179712 - DNA, 14 bp, Homo sapiens
taattctgtacata

SEQ ID NO: 3179713 - DNA, 22 bp, Homo sapiens
taattcttacactgcctgtata

SEQ ID NO: 3179714 - DNA, 15 bp, Homo sapiens
taattcttcacctgt

SEQ ID NO: 3179715 - DNA, 15 bp, Homo sapiens
taattcttgtatatt

SEQ ID NO: 3179716 - DNA, 19 bp, Homo sapiens
taattgatcaaattcattt

SEQ ID NO: 3179717 - DNA, 18 bp, Homo sapiens
taattgcttaaaagacat

SEQ ID NO: 3179718 - DNA, 16 bp, Homo sapiens
taattgcttacatttt

SEQ ID NO: 3179719 - DNA, 23 bp, Homo sapiens
taattgcttacatttttacaata

SEQ ID NO: 3179720 - DNA, 17 bp, Homo sapiens
taattgctttgccaaaa

SEQ ID NO: 3179721 - DNA, 22 bp, Homo sapiens
taattggcccaagtcattgttt

SEQ ID NO: 3179722 - DNA, 22 bp, Homo sapiens
taattggtgctatttgaagaaa

SEQ ID NO: 3179723 - DNA, 13 bp, Homo sapiens
taattgtaaactg

SEQ ID NO: 3179724 - DNA, 22 bp, Homo sapiens
taattgtacaaaattaagcaaa

SEQ ID NO: 3179725 - DNA, 13 bp, Homo sapiens
taattgtagttct

SEQ ID NO: 3179726 - DNA, 17 bp, Homo sapiens
taattgtagttctgtgt

SEQ ID NO: 3179727 - DNA, 12 bp, Homo sapiens
taattgtcatgg

SEQ ID NO: 3179728 - DNA, 14 bp, Homo sapiens
taattgtcatggtt

SEQ ID NO: 3179729 - DNA, 21 bp, Homo sapiens
taattgtgaaaaagttaaaca

SEQ ID NO: 3179730 - DNA, 20 bp, Homo sapiens
taattgtgtaaaaaatggaa

SEQ ID NO: 3179731 - DNA, 20 bp, Homo sapiens
taattgtgtggattctttaa

SEQ ID NO: 3179732 - DNA, 18 bp, Homo sapiens
taattgttccctatgaaa

SEQ ID NO: 3179733 - DNA, 14 bp, Homo sapiens
taattgttgaaatt

SEQ ID NO: 3179734 - DNA, 19 bp, Homo sapiens
taattgttgtttctttcta

SEQ ID NO: 3179735 - DNA, 21 bp, Homo sapiens
taattgtttccaacttgtctg

SEQ ID NO: 3179736 - DNA, 14 bp, Homo sapiens
taattgttttttaa

SEQ ID NO: 3179737 - DNA, 17 bp, Homo sapiens
taattgttttttaaagc

SEQ ID NO: 3179738 - DNA, 20 bp, Homo sapiens
taattgttttttaaagcaag

SEQ ID NO: 3179739 - DNA, 11 bp, Homo sapiens
taatttaaaca

SEQ ID NO: 3179740 - DNA, 19 bp, Homo sapiens
taatttaaacacctcctca

SEQ ID NO: 3179741 - DNA, 19 bp, Homo sapiens
taatttaaacaggcccagc

SEQ ID NO: 3179742 - DNA, 13 bp, Homo sapiens
taatttaaagaga

SEQ ID NO: 3179743 - DNA, 12 bp, Homo sapiens
taatttaaatga

SEQ ID NO: 3179744 - DNA, 19 bp, Homo sapiens
taatttaacaaactaaaaa

SEQ ID NO: 3179745 - DNA, 19 bp, Homo sapiens
taatttaagtcattttcat

SEQ ID NO: 3179746 - DNA, 22 bp, Homo sapiens
taatttacacacttgcatgaat

SEQ ID NO: 3179747 - DNA, 12 bp, Homo sapiens
taatttagaaac

SEQ ID NO: 3179748 - DNA, 22 bp, Homo sapiens
taatttagcagtccaaagaaca

SEQ ID NO: 3179749 - DNA, 21 bp, Homo sapiens
taatttagggtactaaattta

SEQ ID NO: 3179750 - DNA, 16 bp, Homo sapiens
taatttagttattgat

SEQ ID NO: 3179751 - DNA, 16 bp, Homo sapiens
taatttagttgtttct

SEQ ID NO: 3179752 - DNA, 14 bp, Homo sapiens
taatttatctaaat

SEQ ID NO: 3179753 - DNA, 15 bp, Homo sapiens
taatttatctaaatt

SEQ ID NO: 3179754 - DNA, 20 bp, Homo sapiens
taatttatctaaattaaagc

SEQ ID NO: 3179755 - DNA, 21 bp, Homo sapiens
taatttatctaaattaaagcc

SEQ ID NO: 3179756 - DNA, 20 bp, Homo sapiens
taatttatgagtttttgata

SEQ ID NO: 3179757 - DNA, 13 bp, Homo sapiens
taatttatgtgct

SEQ ID NO: 3179758 - DNA, 14 bp, Homo sapiens
taatttattattga

SEQ ID NO: 3179759 - DNA, 19 bp, Homo sapiens
taatttattgtctgtctac

SEQ ID NO: 3179760 - DNA, 19 bp, Homo sapiens
taatttatttagtttttaa

SEQ ID NO: 3179761 - DNA, 12 bp, Homo sapiens
taatttatttat

SEQ ID NO: 3179762 - DNA, 19 bp, Homo sapiens
taatttatttattaagatg

SEQ ID NO: 3179763 - DNA, 20 bp, Homo sapiens
taatttcaaaaatataactt

SEQ ID NO: 3179764 - DNA, 13 bp, Homo sapiens
taatttcatacta

SEQ ID NO: 3179765 - DNA, 24 bp, Homo sapiens
taatttcatactatttagattttc

SEQ ID NO: 3179766 - DNA, 22 bp, Homo sapiens
taatttctaaagcagtttatta

SEQ ID NO: 3179767 - DNA, 11 bp, Homo sapiens
taatttcttca

SEQ ID NO: 3179768 - DNA, 21 bp, Homo sapiens
taatttcttcaaaatgtatat

SEQ ID NO: 3179769 - DNA, 16 bp, Homo sapiens
taatttcttttttcct

SEQ ID NO: 3179770 - DNA, 17 bp, Homo sapiens
taatttctttttttcct

SEQ ID NO: 3179771 - DNA, 15 bp, Homo sapiens
taatttgagagaaat

SEQ ID NO: 3179772 - DNA, 12 bp, Homo sapiens
taatttgatctt

SEQ ID NO: 3179773 - DNA, 24 bp, Homo sapiens
taatttgatgaaagctgattactg

SEQ ID NO: 3179774 - DNA, 16 bp, Homo sapiens
taatttgcattaaatt

SEQ ID NO: 3179775 - DNA, 17 bp, Homo sapiens
taatttgcattaaattc

SEQ ID NO: 3179776 - DNA, 13 bp, Homo sapiens
taatttgtaaact

SEQ ID NO: 3179777 - DNA, 20 bp, Homo sapiens
taatttgtaaacttctgaag

SEQ ID NO: 3179778 - DNA, 20 bp, Homo sapiens
taatttgtgtaataaagtgt

SEQ ID NO: 3179779 - DNA, 21 bp, Homo sapiens
taatttgtgtaataaagtgtt

SEQ ID NO: 3179780 - DNA, 12 bp, Homo sapiens
taatttgtttcc

SEQ ID NO: 3179781 - DNA, 17 bp, Homo sapiens
taatttgttttggatat

SEQ ID NO: 3179782 - DNA, 20 bp, Homo sapiens
taattttaaaagtctatttt

SEQ ID NO: 3179783 - DNA, 14 bp, Homo sapiens
taattttaaacaaa

SEQ ID NO: 3179784 - DNA, 12 bp, Homo sapiens
taattttaaagt

SEQ ID NO: 3179785 - DNA, 15 bp, Homo sapiens
taattttaaataacc

SEQ ID NO: 3179786 - DNA, 21 bp, Homo sapiens
taattttaaataacctctggc

SEQ ID NO: 3179787 - DNA, 15 bp, Homo sapiens
taattttacacatta

SEQ ID NO: 3179788 - DNA, 18 bp, Homo sapiens
taattttatgaatgtctt

SEQ ID NO: 3179789 - DNA, 22 bp, Homo sapiens
taattttattagaataatttca

SEQ ID NO: 3179790 - DNA, 18 bp, Homo sapiens
taattttattttaaaatt

SEQ ID NO: 3179791 - DNA, 19 bp, Homo sapiens
taattttattttaaaattt

SEQ ID NO: 3179792 - DNA, 16 bp, Homo sapiens
taattttcacttctgt

SEQ ID NO: 3179793 - DNA, 20 bp, Homo sapiens
taattttcctcaatcacact

SEQ ID NO: 3179794 - DNA, 22 bp, Homo sapiens
taattttctcaaaagcatttat

SEQ ID NO: 3179795 - DNA, 18 bp, Homo sapiens
taattttgaagtgctgtt

SEQ ID NO: 3179796 - DNA, 14 bp, Homo sapiens
taattttgccttta

SEQ ID NO: 3179797 - DNA, 13 bp, Homo sapiens
taattttggataa

SEQ ID NO: 3179798 - DNA, 21 bp, Homo sapiens
taattttggataatattcatt

SEQ ID NO: 3179799 - DNA, 20 bp, Homo sapiens
taattttgtgcattctttgg

SEQ ID NO: 3179800 - DNA, 15 bp, Homo sapiens
taattttgtgttgta

SEQ ID NO: 3179801 - DNA, 16 bp, Homo sapiens
taattttgtgttgtac

SEQ ID NO: 3179802 - DNA, 14 bp, Homo sapiens
taatttttacccta

SEQ ID NO: 3179803 - DNA, 12 bp, Homo sapiens
taatttttgggg

SEQ ID NO: 3179804 - DNA, 13 bp, Homo sapiens
taatttttgggga

SEQ ID NO: 3179805 - DNA, 23 bp, Homo sapiens
taatttttggggaaaaaagcaca

SEQ ID NO: 3179806 - DNA, 17 bp, Homo sapiens
taattttttattcaagt

SEQ ID NO: 3179807 - DNA, 16 bp, Homo sapiens
taattttttgtaatgt

SEQ ID NO: 3179808 - DNA, 21 bp, Homo sapiens
taatttttttatgttttgttt

SEQ ID NO: 3179809 - DNA, 22 bp, Homo sapiens
taatttttttcaatatttatta

SEQ ID NO: 3179810 - DNA, 19 bp, Homo sapiens
taattttttttgttttttg

SEQ ID NO: 3179811 - DNA, 18 bp, Homo sapiens
taatttttttttcataga

SEQ ID NO: 3179812 - DNA, 16 bp, Homo sapiens
tacaaaaaataaaata

SEQ ID NO: 3179813 - DNA, 21 bp, Homo sapiens
tacaaaaaccaaaaagttaaa

SEQ ID NO: 3179814 - DNA, 18 bp, Homo sapiens
tacaaaaaggtataaata

SEQ ID NO: 3179815 - DNA, 16 bp, Homo sapiens
tacaaaaatgggaaaa

SEQ ID NO: 3179816 - DNA, 23 bp, Homo sapiens
tacaaaagaggagcacttccaaa

SEQ ID NO: 3179817 - DNA, 20 bp, Homo sapiens
tacaaaataaacaaataaca

SEQ ID NO: 3179818 - DNA, 20 bp, Homo sapiens
tacaaaatacaatcctgttt

SEQ ID NO: 3179819 - DNA, 19 bp, Homo sapiens
tacccccttttcagctgag

SEQ ID NO: 3179820 - DNA, 18 bp, Homo sapiens
taccccttacttagcatg

SEQ ID NO: 3179821 - DNA, 18 bp, Homo sapiens
tacccctttctggctctc

SEQ ID NO: 3179822 - DNA, 13 bp, Homo sapiens
taccctaatgtct

SEQ ID NO: 3179823 - DNA, 15 bp, Homo sapiens
taccctagttctctt

SEQ ID NO: 3179824 - DNA, 22 bp, Homo sapiens
taccctcaaccctattcattag

SEQ ID NO: 3179825 - DNA, 23 bp, Homo sapiens
taccctcaggcataggcctgggt

SEQ ID NO: 3179826 - DNA, 14 bp, Homo sapiens
taccctcccacccc

SEQ ID NO: 3179827 - DNA, 11 bp, Homo sapiens
taccctccccc

SEQ ID NO: 3179828 - DNA, 12 bp, Homo sapiens
taccctcctggc

SEQ ID NO: 3179829 - DNA, 15 bp, Homo sapiens
taccctcctggctct

SEQ ID NO: 3179830 - DNA, 15 bp, Homo sapiens
taccctcctgtaaat

SEQ ID NO: 3179831 - DNA, 16 bp, Homo sapiens
taccctctaaaaaaga

SEQ ID NO: 3179832 - DNA, 14 bp, Homo sapiens
tacccttaagctag

SEQ ID NO: 3179833 - DNA, 19 bp, Homo sapiens
tacccttccacctcctaga

SEQ ID NO: 3179834 - DNA, 20 bp, Homo sapiens
tacccttcttttatgagcag

SEQ ID NO: 3179835 - DNA, 14 bp, Homo sapiens
taccctttatagaa

SEQ ID NO: 3179836 - DNA, 22 bp, Homo sapiens
taccctttcctcctttatcaca

SEQ ID NO: 3179837 - DNA, 18 bp, Homo sapiens
taccgagtctcttctcca

SEQ ID NO: 3179838 - DNA, 20 bp, Homo sapiens
taccgagttcaagtgatttt

SEQ ID NO: 3179839 - DNA, 17 bp, Homo sapiens
taccgcctgtctcttta

SEQ ID NO: 3179840 - DNA, 17 bp, Homo sapiens
taccggagagagaatgt

SEQ ID NO: 3179841 - DNA, 20 bp, Homo sapiens
taccggcaagcagcgggcta

SEQ ID NO: 3179842 - DNA, 14 bp, Homo sapiens
taccgtagcctccg

SEQ ID NO: 3179843 - DNA, 13 bp, Homo sapiens
taccgtctacatt

SEQ ID NO: 3179844 - DNA, 17 bp, Homo sapiens
taccgtctacatttcac

SEQ ID NO: 3179845 - DNA, 19 bp, Homo sapiens
tacctaaacagatataaat

SEQ ID NO: 3179846 - DNA, 20 bp, Homo sapiens
tacctaaagtatttttataa

SEQ ID NO: 3179847 - DNA, 13 bp, Homo sapiens
tacctaacatctg

SEQ ID NO: 3179848 - DNA, 17 bp, Homo sapiens
tacctaagattacaaat

SEQ ID NO: 3179849 - DNA, 19 bp, Homo sapiens
tacctaagtgacatttgta

SEQ ID NO: 3179850 - DNA, 15 bp, Homo sapiens
tacctaattgtggat

SEQ ID NO: 3179851 - DNA, 15 bp, Homo sapiens
tacctacaataaact

SEQ ID NO: 3179852 - DNA, 16 bp, Homo sapiens
tacctacaataaactg

SEQ ID NO: 3179853 - DNA, 19 bp, Homo sapiens
tacctacaataaactggta

SEQ ID NO: 3179854 - DNA, 17 bp, Homo sapiens
tacctaccacagtgtct

SEQ ID NO: 3179855 - DNA, 18 bp, Homo sapiens
tacctaccacagtgtctg

SEQ ID NO: 3179856 - DNA, 18 bp, Homo sapiens
tacctactgtgtcttgga

SEQ ID NO: 3179857 - DNA, 13 bp, Homo sapiens
tacctactttgac

SEQ ID NO: 3179858 - DNA, 13 bp, Homo sapiens
tacctagatttac

SEQ ID NO: 3179859 - DNA, 18 bp, Homo sapiens
tacctataatgtgtgtat

SEQ ID NO: 3179860 - DNA, 19 bp, Homo sapiens
tacctataatgtgtgtatg

SEQ ID NO: 3179861 - DNA, 21 bp, Homo sapiens
tacctatcccacctccatccc

SEQ ID NO: 3179862 - DNA, 18 bp, Homo sapiens
tacctcaagccccatttc

SEQ ID NO: 3179863 - DNA, 13 bp, Homo sapiens
tacctcaatgttt

SEQ ID NO: 3179864 - DNA, 14 bp, Homo sapiens
tacctcaatgtttg

SEQ ID NO: 3179865 - DNA, 15 bp, Homo sapiens
tacctcaatgtttga

SEQ ID NO: 3179866 - DNA, 16 bp, Homo sapiens
tacctcaatgtttgag

SEQ ID NO: 3179867 - DNA, 16 bp, Homo sapiens
tacctcactactacat

SEQ ID NO: 3179868 - DNA, 14 bp, Homo sapiens
tacctcaggcagct

SEQ ID NO: 3179869 - DNA, 14 bp, Homo sapiens
tacctcaggttgct

SEQ ID NO: 3179870 - DNA, 20 bp, Homo sapiens
tacctcaggttgctggttgc

SEQ ID NO: 3179871 - DNA, 21 bp, Homo sapiens
tacctcaggttgctggttgct

SEQ ID NO: 3179872 - DNA, 13 bp, Homo sapiens
tacctcatgttta

SEQ ID NO: 3179873 - DNA, 14 bp, Homo sapiens
tacctcatgtttat

SEQ ID NO: 3179874 - DNA, 17 bp, Homo sapiens
tacctcatgtttatgaa

SEQ ID NO: 3179875 - DNA, 18 bp, Homo sapiens
tacctcatgtttatgaaa

SEQ ID NO: 3179876 - DNA, 22 bp, Homo sapiens
tacctccaacagaactaaatgt

SEQ ID NO: 3179877 - DNA, 15 bp, Homo sapiens
tacctccattaaatg

SEQ ID NO: 3179878 - DNA, 13 bp, Homo sapiens
tacctcctctcag

SEQ ID NO: 3179879 - DNA, 19 bp, Homo sapiens
tacctcctctcagtgtttt

SEQ ID NO: 3179880 - DNA, 21 bp, Homo sapiens
tacctccttagctttccctgt

SEQ ID NO: 3179881 - DNA, 18 bp, Homo sapiens
tacctctctgtcccttgc

SEQ ID NO: 3179882 - DNA, 21 bp, Homo sapiens
tacctctcttatagaatattt

SEQ ID NO: 3179883 - DNA, 13 bp, Homo sapiens
tacctctgctggg

SEQ ID NO: 3179884 - DNA, 12 bp, Homo sapiens
tacctctgtgtg

SEQ ID NO: 3179885 - DNA, 17 bp, Homo sapiens
tacctcttattgcaaaa

SEQ ID NO: 3179886 - DNA, 12 bp, Homo sapiens
tacctgaacatt

SEQ ID NO: 3179887 - DNA, 13 bp, Homo sapiens
tacctgagaccag

SEQ ID NO: 3179888 - DNA, 17 bp, Homo sapiens
tacctgattgtattttt

SEQ ID NO: 3179889 - DNA, 12 bp, Homo sapiens
tacctgattttt

SEQ ID NO: 3179890 - DNA, 22 bp, Homo sapiens
tacctgcaggctgagccactct

SEQ ID NO: 3179891 - DNA, 12 bp, Homo sapiens
tacctgccctct

SEQ ID NO: 3179892 - DNA, 13 bp, Homo sapiens
tacctgccctgga

SEQ ID NO: 3179893 - DNA, 19 bp, Homo sapiens
tacctgctgccccagctga

SEQ ID NO: 3179894 - DNA, 13 bp, Homo sapiens
tacctgctggaca

SEQ ID NO: 3179895 - DNA, 11 bp, Homo sapiens
tacctgggaaa

SEQ ID NO: 3179896 - DNA, 15 bp, Homo sapiens
tacctgtgaagtgtt

SEQ ID NO: 3179897 - DNA, 21 bp, Homo sapiens
tacctgtgtggtactctgaaa

SEQ ID NO: 3179898 - DNA, 22 bp, Homo sapiens
tacctgttttgtggtcagctgt

SEQ ID NO: 3179899 - DNA, 12 bp, Homo sapiens
taccttactgtg

SEQ ID NO: 3179900 - DNA, 22 bp, Homo sapiens
taccttactgtggaggaaggat

SEQ ID NO: 3179901 - DNA, 15 bp, Homo sapiens
taccttcaaacttta

SEQ ID NO: 3179902 - DNA, 15 bp, Homo sapiens
taccttcaatactta

SEQ ID NO: 3179903 - DNA, 13 bp, Homo sapiens
taccttcatttca

SEQ ID NO: 3179904 - DNA, 12 bp, Homo sapiens
taccttctttca

SEQ ID NO: 3179905 - DNA, 15 bp, Homo sapiens
taccttgaaaggaag

SEQ ID NO: 3179906 - DNA, 14 bp, Homo sapiens
taccttgtatactg

SEQ ID NO: 3179907 - DNA, 16 bp, Homo sapiens
taccttgtatactgta

SEQ ID NO: 3179908 - DNA, 16 bp, Homo sapiens
tacctttatggtttct

SEQ ID NO: 3179909 - DNA, 21 bp, Homo sapiens
taccttttaagacattttcat

SEQ ID NO: 3179910 - DNA, 16 bp, Homo sapiens
taccttttatgtagca

SEQ ID NO: 3179911 - DNA, 17 bp, Homo sapiens
taccttttctgttgtac

SEQ ID NO: 3179912 - DNA, 18 bp, Homo sapiens
taccttttttttttcttg

SEQ ID NO: 3179913 - DNA, 22 bp, Homo sapiens
tacgaacctacagttttaactg

SEQ ID NO: 3179914 - DNA, 19 bp, Homo sapiens
tacgacgtgggaatttcaa

SEQ ID NO: 3179915 - DNA, 14 bp, Homo sapiens
tacgactaatcacc

SEQ ID NO: 3179916 - DNA, 17 bp, Homo sapiens
tacgactttattttctg

SEQ ID NO: 3179917 - DNA, 19 bp, Homo sapiens
tacgagggaggaacacctg

SEQ ID NO: 3179918 - DNA, 19 bp, Homo sapiens
tacggatcatcaacaagat

SEQ ID NO: 3179919 - DNA, 17 bp, Homo sapiens
tacgtagttgtgctttt

SEQ ID NO: 3179920 - DNA, 14 bp, Homo sapiens
tacgtctgacaggc

SEQ ID NO: 3179921 - DNA, 16 bp, Homo sapiens
tacgtctgacaggcaa

SEQ ID NO: 3179922 - DNA, 15 bp, Homo sapiens
tacgttattgttgac

SEQ ID NO: 3179923 - DNA, 12 bp, Homo sapiens
tacgtttgttat

SEQ ID NO: 3179924 - DNA, 18 bp, Homo sapiens
tactaaaaaaaagatgaa

SEQ ID NO: 3179925 - DNA, 12 bp, Homo sapiens
tactaaaaagta

SEQ ID NO: 3179926 - DNA, 14 bp, Homo sapiens
tactaaaaatgcaa

SEQ ID NO: 3179927 - DNA, 12 bp, Homo sapiens
tactaaacatat

SEQ ID NO: 3179928 - DNA, 19 bp, Homo sapiens
tactaaaccaactctaata

SEQ ID NO: 3179929 - DNA, 21 bp, Homo sapiens
tactaaaccaactctaatatt

SEQ ID NO: 3179930 - DNA, 22 bp, Homo sapiens
tactaaagatatcagagctctt

SEQ ID NO: 3179931 - DNA, 13 bp, Homo sapiens
tactaaatttaaa

SEQ ID NO: 3179932 - DNA, 14 bp, Homo sapiens
tactaaatttaaat

SEQ ID NO: 3179933 - DNA, 21 bp, Homo sapiens
tactaaatttaaatttaaaga

SEQ ID NO: 3179934 - DNA, 23 bp, Homo sapiens
tactaaatttaaatttaaagata

SEQ ID NO: 3179935 - DNA, 14 bp, Homo sapiens
tactaacacaagga

SEQ ID NO: 3179936 - DNA, 18 bp, Homo sapiens
tactaagttattttatga

SEQ ID NO: 3179937 - DNA, 13 bp, Homo sapiens
tactaattccaca

SEQ ID NO: 3179938 - DNA, 13 bp, Homo sapiens
tactacaaaattt

SEQ ID NO: 3179939 - DNA, 13 bp, Homo sapiens
tactacactgagg

SEQ ID NO: 3179940 - DNA, 15 bp, Homo sapiens
tactacagtcaagat

SEQ ID NO: 3179941 - DNA, 12 bp, Homo sapiens
tactacatctgt

SEQ ID NO: 3179942 - DNA, 16 bp, Homo sapiens
tactaccacaaggaaa

SEQ ID NO: 3179943 - DNA, 13 bp, Homo sapiens
tactacctctgaa

SEQ ID NO: 3179944 - DNA, 14 bp, Homo sapiens
tactaccttgaaaa

SEQ ID NO: 3179945 - DNA, 15 bp, Homo sapiens
tactagaatttgtat

SEQ ID NO: 3179946 - DNA, 22 bp, Homo sapiens
tactagagtaaaggccatcaaa

SEQ ID NO: 3179947 - DNA, 16 bp, Homo sapiens
tagatgggtgggggct

SEQ ID NO: 3179948 - DNA, 20 bp, Homo sapiens
tagatgggtgggggctcctg

SEQ ID NO: 3179949 - DNA, 14 bp, Homo sapiens
tagatggtgaaatt

SEQ ID NO: 3179950 - DNA, 15 bp, Homo sapiens
tagatggtgaaattt

SEQ ID NO: 3179951 - DNA, 16 bp, Homo sapiens
tagatggttacactgt

SEQ ID NO: 3179952 - DNA, 19 bp, Homo sapiens
tagatggtttgagcctgag

SEQ ID NO: 3179953 - DNA, 18 bp, Homo sapiens
tagatgtccctttcttgg

SEQ ID NO: 3179954 - DNA, 22 bp, Homo sapiens
tagatgtccctttcttggccag

SEQ ID NO: 3179955 - DNA, 21 bp, Homo sapiens
tagatgtctaggtacttcagg

SEQ ID NO: 3179956 - DNA, 21 bp, Homo sapiens
tagatgtctttaggcagcagc

SEQ ID NO: 3179957 - DNA, 22 bp, Homo sapiens
tagatgtgcatttttgtgaaat

SEQ ID NO: 3179958 - DNA, 18 bp, Homo sapiens
tagatgtggtccttagga

SEQ ID NO: 3179959 - DNA, 14 bp, Homo sapiens
tagatgttgtcttg

SEQ ID NO: 3179960 - DNA, 16 bp, Homo sapiens
tagatgttgtcttggc

SEQ ID NO: 3179961 - DNA, 20 bp, Homo sapiens
tagatgtttattcttctaga

SEQ ID NO: 3179962 - DNA, 21 bp, Homo sapiens
tagatgtttattcttctagag

SEQ ID NO: 3179963 - DNA, 22 bp, Homo sapiens
tagatgtttcaactgtgctctt

SEQ ID NO: 3179964 - DNA, 18 bp, Homo sapiens
tagattaaatatagatta

SEQ ID NO: 3179965 - DNA, 23 bp, Homo sapiens
tagattaatactctatttttaca

SEQ ID NO: 3179966 - DNA, 21 bp, Homo sapiens
tagattaccccctcattgttt

SEQ ID NO: 3179967 - DNA, 19 bp, Homo sapiens
tagattatatcaaagtatt

SEQ ID NO: 3179968 - DNA, 16 bp, Homo sapiens
tagattatggagcttt

SEQ ID NO: 3179969 - DNA, 18 bp, Homo sapiens
tagattcaaaggttctag

SEQ ID NO: 3179970 - DNA, 21 bp, Homo sapiens
tagattcctcttgcctctctc

SEQ ID NO: 3179971 - DNA, 23 bp, Homo sapiens
tagattctcttgtataagatcct

SEQ ID NO: 3179972 - DNA, 12 bp, Homo sapiens
tagattgcagaa

SEQ ID NO: 3179973 - DNA, 16 bp, Homo sapiens
tagattgcttctgtag

SEQ ID NO: 3179974 - DNA, 22 bp, Homo sapiens
tagatttatttttcagttccaa

SEQ ID NO: 3179975 - DNA, 16 bp, Homo sapiens
tagatttcatagttca

SEQ ID NO: 3179976 - DNA, 12 bp, Homo sapiens
tagatttctaca

SEQ ID NO: 3179977 - DNA, 16 bp, Homo sapiens
tagattttattttact

SEQ ID NO: 3179978 - DNA, 17 bp, Homo sapiens
tagattttattttacta

SEQ ID NO: 3179979 - DNA, 18 bp, Homo sapiens
tagcaaaaacatgtatgt

SEQ ID NO: 3179980 - DNA, 22 bp, Homo sapiens
tagcaaaaatagttaaaatgct

SEQ ID NO: 3179981 - DNA, 22 bp, Homo sapiens
tagcaaaacgcatggagtgtgt

SEQ ID NO: 3179982 - DNA, 21 bp, Homo sapiens
tagcaaaattcttaagtatgt

SEQ ID NO: 3179983 - DNA, 16 bp, Homo sapiens
tagcaacaacaattgg

SEQ ID NO: 3179984 - DNA, 13 bp, Homo sapiens
tagcaacttttgt

SEQ ID NO: 3179985 - DNA, 16 bp, Homo sapiens
tagcaagctggcctct

SEQ ID NO: 3179986 - DNA, 17 bp, Homo sapiens
tagcaaggtcatttctt

SEQ ID NO: 3179987 - DNA, 18 bp, Homo sapiens
tagcaagttacagtgatg

SEQ ID NO: 3179988 - DNA, 15 bp, Homo sapiens
tagcaataaataaca

SEQ ID NO: 3179989 - DNA, 20 bp, Homo sapiens
tagcaataaataacacttgt

SEQ ID NO: 3179990 - DNA, 21 bp, Homo sapiens
tagcaataaataacacttgtc

SEQ ID NO: 3179991 - DNA, 21 bp, Homo sapiens
tagcaattttctttgtttctt

SEQ ID NO: 3179992 - DNA, 18 bp, Homo sapiens
tagcacacttttccacat

SEQ ID NO: 3179993 - DNA, 23 bp, Homo sapiens
tagcacagattttaattgtcatg

SEQ ID NO: 3179994 - DNA, 17 bp, Homo sapiens
tagcacataaactttgg

SEQ ID NO: 3179995 - DNA, 18 bp, Homo sapiens
tagcacgtttaaagttct

SEQ ID NO: 3179996 - DNA, 19 bp, Homo sapiens
tagcacgtttaaagttctg

SEQ ID NO: 3179997 - DNA, 11 bp, Homo sapiens
tagcactgagg

SEQ ID NO: 3179998 - DNA, 16 bp, Homo sapiens
tagcacttgacctttt

SEQ ID NO: 3179999 - DNA, 15 bp, Homo sapiens
tagcactttcattgc

SEQ ID NO: 3180000 - DNA, 15 bp, Homo sapiens
tagcactttgaaata

SEQ ID NO: 3180001 - DNA, 21 bp, Homo sapiens
tagcactttgaaatacctcat

SEQ ID NO: 3180002 - DNA, 17 bp, Homo sapiens
tagcagacagaaactgg

SEQ ID NO: 3180003 - DNA, 23 bp, Homo sapiens
tagcagagaatgaaagggcccag

SEQ ID NO: 3180004 - DNA, 14 bp, Homo sapiens
tagcagagttaaat

SEQ ID NO: 3180005 - DNA, 20 bp, Homo sapiens
tagcagattttaattttgaa

SEQ ID NO: 3180006 - DNA, 18 bp, Homo sapiens
tagcagcaaaaatataaa

SEQ ID NO: 3180007 - DNA, 21 bp, Homo sapiens
tagcagcaaaaatataaaata

SEQ ID NO: 3180008 - DNA, 16 bp, Homo sapiens
tagcagccagttcaaa

SEQ ID NO: 3180009 - DNA, 22 bp, Homo sapiens
tagcagcggaacaaggagtcag

SEQ ID NO: 3180010 - DNA, 11 bp, Homo sapiens
tagcagctgga

SEQ ID NO: 3180011 - DNA, 16 bp, Homo sapiens
tagcaggggcaccttc

SEQ ID NO: 3180012 - DNA, 17 bp, Homo sapiens
tagcaggggcaccttcc

SEQ ID NO: 3180013 - DNA, 18 bp, Homo sapiens
tagcataaataaaactga

SEQ ID NO: 3180014 - DNA, 19 bp, Homo sapiens
tagcataaataaaactgaa

SEQ ID NO: 3180015 - DNA, 21 bp, Homo sapiens
tagcataattttgtgttgtac

SEQ ID NO: 3180016 - DNA, 15 bp, Homo sapiens
tagcatacatttata

SEQ ID NO: 3180017 - DNA, 22 bp, Homo sapiens
tagcatctcaggagatttcatg

SEQ ID NO: 3180018 - DNA, 21 bp, Homo sapiens
tagcatgatgaaactgtcata

SEQ ID NO: 3180019 - DNA, 14 bp, Homo sapiens
tagcatgcacaaag

SEQ ID NO: 3180020 - DNA, 17 bp, Homo sapiens
tagcatgcacaaagtgt

SEQ ID NO: 3180021 - DNA, 17 bp, Homo sapiens
tagcatgtttgctgaac

SEQ ID NO: 3180022 - DNA, 22 bp, Homo sapiens
tagcattacccccaacctcatt

SEQ ID NO: 3180023 - DNA, 14 bp, Homo sapiens
tagcattctttgga

SEQ ID NO: 3180024 - DNA, 20 bp, Homo sapiens
tagcattctttggagttaaa

SEQ ID NO: 3180025 - DNA, 23 bp, Homo sapiens
tagcattgtcttgttctgtccct

SEQ ID NO: 3180026 - DNA, 15 bp, Homo sapiens
tagcatttcattctt

SEQ ID NO: 3180027 - DNA, 20 bp, Homo sapiens
tagcatttttgatttatgca

SEQ ID NO: 3180028 - DNA, 20 bp, Homo sapiens
tagccaaggtgggctgagcc

SEQ ID NO: 3180029 - DNA, 21 bp, Homo sapiens
tagccaaggtgggctgagccc

SEQ ID NO: 3180030 - DNA, 21 bp, Homo sapiens
tagccaatgtctcctcccctt

SEQ ID NO: 3180031 - DNA, 17 bp, Homo sapiens
tagccagaggctctaat

SEQ ID NO: 3180032 - DNA, 17 bp, Homo sapiens
tagccagagggtgggag

SEQ ID NO: 3180033 - DNA, 21 bp, Homo sapiens
tagccagagggtgggagccta

SEQ ID NO: 3180034 - DNA, 15 bp, Homo sapiens
tagccagatttgtct

SEQ ID NO: 3180035 - DNA, 13 bp, Homo sapiens
tagccaggatcat

SEQ ID NO: 3180036 - DNA, 23 bp, Homo sapiens
tagccaggatcatggtgtaataa

SEQ ID NO: 3180037 - DNA, 16 bp, Homo sapiens
tagccagtgctccagg

SEQ ID NO: 3180038 - DNA, 16 bp, Homo sapiens
tagccagttcctgcct

SEQ ID NO: 3180039 - DNA, 16 bp, Homo sapiens
tagccatggctcaggc

SEQ ID NO: 3180040 - DNA, 18 bp, Homo sapiens
tagccatggctcaggcaa

SEQ ID NO: 3180041 - DNA, 18 bp, Homo sapiens
tagccattcctggtaccc

SEQ ID NO: 3180042 - DNA, 22 bp, Homo sapiens
tagccattcctggtacccagcc

SEQ ID NO: 3180043 - DNA, 14 bp, Homo sapiens
tagcccaccctgct

SEQ ID NO: 3180044 - DNA, 14 bp, Homo sapiens
tagcccagactctg

SEQ ID NO: 3180045 - DNA, 14 bp, Homo sapiens
tagcccaggagaga

SEQ ID NO: 3180046 - DNA, 18 bp, Homo sapiens
tagcccaggagagagaaa

SEQ ID NO: 3180047 - DNA, 12 bp, Homo sapiens
tagcccatccct

SEQ ID NO: 3180048 - DNA, 14 bp, Homo sapiens
tagcccatccctgc

SEQ ID NO: 3180049 - DNA, 20 bp, Homo sapiens
tagcccatccctgcctggtc

SEQ ID NO: 3180050 - DNA, 12 bp, Homo sapiens
tagccccagaga

SEQ ID NO: 3180051 - DNA, 22 bp, Homo sapiens
tagcccctggggtggccaccag

SEQ ID NO: 3180052 - DNA, 23 bp, Homo sapiens
tagcccgacagttctgaactgga

SEQ ID NO: 3180053 - DNA, 13 bp, Homo sapiens
tagccctccccct

SEQ ID NO: 3180054 - DNA, 23 bp, Homo sapiens
tagccctccccctcaacctcacc

SEQ ID NO: 3180055 - DNA, 14 bp, Homo sapiens
tagcccttgtccct

SEQ ID NO: 3180056 - DNA, 13 bp, Homo sapiens
tagccctttctgt

SEQ ID NO: 3180057 - DNA, 15 bp, Homo sapiens
tagccctttctgtgt

SEQ ID NO: 3180058 - DNA, 15 bp, Homo sapiens
tagcctaaagggcag

SEQ ID NO: 3180059 - DNA, 17 bp, Homo sapiens
tagcctaaagggcaggg

SEQ ID NO: 3180060 - DNA, 21 bp, Homo sapiens
tagcctaaggctcctgttttg

SEQ ID NO: 3180061 - DNA, 20 bp, Homo sapiens
tagcctaatacaacatgtag

SEQ ID NO: 3180062 - DNA, 21 bp, Homo sapiens
tagcctatttacctgcaggct

SEQ ID NO: 3180063 - DNA, 13 bp, Homo sapiens
tagcctccctgaa

SEQ ID NO: 3180064 - DNA, 19 bp, Homo sapiens
tagcctccttcgcaggcat

SEQ ID NO: 3180065 - DNA, 20 bp, Homo sapiens
tagcctgaaggattctggga

SEQ ID NO: 3180066 - DNA, 13 bp, Homo sapiens
tagcctgatgaga

SEQ ID NO: 3180067 - DNA, 13 bp, Homo sapiens
tagcctgcctcag

SEQ ID NO: 3180068 - DNA, 21 bp, Homo sapiens
tagcctgcctcagtggcagca

SEQ ID NO: 3180069 - DNA, 20 bp, Homo sapiens
tagcctggagcacctttcct

SEQ ID NO: 3180070 - DNA, 14 bp, Homo sapiens
tagcctgggccaga

SEQ ID NO: 3180071 - DNA, 23 bp, Homo sapiens
tagcctgtggcagtaaagagaaa

SEQ ID NO: 3180072 - DNA, 15 bp, Homo sapiens
tataaactttagagt

SEQ ID NO: 3180073 - DNA, 21 bp, Homo sapiens
tataaactttagagtagcatg

SEQ ID NO: 3180074 - DNA, 15 bp, Homo sapiens
tataaagaacaaggt

SEQ ID NO: 3180075 - DNA, 19 bp, Homo sapiens
tataaagaagaacttgcat

SEQ ID NO: 3180076 - DNA, 23 bp, Homo sapiens
tataaagaaggttggtgaatttc

SEQ ID NO: 3180077 - DNA, 22 bp, Homo sapiens
tataaagacaagtatgaatatt

SEQ ID NO: 3180078 - DNA, 15 bp, Homo sapiens
tataaagattgtact

SEQ ID NO: 3180079 - DNA, 21 bp, Homo sapiens
tataaagcgatatacagatga

SEQ ID NO: 3180080 - DNA, 23 bp, Homo sapiens
tataaagcgatatacagatgaaa

SEQ ID NO: 3180081 - DNA, 23 bp, Homo sapiens
tataaagtacccatctagtactt

SEQ ID NO: 3180082 - DNA, 20 bp, Homo sapiens
tataaagtatatattaggat

SEQ ID NO: 3180083 - DNA, 14 bp, Homo sapiens
tataaagtattctt

SEQ ID NO: 3180084 - DNA, 14 bp, Homo sapiens
tataaataaatatt

SEQ ID NO: 3180085 - DNA, 13 bp, Homo sapiens
tataaataataat

SEQ ID NO: 3180086 - DNA, 15 bp, Homo sapiens
tataaatatacagta

SEQ ID NO: 3180087 - DNA, 15 bp, Homo sapiens
tataaatcaatgtca

SEQ ID NO: 3180088 - DNA, 14 bp, Homo sapiens
tataaatcagtatt

SEQ ID NO: 3180089 - DNA, 16 bp, Homo sapiens
tataaatgtatataca

SEQ ID NO: 3180090 - DNA, 20 bp, Homo sapiens
tataaatgtatatacacata

SEQ ID NO: 3180091 - DNA, 18 bp, Homo sapiens
tataaattctactaagtt

SEQ ID NO: 3180092 - DNA, 22 bp, Homo sapiens
tataaattctactaagttattt

SEQ ID NO: 3180093 - DNA, 13 bp, Homo sapiens
tataaattctgtg

SEQ ID NO: 3180094 - DNA, 23 bp, Homo sapiens
tataaattgtctttaaaaactgt

SEQ ID NO: 3180095 - DNA, 15 bp, Homo sapiens
tataaattttttgaa

SEQ ID NO: 3180096 - DNA, 13 bp, Homo sapiens
tataacaagtata

SEQ ID NO: 3180097 - DNA, 14 bp, Homo sapiens
tataacacattttt

SEQ ID NO: 3180098 - DNA, 22 bp, Homo sapiens
tataacacatttttttgcatgc

SEQ ID NO: 3180099 - DNA, 14 bp, Homo sapiens
tataacagatacat

SEQ ID NO: 3180100 - DNA, 20 bp, Homo sapiens
tataacagatacatttccct

SEQ ID NO: 3180101 - DNA, 16 bp, Homo sapiens
tataacagttatattt

SEQ ID NO: 3180102 - DNA, 14 bp, Homo sapiens
tataacatgtaaaa

SEQ ID NO: 3180103 - DNA, 15 bp, Homo sapiens
tataaccatatgata

SEQ ID NO: 3180104 - DNA, 15 bp, Homo sapiens
tataaccccagcctg

SEQ ID NO: 3180105 - DNA, 22 bp, Homo sapiens
tataacctagttaaagaaagga

SEQ ID NO: 3180106 - DNA, 21 bp, Homo sapiens
tataactcatcataaaataaa

SEQ ID NO: 3180107 - DNA, 23 bp, Homo sapiens
tataactctgcactactcctctg

SEQ ID NO: 3180108 - DNA, 13 bp, Homo sapiens
tataactgtacaa

SEQ ID NO: 3180109 - DNA, 19 bp, Homo sapiens
tataacttaaaaaaatgac

SEQ ID NO: 3180110 - DNA, 16 bp, Homo sapiens
tataacttattagcag

SEQ ID NO: 3180111 - DNA, 17 bp, Homo sapiens
tataacttgatgcatgt

SEQ ID NO: 3180112 - DNA, 16 bp, Homo sapiens
tataagcccactgtta

SEQ ID NO: 3180113 - DNA, 18 bp, Homo sapiens
tataagtactagatgcat

SEQ ID NO: 3180114 - DNA, 16 bp, Homo sapiens
tataagtagcaggcca

SEQ ID NO: 3180115 - DNA, 22 bp, Homo sapiens
tataagtagttggtttgtatga

SEQ ID NO: 3180116 - DNA, 23 bp, Homo sapiens
tataagtagttggtttgtatgag

SEQ ID NO: 3180117 - DNA, 22 bp, Homo sapiens
tataagtgcacacagaaatata

SEQ ID NO: 3180118 - DNA, 23 bp, Homo sapiens
tataagtgcacacagaaatatat

SEQ ID NO: 3180119 - DNA, 19 bp, Homo sapiens
tataagtggaggcacttta

SEQ ID NO: 3180120 - DNA, 17 bp, Homo sapiens
tataagttcacaaaatg

SEQ ID NO: 3180121 - DNA, 16 bp, Homo sapiens
tataataaatgtacat

SEQ ID NO: 3180122 - DNA, 17 bp, Homo sapiens
tataatatactaaacca

SEQ ID NO: 3180123 - DNA, 20 bp, Homo sapiens
tataatatactatatttatg

SEQ ID NO: 3180124 - DNA, 17 bp, Homo sapiens
tataatcaaatgatttc

SEQ ID NO: 3180125 - DNA, 18 bp, Homo sapiens
tataatcaaatgatttca

SEQ ID NO: 3180126 - DNA, 20 bp, Homo sapiens
tataatcaaatgatttcata

SEQ ID NO: 3180127 - DNA, 17 bp, Homo sapiens
tataatctcaaaggaga

SEQ ID NO: 3180128 - DNA, 13 bp, Homo sapiens
tataatctgtcaa

SEQ ID NO: 3180129 - DNA, 18 bp, Homo sapiens
tataatcttgtagacact

SEQ ID NO: 3180130 - DNA, 17 bp, Homo sapiens
tataatgaacaaaatta

SEQ ID NO: 3180131 - DNA, 11 bp, Homo sapiens
tataatgaacc

SEQ ID NO: 3180132 - DNA, 21 bp, Homo sapiens
tataatggaagagaaatctca

SEQ ID NO: 3180133 - DNA, 21 bp, Homo sapiens
tataatgtattttcagctcaa

SEQ ID NO: 3180134 - DNA, 23 bp, Homo sapiens
tataatgtattttcagctcaatt

SEQ ID NO: 3180135 - DNA, 13 bp, Homo sapiens
tataatgtgtgta

SEQ ID NO: 3180136 - DNA, 19 bp, Homo sapiens
tataatgttgttatttaaa

SEQ ID NO: 3180137 - DNA, 20 bp, Homo sapiens
tataattcactcaagcactg

SEQ ID NO: 3180138 - DNA, 17 bp, Homo sapiens
tataattctactttgag

SEQ ID NO: 3180139 - DNA, 12 bp, Homo sapiens
tataattctgta

SEQ ID NO: 3180140 - DNA, 14 bp, Homo sapiens
tataattctgtaaa

SEQ ID NO: 3180141 - DNA, 16 bp, Homo sapiens
tataattctgtaaatg

SEQ ID NO: 3180142 - DNA, 14 bp, Homo sapiens
tataattctgtaca

SEQ ID NO: 3180143 - DNA, 15 bp, Homo sapiens
tataattctgtacat

SEQ ID NO: 3180144 - DNA, 21 bp, Homo sapiens
tataattctgtacatagccta

SEQ ID NO: 3180145 - DNA, 19 bp, Homo sapiens
tataattggatttcctaat

SEQ ID NO: 3180146 - DNA, 20 bp, Homo sapiens
tataattggatttcctaata

SEQ ID NO: 3180147 - DNA, 22 bp, Homo sapiens
tataattggatttcctaatact

SEQ ID NO: 3180148 - DNA, 16 bp, Homo sapiens
tataattgtacaaaat

SEQ ID NO: 3180149 - DNA, 15 bp, Homo sapiens
tataatttaacttca

SEQ ID NO: 3180150 - DNA, 22 bp, Homo sapiens
tataatttaacttcagagggaa

SEQ ID NO: 3180151 - DNA, 14 bp, Homo sapiens
tataatttacctaa

SEQ ID NO: 3180152 - DNA, 16 bp, Homo sapiens
tataatttacctaaga

SEQ ID NO: 3180153 - DNA, 14 bp, Homo sapiens
tataatttgacttg

SEQ ID NO: 3180154 - DNA, 16 bp, Homo sapiens
tataattttaaagtaa

SEQ ID NO: 3180155 - DNA, 19 bp, Homo sapiens
tataattttaaagtaattt

SEQ ID NO: 3180156 - DNA, 17 bp, Homo sapiens
tataattttatgaatgt

SEQ ID NO: 3180157 - DNA, 15 bp, Homo sapiens
tataattttttaaag

SEQ ID NO: 3180158 - DNA, 17 bp, Homo sapiens
tatacaaaactttatca

SEQ ID NO: 3180159 - DNA, 22 bp, Homo sapiens
tatacaaacctaccaaaatgga

SEQ ID NO: 3180160 - DNA, 16 bp, Homo sapiens
tatacaaattagaaaa

SEQ ID NO: 3180161 - DNA, 21 bp, Homo sapiens
tatacaaccctggcattatgt

SEQ ID NO: 3180162 - DNA, 21 bp, Homo sapiens
tatacaataacccagttactt

SEQ ID NO: 3180163 - DNA, 22 bp, Homo sapiens
tatacaataacccagttacttt

SEQ ID NO: 3180164 - DNA, 13 bp, Homo sapiens
tatacaatatata

SEQ ID NO: 3180165 - DNA, 18 bp, Homo sapiens
tatacacaagcaatgcaa

SEQ ID NO: 3180166 - DNA, 19 bp, Homo sapiens
tatacacaagcaatgcaag

SEQ ID NO: 3180167 - DNA, 19 bp, Homo sapiens
tatacacaccctgcccctg

SEQ ID NO: 3180168 - DNA, 21 bp, Homo sapiens
tatacacccagttctgaataa

SEQ ID NO: 3180169 - DNA, 21 bp, Homo sapiens
tatacacttacactttatgca

SEQ ID NO: 3180170 - DNA, 14 bp, Homo sapiens
tatacagatgaaaa

SEQ ID NO: 3180171 - DNA, 17 bp, Homo sapiens
tatacagattttctaga

SEQ ID NO: 3180172 - DNA, 18 bp, Homo sapiens
tatacaggcataaaatag

SEQ ID NO: 3180173 - DNA, 20 bp, Homo sapiens
tatacagtaactttatgtgt

SEQ ID NO: 3180174 - DNA, 12 bp, Homo sapiens
tatacagtgcct

SEQ ID NO: 3180175 - DNA, 16 bp, Homo sapiens
tatacagttataaaat

SEQ ID NO: 3180176 - DNA, 18 bp, Homo sapiens
tatacagttataaaatta

SEQ ID NO: 3180177 - DNA, 23 bp, Homo sapiens
tatacagttataaaattaaaagt

SEQ ID NO: 3180178 - DNA, 17 bp, Homo sapiens
tatacagttattttgga

SEQ ID NO: 3180179 - DNA, 19 bp, Homo sapiens
tatacagttattttggata

SEQ ID NO: 3180180 - DNA, 18 bp, Homo sapiens
tatacatatctttattaa

SEQ ID NO: 3180181 - DNA, 13 bp, Homo sapiens
tatacatatgtag

SEQ ID NO: 3180182 - DNA, 23 bp, Homo sapiens
tatacatatgtagactatataca

SEQ ID NO: 3180183 - DNA, 15 bp, Homo sapiens
tatacatgccagtga

SEQ ID NO: 3180184 - DNA, 15 bp, Homo sapiens
tatacatgtgataca

SEQ ID NO: 3180185 - DNA, 22 bp, Homo sapiens
tatacatgtgtgtatatatgtg

SEQ ID NO: 3180186 - DNA, 17 bp, Homo sapiens
tatacattctttatctt

SEQ ID NO: 3180187 - DNA, 18 bp, Homo sapiens
tatacattgtgtgaaaaa

SEQ ID NO: 3180188 - DNA, 12 bp, Homo sapiens
tatacatttgtt

SEQ ID NO: 3180189 - DNA, 14 bp, Homo sapiens
tataccatttcctc

SEQ ID NO: 3180190 - DNA, 20 bp, Homo sapiens
tatacccgggaccaaactca

SEQ ID NO: 3180191 - DNA, 15 bp, Homo sapiens
tatacctataatgtg

SEQ ID NO: 3180192 - DNA, 18 bp, Homo sapiens
tatacctataatgtgtgt

SEQ ID NO: 3180193 - DNA, 19 bp, Homo sapiens
tatacctataatgtgtgta

SEQ ID NO: 3180194 - DNA, 20 bp, Homo sapiens
tatacctgattttttttcct

SEQ ID NO: 3180195 - DNA, 14 bp, Homo sapiens
tatacgtgtagcta

SEQ ID NO: 3180196 - DNA, 15 bp, Homo sapiens
tatacgtgtagctat

SEQ ID NO: 3180197 - DNA, 21 bp, Homo sapiens
tatcatttttgtacagtttgc

SEQ ID NO: 3180198 - DNA, 15 bp, Homo sapiens
tatccaaagactgta

SEQ ID NO: 3180199 - DNA, 17 bp, Homo sapiens
tatccaaagactgtact

SEQ ID NO: 3180200 - DNA, 18 bp, Homo sapiens
tatccaaagactgtactg

SEQ ID NO: 3180201 - DNA, 20 bp, Homo sapiens
tatccacaatagctgacggc

SEQ ID NO: 3180202 - DNA, 13 bp, Homo sapiens
tatccaccacctc

SEQ ID NO: 3180203 - DNA, 16 bp, Homo sapiens
tatccatgtactgtag

SEQ ID NO: 3180204 - DNA, 18 bp, Homo sapiens
tatccatgtactgtagtt

SEQ ID NO: 3180205 - DNA, 15 bp, Homo sapiens
tatccatgtacttgt

SEQ ID NO: 3180206 - DNA, 21 bp, Homo sapiens
tatcccaatcaaagaattaca

SEQ ID NO: 3180207 - DNA, 14 bp, Homo sapiens
tatcccagaaatta

SEQ ID NO: 3180208 - DNA, 18 bp, Homo sapiens
tatccccaatcagctcct

SEQ ID NO: 3180209 - DNA, 22 bp, Homo sapiens
tatccccatctccctgcctggc

SEQ ID NO: 3180210 - DNA, 19 bp, Homo sapiens
tatcccccccctgtatagt

SEQ ID NO: 3180211 - DNA, 17 bp, Homo sapiens
tatcccctgtgccctgc

SEQ ID NO: 3180212 - DNA, 14 bp, Homo sapiens
tatcccgagtctgg

SEQ ID NO: 3180213 - DNA, 15 bp, Homo sapiens
tatccctcttgtaag

SEQ ID NO: 3180214 - DNA, 18 bp, Homo sapiens
tatcccttctcacagcac

SEQ ID NO: 3180215 - DNA, 15 bp, Homo sapiens
tatccgactctaagc

SEQ ID NO: 3180216 - DNA, 20 bp, Homo sapiens
tatcctagtcattcttccct

SEQ ID NO: 3180217 - DNA, 20 bp, Homo sapiens
tatcctccctggcagacaca

SEQ ID NO: 3180218 - DNA, 13 bp, Homo sapiens
tatcctctttgta

SEQ ID NO: 3180219 - DNA, 16 bp, Homo sapiens
tatcctgaaatttcag

SEQ ID NO: 3180220 - DNA, 10 bp, Homo sapiens
tatcctgccc

SEQ ID NO: 3180221 - DNA, 21 bp, Homo sapiens
tatccttgtctgaatgtattt

SEQ ID NO: 3180222 - DNA, 20 bp, Homo sapiens
tatcgcaccactgtgtattt

SEQ ID NO: 3180223 - DNA, 20 bp, Homo sapiens
tatcgctgacttcatggaat

SEQ ID NO: 3180224 - DNA, 16 bp, Homo sapiens
tatcggagacagtgat

SEQ ID NO: 3180225 - DNA, 16 bp, Homo sapiens
tatcgggaacagtgtt

SEQ ID NO: 3180226 - DNA, 14 bp, Homo sapiens
tatcgggagcagtg

SEQ ID NO: 3180227 - DNA, 18 bp, Homo sapiens
tatcgggagcagtgtctt

SEQ ID NO: 3180228 - DNA, 20 bp, Homo sapiens
tatcgtttttgtattttcat

SEQ ID NO: 3180229 - DNA, 14 bp, Homo sapiens
tatctaaaagaaat

SEQ ID NO: 3180230 - DNA, 16 bp, Homo sapiens
tatctaaatgttgaaa

SEQ ID NO: 3180231 - DNA, 15 bp, Homo sapiens
tatctaagaataata

SEQ ID NO: 3180232 - DNA, 21 bp, Homo sapiens
tatctaatatgtaacaagcca

SEQ ID NO: 3180233 - DNA, 15 bp, Homo sapiens
tatctaattatttcc

SEQ ID NO: 3180234 - DNA, 22 bp, Homo sapiens
tatctacccaagggcagaaagt

SEQ ID NO: 3180235 - DNA, 20 bp, Homo sapiens
tatctactgataaagaaaga

SEQ ID NO: 3180236 - DNA, 13 bp, Homo sapiens
tatctataattta

SEQ ID NO: 3180237 - DNA, 16 bp, Homo sapiens
tatctatatataattc

SEQ ID NO: 3180238 - DNA, 20 bp, Homo sapiens
tatctatatataattctgta

SEQ ID NO: 3180239 - DNA, 21 bp, Homo sapiens
tatctatatataattctgtac

SEQ ID NO: 3180240 - DNA, 22 bp, Homo sapiens
tatctatatatgtgtatgtacg

SEQ ID NO: 3180241 - DNA, 17 bp, Homo sapiens
tatctattaatatatgt

SEQ ID NO: 3180242 - DNA, 16 bp, Homo sapiens
tatctcaatgaaccat

SEQ ID NO: 3180243 - DNA, 19 bp, Homo sapiens
tatctcagatgttaaaata

SEQ ID NO: 3180244 - DNA, 22 bp, Homo sapiens
tatctcagtcatgcataaatat

SEQ ID NO: 3180245 - DNA, 20 bp, Homo sapiens
tatctcatactgtctgggat

SEQ ID NO: 3180246 - DNA, 17 bp, Homo sapiens
tatctcccccaacccac

SEQ ID NO: 3180247 - DNA, 19 bp, Homo sapiens
tatctcccccaacccacct

SEQ ID NO: 3180248 - DNA, 16 bp, Homo sapiens
tatctccttcccctac

SEQ ID NO: 3180249 - DNA, 23 bp, Homo sapiens
tatctccttcccctacacctccc

SEQ ID NO: 3180250 - DNA, 17 bp, Homo sapiens
tatctctaggctgtttt

SEQ ID NO: 3180251 - DNA, 22 bp, Homo sapiens
tatctctaggctgttttctcca

SEQ ID NO: 3180252 - DNA, 16 bp, Homo sapiens
tatctctatttaatat

SEQ ID NO: 3180253 - DNA, 23 bp, Homo sapiens
tatctctgaagcatgtttcatgt

SEQ ID NO: 3180254 - DNA, 11 bp, Homo sapiens
tatctctgtgt

SEQ ID NO: 3180255 - DNA, 16 bp, Homo sapiens
tatctctgtgtgcaca

SEQ ID NO: 3180256 - DNA, 15 bp, Homo sapiens
tatctcttggaaaat

SEQ ID NO: 3180257 - DNA, 15 bp, Homo sapiens
tatctgaaaatgtat

SEQ ID NO: 3180258 - DNA, 20 bp, Homo sapiens
tatctgaaaatgtatgtgta

SEQ ID NO: 3180259 - DNA, 21 bp, Homo sapiens
tatctgagttgccaagacaaa

SEQ ID NO: 3180260 - DNA, 11 bp, Homo sapiens
tatctgcagaa

SEQ ID NO: 3180261 - DNA, 11 bp, Homo sapiens
tatctgcctgg

SEQ ID NO: 3180262 - DNA, 12 bp, Homo sapiens
tatctgcctggc

SEQ ID NO: 3180263 - DNA, 19 bp, Homo sapiens
tatctgcctggcctggctc

SEQ ID NO: 3180264 - DNA, 13 bp, Homo sapiens
tatctggcactgt

SEQ ID NO: 3180265 - DNA, 18 bp, Homo sapiens
tatctgggattattcttt

SEQ ID NO: 3180266 - DNA, 21 bp, Homo sapiens
tatctgggattattctttgaa

SEQ ID NO: 3180267 - DNA, 14 bp, Homo sapiens
tatctgggcctggg

SEQ ID NO: 3180268 - DNA, 18 bp, Homo sapiens
tatctgggctgtgggcaa

SEQ ID NO: 3180269 - DNA, 17 bp, Homo sapiens
tatctgggtaagaagaa

SEQ ID NO: 3180270 - DNA, 14 bp, Homo sapiens
tatctggtgcctcc

SEQ ID NO: 3180271 - DNA, 18 bp, Homo sapiens
tatctggtgcctcctcaa

SEQ ID NO: 3180272 - DNA, 16 bp, Homo sapiens
tatctgtatctctctc

SEQ ID NO: 3180273 - DNA, 13 bp, Homo sapiens
tatctgtatttat

SEQ ID NO: 3180274 - DNA, 14 bp, Homo sapiens
tatctgtatttatt

SEQ ID NO: 3180275 - DNA, 15 bp, Homo sapiens
tatctgtcatctctc

SEQ ID NO: 3180276 - DNA, 20 bp, Homo sapiens
tatctgtcatttgagcaggg

SEQ ID NO: 3180277 - DNA, 19 bp, Homo sapiens
tatctgtgaaatgctggca

SEQ ID NO: 3180278 - DNA, 17 bp, Homo sapiens
tatctgtgcgtgaaaca

SEQ ID NO: 3180279 - DNA, 17 bp, Homo sapiens
tatctgtgtttttgaaa

SEQ ID NO: 3180280 - DNA, 12 bp, Homo sapiens
tatctgttcttg

SEQ ID NO: 3180281 - DNA, 14 bp, Homo sapiens
tatcttacaatatt

SEQ ID NO: 3180282 - DNA, 20 bp, Homo sapiens
tatcttacctgtaaagtcta

SEQ ID NO: 3180283 - DNA, 14 bp, Homo sapiens
tatcttcaaacttt

SEQ ID NO: 3180284 - DNA, 21 bp, Homo sapiens
tatcttcaaactttcactttg

SEQ ID NO: 3180285 - DNA, 12 bp, Homo sapiens
tatcttcacata

SEQ ID NO: 3180286 - DNA, 14 bp, Homo sapiens
tatcttcacattgt

SEQ ID NO: 3180287 - DNA, 13 bp, Homo sapiens
tatcttcctttct

SEQ ID NO: 3180288 - DNA, 21 bp, Homo sapiens
tatcttctcaagttctaagat

SEQ ID NO: 3180289 - DNA, 12 bp, Homo sapiens
tatcttctggat

SEQ ID NO: 3180290 - DNA, 13 bp, Homo sapiens
tatcttctggatt

SEQ ID NO: 3180291 - DNA, 14 bp, Homo sapiens
tatcttctggatta

SEQ ID NO: 3180292 - DNA, 21 bp, Homo sapiens
tatcttctggattagaatgcc

SEQ ID NO: 3180293 - DNA, 17 bp, Homo sapiens
tatcttcttcaaataca

SEQ ID NO: 3180294 - DNA, 21 bp, Homo sapiens
tatcttcttcaaatacaaagt

SEQ ID NO: 3180295 - DNA, 19 bp, Homo sapiens
tatcttggggcaagactgc

SEQ ID NO: 3180296 - DNA, 12 bp, Homo sapiens
tatctttatgct

SEQ ID NO: 3180297 - DNA, 14 bp, Homo sapiens
tatctttatgctgt

SEQ ID NO: 3180298 - DNA, 15 bp, Homo sapiens
tatctttattaatca

SEQ ID NO: 3180299 - DNA, 22 bp, Homo sapiens
tatctttccatgggagccagct

SEQ ID NO: 3180300 - DNA, 14 bp, Homo sapiens
tatctttctttcca

SEQ ID NO: 3180301 - DNA, 17 bp, Homo sapiens
tatctttctttccattt

SEQ ID NO: 3180302 - DNA, 22 bp, Homo sapiens
tatctttctttccatttacagt

SEQ ID NO: 3180303 - DNA, 17 bp, Homo sapiens
tatctttttaaaaactc

SEQ ID NO: 3180304 - DNA, 17 bp, Homo sapiens
tatgaaaaaatatgaac

SEQ ID NO: 3180305 - DNA, 18 bp, Homo sapiens
tatgaaaaacaaaaataa

SEQ ID NO: 3180306 - DNA, 19 bp, Homo sapiens
tatgaaactctacatttaa

SEQ ID NO: 3180307 - DNA, 22 bp, Homo sapiens
tatgaaactctacatttaaaca

SEQ ID NO: 3180308 - DNA, 14 bp, Homo sapiens
tatgaaagaatata

SEQ ID NO: 3180309 - DNA, 23 bp, Homo sapiens
tatgaaagaatatatttatttaa

SEQ ID NO: 3180310 - DNA, 23 bp, Homo sapiens
tatgaaagatggctgtgcctctg

SEQ ID NO: 3180311 - DNA, 17 bp, Homo sapiens
tatgaaagattgtgggg

SEQ ID NO: 3180312 - DNA, 13 bp, Homo sapiens
tatgaaataaaga

SEQ ID NO: 3180313 - DNA, 17 bp, Homo sapiens
tatgaacatattgttga

SEQ ID NO: 3180314 - DNA, 19 bp, Homo sapiens
tatgaaccctttgtttctt

SEQ ID NO: 3180315 - DNA, 21 bp, Homo sapiens
tatgaaccctttgtttcttgt

SEQ ID NO: 3180316 - DNA, 18 bp, Homo sapiens
tatgaacctattttcatt

SEQ ID NO: 3180317 - DNA, 20 bp, Homo sapiens
tatgaacctattttcatttg

SEQ ID NO: 3180318 - DNA, 21 bp, Homo sapiens
tatgaactacaggtgtttgac

SEQ ID NO: 3180319 - DNA, 14 bp, Homo sapiens
tatgaagaactgag

SEQ ID NO: 3180320 - DNA, 16 bp, Homo sapiens
tatgaagaactgagga

SEQ ID NO: 3180321 - DNA, 21 bp, Homo sapiens
tatgaagcagatttatttttg

SEQ ID NO: 3180322 - DNA, 20 bp, Homo sapiens
tatgaaggaatcattccagt

SEQ ID NO: 3180323 - DNA, 16 bp, Homo sapiens
tattaagatggattct

SEQ ID NO: 3180324 - DNA, 19 bp, Homo sapiens
tattaagatggattctcag

SEQ ID NO: 3180325 - DNA, 14 bp, Homo sapiens
tattaagcagtaaa

SEQ ID NO: 3180326 - DNA, 19 bp, Homo sapiens
tattaagcagtaaaaactg

SEQ ID NO: 3180327 - DNA, 13 bp, Homo sapiens
tattaataaagca

SEQ ID NO: 3180328 - DNA, 20 bp, Homo sapiens
tattaatcaccttctttgta

SEQ ID NO: 3180329 - DNA, 14 bp, Homo sapiens
tattaatcttagtg

SEQ ID NO: 3180330 - DNA, 11 bp, Homo sapiens
tattaatttat

SEQ ID NO: 3180331 - DNA, 15 bp, Homo sapiens
tattacaatttgtat

SEQ ID NO: 3180332 - DNA, 18 bp, Homo sapiens
tattacacatttgtacag

SEQ ID NO: 3180333 - DNA, 21 bp, Homo sapiens
tattacactgtatttgtatct

SEQ ID NO: 3180334 - DNA, 15 bp, Homo sapiens
tattacatctaatgc

SEQ ID NO: 3180335 - DNA, 20 bp, Homo sapiens
tattacatttaaatccttgt

SEQ ID NO: 3180336 - DNA, 15 bp, Homo sapiens
tattacattttcagt

SEQ ID NO: 3180337 - DNA, 20 bp, Homo sapiens
tattaccaaaaaagtatttt

SEQ ID NO: 3180338 - DNA, 15 bp, Homo sapiens
tattaccatgagaag

SEQ ID NO: 3180339 - DNA, 21 bp, Homo sapiens
tattaccccctccttcagaca

SEQ ID NO: 3180340 - DNA, 11 bp, Homo sapiens
tattacctctg

SEQ ID NO: 3180341 - DNA, 17 bp, Homo sapiens
tattaccttaagatttt

SEQ ID NO: 3180342 - DNA, 19 bp, Homo sapiens
tattaccttaagatttttc

SEQ ID NO: 3180343 - DNA, 20 bp, Homo sapiens
tattactcccctaagtcttt

SEQ ID NO: 3180344 - DNA, 18 bp, Homo sapiens
tattactgtctggtttta

SEQ ID NO: 3180345 - DNA, 14 bp, Homo sapiens
tattactgtcttta

SEQ ID NO: 3180346 - DNA, 22 bp, Homo sapiens
tattactgtctttattcttatt

SEQ ID NO: 3180347 - DNA, 17 bp, Homo sapiens
tattactgtcttttcta

SEQ ID NO: 3180348 - DNA, 16 bp, Homo sapiens
tattactgttgcattt

SEQ ID NO: 3180349 - DNA, 20 bp, Homo sapiens
tattactgttgcatttactt

SEQ ID NO: 3180350 - DNA, 21 bp, Homo sapiens
tattactgtttatttctgttt

SEQ ID NO: 3180351 - DNA, 13 bp, Homo sapiens
tattacttctgct

SEQ ID NO: 3180352 - DNA, 14 bp, Homo sapiens
tattactttatcac

SEQ ID NO: 3180353 - DNA, 23 bp, Homo sapiens
tattactttatcactttttgaac

SEQ ID NO: 3180354 - DNA, 16 bp, Homo sapiens
tattactttctctgta

SEQ ID NO: 3180355 - DNA, 13 bp, Homo sapiens
tattagacatcaa

SEQ ID NO: 3180356 - DNA, 14 bp, Homo sapiens
tattagacttctaa

SEQ ID NO: 3180357 - DNA, 16 bp, Homo sapiens
tattagactttagaaa

SEQ ID NO: 3180358 - DNA, 13 bp, Homo sapiens
tattagccaggat

SEQ ID NO: 3180359 - DNA, 16 bp, Homo sapiens
tattagggagaaaatt

SEQ ID NO: 3180360 - DNA, 17 bp, Homo sapiens
tattaggtgcaatttca

SEQ ID NO: 3180361 - DNA, 15 bp, Homo sapiens
tattaggttgtcacg

SEQ ID NO: 3180362 - DNA, 21 bp, Homo sapiens
tattagtactgctcttgtttc

SEQ ID NO: 3180363 - DNA, 14 bp, Homo sapiens
tattagtgaagatg

SEQ ID NO: 3180364 - DNA, 13 bp, Homo sapiens
tattagttaatat

SEQ ID NO: 3180365 - DNA, 22 bp, Homo sapiens
tattagttccctgtctcttgaa

SEQ ID NO: 3180366 - DNA, 15 bp, Homo sapiens
tattataaaaccatg

SEQ ID NO: 3180367 - DNA, 20 bp, Homo sapiens
tattataaatatatataaag

SEQ ID NO: 3180368 - DNA, 20 bp, Homo sapiens
tattataaattctactaagt

SEQ ID NO: 3180369 - DNA, 19 bp, Homo sapiens
tattataactctgtataat

SEQ ID NO: 3180370 - DNA, 15 bp, Homo sapiens
tattataacttaaaa

SEQ ID NO: 3180371 - DNA, 20 bp, Homo sapiens
tattataagcattgaaatta

SEQ ID NO: 3180372 - DNA, 23 bp, Homo sapiens
tattataatataatatggaacct

SEQ ID NO: 3180373 - DNA, 19 bp, Homo sapiens
tattataatttttttcaat

SEQ ID NO: 3180374 - DNA, 19 bp, Homo sapiens
tattatacatgtgatacat

SEQ ID NO: 3180375 - DNA, 19 bp, Homo sapiens
tattatactaagaaaagat

SEQ ID NO: 3180376 - DNA, 21 bp, Homo sapiens
tattatagcaactttaagaag

SEQ ID NO: 3180377 - DNA, 14 bp, Homo sapiens
tattatcactgtct

SEQ ID NO: 3180378 - DNA, 13 bp, Homo sapiens
tattatctgtcag

SEQ ID NO: 3180379 - DNA, 14 bp, Homo sapiens
tattatctgtcagc

SEQ ID NO: 3180380 - DNA, 20 bp, Homo sapiens
tattatcttgttcaggaaaa

SEQ ID NO: 3180381 - DNA, 19 bp, Homo sapiens
tattatgctttattggaaa

SEQ ID NO: 3180382 - DNA, 16 bp, Homo sapiens
tattatggaaaactgt

SEQ ID NO: 3180383 - DNA, 20 bp, Homo sapiens
tattatggaaaactgtgttg

SEQ ID NO: 3180384 - DNA, 15 bp, Homo sapiens
tattatgtagctgaa

SEQ ID NO: 3180385 - DNA, 17 bp, Homo sapiens
tattatgtgaagaattt

SEQ ID NO: 3180386 - DNA, 20 bp, Homo sapiens
tattatgtgaagaatttaga

SEQ ID NO: 3180387 - DNA, 14 bp, Homo sapiens
tattatgtttatta

SEQ ID NO: 3180388 - DNA, 17 bp, Homo sapiens
tattattaatataataa

SEQ ID NO: 3180389 - DNA, 19 bp, Homo sapiens
tattattacttatttttga

SEQ ID NO: 3180390 - DNA, 16 bp, Homo sapiens
tattattgaaattgta

SEQ ID NO: 3180391 - DNA, 14 bp, Homo sapiens
tattattgaagatt

SEQ ID NO: 3180392 - DNA, 12 bp, Homo sapiens
tattatttctat

SEQ ID NO: 3180393 - DNA, 13 bp, Homo sapiens
tattatttgaagc

SEQ ID NO: 3180394 - DNA, 23 bp, Homo sapiens
tattatttggcagtttggtattt

SEQ ID NO: 3180395 - DNA, 16 bp, Homo sapiens
tattattttcacctgt

SEQ ID NO: 3180396 - DNA, 13 bp, Homo sapiens
tattattttgggg

SEQ ID NO: 3180397 - DNA, 20 bp, Homo sapiens
tattatttttataattgtac

SEQ ID NO: 3180398 - DNA, 20 bp, Homo sapiens
tattatttttttaaaatttt

SEQ ID NO: 3180399 - DNA, 21 bp, Homo sapiens
tattcaaaccaatttcttcct

SEQ ID NO: 3180400 - DNA, 19 bp, Homo sapiens
tattcaagcaaacatcaaa

SEQ ID NO: 3180401 - DNA, 14 bp, Homo sapiens
tattcaatgtgaca

SEQ ID NO: 3180402 - DNA, 17 bp, Homo sapiens
tattcaattcctctggg

SEQ ID NO: 3180403 - DNA, 18 bp, Homo sapiens
tattcaattcctctggga

SEQ ID NO: 3180404 - DNA, 14 bp, Homo sapiens
tattcacatgttct

SEQ ID NO: 3180405 - DNA, 21 bp, Homo sapiens
tattcacgtgcagcagcaaca

SEQ ID NO: 3180406 - DNA, 23 bp, Homo sapiens
tattcacgtgcagcagcaacaca

SEQ ID NO: 3180407 - DNA, 21 bp, Homo sapiens
tattcactgaagttctcctga

SEQ ID NO: 3180408 - DNA, 18 bp, Homo sapiens
tattcagacaagcaacag

SEQ ID NO: 3180409 - DNA, 14 bp, Homo sapiens
tattcagataatta

SEQ ID NO: 3180410 - DNA, 17 bp, Homo sapiens
tattcagcttcatttgt

SEQ ID NO: 3180411 - DNA, 20 bp, Homo sapiens
tattcaggacttgaaagaaa

SEQ ID NO: 3180412 - DNA, 15 bp, Homo sapiens
tattcataaagagaa

SEQ ID NO: 3180413 - DNA, 18 bp, Homo sapiens
tattcataaagagaaaat

SEQ ID NO: 3180414 - DNA, 14 bp, Homo sapiens
tattcataatgaat

SEQ ID NO: 3180415 - DNA, 20 bp, Homo sapiens
tattcataatgaattataac

SEQ ID NO: 3180416 - DNA, 14 bp, Homo sapiens
tattcatgcttctt

SEQ ID NO: 3180417 - DNA, 13 bp, Homo sapiens
tattcatgttttg

SEQ ID NO: 3180418 - DNA, 18 bp, Homo sapiens
tattcattaaatgtttga

SEQ ID NO: 3180419 - DNA, 13 bp, Homo sapiens
tattcatttaaaa

SEQ ID NO: 3180420 - DNA, 14 bp, Homo sapiens
tattcatttaaaat

SEQ ID NO: 3180421 - DNA, 15 bp, Homo sapiens
tattcatttaaaatg

SEQ ID NO: 3180422 - DNA, 16 bp, Homo sapiens
tattcatttaaaatga

SEQ ID NO: 3180423 - DNA, 17 bp, Homo sapiens
tattcatttaaaatgat

SEQ ID NO: 3180424 - DNA, 12 bp, Homo sapiens
tattcatttagt

SEQ ID NO: 3180425 - DNA, 20 bp, Homo sapiens
tattccacagatatcttttt

SEQ ID NO: 3180426 - DNA, 20 bp, Homo sapiens
tattccagaatgctgtacat

SEQ ID NO: 3180427 - DNA, 13 bp, Homo sapiens
tattccatcaata

SEQ ID NO: 3180428 - DNA, 19 bp, Homo sapiens
tattccatccatatacttt

SEQ ID NO: 3180429 - DNA, 20 bp, Homo sapiens
tattcccctatctctagaat

SEQ ID NO: 3180430 - DNA, 22 bp, Homo sapiens
tattccctgcccaaacccttaa

SEQ ID NO: 3180431 - DNA, 14 bp, Homo sapiens
tattcccttgtatt

SEQ ID NO: 3180432 - DNA, 15 bp, Homo sapiens
tattcccttgtattt

SEQ ID NO: 3180433 - DNA, 19 bp, Homo sapiens
tattcccttgtattttgtt

SEQ ID NO: 3180434 - DNA, 16 bp, Homo sapiens
tattcctccaaatctc

SEQ ID NO: 3180435 - DNA, 18 bp, Homo sapiens
tattcctccaaatctctt

SEQ ID NO: 3180436 - DNA, 23 bp, Homo sapiens
tattcctccaaatctcttgcttg

SEQ ID NO: 3180437 - DNA, 21 bp, Homo sapiens
tattcctctaggcaagcagga

SEQ ID NO: 3180438 - DNA, 14 bp, Homo sapiens
tattcctgtatgtt

SEQ ID NO: 3180439 - DNA, 22 bp, Homo sapiens
tattccttgatactaaaagttc

SEQ ID NO: 3180440 - DNA, 22 bp, Homo sapiens
tattcctttatacacagtggat

SEQ ID NO: 3180441 - DNA, 19 bp, Homo sapiens
tattccttttgtgtacagt

SEQ ID NO: 3180442 - DNA, 12 bp, Homo sapiens
tattctaagact

SEQ ID NO: 3180443 - DNA, 22 bp, Homo sapiens
tattctaagacttactctaaga

SEQ ID NO: 3180444 - DNA, 16 bp, Homo sapiens
tattctaataaatata

SEQ ID NO: 3180445 - DNA, 15 bp, Homo sapiens
tattctaattaaaat

SEQ ID NO: 3180446 - DNA, 18 bp, Homo sapiens
tattctaattaaaattgt

SEQ ID NO: 3180447 - DNA, 14 bp, Homo sapiens
tattctacatttca

SEQ ID NO: 3180448 - DNA, 15 bp, Homo sapiens
tattctacatttcac

SEQ ID NO: 3180449 - DNA, 22 bp, Homo sapiens
tatttaagaaaagcacttttgt

SEQ ID NO: 3180450 - DNA, 21 bp, Homo sapiens
tatttaagaaaatacaataaa

SEQ ID NO: 3180451 - DNA, 12 bp, Homo sapiens
tatttaagcctt

SEQ ID NO: 3180452 - DNA, 20 bp, Homo sapiens
tatttaagttatcaacttta

SEQ ID NO: 3180453 - DNA, 19 bp, Homo sapiens
tatttaatgataagtaaat

SEQ ID NO: 3180454 - DNA, 17 bp, Homo sapiens
tatttaattttcctgga

SEQ ID NO: 3180455 - DNA, 20 bp, Homo sapiens
tatttaattttttactttca

SEQ ID NO: 3180456 - DNA, 20 bp, Homo sapiens
tatttacagtgaaaatgtaa

SEQ ID NO: 3180457 - DNA, 21 bp, Homo sapiens
tatttacatgaattgcatttt

SEQ ID NO: 3180458 - DNA, 21 bp, Homo sapiens
tatttacattttatatttttg

SEQ ID NO: 3180459 - DNA, 14 bp, Homo sapiens
tatttacgctttga

SEQ ID NO: 3180460 - DNA, 15 bp, Homo sapiens
tatttacgctttgat

SEQ ID NO: 3180461 - DNA, 22 bp, Homo sapiens
tatttacgctttgattcatagt

SEQ ID NO: 3180462 - DNA, 17 bp, Homo sapiens
tatttactctttgcaaa

SEQ ID NO: 3180463 - DNA, 21 bp, Homo sapiens
tatttactgagcttctctgtg

SEQ ID NO: 3180464 - DNA, 22 bp, Homo sapiens
tatttactgagcttctctgtga

SEQ ID NO: 3180465 - DNA, 19 bp, Homo sapiens
tatttacttcgttttggtt

SEQ ID NO: 3180466 - DNA, 18 bp, Homo sapiens
tatttacttcttatacat

SEQ ID NO: 3180467 - DNA, 21 bp, Homo sapiens
tatttagactcatcttactgt

SEQ ID NO: 3180468 - DNA, 14 bp, Homo sapiens
tatttagtgctgca

SEQ ID NO: 3180469 - DNA, 15 bp, Homo sapiens
tatttagttatagtt

SEQ ID NO: 3180470 - DNA, 20 bp, Homo sapiens
tatttagttatagtttcaga

SEQ ID NO: 3180471 - DNA, 15 bp, Homo sapiens
tatttataaaacttc

SEQ ID NO: 3180472 - DNA, 19 bp, Homo sapiens
tatttataaactaggtaaa

SEQ ID NO: 3180473 - DNA, 17 bp, Homo sapiens
tatttataaatatattt

SEQ ID NO: 3180474 - DNA, 20 bp, Homo sapiens
tatttataacaacctaaatt

SEQ ID NO: 3180475 - DNA, 18 bp, Homo sapiens
tatttataacagcattct

SEQ ID NO: 3180476 - DNA, 17 bp, Homo sapiens
tatttataagcagattt

SEQ ID NO: 3180477 - DNA, 19 bp, Homo sapiens
tatttatacaagattgaaa

SEQ ID NO: 3180478 - DNA, 17 bp, Homo sapiens
tatttatacagtgcctt

SEQ ID NO: 3180479 - DNA, 16 bp, Homo sapiens
tatttatagaaagctt

SEQ ID NO: 3180480 - DNA, 23 bp, Homo sapiens
tatttataggccagggcatgtgt

SEQ ID NO: 3180481 - DNA, 14 bp, Homo sapiens
tatttatatatatt

SEQ ID NO: 3180482 - DNA, 15 bp, Homo sapiens
tatttatatatttga

SEQ ID NO: 3180483 - DNA, 14 bp, Homo sapiens
tatttatatttcac

SEQ ID NO: 3180484 - DNA, 15 bp, Homo sapiens
tatttatatttggaa

SEQ ID NO: 3180485 - DNA, 20 bp, Homo sapiens
tatttatccaaaatgtgtat

SEQ ID NO: 3180486 - DNA, 22 bp, Homo sapiens
tatttatctgtgtttttgaaat

SEQ ID NO: 3180487 - DNA, 17 bp, Homo sapiens
tatttatgctataaatt

SEQ ID NO: 3180488 - DNA, 13 bp, Homo sapiens
tatttatgtgtat

SEQ ID NO: 3180489 - DNA, 13 bp, Homo sapiens
tatttatgtttgc

SEQ ID NO: 3180490 - DNA, 13 bp, Homo sapiens
tatttattaaata

SEQ ID NO: 3180491 - DNA, 13 bp, Homo sapiens
tatttattaatat

SEQ ID NO: 3180492 - DNA, 16 bp, Homo sapiens
tatttattaatttgaa

SEQ ID NO: 3180493 - DNA, 14 bp, Homo sapiens
tatttattacataa

SEQ ID NO: 3180494 - DNA, 16 bp, Homo sapiens
tatttattacataatt

SEQ ID NO: 3180495 - DNA, 12 bp, Homo sapiens
tatttattaccg

SEQ ID NO: 3180496 - DNA, 16 bp, Homo sapiens
tatttattacctctga

SEQ ID NO: 3180497 - DNA, 17 bp, Homo sapiens
tatttattagccaactg

SEQ ID NO: 3180498 - DNA, 18 bp, Homo sapiens
tatttattagccaactgt

SEQ ID NO: 3180499 - DNA, 14 bp, Homo sapiens
tatttattatttat

SEQ ID NO: 3180500 - DNA, 21 bp, Homo sapiens
tatttattcagcttcatttgt

SEQ ID NO: 3180501 - DNA, 20 bp, Homo sapiens
tatttattccatattcatgt

SEQ ID NO: 3180502 - DNA, 11 bp, Homo sapiens
tatttattggg

SEQ ID NO: 3180503 - DNA, 24 bp, Homo sapiens
tatttattgttagaaaatgactta

SEQ ID NO: 3180504 - DNA, 16 bp, Homo sapiens
tatttattgtttattt

SEQ ID NO: 3180505 - DNA, 22 bp, Homo sapiens
tatttattgtttatttatcagt

SEQ ID NO: 3180506 - DNA, 17 bp, Homo sapiens
tatttatttaaagcatt

SEQ ID NO: 3180507 - DNA, 13 bp, Homo sapiens
tatttatttatgg

SEQ ID NO: 3180508 - DNA, 14 bp, Homo sapiens
tatttatttattta

SEQ ID NO: 3180509 - DNA, 13 bp, Homo sapiens
tatttcaactgct

SEQ ID NO: 3180510 - DNA, 19 bp, Homo sapiens
tatttcaactgctgtaaaa

SEQ ID NO: 3180511 - DNA, 22 bp, Homo sapiens
tatttcaagtgcctagactgtt

SEQ ID NO: 3180512 - DNA, 19 bp, Homo sapiens
tatttcacaggctgtaaat

SEQ ID NO: 3180513 - DNA, 22 bp, Homo sapiens
tatttcagatatcaaaattcta

SEQ ID NO: 3180514 - DNA, 21 bp, Homo sapiens
tatttcagtgtagttaattta

SEQ ID NO: 3180515 - DNA, 16 bp, Homo sapiens
tatttcatgtctttac

SEQ ID NO: 3180516 - DNA, 12 bp, Homo sapiens
tatttcattgcc

SEQ ID NO: 3180517 - DNA, 18 bp, Homo sapiens
tatttccaaacctggttc

SEQ ID NO: 3180518 - DNA, 19 bp, Homo sapiens
tatttccaaacctggttca

SEQ ID NO: 3180519 - DNA, 14 bp, Homo sapiens
tatttccactaaaa

SEQ ID NO: 3180520 - DNA, 15 bp, Homo sapiens
tatttccactaaaaa

SEQ ID NO: 3180521 - DNA, 18 bp, Homo sapiens
tatttccattcaacaaga

SEQ ID NO: 3180522 - DNA, 22 bp, Homo sapiens
tatttccccaggggaaaatgaa

SEQ ID NO: 3180523 - DNA, 14 bp, Homo sapiens
tatttccccttgga

SEQ ID NO: 3180524 - DNA, 15 bp, Homo sapiens
tatttccccttggac

SEQ ID NO: 3180525 - DNA, 23 bp, Homo sapiens
tatttcctatattgttttcagtg

SEQ ID NO: 3180526 - DNA, 13 bp, Homo sapiens
tatttcctccctc

SEQ ID NO: 3180527 - DNA, 11 bp, Homo sapiens
tatttcctgac

SEQ ID NO: 3180528 - DNA, 15 bp, Homo sapiens
tatttcctgacttga

SEQ ID NO: 3180529 - DNA, 16 bp, Homo sapiens
tatttcctgacttgag

SEQ ID NO: 3180530 - DNA, 13 bp, Homo sapiens
tatttctattatt

SEQ ID NO: 3180531 - DNA, 19 bp, Homo sapiens
tatttctcaacaaagcaca

SEQ ID NO: 3180532 - DNA, 11 bp, Homo sapiens
tatttctcctt

SEQ ID NO: 3180533 - DNA, 16 bp, Homo sapiens
tatttctcctttgcaa

SEQ ID NO: 3180534 - DNA, 22 bp, Homo sapiens
tatttctcctttgcaatagcag

SEQ ID NO: 3180535 - DNA, 14 bp, Homo sapiens
tatttctctagtgt

SEQ ID NO: 3180536 - DNA, 13 bp, Homo sapiens
tatttctcttgct

SEQ ID NO: 3180537 - DNA, 20 bp, Homo sapiens
tatttcttaacctttgctat

SEQ ID NO: 3180538 - DNA, 23 bp, Homo sapiens
tatttcttaacctttgctatgta

SEQ ID NO: 3180539 - DNA, 23 bp, Homo sapiens
tatttcttaattattataaaaat

SEQ ID NO: 3180540 - DNA, 18 bp, Homo sapiens
tatttcttatacgctttt

SEQ ID NO: 3180541 - DNA, 13 bp, Homo sapiens
tatttcttgtttg

SEQ ID NO: 3180542 - DNA, 15 bp, Homo sapiens
tatttctttctcgaa

SEQ ID NO: 3180543 - DNA, 17 bp, Homo sapiens
tatttgaaatactaaaa

SEQ ID NO: 3180544 - DNA, 19 bp, Homo sapiens
tatttgaaatactaaaagc

SEQ ID NO: 3180545 - DNA, 15 bp, Homo sapiens
tatttgaacaagtgg

SEQ ID NO: 3180546 - DNA, 22 bp, Homo sapiens
tatttgaacatgtgccttttct

SEQ ID NO: 3180547 - DNA, 13 bp, Homo sapiens
tatttgaagaaaa

SEQ ID NO: 3180548 - DNA, 21 bp, Homo sapiens
tatttgaagaaaaaaatgtac

SEQ ID NO: 3180549 - DNA, 23 bp, Homo sapiens
tatttgaataatgacagatggtg

SEQ ID NO: 3180550 - DNA, 15 bp, Homo sapiens
tatttgaatatcatt

SEQ ID NO: 3180551 - DNA, 12 bp, Homo sapiens
tatttgaatgaa

SEQ ID NO: 3180552 - DNA, 13 bp, Homo sapiens
tatttgaatgaaa

SEQ ID NO: 3180553 - DNA, 14 bp, Homo sapiens
tatttgaatgaaaa

SEQ ID NO: 3180554 - DNA, 17 bp, Homo sapiens
tatttgaatgaaaacat

SEQ ID NO: 3180555 - DNA, 18 bp, Homo sapiens
tatttgaatgaaaacatt

SEQ ID NO: 3180556 - DNA, 19 bp, Homo sapiens
tatttgaattttaaatcta

SEQ ID NO: 3180557 - DNA, 21 bp, Homo sapiens
tatttgaattttaaatctaaa

SEQ ID NO: 3180558 - DNA, 19 bp, Homo sapiens
tatttgacttgcatgaaga

SEQ ID NO: 3180559 - DNA, 18 bp, Homo sapiens
tatttgagtcacttgtgt

SEQ ID NO: 3180560 - DNA, 14 bp, Homo sapiens
tatttgcaacattt

SEQ ID NO: 3180561 - DNA, 16 bp, Homo sapiens
tatttgcaacatttac

SEQ ID NO: 3180562 - DNA, 20 bp, Homo sapiens
tatttgcacttatgtacttg

SEQ ID NO: 3180563 - DNA, 15 bp, Homo sapiens
tatttgcatgttacc

SEQ ID NO: 3180564 - DNA, 15 bp, Homo sapiens
tatttgcattgagga

SEQ ID NO: 3180565 - DNA, 23 bp, Homo sapiens
tatttgccaataaagcttttgga

SEQ ID NO: 3180566 - DNA, 18 bp, Homo sapiens
tatttgctgacaaccatt

SEQ ID NO: 3180567 - DNA, 14 bp, Homo sapiens
tatttgctgtcaca

SEQ ID NO: 3180568 - DNA, 12 bp, Homo sapiens
tatttggaaaga

SEQ ID NO: 3180569 - DNA, 16 bp, Homo sapiens
tatttggaatatttga

SEQ ID NO: 3180570 - DNA, 17 bp, Homo sapiens
tatttggcagtttggta

SEQ ID NO: 3180571 - DNA, 14 bp, Homo sapiens
tatttggcttaaat

SEQ ID NO: 3180572 - DNA, 15 bp, Homo sapiens
tatttggcttaaata

SEQ ID NO: 3180573 - DNA, 19 bp, Homo sapiens
tatttggcttaaatatagt

SEQ ID NO: 3180574 - DNA, 14 bp, Homo sapiens
tatttgggaagtga

SEQ ID NO: 3180575 - DNA, 14 bp, Homo sapiens
tcaagtctctgctg

SEQ ID NO: 3180576 - DNA, 19 bp, Homo sapiens
tcaagtctctgctggccca

SEQ ID NO: 3180577 - DNA, 12 bp, Homo sapiens
tcaagtcttccc

SEQ ID NO: 3180578 - DNA, 16 bp, Homo sapiens
tcaagtgattctcctg

SEQ ID NO: 3180579 - DNA, 11 bp, Homo sapiens
tcaagtgccta

SEQ ID NO: 3180580 - DNA, 18 bp, Homo sapiens
tcaagtgcctagactgtt

SEQ ID NO: 3180581 - DNA, 21 bp, Homo sapiens
tcaagtgcctagactgttact

SEQ ID NO: 3180582 - DNA, 18 bp, Homo sapiens
tcaagtggggctcgccat

SEQ ID NO: 3180583 - DNA, 14 bp, Homo sapiens
tcaagttaaagtga

SEQ ID NO: 3180584 - DNA, 15 bp, Homo sapiens
tcaagttattcaaat

SEQ ID NO: 3180585 - DNA, 15 bp, Homo sapiens
tcaagttctaagatt

SEQ ID NO: 3180586 - DNA, 19 bp, Homo sapiens
tcaagttctaagattctaa

SEQ ID NO: 3180587 - DNA, 13 bp, Homo sapiens
tcaagttgtaaaa

SEQ ID NO: 3180588 - DNA, 20 bp, Homo sapiens
tcaagttgtaaaaatgaaag

SEQ ID NO: 3180589 - DNA, 17 bp, Homo sapiens
tcaagtttacacttcat

SEQ ID NO: 3180590 - DNA, 20 bp, Homo sapiens
tcaagtttgggtctgtgctg

SEQ ID NO: 3180591 - DNA, 15 bp, Homo sapiens
tcaagttttaaagtt

SEQ ID NO: 3180592 - DNA, 19 bp, Homo sapiens
tcaagttttgggtatgttt

SEQ ID NO: 3180593 - DNA, 14 bp, Homo sapiens
tcaataaaatgtga

SEQ ID NO: 3180594 - DNA, 18 bp, Homo sapiens
tcaataaaatgtgatttt

SEQ ID NO: 3180595 - DNA, 23 bp, Homo sapiens
tcaataaaatgtgatttttctga

SEQ ID NO: 3180596 - DNA, 17 bp, Homo sapiens
tcaataaacaacagctg

SEQ ID NO: 3180597 - DNA, 18 bp, Homo sapiens
tcaataaacaacagctga

SEQ ID NO: 3180598 - DNA, 21 bp, Homo sapiens
tcaataaacttagaggaaaat

SEQ ID NO: 3180599 - DNA, 15 bp, Homo sapiens
tcaataaatgtctgt

SEQ ID NO: 3180600 - DNA, 16 bp, Homo sapiens
tcaataaatgtctgtt

SEQ ID NO: 3180601 - DNA, 13 bp, Homo sapiens
tcaataagaaggt

SEQ ID NO: 3180602 - DNA, 13 bp, Homo sapiens
tcaatacagtgaa

SEQ ID NO: 3180603 - DNA, 22 bp, Homo sapiens
tcaatagaactgtttcaactgt

SEQ ID NO: 3180604 - DNA, 12 bp, Homo sapiens
tcaatagttgaa

SEQ ID NO: 3180605 - DNA, 16 bp, Homo sapiens
tcaatagttgaattag

SEQ ID NO: 3180606 - DNA, 18 bp, Homo sapiens
tcaatatccctcttgtaa

SEQ ID NO: 3180607 - DNA, 19 bp, Homo sapiens
tcaatatccctcttgtaag

SEQ ID NO: 3180608 - DNA, 19 bp, Homo sapiens
tcaatatgcaagcagcttt

SEQ ID NO: 3180609 - DNA, 15 bp, Homo sapiens
tcaatattaaataca

SEQ ID NO: 3180610 - DNA, 21 bp, Homo sapiens
tcaatattaaatacagacact

SEQ ID NO: 3180611 - DNA, 22 bp, Homo sapiens
tcaatattaaatacagacacta

SEQ ID NO: 3180612 - DNA, 17 bp, Homo sapiens
tcaatattcctgaatga

SEQ ID NO: 3180613 - DNA, 18 bp, Homo sapiens
tcaatattcctgaatgaa

SEQ ID NO: 3180614 - DNA, 21 bp, Homo sapiens
tcaatattcctgaatgaaata

SEQ ID NO: 3180615 - DNA, 13 bp, Homo sapiens
tcaatatttatta

SEQ ID NO: 3180616 - DNA, 17 bp, Homo sapiens
tcaatcaactttactgt

SEQ ID NO: 3180617 - DNA, 18 bp, Homo sapiens
tcaatcaactttactgta

SEQ ID NO: 3180618 - DNA, 23 bp, Homo sapiens
tcaatcactgcactgcatgcaaa

SEQ ID NO: 3180619 - DNA, 12 bp, Homo sapiens
tcaatcactgtc

SEQ ID NO: 3180620 - DNA, 22 bp, Homo sapiens
tcaatcactgtcctccacacaa

SEQ ID NO: 3180621 - DNA, 14 bp, Homo sapiens
tcaatcatcaaaaa

SEQ ID NO: 3180622 - DNA, 16 bp, Homo sapiens
tcaatcatctgtgtga

SEQ ID NO: 3180623 - DNA, 14 bp, Homo sapiens
tcaatcatgaatga

SEQ ID NO: 3180624 - DNA, 16 bp, Homo sapiens
tcaatcccaattctgt

SEQ ID NO: 3180625 - DNA, 20 bp, Homo sapiens
tcaatcccaattctgtccca

SEQ ID NO: 3180626 - DNA, 12 bp, Homo sapiens
tcaatcctggta

SEQ ID NO: 3180627 - DNA, 14 bp, Homo sapiens
tcaatcctggtaac

SEQ ID NO: 3180628 - DNA, 14 bp, Homo sapiens
tcaatctgtgtaag

SEQ ID NO: 3180629 - DNA, 16 bp, Homo sapiens
tcaatgaagccagctc

SEQ ID NO: 3180630 - DNA, 15 bp, Homo sapiens
tcaatgaatattgaa

SEQ ID NO: 3180631 - DNA, 16 bp, Homo sapiens
tcaatgattattttca

SEQ ID NO: 3180632 - DNA, 21 bp, Homo sapiens
tcaatggcctaaaactggcct

SEQ ID NO: 3180633 - DNA, 17 bp, Homo sapiens
tcaatgggctcttccaa

SEQ ID NO: 3180634 - DNA, 16 bp, Homo sapiens
tcaatgtgacatttac

SEQ ID NO: 3180635 - DNA, 17 bp, Homo sapiens
tcaatgtgattctaatg

SEQ ID NO: 3180636 - DNA, 18 bp, Homo sapiens
tcaatgtgattctaatgt

SEQ ID NO: 3180637 - DNA, 22 bp, Homo sapiens
tcaatgtgattctaatgtcttc

SEQ ID NO: 3180638 - DNA, 13 bp, Homo sapiens
tcaatgtgcagtg

SEQ ID NO: 3180639 - DNA, 17 bp, Homo sapiens
tcaatgtgtataaattg

SEQ ID NO: 3180640 - DNA, 24 bp, Homo sapiens
tcaatgttcattgtaatgttactg

SEQ ID NO: 3180641 - DNA, 12 bp, Homo sapiens
tcaattaaatgt

SEQ ID NO: 3180642 - DNA, 14 bp, Homo sapiens
tcaattaaatgtag

SEQ ID NO: 3180643 - DNA, 20 bp, Homo sapiens
tcaattacggactctggata

SEQ ID NO: 3180644 - DNA, 13 bp, Homo sapiens
tcaattactggtc

SEQ ID NO: 3180645 - DNA, 16 bp, Homo sapiens
tcaattactggtccaa

SEQ ID NO: 3180646 - DNA, 19 bp, Homo sapiens
tcaattatagtttctgagg

SEQ ID NO: 3180647 - DNA, 18 bp, Homo sapiens
tcaattcagattgtcttg

SEQ ID NO: 3180648 - DNA, 14 bp, Homo sapiens
tcaattccacctgc

SEQ ID NO: 3180649 - DNA, 15 bp, Homo sapiens
tcaattgaatggtca

SEQ ID NO: 3180650 - DNA, 17 bp, Homo sapiens
tcaattggcagtgactt

SEQ ID NO: 3180651 - DNA, 13 bp, Homo sapiens
tcaattgtaaatt

SEQ ID NO: 3180652 - DNA, 18 bp, Homo sapiens
tcaattgtaaattgaatc

SEQ ID NO: 3180653 - DNA, 20 bp, Homo sapiens
tcaatttaaaaagcaaaaaa

SEQ ID NO: 3180654 - DNA, 15 bp, Homo sapiens
tcaatttaaataacc

SEQ ID NO: 3180655 - DNA, 18 bp, Homo sapiens
tcaatttccctcaggttc

SEQ ID NO: 3180656 - DNA, 15 bp, Homo sapiens
tcaatttctgtgttg

SEQ ID NO: 3180657 - DNA, 14 bp, Homo sapiens
tcaattttcattaa

SEQ ID NO: 3180658 - DNA, 18 bp, Homo sapiens
tcaattttgacttaatgt

SEQ ID NO: 3180659 - DNA, 14 bp, Homo sapiens
tcaatttttaggaa

SEQ ID NO: 3180660 - DNA, 20 bp, Homo sapiens
tcacaaaaatttgaacactg

SEQ ID NO: 3180661 - DNA, 15 bp, Homo sapiens
tcacaaacttttata

SEQ ID NO: 3180662 - DNA, 12 bp, Homo sapiens
tcacaacctctc

SEQ ID NO: 3180663 - DNA, 13 bp, Homo sapiens
tcacaagaagatt

SEQ ID NO: 3180664 - DNA, 17 bp, Homo sapiens
tcacaagcgctcccagc

SEQ ID NO: 3180665 - DNA, 18 bp, Homo sapiens
tcacaataaatgtattca

SEQ ID NO: 3180666 - DNA, 14 bp, Homo sapiens
tcacaatacagata

SEQ ID NO: 3180667 - DNA, 14 bp, Homo sapiens
tcacacaagatttg

SEQ ID NO: 3180668 - DNA, 18 bp, Homo sapiens
tcacacacacagctgggc

SEQ ID NO: 3180669 - DNA, 12 bp, Homo sapiens
tcacacacctgt

SEQ ID NO: 3180670 - DNA, 15 bp, Homo sapiens
tcacacactttggct

SEQ ID NO: 3180671 - DNA, 23 bp, Homo sapiens
tcacacagggctctttgatggac

SEQ ID NO: 3180672 - DNA, 17 bp, Homo sapiens
tcacacatatcagcagg

SEQ ID NO: 3180673 - DNA, 19 bp, Homo sapiens
tcacacatccagacatcat

SEQ ID NO: 3180674 - DNA, 14 bp, Homo sapiens
tcacaccaaggaag

SEQ ID NO: 3180675 - DNA, 15 bp, Homo sapiens
tcacaccactgtact

SEQ ID NO: 3180676 - DNA, 15 bp, Homo sapiens
tcacacccaccgtcc

SEQ ID NO: 3180677 - DNA, 14 bp, Homo sapiens
tcacaccccaggcc

SEQ ID NO: 3180678 - DNA, 16 bp, Homo sapiens
tcacaccccaggccct

SEQ ID NO: 3180679 - DNA, 20 bp, Homo sapiens
tcacaccctgcaaggcccac

SEQ ID NO: 3180680 - DNA, 21 bp, Homo sapiens
tcacaccctgcaaggcccaca

SEQ ID NO: 3180681 - DNA, 23 bp, Homo sapiens
tcacaccctgcaaggcccacagg

SEQ ID NO: 3180682 - DNA, 20 bp, Homo sapiens
tcacacctgaactgaacacc

SEQ ID NO: 3180683 - DNA, 12 bp, Homo sapiens
tcacacctgact

SEQ ID NO: 3180684 - DNA, 13 bp, Homo sapiens
tcacacctgactc

SEQ ID NO: 3180685 - DNA, 18 bp, Homo sapiens
tcacacctgactctgaaa

SEQ ID NO: 3180686 - DNA, 19 bp, Homo sapiens
tcacacctgactctgaaat

SEQ ID NO: 3180687 - DNA, 22 bp, Homo sapiens
tcacacctgcaatcccagcacc

SEQ ID NO: 3180688 - DNA, 15 bp, Homo sapiens
tcacactaaaattta

SEQ ID NO: 3180689 - DNA, 18 bp, Homo sapiens
tcacactaagagggcaga

SEQ ID NO: 3180690 - DNA, 15 bp, Homo sapiens
tcacactcagaaaga

SEQ ID NO: 3180691 - DNA, 21 bp, Homo sapiens
tcacactgggtggtggcctgg

SEQ ID NO: 3180692 - DNA, 11 bp, Homo sapiens
tcacacttgtg

SEQ ID NO: 3180693 - DNA, 11 bp, Homo sapiens
tcacactttgc

SEQ ID NO: 3180694 - DNA, 13 bp, Homo sapiens
tcacactttttat

SEQ ID NO: 3180695 - DNA, 23 bp, Homo sapiens
tcacactttttatttaattaaat

SEQ ID NO: 3180696 - DNA, 16 bp, Homo sapiens
tcacagaaaaagcatg

SEQ ID NO: 3180697 - DNA, 14 bp, Homo sapiens
tcacagaaatcaga

SEQ ID NO: 3180698 - DNA, 21 bp, Homo sapiens
tcacagaacccttggagccaa

SEQ ID NO: 3180699 - DNA, 22 bp, Homo sapiens
tcacagattgaggtaataatga

SEQ ID NO: 3180700 - DNA, 17 bp, Homo sapiens
tcacagcacatgctggc

SEQ ID NO: 3180701 - DNA, 19 bp, Homo sapiens
tcacagcacatgctggcca

SEQ ID NO: 3180702 - DNA, 15 bp, Homo sapiens
tcagagtttgtgtgt

SEQ ID NO: 3180703 - DNA, 15 bp, Homo sapiens
tcagatataagagaa

SEQ ID NO: 3180704 - DNA, 22 bp, Homo sapiens
tcagatataagagaagtctcat

SEQ ID NO: 3180705 - DNA, 15 bp, Homo sapiens
tcagatatcaaaatt

SEQ ID NO: 3180706 - DNA, 16 bp, Homo sapiens
tcagatatcaaaattc

SEQ ID NO: 3180707 - DNA, 21 bp, Homo sapiens
tcagatatttatatttttatt

SEQ ID NO: 3180708 - DNA, 21 bp, Homo sapiens
tcagatattttttcagaaata

SEQ ID NO: 3180709 - DNA, 19 bp, Homo sapiens
tcagatcactgaatttata

SEQ ID NO: 3180710 - DNA, 21 bp, Homo sapiens
tcagatcactgaatttataaa

SEQ ID NO: 3180711 - DNA, 17 bp, Homo sapiens
tcagatgagaacaaagc

SEQ ID NO: 3180712 - DNA, 20 bp, Homo sapiens
tcagatgagaacaaagctgt

SEQ ID NO: 3180713 - DNA, 14 bp, Homo sapiens
tcagatgctccaag

SEQ ID NO: 3180714 - DNA, 16 bp, Homo sapiens
tcagatgctccaagat

SEQ ID NO: 3180715 - DNA, 18 bp, Homo sapiens
tcagatgctccaagattc

SEQ ID NO: 3180716 - DNA, 19 bp, Homo sapiens
tcagatgctccaagattct

SEQ ID NO: 3180717 - DNA, 18 bp, Homo sapiens
tcagatgcttctgggaga

SEQ ID NO: 3180718 - DNA, 19 bp, Homo sapiens
tcagatgcttgcggcaaaa

SEQ ID NO: 3180719 - DNA, 15 bp, Homo sapiens
tcagatgtcttctgc

SEQ ID NO: 3180720 - DNA, 15 bp, Homo sapiens
tcagatgttaaaata

SEQ ID NO: 3180721 - DNA, 12 bp, Homo sapiens
tcagatttgaac

SEQ ID NO: 3180722 - DNA, 20 bp, Homo sapiens
tcagatttttaaagttttgt

SEQ ID NO: 3180723 - DNA, 22 bp, Homo sapiens
tcagcaaaccatttttaaagta

SEQ ID NO: 3180724 - DNA, 19 bp, Homo sapiens
tcagcaagttagaactagc

SEQ ID NO: 3180725 - DNA, 21 bp, Homo sapiens
tcagcaatactcatcagagca

SEQ ID NO: 3180726 - DNA, 12 bp, Homo sapiens
tcagcaccaccc

SEQ ID NO: 3180727 - DNA, 12 bp, Homo sapiens
tcagcaccccca

SEQ ID NO: 3180728 - DNA, 13 bp, Homo sapiens
tcagcacccccac

SEQ ID NO: 3180729 - DNA, 18 bp, Homo sapiens
tcagcacccccacccacc

SEQ ID NO: 3180730 - DNA, 15 bp, Homo sapiens
tcagcaccccttcca

SEQ ID NO: 3180731 - DNA, 15 bp, Homo sapiens
tcagcaccctgggtg

SEQ ID NO: 3180732 - DNA, 19 bp, Homo sapiens
tcagcaccctgggtgccat

SEQ ID NO: 3180733 - DNA, 15 bp, Homo sapiens
tcagcactgaaaata

SEQ ID NO: 3180734 - DNA, 21 bp, Homo sapiens
tcagcactgaaaataccatca

SEQ ID NO: 3180735 - DNA, 14 bp, Homo sapiens
tcagcactgtccct

SEQ ID NO: 3180736 - DNA, 23 bp, Homo sapiens
tcagcagaaacacacagtcacat

SEQ ID NO: 3180737 - DNA, 22 bp, Homo sapiens
tcagcagagttattgaatctta

SEQ ID NO: 3180738 - DNA, 22 bp, Homo sapiens
tcagcagcagctctgagccaga

SEQ ID NO: 3180739 - DNA, 17 bp, Homo sapiens
tcagcagcctccctgaa

SEQ ID NO: 3180740 - DNA, 22 bp, Homo sapiens
tcagcagcctgcgctcggcagg

SEQ ID NO: 3180741 - DNA, 23 bp, Homo sapiens
tcagcagcctgcgctcggcagga

SEQ ID NO: 3180742 - DNA, 18 bp, Homo sapiens
tcagcagtcaatacaaat

SEQ ID NO: 3180743 - DNA, 12 bp, Homo sapiens
tcagcagtctag

SEQ ID NO: 3180744 - DNA, 17 bp, Homo sapiens
tcagcatcctggcaccc

SEQ ID NO: 3180745 - DNA, 18 bp, Homo sapiens
tcagcatgcttcccagag

SEQ ID NO: 3180746 - DNA, 21 bp, Homo sapiens
tcagcatgcttcccagaggga

SEQ ID NO: 3180747 - DNA, 15 bp, Homo sapiens
tcagcattattgaaa

SEQ ID NO: 3180748 - DNA, 14 bp, Homo sapiens
tcagcattccctcc

SEQ ID NO: 3180749 - DNA, 20 bp, Homo sapiens
tcagcattctcactcctacc

SEQ ID NO: 3180750 - DNA, 18 bp, Homo sapiens
tcagcattcttagcctgt

SEQ ID NO: 3180751 - DNA, 21 bp, Homo sapiens
tcagcattcttagcctgtggc

SEQ ID NO: 3180752 - DNA, 16 bp, Homo sapiens
tcagccaaatgtaatt

SEQ ID NO: 3180753 - DNA, 23 bp, Homo sapiens
tcagccaaggttttataaggctg

SEQ ID NO: 3180754 - DNA, 17 bp, Homo sapiens
tcagccacacccaggca

SEQ ID NO: 3180755 - DNA, 23 bp, Homo sapiens
tcagccaccatcctattgcaaag

SEQ ID NO: 3180756 - DNA, 17 bp, Homo sapiens
tcagccacgaccagccc

SEQ ID NO: 3180757 - DNA, 18 bp, Homo sapiens
tcagccacgaccagcccc

SEQ ID NO: 3180758 - DNA, 21 bp, Homo sapiens
tcagccacgaccagccccttc

SEQ ID NO: 3180759 - DNA, 23 bp, Homo sapiens
tcagccacgaccagccccttcct

SEQ ID NO: 3180760 - DNA, 14 bp, Homo sapiens
tcagcccacctgca

SEQ ID NO: 3180761 - DNA, 19 bp, Homo sapiens
tcagcccacctgcacccag

SEQ ID NO: 3180762 - DNA, 12 bp, Homo sapiens
tcagcccagaag

SEQ ID NO: 3180763 - DNA, 13 bp, Homo sapiens
tcagcccccagcc

SEQ ID NO: 3180764 - DNA, 19 bp, Homo sapiens
tcagcccccagcccctccc

SEQ ID NO: 3180765 - DNA, 20 bp, Homo sapiens
tcagcccccagcccctcccc

SEQ ID NO: 3180766 - DNA, 18 bp, Homo sapiens
tcagcccccaggccaggt

SEQ ID NO: 3180767 - DNA, 19 bp, Homo sapiens
tcagccccgagctgtcccc

SEQ ID NO: 3180768 - DNA, 18 bp, Homo sapiens
tcagccctccctgcccct

SEQ ID NO: 3180769 - DNA, 21 bp, Homo sapiens
tcagcccttgcccccatccct

SEQ ID NO: 3180770 - DNA, 20 bp, Homo sapiens
tcagccgagccgggcctggg

SEQ ID NO: 3180771 - DNA, 22 bp, Homo sapiens
tcagccggcgtggcaaatataa

SEQ ID NO: 3180772 - DNA, 15 bp, Homo sapiens
tcagcctactgcctc

SEQ ID NO: 3180773 - DNA, 14 bp, Homo sapiens
tcagcctcagagga

SEQ ID NO: 3180774 - DNA, 16 bp, Homo sapiens
tcagcctcccaaagtg

SEQ ID NO: 3180775 - DNA, 21 bp, Homo sapiens
tcagcctcccaaagtgctggg

SEQ ID NO: 3180776 - DNA, 20 bp, Homo sapiens
tcagcctcccgagtagctgg

SEQ ID NO: 3180777 - DNA, 17 bp, Homo sapiens
tcagcctcctgagcctg

SEQ ID NO: 3180778 - DNA, 19 bp, Homo sapiens
tcagcctcctgagcctgtg

SEQ ID NO: 3180779 - DNA, 20 bp, Homo sapiens
tcagcctctcaagtagctgg

SEQ ID NO: 3180780 - DNA, 12 bp, Homo sapiens
tcagcctcttaa

SEQ ID NO: 3180781 - DNA, 13 bp, Homo sapiens
tcagcctgaggct

SEQ ID NO: 3180782 - DNA, 20 bp, Homo sapiens
tcagcctgaggctgagactg

SEQ ID NO: 3180783 - DNA, 22 bp, Homo sapiens
tcagcctgctgcccaggctgtg

SEQ ID NO: 3180784 - DNA, 12 bp, Homo sapiens
tcagcctgtgct

SEQ ID NO: 3180785 - DNA, 16 bp, Homo sapiens
tcagcctgtgctgtgg

SEQ ID NO: 3180786 - DNA, 18 bp, Homo sapiens
tcagcctgtgctgtggca

SEQ ID NO: 3180787 - DNA, 22 bp, Homo sapiens
tcagcgaagtctcatgggaagc

SEQ ID NO: 3180788 - DNA, 15 bp, Homo sapiens
tcagcgctcctcctg

SEQ ID NO: 3180789 - DNA, 15 bp, Homo sapiens
tcagcggggacagct

SEQ ID NO: 3180790 - DNA, 17 bp, Homo sapiens
tcagcggggacagctcc

SEQ ID NO: 3180791 - DNA, 19 bp, Homo sapiens
tcagcggggacagctcctt

SEQ ID NO: 3180792 - DNA, 20 bp, Homo sapiens
tcagcggggacagctccttc

SEQ ID NO: 3180793 - DNA, 21 bp, Homo sapiens
tcagcggggacagctccttct

SEQ ID NO: 3180794 - DNA, 23 bp, Homo sapiens
tcagcggggacagctccttctgt

SEQ ID NO: 3180795 - DNA, 14 bp, Homo sapiens
tcagcgtcccctgc

SEQ ID NO: 3180796 - DNA, 19 bp, Homo sapiens
tcagctactgatttttgtg

SEQ ID NO: 3180797 - DNA, 18 bp, Homo sapiens
tcagctagcttttaggaa

SEQ ID NO: 3180798 - DNA, 15 bp, Homo sapiens
tcagctcaggcagct

SEQ ID NO: 3180799 - DNA, 21 bp, Homo sapiens
tcagctccagctcaccagccc

SEQ ID NO: 3180800 - DNA, 22 bp, Homo sapiens
tcagctccagggaatccaagcc

SEQ ID NO: 3180801 - DNA, 13 bp, Homo sapiens
tcagctccccctg

SEQ ID NO: 3180802 - DNA, 22 bp, Homo sapiens
tcagctccccctgtcccctcag

SEQ ID NO: 3180803 - DNA, 18 bp, Homo sapiens
tcagctctctgggacctc

SEQ ID NO: 3180804 - DNA, 21 bp, Homo sapiens
tcagctctctgggacctcctt

SEQ ID NO: 3180805 - DNA, 15 bp, Homo sapiens
tcagctctctgtata

SEQ ID NO: 3180806 - DNA, 13 bp, Homo sapiens
tcagctctggaga

SEQ ID NO: 3180807 - DNA, 18 bp, Homo sapiens
tcagctctgggagaggat

SEQ ID NO: 3180808 - DNA, 18 bp, Homo sapiens
tcagctgagccctgggga

SEQ ID NO: 3180809 - DNA, 20 bp, Homo sapiens
tcagctgcaaggtactctgg

SEQ ID NO: 3180810 - DNA, 22 bp, Homo sapiens
tcagctgcaaggtactctggtg

SEQ ID NO: 3180811 - DNA, 13 bp, Homo sapiens
tcagctgcctgaa

SEQ ID NO: 3180812 - DNA, 17 bp, Homo sapiens
tcagctggttactcagg

SEQ ID NO: 3180813 - DNA, 21 bp, Homo sapiens
tcagctggttactcagggttc

SEQ ID NO: 3180814 - DNA, 16 bp, Homo sapiens
tcagctgtagtcctca

SEQ ID NO: 3180815 - DNA, 18 bp, Homo sapiens
tcagcttaaaataaacag

SEQ ID NO: 3180816 - DNA, 17 bp, Homo sapiens
tcagcttcttcctaggt

SEQ ID NO: 3180817 - DNA, 18 bp, Homo sapiens
tcagcttcttcctaggtc

SEQ ID NO: 3180818 - DNA, 20 bp, Homo sapiens
tcagcttgtaaatagctcag

SEQ ID NO: 3180819 - DNA, 17 bp, Homo sapiens
tcagctttcagagccag

SEQ ID NO: 3180820 - DNA, 20 bp, Homo sapiens
tcagctttcagagccagtga

SEQ ID NO: 3180821 - DNA, 22 bp, Homo sapiens
tcagctttcagagccagtgaag

SEQ ID NO: 3180822 - DNA, 17 bp, Homo sapiens
tcagctttgactttatc

SEQ ID NO: 3180823 - DNA, 20 bp, Homo sapiens
tcaggaaatatatatgtgtg

SEQ ID NO: 3180824 - DNA, 17 bp, Homo sapiens
tcaggaaatctacttcc

SEQ ID NO: 3180825 - DNA, 18 bp, Homo sapiens
tcaggaacaagtaatgta

SEQ ID NO: 3180826 - DNA, 18 bp, Homo sapiens
tcaggaacagtggctggg

SEQ ID NO: 3180827 - DNA, 21 bp, Homo sapiens
tcatgctgaatccacctcgga

SEQ ID NO: 3180828 - DNA, 20 bp, Homo sapiens
tcatggaatggcaggtgtca

SEQ ID NO: 3180829 - DNA, 20 bp, Homo sapiens
tcatggattcattacagctt

SEQ ID NO: 3180830 - DNA, 19 bp, Homo sapiens
tcatggccttgaaacagtt

SEQ ID NO: 3180831 - DNA, 23 bp, Homo sapiens
tcatggccttgaaacagttccat

SEQ ID NO: 3180832 - DNA, 20 bp, Homo sapiens
tcatggcgtaatgggcctgc

SEQ ID NO: 3180833 - DNA, 16 bp, Homo sapiens
tcatggctgctgttgc

SEQ ID NO: 3180834 - DNA, 23 bp, Homo sapiens
tcatgggaatgatagcccagaac

SEQ ID NO: 3180835 - DNA, 21 bp, Homo sapiens
tcatgggtcccttgaaggaag

SEQ ID NO: 3180836 - DNA, 22 bp, Homo sapiens
tcatgggtcccttgaaggaaga

SEQ ID NO: 3180837 - DNA, 23 bp, Homo sapiens
tcatggtgggttcaggggactca

SEQ ID NO: 3180838 - DNA, 20 bp, Homo sapiens
tcatggtgtaataagacata

SEQ ID NO: 3180839 - DNA, 10 bp, Homo sapiens
tcatgtaaca

SEQ ID NO: 3180840 - DNA, 12 bp, Homo sapiens
tcatgtaacatt

SEQ ID NO: 3180841 - DNA, 18 bp, Homo sapiens
tcatgtagaatatggcta

SEQ ID NO: 3180842 - DNA, 19 bp, Homo sapiens
tcatgtagagaaaagcaca

SEQ ID NO: 3180843 - DNA, 20 bp, Homo sapiens
tcatgtagagaaaagcacac

SEQ ID NO: 3180844 - DNA, 15 bp, Homo sapiens
tcatgtatttgagca

SEQ ID NO: 3180845 - DNA, 14 bp, Homo sapiens
tcatgtattttaca

SEQ ID NO: 3180846 - DNA, 17 bp, Homo sapiens
tcatgtattttacacaa

SEQ ID NO: 3180847 - DNA, 18 bp, Homo sapiens
tcatgtattttacacaaa

SEQ ID NO: 3180848 - DNA, 18 bp, Homo sapiens
tcatgtcaacttctggct

SEQ ID NO: 3180849 - DNA, 17 bp, Homo sapiens
tcatgtcaggcctgtgt

SEQ ID NO: 3180850 - DNA, 13 bp, Homo sapiens
tcatgtccatccc

SEQ ID NO: 3180851 - DNA, 15 bp, Homo sapiens
tcatgtccatccctt

SEQ ID NO: 3180852 - DNA, 16 bp, Homo sapiens
tcatgtccatcccttt

SEQ ID NO: 3180853 - DNA, 20 bp, Homo sapiens
tcatgtccatcccttttcct

SEQ ID NO: 3180854 - DNA, 20 bp, Homo sapiens
tcatgtggcccaactctcct

SEQ ID NO: 3180855 - DNA, 17 bp, Homo sapiens
tcatgtgggtgagccag

SEQ ID NO: 3180856 - DNA, 16 bp, Homo sapiens
tcatgttactcagtgt

SEQ ID NO: 3180857 - DNA, 12 bp, Homo sapiens
tcatgttatttt

SEQ ID NO: 3180858 - DNA, 14 bp, Homo sapiens
tcatgttattttat

SEQ ID NO: 3180859 - DNA, 13 bp, Homo sapiens
tcatgttcctcaa

SEQ ID NO: 3180860 - DNA, 13 bp, Homo sapiens
tcatgttggtcaa

SEQ ID NO: 3180861 - DNA, 19 bp, Homo sapiens
tcatgttgttaaaattatg

SEQ ID NO: 3180862 - DNA, 17 bp, Homo sapiens
tcatgtttgcttcataa

SEQ ID NO: 3180863 - DNA, 20 bp, Homo sapiens
tcatgtttgcttcataaatg

SEQ ID NO: 3180864 - DNA, 15 bp, Homo sapiens
tcatgttttgtgact

SEQ ID NO: 3180865 - DNA, 16 bp, Homo sapiens
tcatgttttgtgacta

SEQ ID NO: 3180866 - DNA, 17 bp, Homo sapiens
tcatgttttgtgactat

SEQ ID NO: 3180867 - DNA, 14 bp, Homo sapiens
tcattaaatgtttg

SEQ ID NO: 3180868 - DNA, 18 bp, Homo sapiens
tcattaaattggaatttt

SEQ ID NO: 3180869 - DNA, 20 bp, Homo sapiens
tcattaatgatgatcttcag

SEQ ID NO: 3180870 - DNA, 17 bp, Homo sapiens
tcattaccactcgtaaa

SEQ ID NO: 3180871 - DNA, 19 bp, Homo sapiens
tcattacccttccctgcac

SEQ ID NO: 3180872 - DNA, 15 bp, Homo sapiens
tcattactgggcctt

SEQ ID NO: 3180873 - DNA, 19 bp, Homo sapiens
tcattactgttccagattc

SEQ ID NO: 3180874 - DNA, 21 bp, Homo sapiens
tcattacttgattaagatttt

SEQ ID NO: 3180875 - DNA, 13 bp, Homo sapiens
tcattatattcta

SEQ ID NO: 3180876 - DNA, 20 bp, Homo sapiens
tcattatattctaattaaaa

SEQ ID NO: 3180877 - DNA, 13 bp, Homo sapiens
tcattatgtcaac

SEQ ID NO: 3180878 - DNA, 21 bp, Homo sapiens
tcattattggaattaacctgg

SEQ ID NO: 3180879 - DNA, 22 bp, Homo sapiens
tcattatttttgttagcaaaga

SEQ ID NO: 3180880 - DNA, 15 bp, Homo sapiens
tcattcaaatcagtg

SEQ ID NO: 3180881 - DNA, 16 bp, Homo sapiens
tcattcaaatcagtga

SEQ ID NO: 3180882 - DNA, 16 bp, Homo sapiens
tcattcagctaacaaa

SEQ ID NO: 3180883 - DNA, 17 bp, Homo sapiens
tcattccaacagtgagt

SEQ ID NO: 3180884 - DNA, 13 bp, Homo sapiens
tcattcccagagt

SEQ ID NO: 3180885 - DNA, 14 bp, Homo sapiens
tcattcccccttcc

SEQ ID NO: 3180886 - DNA, 18 bp, Homo sapiens
tcattcccccttcctagt

SEQ ID NO: 3180887 - DNA, 18 bp, Homo sapiens
tcattcctaacacagcat

SEQ ID NO: 3180888 - DNA, 20 bp, Homo sapiens
tcattccttcactcatccag

SEQ ID NO: 3180889 - DNA, 21 bp, Homo sapiens
tcattccttctttttaaaatg

SEQ ID NO: 3180890 - DNA, 22 bp, Homo sapiens
tcattcgcctttgtcttgtact

SEQ ID NO: 3180891 - DNA, 21 bp, Homo sapiens
tcattcgctcccacattctga

SEQ ID NO: 3180892 - DNA, 14 bp, Homo sapiens
tcattctacagaat

SEQ ID NO: 3180893 - DNA, 15 bp, Homo sapiens
tcattctatcaagcc

SEQ ID NO: 3180894 - DNA, 12 bp, Homo sapiens
tcattctcctgc

SEQ ID NO: 3180895 - DNA, 15 bp, Homo sapiens
tcattctcctgcctg

SEQ ID NO: 3180896 - DNA, 16 bp, Homo sapiens
tcattctgcaagtata

SEQ ID NO: 3180897 - DNA, 21 bp, Homo sapiens
tcattcttacaattgcactgc

SEQ ID NO: 3180898 - DNA, 22 bp, Homo sapiens
tcattcttacaattgcactgct

SEQ ID NO: 3180899 - DNA, 23 bp, Homo sapiens
tcattcttacaattgcactgctg

SEQ ID NO: 3180900 - DNA, 17 bp, Homo sapiens
tcattcttctctagctg

SEQ ID NO: 3180901 - DNA, 13 bp, Homo sapiens
tcattctttattc

SEQ ID NO: 3180902 - DNA, 18 bp, Homo sapiens
tcattgaaatacttttta

SEQ ID NO: 3180903 - DNA, 13 bp, Homo sapiens
tcattgaagcaga

SEQ ID NO: 3180904 - DNA, 14 bp, Homo sapiens
tcattgaagtattt

SEQ ID NO: 3180905 - DNA, 16 bp, Homo sapiens
tcattgacctctcagg

SEQ ID NO: 3180906 - DNA, 20 bp, Homo sapiens
tcattgacctctcagggcct

SEQ ID NO: 3180907 - DNA, 17 bp, Homo sapiens
tcattgattttataatt

SEQ ID NO: 3180908 - DNA, 23 bp, Homo sapiens
tcattgccagtgtctttctttgg

SEQ ID NO: 3180909 - DNA, 15 bp, Homo sapiens
tcattgcccccacct

SEQ ID NO: 3180910 - DNA, 18 bp, Homo sapiens
tcattgcccccacctctg

SEQ ID NO: 3180911 - DNA, 14 bp, Homo sapiens
tcattgcctcctgt

SEQ ID NO: 3180912 - DNA, 17 bp, Homo sapiens
tcattgcctcctgttct

SEQ ID NO: 3180913 - DNA, 16 bp, Homo sapiens
tcattgctaaactgat

SEQ ID NO: 3180914 - DNA, 14 bp, Homo sapiens
tcattgctgctgct

SEQ ID NO: 3180915 - DNA, 21 bp, Homo sapiens
tcattgctttgaagcagttgt

SEQ ID NO: 3180916 - DNA, 18 bp, Homo sapiens
tcattggatttttgttaa

SEQ ID NO: 3180917 - DNA, 11 bp, Homo sapiens
tcattggccag

SEQ ID NO: 3180918 - DNA, 19 bp, Homo sapiens
tcattggccagctcataaa

SEQ ID NO: 3180919 - DNA, 12 bp, Homo sapiens
tcattggctcct

SEQ ID NO: 3180920 - DNA, 19 bp, Homo sapiens
tcattgtaatgttactgat

SEQ ID NO: 3180921 - DNA, 15 bp, Homo sapiens
tcattgtatgatgtg

SEQ ID NO: 3180922 - DNA, 12 bp, Homo sapiens
tcattgtattca

SEQ ID NO: 3180923 - DNA, 23 bp, Homo sapiens
tcattgtttattaacaaattatg

SEQ ID NO: 3180924 - DNA, 17 bp, Homo sapiens
tcattgttttgaatatt

SEQ ID NO: 3180925 - DNA, 23 bp, Homo sapiens
tcatttaaaaaaaaaatttgttt

SEQ ID NO: 3180926 - DNA, 16 bp, Homo sapiens
tcatttaaaaagctca

SEQ ID NO: 3180927 - DNA, 17 bp, Homo sapiens
tcatttaaaatgattag

SEQ ID NO: 3180928 - DNA, 22 bp, Homo sapiens
tcatttaaacccaatcagatgc

SEQ ID NO: 3180929 - DNA, 20 bp, Homo sapiens
tcatttacctcgcagtgtgt

SEQ ID NO: 3180930 - DNA, 19 bp, Homo sapiens
tcatttagataatttgaaa

SEQ ID NO: 3180931 - DNA, 23 bp, Homo sapiens
tcatttagcatgttgttgaaagg

SEQ ID NO: 3180932 - DNA, 18 bp, Homo sapiens
tcatttagtcatgtgacc

SEQ ID NO: 3180933 - DNA, 16 bp, Homo sapiens
tcatttatctataatt

SEQ ID NO: 3180934 - DNA, 18 bp, Homo sapiens
tcatttatctataattta

SEQ ID NO: 3180935 - DNA, 21 bp, Homo sapiens
tcatttatctataatttacct

SEQ ID NO: 3180936 - DNA, 14 bp, Homo sapiens
tcatttatgaaaag

SEQ ID NO: 3180937 - DNA, 16 bp, Homo sapiens
tcatttattctgcttc

SEQ ID NO: 3180938 - DNA, 15 bp, Homo sapiens
tcatttcacacagtg

SEQ ID NO: 3180939 - DNA, 19 bp, Homo sapiens
tcatttccaactcaggtta

SEQ ID NO: 3180940 - DNA, 20 bp, Homo sapiens
tcatttccgttttgcctgtg

SEQ ID NO: 3180941 - DNA, 13 bp, Homo sapiens
tcatttcctgtgt

SEQ ID NO: 3180942 - DNA, 13 bp, Homo sapiens
tcatttctaaaag

SEQ ID NO: 3180943 - DNA, 15 bp, Homo sapiens
tcatttcttcctcag

SEQ ID NO: 3180944 - DNA, 18 bp, Homo sapiens
tcatttcttcctcagctg

SEQ ID NO: 3180945 - DNA, 21 bp, Homo sapiens
tcatttgagcagggctcagcg

SEQ ID NO: 3180946 - DNA, 16 bp, Homo sapiens
tcatttgatgctaaat

SEQ ID NO: 3180947 - DNA, 19 bp, Homo sapiens
tcatttgcccttaaggaca

SEQ ID NO: 3180948 - DNA, 21 bp, Homo sapiens
tcatttggtgttcctggaagc

SEQ ID NO: 3180949 - DNA, 20 bp, Homo sapiens
tcatttggttcattaattct

SEQ ID NO: 3180950 - DNA, 18 bp, Homo sapiens
tcatttgtattgcttatt

SEQ ID NO: 3180951 - DNA, 12 bp, Homo sapiens
tcatttgtgtca

SEQ ID NO: 3180952 - DNA, 16 bp, Homo sapiens
tcatttgttgtgatgt

SEQ ID NO: 3180953 - DNA, 13 bp, Homo sapiens
tccaatttaagga

SEQ ID NO: 3180954 - DNA, 17 bp, Homo sapiens
tccaatttacatactct

SEQ ID NO: 3180955 - DNA, 18 bp, Homo sapiens
tccaattttctggaatac

SEQ ID NO: 3180956 - DNA, 15 bp, Homo sapiens
tccacaaaagaagtg

SEQ ID NO: 3180957 - DNA, 16 bp, Homo sapiens
tccacaatgactgctt

SEQ ID NO: 3180958 - DNA, 20 bp, Homo sapiens
tccacacaaagattttctaa

SEQ ID NO: 3180959 - DNA, 18 bp, Homo sapiens
tccacacaagggaaggac

SEQ ID NO: 3180960 - DNA, 22 bp, Homo sapiens
tccacacaattatttatttcat

SEQ ID NO: 3180961 - DNA, 23 bp, Homo sapiens
tccacacaggggtggagtttctg

SEQ ID NO: 3180962 - DNA, 17 bp, Homo sapiens
tccacaccaagcagcaa

SEQ ID NO: 3180963 - DNA, 16 bp, Homo sapiens
tccacaccagtggcct

SEQ ID NO: 3180964 - DNA, 17 bp, Homo sapiens
tccacaccagtggcctc

SEQ ID NO: 3180965 - DNA, 16 bp, Homo sapiens
tccacacccgtgagaa

SEQ ID NO: 3180966 - DNA, 22 bp, Homo sapiens
tccacagagagggagagcagag

SEQ ID NO: 3180967 - DNA, 23 bp, Homo sapiens
tccacagagagggagagcagaga

SEQ ID NO: 3180968 - DNA, 17 bp, Homo sapiens
tccacagagatgtttat

SEQ ID NO: 3180969 - DNA, 14 bp, Homo sapiens
tccacagccgcagc

SEQ ID NO: 3180970 - DNA, 22 bp, Homo sapiens
tccacagcgagggcagctgcta

SEQ ID NO: 3180971 - DNA, 22 bp, Homo sapiens
tccacagcttttacgtagtaaa

SEQ ID NO: 3180972 - DNA, 18 bp, Homo sapiens
tccacaggggcaggcctg

SEQ ID NO: 3180973 - DNA, 15 bp, Homo sapiens
tccacaggtctagac

SEQ ID NO: 3180974 - DNA, 19 bp, Homo sapiens
tccacagtgttcatttgaa

SEQ ID NO: 3180975 - DNA, 23 bp, Homo sapiens
tccacagttcagtggcagggctc

SEQ ID NO: 3180976 - DNA, 16 bp, Homo sapiens
tccacagttgccacca

SEQ ID NO: 3180977 - DNA, 18 bp, Homo sapiens
tccacatatagagctcca

SEQ ID NO: 3180978 - DNA, 19 bp, Homo sapiens
tccacatcccagcagccca

SEQ ID NO: 3180979 - DNA, 16 bp, Homo sapiens
tccacatcctgtgtca

SEQ ID NO: 3180980 - DNA, 14 bp, Homo sapiens
tccacatctgcctt

SEQ ID NO: 3180981 - DNA, 12 bp, Homo sapiens
tccacatgtaca

SEQ ID NO: 3180982 - DNA, 13 bp, Homo sapiens
tccacatgtacat

SEQ ID NO: 3180983 - DNA, 15 bp, Homo sapiens
tccacatttctaaaa

SEQ ID NO: 3180984 - DNA, 18 bp, Homo sapiens
tccacatttgtcacagaa

SEQ ID NO: 3180985 - DNA, 19 bp, Homo sapiens
tccaccaaaccccacttcc

SEQ ID NO: 3180986 - DNA, 21 bp, Homo sapiens
tccaccacatctgccagacct

SEQ ID NO: 3180987 - DNA, 18 bp, Homo sapiens
tccaccaccactggccac

SEQ ID NO: 3180988 - DNA, 19 bp, Homo sapiens
tccaccaccactggccacc

SEQ ID NO: 3180989 - DNA, 24 bp, Homo sapiens
tccaccacccaacccaaaccatga

SEQ ID NO: 3180990 - DNA, 16 bp, Homo sapiens
tccaccacctccctca

SEQ ID NO: 3180991 - DNA, 15 bp, Homo sapiens
tccaccagcagcatg

SEQ ID NO: 3180992 - DNA, 15 bp, Homo sapiens
tccacccaaccctat

SEQ ID NO: 3180993 - DNA, 12 bp, Homo sapiens
tccacccagccc

SEQ ID NO: 3180994 - DNA, 14 bp, Homo sapiens
tccacccagcccct

SEQ ID NO: 3180995 - DNA, 15 bp, Homo sapiens
tccacccagcccctg

SEQ ID NO: 3180996 - DNA, 17 bp, Homo sapiens
tccacccagcccctggc

SEQ ID NO: 3180997 - DNA, 14 bp, Homo sapiens
tccacccaggagcc

SEQ ID NO: 3180998 - DNA, 12 bp, Homo sapiens
tccacccaggct

SEQ ID NO: 3180999 - DNA, 19 bp, Homo sapiens
tccacccaggctgcactgc

SEQ ID NO: 3181000 - DNA, 17 bp, Homo sapiens
tccacccagtgctgcca

SEQ ID NO: 3181001 - DNA, 13 bp, Homo sapiens
tccacccattccc

SEQ ID NO: 3181002 - DNA, 24 bp, Homo sapiens
tccacccattcccccatgtggctg

SEQ ID NO: 3181003 - DNA, 18 bp, Homo sapiens
tccaccccaagagaactc

SEQ ID NO: 3181004 - DNA, 12 bp, Homo sapiens
tccaccccatcc

SEQ ID NO: 3181005 - DNA, 15 bp, Homo sapiens
tccaccccctgccca

SEQ ID NO: 3181006 - DNA, 18 bp, Homo sapiens
tccacccgggggagccca

SEQ ID NO: 3181007 - DNA, 20 bp, Homo sapiens
tccacccgggggagcccagt

SEQ ID NO: 3181008 - DNA, 13 bp, Homo sapiens
tccaccctccacc

SEQ ID NO: 3181009 - DNA, 14 bp, Homo sapiens
tccaccctccacct

SEQ ID NO: 3181010 - DNA, 15 bp, Homo sapiens
tccaccctccacctt

SEQ ID NO: 3181011 - DNA, 18 bp, Homo sapiens
tccaccctccaccttcca

SEQ ID NO: 3181012 - DNA, 18 bp, Homo sapiens
tccaccctcccccagaca

SEQ ID NO: 3181013 - DNA, 13 bp, Homo sapiens
tccaccctgccaa

SEQ ID NO: 3181014 - DNA, 23 bp, Homo sapiens
tccaccctgccaagactcctcag

SEQ ID NO: 3181015 - DNA, 14 bp, Homo sapiens
tccaccctgctctc

SEQ ID NO: 3181016 - DNA, 15 bp, Homo sapiens
tccaccctggctggg

SEQ ID NO: 3181017 - DNA, 14 bp, Homo sapiens
tccaccctgtcccc

SEQ ID NO: 3181018 - DNA, 13 bp, Homo sapiens
tccacccttggcc

SEQ ID NO: 3181019 - DNA, 15 bp, Homo sapiens
tccacccttggcctg

SEQ ID NO: 3181020 - DNA, 15 bp, Homo sapiens
tccaccggcccctgg

SEQ ID NO: 3181021 - DNA, 18 bp, Homo sapiens
tccaccggcccctggcag

SEQ ID NO: 3181022 - DNA, 12 bp, Homo sapiens
tccacctcggag

SEQ ID NO: 3181023 - DNA, 23 bp, Homo sapiens
tccacctgggcatatccaccacc

SEQ ID NO: 3181024 - DNA, 21 bp, Homo sapiens
tccacctggtactccctctca

SEQ ID NO: 3181025 - DNA, 16 bp, Homo sapiens
tccacctgtctcagcc

SEQ ID NO: 3181026 - DNA, 16 bp, Homo sapiens
tccacctgtgccctca

SEQ ID NO: 3181027 - DNA, 15 bp, Homo sapiens
tccaccttcccatgc

SEQ ID NO: 3181028 - DNA, 16 bp, Homo sapiens
tccaccttctcacctg

SEQ ID NO: 3181029 - DNA, 15 bp, Homo sapiens
tccaccttggctctg

SEQ ID NO: 3181030 - DNA, 20 bp, Homo sapiens
tccacgaagccttaagccat

SEQ ID NO: 3181031 - DNA, 15 bp, Homo sapiens
tccacgcctcctggc

SEQ ID NO: 3181032 - DNA, 17 bp, Homo sapiens
tccacgcctcctggcca

SEQ ID NO: 3181033 - DNA, 18 bp, Homo sapiens
tccacgcctcctggccag

SEQ ID NO: 3181034 - DNA, 20 bp, Homo sapiens
tccacggtgcgtggctgtgg

SEQ ID NO: 3181035 - DNA, 16 bp, Homo sapiens
tccacgtccccctggg

SEQ ID NO: 3181036 - DNA, 17 bp, Homo sapiens
tccacgtccccctgggg

SEQ ID NO: 3181037 - DNA, 14 bp, Homo sapiens
tccactaaaaatat

SEQ ID NO: 3181038 - DNA, 17 bp, Homo sapiens
tccactacacctggctg

SEQ ID NO: 3181039 - DNA, 22 bp, Homo sapiens
tccactcagctgtcctgcagca

SEQ ID NO: 3181040 - DNA, 15 bp, Homo sapiens
tccactccctgctcc

SEQ ID NO: 3181041 - DNA, 16 bp, Homo sapiens
tccactccctgctcca

SEQ ID NO: 3181042 - DNA, 18 bp, Homo sapiens
tccactccctgctccacg

SEQ ID NO: 3181043 - DNA, 17 bp, Homo sapiens
tccactcgacccagaat

SEQ ID NO: 3181044 - DNA, 19 bp, Homo sapiens
tccactcgatgatgcttct

SEQ ID NO: 3181045 - DNA, 20 bp, Homo sapiens
tccactctaccctcccaccc

SEQ ID NO: 3181046 - DNA, 20 bp, Homo sapiens
tccactctgcttctctgact

SEQ ID NO: 3181047 - DNA, 24 bp, Homo sapiens
tccactctgcttctctgacttctg

SEQ ID NO: 3181048 - DNA, 18 bp, Homo sapiens
tccactgcaaataaagcc

SEQ ID NO: 3181049 - DNA, 12 bp, Homo sapiens
tccactgccctg

SEQ ID NO: 3181050 - DNA, 15 bp, Homo sapiens
tccactgccctggca

SEQ ID NO: 3181051 - DNA, 21 bp, Homo sapiens
tccactgccctggcagcagca

SEQ ID NO: 3181052 - DNA, 16 bp, Homo sapiens
tccactgcctctgcct

SEQ ID NO: 3181053 - DNA, 15 bp, Homo sapiens
tccactgccttcgat

SEQ ID NO: 3181054 - DNA, 18 bp, Homo sapiens
tccactggacagacccag

SEQ ID NO: 3181055 - DNA, 22 bp, Homo sapiens
tccactggacagacccaggtct

SEQ ID NO: 3181056 - DNA, 24 bp, Homo sapiens
tccactggacagacccaggtcttc

SEQ ID NO: 3181057 - DNA, 16 bp, Homo sapiens
tccactggacttgagc

SEQ ID NO: 3181058 - DNA, 17 bp, Homo sapiens
tccactgtcaccctcca

SEQ ID NO: 3181059 - DNA, 19 bp, Homo sapiens
tccactgtcactgtttctc

SEQ ID NO: 3181060 - DNA, 21 bp, Homo sapiens
tccactgtgccatgtgccagg

SEQ ID NO: 3181061 - DNA, 22 bp, Homo sapiens
tccactgtgccatgtgccaggt

SEQ ID NO: 3181062 - DNA, 17 bp, Homo sapiens
tccactgtgcctttgca

SEQ ID NO: 3181063 - DNA, 12 bp, Homo sapiens
tccactgtgtat

SEQ ID NO: 3181064 - DNA, 12 bp, Homo sapiens
tccacttcccgt

SEQ ID NO: 3181065 - DNA, 13 bp, Homo sapiens
tccacttcccgtc

SEQ ID NO: 3181066 - DNA, 19 bp, Homo sapiens
tccacttctaactccactg

SEQ ID NO: 3181067 - DNA, 14 bp, Homo sapiens
tccacttcttcctt

SEQ ID NO: 3181068 - DNA, 22 bp, Homo sapiens
tccacttgccctgttctcttca

SEQ ID NO: 3181069 - DNA, 13 bp, Homo sapiens
tccacttggtctg

SEQ ID NO: 3181070 - DNA, 15 bp, Homo sapiens
tccacttggtctgtg

SEQ ID NO: 3181071 - DNA, 17 bp, Homo sapiens
tccacttggtctgtgag

SEQ ID NO: 3181072 - DNA, 21 bp, Homo sapiens
tccactttcatctggggtggg

SEQ ID NO: 3181073 - DNA, 13 bp, Homo sapiens
tccactttgttct

SEQ ID NO: 3181074 - DNA, 15 bp, Homo sapiens
tccactttgtttcgt

SEQ ID NO: 3181075 - DNA, 23 bp, Homo sapiens
tccagaaaggatatttaagaaaa

SEQ ID NO: 3181076 - DNA, 11 bp, Homo sapiens
tccagaaatgg

SEQ ID NO: 3181077 - DNA, 23 bp, Homo sapiens
tccagaaatgtctaaatgctgaa

SEQ ID NO: 3181078 - DNA, 19 bp, Homo sapiens
tccagaaccacacttgaaa

SEQ ID NO: 3181079 - DNA, 17 bp, Homo sapiens
tcccatgacccacccct

SEQ ID NO: 3181080 - DNA, 16 bp, Homo sapiens
tcccatgagcctcagc

SEQ ID NO: 3181081 - DNA, 18 bp, Homo sapiens
tcccatgagcctcagcat

SEQ ID NO: 3181082 - DNA, 22 bp, Homo sapiens
tcccatgagcctcagcatcctg

SEQ ID NO: 3181083 - DNA, 16 bp, Homo sapiens
tcccatgatccctgtg

SEQ ID NO: 3181084 - DNA, 16 bp, Homo sapiens
tcccatgcaggccctt

SEQ ID NO: 3181085 - DNA, 15 bp, Homo sapiens
tcccatgcctggtcc

SEQ ID NO: 3181086 - DNA, 19 bp, Homo sapiens
tcccatgcctgtctctgtt

SEQ ID NO: 3181087 - DNA, 20 bp, Homo sapiens
tcccatggacactccagtgc

SEQ ID NO: 3181088 - DNA, 10 bp, Homo sapiens
tcccatgtgg

SEQ ID NO: 3181089 - DNA, 14 bp, Homo sapiens
tcccattcctccct

SEQ ID NO: 3181090 - DNA, 16 bp, Homo sapiens
tcccattcttggccca

SEQ ID NO: 3181091 - DNA, 22 bp, Homo sapiens
tcccattgcatcacctctgtaa

SEQ ID NO: 3181092 - DNA, 13 bp, Homo sapiens
tcccatttcagga

SEQ ID NO: 3181093 - DNA, 15 bp, Homo sapiens
tcccatttctcactg

SEQ ID NO: 3181094 - DNA, 16 bp, Homo sapiens
tcccatttctcactga

SEQ ID NO: 3181095 - DNA, 19 bp, Homo sapiens
tcccatttgtgccagagga

SEQ ID NO: 3181096 - DNA, 18 bp, Homo sapiens
tcccattttggaatttgc

SEQ ID NO: 3181097 - DNA, 17 bp, Homo sapiens
tccccaaagtaccacac

SEQ ID NO: 3181098 - DNA, 16 bp, Homo sapiens
tccccaacccccaact

SEQ ID NO: 3181099 - DNA, 22 bp, Homo sapiens
tccccaaccgtgtctgtctggc

SEQ ID NO: 3181100 - DNA, 23 bp, Homo sapiens
tccccaagattcacacctgactc

SEQ ID NO: 3181101 - DNA, 16 bp, Homo sapiens
tccccaagggccctgg

SEQ ID NO: 3181102 - DNA, 23 bp, Homo sapiens
tccccaagtggtttccacatgct

SEQ ID NO: 3181103 - DNA, 23 bp, Homo sapiens
tccccaattacagggtgactcac

SEQ ID NO: 3181104 - DNA, 19 bp, Homo sapiens
tccccacaccttccagggc

SEQ ID NO: 3181105 - DNA, 22 bp, Homo sapiens
tccccacaccttccagggccct

SEQ ID NO: 3181106 - DNA, 19 bp, Homo sapiens
tccccacagcctctggctc

SEQ ID NO: 3181107 - DNA, 19 bp, Homo sapiens
tccccacagcgtccctggc

SEQ ID NO: 3181108 - DNA, 16 bp, Homo sapiens
tccccaccagctcgtt

SEQ ID NO: 3181109 - DNA, 15 bp, Homo sapiens
tccccacccacccca

SEQ ID NO: 3181110 - DNA, 13 bp, Homo sapiens
tccccaccccacc

SEQ ID NO: 3181111 - DNA, 14 bp, Homo sapiens
tccccacccctgcc

SEQ ID NO: 3181112 - DNA, 15 bp, Homo sapiens
tccccacccctgccc

SEQ ID NO: 3181113 - DNA, 18 bp, Homo sapiens
tccccaccctcctcttgg

SEQ ID NO: 3181114 - DNA, 20 bp, Homo sapiens
tccccacccttgagaaggtg

SEQ ID NO: 3181115 - DNA, 16 bp, Homo sapiens
tccccacgagggctgg

SEQ ID NO: 3181116 - DNA, 17 bp, Homo sapiens
tccccacgagggctggc

SEQ ID NO: 3181117 - DNA, 21 bp, Homo sapiens
tccccacgagtcacctgcaag

SEQ ID NO: 3181118 - DNA, 18 bp, Homo sapiens
tccccacggccgctccag

SEQ ID NO: 3181119 - DNA, 18 bp, Homo sapiens
tccccactaataaagtgc

SEQ ID NO: 3181120 - DNA, 19 bp, Homo sapiens
tccccactaggttcttttc

SEQ ID NO: 3181121 - DNA, 19 bp, Homo sapiens
tccccacttgtccgctggg

SEQ ID NO: 3181122 - DNA, 15 bp, Homo sapiens
tccccagagctgtgc

SEQ ID NO: 3181123 - DNA, 18 bp, Homo sapiens
tccccagattgcaacagg

SEQ ID NO: 3181124 - DNA, 10 bp, Homo sapiens
tccccagccc

SEQ ID NO: 3181125 - DNA, 11 bp, Homo sapiens
tccccagcccc

SEQ ID NO: 3181126 - DNA, 16 bp, Homo sapiens
tccccagcccctagcc

SEQ ID NO: 3181127 - DNA, 20 bp, Homo sapiens
tccccagcccctagcccagg

SEQ ID NO: 3181128 - DNA, 21 bp, Homo sapiens
tccccagcccctagcccagga

SEQ ID NO: 3181129 - DNA, 18 bp, Homo sapiens
tccccagccctggctctg

SEQ ID NO: 3181130 - DNA, 16 bp, Homo sapiens
tccccagcccttctgc

SEQ ID NO: 3181131 - DNA, 12 bp, Homo sapiens
tccccaggccca

SEQ ID NO: 3181132 - DNA, 14 bp, Homo sapiens
tccccaggcccacc

SEQ ID NO: 3181133 - DNA, 20 bp, Homo sapiens
tccccaggcctccagcctct

SEQ ID NO: 3181134 - DNA, 15 bp, Homo sapiens
tccccagggaaggaa

SEQ ID NO: 3181135 - DNA, 12 bp, Homo sapiens
tccccagggccc

SEQ ID NO: 3181136 - DNA, 14 bp, Homo sapiens
tccccagggcccct

SEQ ID NO: 3181137 - DNA, 16 bp, Homo sapiens
tccccagggcccctcc

SEQ ID NO: 3181138 - DNA, 22 bp, Homo sapiens
tccccagggcccctccctctgc

SEQ ID NO: 3181139 - DNA, 11 bp, Homo sapiens
tccccagggct

SEQ ID NO: 3181140 - DNA, 22 bp, Homo sapiens
tccccagtctctcttaaagttg

SEQ ID NO: 3181141 - DNA, 18 bp, Homo sapiens
tccccatcacggagggtc

SEQ ID NO: 3181142 - DNA, 17 bp, Homo sapiens
tccccatccccaccagc

SEQ ID NO: 3181143 - DNA, 14 bp, Homo sapiens
tccccatccccatt

SEQ ID NO: 3181144 - DNA, 17 bp, Homo sapiens
tccccatccctgtcatt

SEQ ID NO: 3181145 - DNA, 16 bp, Homo sapiens
tccccatcctccagct

SEQ ID NO: 3181146 - DNA, 15 bp, Homo sapiens
tccccatctccctgc

SEQ ID NO: 3181147 - DNA, 22 bp, Homo sapiens
tccccatctccctgcctggccc

SEQ ID NO: 3181148 - DNA, 14 bp, Homo sapiens
tccccatctgggtc

SEQ ID NO: 3181149 - DNA, 22 bp, Homo sapiens
tccccatgtgcctgcaccagga

SEQ ID NO: 3181150 - DNA, 15 bp, Homo sapiens
tccccatttcccatc

SEQ ID NO: 3181151 - DNA, 16 bp, Homo sapiens
tccccatttcccatct

SEQ ID NO: 3181152 - DNA, 18 bp, Homo sapiens
tccccatttcccatctgc

SEQ ID NO: 3181153 - DNA, 19 bp, Homo sapiens
tccccatttcccatctgca

SEQ ID NO: 3181154 - DNA, 20 bp, Homo sapiens
tccccatttcccatctgcac

SEQ ID NO: 3181155 - DNA, 15 bp, Homo sapiens
tccccatttcctgta

SEQ ID NO: 3181156 - DNA, 22 bp, Homo sapiens
tccccatttcctgtacaatcat

SEQ ID NO: 3181157 - DNA, 15 bp, Homo sapiens
tcccccaacccacct

SEQ ID NO: 3181158 - DNA, 20 bp, Homo sapiens
tcccccaacccacctctggc

SEQ ID NO: 3181159 - DNA, 23 bp, Homo sapiens
tcccccaacccacctctggccct

SEQ ID NO: 3181160 - DNA, 19 bp, Homo sapiens
tcccccaacccccacccca

SEQ ID NO: 3181161 - DNA, 21 bp, Homo sapiens
tcccccaacccccaccccaca

SEQ ID NO: 3181162 - DNA, 17 bp, Homo sapiens
tcccccaactctgagcc

SEQ ID NO: 3181163 - DNA, 21 bp, Homo sapiens
tcccccaactctgagcccatg

SEQ ID NO: 3181164 - DNA, 12 bp, Homo sapiens
tcccccacccct

SEQ ID NO: 3181165 - DNA, 13 bp, Homo sapiens
tcccccaccctcc

SEQ ID NO: 3181166 - DNA, 20 bp, Homo sapiens
tcccccacctcggtcactcc

SEQ ID NO: 3181167 - DNA, 12 bp, Homo sapiens
tcccccacctga

SEQ ID NO: 3181168 - DNA, 12 bp, Homo sapiens
tcccccatagcc

SEQ ID NO: 3181169 - DNA, 13 bp, Homo sapiens
tcccccatctccc

SEQ ID NO: 3181170 - DNA, 15 bp, Homo sapiens
tcccccatgtggctg

SEQ ID NO: 3181171 - DNA, 17 bp, Homo sapiens
tccccccacaagtgccc

SEQ ID NO: 3181172 - DNA, 12 bp, Homo sapiens
tccccccactct

SEQ ID NO: 3181173 - DNA, 21 bp, Homo sapiens
tccccccactctccccacact

SEQ ID NO: 3181174 - DNA, 13 bp, Homo sapiens
tcccccccagcct

SEQ ID NO: 3181175 - DNA, 13 bp, Homo sapiens
tccccccgcccac

SEQ ID NO: 3181176 - DNA, 14 bp, Homo sapiens
tccccccgcccacc

SEQ ID NO: 3181177 - DNA, 15 bp, Homo sapiens
tccccccgcccaccc

SEQ ID NO: 3181178 - DNA, 13 bp, Homo sapiens
tcccccctcccac

SEQ ID NO: 3181179 - DNA, 20 bp, Homo sapiens
tcccccgacactgctgcacc

SEQ ID NO: 3181180 - DNA, 16 bp, Homo sapiens
tcccccgagctcttgg

SEQ ID NO: 3181181 - DNA, 19 bp, Homo sapiens
tcccccgagctcttggcct

SEQ ID NO: 3181182 - DNA, 21 bp, Homo sapiens
tcccccgcagtccccagccct

SEQ ID NO: 3181183 - DNA, 16 bp, Homo sapiens
tcccccggggcaaggt

SEQ ID NO: 3181184 - DNA, 13 bp, Homo sapiens
tccccctacccac

SEQ ID NO: 3181185 - DNA, 15 bp, Homo sapiens
tccccctatccttgg

SEQ ID NO: 3181186 - DNA, 21 bp, Homo sapiens
tccccctatttattgactttg

SEQ ID NO: 3181187 - DNA, 22 bp, Homo sapiens
tccccctatttattgactttga

SEQ ID NO: 3181188 - DNA, 17 bp, Homo sapiens
tccccctcaacctcacc

SEQ ID NO: 3181189 - DNA, 17 bp, Homo sapiens
tccccctcccagggcca

SEQ ID NO: 3181190 - DNA, 20 bp, Homo sapiens
tccccctcttcttctgaaga

SEQ ID NO: 3181191 - DNA, 12 bp, Homo sapiens
tccccctgccct

SEQ ID NO: 3181192 - DNA, 22 bp, Homo sapiens
tccccctgggctctgccccagc

SEQ ID NO: 3181193 - DNA, 15 bp, Homo sapiens
tccccctgtcccctc

SEQ ID NO: 3181194 - DNA, 17 bp, Homo sapiens
tccccctgttttctgtt

SEQ ID NO: 3181195 - DNA, 20 bp, Homo sapiens
tcccccttccaaataataaa

SEQ ID NO: 3181196 - DNA, 12 bp, Homo sapiens
tcccccttcctt

SEQ ID NO: 3181197 - DNA, 17 bp, Homo sapiens
tccccgaggagctgggc

SEQ ID NO: 3181198 - DNA, 19 bp, Homo sapiens
tccccgaggagctgggccc

SEQ ID NO: 3181199 - DNA, 22 bp, Homo sapiens
tccccgagtcagggcgacttcc

SEQ ID NO: 3181200 - DNA, 23 bp, Homo sapiens
tccccgataccatgctgtaagga

SEQ ID NO: 3181201 - DNA, 20 bp, Homo sapiens
tccccgatgtcccctgcggg

SEQ ID NO: 3181202 - DNA, 13 bp, Homo sapiens
tccccgcctggcc

SEQ ID NO: 3181203 - DNA, 17 bp, Homo sapiens
tccccgcctggccagga

SEQ ID NO: 3181204 - DNA, 20 bp, Homo sapiens
tccccgcctggccaggagca

SEQ ID NO: 3181205 - DNA, 14 bp, Homo sapiens
tcctagataaaaag

SEQ ID NO: 3181206 - DNA, 22 bp, Homo sapiens
tcctagcagacagaaactggat

SEQ ID NO: 3181207 - DNA, 14 bp, Homo sapiens
tcctagcctgtttc

SEQ ID NO: 3181208 - DNA, 19 bp, Homo sapiens
tcctaggagagccaacctc

SEQ ID NO: 3181209 - DNA, 15 bp, Homo sapiens
tcctaggcccaggcc

SEQ ID NO: 3181210 - DNA, 21 bp, Homo sapiens
tcctaggcccaggcctgggtt

SEQ ID NO: 3181211 - DNA, 14 bp, Homo sapiens
tcctaggtccaagc

SEQ ID NO: 3181212 - DNA, 16 bp, Homo sapiens
tcctaggtccaagccc

SEQ ID NO: 3181213 - DNA, 20 bp, Homo sapiens
tcctagtgaaccacaggttt

SEQ ID NO: 3181214 - DNA, 17 bp, Homo sapiens
tcctagtttcctctcct

SEQ ID NO: 3181215 - DNA, 16 bp, Homo sapiens
tcctataacttcttcc

SEQ ID NO: 3181216 - DNA, 22 bp, Homo sapiens
tcctataacttcttcctgctgg

SEQ ID NO: 3181217 - DNA, 18 bp, Homo sapiens
tcctataacttgatgcat

SEQ ID NO: 3181218 - DNA, 16 bp, Homo sapiens
tcctataatctgtcaa

SEQ ID NO: 3181219 - DNA, 22 bp, Homo sapiens
tcctataatctgtcaaaacact

SEQ ID NO: 3181220 - DNA, 14 bp, Homo sapiens
tcctatatatttct

SEQ ID NO: 3181221 - DNA, 21 bp, Homo sapiens
tcctatattgttttcagtgta

SEQ ID NO: 3181222 - DNA, 20 bp, Homo sapiens
tcctatcaagccagtacgtg

SEQ ID NO: 3181223 - DNA, 17 bp, Homo sapiens
tcctatcagaagtttct

SEQ ID NO: 3181224 - DNA, 17 bp, Homo sapiens
tcctatctatcttccaa

SEQ ID NO: 3181225 - DNA, 13 bp, Homo sapiens
tcctatctccccc

SEQ ID NO: 3181226 - DNA, 21 bp, Homo sapiens
tcctatctcccccaacccacc

SEQ ID NO: 3181227 - DNA, 20 bp, Homo sapiens
tcctatctggggagctcctg

SEQ ID NO: 3181228 - DNA, 13 bp, Homo sapiens
tcctatctgtgtt

SEQ ID NO: 3181229 - DNA, 14 bp, Homo sapiens
tcctatctgtgttt

SEQ ID NO: 3181230 - DNA, 23 bp, Homo sapiens
tcctatgatggatggcagactct

SEQ ID NO: 3181231 - DNA, 16 bp, Homo sapiens
tcctatggacaactta

SEQ ID NO: 3181232 - DNA, 12 bp, Homo sapiens
tcctatgtgtga

SEQ ID NO: 3181233 - DNA, 20 bp, Homo sapiens
tcctatttccccctcctccc

SEQ ID NO: 3181234 - DNA, 14 bp, Homo sapiens
tcctatttttgtaa

SEQ ID NO: 3181235 - DNA, 14 bp, Homo sapiens
tcctatttttttaa

SEQ ID NO: 3181236 - DNA, 16 bp, Homo sapiens
tcctcaaagaaagtgt

SEQ ID NO: 3181237 - DNA, 18 bp, Homo sapiens
tcctcaaagaaagtgtat

SEQ ID NO: 3181238 - DNA, 19 bp, Homo sapiens
tcctcaaagaaagtgtatt

SEQ ID NO: 3181239 - DNA, 15 bp, Homo sapiens
tcctcaacagtgttt

SEQ ID NO: 3181240 - DNA, 19 bp, Homo sapiens
tcctcaacccctcccctcc

SEQ ID NO: 3181241 - DNA, 19 bp, Homo sapiens
tcctcacacaccctgaggt

SEQ ID NO: 3181242 - DNA, 16 bp, Homo sapiens
tcctcacccccagctt

SEQ ID NO: 3181243 - DNA, 20 bp, Homo sapiens
tcctcacccccagctttgct

SEQ ID NO: 3181244 - DNA, 23 bp, Homo sapiens
tcctcacccctcgccacctttca

SEQ ID NO: 3181245 - DNA, 17 bp, Homo sapiens
tcctcacccctgtcctc

SEQ ID NO: 3181246 - DNA, 21 bp, Homo sapiens
tcctcacccctgtcctcactg

SEQ ID NO: 3181247 - DNA, 22 bp, Homo sapiens
tcctcaccctgatttcttgctt

SEQ ID NO: 3181248 - DNA, 15 bp, Homo sapiens
tcctcacctcatgcc

SEQ ID NO: 3181249 - DNA, 21 bp, Homo sapiens
tcctcacctcatgcccacccc

SEQ ID NO: 3181250 - DNA, 22 bp, Homo sapiens
tcctcacctctggactggctag

SEQ ID NO: 3181251 - DNA, 13 bp, Homo sapiens
tcctcactaaaaa

SEQ ID NO: 3181252 - DNA, 12 bp, Homo sapiens
tcctcactccca

SEQ ID NO: 3181253 - DNA, 14 bp, Homo sapiens
tcctcactctgtcc

SEQ ID NO: 3181254 - DNA, 15 bp, Homo sapiens
tcctcactctgtccc

SEQ ID NO: 3181255 - DNA, 15 bp, Homo sapiens
tcctcactgcccgca

SEQ ID NO: 3181256 - DNA, 17 bp, Homo sapiens
tcctcactgctccctga

SEQ ID NO: 3181257 - DNA, 21 bp, Homo sapiens
tcctcactgctccctgaagcc

SEQ ID NO: 3181258 - DNA, 20 bp, Homo sapiens
tcctcactggaggagcagct

SEQ ID NO: 3181259 - DNA, 15 bp, Homo sapiens
tcctcactgggtggg

SEQ ID NO: 3181260 - DNA, 14 bp, Homo sapiens
tcctcactgtatcc

SEQ ID NO: 3181261 - DNA, 22 bp, Homo sapiens
tcctcacttccatacagctcta

SEQ ID NO: 3181262 - DNA, 15 bp, Homo sapiens
tcctcacttggggga

SEQ ID NO: 3181263 - DNA, 13 bp, Homo sapiens
tcctcagatgggg

SEQ ID NO: 3181264 - DNA, 15 bp, Homo sapiens
tcctcagatggggca

SEQ ID NO: 3181265 - DNA, 17 bp, Homo sapiens
tcctcagcccccaggcc

SEQ ID NO: 3181266 - DNA, 24 bp, Homo sapiens
tcctcagcccccaggccaggtgag

SEQ ID NO: 3181267 - DNA, 15 bp, Homo sapiens
tcctcagctggttac

SEQ ID NO: 3181268 - DNA, 17 bp, Homo sapiens
tcctcaggcacacagct

SEQ ID NO: 3181269 - DNA, 21 bp, Homo sapiens
tcctcagtaacatttctgttc

SEQ ID NO: 3181270 - DNA, 16 bp, Homo sapiens
tcctcataaaaagcaa

SEQ ID NO: 3181271 - DNA, 23 bp, Homo sapiens
tcctcatcccctcgtcctgtccc

SEQ ID NO: 3181272 - DNA, 14 bp, Homo sapiens
tcctcatccctgac

SEQ ID NO: 3181273 - DNA, 20 bp, Homo sapiens
tcctcatgcccaagagatct

SEQ ID NO: 3181274 - DNA, 13 bp, Homo sapiens
tcctcatgtaaca

SEQ ID NO: 3181275 - DNA, 19 bp, Homo sapiens
tcctcatgtaacattggtg

SEQ ID NO: 3181276 - DNA, 20 bp, Homo sapiens
tcctcattataaaatgggaa

SEQ ID NO: 3181277 - DNA, 18 bp, Homo sapiens
tcctccaaatctcttgct

SEQ ID NO: 3181278 - DNA, 17 bp, Homo sapiens
tcctccacatcctgtgt

SEQ ID NO: 3181279 - DNA, 20 bp, Homo sapiens
tcctccacatcctgtgtcag

SEQ ID NO: 3181280 - DNA, 12 bp, Homo sapiens
tcctccacgcct

SEQ ID NO: 3181281 - DNA, 13 bp, Homo sapiens
tcctccagaccac

SEQ ID NO: 3181282 - DNA, 17 bp, Homo sapiens
tcctccagaccaccagc

SEQ ID NO: 3181283 - DNA, 14 bp, Homo sapiens
tcctccagcccctg

SEQ ID NO: 3181284 - DNA, 18 bp, Homo sapiens
tcctccagcccctgtccc

SEQ ID NO: 3181285 - DNA, 10 bp, Homo sapiens
tcctccagct

SEQ ID NO: 3181286 - DNA, 17 bp, Homo sapiens
tcctccaggcctgcctc

SEQ ID NO: 3181287 - DNA, 14 bp, Homo sapiens
tcctcccacctcag

SEQ ID NO: 3181288 - DNA, 15 bp, Homo sapiens
tcctcccacctcagc

SEQ ID NO: 3181289 - DNA, 16 bp, Homo sapiens
tcctcccacctcagcc

SEQ ID NO: 3181290 - DNA, 20 bp, Homo sapiens
tcctcccacctcagcctccc

SEQ ID NO: 3181291 - DNA, 17 bp, Homo sapiens
tcctcccagcgtgtgta

SEQ ID NO: 3181292 - DNA, 20 bp, Homo sapiens
tcctcccagcgtgtgtatcc

SEQ ID NO: 3181293 - DNA, 19 bp, Homo sapiens
tcctcccatcccctggact

SEQ ID NO: 3181294 - DNA, 13 bp, Homo sapiens
tcctcccccaccc

SEQ ID NO: 3181295 - DNA, 15 bp, Homo sapiens
tcctccccctgttct

SEQ ID NO: 3181296 - DNA, 16 bp, Homo sapiens
tcctcccctcacagcc

SEQ ID NO: 3181297 - DNA, 19 bp, Homo sapiens
tcctccctggctgccctgg

SEQ ID NO: 3181298 - DNA, 21 bp, Homo sapiens
tcctccctggctgccctggcc

SEQ ID NO: 3181299 - DNA, 22 bp, Homo sapiens
tcctccctggctgccctggccc

SEQ ID NO: 3181300 - DNA, 19 bp, Homo sapiens
tcctccctgggcagaaagt

SEQ ID NO: 3181301 - DNA, 18 bp, Homo sapiens
tcctccctgtctctgcat

SEQ ID NO: 3181302 - DNA, 13 bp, Homo sapiens
tcctcccttcctt

SEQ ID NO: 3181303 - DNA, 22 bp, Homo sapiens
tcctcccttccttttccctgct

SEQ ID NO: 3181304 - DNA, 19 bp, Homo sapiens
tcctcccttgggttctgat

SEQ ID NO: 3181305 - DNA, 18 bp, Homo sapiens
tcctccctttccttccta

SEQ ID NO: 3181306 - DNA, 15 bp, Homo sapiens
tcctccgaggccagt

SEQ ID NO: 3181307 - DNA, 14 bp, Homo sapiens
tcctccgtccaccc

SEQ ID NO: 3181308 - DNA, 18 bp, Homo sapiens
tcctccgtccacccaggc

SEQ ID NO: 3181309 - DNA, 20 bp, Homo sapiens
tcctccgtccacccaggctg

SEQ ID NO: 3181310 - DNA, 22 bp, Homo sapiens
tcctcctaccgaaaccttgcct

SEQ ID NO: 3181311 - DNA, 20 bp, Homo sapiens
tcctcctaccttttgtctct

SEQ ID NO: 3181312 - DNA, 12 bp, Homo sapiens
tcctcctcacct

SEQ ID NO: 3181313 - DNA, 22 bp, Homo sapiens
tcctcctcagcccccaggccag

SEQ ID NO: 3181314 - DNA, 23 bp, Homo sapiens
tcctcctcagcccccaggccagg

SEQ ID NO: 3181315 - DNA, 12 bp, Homo sapiens
tcctcctccaca

SEQ ID NO: 3181316 - DNA, 16 bp, Homo sapiens
tcctcctccacagtgc

SEQ ID NO: 3181317 - DNA, 14 bp, Homo sapiens
tcctcctccagggt

SEQ ID NO: 3181318 - DNA, 14 bp, Homo sapiens
tcctcctcccaccc

SEQ ID NO: 3181319 - DNA, 22 bp, Homo sapiens
tcctcctcggaaccgctcacct

SEQ ID NO: 3181320 - DNA, 23 bp, Homo sapiens
tcctcctcggaaccgctcaccta

SEQ ID NO: 3181321 - DNA, 12 bp, Homo sapiens
tcctcctgatgg

SEQ ID NO: 3181322 - DNA, 23 bp, Homo sapiens
tcctcctgatggccaagagcatc

SEQ ID NO: 3181323 - DNA, 13 bp, Homo sapiens
tcctcctgcagac

SEQ ID NO: 3181324 - DNA, 14 bp, Homo sapiens
tcctcctgcagaca

SEQ ID NO: 3181325 - DNA, 20 bp, Homo sapiens
tcctcctgcagaccacgccc

SEQ ID NO: 3181326 - DNA, 12 bp, Homo sapiens
tcctcctggaag

SEQ ID NO: 3181327 - DNA, 13 bp, Homo sapiens
tcctcctggaagg

SEQ ID NO: 3181328 - DNA, 12 bp, Homo sapiens
tcctcctgtgtg

SEQ ID NO: 3181329 - DNA, 23 bp, Homo sapiens
tcctccttgcccagactacaggg

SEQ ID NO: 3181330 - DNA, 17 bp, Homo sapiens
tcctccttggtgcctgg

SEQ ID NO: 3181331 - DNA, 14 bp, Homo sapiens
tcctgtgacatgta

SEQ ID NO: 3181332 - DNA, 19 bp, Homo sapiens
tcctgtgatcctttgatgg

SEQ ID NO: 3181333 - DNA, 15 bp, Homo sapiens
tcctgtgcatgggtg

SEQ ID NO: 3181334 - DNA, 18 bp, Homo sapiens
tcctgtgcatgggtgaag

SEQ ID NO: 3181335 - DNA, 17 bp, Homo sapiens
tcctgtgcccacatccc

SEQ ID NO: 3181336 - DNA, 23 bp, Homo sapiens
tcctgtgccgtaaggattgcatc

SEQ ID NO: 3181337 - DNA, 19 bp, Homo sapiens
tcctgtgctctggaggctg

SEQ ID NO: 3181338 - DNA, 12 bp, Homo sapiens
tcctgtgctggg

SEQ ID NO: 3181339 - DNA, 13 bp, Homo sapiens
tcctgtggccagg

SEQ ID NO: 3181340 - DNA, 16 bp, Homo sapiens
tcctgtgtactgtgtc

SEQ ID NO: 3181341 - DNA, 24 bp, Homo sapiens
tcctgtgtcttgcaatggcagcct

SEQ ID NO: 3181342 - DNA, 18 bp, Homo sapiens
tcctgtgtgtactctgtc

SEQ ID NO: 3181343 - DNA, 15 bp, Homo sapiens
tcctgttcagcattc

SEQ ID NO: 3181344 - DNA, 16 bp, Homo sapiens
tcctgttcagcattct

SEQ ID NO: 3181345 - DNA, 14 bp, Homo sapiens
tcctgttctgccca

SEQ ID NO: 3181346 - DNA, 15 bp, Homo sapiens
tcctgttctgcccac

SEQ ID NO: 3181347 - DNA, 16 bp, Homo sapiens
tcctgttgatcccagt

SEQ ID NO: 3181348 - DNA, 21 bp, Homo sapiens
tcctgttgttgttaatgaaaa

SEQ ID NO: 3181349 - DNA, 17 bp, Homo sapiens
tcctgtttataatctga

SEQ ID NO: 3181350 - DNA, 18 bp, Homo sapiens
tcctgtttattcccatct

SEQ ID NO: 3181351 - DNA, 20 bp, Homo sapiens
tcctgttttataatgaaccc

SEQ ID NO: 3181352 - DNA, 14 bp, Homo sapiens
tcctgttttatata

SEQ ID NO: 3181353 - DNA, 17 bp, Homo sapiens
tcctgttttatatatta

SEQ ID NO: 3181354 - DNA, 17 bp, Homo sapiens
tcctgttttgcacagcc

SEQ ID NO: 3181355 - DNA, 21 bp, Homo sapiens
tcctgttttgcacagccaaat

SEQ ID NO: 3181356 - DNA, 12 bp, Homo sapiens
tccttaaaaatc

SEQ ID NO: 3181357 - DNA, 14 bp, Homo sapiens
tccttaagccagga

SEQ ID NO: 3181358 - DNA, 14 bp, Homo sapiens
tccttacctcttcc

SEQ ID NO: 3181359 - DNA, 17 bp, Homo sapiens
tccttacctcttccgga

SEQ ID NO: 3181360 - DNA, 20 bp, Homo sapiens
tccttacctttttatttgca

SEQ ID NO: 3181361 - DNA, 15 bp, Homo sapiens
tccttactctgagcc

SEQ ID NO: 3181362 - DNA, 16 bp, Homo sapiens
tccttactctgagccc

SEQ ID NO: 3181363 - DNA, 18 bp, Homo sapiens
tccttactctgagcccag

SEQ ID NO: 3181364 - DNA, 16 bp, Homo sapiens
tccttactgtgtttca

SEQ ID NO: 3181365 - DNA, 17 bp, Homo sapiens
tccttactgtgtttcag

SEQ ID NO: 3181366 - DNA, 15 bp, Homo sapiens
tccttacttttaagg

SEQ ID NO: 3181367 - DNA, 15 bp, Homo sapiens
tccttagaacatttt

SEQ ID NO: 3181368 - DNA, 20 bp, Homo sapiens
tccttagaacattttaattc

SEQ ID NO: 3181369 - DNA, 17 bp, Homo sapiens
tccttagaccttccata

SEQ ID NO: 3181370 - DNA, 15 bp, Homo sapiens
tccttagccctgtct

SEQ ID NO: 3181371 - DNA, 22 bp, Homo sapiens
tccttagctttccctgtgccac

SEQ ID NO: 3181372 - DNA, 17 bp, Homo sapiens
tccttaggcctctgaga

SEQ ID NO: 3181373 - DNA, 17 bp, Homo sapiens
tccttagtcttctcata

SEQ ID NO: 3181374 - DNA, 12 bp, Homo sapiens
tccttagtgtat

SEQ ID NO: 3181375 - DNA, 19 bp, Homo sapiens
tccttatcctacagtacaa

SEQ ID NO: 3181376 - DNA, 23 bp, Homo sapiens
tccttatcctacagtacaatcag

SEQ ID NO: 3181377 - DNA, 13 bp, Homo sapiens
tccttattcttct

SEQ ID NO: 3181378 - DNA, 20 bp, Homo sapiens
tccttatttgcttcattgta

SEQ ID NO: 3181379 - DNA, 19 bp, Homo sapiens
tccttcaaaatccttccaa

SEQ ID NO: 3181380 - DNA, 20 bp, Homo sapiens
tccttcaaaatccttccaaa

SEQ ID NO: 3181381 - DNA, 15 bp, Homo sapiens
tccttcaagccagca

SEQ ID NO: 3181382 - DNA, 18 bp, Homo sapiens
tccttcaagttagctcag

SEQ ID NO: 3181383 - DNA, 20 bp, Homo sapiens
tccttcaagttagctcagga

SEQ ID NO: 3181384 - DNA, 23 bp, Homo sapiens
tccttcaagttagctcaggaggc

SEQ ID NO: 3181385 - DNA, 19 bp, Homo sapiens
tccttcacaggcagtgcat

SEQ ID NO: 3181386 - DNA, 16 bp, Homo sapiens
tccttcactcatccag

SEQ ID NO: 3181387 - DNA, 15 bp, Homo sapiens
tccttcactgttccc

SEQ ID NO: 3181388 - DNA, 19 bp, Homo sapiens
tccttcactgttccctctg

SEQ ID NO: 3181389 - DNA, 12 bp, Homo sapiens
tccttcagacac

SEQ ID NO: 3181390 - DNA, 12 bp, Homo sapiens
tccttcagagct

SEQ ID NO: 3181391 - DNA, 13 bp, Homo sapiens
tccttcagagctc

SEQ ID NO: 3181392 - DNA, 18 bp, Homo sapiens
tccttcagggtttaatag

SEQ ID NO: 3181393 - DNA, 14 bp, Homo sapiens
tccttcattaatga

SEQ ID NO: 3181394 - DNA, 17 bp, Homo sapiens
tccttccaaaaaattaa

SEQ ID NO: 3181395 - DNA, 14 bp, Homo sapiens
tccttccacctccc

SEQ ID NO: 3181396 - DNA, 13 bp, Homo sapiens
tccttccaggccc

SEQ ID NO: 3181397 - DNA, 16 bp, Homo sapiens
tccttccaggccccca

SEQ ID NO: 3181398 - DNA, 21 bp, Homo sapiens
tccttccagtgtccttagaac

SEQ ID NO: 3181399 - DNA, 21 bp, Homo sapiens
tccttcccatgcctgtctctg

SEQ ID NO: 3181400 - DNA, 13 bp, Homo sapiens
tccttccccagga

SEQ ID NO: 3181401 - DNA, 21 bp, Homo sapiens
tccttccccctcactgaagct

SEQ ID NO: 3181402 - DNA, 16 bp, Homo sapiens
tccttcccctcttctt

SEQ ID NO: 3181403 - DNA, 17 bp, Homo sapiens
tccttcccctttcccca

SEQ ID NO: 3181404 - DNA, 14 bp, Homo sapiens
tccttccctgtaaa

SEQ ID NO: 3181405 - DNA, 20 bp, Homo sapiens
tccttcctaatttcccttct

SEQ ID NO: 3181406 - DNA, 13 bp, Homo sapiens
tccttcctaccct

SEQ ID NO: 3181407 - DNA, 18 bp, Homo sapiens
tccttcctatgcccaggt

SEQ ID NO: 3181408 - DNA, 21 bp, Homo sapiens
tccttcctgttagtggttgtg

SEQ ID NO: 3181409 - DNA, 19 bp, Homo sapiens
tccttcggtcttttgtatt

SEQ ID NO: 3181410 - DNA, 15 bp, Homo sapiens
tccttctattctagc

SEQ ID NO: 3181411 - DNA, 13 bp, Homo sapiens
tccttctccagga

SEQ ID NO: 3181412 - DNA, 15 bp, Homo sapiens
tccttctctgaacac

SEQ ID NO: 3181413 - DNA, 18 bp, Homo sapiens
tccttctctgaacacagg

SEQ ID NO: 3181414 - DNA, 20 bp, Homo sapiens
tccttctctgaacacaggca

SEQ ID NO: 3181415 - DNA, 21 bp, Homo sapiens
tccttctctgaacacaggcag

SEQ ID NO: 3181416 - DNA, 22 bp, Homo sapiens
tccttctctgaacacaggcagc

SEQ ID NO: 3181417 - DNA, 13 bp, Homo sapiens
tccttctttgata

SEQ ID NO: 3181418 - DNA, 21 bp, Homo sapiens
tccttgaagaactgcaggccc

SEQ ID NO: 3181419 - DNA, 22 bp, Homo sapiens
tccttgaccttcctctggggct

SEQ ID NO: 3181420 - DNA, 14 bp, Homo sapiens
tccttgatttcaaa

SEQ ID NO: 3181421 - DNA, 14 bp, Homo sapiens
tccttgcacccctc

SEQ ID NO: 3181422 - DNA, 20 bp, Homo sapiens
tccttgcacccctcactctg

SEQ ID NO: 3181423 - DNA, 21 bp, Homo sapiens
tccttgcacccctcactctgg

SEQ ID NO: 3181424 - DNA, 14 bp, Homo sapiens
tccttgccccacag

SEQ ID NO: 3181425 - DNA, 17 bp, Homo sapiens
tccttgccccacagttg

SEQ ID NO: 3181426 - DNA, 19 bp, Homo sapiens
tccttgccccacagttgtg

SEQ ID NO: 3181427 - DNA, 24 bp, Homo sapiens
tccttgccccacagttgtgttcat

SEQ ID NO: 3181428 - DNA, 20 bp, Homo sapiens
tccttgctctccctcttctc

SEQ ID NO: 3181429 - DNA, 21 bp, Homo sapiens
tccttgctctccctcttctca

SEQ ID NO: 3181430 - DNA, 16 bp, Homo sapiens
tccttggaagtttcat

SEQ ID NO: 3181431 - DNA, 21 bp, Homo sapiens
tccttggaggaaacttaagat

SEQ ID NO: 3181432 - DNA, 15 bp, Homo sapiens
tccttggcaccaaag

SEQ ID NO: 3181433 - DNA, 20 bp, Homo sapiens
tccttggctttatgcacatt

SEQ ID NO: 3181434 - DNA, 13 bp, Homo sapiens
tccttgggcactt

SEQ ID NO: 3181435 - DNA, 12 bp, Homo sapiens
tccttgggctcc

SEQ ID NO: 3181436 - DNA, 15 bp, Homo sapiens
tccttgggctgggac

SEQ ID NO: 3181437 - DNA, 18 bp, Homo sapiens
tccttgggtcattgacct

SEQ ID NO: 3181438 - DNA, 13 bp, Homo sapiens
tccttgtcactgg

SEQ ID NO: 3181439 - DNA, 20 bp, Homo sapiens
tccttgtctgaatgtattta

SEQ ID NO: 3181440 - DNA, 13 bp, Homo sapiens
tccttgtggcaga

SEQ ID NO: 3181441 - DNA, 15 bp, Homo sapiens
tccttgtggcagagg

SEQ ID NO: 3181442 - DNA, 17 bp, Homo sapiens
tccttgttggtcagagg

SEQ ID NO: 3181443 - DNA, 13 bp, Homo sapiens
tccttgtttatca

SEQ ID NO: 3181444 - DNA, 18 bp, Homo sapiens
tcctttaaaaaagaaaag

SEQ ID NO: 3181445 - DNA, 21 bp, Homo sapiens
tcctttacaaaagaaatacct

SEQ ID NO: 3181446 - DNA, 19 bp, Homo sapiens
tcctttacattcaactttt

SEQ ID NO: 3181447 - DNA, 23 bp, Homo sapiens
tcctttaggagggagttatctaa

SEQ ID NO: 3181448 - DNA, 14 bp, Homo sapiens
tcctttccccagcc

SEQ ID NO: 3181449 - DNA, 14 bp, Homo sapiens
tcctttcccctctc

SEQ ID NO: 3181450 - DNA, 17 bp, Homo sapiens
tcctttcccctctctgc

SEQ ID NO: 3181451 - DNA, 18 bp, Homo sapiens
tcctttcccctctctgcc

SEQ ID NO: 3181452 - DNA, 20 bp, Homo sapiens
tcctttcccctctctgcccc

SEQ ID NO: 3181453 - DNA, 21 bp, Homo sapiens
tcctttcccctctctgcccct

SEQ ID NO: 3181454 - DNA, 22 bp, Homo sapiens
tcctttcccctctctgcccctg

SEQ ID NO: 3181455 - DNA, 12 bp, Homo sapiens
tcctttcccttt

SEQ ID NO: 3181456 - DNA, 22 bp, Homo sapiens
tcctttctaacaaaaaaatata

SEQ ID NO: 3181457 - DNA, 15 bp, Homo sapiens
tctaggcctctccag

SEQ ID NO: 3181458 - DNA, 18 bp, Homo sapiens
tctagggttgctggagcc

SEQ ID NO: 3181459 - DNA, 13 bp, Homo sapiens
tctaggtaatttt

SEQ ID NO: 3181460 - DNA, 20 bp, Homo sapiens
tctaggtaggggcccacttc

SEQ ID NO: 3181461 - DNA, 15 bp, Homo sapiens
tctaggttatacaat

SEQ ID NO: 3181462 - DNA, 17 bp, Homo sapiens
tctaggttatacaataa

SEQ ID NO: 3181463 - DNA, 18 bp, Homo sapiens
tctaggttatacaataac

SEQ ID NO: 3181464 - DNA, 19 bp, Homo sapiens
tctaggtttcaaagatgct

SEQ ID NO: 3181465 - DNA, 20 bp, Homo sapiens
tctaggtttcaaagatgctg

SEQ ID NO: 3181466 - DNA, 16 bp, Homo sapiens
tctagtaacaatacat

SEQ ID NO: 3181467 - DNA, 19 bp, Homo sapiens
tctagtcacaaagactcct

SEQ ID NO: 3181468 - DNA, 15 bp, Homo sapiens
tctagtcattgtcat

SEQ ID NO: 3181469 - DNA, 14 bp, Homo sapiens
tctagtcttggcca

SEQ ID NO: 3181470 - DNA, 13 bp, Homo sapiens
tctagtgggacag

SEQ ID NO: 3181471 - DNA, 19 bp, Homo sapiens
tctagtgggacagcccaga

SEQ ID NO: 3181472 - DNA, 18 bp, Homo sapiens
tctagtggtctttgtaag

SEQ ID NO: 3181473 - DNA, 19 bp, Homo sapiens
tctagtggtctttgtaaga

SEQ ID NO: 3181474 - DNA, 14 bp, Homo sapiens
tctagttcaatgcc

SEQ ID NO: 3181475 - DNA, 16 bp, Homo sapiens
tctagttctttcctcc

SEQ ID NO: 3181476 - DNA, 15 bp, Homo sapiens
tctagtttcagtaaa

SEQ ID NO: 3181477 - DNA, 22 bp, Homo sapiens
tctagttttttacttttgttta

SEQ ID NO: 3181478 - DNA, 16 bp, Homo sapiens
tctataaaactctgca

SEQ ID NO: 3181479 - DNA, 13 bp, Homo sapiens
tctataaaagaat

SEQ ID NO: 3181480 - DNA, 20 bp, Homo sapiens
tctataaagaagaacttgca

SEQ ID NO: 3181481 - DNA, 21 bp, Homo sapiens
tctataacagatcctttcaaa

SEQ ID NO: 3181482 - DNA, 22 bp, Homo sapiens
tctataacagatcctttcaaaa

SEQ ID NO: 3181483 - DNA, 16 bp, Homo sapiens
tctataaggccataaa

SEQ ID NO: 3181484 - DNA, 11 bp, Homo sapiens
tctatacaaat

SEQ ID NO: 3181485 - DNA, 16 bp, Homo sapiens
tctatacaaatataaa

SEQ ID NO: 3181486 - DNA, 15 bp, Homo sapiens
tctatacatatcttt

SEQ ID NO: 3181487 - DNA, 15 bp, Homo sapiens
tctatacatctctcc

SEQ ID NO: 3181488 - DNA, 16 bp, Homo sapiens
tctataccaaccaaac

SEQ ID NO: 3181489 - DNA, 13 bp, Homo sapiens
tctatagactcta

SEQ ID NO: 3181490 - DNA, 18 bp, Homo sapiens
tctataggaacatatgaa

SEQ ID NO: 3181491 - DNA, 20 bp, Homo sapiens
tctataggaacatatgaaaa

SEQ ID NO: 3181492 - DNA, 14 bp, Homo sapiens
tctatataaaataa

SEQ ID NO: 3181493 - DNA, 15 bp, Homo sapiens
tctatataaaataac

SEQ ID NO: 3181494 - DNA, 23 bp, Homo sapiens
tctatataaaataactaaaatgt

SEQ ID NO: 3181495 - DNA, 14 bp, Homo sapiens
tctatatataattc

SEQ ID NO: 3181496 - DNA, 20 bp, Homo sapiens
tctatatataattctgtaca

SEQ ID NO: 3181497 - DNA, 12 bp, Homo sapiens
tctatatctgaa

SEQ ID NO: 3181498 - DNA, 18 bp, Homo sapiens
tctatattagatcaaata

SEQ ID NO: 3181499 - DNA, 15 bp, Homo sapiens
tctatattatgtctt

SEQ ID NO: 3181500 - DNA, 22 bp, Homo sapiens
tctatattatgtcttcttttgt

SEQ ID NO: 3181501 - DNA, 18 bp, Homo sapiens
tctatattttaatagaaa

SEQ ID NO: 3181502 - DNA, 19 bp, Homo sapiens
tctatatttttatttctac

SEQ ID NO: 3181503 - DNA, 17 bp, Homo sapiens
tctatcaagtcaatcat

SEQ ID NO: 3181504 - DNA, 21 bp, Homo sapiens
tctatcagttatcctttgtga

SEQ ID NO: 3181505 - DNA, 18 bp, Homo sapiens
tctatccaaatctgaaga

SEQ ID NO: 3181506 - DNA, 16 bp, Homo sapiens
tctatcctacaacaag

SEQ ID NO: 3181507 - DNA, 20 bp, Homo sapiens
tctatcgagtttgcaatgtc

SEQ ID NO: 3181508 - DNA, 12 bp, Homo sapiens
tctatctctcaa

SEQ ID NO: 3181509 - DNA, 20 bp, Homo sapiens
tctatctgcctttacctaca

SEQ ID NO: 3181510 - DNA, 14 bp, Homo sapiens
tctatcttccaaat

SEQ ID NO: 3181511 - DNA, 18 bp, Homo sapiens
tctatgaagcccacccag

SEQ ID NO: 3181512 - DNA, 16 bp, Homo sapiens
tctatgaagttgctgt

SEQ ID NO: 3181513 - DNA, 21 bp, Homo sapiens
tctatgaagttgctgtttatt

SEQ ID NO: 3181514 - DNA, 22 bp, Homo sapiens
tctatgagaacaagtcacagct

SEQ ID NO: 3181515 - DNA, 23 bp, Homo sapiens
tctatgagaacaagtcacagctg

SEQ ID NO: 3181516 - DNA, 18 bp, Homo sapiens
tctatgagggtgtttcct

SEQ ID NO: 3181517 - DNA, 14 bp, Homo sapiens
tctatgagtctaga

SEQ ID NO: 3181518 - DNA, 16 bp, Homo sapiens
tctatgagtctagatg

SEQ ID NO: 3181519 - DNA, 11 bp, Homo sapiens
tctatgatata

SEQ ID NO: 3181520 - DNA, 18 bp, Homo sapiens
tctatgccccaaatatag

SEQ ID NO: 3181521 - DNA, 15 bp, Homo sapiens
tctatggctttcaaa

SEQ ID NO: 3181522 - DNA, 19 bp, Homo sapiens
tctatgggactcaatgcac

SEQ ID NO: 3181523 - DNA, 16 bp, Homo sapiens
tctatggttatgaaag

SEQ ID NO: 3181524 - DNA, 18 bp, Homo sapiens
tctatggttatgaaagaa

SEQ ID NO: 3181525 - DNA, 22 bp, Homo sapiens
tctatggttatgaaagaatata

SEQ ID NO: 3181526 - DNA, 12 bp, Homo sapiens
tctatgtatgtt

SEQ ID NO: 3181527 - DNA, 16 bp, Homo sapiens
tctatgttaaatactg

SEQ ID NO: 3181528 - DNA, 17 bp, Homo sapiens
tctatgttaaatactgt

SEQ ID NO: 3181529 - DNA, 18 bp, Homo sapiens
tctatgttaaatactgtg

SEQ ID NO: 3181530 - DNA, 20 bp, Homo sapiens
tctatgttaaatactgtgca

SEQ ID NO: 3181531 - DNA, 22 bp, Homo sapiens
tctatgttaaatactgtgcaga

SEQ ID NO: 3181532 - DNA, 13 bp, Homo sapiens
tctatgtttgtgt

SEQ ID NO: 3181533 - DNA, 17 bp, Homo sapiens
tctattaaaattgccat

SEQ ID NO: 3181534 - DNA, 19 bp, Homo sapiens
tctattaaaattgccattt

SEQ ID NO: 3181535 - DNA, 22 bp, Homo sapiens
tctattaaagtgctaaggttct

SEQ ID NO: 3181536 - DNA, 23 bp, Homo sapiens
tctattaaatagttatataattc

SEQ ID NO: 3181537 - DNA, 21 bp, Homo sapiens
tctattacttttgcaaactgt

SEQ ID NO: 3181538 - DNA, 18 bp, Homo sapiens
tctattccatttgtattg

SEQ ID NO: 3181539 - DNA, 17 bp, Homo sapiens
tctattccttctggcct

SEQ ID NO: 3181540 - DNA, 18 bp, Homo sapiens
tctattccttctggcctt

SEQ ID NO: 3181541 - DNA, 12 bp, Homo sapiens
tctattctgtgt

SEQ ID NO: 3181542 - DNA, 22 bp, Homo sapiens
tctattgacttcaatgatagta

SEQ ID NO: 3181543 - DNA, 16 bp, Homo sapiens
tctattgatgtacagt

SEQ ID NO: 3181544 - DNA, 15 bp, Homo sapiens
tctattgggttcatt

SEQ ID NO: 3181545 - DNA, 18 bp, Homo sapiens
tctattgggttcattatt

SEQ ID NO: 3181546 - DNA, 12 bp, Homo sapiens
tctattggtctc

SEQ ID NO: 3181547 - DNA, 14 bp, Homo sapiens
tctattgtagcatt

SEQ ID NO: 3181548 - DNA, 18 bp, Homo sapiens
tctattgtgggacttatt

SEQ ID NO: 3181549 - DNA, 12 bp, Homo sapiens
tctatttaatat

SEQ ID NO: 3181550 - DNA, 18 bp, Homo sapiens
tctatttatatgtacatg

SEQ ID NO: 3181551 - DNA, 13 bp, Homo sapiens
tctatttattggg

SEQ ID NO: 3181552 - DNA, 15 bp, Homo sapiens
tctatttgtagatta

SEQ ID NO: 3181553 - DNA, 20 bp, Homo sapiens
tctattttactttgtacttg

SEQ ID NO: 3181554 - DNA, 13 bp, Homo sapiens
tctattttattat

SEQ ID NO: 3181555 - DNA, 19 bp, Homo sapiens
tctattttattatgagctt

SEQ ID NO: 3181556 - DNA, 18 bp, Homo sapiens
tctattttcttaaaccaa

SEQ ID NO: 3181557 - DNA, 15 bp, Homo sapiens
tctattttggattgt

SEQ ID NO: 3181558 - DNA, 17 bp, Homo sapiens
tctattttgtaaactca

SEQ ID NO: 3181559 - DNA, 12 bp, Homo sapiens
tctattttgtga

SEQ ID NO: 3181560 - DNA, 16 bp, Homo sapiens
tctattttgtttttta

SEQ ID NO: 3181561 - DNA, 21 bp, Homo sapiens
tctatttttttaactgaaaat

SEQ ID NO: 3181562 - DNA, 22 bp, Homo sapiens
tctcaaaaaaaaaaaaatgcac

SEQ ID NO: 3181563 - DNA, 16 bp, Homo sapiens
tctcaaaacagagggc

SEQ ID NO: 3181564 - DNA, 21 bp, Homo sapiens
tctcaaaactggacagtcact

SEQ ID NO: 3181565 - DNA, 18 bp, Homo sapiens
tctcaaaataagttgaaa

SEQ ID NO: 3181566 - DNA, 19 bp, Homo sapiens
tctcaaactaaaagacatt

SEQ ID NO: 3181567 - DNA, 21 bp, Homo sapiens
tctcaaactcttgacctcagg

SEQ ID NO: 3181568 - DNA, 22 bp, Homo sapiens
tctcaaactcttgacctcaggt

SEQ ID NO: 3181569 - DNA, 18 bp, Homo sapiens
tctcaaaggagaaaaaaa

SEQ ID NO: 3181570 - DNA, 20 bp, Homo sapiens
tctcaaagtataatctttct

SEQ ID NO: 3181571 - DNA, 22 bp, Homo sapiens
tctcaaagtttcctaatcagaa

SEQ ID NO: 3181572 - DNA, 19 bp, Homo sapiens
tctcaaagttttattataa

SEQ ID NO: 3181573 - DNA, 20 bp, Homo sapiens
tctcaaataggctattaaaa

SEQ ID NO: 3181574 - DNA, 17 bp, Homo sapiens
tctcaagagggcactgg

SEQ ID NO: 3181575 - DNA, 17 bp, Homo sapiens
tctcaagctagccagag

SEQ ID NO: 3181576 - DNA, 22 bp, Homo sapiens
tctcaagctatgatcagaagac

SEQ ID NO: 3181577 - DNA, 15 bp, Homo sapiens
tctcaagtagctggg

SEQ ID NO: 3181578 - DNA, 12 bp, Homo sapiens
tctcaagttcta

SEQ ID NO: 3181579 - DNA, 13 bp, Homo sapiens
tctcaagttctaa

SEQ ID NO: 3181580 - DNA, 14 bp, Homo sapiens
tctcaagttctaag

SEQ ID NO: 3181581 - DNA, 17 bp, Homo sapiens
tctcaagttctaagatt

SEQ ID NO: 3181582 - DNA, 18 bp, Homo sapiens
tctcaagttctaagattc

SEQ ID NO: 3181583 - DNA, 16 bp, Homo sapiens
tctcggttctgcgcca

SEQ ID NO: 3181584 - DNA, 15 bp, Homo sapiens
tctcgtgtacagctc

SEQ ID NO: 3181585 - DNA, 16 bp, Homo sapiens
tctcgttcccaaagaa

SEQ ID NO: 3181586 - DNA, 12 bp, Homo sapiens
tctcgtttttct

SEQ ID NO: 3181587 - DNA, 18 bp, Homo sapiens
tctctaaatcaagtattt

SEQ ID NO: 3181588 - DNA, 18 bp, Homo sapiens
tctctaacttattttatt

SEQ ID NO: 3181589 - DNA, 19 bp, Homo sapiens
tctctaattccatccataa

SEQ ID NO: 3181590 - DNA, 20 bp, Homo sapiens
tctctacaaaaaataaaata

SEQ ID NO: 3181591 - DNA, 14 bp, Homo sapiens
tctctacagtgcca

SEQ ID NO: 3181592 - DNA, 15 bp, Homo sapiens
tctctacatgctctt

SEQ ID NO: 3181593 - DNA, 15 bp, Homo sapiens
tctctacccctttct

SEQ ID NO: 3181594 - DNA, 16 bp, Homo sapiens
tctctacccctttctt

SEQ ID NO: 3181595 - DNA, 17 bp, Homo sapiens
tctctactaccacaagg

SEQ ID NO: 3181596 - DNA, 13 bp, Homo sapiens
tctctagaatttt

SEQ ID NO: 3181597 - DNA, 17 bp, Homo sapiens
tctctagaattttaagt

SEQ ID NO: 3181598 - DNA, 22 bp, Homo sapiens
tctctagaattttaagtgcttt

SEQ ID NO: 3181599 - DNA, 24 bp, Homo sapiens
tctctagctggtggtttcacggtg

SEQ ID NO: 3181600 - DNA, 18 bp, Homo sapiens
tctctaggcctctccagt

SEQ ID NO: 3181601 - DNA, 19 bp, Homo sapiens
tctctaggcctctccagtt

SEQ ID NO: 3181602 - DNA, 17 bp, Homo sapiens
tctctagttccacgcct

SEQ ID NO: 3181603 - DNA, 18 bp, Homo sapiens
tctctatttaaattcttt

SEQ ID NO: 3181604 - DNA, 23 bp, Homo sapiens
tctctatttaaattcttttttaa

SEQ ID NO: 3181605 - DNA, 14 bp, Homo sapiens
tctctatttaatat

SEQ ID NO: 3181606 - DNA, 21 bp, Homo sapiens
tctctcaaaagagaaaaacaa

SEQ ID NO: 3181607 - DNA, 16 bp, Homo sapiens
tctctcaggagtatct

SEQ ID NO: 3181608 - DNA, 23 bp, Homo sapiens
tctctcatcctccagtaccttgc

SEQ ID NO: 3181609 - DNA, 15 bp, Homo sapiens
tctctcatctgatca

SEQ ID NO: 3181610 - DNA, 13 bp, Homo sapiens
tctctcatcttgt

SEQ ID NO: 3181611 - DNA, 18 bp, Homo sapiens
tctctcatcttgttcttc

SEQ ID NO: 3181612 - DNA, 18 bp, Homo sapiens
tctctccagctgactaaa

SEQ ID NO: 3181613 - DNA, 19 bp, Homo sapiens
tctctccagctgactaaac

SEQ ID NO: 3181614 - DNA, 19 bp, Homo sapiens
tctctccccctatttattg

SEQ ID NO: 3181615 - DNA, 20 bp, Homo sapiens
tctctcccctcaaagtctgc

SEQ ID NO: 3181616 - DNA, 18 bp, Homo sapiens
tctctccctctccctgtc

SEQ ID NO: 3181617 - DNA, 15 bp, Homo sapiens
tctctccctgccaga

SEQ ID NO: 3181618 - DNA, 22 bp, Homo sapiens
tctctccctgccagaggggaag

SEQ ID NO: 3181619 - DNA, 20 bp, Homo sapiens
tctctcccttcctctctcct

SEQ ID NO: 3181620 - DNA, 14 bp, Homo sapiens
tctctcctctctgc

SEQ ID NO: 3181621 - DNA, 15 bp, Homo sapiens
tctctcctctctgct

SEQ ID NO: 3181622 - DNA, 16 bp, Homo sapiens
tctctcctctctgctt

SEQ ID NO: 3181623 - DNA, 12 bp, Homo sapiens
tctctcctggcc

SEQ ID NO: 3181624 - DNA, 20 bp, Homo sapiens
tctctcggctccccatgtgt

SEQ ID NO: 3181625 - DNA, 18 bp, Homo sapiens
tctctcggtgtggcgtga

SEQ ID NO: 3181626 - DNA, 21 bp, Homo sapiens
tctctctacaagagcccctgc

SEQ ID NO: 3181627 - DNA, 20 bp, Homo sapiens
tctctctcgaccttctggta

SEQ ID NO: 3181628 - DNA, 13 bp, Homo sapiens
tctctctctacaa

SEQ ID NO: 3181629 - DNA, 14 bp, Homo sapiens
tctctctctctctc

SEQ ID NO: 3181630 - DNA, 15 bp, Homo sapiens
tctctctggggccct

SEQ ID NO: 3181631 - DNA, 16 bp, Homo sapiens
tctctcttaaagttgg

SEQ ID NO: 3181632 - DNA, 16 bp, Homo sapiens
tctctcttcagactct

SEQ ID NO: 3181633 - DNA, 18 bp, Homo sapiens
tctctcttcagactctca

SEQ ID NO: 3181634 - DNA, 20 bp, Homo sapiens
tctctcttcagactctcagc

SEQ ID NO: 3181635 - DNA, 11 bp, Homo sapiens
tctctcttctg

SEQ ID NO: 3181636 - DNA, 20 bp, Homo sapiens
tctctcttctgctccaccct

SEQ ID NO: 3181637 - DNA, 14 bp, Homo sapiens
tctctcttttcatt

SEQ ID NO: 3181638 - DNA, 17 bp, Homo sapiens
tctctgaacacaggcag

SEQ ID NO: 3181639 - DNA, 13 bp, Homo sapiens
tctctgacttctg

SEQ ID NO: 3181640 - DNA, 14 bp, Homo sapiens
tctctgacttctgc

SEQ ID NO: 3181641 - DNA, 19 bp, Homo sapiens
tctctgagaccacagaggc

SEQ ID NO: 3181642 - DNA, 12 bp, Homo sapiens
tctctgagactc

SEQ ID NO: 3181643 - DNA, 13 bp, Homo sapiens
tctctgagactct

SEQ ID NO: 3181644 - DNA, 14 bp, Homo sapiens
tctctgaggacact

SEQ ID NO: 3181645 - DNA, 22 bp, Homo sapiens
tctctgagtggtggttcctttg

SEQ ID NO: 3181646 - DNA, 24 bp, Homo sapiens
tctctgagtggtggttcctttgca

SEQ ID NO: 3181647 - DNA, 23 bp, Homo sapiens
tctctgatcaaaattacttttct

SEQ ID NO: 3181648 - DNA, 20 bp, Homo sapiens
tctctgattttcaaagcttt

SEQ ID NO: 3181649 - DNA, 19 bp, Homo sapiens
tctctgcaccggacagtcg

SEQ ID NO: 3181650 - DNA, 20 bp, Homo sapiens
tctctgcagacttcccagct

SEQ ID NO: 3181651 - DNA, 21 bp, Homo sapiens
tctctgcagtaaaacacattt

SEQ ID NO: 3181652 - DNA, 13 bp, Homo sapiens
tctctgcatctga

SEQ ID NO: 3181653 - DNA, 12 bp, Homo sapiens
tctctgccaccc

SEQ ID NO: 3181654 - DNA, 13 bp, Homo sapiens
tctctgccaccca

SEQ ID NO: 3181655 - DNA, 14 bp, Homo sapiens
tctctgccacccac

SEQ ID NO: 3181656 - DNA, 15 bp, Homo sapiens
tctctgccacccact

SEQ ID NO: 3181657 - DNA, 17 bp, Homo sapiens
tctctgccacccactca

SEQ ID NO: 3181658 - DNA, 14 bp, Homo sapiens
tctctgccagtgac

SEQ ID NO: 3181659 - DNA, 21 bp, Homo sapiens
tctctgccagtgacagacagg

SEQ ID NO: 3181660 - DNA, 15 bp, Homo sapiens
tctctgccggctctt

SEQ ID NO: 3181661 - DNA, 19 bp, Homo sapiens
tctctgccggctctttcct

SEQ ID NO: 3181662 - DNA, 18 bp, Homo sapiens
tctctgcctagaatcttt

SEQ ID NO: 3181663 - DNA, 23 bp, Homo sapiens
tctctgcctagaatctttattca

SEQ ID NO: 3181664 - DNA, 19 bp, Homo sapiens
tctctgctccaccacatcc

SEQ ID NO: 3181665 - DNA, 17 bp, Homo sapiens
tctctgctcgccctcct

SEQ ID NO: 3181666 - DNA, 13 bp, Homo sapiens
tctctgctgaagg

SEQ ID NO: 3181667 - DNA, 19 bp, Homo sapiens
tctctgctgagctgggccc

SEQ ID NO: 3181668 - DNA, 22 bp, Homo sapiens
tctctggaaaggggggagctgg

SEQ ID NO: 3181669 - DNA, 18 bp, Homo sapiens
tctctggcctcccacccg

SEQ ID NO: 3181670 - DNA, 23 bp, Homo sapiens
tctctggccttcggcctccatcc

SEQ ID NO: 3181671 - DNA, 20 bp, Homo sapiens
tctctggctgtaaggctcta

SEQ ID NO: 3181672 - DNA, 16 bp, Homo sapiens
tctctggggcaggctg

SEQ ID NO: 3181673 - DNA, 14 bp, Homo sapiens
tctctggggccctg

SEQ ID NO: 3181674 - DNA, 18 bp, Homo sapiens
tctctgtagggaactctg

SEQ ID NO: 3181675 - DNA, 15 bp, Homo sapiens
tctctgtcccttgct

SEQ ID NO: 3181676 - DNA, 19 bp, Homo sapiens
tctctgtcccttgctgtat

SEQ ID NO: 3181677 - DNA, 20 bp, Homo sapiens
tctctgtcccttgctgtatg

SEQ ID NO: 3181678 - DNA, 16 bp, Homo sapiens
tctctgtcctacttct

SEQ ID NO: 3181679 - DNA, 22 bp, Homo sapiens
tctctgtgaacgatttagaaag

SEQ ID NO: 3181680 - DNA, 20 bp, Homo sapiens
tctctgtgaatacaattaaa

SEQ ID NO: 3181681 - DNA, 12 bp, Homo sapiens
tctctgtgcctt

SEQ ID NO: 3181682 - DNA, 17 bp, Homo sapiens
tctctgtgtctaagatt

SEQ ID NO: 3181683 - DNA, 20 bp, Homo sapiens
tctctgtgtttgttcctaca

SEQ ID NO: 3181684 - DNA, 18 bp, Homo sapiens
tctcttaatttaatcttt

SEQ ID NO: 3181685 - DNA, 20 bp, Homo sapiens
tctcttatagaatatttatt

SEQ ID NO: 3181686 - DNA, 12 bp, Homo sapiens
tctcttatcttt

SEQ ID NO: 3181687 - DNA, 19 bp, Homo sapiens
tctcttcagactctcagcc

SEQ ID NO: 3181688 - DNA, 19 bp, Homo sapiens
tctcttcatttttttttca

SEQ ID NO: 3181689 - DNA, 16 bp, Homo sapiens
tctcttccacatgtta

SEQ ID NO: 3181690 - DNA, 19 bp, Homo sapiens
tctcttccctttccccagc

SEQ ID NO: 3181691 - DNA, 23 bp, Homo sapiens
tctcttccctttccccagcatca

SEQ ID NO: 3181692 - DNA, 19 bp, Homo sapiens
tctcttcctccgaggccag

SEQ ID NO: 3181693 - DNA, 11 bp, Homo sapiens
tctcttcctgt

SEQ ID NO: 3181694 - DNA, 19 bp, Homo sapiens
tctcttccttcggtctttt

SEQ ID NO: 3181695 - DNA, 11 bp, Homo sapiens
tctcttctcca

SEQ ID NO: 3181696 - DNA, 14 bp, Homo sapiens
tctcttctcccaga

SEQ ID NO: 3181697 - DNA, 21 bp, Homo sapiens
tctcttctcccagaatcccag

SEQ ID NO: 3181698 - DNA, 14 bp, Homo sapiens
tctcttctctccag

SEQ ID NO: 3181699 - DNA, 15 bp, Homo sapiens
tctcttctctccagc

SEQ ID NO: 3181700 - DNA, 23 bp, Homo sapiens
tctcttctctccagctgactaaa

SEQ ID NO: 3181701 - DNA, 15 bp, Homo sapiens
tctcttctctgcaat

SEQ ID NO: 3181702 - DNA, 19 bp, Homo sapiens
tctcttctctgcaatgctt

SEQ ID NO: 3181703 - DNA, 13 bp, Homo sapiens
tctcttctgctcc

SEQ ID NO: 3181704 - DNA, 12 bp, Homo sapiens
tctcttcttcat

SEQ ID NO: 3181705 - DNA, 15 bp, Homo sapiens
tctcttcttgtttct

SEQ ID NO: 3181706 - DNA, 15 bp, Homo sapiens
tctcttgagctggcc

SEQ ID NO: 3181707 - DNA, 14 bp, Homo sapiens
tctcttgagtttgt

SEQ ID NO: 3181708 - DNA, 14 bp, Homo sapiens
tctcttgcttgtca

SEQ ID NO: 3181709 - DNA, 16 bp, Homo sapiens
tcttacccaaagcaca

SEQ ID NO: 3181710 - DNA, 23 bp, Homo sapiens
tcttacctgtatgtctccagtat

SEQ ID NO: 3181711 - DNA, 24 bp, Homo sapiens
tcttactaaacattttgttattgg

SEQ ID NO: 3181712 - DNA, 21 bp, Homo sapiens
tcttactattaagcagtaaaa

SEQ ID NO: 3181713 - DNA, 18 bp, Homo sapiens
tcttactgtacctgttcc

SEQ ID NO: 3181714 - DNA, 17 bp, Homo sapiens
tcttacttgagccttta

SEQ ID NO: 3181715 - DNA, 20 bp, Homo sapiens
tcttagactacatttagaga

SEQ ID NO: 3181716 - DNA, 22 bp, Homo sapiens
tcttagagccttttatctgcag

SEQ ID NO: 3181717 - DNA, 23 bp, Homo sapiens
tcttagagccttttatctgcaga

SEQ ID NO: 3181718 - DNA, 12 bp, Homo sapiens
tcttagattctc

SEQ ID NO: 3181719 - DNA, 22 bp, Homo sapiens
tcttagcatagcttattattga

SEQ ID NO: 3181720 - DNA, 22 bp, Homo sapiens
tcttagcctgtggcagtaaaga

SEQ ID NO: 3181721 - DNA, 20 bp, Homo sapiens
tcttagctatcattgcttcc

SEQ ID NO: 3181722 - DNA, 21 bp, Homo sapiens
tcttagctatcattgcttcct

SEQ ID NO: 3181723 - DNA, 22 bp, Homo sapiens
tcttagctggatataatgtatt

SEQ ID NO: 3181724 - DNA, 23 bp, Homo sapiens
tcttagctgtctgctcagacaga

SEQ ID NO: 3181725 - DNA, 17 bp, Homo sapiens
tcttagctttttaattg

SEQ ID NO: 3181726 - DNA, 18 bp, Homo sapiens
tcttagctttttaattgt

SEQ ID NO: 3181727 - DNA, 21 bp, Homo sapiens
tcttagctttttaattgttgt

SEQ ID NO: 3181728 - DNA, 15 bp, Homo sapiens
tcttaggaagagaaa

SEQ ID NO: 3181729 - DNA, 17 bp, Homo sapiens
tcttaggggagagcttt

SEQ ID NO: 3181730 - DNA, 15 bp, Homo sapiens
tcttaggtcagatgg

SEQ ID NO: 3181731 - DNA, 14 bp, Homo sapiens
tcttagtgcctgag

SEQ ID NO: 3181732 - DNA, 20 bp, Homo sapiens
tcttagtgcttcagagtttg

SEQ ID NO: 3181733 - DNA, 16 bp, Homo sapiens
tcttagtttggattct

SEQ ID NO: 3181734 - DNA, 22 bp, Homo sapiens
tcttatacaacagcaaaccctg

SEQ ID NO: 3181735 - DNA, 23 bp, Homo sapiens
tcttatacaacagcaaaccctga

SEQ ID NO: 3181736 - DNA, 14 bp, Homo sapiens
tcttatacatttga

SEQ ID NO: 3181737 - DNA, 13 bp, Homo sapiens
tcttatagttcta

SEQ ID NO: 3181738 - DNA, 19 bp, Homo sapiens
tcttatattggtttgcaca

SEQ ID NO: 3181739 - DNA, 23 bp, Homo sapiens
tcttatcaaggactctggtttct

SEQ ID NO: 3181740 - DNA, 22 bp, Homo sapiens
tcttatccaacatcaacatctt

SEQ ID NO: 3181741 - DNA, 19 bp, Homo sapiens
tcttatcccccccagcctg

SEQ ID NO: 3181742 - DNA, 21 bp, Homo sapiens
tcttatcccccccagcctggc

SEQ ID NO: 3181743 - DNA, 16 bp, Homo sapiens
tcttatctgccatgtc

SEQ ID NO: 3181744 - DNA, 19 bp, Homo sapiens
tcttatctgccatgtccat

SEQ ID NO: 3181745 - DNA, 13 bp, Homo sapiens
tcttatctttgat

SEQ ID NO: 3181746 - DNA, 16 bp, Homo sapiens
tcttatgatgttttcc

SEQ ID NO: 3181747 - DNA, 23 bp, Homo sapiens
tcttatgcttccattaacaaatg

SEQ ID NO: 3181748 - DNA, 22 bp, Homo sapiens
tcttatggaattgatttgcatt

SEQ ID NO: 3181749 - DNA, 17 bp, Homo sapiens
tcttatgtagagttttt

SEQ ID NO: 3181750 - DNA, 14 bp, Homo sapiens
tcttatgtgtgcct

SEQ ID NO: 3181751 - DNA, 22 bp, Homo sapiens
tcttatgttatcaccttccaaa

SEQ ID NO: 3181752 - DNA, 17 bp, Homo sapiens
tcttattagggagaaaa

SEQ ID NO: 3181753 - DNA, 22 bp, Homo sapiens
tcttattagttccccaaataca

SEQ ID NO: 3181754 - DNA, 13 bp, Homo sapiens
tcttattataaaa

SEQ ID NO: 3181755 - DNA, 24 bp, Homo sapiens
tcttattcccaaactacagaataa

SEQ ID NO: 3181756 - DNA, 21 bp, Homo sapiens
tcttattccgagcattccagt

SEQ ID NO: 3181757 - DNA, 22 bp, Homo sapiens
tcttattgaaaaaaaaaatgtt

SEQ ID NO: 3181758 - DNA, 14 bp, Homo sapiens
tcttattgcccacg

SEQ ID NO: 3181759 - DNA, 18 bp, Homo sapiens
tcttattgcccacgctgg

SEQ ID NO: 3181760 - DNA, 13 bp, Homo sapiens
tcttatttctgaa

SEQ ID NO: 3181761 - DNA, 14 bp, Homo sapiens
tcttatttctgaat

SEQ ID NO: 3181762 - DNA, 19 bp, Homo sapiens
tcttcaaaatgtatatatt

SEQ ID NO: 3181763 - DNA, 14 bp, Homo sapiens
tcttcaaactgtga

SEQ ID NO: 3181764 - DNA, 19 bp, Homo sapiens
tcttcaaactttcactttg

SEQ ID NO: 3181765 - DNA, 16 bp, Homo sapiens
tcttcaaatacaaagt

SEQ ID NO: 3181766 - DNA, 17 bp, Homo sapiens
tcttcaaatccttccaa

SEQ ID NO: 3181767 - DNA, 20 bp, Homo sapiens
tcttcaacatcaatgttcat

SEQ ID NO: 3181768 - DNA, 21 bp, Homo sapiens
tcttcaacatcaatgttcatt

SEQ ID NO: 3181769 - DNA, 23 bp, Homo sapiens
tcttcaacatcaatgttcattgt

SEQ ID NO: 3181770 - DNA, 12 bp, Homo sapiens
tcttcaaccagt

SEQ ID NO: 3181771 - DNA, 19 bp, Homo sapiens
tcttcaactgaccagcctc

SEQ ID NO: 3181772 - DNA, 20 bp, Homo sapiens
tcttcaagccagctctaggc

SEQ ID NO: 3181773 - DNA, 17 bp, Homo sapiens
tcttcaagcctgggcgt

SEQ ID NO: 3181774 - DNA, 15 bp, Homo sapiens
tcttcaagctgtccc

SEQ ID NO: 3181775 - DNA, 19 bp, Homo sapiens
tcttcaagggaagaaacac

SEQ ID NO: 3181776 - DNA, 15 bp, Homo sapiens
tcttcaatgatcaaa

SEQ ID NO: 3181777 - DNA, 18 bp, Homo sapiens
tcttcaatttattactga

SEQ ID NO: 3181778 - DNA, 18 bp, Homo sapiens
tcttcacagctctgtgtt

SEQ ID NO: 3181779 - DNA, 20 bp, Homo sapiens
tcttcacccagctaatctgt

SEQ ID NO: 3181780 - DNA, 15 bp, Homo sapiens
tcttcaccccggcag

SEQ ID NO: 3181781 - DNA, 17 bp, Homo sapiens
tcttcaccccggcaggc

SEQ ID NO: 3181782 - DNA, 18 bp, Homo sapiens
tcttcaccccggcaggcc

SEQ ID NO: 3181783 - DNA, 23 bp, Homo sapiens
tcttcaccccggcaggccctgca

SEQ ID NO: 3181784 - DNA, 17 bp, Homo sapiens
tcttcacctctatccaa

SEQ ID NO: 3181785 - DNA, 14 bp, Homo sapiens
tcttcacctgccac

SEQ ID NO: 3181786 - DNA, 15 bp, Homo sapiens
tcttcacctgccacc

SEQ ID NO: 3181787 - DNA, 16 bp, Homo sapiens
tcttcacctgttatgt

SEQ ID NO: 3181788 - DNA, 16 bp, Homo sapiens
tcttcactcaaatttt

SEQ ID NO: 3181789 - DNA, 18 bp, Homo sapiens
tcttcactctctgaagat

SEQ ID NO: 3181790 - DNA, 14 bp, Homo sapiens
tcttcactcttagg

SEQ ID NO: 3181791 - DNA, 20 bp, Homo sapiens
tcttcactgcaattttgtgt

SEQ ID NO: 3181792 - DNA, 13 bp, Homo sapiens
tcttcactggctt

SEQ ID NO: 3181793 - DNA, 19 bp, Homo sapiens
tcttcactgtggccacagc

SEQ ID NO: 3181794 - DNA, 17 bp, Homo sapiens
tcttcagaactgccctt

SEQ ID NO: 3181795 - DNA, 20 bp, Homo sapiens
tcttcagaactgcccttgct

SEQ ID NO: 3181796 - DNA, 20 bp, Homo sapiens
tcttcagactctcagcccag

SEQ ID NO: 3181797 - DNA, 21 bp, Homo sapiens
tcttcagccccttctcccctc

SEQ ID NO: 3181798 - DNA, 14 bp, Homo sapiens
tcttcaggcctccc

SEQ ID NO: 3181799 - DNA, 16 bp, Homo sapiens
tcttcagtcagaaaac

SEQ ID NO: 3181800 - DNA, 20 bp, Homo sapiens
tcttcagtgactcctgctgg

SEQ ID NO: 3181801 - DNA, 21 bp, Homo sapiens
tcttcagtgactcctgctggt

SEQ ID NO: 3181802 - DNA, 18 bp, Homo sapiens
tcttcagtgcaaattgta

SEQ ID NO: 3181803 - DNA, 19 bp, Homo sapiens
tcttcagtgcaaattgtat

SEQ ID NO: 3181804 - DNA, 18 bp, Homo sapiens
tcttcagttttatcttta

SEQ ID NO: 3181805 - DNA, 19 bp, Homo sapiens
tcttcagttttatctttaa

SEQ ID NO: 3181806 - DNA, 21 bp, Homo sapiens
tcttcatattctaaaaccatt

SEQ ID NO: 3181807 - DNA, 17 bp, Homo sapiens
tcttcatgcaatgacat

SEQ ID NO: 3181808 - DNA, 16 bp, Homo sapiens
tcttcatttcattgta

SEQ ID NO: 3181809 - DNA, 15 bp, Homo sapiens
tcttcattttggttt

SEQ ID NO: 3181810 - DNA, 18 bp, Homo sapiens
tcttccaagcaaaggtga

SEQ ID NO: 3181811 - DNA, 20 bp, Homo sapiens
tcttccacaaaaaatacttt

SEQ ID NO: 3181812 - DNA, 19 bp, Homo sapiens
tcttccacctgtgccctca

SEQ ID NO: 3181813 - DNA, 13 bp, Homo sapiens
tcttccagacctg

SEQ ID NO: 3181814 - DNA, 14 bp, Homo sapiens
tcttccagacctgc

SEQ ID NO: 3181815 - DNA, 20 bp, Homo sapiens
tcttccagctgcttcaggga

SEQ ID NO: 3181816 - DNA, 18 bp, Homo sapiens
tcttccagtcttcctgac

SEQ ID NO: 3181817 - DNA, 21 bp, Homo sapiens
tcttccagtcttcctgacact

SEQ ID NO: 3181818 - DNA, 12 bp, Homo sapiens
tcttccataatg

SEQ ID NO: 3181819 - DNA, 16 bp, Homo sapiens
tcttccataatgtata

SEQ ID NO: 3181820 - DNA, 21 bp, Homo sapiens
tcttccatgtgaacagcataa

SEQ ID NO: 3181821 - DNA, 22 bp, Homo sapiens
tcttcccatgactgcacccagc

SEQ ID NO: 3181822 - DNA, 15 bp, Homo sapiens
tcttccccaccgcag

SEQ ID NO: 3181823 - DNA, 19 bp, Homo sapiens
tcttccccactccccacct

SEQ ID NO: 3181824 - DNA, 14 bp, Homo sapiens
tcttccctacctca

SEQ ID NO: 3181825 - DNA, 10 bp, Homo sapiens
tcttccctcc

SEQ ID NO: 3181826 - DNA, 21 bp, Homo sapiens
tcttccgaatgggttttctat

SEQ ID NO: 3181827 - DNA, 16 bp, Homo sapiens
tcttccggagatgtag

SEQ ID NO: 3181828 - DNA, 18 bp, Homo sapiens
tcttccggagatgtagca

SEQ ID NO: 3181829 - DNA, 17 bp, Homo sapiens
tcttcctacctatccca

SEQ ID NO: 3181830 - DNA, 21 bp, Homo sapiens
tcttcctagttttctcctccc

SEQ ID NO: 3181831 - DNA, 15 bp, Homo sapiens
tcttcctccagctgc

SEQ ID NO: 3181832 - DNA, 17 bp, Homo sapiens
tcttcctccgaggccag

SEQ ID NO: 3181833 - DNA, 20 bp, Homo sapiens
tgaaaatgtgctatactgca

SEQ ID NO: 3181834 - DNA, 21 bp, Homo sapiens
tgaaaatgtgctatactgcat

SEQ ID NO: 3181835 - DNA, 12 bp, Homo sapiens
tgaaaatgtgtt

SEQ ID NO: 3181836 - DNA, 21 bp, Homo sapiens
tgaaaattattttaaacaaaa

SEQ ID NO: 3181837 - DNA, 20 bp, Homo sapiens
tgaaaattcgcccgagctgt

SEQ ID NO: 3181838 - DNA, 13 bp, Homo sapiens
tgaaaattctgtt

SEQ ID NO: 3181839 - DNA, 16 bp, Homo sapiens
tgaaaattgaaaagta

SEQ ID NO: 3181840 - DNA, 19 bp, Homo sapiens
tgaaacaaaaattgtcttt

SEQ ID NO: 3181841 - DNA, 11 bp, Homo sapiens
tgaaacaatgt

SEQ ID NO: 3181842 - DNA, 22 bp, Homo sapiens
tgaaacacaccaggctgtgggc

SEQ ID NO: 3181843 - DNA, 21 bp, Homo sapiens
tgaaacacagctgttcttctg

SEQ ID NO: 3181844 - DNA, 17 bp, Homo sapiens
tgaaacacgaaacttgt

SEQ ID NO: 3181845 - DNA, 15 bp, Homo sapiens
tgaaacactttgcct

SEQ ID NO: 3181846 - DNA, 20 bp, Homo sapiens
tgaaacactttgcctcctgt

SEQ ID NO: 3181847 - DNA, 17 bp, Homo sapiens
tgaaacagcctctgcaa

SEQ ID NO: 3181848 - DNA, 22 bp, Homo sapiens
tgaaacagcctctgcaagattt

SEQ ID NO: 3181849 - DNA, 21 bp, Homo sapiens
tgaaacattcacacagggctc

SEQ ID NO: 3181850 - DNA, 18 bp, Homo sapiens
tgaaacattccgaagagg

SEQ ID NO: 3181851 - DNA, 12 bp, Homo sapiens
tgaaaccaaaac

SEQ ID NO: 3181852 - DNA, 15 bp, Homo sapiens
tgaaaccatgactgt

SEQ ID NO: 3181853 - DNA, 19 bp, Homo sapiens
tgaaacctagtactgcccc

SEQ ID NO: 3181854 - DNA, 15 bp, Homo sapiens
tgaaacctctgcctt

SEQ ID NO: 3181855 - DNA, 16 bp, Homo sapiens
tgaaaccttttttaag

SEQ ID NO: 3181856 - DNA, 18 bp, Homo sapiens
tgaaaccttttttaagat

SEQ ID NO: 3181857 - DNA, 23 bp, Homo sapiens
tgaaaccttttttaagatttttc

SEQ ID NO: 3181858 - DNA, 17 bp, Homo sapiens
tgaaacctttttttatc

SEQ ID NO: 3181859 - DNA, 16 bp, Homo sapiens
tgaaactcacaaatga

SEQ ID NO: 3181860 - DNA, 17 bp, Homo sapiens
tgaaactcacaaatgat

SEQ ID NO: 3181861 - DNA, 16 bp, Homo sapiens
tgaaactctacattta

SEQ ID NO: 3181862 - DNA, 18 bp, Homo sapiens
tgaaactggcactgaatt

SEQ ID NO: 3181863 - DNA, 22 bp, Homo sapiens
tgaaactggttttaagtgcttt

SEQ ID NO: 3181864 - DNA, 18 bp, Homo sapiens
tgaaactgtcataatggt

SEQ ID NO: 3181865 - DNA, 15 bp, Homo sapiens
tgaaacttcataaat

SEQ ID NO: 3181866 - DNA, 15 bp, Homo sapiens
tgaaactttgggaaa

SEQ ID NO: 3181867 - DNA, 22 bp, Homo sapiens
tgaaactttgggaaaacatgtt

SEQ ID NO: 3181868 - DNA, 23 bp, Homo sapiens
tgaaactttgggaaaacatgtta

SEQ ID NO: 3181869 - DNA, 15 bp, Homo sapiens
tgaaagaaaattgag

SEQ ID NO: 3181870 - DNA, 14 bp, Homo sapiens
tgaaagaaacagtt

SEQ ID NO: 3181871 - DNA, 20 bp, Homo sapiens
tgaaagaaagctgagaagaa

SEQ ID NO: 3181872 - DNA, 12 bp, Homo sapiens
tgaaagaagcaa

SEQ ID NO: 3181873 - DNA, 14 bp, Homo sapiens
tgaaagaagcaaga

SEQ ID NO: 3181874 - DNA, 15 bp, Homo sapiens
tgaaagaagcaagac

SEQ ID NO: 3181875 - DNA, 14 bp, Homo sapiens
tgaaagaatatatt

SEQ ID NO: 3181876 - DNA, 14 bp, Homo sapiens
tgaaagacctgaat

SEQ ID NO: 3181877 - DNA, 22 bp, Homo sapiens
tgaaagacctgaataccactta

SEQ ID NO: 3181878 - DNA, 17 bp, Homo sapiens
tgaaagaccttctccaa

SEQ ID NO: 3181879 - DNA, 19 bp, Homo sapiens
tgaaagactgtacaaagta

SEQ ID NO: 3181880 - DNA, 19 bp, Homo sapiens
tgaaagagttaagaatgtc

SEQ ID NO: 3181881 - DNA, 22 bp, Homo sapiens
tgaaagatggctgtgcctctgc

SEQ ID NO: 3181882 - DNA, 21 bp, Homo sapiens
tgaaagcacaggagacactgt

SEQ ID NO: 3181883 - DNA, 14 bp, Homo sapiens
tgaaagcagcagct

SEQ ID NO: 3181884 - DNA, 22 bp, Homo sapiens
tgaaagcagggaatttctatct

SEQ ID NO: 3181885 - DNA, 17 bp, Homo sapiens
tgaaagcatccatgtgt

SEQ ID NO: 3181886 - DNA, 23 bp, Homo sapiens
tgaaagccagctgccgaccagag

SEQ ID NO: 3181887 - DNA, 22 bp, Homo sapiens
tgaaagccttagggaagctggc

SEQ ID NO: 3181888 - DNA, 17 bp, Homo sapiens
tgaaagctctgttgcaa

SEQ ID NO: 3181889 - DNA, 20 bp, Homo sapiens
tgaaagctgagaactcctga

SEQ ID NO: 3181890 - DNA, 18 bp, Homo sapiens
tgaaagctgattactgtc

SEQ ID NO: 3181891 - DNA, 16 bp, Homo sapiens
tgaaagctgatttttt

SEQ ID NO: 3181892 - DNA, 11 bp, Homo sapiens
tgaaagctgtg

SEQ ID NO: 3181893 - DNA, 22 bp, Homo sapiens
tgaaaggaagagctaataaatc

SEQ ID NO: 3181894 - DNA, 18 bp, Homo sapiens
tgaaaggaagctccactg

SEQ ID NO: 3181895 - DNA, 23 bp, Homo sapiens
tgaaaggcagggcccttggggct

SEQ ID NO: 3181896 - DNA, 22 bp, Homo sapiens
tgaaagggagctatcaggaaca

SEQ ID NO: 3181897 - DNA, 13 bp, Homo sapiens
tgaaagggcccag

SEQ ID NO: 3181898 - DNA, 15 bp, Homo sapiens
tgaaagggcccagag

SEQ ID NO: 3181899 - DNA, 16 bp, Homo sapiens
tgaaagggcccagaga

SEQ ID NO: 3181900 - DNA, 19 bp, Homo sapiens
tgaaagggctatggcaagg

SEQ ID NO: 3181901 - DNA, 18 bp, Homo sapiens
tgaaaggttttttttcag

SEQ ID NO: 3181902 - DNA, 17 bp, Homo sapiens
tgaaagttttccagtat

SEQ ID NO: 3181903 - DNA, 21 bp, Homo sapiens
tgaaagttttccagtattgaa

SEQ ID NO: 3181904 - DNA, 16 bp, Homo sapiens
tgaaataaaacaggac

SEQ ID NO: 3181905 - DNA, 12 bp, Homo sapiens
tgaaataaacac

SEQ ID NO: 3181906 - DNA, 15 bp, Homo sapiens
tgaaataaacactgg

SEQ ID NO: 3181907 - DNA, 20 bp, Homo sapiens
tgaaataaagaaattgcaat

SEQ ID NO: 3181908 - DNA, 22 bp, Homo sapiens
tgaaataaagaatttaaagaat

SEQ ID NO: 3181909 - DNA, 20 bp, Homo sapiens
tgaaataactggaacaaatt

SEQ ID NO: 3181910 - DNA, 23 bp, Homo sapiens
tgaaataccacaagcctgagaac

SEQ ID NO: 3181911 - DNA, 16 bp, Homo sapiens
tgaaataccagtgtgg

SEQ ID NO: 3181912 - DNA, 12 bp, Homo sapiens
tgaaatacctca

SEQ ID NO: 3181913 - DNA, 13 bp, Homo sapiens
tgaaatacctcat

SEQ ID NO: 3181914 - DNA, 22 bp, Homo sapiens
tgaaatacctcatgtttatgaa

SEQ ID NO: 3181915 - DNA, 11 bp, Homo sapiens
tgaaatacctt

SEQ ID NO: 3181916 - DNA, 17 bp, Homo sapiens
tgaaatactaaaagcaa

SEQ ID NO: 3181917 - DNA, 20 bp, Homo sapiens
tgaaatactttttaacaaaa

SEQ ID NO: 3181918 - DNA, 15 bp, Homo sapiens
tgaaatcatcaaaaa

SEQ ID NO: 3181919 - DNA, 18 bp, Homo sapiens
tgaaatccttgactggac

SEQ ID NO: 3181920 - DNA, 13 bp, Homo sapiens
tgaaatgaaaaca

SEQ ID NO: 3181921 - DNA, 14 bp, Homo sapiens
tgaaatgaaaacat

SEQ ID NO: 3181922 - DNA, 19 bp, Homo sapiens
tgaaatgaaaacatgtaat

SEQ ID NO: 3181923 - DNA, 17 bp, Homo sapiens
tgaaatgaaatttaaac

SEQ ID NO: 3181924 - DNA, 21 bp, Homo sapiens
tgaaatgagcatgcattttct

SEQ ID NO: 3181925 - DNA, 23 bp, Homo sapiens
tgaaatgaggtcagagcctgcag

SEQ ID NO: 3181926 - DNA, 20 bp, Homo sapiens
tgaaatgcatcaggtccttt

SEQ ID NO: 3181927 - DNA, 17 bp, Homo sapiens
tgaaatgccctcctaaa

SEQ ID NO: 3181928 - DNA, 19 bp, Homo sapiens
tgaaatgggagatggtcag

SEQ ID NO: 3181929 - DNA, 21 bp, Homo sapiens
tgaaatgtttggattctctta

SEQ ID NO: 3181930 - DNA, 19 bp, Homo sapiens
tgaaattaacacaaaggaa

SEQ ID NO: 3181931 - DNA, 21 bp, Homo sapiens
tgaaattaagaaggcaaaaat

SEQ ID NO: 3181932 - DNA, 23 bp, Homo sapiens
tgaaattaagaaggcaaaaatgt

SEQ ID NO: 3181933 - DNA, 20 bp, Homo sapiens
tgaaattactacaaaatttg

SEQ ID NO: 3181934 - DNA, 23 bp, Homo sapiens
tgaaattactacaaaatttgaaa

SEQ ID NO: 3181935 - DNA, 18 bp, Homo sapiens
tgaaattatgtatgttta

SEQ ID NO: 3181936 - DNA, 19 bp, Homo sapiens
tgaaattatgtatgtttac

SEQ ID NO: 3181937 - DNA, 14 bp, Homo sapiens
tgaaattattttct

SEQ ID NO: 3181938 - DNA, 17 bp, Homo sapiens
tgaaattccaaagtctc

SEQ ID NO: 3181939 - DNA, 19 bp, Homo sapiens
tgaaattccaaagtctcta

SEQ ID NO: 3181940 - DNA, 13 bp, Homo sapiens
tgaaattctaaag

SEQ ID NO: 3181941 - DNA, 13 bp, Homo sapiens
tgaaattctattt

SEQ ID NO: 3181942 - DNA, 17 bp, Homo sapiens
tgaaattgtacatattt

SEQ ID NO: 3181943 - DNA, 22 bp, Homo sapiens
tgaaattgtctagcagagcagg

SEQ ID NO: 3181944 - DNA, 23 bp, Homo sapiens
tgaaattgtttaagtgttgtaaa

SEQ ID NO: 3181945 - DNA, 22 bp, Homo sapiens
tgaaatttaaacattaaaaatg

SEQ ID NO: 3181946 - DNA, 17 bp, Homo sapiens
tgaaatttattcacata

SEQ ID NO: 3181947 - DNA, 22 bp, Homo sapiens
tgaaatttcagattcccagagc

SEQ ID NO: 3181948 - DNA, 22 bp, Homo sapiens
tgaaattttaacctatgatatt

SEQ ID NO: 3181949 - DNA, 16 bp, Homo sapiens
tgaaattttagaaata

SEQ ID NO: 3181950 - DNA, 22 bp, Homo sapiens
tgaaattttatatgcttactga

SEQ ID NO: 3181951 - DNA, 19 bp, Homo sapiens
tgaaattttctagactttc

SEQ ID NO: 3181952 - DNA, 21 bp, Homo sapiens
tgaaattttctagactttctg

SEQ ID NO: 3181953 - DNA, 12 bp, Homo sapiens
tgaaattttgca

SEQ ID NO: 3181954 - DNA, 22 bp, Homo sapiens
tgaaattttgcaaatataaaca

SEQ ID NO: 3181955 - DNA, 18 bp, Homo sapiens
tgaacaaaaaataaaaat

SEQ ID NO: 3181956 - DNA, 13 bp, Homo sapiens
tgaacaaactaaa

SEQ ID NO: 3181957 - DNA, 19 bp, Homo sapiens
tgaacaagttttaatgtat

SEQ ID NO: 3181958 - DNA, 16 bp, Homo sapiens
tgacctcccagcccta

SEQ ID NO: 3181959 - DNA, 22 bp, Homo sapiens
tgacctcccagccctatggatg

SEQ ID NO: 3181960 - DNA, 22 bp, Homo sapiens
tgacctccctctaatttatctt

SEQ ID NO: 3181961 - DNA, 17 bp, Homo sapiens
tgacctcgtgatccgcc

SEQ ID NO: 3181962 - DNA, 18 bp, Homo sapiens
tgacctcgtgatccgccc

SEQ ID NO: 3181963 - DNA, 15 bp, Homo sapiens
tgacctctataaact

SEQ ID NO: 3181964 - DNA, 13 bp, Homo sapiens
tgacctctcaggg

SEQ ID NO: 3181965 - DNA, 14 bp, Homo sapiens
tgacctctcagggc

SEQ ID NO: 3181966 - DNA, 17 bp, Homo sapiens
tgacctctcagggcctg

SEQ ID NO: 3181967 - DNA, 20 bp, Homo sapiens
tgacctctcagggcctggca

SEQ ID NO: 3181968 - DNA, 15 bp, Homo sapiens
tgacctcttgctgtc

SEQ ID NO: 3181969 - DNA, 23 bp, Homo sapiens
tgacctgaggagacatctacaca

SEQ ID NO: 3181970 - DNA, 15 bp, Homo sapiens
tgacctgaggctgtg

SEQ ID NO: 3181971 - DNA, 17 bp, Homo sapiens
tgacctgaggctgtggt

SEQ ID NO: 3181972 - DNA, 13 bp, Homo sapiens
tgacctgatttca

SEQ ID NO: 3181973 - DNA, 20 bp, Homo sapiens
tgacctgccccgcccagctg

SEQ ID NO: 3181974 - DNA, 15 bp, Homo sapiens
tgacctgcctctcac

SEQ ID NO: 3181975 - DNA, 21 bp, Homo sapiens
tgacctgcctctcacacacat

SEQ ID NO: 3181976 - DNA, 15 bp, Homo sapiens
tgacctgctccgctg

SEQ ID NO: 3181977 - DNA, 21 bp, Homo sapiens
tgacctgctgggtaaactgtg

SEQ ID NO: 3181978 - DNA, 12 bp, Homo sapiens
tgacctgtcacc

SEQ ID NO: 3181979 - DNA, 16 bp, Homo sapiens
tgacctgtcatgcccc

SEQ ID NO: 3181980 - DNA, 20 bp, Homo sapiens
tgacctgtcatgcccccctc

SEQ ID NO: 3181981 - DNA, 15 bp, Homo sapiens
tgacctgtgaccagc

SEQ ID NO: 3181982 - DNA, 22 bp, Homo sapiens
tgacctgtgaccagcactgtct

SEQ ID NO: 3181983 - DNA, 16 bp, Homo sapiens
tgacctgtttctctgc

SEQ ID NO: 3181984 - DNA, 11 bp, Homo sapiens
tgaccttcctc

SEQ ID NO: 3181985 - DNA, 14 bp, Homo sapiens
tgaccttcctctgg

SEQ ID NO: 3181986 - DNA, 19 bp, Homo sapiens
tgaccttggagagacacag

SEQ ID NO: 3181987 - DNA, 15 bp, Homo sapiens
tgacctttgtctaga

SEQ ID NO: 3181988 - DNA, 17 bp, Homo sapiens
tgaccttttcttcattt

SEQ ID NO: 3181989 - DNA, 20 bp, Homo sapiens
tgaccttttgacttaaagca

SEQ ID NO: 3181990 - DNA, 14 bp, Homo sapiens
tgacgaagtctctt

SEQ ID NO: 3181991 - DNA, 20 bp, Homo sapiens
tgacgacaagtgctgaacag

SEQ ID NO: 3181992 - DNA, 18 bp, Homo sapiens
tgacgcagacagagggga

SEQ ID NO: 3181993 - DNA, 23 bp, Homo sapiens
tgacgccctgcgttggagccact

SEQ ID NO: 3181994 - DNA, 12 bp, Homo sapiens
tgacggccctgc

SEQ ID NO: 3181995 - DNA, 15 bp, Homo sapiens
tgacggccctgcaat

SEQ ID NO: 3181996 - DNA, 15 bp, Homo sapiens
tgacgggaggcccca

SEQ ID NO: 3181997 - DNA, 17 bp, Homo sapiens
tgacggggcagtcagat

SEQ ID NO: 3181998 - DNA, 19 bp, Homo sapiens
tgacgtcaagtctccttcc

SEQ ID NO: 3181999 - DNA, 18 bp, Homo sapiens
tgacgtgcacctgtactc

SEQ ID NO: 3182000 - DNA, 16 bp, Homo sapiens
tgacgtgccttttgca

SEQ ID NO: 3182001 - DNA, 23 bp, Homo sapiens
tgacgtggagcggggtatgaaga

SEQ ID NO: 3182002 - DNA, 14 bp, Homo sapiens
tgactaaaatattt

SEQ ID NO: 3182003 - DNA, 18 bp, Homo sapiens
tgactaaactttttttct

SEQ ID NO: 3182004 - DNA, 21 bp, Homo sapiens
tgactaaactttttttctgta

SEQ ID NO: 3182005 - DNA, 14 bp, Homo sapiens
tgactaaagctatg

SEQ ID NO: 3182006 - DNA, 16 bp, Homo sapiens
tgactaaagctatgtt

SEQ ID NO: 3182007 - DNA, 15 bp, Homo sapiens
tgactaaattcgtga

SEQ ID NO: 3182008 - DNA, 19 bp, Homo sapiens
tgactaaattcgtgatttt

SEQ ID NO: 3182009 - DNA, 20 bp, Homo sapiens
tgactaactagacaccaaag

SEQ ID NO: 3182010 - DNA, 21 bp, Homo sapiens
tgactaactcaaatacacatt

SEQ ID NO: 3182011 - DNA, 15 bp, Homo sapiens
tgactaattttacat

SEQ ID NO: 3182012 - DNA, 15 bp, Homo sapiens
tgactactttgcctt

SEQ ID NO: 3182013 - DNA, 19 bp, Homo sapiens
tgactagacgttcatttgt

SEQ ID NO: 3182014 - DNA, 23 bp, Homo sapiens
tgactagatgatggatgccaata

SEQ ID NO: 3182015 - DNA, 19 bp, Homo sapiens
tgactagggattcaggctg

SEQ ID NO: 3182016 - DNA, 21 bp, Homo sapiens
tgactagggattcaggctgct

SEQ ID NO: 3182017 - DNA, 16 bp, Homo sapiens
tgactagtacaaatta

SEQ ID NO: 3182018 - DNA, 17 bp, Homo sapiens
tgactagtacaaattat

SEQ ID NO: 3182019 - DNA, 23 bp, Homo sapiens
tgactagtacaaattataaaaag

SEQ ID NO: 3182020 - DNA, 15 bp, Homo sapiens
tgactataaacatta

SEQ ID NO: 3182021 - DNA, 22 bp, Homo sapiens
tgactataaacattaaaagaag

SEQ ID NO: 3182022 - DNA, 16 bp, Homo sapiens
tgactataaccttgtt

SEQ ID NO: 3182023 - DNA, 16 bp, Homo sapiens
tgactatatagagatg

SEQ ID NO: 3182024 - DNA, 18 bp, Homo sapiens
tgactatatagagatgtt

SEQ ID NO: 3182025 - DNA, 19 bp, Homo sapiens
tgactatatagagatgttt

SEQ ID NO: 3182026 - DNA, 23 bp, Homo sapiens
tgactcaacatgttactgaccag

SEQ ID NO: 3182027 - DNA, 15 bp, Homo sapiens
tgactcaagaagtga

SEQ ID NO: 3182028 - DNA, 22 bp, Homo sapiens
tgactcaagaagtgaagaatgc

SEQ ID NO: 3182029 - DNA, 22 bp, Homo sapiens
tgactcacaggccctggagaag

SEQ ID NO: 3182030 - DNA, 18 bp, Homo sapiens
tgactcacttatcccaag

SEQ ID NO: 3182031 - DNA, 13 bp, Homo sapiens
tgactcagaggct

SEQ ID NO: 3182032 - DNA, 18 bp, Homo sapiens
tgactcaggcgcctggca

SEQ ID NO: 3182033 - DNA, 21 bp, Homo sapiens
tgactcaggcgcctggcacat

SEQ ID NO: 3182034 - DNA, 19 bp, Homo sapiens
tgactccaagaacaattgt

SEQ ID NO: 3182035 - DNA, 19 bp, Homo sapiens
tgactccaccttctcacct

SEQ ID NO: 3182036 - DNA, 20 bp, Homo sapiens
tgactccacgatcctgccac

SEQ ID NO: 3182037 - DNA, 21 bp, Homo sapiens
tgactccacgatcctgccacc

SEQ ID NO: 3182038 - DNA, 15 bp, Homo sapiens
tgactccctgtgggg

SEQ ID NO: 3182039 - DNA, 16 bp, Homo sapiens
tgactccctgtggggg

SEQ ID NO: 3182040 - DNA, 23 bp, Homo sapiens
tgactccctgtgggggtggccat

SEQ ID NO: 3182041 - DNA, 22 bp, Homo sapiens
tgactcccttaaaatagaaata

SEQ ID NO: 3182042 - DNA, 18 bp, Homo sapiens
tgactcctacctgccctg

SEQ ID NO: 3182043 - DNA, 19 bp, Homo sapiens
tgactcctacctgccctgg

SEQ ID NO: 3182044 - DNA, 17 bp, Homo sapiens
tgactcctgctggtacc

SEQ ID NO: 3182045 - DNA, 22 bp, Homo sapiens
tgactcctgctggtacctgccc

SEQ ID NO: 3182046 - DNA, 13 bp, Homo sapiens
tgactcgccataa

SEQ ID NO: 3182047 - DNA, 22 bp, Homo sapiens
tgactcgccataaatcagccgc

SEQ ID NO: 3182048 - DNA, 18 bp, Homo sapiens
tgactcgggggtggggaa

SEQ ID NO: 3182049 - DNA, 16 bp, Homo sapiens
tgactcggtttctcca

SEQ ID NO: 3182050 - DNA, 15 bp, Homo sapiens
tgactcgtgctgcat

SEQ ID NO: 3182051 - DNA, 15 bp, Homo sapiens
tgactctccagggag

SEQ ID NO: 3182052 - DNA, 15 bp, Homo sapiens
tgactctgaaatctg

SEQ ID NO: 3182053 - DNA, 16 bp, Homo sapiens
tgactctgaaatctga

SEQ ID NO: 3182054 - DNA, 18 bp, Homo sapiens
tgactctgagtccactgc

SEQ ID NO: 3182055 - DNA, 17 bp, Homo sapiens
tgactctggcaaagctt

SEQ ID NO: 3182056 - DNA, 21 bp, Homo sapiens
tgactgaaaaaaaaaaagaag

SEQ ID NO: 3182057 - DNA, 22 bp, Homo sapiens
tgactgaaaaaaaaaaagaaga

SEQ ID NO: 3182058 - DNA, 15 bp, Homo sapiens
tgactgaaggaaaag

SEQ ID NO: 3182059 - DNA, 18 bp, Homo sapiens
tgactgcacccagctcca

SEQ ID NO: 3182060 - DNA, 19 bp, Homo sapiens
tgactgcacccagctccag

SEQ ID NO: 3182061 - DNA, 14 bp, Homo sapiens
tgactgccaagcca

SEQ ID NO: 3182062 - DNA, 21 bp, Homo sapiens
tgactgccaagccagattctc

SEQ ID NO: 3182063 - DNA, 18 bp, Homo sapiens
tgactgcccattcaccaa

SEQ ID NO: 3182064 - DNA, 21 bp, Homo sapiens
tgactgctccccagccctggc

SEQ ID NO: 3182065 - DNA, 22 bp, Homo sapiens
tgactgctccccagccctggct

SEQ ID NO: 3182066 - DNA, 24 bp, Homo sapiens
tgactggcaagaggcctcatgcct

SEQ ID NO: 3182067 - DNA, 11 bp, Homo sapiens
tgactggcagg

SEQ ID NO: 3182068 - DNA, 19 bp, Homo sapiens
tgactggctgtctgcctgt

SEQ ID NO: 3182069 - DNA, 22 bp, Homo sapiens
tgactggctgtctgcctgtatt

SEQ ID NO: 3182070 - DNA, 17 bp, Homo sapiens
tgactggcttcagcaag

SEQ ID NO: 3182071 - DNA, 14 bp, Homo sapiens
tgactggggctggg

SEQ ID NO: 3182072 - DNA, 15 bp, Homo sapiens
tgactggggctgggg

SEQ ID NO: 3182073 - DNA, 19 bp, Homo sapiens
tgactggggctggggtgag

SEQ ID NO: 3182074 - DNA, 16 bp, Homo sapiens
tgactggttgttcaaa

SEQ ID NO: 3182075 - DNA, 20 bp, Homo sapiens
tgactggtttacaggccctg

SEQ ID NO: 3182076 - DNA, 16 bp, Homo sapiens
tgactgtactcctccc

SEQ ID NO: 3182077 - DNA, 16 bp, Homo sapiens
tgactgtcactgttcc

SEQ ID NO: 3182078 - DNA, 24 bp, Homo sapiens
tgactgtcctctcccctccagcct

SEQ ID NO: 3182079 - DNA, 18 bp, Homo sapiens
tgactgtgaccaccttct

SEQ ID NO: 3182080 - DNA, 15 bp, Homo sapiens
tgactgttcttggta

SEQ ID NO: 3182081 - DNA, 18 bp, Homo sapiens
tgactgttgatgaagtat

SEQ ID NO: 3182082 - DNA, 15 bp, Homo sapiens
tgactgtttggctta

SEQ ID NO: 3182083 - DNA, 23 bp, Homo sapiens
tgattactggcctttttcattta

SEQ ID NO: 3182084 - DNA, 24 bp, Homo sapiens
tgattactgtcaaggctgcttaga

SEQ ID NO: 3182085 - DNA, 17 bp, Homo sapiens
tgattactgtcaataaa

SEQ ID NO: 3182086 - DNA, 19 bp, Homo sapiens
tgattactgtcaataaaca

SEQ ID NO: 3182087 - DNA, 21 bp, Homo sapiens
tgattagaaggcaagtttcta

SEQ ID NO: 3182088 - DNA, 13 bp, Homo sapiens
tgattagcaagtt

SEQ ID NO: 3182089 - DNA, 15 bp, Homo sapiens
tgattagttaaaaaa

SEQ ID NO: 3182090 - DNA, 16 bp, Homo sapiens
tgattatacaaaagag

SEQ ID NO: 3182091 - DNA, 22 bp, Homo sapiens
tgattatgtcttttatatttgt

SEQ ID NO: 3182092 - DNA, 14 bp, Homo sapiens
tgattattatgttt

SEQ ID NO: 3182093 - DNA, 16 bp, Homo sapiens
tgattattatgtttat

SEQ ID NO: 3182094 - DNA, 15 bp, Homo sapiens
tgattattgtattta

SEQ ID NO: 3182095 - DNA, 21 bp, Homo sapiens
tgattattttcattacaatgg

SEQ ID NO: 3182096 - DNA, 21 bp, Homo sapiens
tgattattttttttttcttct

SEQ ID NO: 3182097 - DNA, 11 bp, Homo sapiens
tgattcaaatg

SEQ ID NO: 3182098 - DNA, 12 bp, Homo sapiens
tgattcactgca

SEQ ID NO: 3182099 - DNA, 13 bp, Homo sapiens
tgattcactgcat

SEQ ID NO: 3182100 - DNA, 18 bp, Homo sapiens
tgattcagaaaatgttct

SEQ ID NO: 3182101 - DNA, 21 bp, Homo sapiens
tgattcagaaaatgttctgtt

SEQ ID NO: 3182102 - DNA, 13 bp, Homo sapiens
tgattcataacaa

SEQ ID NO: 3182103 - DNA, 17 bp, Homo sapiens
tgattcataacaatgta

SEQ ID NO: 3182104 - DNA, 16 bp, Homo sapiens
tgattcatagtaactt

SEQ ID NO: 3182105 - DNA, 22 bp, Homo sapiens
tgattccactacacctggctga

SEQ ID NO: 3182106 - DNA, 21 bp, Homo sapiens
tgattcccaagctctgctcct

SEQ ID NO: 3182107 - DNA, 18 bp, Homo sapiens
tgattccttgagcatttt

SEQ ID NO: 3182108 - DNA, 17 bp, Homo sapiens
tgattctaatgtcttca

SEQ ID NO: 3182109 - DNA, 19 bp, Homo sapiens
tgattctaatgtcttcatt

SEQ ID NO: 3182110 - DNA, 14 bp, Homo sapiens
tgattctattatat

SEQ ID NO: 3182111 - DNA, 16 bp, Homo sapiens
tgattctattatatat

SEQ ID NO: 3182112 - DNA, 19 bp, Homo sapiens
tgattctccttttatgtgt

SEQ ID NO: 3182113 - DNA, 19 bp, Homo sapiens
tgattctctacatgctctt

SEQ ID NO: 3182114 - DNA, 13 bp, Homo sapiens
tgattctctgagt

SEQ ID NO: 3182115 - DNA, 15 bp, Homo sapiens
tgattctgatttcag

SEQ ID NO: 3182116 - DNA, 17 bp, Homo sapiens
tgattctgatttcagtt

SEQ ID NO: 3182117 - DNA, 22 bp, Homo sapiens
tgattctgatttcagtttttca

SEQ ID NO: 3182118 - DNA, 16 bp, Homo sapiens
tgattctgcagtaaat

SEQ ID NO: 3182119 - DNA, 22 bp, Homo sapiens
tgattctgcagtaaatctttta

SEQ ID NO: 3182120 - DNA, 17 bp, Homo sapiens
tgattctggctttaagc

SEQ ID NO: 3182121 - DNA, 21 bp, Homo sapiens
tgattctggctttaagccttc

SEQ ID NO: 3182122 - DNA, 12 bp, Homo sapiens
tgattgcacaga

SEQ ID NO: 3182123 - DNA, 13 bp, Homo sapiens
tgattgcacagaa

SEQ ID NO: 3182124 - DNA, 17 bp, Homo sapiens
tgattgcagaaaggaga

SEQ ID NO: 3182125 - DNA, 13 bp, Homo sapiens
tgattgctgccat

SEQ ID NO: 3182126 - DNA, 23 bp, Homo sapiens
tgattggacattttcttcagaga

SEQ ID NO: 3182127 - DNA, 14 bp, Homo sapiens
tgattggattattc

SEQ ID NO: 3182128 - DNA, 21 bp, Homo sapiens
tgattggcctgtagagttgct

SEQ ID NO: 3182129 - DNA, 17 bp, Homo sapiens
tgattgggaaaacattt

SEQ ID NO: 3182130 - DNA, 20 bp, Homo sapiens
tgattgggaaaacatttgct

SEQ ID NO: 3182131 - DNA, 19 bp, Homo sapiens
tgattggtgcaacccttac

SEQ ID NO: 3182132 - DNA, 15 bp, Homo sapiens
tgattgtactttgaa

SEQ ID NO: 3182133 - DNA, 14 bp, Homo sapiens
tgattgtggaatgg

SEQ ID NO: 3182134 - DNA, 18 bp, Homo sapiens
tgattgtggaatggagat

SEQ ID NO: 3182135 - DNA, 19 bp, Homo sapiens
tgattgttaatttacagct

SEQ ID NO: 3182136 - DNA, 13 bp, Homo sapiens
tgattgtttacag

SEQ ID NO: 3182137 - DNA, 22 bp, Homo sapiens
tgattgtttcttcttcatgctt

SEQ ID NO: 3182138 - DNA, 14 bp, Homo sapiens
tgatttaataaaat

SEQ ID NO: 3182139 - DNA, 17 bp, Homo sapiens
tgatttaataaaataat

SEQ ID NO: 3182140 - DNA, 21 bp, Homo sapiens
tgatttaataaaataattcta

SEQ ID NO: 3182141 - DNA, 16 bp, Homo sapiens
tgatttacagcaagta

SEQ ID NO: 3182142 - DNA, 19 bp, Homo sapiens
tgatttacagcaagtagat

SEQ ID NO: 3182143 - DNA, 13 bp, Homo sapiens
tgatttacatgta

SEQ ID NO: 3182144 - DNA, 14 bp, Homo sapiens
tgatttacatgtat

SEQ ID NO: 3182145 - DNA, 13 bp, Homo sapiens
tgatttatgcatg

SEQ ID NO: 3182146 - DNA, 22 bp, Homo sapiens
tgatttatgcatggaaacctga

SEQ ID NO: 3182147 - DNA, 18 bp, Homo sapiens
tgatttatttctactata

SEQ ID NO: 3182148 - DNA, 15 bp, Homo sapiens
tgatttcaaaatcag

SEQ ID NO: 3182149 - DNA, 17 bp, Homo sapiens
tgatttcactttgggat

SEQ ID NO: 3182150 - DNA, 18 bp, Homo sapiens
tgatttcagaagagactg

SEQ ID NO: 3182151 - DNA, 23 bp, Homo sapiens
tgatttcagtttttcatttgttt

SEQ ID NO: 3182152 - DNA, 16 bp, Homo sapiens
tgatttcatcttctgg

SEQ ID NO: 3182153 - DNA, 12 bp, Homo sapiens
tgatttccaggc

SEQ ID NO: 3182154 - DNA, 20 bp, Homo sapiens
tgatttccaggcccctgagg

SEQ ID NO: 3182155 - DNA, 14 bp, Homo sapiens
tgatttcctaaaca

SEQ ID NO: 3182156 - DNA, 13 bp, Homo sapiens
tgatttccttgaa

SEQ ID NO: 3182157 - DNA, 16 bp, Homo sapiens
tgatttccttgaatgt

SEQ ID NO: 3182158 - DNA, 19 bp, Homo sapiens
tgatttccttgaatgtggc

SEQ ID NO: 3182159 - DNA, 20 bp, Homo sapiens
tgatttctattcaaggtggc

SEQ ID NO: 3182160 - DNA, 21 bp, Homo sapiens
tgatttcttttcttcctggct

SEQ ID NO: 3182161 - DNA, 16 bp, Homo sapiens
tgatttgaaaaatata

SEQ ID NO: 3182162 - DNA, 19 bp, Homo sapiens
tgatttgaagaacatgtga

SEQ ID NO: 3182163 - DNA, 15 bp, Homo sapiens
tgatttgatgtgact

SEQ ID NO: 3182164 - DNA, 14 bp, Homo sapiens
tgatttgcatggat

SEQ ID NO: 3182165 - DNA, 12 bp, Homo sapiens
tgatttgcattg

SEQ ID NO: 3182166 - DNA, 15 bp, Homo sapiens
tgatttgcattgaac

SEQ ID NO: 3182167 - DNA, 15 bp, Homo sapiens
tgatttgtcccagcc

SEQ ID NO: 3182168 - DNA, 14 bp, Homo sapiens
tgatttgttttgaa

SEQ ID NO: 3182169 - DNA, 12 bp, Homo sapiens
tgattttaacaa

SEQ ID NO: 3182170 - DNA, 16 bp, Homo sapiens
tgattttaacaataac

SEQ ID NO: 3182171 - DNA, 20 bp, Homo sapiens
tgattttaggagctaaggct

SEQ ID NO: 3182172 - DNA, 22 bp, Homo sapiens
tgattttaggagctaaggctct

SEQ ID NO: 3182173 - DNA, 15 bp, Homo sapiens
tgattttatctgtga

SEQ ID NO: 3182174 - DNA, 12 bp, Homo sapiens
tgattttatgat

SEQ ID NO: 3182175 - DNA, 18 bp, Homo sapiens
tgattttatgatcagtgt

SEQ ID NO: 3182176 - DNA, 20 bp, Homo sapiens
tgattttcaaagctttttcc

SEQ ID NO: 3182177 - DNA, 22 bp, Homo sapiens
tgattttgcaaaatgagttgtg

SEQ ID NO: 3182178 - DNA, 18 bp, Homo sapiens
tgattttgccccctgagg

SEQ ID NO: 3182179 - DNA, 20 bp, Homo sapiens
tgattttggaaagatgttaa

SEQ ID NO: 3182180 - DNA, 16 bp, Homo sapiens
tgatttttaaagtact

SEQ ID NO: 3182181 - DNA, 22 bp, Homo sapiens
tgatttttgcctcttccagtct

SEQ ID NO: 3182182 - DNA, 13 bp, Homo sapiens
tgatttttgtctc

SEQ ID NO: 3182183 - DNA, 18 bp, Homo sapiens
tgattttttgaaagttaa

SEQ ID NO: 3182184 - DNA, 18 bp, Homo sapiens
tgatttttttaatagtgc

SEQ ID NO: 3182185 - DNA, 13 bp, Homo sapiens
tgatttttttcca

SEQ ID NO: 3182186 - DNA, 16 bp, Homo sapiens
tgatttttttttttca

SEQ ID NO: 3182187 - DNA, 17 bp, Homo sapiens
tgcaaaaaaagcctcca

SEQ ID NO: 3182188 - DNA, 18 bp, Homo sapiens
tgcaaaaaaagcctccaa

SEQ ID NO: 3182189 - DNA, 20 bp, Homo sapiens
tgcaaaaaaagcctccaagg

SEQ ID NO: 3182190 - DNA, 21 bp, Homo sapiens
tgcaaaaaaagcctccaaggg

SEQ ID NO: 3182191 - DNA, 22 bp, Homo sapiens
tgcaaaaaaagcctccaagggt

SEQ ID NO: 3182192 - DNA, 12 bp, Homo sapiens
tgcaaaaaatag

SEQ ID NO: 3182193 - DNA, 23 bp, Homo sapiens
tgcaaaaatatttataaaacttc

SEQ ID NO: 3182194 - DNA, 12 bp, Homo sapiens
tgcaaaaatgga

SEQ ID NO: 3182195 - DNA, 23 bp, Homo sapiens
tgcaaaagactaatttaaaaaat

SEQ ID NO: 3182196 - DNA, 15 bp, Homo sapiens
tgcaaaagcttcaaa

SEQ ID NO: 3182197 - DNA, 14 bp, Homo sapiens
tgcaaaattgtttt

SEQ ID NO: 3182198 - DNA, 15 bp, Homo sapiens
tgcaaaattgttttc

SEQ ID NO: 3182199 - DNA, 16 bp, Homo sapiens
tgcaaaattgttttca

SEQ ID NO: 3182200 - DNA, 18 bp, Homo sapiens
tgcaaaattgttttcact

SEQ ID NO: 3182201 - DNA, 22 bp, Homo sapiens
tgcaaaatttgatgccaggaca

SEQ ID NO: 3182202 - DNA, 22 bp, Homo sapiens
tgcaaacaagaaacgtgtcaca

SEQ ID NO: 3182203 - DNA, 23 bp, Homo sapiens
tgcaaacaatgaagaattatgta

SEQ ID NO: 3182204 - DNA, 17 bp, Homo sapiens
tgcaaacagaacagggt

SEQ ID NO: 3182205 - DNA, 18 bp, Homo sapiens
tgcaaaccttcctgggag

SEQ ID NO: 3182206 - DNA, 20 bp, Homo sapiens
tgcaaacttttttatatctt

SEQ ID NO: 3182207 - DNA, 20 bp, Homo sapiens
tgcaaagaactccagagtca

SEQ ID NO: 3182208 - DNA, 13 bp, Homo sapiens
tgcaaaggcctgg

SEQ ID NO: 3182209 - DNA, 18 bp, Homo sapiens
tgcatgcatgcaaatgag

SEQ ID NO: 3182210 - DNA, 17 bp, Homo sapiens
tgcatgcttctttataa

SEQ ID NO: 3182211 - DNA, 15 bp, Homo sapiens
tgcatggaaacctga

SEQ ID NO: 3182212 - DNA, 19 bp, Homo sapiens
tgcatggaaacctgaaaaa

SEQ ID NO: 3182213 - DNA, 17 bp, Homo sapiens
tgcatggacctaacatt

SEQ ID NO: 3182214 - DNA, 20 bp, Homo sapiens
tgcatggacctaacattcga

SEQ ID NO: 3182215 - DNA, 13 bp, Homo sapiens
tgcatggagcagg

SEQ ID NO: 3182216 - DNA, 16 bp, Homo sapiens
tgcatggaggccctcc

SEQ ID NO: 3182217 - DNA, 17 bp, Homo sapiens
tgcatggattcagcatg

SEQ ID NO: 3182218 - DNA, 20 bp, Homo sapiens
tgcatggctccagaaatgtc

SEQ ID NO: 3182219 - DNA, 17 bp, Homo sapiens
tgcatgtactgtatatt

SEQ ID NO: 3182220 - DNA, 16 bp, Homo sapiens
tgcatgtatgtcttgg

SEQ ID NO: 3182221 - DNA, 16 bp, Homo sapiens
tgcatgtcctgtaaag

SEQ ID NO: 3182222 - DNA, 19 bp, Homo sapiens
tgcatgtgaagcatgcttt

SEQ ID NO: 3182223 - DNA, 23 bp, Homo sapiens
tgcatgtgaagcatgctttgctg

SEQ ID NO: 3182224 - DNA, 21 bp, Homo sapiens
tgcatgtggtttggttcctct

SEQ ID NO: 3182225 - DNA, 22 bp, Homo sapiens
tgcatgtggtttggttcctctc

SEQ ID NO: 3182226 - DNA, 13 bp, Homo sapiens
tgcatgtgtgtat

SEQ ID NO: 3182227 - DNA, 12 bp, Homo sapiens
tgcatgttacta

SEQ ID NO: 3182228 - DNA, 13 bp, Homo sapiens
tgcattaaattca

SEQ ID NO: 3182229 - DNA, 17 bp, Homo sapiens
tgcattaaattcacaaa

SEQ ID NO: 3182230 - DNA, 20 bp, Homo sapiens
tgcattagaaatagacagta

SEQ ID NO: 3182231 - DNA, 19 bp, Homo sapiens
tgcattagcacagatttta

SEQ ID NO: 3182232 - DNA, 22 bp, Homo sapiens
tgcattagggatgcctcctttc

SEQ ID NO: 3182233 - DNA, 22 bp, Homo sapiens
tgcattatatcaaatctaccac

SEQ ID NO: 3182234 - DNA, 23 bp, Homo sapiens
tgcattcacatttagaaaagtga

SEQ ID NO: 3182235 - DNA, 15 bp, Homo sapiens
tgcattcattttctg

SEQ ID NO: 3182236 - DNA, 23 bp, Homo sapiens
tgcattcattttctgacatgcat

SEQ ID NO: 3182237 - DNA, 14 bp, Homo sapiens
tgcattcattttta

SEQ ID NO: 3182238 - DNA, 15 bp, Homo sapiens
tgcattcatttttat

SEQ ID NO: 3182239 - DNA, 20 bp, Homo sapiens
tgcattcatttttatagcaa

SEQ ID NO: 3182240 - DNA, 12 bp, Homo sapiens
tgcattctagta

SEQ ID NO: 3182241 - DNA, 20 bp, Homo sapiens
tgcattctctcccatcctgg

SEQ ID NO: 3182242 - DNA, 19 bp, Homo sapiens
tgcattctgcctctctagg

SEQ ID NO: 3182243 - DNA, 20 bp, Homo sapiens
tgcattctgcctctctagga

SEQ ID NO: 3182244 - DNA, 16 bp, Homo sapiens
tgcattctggatttta

SEQ ID NO: 3182245 - DNA, 15 bp, Homo sapiens
tgcattcttctctgt

SEQ ID NO: 3182246 - DNA, 14 bp, Homo sapiens
tgcattctttggta

SEQ ID NO: 3182247 - DNA, 22 bp, Homo sapiens
tgcattgaacacaaactgtaaa

SEQ ID NO: 3182248 - DNA, 13 bp, Homo sapiens
tgcattgaatata

SEQ ID NO: 3182249 - DNA, 14 bp, Homo sapiens
tgcattgaatatat

SEQ ID NO: 3182250 - DNA, 16 bp, Homo sapiens
tgcattgaatatatta

SEQ ID NO: 3182251 - DNA, 16 bp, Homo sapiens
tgcattgaggaaatat

SEQ ID NO: 3182252 - DNA, 11 bp, Homo sapiens
tgcattgctgg

SEQ ID NO: 3182253 - DNA, 19 bp, Homo sapiens
tgcattgtgattggcctgt

SEQ ID NO: 3182254 - DNA, 17 bp, Homo sapiens
tgcattgttattgtgga

SEQ ID NO: 3182255 - DNA, 19 bp, Homo sapiens
tgcattgttggctatttga

SEQ ID NO: 3182256 - DNA, 22 bp, Homo sapiens
tgcattgttggctatttgaaat

SEQ ID NO: 3182257 - DNA, 12 bp, Homo sapiens
tgcatttaataa

SEQ ID NO: 3182258 - DNA, 15 bp, Homo sapiens
tgcatttaataaaga

SEQ ID NO: 3182259 - DNA, 20 bp, Homo sapiens
tgcatttaataaagatgagt

SEQ ID NO: 3182260 - DNA, 12 bp, Homo sapiens
tgcatttcaaat

SEQ ID NO: 3182261 - DNA, 15 bp, Homo sapiens
tgcatttcaaatgtt

SEQ ID NO: 3182262 - DNA, 16 bp, Homo sapiens
tgcatttcaaatgtta

SEQ ID NO: 3182263 - DNA, 21 bp, Homo sapiens
tgcatttctcttctcagctct

SEQ ID NO: 3182264 - DNA, 18 bp, Homo sapiens
tgcatttctgaatagaaa

SEQ ID NO: 3182265 - DNA, 19 bp, Homo sapiens
tgcatttctgaatagaaat

SEQ ID NO: 3182266 - DNA, 23 bp, Homo sapiens
tgcatttgagagaagccacgctg

SEQ ID NO: 3182267 - DNA, 14 bp, Homo sapiens
tgcatttggcactg

SEQ ID NO: 3182268 - DNA, 16 bp, Homo sapiens
tgcatttgtaaatgct

SEQ ID NO: 3182269 - DNA, 19 bp, Homo sapiens
tgcatttttgtgaaatgaa

SEQ ID NO: 3182270 - DNA, 19 bp, Homo sapiens
tgccaaaattcatttctaa

SEQ ID NO: 3182271 - DNA, 16 bp, Homo sapiens
tgccaaaggatgtgat

SEQ ID NO: 3182272 - DNA, 19 bp, Homo sapiens
tgccaaaggatgtgatata

SEQ ID NO: 3182273 - DNA, 18 bp, Homo sapiens
tgccaaagggaaatatca

SEQ ID NO: 3182274 - DNA, 22 bp, Homo sapiens
tgccaaagtacagaatttgaat

SEQ ID NO: 3182275 - DNA, 16 bp, Homo sapiens
tgccaaataaacagct

SEQ ID NO: 3182276 - DNA, 17 bp, Homo sapiens
tgccaaatatgtcctgg

SEQ ID NO: 3182277 - DNA, 18 bp, Homo sapiens
tgccaacaccacagaaat

SEQ ID NO: 3182278 - DNA, 23 bp, Homo sapiens
tgccaacctgttcttagagtgta

SEQ ID NO: 3182279 - DNA, 16 bp, Homo sapiens
tgccaactaagccctc

SEQ ID NO: 3182280 - DNA, 18 bp, Homo sapiens
tgccaactaagccctcga

SEQ ID NO: 3182281 - DNA, 19 bp, Homo sapiens
tgccaagacaaatcaacag

SEQ ID NO: 3182282 - DNA, 16 bp, Homo sapiens
tgccaaggccagagtg

SEQ ID NO: 3182283 - DNA, 17 bp, Homo sapiens
tgccaagtctcagaaga

SEQ ID NO: 3182284 - DNA, 18 bp, Homo sapiens
tgccaataaaagttttct

SEQ ID NO: 3182285 - DNA, 13 bp, Homo sapiens
tgccaataaagct

SEQ ID NO: 3182286 - DNA, 15 bp, Homo sapiens
tgccaataaagcttt

SEQ ID NO: 3182287 - DNA, 22 bp, Homo sapiens
tgccaataaagcttttggaagc

SEQ ID NO: 3182288 - DNA, 15 bp, Homo sapiens
tgccaatatgtattg

SEQ ID NO: 3182289 - DNA, 21 bp, Homo sapiens
tgccaatgaggtctgaaatgg

SEQ ID NO: 3182290 - DNA, 21 bp, Homo sapiens
tgccaattattgttacacatt

SEQ ID NO: 3182291 - DNA, 13 bp, Homo sapiens
tgccaatttcaag

SEQ ID NO: 3182292 - DNA, 17 bp, Homo sapiens
tgccacaaccagccagg

SEQ ID NO: 3182293 - DNA, 20 bp, Homo sapiens
tgccacacagagtggtcttt

SEQ ID NO: 3182294 - DNA, 21 bp, Homo sapiens
tgccacacagtgacttggccc

SEQ ID NO: 3182295 - DNA, 14 bp, Homo sapiens
tgccacaccctccc

SEQ ID NO: 3182296 - DNA, 14 bp, Homo sapiens
tgccacactctcca

SEQ ID NO: 3182297 - DNA, 12 bp, Homo sapiens
tgccacacttca

SEQ ID NO: 3182298 - DNA, 15 bp, Homo sapiens
tgccacacttcaggc

SEQ ID NO: 3182299 - DNA, 23 bp, Homo sapiens
tgccacacttcaggctcttctcc

SEQ ID NO: 3182300 - DNA, 22 bp, Homo sapiens
tgccacagctggagctctcaaa

SEQ ID NO: 3182301 - DNA, 12 bp, Homo sapiens
tgccacatttct

SEQ ID NO: 3182302 - DNA, 17 bp, Homo sapiens
tgccaccaccctgcccc

SEQ ID NO: 3182303 - DNA, 16 bp, Homo sapiens
tgccaccacctctgtg

SEQ ID NO: 3182304 - DNA, 17 bp, Homo sapiens
tgccaccacgtctgcca

SEQ ID NO: 3182305 - DNA, 14 bp, Homo sapiens
tgccaccagagacc

SEQ ID NO: 3182306 - DNA, 22 bp, Homo sapiens
tgccaccagagaccgtcctcac

SEQ ID NO: 3182307 - DNA, 18 bp, Homo sapiens
tgccaccaggccacctcc

SEQ ID NO: 3182308 - DNA, 17 bp, Homo sapiens
tgccacccaccagggcg

SEQ ID NO: 3182309 - DNA, 13 bp, Homo sapiens
tgccacccacctt

SEQ ID NO: 3182310 - DNA, 17 bp, Homo sapiens
tgccacccactcaggat

SEQ ID NO: 3182311 - DNA, 14 bp, Homo sapiens
tgccaccccatgtg

SEQ ID NO: 3182312 - DNA, 20 bp, Homo sapiens
tgccaccccatgtgccttta

SEQ ID NO: 3182313 - DNA, 14 bp, Homo sapiens
tgccaccctagcca

SEQ ID NO: 3182314 - DNA, 12 bp, Homo sapiens
tgccaccctcac

SEQ ID NO: 3182315 - DNA, 13 bp, Homo sapiens
tgccaccctcaca

SEQ ID NO: 3182316 - DNA, 19 bp, Homo sapiens
tgccaccctggggagaaag

SEQ ID NO: 3182317 - DNA, 20 bp, Homo sapiens
tgccaccctggggagaaagt

SEQ ID NO: 3182318 - DNA, 15 bp, Homo sapiens
tgccacgttccacag

SEQ ID NO: 3182319 - DNA, 19 bp, Homo sapiens
tgccacgttccacagttgc

SEQ ID NO: 3182320 - DNA, 19 bp, Homo sapiens
tgccactaaactacattgt

SEQ ID NO: 3182321 - DNA, 22 bp, Homo sapiens
tgccactacggaatagttggct

SEQ ID NO: 3182322 - DNA, 15 bp, Homo sapiens
tgccactcactaggc

SEQ ID NO: 3182323 - DNA, 17 bp, Homo sapiens
tgccactcactaggccc

SEQ ID NO: 3182324 - DNA, 21 bp, Homo sapiens
tgccactcactaggcccccac

SEQ ID NO: 3182325 - DNA, 22 bp, Homo sapiens
tgccactcactaggcccccact

SEQ ID NO: 3182326 - DNA, 16 bp, Homo sapiens
tgccactccctgagct

SEQ ID NO: 3182327 - DNA, 14 bp, Homo sapiens
tgccactcctccct

SEQ ID NO: 3182328 - DNA, 15 bp, Homo sapiens
tgccactcctccctc

SEQ ID NO: 3182329 - DNA, 14 bp, Homo sapiens
tgccactgcactcc

SEQ ID NO: 3182330 - DNA, 23 bp, Homo sapiens
tgccactgccaggcacctggcct

SEQ ID NO: 3182331 - DNA, 14 bp, Homo sapiens
tgccactgcccccc

SEQ ID NO: 3182332 - DNA, 23 bp, Homo sapiens
tgccactgccccccgaggctgct

SEQ ID NO: 3182333 - DNA, 22 bp, Homo sapiens
tgccactgcccgagctggtgca

SEQ ID NO: 3182334 - DNA, 18 bp, Homo sapiens
tgccactgcctcttcctc

SEQ ID NO: 3182335 - DNA, 15 bp, Homo sapiens
tgcctgtaacttgag

SEQ ID NO: 3182336 - DNA, 17 bp, Homo sapiens
tgcctgtaatcccaact

SEQ ID NO: 3182337 - DNA, 22 bp, Homo sapiens
tgcctgtagagacaatacagta

SEQ ID NO: 3182338 - DNA, 15 bp, Homo sapiens
tgcctgtagcagtga

SEQ ID NO: 3182339 - DNA, 16 bp, Homo sapiens
tgcctgtatactttag

SEQ ID NO: 3182340 - DNA, 15 bp, Homo sapiens
tgcctgtccagcctg

SEQ ID NO: 3182341 - DNA, 19 bp, Homo sapiens
tgcctgtccagcctgggca

SEQ ID NO: 3182342 - DNA, 20 bp, Homo sapiens
tgcctgtccagcctgggcag

SEQ ID NO: 3182343 - DNA, 12 bp, Homo sapiens
tgcctgtctctg

SEQ ID NO: 3182344 - DNA, 15 bp, Homo sapiens
tgcctgtctctgttc

SEQ ID NO: 3182345 - DNA, 19 bp, Homo sapiens
tgcctgtgccacccaccag

SEQ ID NO: 3182346 - DNA, 20 bp, Homo sapiens
tgcctgtgccacccaccagg

SEQ ID NO: 3182347 - DNA, 22 bp, Homo sapiens
tgcctgtggaagagtgtgtgtg

SEQ ID NO: 3182348 - DNA, 23 bp, Homo sapiens
tgcctgtggcgccgtctccaggg

SEQ ID NO: 3182349 - DNA, 15 bp, Homo sapiens
tgcctgtgtatggaa

SEQ ID NO: 3182350 - DNA, 15 bp, Homo sapiens
tgcctgtgtccatgc

SEQ ID NO: 3182351 - DNA, 21 bp, Homo sapiens
tgcctgtgtccatgcgctcag

SEQ ID NO: 3182352 - DNA, 15 bp, Homo sapiens
tgcctgttcagctcc

SEQ ID NO: 3182353 - DNA, 16 bp, Homo sapiens
tgcctgttcagctcca

SEQ ID NO: 3182354 - DNA, 21 bp, Homo sapiens
tgcctgttcagctccagctca

SEQ ID NO: 3182355 - DNA, 13 bp, Homo sapiens
tgccttaaagaaa

SEQ ID NO: 3182356 - DNA, 23 bp, Homo sapiens
tgccttaataagaatggttgcct

SEQ ID NO: 3182357 - DNA, 20 bp, Homo sapiens
tgccttactggtttccccag

SEQ ID NO: 3182358 - DNA, 22 bp, Homo sapiens
tgccttagaaacacataaatta

SEQ ID NO: 3182359 - DNA, 17 bp, Homo sapiens
tgccttaggcctacctg

SEQ ID NO: 3182360 - DNA, 13 bp, Homo sapiens
tgccttcaggaat

SEQ ID NO: 3182361 - DNA, 17 bp, Homo sapiens
tgccttccctagcttta

SEQ ID NO: 3182362 - DNA, 13 bp, Homo sapiens
tgccttcctcatc

SEQ ID NO: 3182363 - DNA, 16 bp, Homo sapiens
tgccttcctcatcccc

SEQ ID NO: 3182364 - DNA, 15 bp, Homo sapiens
tgccttcctgttttt

SEQ ID NO: 3182365 - DNA, 19 bp, Homo sapiens
tgccttcctgtttttcaca

SEQ ID NO: 3182366 - DNA, 21 bp, Homo sapiens
tgccttcgcttcttgcctctg

SEQ ID NO: 3182367 - DNA, 23 bp, Homo sapiens
tgccttcgcttcttgcctctgtg

SEQ ID NO: 3182368 - DNA, 22 bp, Homo sapiens
tgccttcgttaactgtgtatgt

SEQ ID NO: 3182369 - DNA, 19 bp, Homo sapiens
tgccttctcctctctgggc

SEQ ID NO: 3182370 - DNA, 24 bp, Homo sapiens
tgccttctccttccccaggatgga

SEQ ID NO: 3182371 - DNA, 17 bp, Homo sapiens
tgccttctgacggccct

SEQ ID NO: 3182372 - DNA, 13 bp, Homo sapiens
tgccttctgggct

SEQ ID NO: 3182373 - DNA, 12 bp, Homo sapiens
tgccttctgtcc

SEQ ID NO: 3182374 - DNA, 16 bp, Homo sapiens
tgccttcttcacccag

SEQ ID NO: 3182375 - DNA, 12 bp, Homo sapiens
tgccttcttctt

SEQ ID NO: 3182376 - DNA, 22 bp, Homo sapiens
tgccttctttagaccctcgggc

SEQ ID NO: 3182377 - DNA, 12 bp, Homo sapiens
tgccttgaactg

SEQ ID NO: 3182378 - DNA, 13 bp, Homo sapiens
tgccttgaactgt

SEQ ID NO: 3182379 - DNA, 15 bp, Homo sapiens
tgccttgcagaactg

SEQ ID NO: 3182380 - DNA, 19 bp, Homo sapiens
tgccttgcagaactgccat

SEQ ID NO: 3182381 - DNA, 14 bp, Homo sapiens
tgccttgcagccac

SEQ ID NO: 3182382 - DNA, 19 bp, Homo sapiens
tgccttgcagccacatggc

SEQ ID NO: 3182383 - DNA, 21 bp, Homo sapiens
tgccttgcagccacatggccc

SEQ ID NO: 3182384 - DNA, 22 bp, Homo sapiens
tgccttgcagccacatggcccc

SEQ ID NO: 3182385 - DNA, 16 bp, Homo sapiens
tgccttgctcctagca

SEQ ID NO: 3182386 - DNA, 15 bp, Homo sapiens
tgccttgctcggcgc

SEQ ID NO: 3182387 - DNA, 20 bp, Homo sapiens
tgccttgctgtttgtcctga

SEQ ID NO: 3182388 - DNA, 22 bp, Homo sapiens
tgccttgctgtttgtcctgaga

SEQ ID NO: 3182389 - DNA, 13 bp, Homo sapiens
tgccttggctcag

SEQ ID NO: 3182390 - DNA, 16 bp, Homo sapiens
tgccttggctcagaca

SEQ ID NO: 3182391 - DNA, 14 bp, Homo sapiens
tgccttgggccttg

SEQ ID NO: 3182392 - DNA, 22 bp, Homo sapiens
tgccttgggccttgctgctgct

SEQ ID NO: 3182393 - DNA, 17 bp, Homo sapiens
tgccttgggctgctcct

SEQ ID NO: 3182394 - DNA, 19 bp, Homo sapiens
tgccttgggctgctcctca

SEQ ID NO: 3182395 - DNA, 23 bp, Homo sapiens
tgccttggggaggacaaaacttc

SEQ ID NO: 3182396 - DNA, 11 bp, Homo sapiens
tgccttgtata

SEQ ID NO: 3182397 - DNA, 14 bp, Homo sapiens
tgcctttaaatctg

SEQ ID NO: 3182398 - DNA, 12 bp, Homo sapiens
tgcctttaacag

SEQ ID NO: 3182399 - DNA, 23 bp, Homo sapiens
tgcctttaacagaaactttcaaa

SEQ ID NO: 3182400 - DNA, 14 bp, Homo sapiens
tgcctttaagccaa

SEQ ID NO: 3182401 - DNA, 18 bp, Homo sapiens
tgcctttaagccaaagaa

SEQ ID NO: 3182402 - DNA, 21 bp, Homo sapiens
tgcctttatttgctgttaact

SEQ ID NO: 3182403 - DNA, 21 bp, Homo sapiens
tgcctttcaggcccattacct

SEQ ID NO: 3182404 - DNA, 13 bp, Homo sapiens
tgcctttctagtc

SEQ ID NO: 3182405 - DNA, 22 bp, Homo sapiens
tgcctttctgcagtttttcagg

SEQ ID NO: 3182406 - DNA, 14 bp, Homo sapiens
tgcctttcttctgc

SEQ ID NO: 3182407 - DNA, 12 bp, Homo sapiens
tgcctttgagac

SEQ ID NO: 3182408 - DNA, 17 bp, Homo sapiens
tgcctttgagacagttt

SEQ ID NO: 3182409 - DNA, 16 bp, Homo sapiens
tgcctttgcaaatcag

SEQ ID NO: 3182410 - DNA, 13 bp, Homo sapiens
tgcctttgtaagt

SEQ ID NO: 3182411 - DNA, 16 bp, Homo sapiens
tgcctttgtaagttat

SEQ ID NO: 3182412 - DNA, 18 bp, Homo sapiens
tgcctttgtggccttccc

SEQ ID NO: 3182413 - DNA, 15 bp, Homo sapiens
tgccttttgcacccc

SEQ ID NO: 3182414 - DNA, 18 bp, Homo sapiens
tgccttttgcacccctcc

SEQ ID NO: 3182415 - DNA, 17 bp, Homo sapiens
tgccttttgcagaagag

SEQ ID NO: 3182416 - DNA, 14 bp, Homo sapiens
tgccttttgctgcg

SEQ ID NO: 3182417 - DNA, 17 bp, Homo sapiens
tgccttttgctgcgcac

SEQ ID NO: 3182418 - DNA, 19 bp, Homo sapiens
tgcgaactagagatgtgca

SEQ ID NO: 3182419 - DNA, 18 bp, Homo sapiens
tgcgaaggggccctggtc

SEQ ID NO: 3182420 - DNA, 16 bp, Homo sapiens
tgcgactttctgcctg

SEQ ID NO: 3182421 - DNA, 21 bp, Homo sapiens
tgcgactttctgcctggagtg

SEQ ID NO: 3182422 - DNA, 23 bp, Homo sapiens
tgcgaggaccactttggagactg

SEQ ID NO: 3182423 - DNA, 13 bp, Homo sapiens
tgcgatagagtct

SEQ ID NO: 3182424 - DNA, 20 bp, Homo sapiens
tgcgcaccaatgcccagcag

SEQ ID NO: 3182425 - DNA, 19 bp, Homo sapiens
tgcgccacttcctttgtgt

SEQ ID NO: 3182426 - DNA, 20 bp, Homo sapiens
tgcgccacttcctttgtgtt

SEQ ID NO: 3182427 - DNA, 22 bp, Homo sapiens
tgcgccacttcctttgtgttta

SEQ ID NO: 3182428 - DNA, 18 bp, Homo sapiens
tgcgccccgcccacaccc

SEQ ID NO: 3182429 - DNA, 21 bp, Homo sapiens
tgcgccccgcccacaccctcg

SEQ ID NO: 3182430 - DNA, 15 bp, Homo sapiens
tgcgccctgcactcc

SEQ ID NO: 3182431 - DNA, 17 bp, Homo sapiens
tgcgcctcaggctgctg

SEQ ID NO: 3182432 - DNA, 18 bp, Homo sapiens
tgcgcctgtgatgctggg

SEQ ID NO: 3182433 - DNA, 20 bp, Homo sapiens
tgcgcggaggagctagcctg

SEQ ID NO: 3182434 - DNA, 23 bp, Homo sapiens
tgcgcgtgcacgtggagagctgg

SEQ ID NO: 3182435 - DNA, 14 bp, Homo sapiens
tgcgcgtgtgcacg

SEQ ID NO: 3182436 - DNA, 14 bp, Homo sapiens
tgcgctcagggcca

SEQ ID NO: 3182437 - DNA, 19 bp, Homo sapiens
tgcgctcagggccatgctg

SEQ ID NO: 3182438 - DNA, 22 bp, Homo sapiens
tgcgctcagggccatgctgagg

SEQ ID NO: 3182439 - DNA, 23 bp, Homo sapiens
tgcgctcggcaggaaggagcggc

SEQ ID NO: 3182440 - DNA, 21 bp, Homo sapiens
tgcgctcttggtccctggtcc

SEQ ID NO: 3182441 - DNA, 22 bp, Homo sapiens
tgcgctttattgcccatgggat

SEQ ID NO: 3182442 - DNA, 23 bp, Homo sapiens
tgcgctttattgcccatgggata

SEQ ID NO: 3182443 - DNA, 21 bp, Homo sapiens
tgcggacagccacggccaggc

SEQ ID NO: 3182444 - DNA, 22 bp, Homo sapiens
tgcggacagccacggccaggcc

SEQ ID NO: 3182445 - DNA, 13 bp, Homo sapiens
tgcggaccccagc

SEQ ID NO: 3182446 - DNA, 14 bp, Homo sapiens
tgcggaccccagct

SEQ ID NO: 3182447 - DNA, 23 bp, Homo sapiens
tgcggaccccagctgtgagcctt

SEQ ID NO: 3182448 - DNA, 16 bp, Homo sapiens
tgcggaggagctgcct

SEQ ID NO: 3182449 - DNA, 19 bp, Homo sapiens
tgcggaggagctgcctgct

SEQ ID NO: 3182450 - DNA, 15 bp, Homo sapiens
tgcggagtgaagagg

SEQ ID NO: 3182451 - DNA, 13 bp, Homo sapiens
tgcggccccagga

SEQ ID NO: 3182452 - DNA, 16 bp, Homo sapiens
tgcggccccaggaggg

SEQ ID NO: 3182453 - DNA, 14 bp, Homo sapiens
tgcggcgtggagac

SEQ ID NO: 3182454 - DNA, 18 bp, Homo sapiens
tgcggcgtggagactggc

SEQ ID NO: 3182455 - DNA, 21 bp, Homo sapiens
tgcggcgtggagactggcagg

SEQ ID NO: 3182456 - DNA, 16 bp, Homo sapiens
tgcgggagctctgtat

SEQ ID NO: 3182457 - DNA, 16 bp, Homo sapiens
tgcgggcacaataaat

SEQ ID NO: 3182458 - DNA, 17 bp, Homo sapiens
tgcggggcagggccttc

SEQ ID NO: 3182459 - DNA, 17 bp, Homo sapiens
tgcggtccacccaggag

SEQ ID NO: 3182460 - DNA, 12 bp, Homo sapiens
tgctccctcagc

SEQ ID NO: 3182461 - DNA, 17 bp, Homo sapiens
tgctccctcccctgccc

SEQ ID NO: 3182462 - DNA, 18 bp, Homo sapiens
tgctccctcccctgccct

SEQ ID NO: 3182463 - DNA, 13 bp, Homo sapiens
tgctccctgaagc

SEQ ID NO: 3182464 - DNA, 14 bp, Homo sapiens
tgctccctgaagcc

SEQ ID NO: 3182465 - DNA, 15 bp, Homo sapiens
tgctccctgaagcca

SEQ ID NO: 3182466 - DNA, 17 bp, Homo sapiens
tgctccctgaagccagc

SEQ ID NO: 3182467 - DNA, 18 bp, Homo sapiens
tgctccctgaagccagcc

SEQ ID NO: 3182468 - DNA, 20 bp, Homo sapiens
tgctccctgctttggctgag

SEQ ID NO: 3182469 - DNA, 16 bp, Homo sapiens
tgctcccttcagcccc

SEQ ID NO: 3182470 - DNA, 20 bp, Homo sapiens
tgctccgctgctccttggct

SEQ ID NO: 3182471 - DNA, 15 bp, Homo sapiens
tgctccgtgcctcca

SEQ ID NO: 3182472 - DNA, 16 bp, Homo sapiens
tgctccgtgcctccac

SEQ ID NO: 3182473 - DNA, 19 bp, Homo sapiens
tgctccgtgcctccaccac

SEQ ID NO: 3182474 - DNA, 17 bp, Homo sapiens
tgctcctaactccaccg

SEQ ID NO: 3182475 - DNA, 18 bp, Homo sapiens
tgctcctagcagacagaa

SEQ ID NO: 3182476 - DNA, 18 bp, Homo sapiens
tgctcctagtttgacctc

SEQ ID NO: 3182477 - DNA, 15 bp, Homo sapiens
tgctcctccctgccc

SEQ ID NO: 3182478 - DNA, 16 bp, Homo sapiens
tgctcctccctgcccc

SEQ ID NO: 3182479 - DNA, 18 bp, Homo sapiens
tgctcctccctgcccccc

SEQ ID NO: 3182480 - DNA, 19 bp, Homo sapiens
tgctcctccctgcccccca

SEQ ID NO: 3182481 - DNA, 14 bp, Homo sapiens
tgctcctccctggc

SEQ ID NO: 3182482 - DNA, 19 bp, Homo sapiens
tgctcctcctgccctgtcc

SEQ ID NO: 3182483 - DNA, 13 bp, Homo sapiens
tgctcctgcagca

SEQ ID NO: 3182484 - DNA, 17 bp, Homo sapiens
tgctccttggcttacct

SEQ ID NO: 3182485 - DNA, 22 bp, Homo sapiens
tgctccttggcttacctgacct

SEQ ID NO: 3182486 - DNA, 23 bp, Homo sapiens
tgctcgccctcctttctgtgccc

SEQ ID NO: 3182487 - DNA, 20 bp, Homo sapiens
tgctctacaatgacacacaa

SEQ ID NO: 3182488 - DNA, 23 bp, Homo sapiens
tgctctacccatgagcctgcccg

SEQ ID NO: 3182489 - DNA, 13 bp, Homo sapiens
tgctctagccagg

SEQ ID NO: 3182490 - DNA, 14 bp, Homo sapiens
tgctctagccagga

SEQ ID NO: 3182491 - DNA, 12 bp, Homo sapiens
tgctctagctgg

SEQ ID NO: 3182492 - DNA, 14 bp, Homo sapiens
tgctctagctggca

SEQ ID NO: 3182493 - DNA, 13 bp, Homo sapiens
tgctctaggaaga

SEQ ID NO: 3182494 - DNA, 15 bp, Homo sapiens
tgctctaggaagaca

SEQ ID NO: 3182495 - DNA, 19 bp, Homo sapiens
tgctctagggaatctggat

SEQ ID NO: 3182496 - DNA, 14 bp, Homo sapiens
tgctctagtgggac

SEQ ID NO: 3182497 - DNA, 18 bp, Homo sapiens
tgctctagtgggacagcc

SEQ ID NO: 3182498 - DNA, 18 bp, Homo sapiens
tgctctcagcctcccaca

SEQ ID NO: 3182499 - DNA, 19 bp, Homo sapiens
tgctctcagcctcccacaa

SEQ ID NO: 3182500 - DNA, 15 bp, Homo sapiens
tgctctcatatatat

SEQ ID NO: 3182501 - DNA, 18 bp, Homo sapiens
tgctctcccctcccagtc

SEQ ID NO: 3182502 - DNA, 15 bp, Homo sapiens
tgctctcccctgccc

SEQ ID NO: 3182503 - DNA, 20 bp, Homo sapiens
tgctctcccctgccctgctg

SEQ ID NO: 3182504 - DNA, 22 bp, Homo sapiens
tgctctcgcacctttccaaagt

SEQ ID NO: 3182505 - DNA, 17 bp, Homo sapiens
tgctctctcatcttgtt

SEQ ID NO: 3182506 - DNA, 13 bp, Homo sapiens
tgctctctgggct

SEQ ID NO: 3182507 - DNA, 20 bp, Homo sapiens
tgctctctgtggtgcctctc

SEQ ID NO: 3182508 - DNA, 22 bp, Homo sapiens
tgctctgagaagaggagccctc

SEQ ID NO: 3182509 - DNA, 15 bp, Homo sapiens
tgctctgcatgttac

SEQ ID NO: 3182510 - DNA, 17 bp, Homo sapiens
tgctctgccccaagccc

SEQ ID NO: 3182511 - DNA, 12 bp, Homo sapiens
tgctctgcccct

SEQ ID NO: 3182512 - DNA, 14 bp, Homo sapiens
tgctctgctgacag

SEQ ID NO: 3182513 - DNA, 22 bp, Homo sapiens
tgctctgctgacagacacaggc

SEQ ID NO: 3182514 - DNA, 15 bp, Homo sapiens
tgctctggacaggca

SEQ ID NO: 3182515 - DNA, 16 bp, Homo sapiens
tgctctggacaggcat

SEQ ID NO: 3182516 - DNA, 20 bp, Homo sapiens
tgctctgtaggagctaccct

SEQ ID NO: 3182517 - DNA, 17 bp, Homo sapiens
tgctctgtgtatatctc

SEQ ID NO: 3182518 - DNA, 18 bp, Homo sapiens
tgctctgtgtatatctct

SEQ ID NO: 3182519 - DNA, 18 bp, Homo sapiens
tgctctgtgttcccagag

SEQ ID NO: 3182520 - DNA, 19 bp, Homo sapiens
tgctctgtgttcccagagg

SEQ ID NO: 3182521 - DNA, 20 bp, Homo sapiens
tgctctgtgttcccagaggc

SEQ ID NO: 3182522 - DNA, 20 bp, Homo sapiens
tgctcttactacactgagga

SEQ ID NO: 3182523 - DNA, 21 bp, Homo sapiens
tgctcttactacactgaggag

SEQ ID NO: 3182524 - DNA, 17 bp, Homo sapiens
tgctcttatgccatttg

SEQ ID NO: 3182525 - DNA, 18 bp, Homo sapiens
tgctcttgggcctgggga

SEQ ID NO: 3182526 - DNA, 18 bp, Homo sapiens
tgctcttgtttttattaa

SEQ ID NO: 3182527 - DNA, 23 bp, Homo sapiens
tgctctttcccccttccatctct

SEQ ID NO: 3182528 - DNA, 16 bp, Homo sapiens
tgctctttctctgcca

SEQ ID NO: 3182529 - DNA, 18 bp, Homo sapiens
tgctctttctctgccagt

SEQ ID NO: 3182530 - DNA, 22 bp, Homo sapiens
tgctctttctctgccagtgaca

SEQ ID NO: 3182531 - DNA, 19 bp, Homo sapiens
tgctctttgacaactaaaa

SEQ ID NO: 3182532 - DNA, 22 bp, Homo sapiens
tgctctttgacaactaaaatta

SEQ ID NO: 3182533 - DNA, 15 bp, Homo sapiens
tgctcttttctcctc

SEQ ID NO: 3182534 - DNA, 21 bp, Homo sapiens
tgctcttttctcctcactgta

SEQ ID NO: 3182535 - DNA, 20 bp, Homo sapiens
tgctcttttggtggggagca

SEQ ID NO: 3182536 - DNA, 21 bp, Homo sapiens
tgctgaaaaccatctggcctg

SEQ ID NO: 3182537 - DNA, 17 bp, Homo sapiens
tgctgaaattttatatg

SEQ ID NO: 3182538 - DNA, 17 bp, Homo sapiens
tgctgaacgcagaagaa

SEQ ID NO: 3182539 - DNA, 20 bp, Homo sapiens
tgctgaacgcagaagaaagg

SEQ ID NO: 3182540 - DNA, 23 bp, Homo sapiens
tgctgaaggaataaattgctcct

SEQ ID NO: 3182541 - DNA, 21 bp, Homo sapiens
tgctgaagggcattctttccc

SEQ ID NO: 3182542 - DNA, 14 bp, Homo sapiens
tgctgaatatctgt

SEQ ID NO: 3182543 - DNA, 17 bp, Homo sapiens
tgctgaatatctgttca

SEQ ID NO: 3182544 - DNA, 18 bp, Homo sapiens
tgctgaatccacctcgga

SEQ ID NO: 3182545 - DNA, 20 bp, Homo sapiens
tgctgaatccacctcggagc

SEQ ID NO: 3182546 - DNA, 22 bp, Homo sapiens
tgctgaatggttttcaaaataa

SEQ ID NO: 3182547 - DNA, 16 bp, Homo sapiens
tgctgacagacacagg

SEQ ID NO: 3182548 - DNA, 23 bp, Homo sapiens
tgctgacagacacaggcccggct

SEQ ID NO: 3182549 - DNA, 20 bp, Homo sapiens
tgctgacatggctctggact

SEQ ID NO: 3182550 - DNA, 14 bp, Homo sapiens
tgctgactgtactc

SEQ ID NO: 3182551 - DNA, 13 bp, Homo sapiens
tgctgacttttta

SEQ ID NO: 3182552 - DNA, 17 bp, Homo sapiens
tgctgagagcccccacc

SEQ ID NO: 3182553 - DNA, 16 bp, Homo sapiens
tgctgagattcttcag

SEQ ID NO: 3182554 - DNA, 12 bp, Homo sapiens
tgctgagccact

SEQ ID NO: 3182555 - DNA, 14 bp, Homo sapiens
tgctgagcctctgc

SEQ ID NO: 3182556 - DNA, 22 bp, Homo sapiens
tgctgagctgggcccagcccct

SEQ ID NO: 3182557 - DNA, 10 bp, Homo sapiens
tgctgagctt

SEQ ID NO: 3182558 - DNA, 13 bp, Homo sapiens
tgctgaggcctgg

SEQ ID NO: 3182559 - DNA, 14 bp, Homo sapiens
tgctgaggcctggg

SEQ ID NO: 3182560 - DNA, 15 bp, Homo sapiens
tgctgaggcctgggc

SEQ ID NO: 3182561 - DNA, 17 bp, Homo sapiens
tgctgaggcctgggccg

SEQ ID NO: 3182562 - DNA, 19 bp, Homo sapiens
tgctgatcatcgccagagg

SEQ ID NO: 3182563 - DNA, 19 bp, Homo sapiens
tgctgatcgtagaaaattt

SEQ ID NO: 3182564 - DNA, 21 bp, Homo sapiens
tgctgatgaactcttaatcaa

SEQ ID NO: 3182565 - DNA, 19 bp, Homo sapiens
tgctgatgaatcactgttt

SEQ ID NO: 3182566 - DNA, 16 bp, Homo sapiens
tgctgatggcttgaca

SEQ ID NO: 3182567 - DNA, 19 bp, Homo sapiens
tgctgatggcttgacatgt

SEQ ID NO: 3182568 - DNA, 14 bp, Homo sapiens
tgctgatgtcaaag

SEQ ID NO: 3182569 - DNA, 15 bp, Homo sapiens
tgctgcacttcctgt

SEQ ID NO: 3182570 - DNA, 17 bp, Homo sapiens
tgctgcacttcctgttt

SEQ ID NO: 3182571 - DNA, 18 bp, Homo sapiens
tgctgcaggggctctgga

SEQ ID NO: 3182572 - DNA, 15 bp, Homo sapiens
tgctgcatagctcta

SEQ ID NO: 3182573 - DNA, 15 bp, Homo sapiens
tgctgcatgcctggt

SEQ ID NO: 3182574 - DNA, 16 bp, Homo sapiens
tgctgccacacttcag

SEQ ID NO: 3182575 - DNA, 11 bp, Homo sapiens
tgctgccatcc

SEQ ID NO: 3182576 - DNA, 12 bp, Homo sapiens
tgctgccatcca

SEQ ID NO: 3182577 - DNA, 16 bp, Homo sapiens
tgctgccatgccactg

SEQ ID NO: 3182578 - DNA, 22 bp, Homo sapiens
tgctgccatgccactgccaggc

SEQ ID NO: 3182579 - DNA, 13 bp, Homo sapiens
tgctgcccaggcc

SEQ ID NO: 3182580 - DNA, 15 bp, Homo sapiens
tgctgcccccacccc

SEQ ID NO: 3182581 - DNA, 22 bp, Homo sapiens
tgctgcccccaccccggggacc

SEQ ID NO: 3182582 - DNA, 16 bp, Homo sapiens
tgctgccgcctcccag

SEQ ID NO: 3182583 - DNA, 23 bp, Homo sapiens
tgctgcctgcccgcacagcagcc

SEQ ID NO: 3182584 - DNA, 21 bp, Homo sapiens
tgctgcgcaccaatgcccagc

SEQ ID NO: 3182585 - DNA, 18 bp, Homo sapiens
tgctgcgtccccactccc

SEQ ID NO: 3182586 - DNA, 19 bp, Homo sapiens
tggacacaaattttcaagt

SEQ ID NO: 3182587 - DNA, 21 bp, Homo sapiens
tggacacaaattttcaagttt

SEQ ID NO: 3182588 - DNA, 19 bp, Homo sapiens
tggacacaacagcagtctc

SEQ ID NO: 3182589 - DNA, 21 bp, Homo sapiens
tggacacaacagcagtctcct

SEQ ID NO: 3182590 - DNA, 23 bp, Homo sapiens
tggacacaataggtctttctctc

SEQ ID NO: 3182591 - DNA, 13 bp, Homo sapiens
tggacacccctgc

SEQ ID NO: 3182592 - DNA, 16 bp, Homo sapiens
tggacactcagacctg

SEQ ID NO: 3182593 - DNA, 23 bp, Homo sapiens
tggacacttaatactaccttgaa

SEQ ID NO: 3182594 - DNA, 13 bp, Homo sapiens
tggacagacccag

SEQ ID NO: 3182595 - DNA, 14 bp, Homo sapiens
tggacagacccagg

SEQ ID NO: 3182596 - DNA, 23 bp, Homo sapiens
tggacagacccaggtcttccaga

SEQ ID NO: 3182597 - DNA, 15 bp, Homo sapiens
tggacagagaagggc

SEQ ID NO: 3182598 - DNA, 14 bp, Homo sapiens
tggacagccccctt

SEQ ID NO: 3182599 - DNA, 19 bp, Homo sapiens
tggacagcgatgaggggac

SEQ ID NO: 3182600 - DNA, 20 bp, Homo sapiens
tggacaggagtcagtgtctg

SEQ ID NO: 3182601 - DNA, 12 bp, Homo sapiens
tggacaggcatg

SEQ ID NO: 3182602 - DNA, 17 bp, Homo sapiens
tggacaggcatgttctc

SEQ ID NO: 3182603 - DNA, 15 bp, Homo sapiens
tggacagtcctggga

SEQ ID NO: 3182604 - DNA, 22 bp, Homo sapiens
tggacagtgggcatcagcagca

SEQ ID NO: 3182605 - DNA, 20 bp, Homo sapiens
tggacagttcacaccctgca

SEQ ID NO: 3182606 - DNA, 18 bp, Homo sapiens
tggacatttaacttttct

SEQ ID NO: 3182607 - DNA, 18 bp, Homo sapiens
tggacatttgccttgctg

SEQ ID NO: 3182608 - DNA, 19 bp, Homo sapiens
tggacatttgccttgctgg

SEQ ID NO: 3182609 - DNA, 20 bp, Homo sapiens
tggaccaattattgatatat

SEQ ID NO: 3182610 - DNA, 20 bp, Homo sapiens
tggaccactgcatgagcttt

SEQ ID NO: 3182611 - DNA, 19 bp, Homo sapiens
tggaccactgggcaatgat

SEQ ID NO: 3182612 - DNA, 15 bp, Homo sapiens
tggacccaaggaaaa

SEQ ID NO: 3182613 - DNA, 21 bp, Homo sapiens
tggacccaaggaaaactgcat

SEQ ID NO: 3182614 - DNA, 22 bp, Homo sapiens
tggacccacgaacgctcttagc

SEQ ID NO: 3182615 - DNA, 13 bp, Homo sapiens
tggaccccagctg

SEQ ID NO: 3182616 - DNA, 18 bp, Homo sapiens
tggaccccagctgggagg

SEQ ID NO: 3182617 - DNA, 14 bp, Homo sapiens
tggaccgggtgggc

SEQ ID NO: 3182618 - DNA, 19 bp, Homo sapiens
tggaccgggtgggcctggc

SEQ ID NO: 3182619 - DNA, 20 bp, Homo sapiens
tggaccgggtgggcctggcc

SEQ ID NO: 3182620 - DNA, 19 bp, Homo sapiens
tggaccgtggacaggccca

SEQ ID NO: 3182621 - DNA, 19 bp, Homo sapiens
tggacctatgtcctaagga

SEQ ID NO: 3182622 - DNA, 16 bp, Homo sapiens
tggaccttaggccttc

SEQ ID NO: 3182623 - DNA, 16 bp, Homo sapiens
tggaccttgagaccac

SEQ ID NO: 3182624 - DNA, 22 bp, Homo sapiens
tggactaaatgcctagttttta

SEQ ID NO: 3182625 - DNA, 22 bp, Homo sapiens
tggactaaccccaacgcacagg

SEQ ID NO: 3182626 - DNA, 14 bp, Homo sapiens
tggactaagcaatt

SEQ ID NO: 3182627 - DNA, 17 bp, Homo sapiens
tggactacaaaatacaa

SEQ ID NO: 3182628 - DNA, 17 bp, Homo sapiens
tggactatctgtctggt

SEQ ID NO: 3182629 - DNA, 20 bp, Homo sapiens
tggactatctgtctggtggc

SEQ ID NO: 3182630 - DNA, 17 bp, Homo sapiens
tggactcaatccctagg

SEQ ID NO: 3182631 - DNA, 15 bp, Homo sapiens
tggactcagcagtga

SEQ ID NO: 3182632 - DNA, 12 bp, Homo sapiens
tggactcagccc

SEQ ID NO: 3182633 - DNA, 20 bp, Homo sapiens
tggactccagcctgcctggc

SEQ ID NO: 3182634 - DNA, 21 bp, Homo sapiens
tggactccagcctgcctggca

SEQ ID NO: 3182635 - DNA, 22 bp, Homo sapiens
tggactccagcctgcctggcag

SEQ ID NO: 3182636 - DNA, 23 bp, Homo sapiens
tggactccagcctgcctggcagg

SEQ ID NO: 3182637 - DNA, 15 bp, Homo sapiens
tggactcctctgtcc

SEQ ID NO: 3182638 - DNA, 17 bp, Homo sapiens
tggactctaaagaccaa

SEQ ID NO: 3182639 - DNA, 18 bp, Homo sapiens
tggactctaaagaccaaa

SEQ ID NO: 3182640 - DNA, 14 bp, Homo sapiens
tggactctgcacat

SEQ ID NO: 3182641 - DNA, 15 bp, Homo sapiens
tggactctgcacatg

SEQ ID NO: 3182642 - DNA, 19 bp, Homo sapiens
tggactctgcacatgtctt

SEQ ID NO: 3182643 - DNA, 22 bp, Homo sapiens
tggactctgcacatgtcttgta

SEQ ID NO: 3182644 - DNA, 16 bp, Homo sapiens
tggactctgcatccca

SEQ ID NO: 3182645 - DNA, 18 bp, Homo sapiens
tggactctgcatcccagc

SEQ ID NO: 3182646 - DNA, 20 bp, Homo sapiens
tggactctgcatcccagcac

SEQ ID NO: 3182647 - DNA, 13 bp, Homo sapiens
tggactctgcccc

SEQ ID NO: 3182648 - DNA, 21 bp, Homo sapiens
tggactctggtgcctccagag

SEQ ID NO: 3182649 - DNA, 22 bp, Homo sapiens
tggactctggtgcctccagagg

SEQ ID NO: 3182650 - DNA, 15 bp, Homo sapiens
tggactcttgctctt

SEQ ID NO: 3182651 - DNA, 18 bp, Homo sapiens
tggactcttgctctttct

SEQ ID NO: 3182652 - DNA, 17 bp, Homo sapiens
tggactgaagcctgcag

SEQ ID NO: 3182653 - DNA, 19 bp, Homo sapiens
tggactgagccaaggaggc

SEQ ID NO: 3182654 - DNA, 14 bp, Homo sapiens
tggactgagcggcc

SEQ ID NO: 3182655 - DNA, 19 bp, Homo sapiens
tggactgcagaagcaaggg

SEQ ID NO: 3182656 - DNA, 13 bp, Homo sapiens
tggactgcattta

SEQ ID NO: 3182657 - DNA, 20 bp, Homo sapiens
tggactgcatttaaatttga

SEQ ID NO: 3182658 - DNA, 21 bp, Homo sapiens
tggactggaggcccctggagc

SEQ ID NO: 3182659 - DNA, 17 bp, Homo sapiens
tggactggaggtgggca

SEQ ID NO: 3182660 - DNA, 13 bp, Homo sapiens
tggactggctaga

SEQ ID NO: 3182661 - DNA, 22 bp, Homo sapiens
tggactggctagagtcctcact

SEQ ID NO: 3182662 - DNA, 16 bp, Homo sapiens
tggactggtggcccct

SEQ ID NO: 3182663 - DNA, 15 bp, Homo sapiens
tggactgtgatgcca

SEQ ID NO: 3182664 - DNA, 20 bp, Homo sapiens
tggactgtgatgccacacag

SEQ ID NO: 3182665 - DNA, 15 bp, Homo sapiens
tggactgttccaggc

SEQ ID NO: 3182666 - DNA, 15 bp, Homo sapiens
tggacttagaaagca

SEQ ID NO: 3182667 - DNA, 16 bp, Homo sapiens
tggacttagaaagcag

SEQ ID NO: 3182668 - DNA, 21 bp, Homo sapiens
tggacttagaaagcaggggct

SEQ ID NO: 3182669 - DNA, 18 bp, Homo sapiens
tggacttatttcttcaaa

SEQ ID NO: 3182670 - DNA, 14 bp, Homo sapiens
tggacttctgtggg

SEQ ID NO: 3182671 - DNA, 16 bp, Homo sapiens
tggacttctgtgggcc

SEQ ID NO: 3182672 - DNA, 14 bp, Homo sapiens
tggacttgtatatt

SEQ ID NO: 3182673 - DNA, 18 bp, Homo sapiens
tggacttgtatatttgta

SEQ ID NO: 3182674 - DNA, 12 bp, Homo sapiens
tggactttcaaa

SEQ ID NO: 3182675 - DNA, 13 bp, Homo sapiens
tggactttcctgc

SEQ ID NO: 3182676 - DNA, 14 bp, Homo sapiens
tggactttcctgca

SEQ ID NO: 3182677 - DNA, 19 bp, Homo sapiens
tggacttttcgttaacatt

SEQ ID NO: 3182678 - DNA, 14 bp, Homo sapiens
tggagaaagaagtg

SEQ ID NO: 3182679 - DNA, 16 bp, Homo sapiens
tggagaaagagctgcc

SEQ ID NO: 3182680 - DNA, 19 bp, Homo sapiens
tggagaaagcactgacctg

SEQ ID NO: 3182681 - DNA, 11 bp, Homo sapiens
tggagaacagt

SEQ ID NO: 3182682 - DNA, 20 bp, Homo sapiens
tggagaacagtggttgcctg

SEQ ID NO: 3182683 - DNA, 22 bp, Homo sapiens
tggagaacagtggttgcctggg

SEQ ID NO: 3182684 - DNA, 18 bp, Homo sapiens
tggagaacgccagtctcc

SEQ ID NO: 3182685 - DNA, 20 bp, Homo sapiens
tggagaacgccagtctccca

SEQ ID NO: 3182686 - DNA, 14 bp, Homo sapiens
tggagaactagaga

SEQ ID NO: 3182687 - DNA, 18 bp, Homo sapiens
tggagaattgctgaaggg

SEQ ID NO: 3182688 - DNA, 23 bp, Homo sapiens
tggagacactcctataaggagag

SEQ ID NO: 3182689 - DNA, 13 bp, Homo sapiens
tggagacagcccc

SEQ ID NO: 3182690 - DNA, 22 bp, Homo sapiens
tggagacagtcctttcccacca

SEQ ID NO: 3182691 - DNA, 18 bp, Homo sapiens
tggagaccagggagcctt

SEQ ID NO: 3182692 - DNA, 20 bp, Homo sapiens
tggagaccatgcagagcgcc

SEQ ID NO: 3182693 - DNA, 19 bp, Homo sapiens
tggagaccgcttcacccct

SEQ ID NO: 3182694 - DNA, 23 bp, Homo sapiens
tggagaccgcttcacccctgcac

SEQ ID NO: 3182695 - DNA, 20 bp, Homo sapiens
tggagacgtggaacctctgt

SEQ ID NO: 3182696 - DNA, 23 bp, Homo sapiens
tggagacgtggaacctctgtctc

SEQ ID NO: 3182697 - DNA, 24 bp, Homo sapiens
tggagacgtggaacctctgtctca

SEQ ID NO: 3182698 - DNA, 16 bp, Homo sapiens
tggagactcctggtct

SEQ ID NO: 3182699 - DNA, 19 bp, Homo sapiens
tggagactctgtggggcct

SEQ ID NO: 3182700 - DNA, 12 bp, Homo sapiens
tggagactgctt

SEQ ID NO: 3182701 - DNA, 17 bp, Homo sapiens
tggagactgcttcccat

SEQ ID NO: 3182702 - DNA, 14 bp, Homo sapiens
tggagactggcagg

SEQ ID NO: 3182703 - DNA, 17 bp, Homo sapiens
tggagactggggtggcc

SEQ ID NO: 3182704 - DNA, 18 bp, Homo sapiens
tggagactggggtggcct

SEQ ID NO: 3182705 - DNA, 21 bp, Homo sapiens
tggagagaaacaataaagaga

SEQ ID NO: 3182706 - DNA, 22 bp, Homo sapiens
tggagagaaacaataaagagat

SEQ ID NO: 3182707 - DNA, 13 bp, Homo sapiens
tggagagaatcat

SEQ ID NO: 3182708 - DNA, 21 bp, Homo sapiens
tggagagagattctgttgcat

SEQ ID NO: 3182709 - DNA, 20 bp, Homo sapiens
tggagagcctcttagtgatt

SEQ ID NO: 3182710 - DNA, 21 bp, Homo sapiens
tggagagcgaggaggcgcggc

SEQ ID NO: 3182711 - DNA, 13 bp, Homo sapiens
tggattcatcagc

SEQ ID NO: 3182712 - DNA, 22 bp, Homo sapiens
tggattcccccccctttcctaa

SEQ ID NO: 3182713 - DNA, 15 bp, Homo sapiens
tggattctaaataca

SEQ ID NO: 3182714 - DNA, 12 bp, Homo sapiens
tggattctcaga

SEQ ID NO: 3182715 - DNA, 17 bp, Homo sapiens
tggattctctaaccttt

SEQ ID NO: 3182716 - DNA, 20 bp, Homo sapiens
tggattctgaggccctgccc

SEQ ID NO: 3182717 - DNA, 13 bp, Homo sapiens
tggattgagggta

SEQ ID NO: 3182718 - DNA, 20 bp, Homo sapiens
tggattggattatttaataa

SEQ ID NO: 3182719 - DNA, 15 bp, Homo sapiens
tggattggccaaaca

SEQ ID NO: 3182720 - DNA, 14 bp, Homo sapiens
tggattgtggttcc

SEQ ID NO: 3182721 - DNA, 16 bp, Homo sapiens
tggatttagtttcagt

SEQ ID NO: 3182722 - DNA, 21 bp, Homo sapiens
tggatttatagtatgtgactt

SEQ ID NO: 3182723 - DNA, 21 bp, Homo sapiens
tggatttcctaatactgtcat

SEQ ID NO: 3182724 - DNA, 17 bp, Homo sapiens
tggatttgcctgtgcca

SEQ ID NO: 3182725 - DNA, 17 bp, Homo sapiens
tggattttctactgtaa

SEQ ID NO: 3182726 - DNA, 13 bp, Homo sapiens
tggatttttgtta

SEQ ID NO: 3182727 - DNA, 17 bp, Homo sapiens
tggattttttaaatcat

SEQ ID NO: 3182728 - DNA, 16 bp, Homo sapiens
tggcaaaagccttgtg

SEQ ID NO: 3182729 - DNA, 12 bp, Homo sapiens
tggcaaatataa

SEQ ID NO: 3182730 - DNA, 22 bp, Homo sapiens
tggcaaatggaggcttttcact

SEQ ID NO: 3182731 - DNA, 20 bp, Homo sapiens
tggcaaattaacttgagttt

SEQ ID NO: 3182732 - DNA, 14 bp, Homo sapiens
tggcaacaggacag

SEQ ID NO: 3182733 - DNA, 20 bp, Homo sapiens
tggcaacaggacagagttca

SEQ ID NO: 3182734 - DNA, 19 bp, Homo sapiens
tggcaagaaagctggtaaa

SEQ ID NO: 3182735 - DNA, 14 bp, Homo sapiens
tggcaagaacttgt

SEQ ID NO: 3182736 - DNA, 19 bp, Homo sapiens
tggcaagaacttgtttaca

SEQ ID NO: 3182737 - DNA, 13 bp, Homo sapiens
tggcaagagcccc

SEQ ID NO: 3182738 - DNA, 13 bp, Homo sapiens
tggcaagaggcct

SEQ ID NO: 3182739 - DNA, 14 bp, Homo sapiens
tggcaagaggcctc

SEQ ID NO: 3182740 - DNA, 19 bp, Homo sapiens
tggcaagaggcctcatgcc

SEQ ID NO: 3182741 - DNA, 22 bp, Homo sapiens
tggcaagagggtgacagcttcc

SEQ ID NO: 3182742 - DNA, 17 bp, Homo sapiens
tggcaagatgaaataat

SEQ ID NO: 3182743 - DNA, 21 bp, Homo sapiens
tggcaagcagggaaagctcca

SEQ ID NO: 3182744 - DNA, 17 bp, Homo sapiens
tggcaagggggtgtcat

SEQ ID NO: 3182745 - DNA, 23 bp, Homo sapiens
tggcaagttttgatatgagtata

SEQ ID NO: 3182746 - DNA, 12 bp, Homo sapiens
tggcaataaact

SEQ ID NO: 3182747 - DNA, 18 bp, Homo sapiens
tggcaatagtgggccctc

SEQ ID NO: 3182748 - DNA, 16 bp, Homo sapiens
tggcaatagtgtgttc

SEQ ID NO: 3182749 - DNA, 20 bp, Homo sapiens
tggcaatgggatttgggcta

SEQ ID NO: 3182750 - DNA, 13 bp, Homo sapiens
tggcaattccaat

SEQ ID NO: 3182751 - DNA, 17 bp, Homo sapiens
tggcaattccaatattt

SEQ ID NO: 3182752 - DNA, 23 bp, Homo sapiens
tggcaattcctcttcattgtcta

SEQ ID NO: 3182753 - DNA, 16 bp, Homo sapiens
tggcaattgtccccag

SEQ ID NO: 3182754 - DNA, 10 bp, Homo sapiens
tggcacaatg

SEQ ID NO: 3182755 - DNA, 15 bp, Homo sapiens
tggcacaatgaatgt

SEQ ID NO: 3182756 - DNA, 23 bp, Homo sapiens
tggcacagaacaggaggtgtgaa

SEQ ID NO: 3182757 - DNA, 23 bp, Homo sapiens
tggcacagaggtagtctcactgc

SEQ ID NO: 3182758 - DNA, 13 bp, Homo sapiens
tggcacaggactg

SEQ ID NO: 3182759 - DNA, 14 bp, Homo sapiens
tggcacaggactga

SEQ ID NO: 3182760 - DNA, 19 bp, Homo sapiens
tggcacatttcagggagaa

SEQ ID NO: 3182761 - DNA, 22 bp, Homo sapiens
tggcacatttcagggagaaact

SEQ ID NO: 3182762 - DNA, 17 bp, Homo sapiens
tggcaccaaagatgcag

SEQ ID NO: 3182763 - DNA, 19 bp, Homo sapiens
tggcaccaaagatgcagcc

SEQ ID NO: 3182764 - DNA, 20 bp, Homo sapiens
tggcaccagaggtgcttctg

SEQ ID NO: 3182765 - DNA, 20 bp, Homo sapiens
tggcaccagccccctggatg

SEQ ID NO: 3182766 - DNA, 13 bp, Homo sapiens
tggcaccatgtgc

SEQ ID NO: 3182767 - DNA, 14 bp, Homo sapiens
tggcaccccagcta

SEQ ID NO: 3182768 - DNA, 18 bp, Homo sapiens
tggcacccccacaagctg

SEQ ID NO: 3182769 - DNA, 15 bp, Homo sapiens
tggcacccggcccct

SEQ ID NO: 3182770 - DNA, 18 bp, Homo sapiens
tggcacccggcccctgct

SEQ ID NO: 3182771 - DNA, 19 bp, Homo sapiens
tggcacccggcccctgctg

SEQ ID NO: 3182772 - DNA, 16 bp, Homo sapiens
tggcacctcctgagaa

SEQ ID NO: 3182773 - DNA, 19 bp, Homo sapiens
tggcacctcctgagaaggc

SEQ ID NO: 3182774 - DNA, 20 bp, Homo sapiens
tggcacgccctactccactg

SEQ ID NO: 3182775 - DNA, 16 bp, Homo sapiens
tggcactataatgtaa

SEQ ID NO: 3182776 - DNA, 18 bp, Homo sapiens
tggcactcacagacctgg

SEQ ID NO: 3182777 - DNA, 22 bp, Homo sapiens
tggcactgagatatttattgtt

SEQ ID NO: 3182778 - DNA, 21 bp, Homo sapiens
tggcactggtaggttgggaca

SEQ ID NO: 3182779 - DNA, 22 bp, Homo sapiens
tggcactggtaggttgggacac

SEQ ID NO: 3182780 - DNA, 17 bp, Homo sapiens
tggcactgttaatacac

SEQ ID NO: 3182781 - DNA, 18 bp, Homo sapiens
tggcacttaagtgcactt

SEQ ID NO: 3182782 - DNA, 19 bp, Homo sapiens
tggcacttaagtgcacttt

SEQ ID NO: 3182783 - DNA, 20 bp, Homo sapiens
tggcacttagcccaagaggt

SEQ ID NO: 3182784 - DNA, 11 bp, Homo sapiens
tggcacttgta

SEQ ID NO: 3182785 - DNA, 14 bp, Homo sapiens
tggcacttgtattt

SEQ ID NO: 3182786 - DNA, 15 bp, Homo sapiens
tggcacttgtattta

SEQ ID NO: 3182787 - DNA, 16 bp, Homo sapiens
tggcactttttcattt

SEQ ID NO: 3182788 - DNA, 17 bp, Homo sapiens
tggcagaaaagaggaga

SEQ ID NO: 3182789 - DNA, 14 bp, Homo sapiens
tggcagaagacacc

SEQ ID NO: 3182790 - DNA, 21 bp, Homo sapiens
tggcagaagacaccagagcag

SEQ ID NO: 3182791 - DNA, 22 bp, Homo sapiens
tggcagaagacaccagagcaga

SEQ ID NO: 3182792 - DNA, 23 bp, Homo sapiens
tggcagaagacaccagagcagat

SEQ ID NO: 3182793 - DNA, 21 bp, Homo sapiens
tggcagaagggaattgctcag

SEQ ID NO: 3182794 - DNA, 19 bp, Homo sapiens
tggcagactctttaataaa

SEQ ID NO: 3182795 - DNA, 21 bp, Homo sapiens
tggcagagcagtctaaacaga

SEQ ID NO: 3182796 - DNA, 20 bp, Homo sapiens
tggcagagttacagttctgt

SEQ ID NO: 3182797 - DNA, 19 bp, Homo sapiens
tggcagataatcagcctct

SEQ ID NO: 3182798 - DNA, 21 bp, Homo sapiens
tggcagataatcagcctctta

SEQ ID NO: 3182799 - DNA, 16 bp, Homo sapiens
tggcagattttacaaa

SEQ ID NO: 3182800 - DNA, 22 bp, Homo sapiens
tggcagattttacaaaagatgt

SEQ ID NO: 3182801 - DNA, 15 bp, Homo sapiens
tggcagcacagccca

SEQ ID NO: 3182802 - DNA, 22 bp, Homo sapiens
tggcagcacagcccagggcctg

SEQ ID NO: 3182803 - DNA, 21 bp, Homo sapiens
tggcagccagacttctggagg

SEQ ID NO: 3182804 - DNA, 21 bp, Homo sapiens
tggcagccatgcctcatgcca

SEQ ID NO: 3182805 - DNA, 12 bp, Homo sapiens
tggcagcccaga

SEQ ID NO: 3182806 - DNA, 11 bp, Homo sapiens
tggcagccctg

SEQ ID NO: 3182807 - DNA, 14 bp, Homo sapiens
tggcagccctgtag

SEQ ID NO: 3182808 - DNA, 17 bp, Homo sapiens
tggcagccctgtaggga

SEQ ID NO: 3182809 - DNA, 19 bp, Homo sapiens
tggcagccgtgccttcagc

SEQ ID NO: 3182810 - DNA, 20 bp, Homo sapiens
tggcagccgtgccttcagct

SEQ ID NO: 3182811 - DNA, 22 bp, Homo sapiens
tggcagccgtgccttcagctct

SEQ ID NO: 3182812 - DNA, 23 bp, Homo sapiens
tggcagccgtgccttcagctcta

SEQ ID NO: 3182813 - DNA, 15 bp, Homo sapiens
tggcagctagtgcct

SEQ ID NO: 3182814 - DNA, 16 bp, Homo sapiens
tggcagctagtgcctt

SEQ ID NO: 3182815 - DNA, 13 bp, Homo sapiens
tggcagctctagc

SEQ ID NO: 3182816 - DNA, 16 bp, Homo sapiens
tggcagctgagagccc

SEQ ID NO: 3182817 - DNA, 16 bp, Homo sapiens
tggcagctgccccagg

SEQ ID NO: 3182818 - DNA, 17 bp, Homo sapiens
tggcaggacacatcccg

SEQ ID NO: 3182819 - DNA, 22 bp, Homo sapiens
tggcaggatgaccctgcgaagg

SEQ ID NO: 3182820 - DNA, 19 bp, Homo sapiens
tggcaggcacacagcagcc

SEQ ID NO: 3182821 - DNA, 21 bp, Homo sapiens
tggcaggcacacagcagcccc

SEQ ID NO: 3182822 - DNA, 15 bp, Homo sapiens
tggcaggctggccag

SEQ ID NO: 3182823 - DNA, 14 bp, Homo sapiens
tggcaggctgggtg

SEQ ID NO: 3182824 - DNA, 23 bp, Homo sapiens
tggcagggctggccccagggcac

SEQ ID NO: 3182825 - DNA, 14 bp, Homo sapiens
tggcaggggaagcc

SEQ ID NO: 3182826 - DNA, 18 bp, Homo sapiens
tggcaggggaagccttgc

SEQ ID NO: 3182827 - DNA, 22 bp, Homo sapiens
tggcagggggccccgccagggc

SEQ ID NO: 3182828 - DNA, 23 bp, Homo sapiens
tggcagggggccccgccagggct

SEQ ID NO: 3182829 - DNA, 14 bp, Homo sapiens
tggcagtaaagaga

SEQ ID NO: 3182830 - DNA, 17 bp, Homo sapiens
tggcagtaaagagaaac

SEQ ID NO: 3182831 - DNA, 19 bp, Homo sapiens
tggcagtaaagagaaactt

SEQ ID NO: 3182832 - DNA, 13 bp, Homo sapiens
tggcagtgacttt

SEQ ID NO: 3182833 - DNA, 18 bp, Homo sapiens
tggcagtggcagagaatc

SEQ ID NO: 3182834 - DNA, 16 bp, Homo sapiens
tggcagtgggagctgc

SEQ ID NO: 3182835 - DNA, 19 bp, Homo sapiens
tggcagtgggagctgcctg

SEQ ID NO: 3182836 - DNA, 23 bp, Homo sapiens
tgggacagcctcttcagcccctt

SEQ ID NO: 3182837 - DNA, 16 bp, Homo sapiens
tgggaccagagccaga

SEQ ID NO: 3182838 - DNA, 13 bp, Homo sapiens
tgggacccagcta

SEQ ID NO: 3182839 - DNA, 20 bp, Homo sapiens
tgggacctgccaggcagggg

SEQ ID NO: 3182840 - DNA, 14 bp, Homo sapiens
tgggacggtgccca

SEQ ID NO: 3182841 - DNA, 15 bp, Homo sapiens
tgggactacaggcac

SEQ ID NO: 3182842 - DNA, 16 bp, Homo sapiens
tgggactacaggcacc

SEQ ID NO: 3182843 - DNA, 16 bp, Homo sapiens
tgggactacaggtgtg

SEQ ID NO: 3182844 - DNA, 13 bp, Homo sapiens
tgggactcagcct

SEQ ID NO: 3182845 - DNA, 23 bp, Homo sapiens
tgggactcagccttcagacagag

SEQ ID NO: 3182846 - DNA, 15 bp, Homo sapiens
tgggactcaggatat

SEQ ID NO: 3182847 - DNA, 15 bp, Homo sapiens
tgggactcctggtgc

SEQ ID NO: 3182848 - DNA, 20 bp, Homo sapiens
tgggactgagcctggcccat

SEQ ID NO: 3182849 - DNA, 13 bp, Homo sapiens
tgggactggagtc

SEQ ID NO: 3182850 - DNA, 18 bp, Homo sapiens
tgggactggagtccctgt

SEQ ID NO: 3182851 - DNA, 21 bp, Homo sapiens
tgggacttctacccagatgga

SEQ ID NO: 3182852 - DNA, 22 bp, Homo sapiens
tgggagaacctcaggcttcctt

SEQ ID NO: 3182853 - DNA, 14 bp, Homo sapiens
tgggagacatgtga

SEQ ID NO: 3182854 - DNA, 16 bp, Homo sapiens
tgggagacatgtgaca

SEQ ID NO: 3182855 - DNA, 14 bp, Homo sapiens
tgggagagcccctg

SEQ ID NO: 3182856 - DNA, 15 bp, Homo sapiens
tgggagagcccctgg

SEQ ID NO: 3182857 - DNA, 19 bp, Homo sapiens
tgggagagcccctggggcc

SEQ ID NO: 3182858 - DNA, 23 bp, Homo sapiens
tgggagagcccctggggcctaga

SEQ ID NO: 3182859 - DNA, 20 bp, Homo sapiens
tgggagaggatttttttctg

SEQ ID NO: 3182860 - DNA, 13 bp, Homo sapiens
tgggagcaggaga

SEQ ID NO: 3182861 - DNA, 23 bp, Homo sapiens
tgggagcatagcagaggggccag

SEQ ID NO: 3182862 - DNA, 13 bp, Homo sapiens
tgggagccagcct

SEQ ID NO: 3182863 - DNA, 17 bp, Homo sapiens
tgggagccagctgcttt

SEQ ID NO: 3182864 - DNA, 19 bp, Homo sapiens
tgggagccagtcctccact

SEQ ID NO: 3182865 - DNA, 13 bp, Homo sapiens
tgggagccccagg

SEQ ID NO: 3182866 - DNA, 16 bp, Homo sapiens
tgggagccccagggtc

SEQ ID NO: 3182867 - DNA, 15 bp, Homo sapiens
tgggagccctttgga

SEQ ID NO: 3182868 - DNA, 16 bp, Homo sapiens
tgggagcctaaggaag

SEQ ID NO: 3182869 - DNA, 22 bp, Homo sapiens
tgggagcctgcaaactcactgc

SEQ ID NO: 3182870 - DNA, 21 bp, Homo sapiens
tgggagctgagctggaagggg

SEQ ID NO: 3182871 - DNA, 12 bp, Homo sapiens
tgggagctgcct

SEQ ID NO: 3182872 - DNA, 14 bp, Homo sapiens
tgggagctgcctgt

SEQ ID NO: 3182873 - DNA, 21 bp, Homo sapiens
tgggagctgcctgttcagctc

SEQ ID NO: 3182874 - DNA, 23 bp, Homo sapiens
tgggagctgcctgttcagctcca

SEQ ID NO: 3182875 - DNA, 16 bp, Homo sapiens
tgggagcttgggaatg

SEQ ID NO: 3182876 - DNA, 16 bp, Homo sapiens
tgggaggaaagagagc

SEQ ID NO: 3182877 - DNA, 15 bp, Homo sapiens
tgggaggaaatttga

SEQ ID NO: 3182878 - DNA, 11 bp, Homo sapiens
tgggaggacag

SEQ ID NO: 3182879 - DNA, 15 bp, Homo sapiens
tgggaggaggaagac

SEQ ID NO: 3182880 - DNA, 13 bp, Homo sapiens
tgggaggagggag

SEQ ID NO: 3182881 - DNA, 15 bp, Homo sapiens
tgggaggagggagag

SEQ ID NO: 3182882 - DNA, 19 bp, Homo sapiens
tgggaggagggagagggag

SEQ ID NO: 3182883 - DNA, 14 bp, Homo sapiens
tgggaggcaagaaa

SEQ ID NO: 3182884 - DNA, 19 bp, Homo sapiens
tgggaggcaagaggggtgg

SEQ ID NO: 3182885 - DNA, 14 bp, Homo sapiens
tgggaggccaaggc

SEQ ID NO: 3182886 - DNA, 15 bp, Homo sapiens
tgggaggccaaggca

SEQ ID NO: 3182887 - DNA, 18 bp, Homo sapiens
tgggaggccaaggcaggt

SEQ ID NO: 3182888 - DNA, 11 bp, Homo sapiens
tgggaggctga

SEQ ID NO: 3182889 - DNA, 15 bp, Homo sapiens
tgggaggctgaggcg

SEQ ID NO: 3182890 - DNA, 14 bp, Homo sapiens
tgggaggctgaggt

SEQ ID NO: 3182891 - DNA, 17 bp, Homo sapiens
tgggagggagcagacag

SEQ ID NO: 3182892 - DNA, 17 bp, Homo sapiens
tgggagggttcccctgg

SEQ ID NO: 3182893 - DNA, 16 bp, Homo sapiens
tgggaggtcaggaaac

SEQ ID NO: 3182894 - DNA, 19 bp, Homo sapiens
tgggaggtggaagaaggga

SEQ ID NO: 3182895 - DNA, 15 bp, Homo sapiens
tgggagtcacacagt

SEQ ID NO: 3182896 - DNA, 13 bp, Homo sapiens
tgggagtcagagc

SEQ ID NO: 3182897 - DNA, 17 bp, Homo sapiens
tgggagtcagagccctg

SEQ ID NO: 3182898 - DNA, 21 bp, Homo sapiens
tgggagtcagagccctggctg

SEQ ID NO: 3182899 - DNA, 15 bp, Homo sapiens
tgggagtgggcacct

SEQ ID NO: 3182900 - DNA, 19 bp, Homo sapiens
tgggagtgggcacctcaga

SEQ ID NO: 3182901 - DNA, 23 bp, Homo sapiens
tgggataaagatgcaaggaccag

SEQ ID NO: 3182902 - DNA, 20 bp, Homo sapiens
tgggataaaggcccagactc

SEQ ID NO: 3182903 - DNA, 20 bp, Homo sapiens
tgggatacaacctccctctt

SEQ ID NO: 3182904 - DNA, 19 bp, Homo sapiens
tgggatcctccctcatggc

SEQ ID NO: 3182905 - DNA, 23 bp, Homo sapiens
tgggatgacaggcgcctgccatc

SEQ ID NO: 3182906 - DNA, 20 bp, Homo sapiens
tgggatgctagccccagaga

SEQ ID NO: 3182907 - DNA, 15 bp, Homo sapiens
tgggatggaggggag

SEQ ID NO: 3182908 - DNA, 13 bp, Homo sapiens
tgggatgtagaac

SEQ ID NO: 3182909 - DNA, 16 bp, Homo sapiens
tgggatgtgagcccca

SEQ ID NO: 3182910 - DNA, 17 bp, Homo sapiens
tgggatgtgagccccag

SEQ ID NO: 3182911 - DNA, 18 bp, Homo sapiens
tgggatgtgagccccagg

SEQ ID NO: 3182912 - DNA, 14 bp, Homo sapiens
tgggattaagggca

SEQ ID NO: 3182913 - DNA, 18 bp, Homo sapiens
tgggattattctttgaaa

SEQ ID NO: 3182914 - DNA, 17 bp, Homo sapiens
tgggattcaggaatgtg

SEQ ID NO: 3182915 - DNA, 16 bp, Homo sapiens
tgggattcctgaccca

SEQ ID NO: 3182916 - DNA, 21 bp, Homo sapiens
tgggattcctgacccaggccg

SEQ ID NO: 3182917 - DNA, 22 bp, Homo sapiens
tgggattcctgacccaggccgc

SEQ ID NO: 3182918 - DNA, 22 bp, Homo sapiens
tgggattctactttaagcacta

SEQ ID NO: 3182919 - DNA, 14 bp, Homo sapiens
tgggatttaatttc

SEQ ID NO: 3182920 - DNA, 17 bp, Homo sapiens
tgggcaacccccagcct

SEQ ID NO: 3182921 - DNA, 20 bp, Homo sapiens
tgggcaacccccagcctgct

SEQ ID NO: 3182922 - DNA, 21 bp, Homo sapiens
tgggcaacccccagcctgcta

SEQ ID NO: 3182923 - DNA, 16 bp, Homo sapiens
tgggcaccacaaaata

SEQ ID NO: 3182924 - DNA, 13 bp, Homo sapiens
tgggcactggagc

SEQ ID NO: 3182925 - DNA, 14 bp, Homo sapiens
tgggcactggagca

SEQ ID NO: 3182926 - DNA, 16 bp, Homo sapiens
tgggcactgggatgag

SEQ ID NO: 3182927 - DNA, 13 bp, Homo sapiens
tgggcacttgaga

SEQ ID NO: 3182928 - DNA, 18 bp, Homo sapiens
tgggcagagcccccagga

SEQ ID NO: 3182929 - DNA, 18 bp, Homo sapiens
tgggcagagctggctctg

SEQ ID NO: 3182930 - DNA, 12 bp, Homo sapiens
tgggcagcaccc

SEQ ID NO: 3182931 - DNA, 21 bp, Homo sapiens
tgggcagccagaccagcaggc

SEQ ID NO: 3182932 - DNA, 16 bp, Homo sapiens
tgggcagccaggctgc

SEQ ID NO: 3182933 - DNA, 18 bp, Homo sapiens
tgggcagccatcttgaat

SEQ ID NO: 3182934 - DNA, 15 bp, Homo sapiens
tgggcagccccagag

SEQ ID NO: 3182935 - DNA, 12 bp, Homo sapiens
tgggcaggcggt

SEQ ID NO: 3182936 - DNA, 23 bp, Homo sapiens
tgggcaggcggtccccatcccca

SEQ ID NO: 3182937 - DNA, 14 bp, Homo sapiens
tgggcaggtggtgg

SEQ ID NO: 3182938 - DNA, 15 bp, Homo sapiens
tgggcaggtggtggc

SEQ ID NO: 3182939 - DNA, 16 bp, Homo sapiens
tgggcaggtggtggca

SEQ ID NO: 3182940 - DNA, 15 bp, Homo sapiens
tgggcataaactgtt

SEQ ID NO: 3182941 - DNA, 16 bp, Homo sapiens
tgggcatccacccagt

SEQ ID NO: 3182942 - DNA, 21 bp, Homo sapiens
tgggcatccacccagtgctgc

SEQ ID NO: 3182943 - DNA, 20 bp, Homo sapiens
tgggcatgccaccctcacac

SEQ ID NO: 3182944 - DNA, 22 bp, Homo sapiens
tgggcatggtaccagccctggg

SEQ ID NO: 3182945 - DNA, 14 bp, Homo sapiens
tgggcattgctttc

SEQ ID NO: 3182946 - DNA, 20 bp, Homo sapiens
tgggcattgctttccactga

SEQ ID NO: 3182947 - DNA, 14 bp, Homo sapiens
tgggcattgggctg

SEQ ID NO: 3182948 - DNA, 16 bp, Homo sapiens
tgggcattgggctgac

SEQ ID NO: 3182949 - DNA, 18 bp, Homo sapiens
tgggcattgggctgacac

SEQ ID NO: 3182950 - DNA, 15 bp, Homo sapiens
tgggcatttggtgag

SEQ ID NO: 3182951 - DNA, 23 bp, Homo sapiens
tgggcatttggtgagagtcaaag

SEQ ID NO: 3182952 - DNA, 16 bp, Homo sapiens
tgggcatttgtgaggc

SEQ ID NO: 3182953 - DNA, 16 bp, Homo sapiens
tgggccacggaggagg

SEQ ID NO: 3182954 - DNA, 20 bp, Homo sapiens
tgggccagccctgcagccca

SEQ ID NO: 3182955 - DNA, 21 bp, Homo sapiens
tgggccagggctgccctgaga

SEQ ID NO: 3182956 - DNA, 22 bp, Homo sapiens
tgggccagggtctgtgtgaatg

SEQ ID NO: 3182957 - DNA, 20 bp, Homo sapiens
tgggccagtctgtggatcag

SEQ ID NO: 3182958 - DNA, 17 bp, Homo sapiens
tgggccatgtccaaaga

SEQ ID NO: 3182959 - DNA, 23 bp, Homo sapiens
tgggcccaagacagatgccccag

SEQ ID NO: 3182960 - DNA, 19 bp, Homo sapiens
tgggcccagaactgccccc

SEQ ID NO: 3182961 - DNA, 21 bp, Homo sapiens
tgggcccagaactgcccccac

SEQ ID NO: 3182962 - DNA, 12 bp, Homo sapiens
tggtctgtgtga

SEQ ID NO: 3182963 - DNA, 14 bp, Homo sapiens
tggtctgtgtgtgt

SEQ ID NO: 3182964 - DNA, 23 bp, Homo sapiens
tggtcttgagccagtaatcttta

SEQ ID NO: 3182965 - DNA, 14 bp, Homo sapiens
tggtctttcctctg

SEQ ID NO: 3182966 - DNA, 14 bp, Homo sapiens
tggtctttctggag

SEQ ID NO: 3182967 - DNA, 15 bp, Homo sapiens
tggtctttctggaga

SEQ ID NO: 3182968 - DNA, 22 bp, Homo sapiens
tggtctttgtaagagtgtagaa

SEQ ID NO: 3182969 - DNA, 19 bp, Homo sapiens
tggtgaaatttattagtta

SEQ ID NO: 3182970 - DNA, 14 bp, Homo sapiens
tggtgaacatttta

SEQ ID NO: 3182971 - DNA, 19 bp, Homo sapiens
tggtgacatttcccaagtc

SEQ ID NO: 3182972 - DNA, 22 bp, Homo sapiens
tggtgacctctgcctgaagtca

SEQ ID NO: 3182973 - DNA, 21 bp, Homo sapiens
tggtgactcacttcaatgtgt

SEQ ID NO: 3182974 - DNA, 23 bp, Homo sapiens
tggtgagagcccaagttatcttt

SEQ ID NO: 3182975 - DNA, 15 bp, Homo sapiens
tggtgagctgggaag

SEQ ID NO: 3182976 - DNA, 18 bp, Homo sapiens
tggtgagctgggaagctg

SEQ ID NO: 3182977 - DNA, 15 bp, Homo sapiens
tggtgataagtggaa

SEQ ID NO: 3182978 - DNA, 17 bp, Homo sapiens
tggtgataagtggaaaa

SEQ ID NO: 3182979 - DNA, 18 bp, Homo sapiens
tggtgataagtggaaaaa

SEQ ID NO: 3182980 - DNA, 18 bp, Homo sapiens
tggtgatcctctattttg

SEQ ID NO: 3182981 - DNA, 21 bp, Homo sapiens
tggtgatcctctattttgtga

SEQ ID NO: 3182982 - DNA, 21 bp, Homo sapiens
tggtgatctcccaagctatct

SEQ ID NO: 3182983 - DNA, 18 bp, Homo sapiens
tggtgcagagaagctgga

SEQ ID NO: 3182984 - DNA, 23 bp, Homo sapiens
tggtgcagagaagctggacttct

SEQ ID NO: 3182985 - DNA, 15 bp, Homo sapiens
tggtgcagtgtgaaa

SEQ ID NO: 3182986 - DNA, 15 bp, Homo sapiens
tggtgcatagaactg

SEQ ID NO: 3182987 - DNA, 10 bp, Homo sapiens
tggtgcatta

SEQ ID NO: 3182988 - DNA, 17 bp, Homo sapiens
tggtgccagagaggggc

SEQ ID NO: 3182989 - DNA, 19 bp, Homo sapiens
tggtgccaggcgcgtgtaa

SEQ ID NO: 3182990 - DNA, 21 bp, Homo sapiens
tggtgccatttctgaactgtt

SEQ ID NO: 3182991 - DNA, 13 bp, Homo sapiens
tggtgccccacag

SEQ ID NO: 3182992 - DNA, 17 bp, Homo sapiens
tggtgccccacagctac

SEQ ID NO: 3182993 - DNA, 17 bp, Homo sapiens
tggtgcccgtgcccgca

SEQ ID NO: 3182994 - DNA, 17 bp, Homo sapiens
tggtgccctcctcactc

SEQ ID NO: 3182995 - DNA, 20 bp, Homo sapiens
tggtgcctcactgggggctt

SEQ ID NO: 3182996 - DNA, 22 bp, Homo sapiens
tggtgcctcactgggggctttg

SEQ ID NO: 3182997 - DNA, 23 bp, Homo sapiens
tggtgcctcactgggggctttgg

SEQ ID NO: 3182998 - DNA, 14 bp, Homo sapiens
tggtgcctcctcaa

SEQ ID NO: 3182999 - DNA, 13 bp, Homo sapiens
tggtgcctgagag

SEQ ID NO: 3183000 - DNA, 15 bp, Homo sapiens
tggtgcctgagaggc

SEQ ID NO: 3183001 - DNA, 13 bp, Homo sapiens
tggtgcctggcct

SEQ ID NO: 3183002 - DNA, 17 bp, Homo sapiens
tggtgcctggcctggca

SEQ ID NO: 3183003 - DNA, 13 bp, Homo sapiens
tggtgcctttcct

SEQ ID NO: 3183004 - DNA, 14 bp, Homo sapiens
tggtgccttttgtg

SEQ ID NO: 3183005 - DNA, 16 bp, Homo sapiens
tggtgcgatctgggtt

SEQ ID NO: 3183006 - DNA, 19 bp, Homo sapiens
tggtgcgggcacaataaat

SEQ ID NO: 3183007 - DNA, 13 bp, Homo sapiens
tggtgctatttga

SEQ ID NO: 3183008 - DNA, 18 bp, Homo sapiens
tggtgctatttgaagaaa

SEQ ID NO: 3183009 - DNA, 13 bp, Homo sapiens
tggtgctctgtgt

SEQ ID NO: 3183010 - DNA, 13 bp, Homo sapiens
tggtgcttagttt

SEQ ID NO: 3183011 - DNA, 16 bp, Homo sapiens
tggtggacagtcctgg

SEQ ID NO: 3183012 - DNA, 21 bp, Homo sapiens
tggtggaccctactattcatg

SEQ ID NO: 3183013 - DNA, 16 bp, Homo sapiens
tggtggcaagagcccc

SEQ ID NO: 3183014 - DNA, 15 bp, Homo sapiens
tggtggcacaggccc

SEQ ID NO: 3183015 - DNA, 16 bp, Homo sapiens
tggtggcactgagccc

SEQ ID NO: 3183016 - DNA, 10 bp, Homo sapiens
tggtggcctc

SEQ ID NO: 3183017 - DNA, 12 bp, Homo sapiens
tggtggcctcag

SEQ ID NO: 3183018 - DNA, 13 bp, Homo sapiens
tggtggcctcagc

SEQ ID NO: 3183019 - DNA, 16 bp, Homo sapiens
tggtggcctggtccct

SEQ ID NO: 3183020 - DNA, 17 bp, Homo sapiens
tggtggcgggcacctgt

SEQ ID NO: 3183021 - DNA, 21 bp, Homo sapiens
tggtgggctgatttacatgta

SEQ ID NO: 3183022 - DNA, 11 bp, Homo sapiens
tggtggggagg

SEQ ID NO: 3183023 - DNA, 13 bp, Homo sapiens
tggtggggccagg

SEQ ID NO: 3183024 - DNA, 15 bp, Homo sapiens
tggtggggccaggcc

SEQ ID NO: 3183025 - DNA, 16 bp, Homo sapiens
tggtggggccaggcca

SEQ ID NO: 3183026 - DNA, 20 bp, Homo sapiens
tggtggggccaggccaggac

SEQ ID NO: 3183027 - DNA, 14 bp, Homo sapiens
tggtggggtagagg

SEQ ID NO: 3183028 - DNA, 23 bp, Homo sapiens
tggtggggtgtgttccaactgcc

SEQ ID NO: 3183029 - DNA, 22 bp, Homo sapiens
tggtgggtctatgttccccagg

SEQ ID NO: 3183030 - DNA, 22 bp, Homo sapiens
tggtggtactttattcttgctg

SEQ ID NO: 3183031 - DNA, 16 bp, Homo sapiens
tggtggtattttattt

SEQ ID NO: 3183032 - DNA, 14 bp, Homo sapiens
tggtggtcagatgc

SEQ ID NO: 3183033 - DNA, 15 bp, Homo sapiens
tggtggtctgttggc

SEQ ID NO: 3183034 - DNA, 15 bp, Homo sapiens
tggtggttattttaa

SEQ ID NO: 3183035 - DNA, 16 bp, Homo sapiens
tggtggttcctttgca

SEQ ID NO: 3183036 - DNA, 18 bp, Homo sapiens
tggtggttcctttgcacc

SEQ ID NO: 3183037 - DNA, 22 bp, Homo sapiens
tggtggttcctttgcaccctgt

SEQ ID NO: 3183038 - DNA, 14 bp, Homo sapiens
tggtgtaaagctgg

SEQ ID NO: 3183039 - DNA, 18 bp, Homo sapiens
tggtgtaaagctggccct

SEQ ID NO: 3183040 - DNA, 13 bp, Homo sapiens
tggtgtaataaga

SEQ ID NO: 3183041 - DNA, 15 bp, Homo sapiens
tggtgtaataagaca

SEQ ID NO: 3183042 - DNA, 17 bp, Homo sapiens
tggtgtaataagacata

SEQ ID NO: 3183043 - DNA, 19 bp, Homo sapiens
tggtgtaataagacataac

SEQ ID NO: 3183044 - DNA, 13 bp, Homo sapiens
tggtgtaatttat

SEQ ID NO: 3183045 - DNA, 20 bp, Homo sapiens
tggtgtactgggttaatggc

SEQ ID NO: 3183046 - DNA, 17 bp, Homo sapiens
tggtgtagaacactaat

SEQ ID NO: 3183047 - DNA, 16 bp, Homo sapiens
tggtgtcacttactgt

SEQ ID NO: 3183048 - DNA, 17 bp, Homo sapiens
tggtgtcacttactgtt

SEQ ID NO: 3183049 - DNA, 17 bp, Homo sapiens
tggtgtccagctgagtt

SEQ ID NO: 3183050 - DNA, 14 bp, Homo sapiens
tggtgtcctgacca

SEQ ID NO: 3183051 - DNA, 17 bp, Homo sapiens
tggtgtcctgaccaccc

SEQ ID NO: 3183052 - DNA, 23 bp, Homo sapiens
tggtgtctcttctttagaacagg

SEQ ID NO: 3183053 - DNA, 16 bp, Homo sapiens
tggtgtgttggacaga

SEQ ID NO: 3183054 - DNA, 23 bp, Homo sapiens
tggtgttccattgcctcttttca

SEQ ID NO: 3183055 - DNA, 14 bp, Homo sapiens
tggtgttcctggaa

SEQ ID NO: 3183056 - DNA, 21 bp, Homo sapiens
tggtgttggggaaaccttcat

SEQ ID NO: 3183057 - DNA, 23 bp, Homo sapiens
tggtgttttcattcccccttcct

SEQ ID NO: 3183058 - DNA, 17 bp, Homo sapiens
tggttaaaaaggccaaa

SEQ ID NO: 3183059 - DNA, 22 bp, Homo sapiens
tggttaaaactgtacatttaaa

SEQ ID NO: 3183060 - DNA, 16 bp, Homo sapiens
tggttaagagtccaag

SEQ ID NO: 3183061 - DNA, 17 bp, Homo sapiens
tggttaagagtccaaga

SEQ ID NO: 3183062 - DNA, 21 bp, Homo sapiens
tggttaagttggcttctgttt

SEQ ID NO: 3183063 - DNA, 16 bp, Homo sapiens
tggttaataaaactgc

SEQ ID NO: 3183064 - DNA, 22 bp, Homo sapiens
tggttaataaaactgcacagtg

SEQ ID NO: 3183065 - DNA, 17 bp, Homo sapiens
tggttacagtgcagaca

SEQ ID NO: 3183066 - DNA, 19 bp, Homo sapiens
tggttacagtgcagacagg

SEQ ID NO: 3183067 - DNA, 20 bp, Homo sapiens
tggttactaaaaagtaccag

SEQ ID NO: 3183068 - DNA, 23 bp, Homo sapiens
tggttagacgccttccaggtcag

SEQ ID NO: 3183069 - DNA, 15 bp, Homo sapiens
tggttagaggaaggc

SEQ ID NO: 3183070 - DNA, 13 bp, Homo sapiens
tggttatgaaaga

SEQ ID NO: 3183071 - DNA, 17 bp, Homo sapiens
tggttattagcaaggct

SEQ ID NO: 3183072 - DNA, 21 bp, Homo sapiens
tggttattttaaatataaata

SEQ ID NO: 3183073 - DNA, 16 bp, Homo sapiens
tggttcagctaagcta

SEQ ID NO: 3183074 - DNA, 18 bp, Homo sapiens
tggttcagctactttcca

SEQ ID NO: 3183075 - DNA, 13 bp, Homo sapiens
tggttccaagccc

SEQ ID NO: 3183076 - DNA, 17 bp, Homo sapiens
tggttccaagccctgga

SEQ ID NO: 3183077 - DNA, 15 bp, Homo sapiens
tggttccaatgaaat

SEQ ID NO: 3183078 - DNA, 21 bp, Homo sapiens
tggttccagggtccctctgtg

SEQ ID NO: 3183079 - DNA, 17 bp, Homo sapiens
tggttccatgcctgagg

SEQ ID NO: 3183080 - DNA, 19 bp, Homo sapiens
tggttccatgcctgagggt

SEQ ID NO: 3183081 - DNA, 18 bp, Homo sapiens
tggttcccgtttctccac

SEQ ID NO: 3183082 - DNA, 20 bp, Homo sapiens
tggttcccgtttctccacct

SEQ ID NO: 3183083 - DNA, 16 bp, Homo sapiens
tggttcctaagggaaa

SEQ ID NO: 3183084 - DNA, 16 bp, Homo sapiens
tggttccttccctggg

SEQ ID NO: 3183085 - DNA, 15 bp, Homo sapiens
tggttctaatagaac

SEQ ID NO: 3183086 - DNA, 12 bp, Homo sapiens
tggttctgtgac

SEQ ID NO: 3183087 - DNA, 19 bp, Homo sapiens
tggttcttagttctcactg

SEQ ID NO: 3183088 - DNA, 14 bp, Homo sapiens
tgtataaaaaccat

SEQ ID NO: 3183089 - DNA, 19 bp, Homo sapiens
tgtataaaatccaaaatga

SEQ ID NO: 3183090 - DNA, 16 bp, Homo sapiens
tgtataaagattgtac

SEQ ID NO: 3183091 - DNA, 18 bp, Homo sapiens
tgtataaagattgtactt

SEQ ID NO: 3183092 - DNA, 19 bp, Homo sapiens
tgtataaagattgtactta

SEQ ID NO: 3183093 - DNA, 14 bp, Homo sapiens
tgtataaataggag

SEQ ID NO: 3183094 - DNA, 18 bp, Homo sapiens
tgtataaataggagagga

SEQ ID NO: 3183095 - DNA, 12 bp, Homo sapiens
tgtataaatata

SEQ ID NO: 3183096 - DNA, 15 bp, Homo sapiens
tgtataaatgtatat

SEQ ID NO: 3183097 - DNA, 15 bp, Homo sapiens
tgtataaccaagtgt

SEQ ID NO: 3183098 - DNA, 18 bp, Homo sapiens
tgtataacttcttaaaag

SEQ ID NO: 3183099 - DNA, 18 bp, Homo sapiens
tgtataagcactgaaaaa

SEQ ID NO: 3183100 - DNA, 18 bp, Homo sapiens
tgtataagtcaagcacat

SEQ ID NO: 3183101 - DNA, 22 bp, Homo sapiens
tgtataagtcaagcacatgtaa

SEQ ID NO: 3183102 - DNA, 20 bp, Homo sapiens
tgtataagtgcacacagaaa

SEQ ID NO: 3183103 - DNA, 21 bp, Homo sapiens
tgtataagtgcacacagaaat

SEQ ID NO: 3183104 - DNA, 14 bp, Homo sapiens
tgtataatattgaa

SEQ ID NO: 3183105 - DNA, 14 bp, Homo sapiens
tgtataattggatt

SEQ ID NO: 3183106 - DNA, 18 bp, Homo sapiens
tgtataattggatttcct

SEQ ID NO: 3183107 - DNA, 12 bp, Homo sapiens
tgtatacaaata

SEQ ID NO: 3183108 - DNA, 18 bp, Homo sapiens
tgtatacaaatatattgt

SEQ ID NO: 3183109 - DNA, 22 bp, Homo sapiens
tgtatacaaatatattgttaat

SEQ ID NO: 3183110 - DNA, 13 bp, Homo sapiens
tgtatacatgcca

SEQ ID NO: 3183111 - DNA, 21 bp, Homo sapiens
tgtatacattttgttatagaa

SEQ ID NO: 3183112 - DNA, 15 bp, Homo sapiens
tgtatactttagtat

SEQ ID NO: 3183113 - DNA, 17 bp, Homo sapiens
tgtatactttagtatga

SEQ ID NO: 3183114 - DNA, 14 bp, Homo sapiens
tgtatagaaatcta

SEQ ID NO: 3183115 - DNA, 17 bp, Homo sapiens
tgtatagagaatttaag

SEQ ID NO: 3183116 - DNA, 16 bp, Homo sapiens
tgtatagtgtaaaata

SEQ ID NO: 3183117 - DNA, 24 bp, Homo sapiens
tgtatagtgtaaaataagaatgat

SEQ ID NO: 3183118 - DNA, 12 bp, Homo sapiens
tgtatataaaaa

SEQ ID NO: 3183119 - DNA, 16 bp, Homo sapiens
tgtatataaaaatggc

SEQ ID NO: 3183120 - DNA, 14 bp, Homo sapiens
tgtatatacacata

SEQ ID NO: 3183121 - DNA, 16 bp, Homo sapiens
tgtatatacacatata

SEQ ID NO: 3183122 - DNA, 19 bp, Homo sapiens
tgtatatacacatatacct

SEQ ID NO: 3183123 - DNA, 16 bp, Homo sapiens
tgtatatacagttatt

SEQ ID NO: 3183124 - DNA, 14 bp, Homo sapiens
tgtatatagttttt

SEQ ID NO: 3183125 - DNA, 14 bp, Homo sapiens
tgtatatatacata

SEQ ID NO: 3183126 - DNA, 17 bp, Homo sapiens
tgtatatatacatacac

SEQ ID NO: 3183127 - DNA, 20 bp, Homo sapiens
tgtatatatacatacacttg

SEQ ID NO: 3183128 - DNA, 14 bp, Homo sapiens
tgtatatatgtgta

SEQ ID NO: 3183129 - DNA, 15 bp, Homo sapiens
tgtatatatgtgtat

SEQ ID NO: 3183130 - DNA, 18 bp, Homo sapiens
tgtatatatgtgtatata

SEQ ID NO: 3183131 - DNA, 23 bp, Homo sapiens
tgtatatatgtgtatatatacat

SEQ ID NO: 3183132 - DNA, 16 bp, Homo sapiens
tgtatatatttagtgc

SEQ ID NO: 3183133 - DNA, 18 bp, Homo sapiens
tgtatatatttcctatat

SEQ ID NO: 3183134 - DNA, 14 bp, Homo sapiens
tgtatatcagaaaa

SEQ ID NO: 3183135 - DNA, 16 bp, Homo sapiens
tgtatatcattctaca

SEQ ID NO: 3183136 - DNA, 20 bp, Homo sapiens
tgtatatcctatataggaaa

SEQ ID NO: 3183137 - DNA, 15 bp, Homo sapiens
tgtatatccttccaa

SEQ ID NO: 3183138 - DNA, 17 bp, Homo sapiens
tgtatatctcttggaaa

SEQ ID NO: 3183139 - DNA, 18 bp, Homo sapiens
tgtatatgacatttaaat

SEQ ID NO: 3183140 - DNA, 23 bp, Homo sapiens
tgtatatgtattcccttgtattt

SEQ ID NO: 3183141 - DNA, 14 bp, Homo sapiens
tgtatatgttgtaa

SEQ ID NO: 3183142 - DNA, 23 bp, Homo sapiens
tgtatattatggaagattttaaa

SEQ ID NO: 3183143 - DNA, 19 bp, Homo sapiens
tgtatattgtcagatattt

SEQ ID NO: 3183144 - DNA, 14 bp, Homo sapiens
tgtatatttattca

SEQ ID NO: 3183145 - DNA, 15 bp, Homo sapiens
tgtatatttgtacaa

SEQ ID NO: 3183146 - DNA, 22 bp, Homo sapiens
tgtatatttgtgatagcacttt

SEQ ID NO: 3183147 - DNA, 22 bp, Homo sapiens
tgtatattttaagaaataacag

SEQ ID NO: 3183148 - DNA, 17 bp, Homo sapiens
tgtatattttaatgaat

SEQ ID NO: 3183149 - DNA, 22 bp, Homo sapiens
tgtatatttttatattgttttt

SEQ ID NO: 3183150 - DNA, 17 bp, Homo sapiens
tgtatcaaatctgtata

SEQ ID NO: 3183151 - DNA, 19 bp, Homo sapiens
tgtatcaggtcagggactt

SEQ ID NO: 3183152 - DNA, 23 bp, Homo sapiens
tgtatcccatgagcctcagcatc

SEQ ID NO: 3183153 - DNA, 15 bp, Homo sapiens
tgtatccgactctaa

SEQ ID NO: 3183154 - DNA, 21 bp, Homo sapiens
tgtatcgcatattagttaatc

SEQ ID NO: 3183155 - DNA, 12 bp, Homo sapiens
tgtatctaagaa

SEQ ID NO: 3183156 - DNA, 17 bp, Homo sapiens
tgtatctagtgcagctg

SEQ ID NO: 3183157 - DNA, 17 bp, Homo sapiens
tgtatctcatactgtct

SEQ ID NO: 3183158 - DNA, 24 bp, Homo sapiens
tgtatctcatactgtctgggatta

SEQ ID NO: 3183159 - DNA, 17 bp, Homo sapiens
tgtatctctgaagcatg

SEQ ID NO: 3183160 - DNA, 23 bp, Homo sapiens
tgtatctctgaagcatgtttcat

SEQ ID NO: 3183161 - DNA, 13 bp, Homo sapiens
tgtatctgagcag

SEQ ID NO: 3183162 - DNA, 12 bp, Homo sapiens
tgtatctgttta

SEQ ID NO: 3183163 - DNA, 16 bp, Homo sapiens
tgtatcttccatattt

SEQ ID NO: 3183164 - DNA, 18 bp, Homo sapiens
tgtatcttccatatttgg

SEQ ID NO: 3183165 - DNA, 21 bp, Homo sapiens
tgtatcttccatatttggaag

SEQ ID NO: 3183166 - DNA, 18 bp, Homo sapiens
tgtatgaaaaattgggga

SEQ ID NO: 3183167 - DNA, 20 bp, Homo sapiens
tgtatgaaaaattggggagg

SEQ ID NO: 3183168 - DNA, 22 bp, Homo sapiens
tgtatgaaaatccttttaacca

SEQ ID NO: 3183169 - DNA, 22 bp, Homo sapiens
tgtatgaaagatggctgtgcct

SEQ ID NO: 3183170 - DNA, 21 bp, Homo sapiens
tgtatgaaggaatcattccag

SEQ ID NO: 3183171 - DNA, 21 bp, Homo sapiens
tgtatgactaaagagagaatg

SEQ ID NO: 3183172 - DNA, 16 bp, Homo sapiens
tgtatgactgcacatg

SEQ ID NO: 3183173 - DNA, 17 bp, Homo sapiens
tgtatgactgcacatga

SEQ ID NO: 3183174 - DNA, 19 bp, Homo sapiens
tgtatgagatggttaaaaa

SEQ ID NO: 3183175 - DNA, 19 bp, Homo sapiens
tgtatgatgctaatcttgt

SEQ ID NO: 3183176 - DNA, 13 bp, Homo sapiens
tgtatgatgtgtt

SEQ ID NO: 3183177 - DNA, 13 bp, Homo sapiens
tgtatgattactg

SEQ ID NO: 3183178 - DNA, 13 bp, Homo sapiens
tgtatgatttgtt

SEQ ID NO: 3183179 - DNA, 14 bp, Homo sapiens
tgtatgcactttgt

SEQ ID NO: 3183180 - DNA, 14 bp, Homo sapiens
tgtatgccttctgt

SEQ ID NO: 3183181 - DNA, 12 bp, Homo sapiens
tgtatgccttta

SEQ ID NO: 3183182 - DNA, 21 bp, Homo sapiens
tgtatgcctttaaatctgtga

SEQ ID NO: 3183183 - DNA, 23 bp, Homo sapiens
tgtatgctgatcatcgccagagg

SEQ ID NO: 3183184 - DNA, 13 bp, Homo sapiens
tgtatggaaacac

SEQ ID NO: 3183185 - DNA, 17 bp, Homo sapiens
tgtatggaatacagtgt

SEQ ID NO: 3183186 - DNA, 21 bp, Homo sapiens
tgtatgggattggtgggctga

SEQ ID NO: 3183187 - DNA, 16 bp, Homo sapiens
tgtatggttactaaaa

SEQ ID NO: 3183188 - DNA, 22 bp, Homo sapiens
tgtatggttactaaaaagtacc

SEQ ID NO: 3183189 - DNA, 20 bp, Homo sapiens
tgtatgtacttagctgtact

SEQ ID NO: 3183190 - DNA, 19 bp, Homo sapiens
tgtatgtcttggacactgt

SEQ ID NO: 3183191 - DNA, 22 bp, Homo sapiens
tgtatgtgaacaaatcaaattg

SEQ ID NO: 3183192 - DNA, 11 bp, Homo sapiens
tgtatgtgcac

SEQ ID NO: 3183193 - DNA, 12 bp, Homo sapiens
tgtatgtgtatt

SEQ ID NO: 3183194 - DNA, 11 bp, Homo sapiens
tgtatgtgtga

SEQ ID NO: 3183195 - DNA, 13 bp, Homo sapiens
tgtatgtgtgaaa

SEQ ID NO: 3183196 - DNA, 22 bp, Homo sapiens
tgtatgtgtgtaggttatcttt

SEQ ID NO: 3183197 - DNA, 14 bp, Homo sapiens
tgtatgttaaagca

SEQ ID NO: 3183198 - DNA, 14 bp, Homo sapiens
tgtatgttgtacaa

SEQ ID NO: 3183199 - DNA, 11 bp, Homo sapiens
tgtatgtttac

SEQ ID NO: 3183200 - DNA, 16 bp, Homo sapiens
tgtatgtttgcacact

SEQ ID NO: 3183201 - DNA, 13 bp, Homo sapiens
tgtattaaatctt

SEQ ID NO: 3183202 - DNA, 20 bp, Homo sapiens
tgtattaaatcttaaacaat

SEQ ID NO: 3183203 - DNA, 24 bp, Homo sapiens
tgtattaaatcttaaacaatgtat

SEQ ID NO: 3183204 - DNA, 15 bp, Homo sapiens
tgtattaacaaaagt

SEQ ID NO: 3183205 - DNA, 23 bp, Homo sapiens
tgtattacttaggttattttgct

SEQ ID NO: 3183206 - DNA, 14 bp, Homo sapiens
tgtattatcactgt

SEQ ID NO: 3183207 - DNA, 16 bp, Homo sapiens
tgtattattctgcagc

SEQ ID NO: 3183208 - DNA, 21 bp, Homo sapiens
tgtattcaagcaaacatcaaa

SEQ ID NO: 3183209 - DNA, 16 bp, Homo sapiens
tgtattcagataatta

SEQ ID NO: 3183210 - DNA, 17 bp, Homo sapiens
tgtattcagtgagggtc

SEQ ID NO: 3183211 - DNA, 18 bp, Homo sapiens
tgtattcccacccctgga

SEQ ID NO: 3183212 - DNA, 17 bp, Homo sapiens
tgtattcccttgtattt

SEQ ID NO: 3183213 - DNA, 17 bp, Homo sapiens
tgtattcgtgcattttt

SEQ ID NO: 3183214 - DNA, 15 bp, Homo sapiens
tgtcttctgcctgtt

SEQ ID NO: 3183215 - DNA, 17 bp, Homo sapiens
tgtcttctgcctgttat

SEQ ID NO: 3183216 - DNA, 16 bp, Homo sapiens
tgtcttctgggcacag

SEQ ID NO: 3183217 - DNA, 19 bp, Homo sapiens
tgtcttctgggcacagtgg

SEQ ID NO: 3183218 - DNA, 16 bp, Homo sapiens
tgtcttctggtctgtg

SEQ ID NO: 3183219 - DNA, 18 bp, Homo sapiens
tgtcttctggtctgtgtg

SEQ ID NO: 3183220 - DNA, 19 bp, Homo sapiens
tgtcttctggtctgtgtgt

SEQ ID NO: 3183221 - DNA, 21 bp, Homo sapiens
tgtcttctggtctgtgtgtgt

SEQ ID NO: 3183222 - DNA, 21 bp, Homo sapiens
tgtcttcttttgtggtgtctt

SEQ ID NO: 3183223 - DNA, 15 bp, Homo sapiens
tgtcttgaaagtggc

SEQ ID NO: 3183224 - DNA, 20 bp, Homo sapiens
tgtcttgaatgtcttttgaa

SEQ ID NO: 3183225 - DNA, 21 bp, Homo sapiens
tgtcttgcaatggcagccttg

SEQ ID NO: 3183226 - DNA, 19 bp, Homo sapiens
tgtcttggacactgtacaa

SEQ ID NO: 3183227 - DNA, 16 bp, Homo sapiens
tgtcttgggcagagct

SEQ ID NO: 3183228 - DNA, 22 bp, Homo sapiens
tgtcttgtacatgtgtagcctg

SEQ ID NO: 3183229 - DNA, 19 bp, Homo sapiens
tgtcttgtacttctgtgtt

SEQ ID NO: 3183230 - DNA, 16 bp, Homo sapiens
tgtcttgttctgtccc

SEQ ID NO: 3183231 - DNA, 14 bp, Homo sapiens
tgtctttaaaaact

SEQ ID NO: 3183232 - DNA, 16 bp, Homo sapiens
tgtctttactggacct

SEQ ID NO: 3183233 - DNA, 21 bp, Homo sapiens
tgtctttatgagctaaaaata

SEQ ID NO: 3183234 - DNA, 13 bp, Homo sapiens
tgtctttcctgaa

SEQ ID NO: 3183235 - DNA, 22 bp, Homo sapiens
tgtctttcctgaaccatgtgga

SEQ ID NO: 3183236 - DNA, 17 bp, Homo sapiens
tgtctttctaagaaatc

SEQ ID NO: 3183237 - DNA, 13 bp, Homo sapiens
tgtctttctttgg

SEQ ID NO: 3183238 - DNA, 15 bp, Homo sapiens
tgtctttctttggtg

SEQ ID NO: 3183239 - DNA, 12 bp, Homo sapiens
tgtctttgctgt

SEQ ID NO: 3183240 - DNA, 21 bp, Homo sapiens
tgtctttgctgtactcttgct

SEQ ID NO: 3183241 - DNA, 20 bp, Homo sapiens
tgtcttttatgcagatagaa

SEQ ID NO: 3183242 - DNA, 20 bp, Homo sapiens
tgtctttttctggactgaag

SEQ ID NO: 3183243 - DNA, 16 bp, Homo sapiens
tgtgaaaaaaattatt

SEQ ID NO: 3183244 - DNA, 13 bp, Homo sapiens
tgtgaaaaaagaa

SEQ ID NO: 3183245 - DNA, 16 bp, Homo sapiens
tgtgaaaagagtatgt

SEQ ID NO: 3183246 - DNA, 13 bp, Homo sapiens
tgtgaaaagtatc

SEQ ID NO: 3183247 - DNA, 11 bp, Homo sapiens
tgtgaaaatat

SEQ ID NO: 3183248 - DNA, 21 bp, Homo sapiens
tgtgaaaatatacttgactct

SEQ ID NO: 3183249 - DNA, 14 bp, Homo sapiens
tgtgaaaatgggtt

SEQ ID NO: 3183250 - DNA, 14 bp, Homo sapiens
tgtgaaacctgtga

SEQ ID NO: 3183251 - DNA, 20 bp, Homo sapiens
tgtgaaaccttttttaagat

SEQ ID NO: 3183252 - DNA, 17 bp, Homo sapiens
tgtgaaataaaacagga

SEQ ID NO: 3183253 - DNA, 20 bp, Homo sapiens
tgtgaaatcatcaaaaagaa

SEQ ID NO: 3183254 - DNA, 21 bp, Homo sapiens
tgtgaacaaatcaaattgctt

SEQ ID NO: 3183255 - DNA, 21 bp, Homo sapiens
tgtgaaccaccacacccagcc

SEQ ID NO: 3183256 - DNA, 14 bp, Homo sapiens
tgtgaactcaccct

SEQ ID NO: 3183257 - DNA, 22 bp, Homo sapiens
tgtgaactcaccctgggagcca

SEQ ID NO: 3183258 - DNA, 20 bp, Homo sapiens
tgtgaactggaagaaagcaa

SEQ ID NO: 3183259 - DNA, 21 bp, Homo sapiens
tgtgaacttgtagctgtaaaa

SEQ ID NO: 3183260 - DNA, 18 bp, Homo sapiens
tgtgaactttattaaata

SEQ ID NO: 3183261 - DNA, 17 bp, Homo sapiens
tgtgaagaatgtctgta

SEQ ID NO: 3183262 - DNA, 15 bp, Homo sapiens
tgtgaagaatttaga

SEQ ID NO: 3183263 - DNA, 20 bp, Homo sapiens
tgtgaagaatttagatctta

SEQ ID NO: 3183264 - DNA, 14 bp, Homo sapiens
tgtgaagacatttt

SEQ ID NO: 3183265 - DNA, 18 bp, Homo sapiens
tgtgaagataatttgcat

SEQ ID NO: 3183266 - DNA, 19 bp, Homo sapiens
tgtgaagataatttgcata

SEQ ID NO: 3183267 - DNA, 13 bp, Homo sapiens
tgtgaagcaccta

SEQ ID NO: 3183268 - DNA, 23 bp, Homo sapiens
tgtgaaggattatggaaaaataa

SEQ ID NO: 3183269 - DNA, 21 bp, Homo sapiens
tgtgaaggcccaagagcagag

SEQ ID NO: 3183270 - DNA, 12 bp, Homo sapiens
tgtgaataaatt

SEQ ID NO: 3183271 - DNA, 21 bp, Homo sapiens
tgtgaatatttccatatggat

SEQ ID NO: 3183272 - DNA, 11 bp, Homo sapiens
tgtgaatgcac

SEQ ID NO: 3183273 - DNA, 17 bp, Homo sapiens
tgtgaatgccactgcct

SEQ ID NO: 3183274 - DNA, 12 bp, Homo sapiens
tgtgaatgctaa

SEQ ID NO: 3183275 - DNA, 15 bp, Homo sapiens
tgtgaatgcttctca

SEQ ID NO: 3183276 - DNA, 16 bp, Homo sapiens
tgtgaatggattggat

SEQ ID NO: 3183277 - DNA, 22 bp, Homo sapiens
tgtgaatggattggattattta

SEQ ID NO: 3183278 - DNA, 18 bp, Homo sapiens
tgtgaattaaaaaagctc

SEQ ID NO: 3183279 - DNA, 15 bp, Homo sapiens
tgtgaattgactacc

SEQ ID NO: 3183280 - DNA, 12 bp, Homo sapiens
tgtgacaaaatt

SEQ ID NO: 3183281 - DNA, 19 bp, Homo sapiens
tgtgacaactgtctaactt

SEQ ID NO: 3183282 - DNA, 21 bp, Homo sapiens
tgtgacaaggattgctactgt

SEQ ID NO: 3183283 - DNA, 22 bp, Homo sapiens
tgtgacacccacaatcccacct

SEQ ID NO: 3183284 - DNA, 18 bp, Homo sapiens
tgtgacaggaaagccctc

SEQ ID NO: 3183285 - DNA, 22 bp, Homo sapiens
tgtgacaggaaagccctccccc

SEQ ID NO: 3183286 - DNA, 13 bp, Homo sapiens
tgtgacagggcca

SEQ ID NO: 3183287 - DNA, 15 bp, Homo sapiens
tgtgacagggccagt

SEQ ID NO: 3183288 - DNA, 22 bp, Homo sapiens
tgtgacagggccagtggggcct

SEQ ID NO: 3183289 - DNA, 17 bp, Homo sapiens
tgtgacatggtgcctga

SEQ ID NO: 3183290 - DNA, 20 bp, Homo sapiens
tgtgacatggtgcctgagag

SEQ ID NO: 3183291 - DNA, 17 bp, Homo sapiens
tgtgacatttatatatt

SEQ ID NO: 3183292 - DNA, 18 bp, Homo sapiens
tgtgaccaaaataccttg

SEQ ID NO: 3183293 - DNA, 14 bp, Homo sapiens
tgtgaccaactgtg

SEQ ID NO: 3183294 - DNA, 19 bp, Homo sapiens
tgtgaccaactgtgttgta

SEQ ID NO: 3183295 - DNA, 13 bp, Homo sapiens
tgtgaccaagtta

SEQ ID NO: 3183296 - DNA, 19 bp, Homo sapiens
tgtgaccaccttctgtccc

SEQ ID NO: 3183297 - DNA, 15 bp, Homo sapiens
tgtgacccaccagtg

SEQ ID NO: 3183298 - DNA, 16 bp, Homo sapiens
tgtgaccccactgcca

SEQ ID NO: 3183299 - DNA, 20 bp, Homo sapiens
tgtgacctcaggcactagcc

SEQ ID NO: 3183300 - DNA, 15 bp, Homo sapiens
tgtgacctgatttca

SEQ ID NO: 3183301 - DNA, 15 bp, Homo sapiens
tgtgacgcagacaga

SEQ ID NO: 3183302 - DNA, 19 bp, Homo sapiens
tgtgacgtcgggcattcat

SEQ ID NO: 3183303 - DNA, 19 bp, Homo sapiens
tgtgactagaaattcttaa

SEQ ID NO: 3183304 - DNA, 20 bp, Homo sapiens
tgtgactatatagagatgtt

SEQ ID NO: 3183305 - DNA, 21 bp, Homo sapiens
tgtgactggcaagaggcctca

SEQ ID NO: 3183306 - DNA, 20 bp, Homo sapiens
tgtgactgtacccaaatgga

SEQ ID NO: 3183307 - DNA, 18 bp, Homo sapiens
tgtgacttcagctctgtt

SEQ ID NO: 3183308 - DNA, 16 bp, Homo sapiens
tgtgacttttctgatt

SEQ ID NO: 3183309 - DNA, 19 bp, Homo sapiens
tgtgacttttctgattaat

SEQ ID NO: 3183310 - DNA, 20 bp, Homo sapiens
tgtgacttttctgattaata

SEQ ID NO: 3183311 - DNA, 19 bp, Homo sapiens
tgtgactttttagccagtg

SEQ ID NO: 3183312 - DNA, 14 bp, Homo sapiens
tgtgagaaaacgtt

SEQ ID NO: 3183313 - DNA, 21 bp, Homo sapiens
tgtgagaagtgaatgctggga

SEQ ID NO: 3183314 - DNA, 23 bp, Homo sapiens
tgtgagaagtgaatgctgggact

SEQ ID NO: 3183315 - DNA, 24 bp, Homo sapiens
tgtgagaagtgaatgctgggactc

SEQ ID NO: 3183316 - DNA, 13 bp, Homo sapiens
tgtgagaccccca

SEQ ID NO: 3183317 - DNA, 13 bp, Homo sapiens
tgtgagagaaagt

SEQ ID NO: 3183318 - DNA, 13 bp, Homo sapiens
tgtgagagcccat

SEQ ID NO: 3183319 - DNA, 17 bp, Homo sapiens
tgtgagagcgaggctga

SEQ ID NO: 3183320 - DNA, 15 bp, Homo sapiens
tgtgagatgctagaa

SEQ ID NO: 3183321 - DNA, 19 bp, Homo sapiens
tgtgagcaagcatttatgt

SEQ ID NO: 3183322 - DNA, 20 bp, Homo sapiens
tgtgagccccaggggggcct

SEQ ID NO: 3183323 - DNA, 22 bp, Homo sapiens
tgtgagccccaggggggcctcc

SEQ ID NO: 3183324 - DNA, 23 bp, Homo sapiens
tgtgagccccaggggggcctcct

SEQ ID NO: 3183325 - DNA, 21 bp, Homo sapiens
tgtgagcctatgatattcccc

SEQ ID NO: 3183326 - DNA, 14 bp, Homo sapiens
tgtgagcgccttgg

SEQ ID NO: 3183327 - DNA, 14 bp, Homo sapiens
tgtgaggagctgct

SEQ ID NO: 3183328 - DNA, 17 bp, Homo sapiens
tgtgaggagctgctggc

SEQ ID NO: 3183329 - DNA, 18 bp, Homo sapiens
tgtgaggagctgctggct

SEQ ID NO: 3183330 - DNA, 23 bp, Homo sapiens
tgtgaggcccatggttgagaaat

SEQ ID NO: 3183331 - DNA, 21 bp, Homo sapiens
tgtgagtcaccaagcccagtt

SEQ ID NO: 3183332 - DNA, 21 bp, Homo sapiens
tgtgagtctttggttctaagg

SEQ ID NO: 3183333 - DNA, 22 bp, Homo sapiens
tgtgagtctttggttctaagga

SEQ ID NO: 3183334 - DNA, 14 bp, Homo sapiens
tgtgagtggcagcc

SEQ ID NO: 3183335 - DNA, 15 bp, Homo sapiens
tgtgagtggcagcca

SEQ ID NO: 3183336 - DNA, 17 bp, Homo sapiens
tgtgagtggcagccatg

SEQ ID NO: 3183337 - DNA, 16 bp, Homo sapiens
tgtgagtgtaagtgtg

SEQ ID NO: 3183338 - DNA, 13 bp, Homo sapiens
tgtgagtgtgaca

SEQ ID NO: 3183339 - DNA, 17 bp, Homo sapiens
tgtggtgcagtgtgaaa

SEQ ID NO: 3183340 - DNA, 15 bp, Homo sapiens
tgtggtgcctgaggt

SEQ ID NO: 3183341 - DNA, 19 bp, Homo sapiens
tgtggtgcctgaggtctgt

SEQ ID NO: 3183342 - DNA, 15 bp, Homo sapiens
tgtggtggcctcagc

SEQ ID NO: 3183343 - DNA, 12 bp, Homo sapiens
tgtggtgtaaag

SEQ ID NO: 3183344 - DNA, 18 bp, Homo sapiens
tgtggtgtaaagctggcc

SEQ ID NO: 3183345 - DNA, 14 bp, Homo sapiens
tgtggtgtaattta

SEQ ID NO: 3183346 - DNA, 20 bp, Homo sapiens
tgtggtgtaatttataaaat

SEQ ID NO: 3183347 - DNA, 12 bp, Homo sapiens
tgtggtgtgacc

SEQ ID NO: 3183348 - DNA, 15 bp, Homo sapiens
tgtggtgtgaccatg

SEQ ID NO: 3183349 - DNA, 20 bp, Homo sapiens
tgtggtgtgaccatgttcat

SEQ ID NO: 3183350 - DNA, 21 bp, Homo sapiens
tgtggttcagctactttccat

SEQ ID NO: 3183351 - DNA, 22 bp, Homo sapiens
tgtggttcagctactttccatt

SEQ ID NO: 3183352 - DNA, 22 bp, Homo sapiens
tgtggttccatgcagccttggg

SEQ ID NO: 3183353 - DNA, 13 bp, Homo sapiens
tgtggttcctctg

SEQ ID NO: 3183354 - DNA, 18 bp, Homo sapiens
tgtggttctattttactt

SEQ ID NO: 3183355 - DNA, 19 bp, Homo sapiens
tgtggttgacttatgggcc

SEQ ID NO: 3183356 - DNA, 16 bp, Homo sapiens
tgtggttgtagaagga

SEQ ID NO: 3183357 - DNA, 21 bp, Homo sapiens
tgtggtttcagttctgtgtac

SEQ ID NO: 3183358 - DNA, 17 bp, Homo sapiens
tgtggtttcatgttagt

SEQ ID NO: 3183359 - DNA, 22 bp, Homo sapiens
tgtggtttcatgttagttacct

SEQ ID NO: 3183360 - DNA, 22 bp, Homo sapiens
tgtggtttggttcctctctggt

SEQ ID NO: 3183361 - DNA, 10 bp, Homo sapiens
tgtggtttta

SEQ ID NO: 3183362 - DNA, 14 bp, Homo sapiens
tgtggttttatgga

SEQ ID NO: 3183363 - DNA, 17 bp, Homo sapiens
tgtggttttatggagac

SEQ ID NO: 3183364 - DNA, 20 bp, Homo sapiens
tgtgtaaaaaatggaaaaaa

SEQ ID NO: 3183365 - DNA, 21 bp, Homo sapiens
tgtgtaaatatgtacatttgt

SEQ ID NO: 3183366 - DNA, 15 bp, Homo sapiens
tgtgtaacactgtgt

SEQ ID NO: 3183367 - DNA, 12 bp, Homo sapiens
tgtgtaagaaaa

SEQ ID NO: 3183368 - DNA, 16 bp, Homo sapiens
tgtgtaagaaaacaaa

SEQ ID NO: 3183369 - DNA, 18 bp, Homo sapiens
tgtgtaagagaatgttga

SEQ ID NO: 3183370 - DNA, 19 bp, Homo sapiens
tgtgtaagagaatgttgaa

SEQ ID NO: 3183371 - DNA, 22 bp, Homo sapiens
tgtgtaaggtatatgttttata

SEQ ID NO: 3183372 - DNA, 15 bp, Homo sapiens
tgtgtaataaagtgt

SEQ ID NO: 3183373 - DNA, 16 bp, Homo sapiens
tgtgtaatagaaaact

SEQ ID NO: 3183374 - DNA, 21 bp, Homo sapiens
tgtgtaatagaaaactgaaaa

SEQ ID NO: 3183375 - DNA, 21 bp, Homo sapiens
tgtgtaattagtgccacttaa

SEQ ID NO: 3183376 - DNA, 13 bp, Homo sapiens
tgtgtacacatgg

SEQ ID NO: 3183377 - DNA, 15 bp, Homo sapiens
tgtgtacagtgaatt

SEQ ID NO: 3183378 - DNA, 19 bp, Homo sapiens
tgtgtacagtgaattgtct

SEQ ID NO: 3183379 - DNA, 23 bp, Homo sapiens
tgtgtacagtgaattgtctttta

SEQ ID NO: 3183380 - DNA, 20 bp, Homo sapiens
tgtgtacataactctgtaaa

SEQ ID NO: 3183381 - DNA, 19 bp, Homo sapiens
tgtgtacatggcagagttt

SEQ ID NO: 3183382 - DNA, 22 bp, Homo sapiens
tgtgtactcactgaagcctgcg

SEQ ID NO: 3183383 - DNA, 16 bp, Homo sapiens
tgtgtactgataaaat

SEQ ID NO: 3183384 - DNA, 17 bp, Homo sapiens
tgtgtactgataaaata

SEQ ID NO: 3183385 - DNA, 19 bp, Homo sapiens
tgtgtagagttaagaagct

SEQ ID NO: 3183386 - DNA, 14 bp, Homo sapiens
tgtgtagccttttt

SEQ ID NO: 3183387 - DNA, 20 bp, Homo sapiens
tgtgtagcctttttgtataa

SEQ ID NO: 3183388 - DNA, 14 bp, Homo sapiens
tgtgtagctttgct

SEQ ID NO: 3183389 - DNA, 17 bp, Homo sapiens
tgtgtagctttgctctt

SEQ ID NO: 3183390 - DNA, 14 bp, Homo sapiens
tgtgtaggctgggg

SEQ ID NO: 3183391 - DNA, 22 bp, Homo sapiens
tgtgtatacagccctgacgcaa

SEQ ID NO: 3183392 - DNA, 22 bp, Homo sapiens
tgtgtatatattttgtgtgaaa

SEQ ID NO: 3183393 - DNA, 10 bp, Homo sapiens
tgtgtatccg

SEQ ID NO: 3183394 - DNA, 19 bp, Homo sapiens
tgtgtatccgactctaagc

SEQ ID NO: 3183395 - DNA, 20 bp, Homo sapiens
tgtgtatgctgatgatcaaa

SEQ ID NO: 3183396 - DNA, 16 bp, Homo sapiens
tgtgtatgtacatata

SEQ ID NO: 3183397 - DNA, 14 bp, Homo sapiens
tgtgtattgttccc

SEQ ID NO: 3183398 - DNA, 18 bp, Homo sapiens
tgtgtatttaattgtaaa

SEQ ID NO: 3183399 - DNA, 22 bp, Homo sapiens
tgtgtatttaattgtaaactgt

SEQ ID NO: 3183400 - DNA, 19 bp, Homo sapiens
tgtgtatttccagtgcaat

SEQ ID NO: 3183401 - DNA, 16 bp, Homo sapiens
tgtgtattttcctgga

SEQ ID NO: 3183402 - DNA, 17 bp, Homo sapiens
tgtgtcaagacatttct

SEQ ID NO: 3183403 - DNA, 17 bp, Homo sapiens
tgtgtcacagttcttgg

SEQ ID NO: 3183404 - DNA, 21 bp, Homo sapiens
tgtgtcacttgtgctttgctc

SEQ ID NO: 3183405 - DNA, 22 bp, Homo sapiens
tgtgtcacttgtgctttgctct

SEQ ID NO: 3183406 - DNA, 17 bp, Homo sapiens
tgtgtcagaaacatgaa

SEQ ID NO: 3183407 - DNA, 18 bp, Homo sapiens
tgtgtcatttattcaagt

SEQ ID NO: 3183408 - DNA, 16 bp, Homo sapiens
tgtgtccacctgtggg

SEQ ID NO: 3183409 - DNA, 14 bp, Homo sapiens
tgtgtccagcagct

SEQ ID NO: 3183410 - DNA, 14 bp, Homo sapiens
tgtgtcccatgacc

SEQ ID NO: 3183411 - DNA, 21 bp, Homo sapiens
tgtgtcccatgacccacccct

SEQ ID NO: 3183412 - DNA, 12 bp, Homo sapiens
tgtgtcccctca

SEQ ID NO: 3183413 - DNA, 18 bp, Homo sapiens
tgtgtcccctcactctgt

SEQ ID NO: 3183414 - DNA, 19 bp, Homo sapiens
tgtgtcccctcactctgtc

SEQ ID NO: 3183415 - DNA, 15 bp, Homo sapiens
tgtgtctaagattct

SEQ ID NO: 3183416 - DNA, 19 bp, Homo sapiens
tgtgtctaagattctagat

SEQ ID NO: 3183417 - DNA, 16 bp, Homo sapiens
tgtgtctcttttctct

SEQ ID NO: 3183418 - DNA, 19 bp, Homo sapiens
tgtgtctgcgtctgtgttg

SEQ ID NO: 3183419 - DNA, 22 bp, Homo sapiens
tgtgtctgctttaaagggcctg

SEQ ID NO: 3183420 - DNA, 14 bp, Homo sapiens
tgtgtctggacctc

SEQ ID NO: 3183421 - DNA, 13 bp, Homo sapiens
tgtgtctgtacac

SEQ ID NO: 3183422 - DNA, 21 bp, Homo sapiens
tgtgtctgtgccctccaaaga

SEQ ID NO: 3183423 - DNA, 20 bp, Homo sapiens
tgtgtcttgcaatggcagcc

SEQ ID NO: 3183424 - DNA, 18 bp, Homo sapiens
tgtgtctttatagatgta

SEQ ID NO: 3183425 - DNA, 13 bp, Homo sapiens
tgtgtctttctct

SEQ ID NO: 3183426 - DNA, 22 bp, Homo sapiens
tgtgtgaaaaaagaaaatggct

SEQ ID NO: 3183427 - DNA, 20 bp, Homo sapiens
tgtgtgaaataccagtgtgg

SEQ ID NO: 3183428 - DNA, 20 bp, Homo sapiens
tgtgtgaactgctttcaagt

SEQ ID NO: 3183429 - DNA, 22 bp, Homo sapiens
tgtgtgaatgaacactcttttg

SEQ ID NO: 3183430 - DNA, 13 bp, Homo sapiens
tgtgtgaatgtgg

SEQ ID NO: 3183431 - DNA, 20 bp, Homo sapiens
tgtgtgacaattctgttttt

SEQ ID NO: 3183432 - DNA, 16 bp, Homo sapiens
tgtgtgaccaactgtg

SEQ ID NO: 3183433 - DNA, 20 bp, Homo sapiens
tgtgtgaccaactgtgttgt

SEQ ID NO: 3183434 - DNA, 16 bp, Homo sapiens
tgtgtgacttacagaa

SEQ ID NO: 3183435 - DNA, 17 bp, Homo sapiens
tgtgtgagcaagcattt

SEQ ID NO: 3183436 - DNA, 17 bp, Homo sapiens
tgtgtgaggagctgctg

SEQ ID NO: 3183437 - DNA, 15 bp, Homo sapiens
tgtgtgattaaaagg

SEQ ID NO: 3183438 - DNA, 16 bp, Homo sapiens
tgtgtgattgaatctg

SEQ ID NO: 3183439 - DNA, 22 bp, Homo sapiens
tgtgtgcaacagggtatggact

SEQ ID NO: 3183440 - DNA, 13 bp, Homo sapiens
tgtgtgcagtgaa

SEQ ID NO: 3183441 - DNA, 16 bp, Homo sapiens
tgtgtgcctgtggcag

SEQ ID NO: 3183442 - DNA, 17 bp, Homo sapiens
tgtgtgctcatgtatgt

SEQ ID NO: 3183443 - DNA, 21 bp, Homo sapiens
tgtgtgcttacagtaactaat

SEQ ID NO: 3183444 - DNA, 13 bp, Homo sapiens
tgtgtgctttccc

SEQ ID NO: 3183445 - DNA, 19 bp, Homo sapiens
tgtgtggactgtgatgcca

SEQ ID NO: 3183446 - DNA, 17 bp, Homo sapiens
tgtgtgggactgtacac

SEQ ID NO: 3183447 - DNA, 15 bp, Homo sapiens
tgtgtgggatactta

SEQ ID NO: 3183448 - DNA, 19 bp, Homo sapiens
tgtgtggtgtcgtctgtga

SEQ ID NO: 3183449 - DNA, 21 bp, Homo sapiens
tgtgtggtttcagttctgtgt

SEQ ID NO: 3183450 - DNA, 16 bp, Homo sapiens
tgtgtgtaatctgtta

SEQ ID NO: 3183451 - DNA, 11 bp, Homo sapiens
tgtgtgtactc

SEQ ID NO: 3183452 - DNA, 14 bp, Homo sapiens
tgtgtgtatacatg

SEQ ID NO: 3183453 - DNA, 22 bp, Homo sapiens
tgtgtgtatatatgtgtatata

SEQ ID NO: 3183454 - DNA, 15 bp, Homo sapiens
tgtgtgtatgctgat

SEQ ID NO: 3183455 - DNA, 16 bp, Homo sapiens
tgtgtgtgaatgaaca

SEQ ID NO: 3183456 - DNA, 16 bp, Homo sapiens
tgtgtgtgacaattct

SEQ ID NO: 3183457 - DNA, 13 bp, Homo sapiens
tgtgtgtgagttt

SEQ ID NO: 3183458 - DNA, 16 bp, Homo sapiens
tgtgtgtgagtttgct

SEQ ID NO: 3183459 - DNA, 13 bp, Homo sapiens
tgtgtgtggcagg

SEQ ID NO: 3183460 - DNA, 14 bp, Homo sapiens
tgtgtgtggcaggg

SEQ ID NO: 3183461 - DNA, 19 bp, Homo sapiens
tgtgtgtgggctgtgagtg

SEQ ID NO: 3183462 - DNA, 11 bp, Homo sapiens
tgtgtgtgtac

SEQ ID NO: 3183463 - DNA, 14 bp, Homo sapiens
tgtgtgtgtgtact

SEQ ID NO: 3183464 - DNA, 13 bp, Homo sapiens
tgtgtgtgttctt

SEQ ID NO: 3183465 - DNA, 20 bp, Homo sapiens
tgtttactcattgaagcaga

SEQ ID NO: 3183466 - DNA, 15 bp, Homo sapiens
tgtttacttgtaaat

SEQ ID NO: 3183467 - DNA, 21 bp, Homo sapiens
tgtttagagtaaataaactgt

SEQ ID NO: 3183468 - DNA, 17 bp, Homo sapiens
tgtttagcagcagcctt

SEQ ID NO: 3183469 - DNA, 19 bp, Homo sapiens
tgtttataatctgaagata

SEQ ID NO: 3183470 - DNA, 14 bp, Homo sapiens
tgtttatactgtat

SEQ ID NO: 3183471 - DNA, 17 bp, Homo sapiens
tgtttatatggaagaaa

SEQ ID NO: 3183472 - DNA, 14 bp, Homo sapiens
tgtttatatggcgt

SEQ ID NO: 3183473 - DNA, 14 bp, Homo sapiens
tgtttatgagccag

SEQ ID NO: 3183474 - DNA, 16 bp, Homo sapiens
tgtttatgagccagac

SEQ ID NO: 3183475 - DNA, 21 bp, Homo sapiens
tgtttatgagccagacaaatg

SEQ ID NO: 3183476 - DNA, 15 bp, Homo sapiens
tgtttattaaatgct

SEQ ID NO: 3183477 - DNA, 16 bp, Homo sapiens
tgtttattaacaaatt

SEQ ID NO: 3183478 - DNA, 18 bp, Homo sapiens
tgtttattcctgataata

SEQ ID NO: 3183479 - DNA, 16 bp, Homo sapiens
tgtttattcttctaga

SEQ ID NO: 3183480 - DNA, 14 bp, Homo sapiens
tgtttattgagttt

SEQ ID NO: 3183481 - DNA, 14 bp, Homo sapiens
tgtttattgtaaaa

SEQ ID NO: 3183482 - DNA, 23 bp, Homo sapiens
tgtttatttttatatagcttgaa

SEQ ID NO: 3183483 - DNA, 14 bp, Homo sapiens
tgtttatttttcat

SEQ ID NO: 3183484 - DNA, 20 bp, Homo sapiens
tgtttcaaggcactctagat

SEQ ID NO: 3183485 - DNA, 15 bp, Homo sapiens
tgtttcaatcactgt

SEQ ID NO: 3183486 - DNA, 17 bp, Homo sapiens
tgtttcacgtaagactt

SEQ ID NO: 3183487 - DNA, 17 bp, Homo sapiens
tgtttcagcttctctgc

SEQ ID NO: 3183488 - DNA, 14 bp, Homo sapiens
tgtttcatctaagt

SEQ ID NO: 3183489 - DNA, 13 bp, Homo sapiens
tgtttcatgtttt

SEQ ID NO: 3183490 - DNA, 19 bp, Homo sapiens
tgtttcatgttttgtgact

SEQ ID NO: 3183491 - DNA, 21 bp, Homo sapiens
tgtttcatgttttgtgactat

SEQ ID NO: 3183492 - DNA, 23 bp, Homo sapiens
tgtttccagacttccttgagaca

SEQ ID NO: 3183493 - DNA, 20 bp, Homo sapiens
tgtttccagcagaagacaaa

SEQ ID NO: 3183494 - DNA, 21 bp, Homo sapiens
tgtttccagcagaagacaaaa

SEQ ID NO: 3183495 - DNA, 14 bp, Homo sapiens
tgtttccagggtct

SEQ ID NO: 3183496 - DNA, 19 bp, Homo sapiens
tgtttccatattttatagg

SEQ ID NO: 3183497 - DNA, 14 bp, Homo sapiens
tgtttcccataatt

SEQ ID NO: 3183498 - DNA, 12 bp, Homo sapiens
tgtttccctgct

SEQ ID NO: 3183499 - DNA, 15 bp, Homo sapiens
tgtttcccttgcttt

SEQ ID NO: 3183500 - DNA, 22 bp, Homo sapiens
tgtttccttgttggtcagagga

SEQ ID NO: 3183501 - DNA, 20 bp, Homo sapiens
tgtttctaccggagagagaa

SEQ ID NO: 3183502 - DNA, 18 bp, Homo sapiens
tgtttctcttgagctggc

SEQ ID NO: 3183503 - DNA, 20 bp, Homo sapiens
tgtttctcttgagctggcct

SEQ ID NO: 3183504 - DNA, 14 bp, Homo sapiens
tgtttctgaaaatt

SEQ ID NO: 3183505 - DNA, 19 bp, Homo sapiens
tgtttctgactctgagcta

SEQ ID NO: 3183506 - DNA, 20 bp, Homo sapiens
tgtttctgggtcctgaagaa

SEQ ID NO: 3183507 - DNA, 16 bp, Homo sapiens
tgtttcttaaatggaa

SEQ ID NO: 3183508 - DNA, 13 bp, Homo sapiens
tgtttcttcctgc

SEQ ID NO: 3183509 - DNA, 17 bp, Homo sapiens
tgtttcttgtttattga

SEQ ID NO: 3183510 - DNA, 18 bp, Homo sapiens
tgtttcttttgtttggta

SEQ ID NO: 3183511 - DNA, 21 bp, Homo sapiens
tgtttcttttgtttggtaaat

SEQ ID NO: 3183512 - DNA, 23 bp, Homo sapiens
tgtttctttttacagcattgtct

SEQ ID NO: 3183513 - DNA, 13 bp, Homo sapiens
tgtttgaaagtag

SEQ ID NO: 3183514 - DNA, 14 bp, Homo sapiens
tgtttgacacctct

SEQ ID NO: 3183515 - DNA, 23 bp, Homo sapiens
tgtttgaggcaaattaactgtat

SEQ ID NO: 3183516 - DNA, 19 bp, Homo sapiens
tgtttgatgctatttatgc

SEQ ID NO: 3183517 - DNA, 21 bp, Homo sapiens
tgtttgatgctatttatgcaa

SEQ ID NO: 3183518 - DNA, 15 bp, Homo sapiens
tgtttgatgtatgtg

SEQ ID NO: 3183519 - DNA, 16 bp, Homo sapiens
tgtttgatgtatgtgt

SEQ ID NO: 3183520 - DNA, 19 bp, Homo sapiens
tgtttgatgtccccaaagt

SEQ ID NO: 3183521 - DNA, 17 bp, Homo sapiens
tgtttgcagcctgctct

SEQ ID NO: 3183522 - DNA, 16 bp, Homo sapiens
tgtttgccaggacatg

SEQ ID NO: 3183523 - DNA, 19 bp, Homo sapiens
tgtttgccaggacatgcaa

SEQ ID NO: 3183524 - DNA, 20 bp, Homo sapiens
tgtttgccttctacttttaa

SEQ ID NO: 3183525 - DNA, 17 bp, Homo sapiens
tgtttgcttaaacaaag

SEQ ID NO: 3183526 - DNA, 15 bp, Homo sapiens
tgtttgcttattgtt

SEQ ID NO: 3183527 - DNA, 16 bp, Homo sapiens
tgtttgcttattgttc

SEQ ID NO: 3183528 - DNA, 21 bp, Homo sapiens
tgtttgcttattgttccaaga

SEQ ID NO: 3183529 - DNA, 23 bp, Homo sapiens
tgtttgcttattgttccaagaca

SEQ ID NO: 3183530 - DNA, 18 bp, Homo sapiens
tgtttgcttcataaatga

SEQ ID NO: 3183531 - DNA, 22 bp, Homo sapiens
tgtttgcttggaaattccttgc

SEQ ID NO: 3183532 - DNA, 16 bp, Homo sapiens
tgtttggaaaagacag

SEQ ID NO: 3183533 - DNA, 17 bp, Homo sapiens
tgtttggatgtaattta

SEQ ID NO: 3183534 - DNA, 15 bp, Homo sapiens
tgtttggcacttgta

SEQ ID NO: 3183535 - DNA, 17 bp, Homo sapiens
tgtttgggatgaccagg

SEQ ID NO: 3183536 - DNA, 19 bp, Homo sapiens
tgtttggggatgagaaagg

SEQ ID NO: 3183537 - DNA, 18 bp, Homo sapiens
tgtttgggggacgtttct

SEQ ID NO: 3183538 - DNA, 24 bp, Homo sapiens
tgtttgggggacgtttctcatttg

SEQ ID NO: 3183539 - DNA, 23 bp, Homo sapiens
tgtttgggtatcctgcccagtgt

SEQ ID NO: 3183540 - DNA, 14 bp, Homo sapiens
tgtttggtaaatgt

SEQ ID NO: 3183541 - DNA, 15 bp, Homo sapiens
tgtttggtaaatgtt

SEQ ID NO: 3183542 - DNA, 19 bp, Homo sapiens
tgtttggtgcatagaactg

SEQ ID NO: 3183543 - DNA, 20 bp, Homo sapiens
tgtttggtgtttgtctgtgt

SEQ ID NO: 3183544 - DNA, 13 bp, Homo sapiens
tgtttgtaaataa

SEQ ID NO: 3183545 - DNA, 16 bp, Homo sapiens
tgtttgtaaataagag

SEQ ID NO: 3183546 - DNA, 17 bp, Homo sapiens
tgtttgtaaatgcctct

SEQ ID NO: 3183547 - DNA, 13 bp, Homo sapiens
tgtttgtaaatta

SEQ ID NO: 3183548 - DNA, 20 bp, Homo sapiens
tgtttgtacacaacaatcct

SEQ ID NO: 3183549 - DNA, 15 bp, Homo sapiens
tgtttgtatttggaa

SEQ ID NO: 3183550 - DNA, 23 bp, Homo sapiens
tgtttgtattttttatttacatt

SEQ ID NO: 3183551 - DNA, 15 bp, Homo sapiens
tgtttgtctggattg

SEQ ID NO: 3183552 - DNA, 14 bp, Homo sapiens
tgtttgtgtattta

SEQ ID NO: 3183553 - DNA, 21 bp, Homo sapiens
tgtttgttaaaactggcatct

SEQ ID NO: 3183554 - DNA, 15 bp, Homo sapiens
tgtttgttctcttat

SEQ ID NO: 3183555 - DNA, 13 bp, Homo sapiens
tgtttgtttaatt

SEQ ID NO: 3183556 - DNA, 12 bp, Homo sapiens
tgttttaaaaaa

SEQ ID NO: 3183557 - DNA, 22 bp, Homo sapiens
tgttttaaagaatatgactttt

SEQ ID NO: 3183558 - DNA, 22 bp, Homo sapiens
tgttttaaatacgcactacatg

SEQ ID NO: 3183559 - DNA, 22 bp, Homo sapiens
tgttttaaatttatttcaaaaa

SEQ ID NO: 3183560 - DNA, 16 bp, Homo sapiens
tgttttaagaggcagg

SEQ ID NO: 3183561 - DNA, 23 bp, Homo sapiens
tgttttaatttaaacacctcctc

SEQ ID NO: 3183562 - DNA, 13 bp, Homo sapiens
tgttttacaatgt

SEQ ID NO: 3183563 - DNA, 16 bp, Homo sapiens
tgttttactctttttc

SEQ ID NO: 3183564 - DNA, 16 bp, Homo sapiens
tgttttactgtcagat

SEQ ID NO: 3183565 - DNA, 19 bp, Homo sapiens
tgttttactgtcagattaa

SEQ ID NO: 3183566 - DNA, 20 bp, Homo sapiens
tgttttactgtcagattaaa

SEQ ID NO: 3183567 - DNA, 18 bp, Homo sapiens
tgttttactgtgaaactg

SEQ ID NO: 3183568 - DNA, 19 bp, Homo sapiens
tgttttataaaattttgct

SEQ ID NO: 3183569 - DNA, 15 bp, Homo sapiens
tgttttataagttca

SEQ ID NO: 3183570 - DNA, 12 bp, Homo sapiens
tgttttatatat

SEQ ID NO: 3183571 - DNA, 23 bp, Homo sapiens
tgttttatatattatgtgaagaa

SEQ ID NO: 3183572 - DNA, 18 bp, Homo sapiens
tgttttattttttattgt

SEQ ID NO: 3183573 - DNA, 17 bp, Homo sapiens
tgttttcacttgtattg

SEQ ID NO: 3183574 - DNA, 23 bp, Homo sapiens
tgttttcattcccccttcctagt

SEQ ID NO: 3183575 - DNA, 16 bp, Homo sapiens
tgttttccgtgaaaac

SEQ ID NO: 3183576 - DNA, 19 bp, Homo sapiens
tgttttccgtgaaaacgga

SEQ ID NO: 3183577 - DNA, 23 bp, Homo sapiens
tgttttctgagcccgggctgcct

SEQ ID NO: 3183578 - DNA, 11 bp, Homo sapiens
tgttttcttct

SEQ ID NO: 3183579 - DNA, 16 bp, Homo sapiens
tgttttctttctttaa

SEQ ID NO: 3183580 - DNA, 21 bp, Homo sapiens
tgttttctttctttaaatgtt

SEQ ID NO: 3183581 - DNA, 17 bp, Homo sapiens
tgttttgaaggcaaaat

SEQ ID NO: 3183582 - DNA, 15 bp, Homo sapiens
tgttttgaattttgt

SEQ ID NO: 3183583 - DNA, 17 bp, Homo sapiens
tgttttgacggatgatt

SEQ ID NO: 3183584 - DNA, 20 bp, Homo sapiens
tgttttgatgtttgtggcct

SEQ ID NO: 3183585 - DNA, 14 bp, Homo sapiens
tgttttgcactttt

SEQ ID NO: 3183586 - DNA, 17 bp, Homo sapiens
tgttttgggactttttt

SEQ ID NO: 3183587 - DNA, 16 bp, Homo sapiens
tgttttggtagattaa

SEQ ID NO: 3183588 - DNA, 19 bp, Homo sapiens
tgttttggtagattaaata

SEQ ID NO: 3183589 - DNA, 21 bp, Homo sapiens
tgttttggtagattaaatata

SEQ ID NO: 3183590 - DNA, 13 bp, Homo sapiens
ttcagagaatatc

SEQ ID NO: 3183591 - DNA, 22 bp, Homo sapiens
ttcagagaccttaatttatatt

SEQ ID NO: 3183592 - DNA, 19 bp, Homo sapiens
ttcagagagctaaattaca

SEQ ID NO: 3183593 - DNA, 13 bp, Homo sapiens
ttcagagagctgg

SEQ ID NO: 3183594 - DNA, 15 bp, Homo sapiens
ttcagagaggccttt

SEQ ID NO: 3183595 - DNA, 23 bp, Homo sapiens
ttcagagtttgtgtgtatttgta

SEQ ID NO: 3183596 - DNA, 14 bp, Homo sapiens
ttcagatatcaaaa

SEQ ID NO: 3183597 - DNA, 15 bp, Homo sapiens
ttcagatatcaaaat

SEQ ID NO: 3183598 - DNA, 18 bp, Homo sapiens
ttcagatatcaaaattct

SEQ ID NO: 3183599 - DNA, 19 bp, Homo sapiens
ttcagatatcaaaattcta

SEQ ID NO: 3183600 - DNA, 15 bp, Homo sapiens
ttcagatgcttctgg

SEQ ID NO: 3183601 - DNA, 19 bp, Homo sapiens
ttcagatgtcttctgcctg

SEQ ID NO: 3183602 - DNA, 20 bp, Homo sapiens
ttcagatgtcttctgcctgt

SEQ ID NO: 3183603 - DNA, 15 bp, Homo sapiens
ttcagatgtgcattt

SEQ ID NO: 3183604 - DNA, 17 bp, Homo sapiens
ttcagatgtgcatttca

SEQ ID NO: 3183605 - DNA, 19 bp, Homo sapiens
ttcagcaagttagaactag

SEQ ID NO: 3183606 - DNA, 16 bp, Homo sapiens
ttcagcaccaccctag

SEQ ID NO: 3183607 - DNA, 13 bp, Homo sapiens
ttcagcaccctgg

SEQ ID NO: 3183608 - DNA, 13 bp, Homo sapiens
ttcagcactgtcc

SEQ ID NO: 3183609 - DNA, 18 bp, Homo sapiens
ttcagcattaggctttta

SEQ ID NO: 3183610 - DNA, 10 bp, Homo sapiens
ttcagccaag

SEQ ID NO: 3183611 - DNA, 13 bp, Homo sapiens
ttcagcccccagc

SEQ ID NO: 3183612 - DNA, 18 bp, Homo sapiens
ttcagctcaattgttaat

SEQ ID NO: 3183613 - DNA, 14 bp, Homo sapiens
ttcagctctggaga

SEQ ID NO: 3183614 - DNA, 15 bp, Homo sapiens
ttcagctgagccctg

SEQ ID NO: 3183615 - DNA, 23 bp, Homo sapiens
ttcagctgcctgaaacagccatg

SEQ ID NO: 3183616 - DNA, 21 bp, Homo sapiens
ttcagctgtcctccctccacc

SEQ ID NO: 3183617 - DNA, 14 bp, Homo sapiens
ttcagcttcatttg

SEQ ID NO: 3183618 - DNA, 22 bp, Homo sapiens
ttcagcttgtaaatagctcagg

SEQ ID NO: 3183619 - DNA, 22 bp, Homo sapiens
ttcaggaacaagtaatgtatta

SEQ ID NO: 3183620 - DNA, 16 bp, Homo sapiens
ttcaggaagataaaaa

SEQ ID NO: 3183621 - DNA, 18 bp, Homo sapiens
ttcaggaatttaaaatta

SEQ ID NO: 3183622 - DNA, 21 bp, Homo sapiens
ttcaggacttaacggctccag

SEQ ID NO: 3183623 - DNA, 18 bp, Homo sapiens
ttcaggagcgcaagatag

SEQ ID NO: 3183624 - DNA, 19 bp, Homo sapiens
ttcaggagcgcaagataga

SEQ ID NO: 3183625 - DNA, 12 bp, Homo sapiens
ttcaggagggat

SEQ ID NO: 3183626 - DNA, 17 bp, Homo sapiens
ttcaggagttggaatgt

SEQ ID NO: 3183627 - DNA, 16 bp, Homo sapiens
ttcaggcatattttaa

SEQ ID NO: 3183628 - DNA, 13 bp, Homo sapiens
ttcaggccagccc

SEQ ID NO: 3183629 - DNA, 15 bp, Homo sapiens
ttcaggccagcccag

SEQ ID NO: 3183630 - DNA, 13 bp, Homo sapiens
ttcaggctgcttg

SEQ ID NO: 3183631 - DNA, 21 bp, Homo sapiens
ttcaggcttcctgcaattttc

SEQ ID NO: 3183632 - DNA, 23 bp, Homo sapiens
ttcagggaaccgttattataatt

SEQ ID NO: 3183633 - DNA, 13 bp, Homo sapiens
ttcagggagaaac

SEQ ID NO: 3183634 - DNA, 18 bp, Homo sapiens
ttcagggcagggctctga

SEQ ID NO: 3183635 - DNA, 13 bp, Homo sapiens
ttcagggccagaa

SEQ ID NO: 3183636 - DNA, 23 bp, Homo sapiens
ttcagggccagaaggagggcaga

SEQ ID NO: 3183637 - DNA, 16 bp, Homo sapiens
ttcaggggactcagcc

SEQ ID NO: 3183638 - DNA, 15 bp, Homo sapiens
ttcaggggctggggg

SEQ ID NO: 3183639 - DNA, 19 bp, Homo sapiens
ttcagggtggtaaagtatg

SEQ ID NO: 3183640 - DNA, 19 bp, Homo sapiens
ttcagggttggcccctgcc

SEQ ID NO: 3183641 - DNA, 15 bp, Homo sapiens
ttcagggtttaatag

SEQ ID NO: 3183642 - DNA, 22 bp, Homo sapiens
ttcaggtaaagggcaaataatg

SEQ ID NO: 3183643 - DNA, 16 bp, Homo sapiens
ttcaggtaacaggcag

SEQ ID NO: 3183644 - DNA, 13 bp, Homo sapiens
ttcaggtaggccc

SEQ ID NO: 3183645 - DNA, 15 bp, Homo sapiens
ttcaggtaggccctt

SEQ ID NO: 3183646 - DNA, 22 bp, Homo sapiens
ttcaggtaggcccttgtcctgc

SEQ ID NO: 3183647 - DNA, 20 bp, Homo sapiens
ttcaggtcccacgtctggcc

SEQ ID NO: 3183648 - DNA, 19 bp, Homo sapiens
ttcaggtgacatgtgaaac

SEQ ID NO: 3183649 - DNA, 21 bp, Homo sapiens
ttcaggttatcgaaataacaa

SEQ ID NO: 3183650 - DNA, 23 bp, Homo sapiens
ttcagtaagtctcataggttaaa

SEQ ID NO: 3183651 - DNA, 18 bp, Homo sapiens
ttcagtaataaaacatct

SEQ ID NO: 3183652 - DNA, 14 bp, Homo sapiens
ttcagtaataactc

SEQ ID NO: 3183653 - DNA, 21 bp, Homo sapiens
ttcagtaccctctcagctcca

SEQ ID NO: 3183654 - DNA, 18 bp, Homo sapiens
ttcagtagaattaccatt

SEQ ID NO: 3183655 - DNA, 14 bp, Homo sapiens
ttcagtatactgtg

SEQ ID NO: 3183656 - DNA, 17 bp, Homo sapiens
ttcagtatactgtgtgg

SEQ ID NO: 3183657 - DNA, 18 bp, Homo sapiens
ttcagtattttggagaaa

SEQ ID NO: 3183658 - DNA, 17 bp, Homo sapiens
ttcagtccaataggtgt

SEQ ID NO: 3183659 - DNA, 20 bp, Homo sapiens
ttcagtctgaatgctgccac

SEQ ID NO: 3183660 - DNA, 16 bp, Homo sapiens
ttcagtgactcctgct

SEQ ID NO: 3183661 - DNA, 17 bp, Homo sapiens
ttcagtgactcctgctg

SEQ ID NO: 3183662 - DNA, 21 bp, Homo sapiens
ttcagtgcaaattgtatctta

SEQ ID NO: 3183663 - DNA, 15 bp, Homo sapiens
ttcagtggaattgta

SEQ ID NO: 3183664 - DNA, 13 bp, Homo sapiens
ttcagtggcagct

SEQ ID NO: 3183665 - DNA, 15 bp, Homo sapiens
ttcagtggcagctgc

SEQ ID NO: 3183666 - DNA, 17 bp, Homo sapiens
ttcagtggcagggctca

SEQ ID NO: 3183667 - DNA, 16 bp, Homo sapiens
ttcagtgtaaagtgtg

SEQ ID NO: 3183668 - DNA, 12 bp, Homo sapiens
ttcagtgtacat

SEQ ID NO: 3183669 - DNA, 18 bp, Homo sapiens
ttcagtgtagttaattta

SEQ ID NO: 3183670 - DNA, 16 bp, Homo sapiens
ttcagttctgtgtaca

SEQ ID NO: 3183671 - DNA, 18 bp, Homo sapiens
ttcagttgatcactggca

SEQ ID NO: 3183672 - DNA, 19 bp, Homo sapiens
ttcagttgcttgtcttctg

SEQ ID NO: 3183673 - DNA, 17 bp, Homo sapiens
ttcagtttcttctgcgc

SEQ ID NO: 3183674 - DNA, 21 bp, Homo sapiens
ttcagttttcatttggttcat

SEQ ID NO: 3183675 - DNA, 17 bp, Homo sapiens
ttcagtttttcatttgt

SEQ ID NO: 3183676 - DNA, 17 bp, Homo sapiens
ttcagtttttgtatctt

SEQ ID NO: 3183677 - DNA, 19 bp, Homo sapiens
ttcataaacaacttaatgt

SEQ ID NO: 3183678 - DNA, 13 bp, Homo sapiens
ttcataaagagaa

SEQ ID NO: 3183679 - DNA, 19 bp, Homo sapiens
ttcataaagagaaaatgat

SEQ ID NO: 3183680 - DNA, 16 bp, Homo sapiens
ttcataaagtacttga

SEQ ID NO: 3183681 - DNA, 20 bp, Homo sapiens
ttcataaagtacttgagtgt

SEQ ID NO: 3183682 - DNA, 13 bp, Homo sapiens
ttcataacaatgt

SEQ ID NO: 3183683 - DNA, 15 bp, Homo sapiens
ttcataacctagcct

SEQ ID NO: 3183684 - DNA, 16 bp, Homo sapiens
ttcataagctgaacca

SEQ ID NO: 3183685 - DNA, 17 bp, Homo sapiens
ttcataatgaattataa

SEQ ID NO: 3183686 - DNA, 20 bp, Homo sapiens
ttcataatgaattataacag

SEQ ID NO: 3183687 - DNA, 19 bp, Homo sapiens
ttcatacctaagtactgta

SEQ ID NO: 3183688 - DNA, 22 bp, Homo sapiens
ttcatacctaagtactgtaata

SEQ ID NO: 3183689 - DNA, 15 bp, Homo sapiens
ttcatacctcagaat

SEQ ID NO: 3183690 - DNA, 19 bp, Homo sapiens
ttcatactatttagatttt

SEQ ID NO: 3183691 - DNA, 22 bp, Homo sapiens
ttcatactgtaacattcaggaa

SEQ ID NO: 3183692 - DNA, 18 bp, Homo sapiens
ttcatagagatttgtcta

SEQ ID NO: 3183693 - DNA, 19 bp, Homo sapiens
ttcatagagatttgtctaa

SEQ ID NO: 3183694 - DNA, 15 bp, Homo sapiens
ttcatagctccttgg

SEQ ID NO: 3183695 - DNA, 15 bp, Homo sapiens
ttcatagctgtactt

SEQ ID NO: 3183696 - DNA, 20 bp, Homo sapiens
ttcatagggaaaggttttgt

SEQ ID NO: 3183697 - DNA, 20 bp, Homo sapiens
ttcataggtaacacattata

SEQ ID NO: 3183698 - DNA, 14 bp, Homo sapiens
ttcatagttcagaa

SEQ ID NO: 3183699 - DNA, 16 bp, Homo sapiens
ttcatagttcagaatt

SEQ ID NO: 3183700 - DNA, 13 bp, Homo sapiens
ttcatatatacat

SEQ ID NO: 3183701 - DNA, 18 bp, Homo sapiens
ttcatattaagacagtgt

SEQ ID NO: 3183702 - DNA, 22 bp, Homo sapiens
ttcatattaagacagtgtacaa

SEQ ID NO: 3183703 - DNA, 11 bp, Homo sapiens
ttcatattgat

SEQ ID NO: 3183704 - DNA, 14 bp, Homo sapiens
ttcatattgtgcca

SEQ ID NO: 3183705 - DNA, 23 bp, Homo sapiens
ttcatattgttgcattgcttttt

SEQ ID NO: 3183706 - DNA, 22 bp, Homo sapiens
ttcatcaatatccctcttgtaa

SEQ ID NO: 3183707 - DNA, 15 bp, Homo sapiens
ttcatcagtgttaaa

SEQ ID NO: 3183708 - DNA, 21 bp, Homo sapiens
ttcatcatcctaagctattca

SEQ ID NO: 3183709 - DNA, 20 bp, Homo sapiens
ttcatcattccctctcatct

SEQ ID NO: 3183710 - DNA, 20 bp, Homo sapiens
ttcatccaacttatgttttt

SEQ ID NO: 3183711 - DNA, 21 bp, Homo sapiens
ttcatccaatcctcactgggt

SEQ ID NO: 3183712 - DNA, 22 bp, Homo sapiens
ttcatccaatcctcactgggtg

SEQ ID NO: 3183713 - DNA, 22 bp, Homo sapiens
ttcatccaggcccaactgtgag

SEQ ID NO: 3183714 - DNA, 23 bp, Homo sapiens
ttcatccagtttgttctccgggt

SEQ ID NO: 3183715 - DNA, 13 bp, Homo sapiens
ttcatcccagccc

SEQ ID NO: 3183716 - DNA, 16 bp, Homo sapiens
ttcctgacccaggccg

SEQ ID NO: 3183717 - DNA, 22 bp, Homo sapiens
ttcctgacccaggccgcagctc

SEQ ID NO: 3183718 - DNA, 23 bp, Homo sapiens
ttcctgacgaaactggccccgga

SEQ ID NO: 3183719 - DNA, 13 bp, Homo sapiens
ttcctgactggca

SEQ ID NO: 3183720 - DNA, 16 bp, Homo sapiens
ttcctgactggcaaag

SEQ ID NO: 3183721 - DNA, 13 bp, Homo sapiens
ttcctgacttgag

SEQ ID NO: 3183722 - DNA, 16 bp, Homo sapiens
ttcctgagatttcctc

SEQ ID NO: 3183723 - DNA, 17 bp, Homo sapiens
ttcctgataataattga

SEQ ID NO: 3183724 - DNA, 19 bp, Homo sapiens
ttcctgatggtacaggaaa

SEQ ID NO: 3183725 - DNA, 22 bp, Homo sapiens
ttcctgatggtacaggaaagct

SEQ ID NO: 3183726 - DNA, 19 bp, Homo sapiens
ttcctgcaactcaaggact

SEQ ID NO: 3183727 - DNA, 19 bp, Homo sapiens
ttcctgcagccccagaaga

SEQ ID NO: 3183728 - DNA, 20 bp, Homo sapiens
ttcctgcatttctcttctca

SEQ ID NO: 3183729 - DNA, 15 bp, Homo sapiens
ttcctgcatttgtga

SEQ ID NO: 3183730 - DNA, 16 bp, Homo sapiens
ttcctgccccaggcct

SEQ ID NO: 3183731 - DNA, 18 bp, Homo sapiens
ttcctgccccaggcctga

SEQ ID NO: 3183732 - DNA, 19 bp, Homo sapiens
ttcctgcgtcctcctcacc

SEQ ID NO: 3183733 - DNA, 10 bp, Homo sapiens
ttcctgctgg

SEQ ID NO: 3183734 - DNA, 19 bp, Homo sapiens
ttcctggaaacagcatgaa

SEQ ID NO: 3183735 - DNA, 15 bp, Homo sapiens
ttcctggacactcag

SEQ ID NO: 3183736 - DNA, 19 bp, Homo sapiens
ttcctggacatcaccagtc

SEQ ID NO: 3183737 - DNA, 17 bp, Homo sapiens
ttcctggacttaaagaa

SEQ ID NO: 3183738 - DNA, 20 bp, Homo sapiens
ttcctggcaatagtgtgttc

SEQ ID NO: 3183739 - DNA, 14 bp, Homo sapiens
ttcctggctgtaaa

SEQ ID NO: 3183740 - DNA, 12 bp, Homo sapiens
ttcctgggagga

SEQ ID NO: 3183741 - DNA, 19 bp, Homo sapiens
ttcctgggaggacaggcag

SEQ ID NO: 3183742 - DNA, 22 bp, Homo sapiens
ttcctgggcagcctttccagcc

SEQ ID NO: 3183743 - DNA, 11 bp, Homo sapiens
ttcctgggcct

SEQ ID NO: 3183744 - DNA, 14 bp, Homo sapiens
ttcctgggcctgtc

SEQ ID NO: 3183745 - DNA, 17 bp, Homo sapiens
ttcctgggcctttgcaa

SEQ ID NO: 3183746 - DNA, 15 bp, Homo sapiens
ttcctggtacccagc

SEQ ID NO: 3183747 - DNA, 16 bp, Homo sapiens
ttcctggtacccagcc

SEQ ID NO: 3183748 - DNA, 19 bp, Homo sapiens
ttcctggtacccagccatc

SEQ ID NO: 3183749 - DNA, 21 bp, Homo sapiens
ttcctggttttgtacactgct

SEQ ID NO: 3183750 - DNA, 22 bp, Homo sapiens
ttcctggttttgtacactgctg

SEQ ID NO: 3183751 - DNA, 17 bp, Homo sapiens
ttcctgtaacttttaat

SEQ ID NO: 3183752 - DNA, 16 bp, Homo sapiens
ttcctgtactgtgtct

SEQ ID NO: 3183753 - DNA, 23 bp, Homo sapiens
ttcctgtatgttgtacaatcaaa

SEQ ID NO: 3183754 - DNA, 18 bp, Homo sapiens
ttcctgtcagtgtttttg

SEQ ID NO: 3183755 - DNA, 22 bp, Homo sapiens
ttcctgtcagtgtttttgaaac

SEQ ID NO: 3183756 - DNA, 17 bp, Homo sapiens
ttcctgtgatccaccca

SEQ ID NO: 3183757 - DNA, 15 bp, Homo sapiens
ttcctgtgccgtaag

SEQ ID NO: 3183758 - DNA, 23 bp, Homo sapiens
ttcctgttaggtattagaaagtg

SEQ ID NO: 3183759 - DNA, 15 bp, Homo sapiens
ttcctgttcagcatt

SEQ ID NO: 3183760 - DNA, 16 bp, Homo sapiens
ttcctgtttccagggt

SEQ ID NO: 3183761 - DNA, 22 bp, Homo sapiens
ttcctgttttgtacatagattt

SEQ ID NO: 3183762 - DNA, 15 bp, Homo sapiens
ttccttaaactgtgt

SEQ ID NO: 3183763 - DNA, 16 bp, Homo sapiens
ttccttaaactgtgtg

SEQ ID NO: 3183764 - DNA, 19 bp, Homo sapiens
ttccttcagaatatcttaa

SEQ ID NO: 3183765 - DNA, 12 bp, Homo sapiens
ttccttcagatt

SEQ ID NO: 3183766 - DNA, 16 bp, Homo sapiens
ttccttcagggtttaa

SEQ ID NO: 3183767 - DNA, 12 bp, Homo sapiens
ttccttccacag

SEQ ID NO: 3183768 - DNA, 13 bp, Homo sapiens
ttccttctgtaaa

SEQ ID NO: 3183769 - DNA, 15 bp, Homo sapiens
ttccttgaccttcct

SEQ ID NO: 3183770 - DNA, 19 bp, Homo sapiens
ttccttgaccttcctctgg

SEQ ID NO: 3183771 - DNA, 14 bp, Homo sapiens
ttccttgatcattt

SEQ ID NO: 3183772 - DNA, 14 bp, Homo sapiens
ttccttgccccaca

SEQ ID NO: 3183773 - DNA, 20 bp, Homo sapiens
ttccttgccccacagttgtg

SEQ ID NO: 3183774 - DNA, 11 bp, Homo sapiens
ttccttgctct

SEQ ID NO: 3183775 - DNA, 13 bp, Homo sapiens
ttccttgctctcc

SEQ ID NO: 3183776 - DNA, 20 bp, Homo sapiens
ttccttgctgtcctaggcca

SEQ ID NO: 3183777 - DNA, 15 bp, Homo sapiens
ttccttgtactctta

SEQ ID NO: 3183778 - DNA, 18 bp, Homo sapiens
ttccttgtactcttagga

SEQ ID NO: 3183779 - DNA, 12 bp, Homo sapiens
ttccttgtctct

SEQ ID NO: 3183780 - DNA, 13 bp, Homo sapiens
ttccttgtgcaaa

SEQ ID NO: 3183781 - DNA, 22 bp, Homo sapiens
ttccttgttggtcagaggagtg

SEQ ID NO: 3183782 - DNA, 21 bp, Homo sapiens
ttccttgtttatcagatacat

SEQ ID NO: 3183783 - DNA, 17 bp, Homo sapiens
ttcctttaaaaaaattt

SEQ ID NO: 3183784 - DNA, 16 bp, Homo sapiens
ttcctttccctttagc

SEQ ID NO: 3183785 - DNA, 22 bp, Homo sapiens
ttcctttctaatcctatctggg

SEQ ID NO: 3183786 - DNA, 14 bp, Homo sapiens
ttcctttctccagg

SEQ ID NO: 3183787 - DNA, 13 bp, Homo sapiens
ttcctttctcttt

SEQ ID NO: 3183788 - DNA, 20 bp, Homo sapiens
ttcctttcttgtctttcctc

SEQ ID NO: 3183789 - DNA, 18 bp, Homo sapiens
ttcctttcttttccccct

SEQ ID NO: 3183790 - DNA, 14 bp, Homo sapiens
ttcctttgcaccct

SEQ ID NO: 3183791 - DNA, 15 bp, Homo sapiens
ttcctttgctctttc

SEQ ID NO: 3183792 - DNA, 15 bp, Homo sapiens
ttcctttggagcttt

SEQ ID NO: 3183793 - DNA, 17 bp, Homo sapiens
ttcctttgggcctctgc

SEQ ID NO: 3183794 - DNA, 15 bp, Homo sapiens
ttcctttggtgcctc

SEQ ID NO: 3183795 - DNA, 20 bp, Homo sapiens
ttcctttgtaatcactccca

SEQ ID NO: 3183796 - DNA, 20 bp, Homo sapiens
ttcctttgtggttttatgga

SEQ ID NO: 3183797 - DNA, 22 bp, Homo sapiens
ttccttttaaaacacttccata

SEQ ID NO: 3183798 - DNA, 12 bp, Homo sapiens
ttccttttaatt

SEQ ID NO: 3183799 - DNA, 14 bp, Homo sapiens
ttccttttccctgc

SEQ ID NO: 3183800 - DNA, 16 bp, Homo sapiens
ttccttttccctgctt

SEQ ID NO: 3183801 - DNA, 20 bp, Homo sapiens
ttccttttctattccttctg

SEQ ID NO: 3183802 - DNA, 14 bp, Homo sapiens
ttccttttggaaca

SEQ ID NO: 3183803 - DNA, 16 bp, Homo sapiens
ttcctttttaaatgtg

SEQ ID NO: 3183804 - DNA, 17 bp, Homo sapiens
ttcctttttaaatgtga

SEQ ID NO: 3183805 - DNA, 18 bp, Homo sapiens
ttcctttttaaatgtgaa

SEQ ID NO: 3183806 - DNA, 22 bp, Homo sapiens
ttcctttttaaatgtgaatttt

SEQ ID NO: 3183807 - DNA, 20 bp, Homo sapiens
ttcctttttaatatgcttaa

SEQ ID NO: 3183808 - DNA, 16 bp, Homo sapiens
ttccttttttgtctat

SEQ ID NO: 3183809 - DNA, 12 bp, Homo sapiens
ttcgactggtcc

SEQ ID NO: 3183810 - DNA, 16 bp, Homo sapiens
ttcgactggtccagct

SEQ ID NO: 3183811 - DNA, 12 bp, Homo sapiens
ttcgagtagaga

SEQ ID NO: 3183812 - DNA, 23 bp, Homo sapiens
ttcgatacccaggaccaagccac

SEQ ID NO: 3183813 - DNA, 20 bp, Homo sapiens
ttcgatgtgcccaggggagc

SEQ ID NO: 3183814 - DNA, 13 bp, Homo sapiens
ttcgatttctacc

SEQ ID NO: 3183815 - DNA, 23 bp, Homo sapiens
ttcgcacctaccatcagggacag

SEQ ID NO: 3183816 - DNA, 14 bp, Homo sapiens
ttcgcatggtcaca

SEQ ID NO: 3183817 - DNA, 17 bp, Homo sapiens
ttcgcatggtcacacac

SEQ ID NO: 3183818 - DNA, 21 bp, Homo sapiens
ttcgcatggtcacacactgat

SEQ ID NO: 3183819 - DNA, 20 bp, Homo sapiens
ttcgcccgagctgtttatgt

SEQ ID NO: 3183820 - DNA, 13 bp, Homo sapiens
ttcgctcctgtgt

SEQ ID NO: 3183821 - DNA, 19 bp, Homo sapiens
ttcgctcctgtgtcttgca

SEQ ID NO: 3183822 - DNA, 15 bp, Homo sapiens
ttcgctgctctagct

SEQ ID NO: 3183823 - DNA, 15 bp, Homo sapiens
ttcggagaaattctc

SEQ ID NO: 3183824 - DNA, 19 bp, Homo sapiens
ttcggcctccatcctgagg

SEQ ID NO: 3183825 - DNA, 15 bp, Homo sapiens
ttcgggccacagggc

SEQ ID NO: 3183826 - DNA, 18 bp, Homo sapiens
ttcggggaagctgcacat

SEQ ID NO: 3183827 - DNA, 22 bp, Homo sapiens
ttcggggcgatgctccctcagc

SEQ ID NO: 3183828 - DNA, 21 bp, Homo sapiens
ttcgggtgtgcaatgtctgag

SEQ ID NO: 3183829 - DNA, 18 bp, Homo sapiens
ttcggttctccagaatgt

SEQ ID NO: 3183830 - DNA, 18 bp, Homo sapiens
ttcggttgagaatggaaa

SEQ ID NO: 3183831 - DNA, 20 bp, Homo sapiens
ttcgtacataataagtttca

SEQ ID NO: 3183832 - DNA, 16 bp, Homo sapiens
ttcgtaccgcttcctt

SEQ ID NO: 3183833 - DNA, 15 bp, Homo sapiens
ttcgtataatcttgt

SEQ ID NO: 3183834 - DNA, 15 bp, Homo sapiens
ttcgtatgaaaatga

SEQ ID NO: 3183835 - DNA, 18 bp, Homo sapiens
ttcgtatgatcagtactg

SEQ ID NO: 3183836 - DNA, 17 bp, Homo sapiens
ttcgtgaacatcccctc

SEQ ID NO: 3183837 - DNA, 15 bp, Homo sapiens
ttcgtgcactctgct

SEQ ID NO: 3183838 - DNA, 17 bp, Homo sapiens
ttcgtggtgatcaatta

SEQ ID NO: 3183839 - DNA, 22 bp, Homo sapiens
ttcgtggtgatcaattaaatgt

SEQ ID NO: 3183840 - DNA, 21 bp, Homo sapiens
ttcgtgtctctcccaccccgg

SEQ ID NO: 3183841 - DNA, 15 bp, Homo sapiens
ttcgtttattttcaa

SEQ ID NO: 3183842 - DNA, 14 bp, Homo sapiens
ttcttaaaggcctg

SEQ ID NO: 3183843 - DNA, 11 bp, Homo sapiens
ttcttaaatat

SEQ ID NO: 3183844 - DNA, 19 bp, Homo sapiens
ttcttaaatatatgattta

SEQ ID NO: 3183845 - DNA, 12 bp, Homo sapiens
ttcttaaatatg

SEQ ID NO: 3183846 - DNA, 15 bp, Homo sapiens
ttcttaaatctttct

SEQ ID NO: 3183847 - DNA, 13 bp, Homo sapiens
ttcttaacaaccg

SEQ ID NO: 3183848 - DNA, 16 bp, Homo sapiens
ttcttaacaacctggc

SEQ ID NO: 3183849 - DNA, 19 bp, Homo sapiens
ttcttaacctttgctatgt

SEQ ID NO: 3183850 - DNA, 16 bp, Homo sapiens
ttcttaacttcttgct

SEQ ID NO: 3183851 - DNA, 22 bp, Homo sapiens
ttcttaagtatgttattttctg

SEQ ID NO: 3183852 - DNA, 13 bp, Homo sapiens
ttcttaagtcttt

SEQ ID NO: 3183853 - DNA, 13 bp, Homo sapiens
ttcttaattaatt

SEQ ID NO: 3183854 - DNA, 16 bp, Homo sapiens
ttcttaattaatttga

SEQ ID NO: 3183855 - DNA, 13 bp, Homo sapiens
ttcttaattttgt

SEQ ID NO: 3183856 - DNA, 20 bp, Homo sapiens
ttcttacaattgcactgctg

SEQ ID NO: 3183857 - DNA, 16 bp, Homo sapiens
ttcttacacatacagt

SEQ ID NO: 3183858 - DNA, 21 bp, Homo sapiens
ttcttacactgcctgtatact

SEQ ID NO: 3183859 - DNA, 14 bp, Homo sapiens
ttcttacacttctt

SEQ ID NO: 3183860 - DNA, 16 bp, Homo sapiens
ttcttacataattttt

SEQ ID NO: 3183861 - DNA, 16 bp, Homo sapiens
ttcttacatgcatttg

SEQ ID NO: 3183862 - DNA, 17 bp, Homo sapiens
ttcttacccaaagcaca

SEQ ID NO: 3183863 - DNA, 18 bp, Homo sapiens
ttcttaccctagttctct

SEQ ID NO: 3183864 - DNA, 19 bp, Homo sapiens
ttcttaccctagttctctt

SEQ ID NO: 3183865 - DNA, 15 bp, Homo sapiens
ttcttacctgtatgt

SEQ ID NO: 3183866 - DNA, 15 bp, Homo sapiens
ttcttactaaacatt

SEQ ID NO: 3183867 - DNA, 22 bp, Homo sapiens
ttcttactattaagcagtaaaa

SEQ ID NO: 3183868 - DNA, 17 bp, Homo sapiens
ttcttactcattactgc

SEQ ID NO: 3183869 - DNA, 15 bp, Homo sapiens
ttcttagaacagtgg

SEQ ID NO: 3183870 - DNA, 20 bp, Homo sapiens
ttcttagaacagtggaaact

SEQ ID NO: 3183871 - DNA, 13 bp, Homo sapiens
ttcttagagatta

SEQ ID NO: 3183872 - DNA, 13 bp, Homo sapiens
ttcttagagtgta

SEQ ID NO: 3183873 - DNA, 22 bp, Homo sapiens
ttcttagagtgtagctgtaagg

SEQ ID NO: 3183874 - DNA, 17 bp, Homo sapiens
ttcttagcctgtggcag

SEQ ID NO: 3183875 - DNA, 23 bp, Homo sapiens
ttcttagcctgtggcagtaaaga

SEQ ID NO: 3183876 - DNA, 19 bp, Homo sapiens
ttcttagctttttaattgt

SEQ ID NO: 3183877 - DNA, 20 bp, Homo sapiens
ttcttagctttttaattgtt

SEQ ID NO: 3183878 - DNA, 14 bp, Homo sapiens
ttcttagtaaaatg

SEQ ID NO: 3183879 - DNA, 13 bp, Homo sapiens
ttcttagtgactt

SEQ ID NO: 3183880 - DNA, 20 bp, Homo sapiens
ttcttagtgcttcagagttt

SEQ ID NO: 3183881 - DNA, 13 bp, Homo sapiens
ttcttagttctca

SEQ ID NO: 3183882 - DNA, 14 bp, Homo sapiens
ttcttatacacatt

SEQ ID NO: 3183883 - DNA, 17 bp, Homo sapiens
ttcttatacgcttttct

SEQ ID NO: 3183884 - DNA, 15 bp, Homo sapiens
ttcttatggaattga

SEQ ID NO: 3183885 - DNA, 17 bp, Homo sapiens
ttcttatggaattgatt

SEQ ID NO: 3183886 - DNA, 19 bp, Homo sapiens
ttcttatttaatgaaagac

SEQ ID NO: 3183887 - DNA, 19 bp, Homo sapiens
ttcttcaaaatgtatatat

SEQ ID NO: 3183888 - DNA, 23 bp, Homo sapiens
ttcttcaaatctcccacaagtat

SEQ ID NO: 3183889 - DNA, 21 bp, Homo sapiens
ttcttcaacatcaatgttcat

SEQ ID NO: 3183890 - DNA, 22 bp, Homo sapiens
ttcttcaacatcaatgttcatt

SEQ ID NO: 3183891 - DNA, 17 bp, Homo sapiens
ttcttcaagccagctct

SEQ ID NO: 3183892 - DNA, 19 bp, Homo sapiens
ttcttcaagggaagaaaca

SEQ ID NO: 3183893 - DNA, 16 bp, Homo sapiens
ttcttcagaattagat

SEQ ID NO: 3183894 - DNA, 18 bp, Homo sapiens
ttcttcagggccagtcct

SEQ ID NO: 3183895 - DNA, 17 bp, Homo sapiens
ttcttcatgcaatgaca

SEQ ID NO: 3183896 - DNA, 20 bp, Homo sapiens
ttcttcattcaatacaagtg

SEQ ID NO: 3183897 - DNA, 20 bp, Homo sapiens
ttcttcccaatagcaaggct

SEQ ID NO: 3183898 - DNA, 13 bp, Homo sapiens
ttcttccccacaa

SEQ ID NO: 3183899 - DNA, 13 bp, Homo sapiens
ttcttcccttttc

SEQ ID NO: 3183900 - DNA, 17 bp, Homo sapiens
ttcttcctaggtccaag

SEQ ID NO: 3183901 - DNA, 11 bp, Homo sapiens
ttcttcctcac

SEQ ID NO: 3183902 - DNA, 13 bp, Homo sapiens
ttcttcctcagct

SEQ ID NO: 3183903 - DNA, 15 bp, Homo sapiens
ttcttcctcagctgg

SEQ ID NO: 3183904 - DNA, 11 bp, Homo sapiens
ttcttcctctg

SEQ ID NO: 3183905 - DNA, 13 bp, Homo sapiens
ttcttcctttctc

SEQ ID NO: 3183906 - DNA, 21 bp, Homo sapiens
ttcttctaattatttaaataa

SEQ ID NO: 3183907 - DNA, 14 bp, Homo sapiens
ttcttctctagctg

SEQ ID NO: 3183908 - DNA, 13 bp, Homo sapiens
ttcttctgcttca

SEQ ID NO: 3183909 - DNA, 16 bp, Homo sapiens
ttcttctggtgctact

SEQ ID NO: 3183910 - DNA, 23 bp, Homo sapiens
ttcttctggtgctactccatgca

SEQ ID NO: 3183911 - DNA, 16 bp, Homo sapiens
ttcttctgttctgcag

SEQ ID NO: 3183912 - DNA, 17 bp, Homo sapiens
ttcttgaagttcatggt

SEQ ID NO: 3183913 - DNA, 17 bp, Homo sapiens
ttcttgaatataaaaaa

SEQ ID NO: 3183914 - DNA, 19 bp, Homo sapiens
ttcttgacaagctgacttg

SEQ ID NO: 3183915 - DNA, 16 bp, Homo sapiens
ttcttgcactccttcc

SEQ ID NO: 3183916 - DNA, 16 bp, Homo sapiens
ttcttgcatccttcct

SEQ ID NO: 3183917 - DNA, 17 bp, Homo sapiens
ttcttgctagtattcgc

SEQ ID NO: 3183918 - DNA, 22 bp, Homo sapiens
ttcttgctagtattcgctgtgt

SEQ ID NO: 3183919 - DNA, 12 bp, Homo sapiens
ttcttgctgcta

SEQ ID NO: 3183920 - DNA, 16 bp, Homo sapiens
ttcttgctgctagaac

SEQ ID NO: 3183921 - DNA, 19 bp, Homo sapiens
ttcttgctgctagaacttt

SEQ ID NO: 3183922 - DNA, 23 bp, Homo sapiens
ttcttgctgctagaactttttta

SEQ ID NO: 3183923 - DNA, 20 bp, Homo sapiens
ttcttgctggctctgagaat

SEQ ID NO: 3183924 - DNA, 17 bp, Homo sapiens
ttcttgcttctttctag

SEQ ID NO: 3183925 - DNA, 22 bp, Homo sapiens
ttcttggcaaaagccttgtgta

SEQ ID NO: 3183926 - DNA, 23 bp, Homo sapiens
ttcttggcaaaagccttgtgtat

SEQ ID NO: 3183927 - DNA, 15 bp, Homo sapiens
ttcttgggtggttcc

SEQ ID NO: 3183928 - DNA, 19 bp, Homo sapiens
ttcttgggtggttcctaag

SEQ ID NO: 3183929 - DNA, 16 bp, Homo sapiens
ttcttggtagagattc

SEQ ID NO: 3183930 - DNA, 21 bp, Homo sapiens
ttcttggtgcttacacatctc

SEQ ID NO: 3183931 - DNA, 15 bp, Homo sapiens
ttcttgtcagacata

SEQ ID NO: 3183932 - DNA, 21 bp, Homo sapiens
ttcttgtggtgtaaagctggc

SEQ ID NO: 3183933 - DNA, 20 bp, Homo sapiens
ttcttgtgttttactgtcag

SEQ ID NO: 3183934 - DNA, 22 bp, Homo sapiens
ttcttgtgttttactgtcagat

SEQ ID NO: 3183935 - DNA, 15 bp, Homo sapiens
ttcttgtttattgag

SEQ ID NO: 3183936 - DNA, 17 bp, Homo sapiens
ttcttgttttacatttg

SEQ ID NO: 3183937 - DNA, 23 bp, Homo sapiens
ttctttaaaaaacaactatggat

SEQ ID NO: 3183938 - DNA, 19 bp, Homo sapiens
ttctttaaaagaatgacta

SEQ ID NO: 3183939 - DNA, 15 bp, Homo sapiens
ttctttactattaaa

SEQ ID NO: 3183940 - DNA, 19 bp, Homo sapiens
ttctttacttctcacttca

SEQ ID NO: 3183941 - DNA, 11 bp, Homo sapiens
ttctttagaac

SEQ ID NO: 3183942 - DNA, 14 bp, Homo sapiens
ttctttaggagatt

SEQ ID NO: 3183943 - DNA, 22 bp, Homo sapiens
ttctttagtatagccacaaatg

SEQ ID NO: 3183944 - DNA, 14 bp, Homo sapiens
ttctttataaactt

SEQ ID NO: 3183945 - DNA, 17 bp, Homo sapiens
ttctttccatgcagact

SEQ ID NO: 3183946 - DNA, 14 bp, Homo sapiens
ttctttccattatg

SEQ ID NO: 3183947 - DNA, 22 bp, Homo sapiens
ttctttcctcttccccttgccc

SEQ ID NO: 3183948 - DNA, 12 bp, Homo sapiens
ttctttctagaa

SEQ ID NO: 3183949 - DNA, 21 bp, Homo sapiens
ttctttctagtggtctttgta

SEQ ID NO: 3183950 - DNA, 13 bp, Homo sapiens
ttctttctttaaa

SEQ ID NO: 3183951 - DNA, 22 bp, Homo sapiens
ttctttgagggactgcctctgc

SEQ ID NO: 3183952 - DNA, 17 bp, Homo sapiens
ttctttgataatgttaa

SEQ ID NO: 3183953 - DNA, 18 bp, Homo sapiens
ttctttgataatgttaaa

SEQ ID NO: 3183954 - DNA, 13 bp, Homo sapiens
ttctttgattctc

SEQ ID NO: 3183955 - DNA, 23 bp, Homo sapiens
ttctttgattctccttttatgtg

SEQ ID NO: 3183956 - DNA, 14 bp, Homo sapiens
ttctttgcaccaaa

SEQ ID NO: 3183957 - DNA, 14 bp, Homo sapiens
ttctttgcacttaa

SEQ ID NO: 3183958 - DNA, 17 bp, Homo sapiens
ttctttgcttgaacaca

SEQ ID NO: 3183959 - DNA, 21 bp, Homo sapiens
ttctttggattctaaatacat

SEQ ID NO: 3183960 - DNA, 21 bp, Homo sapiens
ttctttggtgcctttcctgtt

SEQ ID NO: 3183961 - DNA, 22 bp, Homo sapiens
ttctttggtgcctttcctgttc

SEQ ID NO: 3183962 - DNA, 15 bp, Homo sapiens
ttctttggttgtgaa

SEQ ID NO: 3183963 - DNA, 12 bp, Homo sapiens
ttctttgtgtag

SEQ ID NO: 3183964 - DNA, 19 bp, Homo sapiens
ttctttgtgtagctttgct

SEQ ID NO: 3183965 - DNA, 14 bp, Homo sapiens
ttcttttaaagacc

SEQ ID NO: 3183966 - DNA, 21 bp, Homo sapiens
ttcttttaaaggggcagaaaa

SEQ ID NO: 3183967 - DNA, 18 bp, Homo sapiens
ttcttttaaattagaaaa

SEQ ID NO: 3183968 - DNA, 22 bp, Homo sapiens
ttgccaagaaaatgaagggatt

SEQ ID NO: 3183969 - DNA, 15 bp, Homo sapiens
ttgccaagacaaatc

SEQ ID NO: 3183970 - DNA, 11 bp, Homo sapiens
ttgccaataaa

SEQ ID NO: 3183971 - DNA, 22 bp, Homo sapiens
ttgccaataaagcttttggaag

SEQ ID NO: 3183972 - DNA, 21 bp, Homo sapiens
ttgccaatgaggtctgaaatg

SEQ ID NO: 3183973 - DNA, 15 bp, Homo sapiens
ttgccacaaccctgt

SEQ ID NO: 3183974 - DNA, 12 bp, Homo sapiens
ttgccacatttc

SEQ ID NO: 3183975 - DNA, 23 bp, Homo sapiens
ttgccacatttctgatcagaggt

SEQ ID NO: 3183976 - DNA, 15 bp, Homo sapiens
ttgccaccccaaccc

SEQ ID NO: 3183977 - DNA, 18 bp, Homo sapiens
ttgccactgcctcttcct

SEQ ID NO: 3183978 - DNA, 23 bp, Homo sapiens
ttgccagactctaggttatacaa

SEQ ID NO: 3183979 - DNA, 17 bp, Homo sapiens
ttgccagcacaggggcc

SEQ ID NO: 3183980 - DNA, 15 bp, Homo sapiens
ttgccagtgtctttc

SEQ ID NO: 3183981 - DNA, 18 bp, Homo sapiens
ttgccatactttgtctga

SEQ ID NO: 3183982 - DNA, 22 bp, Homo sapiens
ttgccatactttgtctgaaaaa

SEQ ID NO: 3183983 - DNA, 17 bp, Homo sapiens
ttgccatagccccatat

SEQ ID NO: 3183984 - DNA, 17 bp, Homo sapiens
ttgccatcaatgatcat

SEQ ID NO: 3183985 - DNA, 18 bp, Homo sapiens
ttgccatcacactgttgc

SEQ ID NO: 3183986 - DNA, 21 bp, Homo sapiens
ttgccatgggcttcactgtat

SEQ ID NO: 3183987 - DNA, 21 bp, Homo sapiens
ttgccatgttggccaggctgg

SEQ ID NO: 3183988 - DNA, 17 bp, Homo sapiens
ttgcccagagcacttta

SEQ ID NO: 3183989 - DNA, 11 bp, Homo sapiens
ttgcccaggca

SEQ ID NO: 3183990 - DNA, 13 bp, Homo sapiens
ttgcccaggcagg

SEQ ID NO: 3183991 - DNA, 20 bp, Homo sapiens
ttgcccagtacatttaaatt

SEQ ID NO: 3183992 - DNA, 16 bp, Homo sapiens
ttgcccatcctgactg

SEQ ID NO: 3183993 - DNA, 14 bp, Homo sapiens
ttgccccaagtcct

SEQ ID NO: 3183994 - DNA, 12 bp, Homo sapiens
ttgccccacagt

SEQ ID NO: 3183995 - DNA, 12 bp, Homo sapiens
ttgcccccacct

SEQ ID NO: 3183996 - DNA, 15 bp, Homo sapiens
ttgcccccacctctg

SEQ ID NO: 3183997 - DNA, 23 bp, Homo sapiens
ttgccccgactccgcttcccctg

SEQ ID NO: 3183998 - DNA, 22 bp, Homo sapiens
ttgccccggccccggccccagc

SEQ ID NO: 3183999 - DNA, 16 bp, Homo sapiens
ttgcccgcgctctttc

SEQ ID NO: 3184000 - DNA, 19 bp, Homo sapiens
ttgcccggattctgggagg

SEQ ID NO: 3184001 - DNA, 15 bp, Homo sapiens
ttgccctagatgagc

SEQ ID NO: 3184002 - DNA, 15 bp, Homo sapiens
ttgccctgacctccc

SEQ ID NO: 3184003 - DNA, 23 bp, Homo sapiens
ttgccctggtttcactggcccaa

SEQ ID NO: 3184004 - DNA, 15 bp, Homo sapiens
ttgcccttgccctga

SEQ ID NO: 3184005 - DNA, 22 bp, Homo sapiens
ttgcctaaatttaatgctgcct

SEQ ID NO: 3184006 - DNA, 17 bp, Homo sapiens
ttgcctccccatttccc

SEQ ID NO: 3184007 - DNA, 14 bp, Homo sapiens
ttgcctctctcagg

SEQ ID NO: 3184008 - DNA, 12 bp, Homo sapiens
ttgcctctgtgc

SEQ ID NO: 3184009 - DNA, 13 bp, Homo sapiens
ttgcctctgtgct

SEQ ID NO: 3184010 - DNA, 14 bp, Homo sapiens
ttgcctctgtgctg

SEQ ID NO: 3184011 - DNA, 19 bp, Homo sapiens
ttgcctcttccagtcttcc

SEQ ID NO: 3184012 - DNA, 13 bp, Homo sapiens
ttgcctgacaatt

SEQ ID NO: 3184013 - DNA, 15 bp, Homo sapiens
ttgcctggctgtgga

SEQ ID NO: 3184014 - DNA, 21 bp, Homo sapiens
ttgcctggctgtggaggcctg

SEQ ID NO: 3184015 - DNA, 12 bp, Homo sapiens
ttgcctgtgcca

SEQ ID NO: 3184016 - DNA, 16 bp, Homo sapiens
ttgccttcccctgtct

SEQ ID NO: 3184017 - DNA, 21 bp, Homo sapiens
ttgccttctctgttcccttgc

SEQ ID NO: 3184018 - DNA, 14 bp, Homo sapiens
ttgccttgagttta

SEQ ID NO: 3184019 - DNA, 14 bp, Homo sapiens
ttgccttgcagcca

SEQ ID NO: 3184020 - DNA, 20 bp, Homo sapiens
ttgccttgcagccacatggc

SEQ ID NO: 3184021 - DNA, 13 bp, Homo sapiens
ttgcctttaacag

SEQ ID NO: 3184022 - DNA, 14 bp, Homo sapiens
ttgcctttcttctg

SEQ ID NO: 3184023 - DNA, 19 bp, Homo sapiens
ttgccttttaatttttaat

SEQ ID NO: 3184024 - DNA, 12 bp, Homo sapiens
ttgcctttttct

SEQ ID NO: 3184025 - DNA, 18 bp, Homo sapiens
ttgcgacggagagaaaaa

SEQ ID NO: 3184026 - DNA, 19 bp, Homo sapiens
ttgcgacggagagaaaaaa

SEQ ID NO: 3184027 - DNA, 19 bp, Homo sapiens
ttgcgatagagtctcactg

SEQ ID NO: 3184028 - DNA, 16 bp, Homo sapiens
ttgcggccccaggagg

SEQ ID NO: 3184029 - DNA, 14 bp, Homo sapiens
ttgcgtcctgcaga

SEQ ID NO: 3184030 - DNA, 14 bp, Homo sapiens
ttgctaaagcactt

SEQ ID NO: 3184031 - DNA, 22 bp, Homo sapiens
ttgctaaagcactttgcactta

SEQ ID NO: 3184032 - DNA, 20 bp, Homo sapiens
ttgctaataaacactggctc

SEQ ID NO: 3184033 - DNA, 18 bp, Homo sapiens
ttgctaatcagtgtctca

SEQ ID NO: 3184034 - DNA, 18 bp, Homo sapiens
ttgctacaaatttatgca

SEQ ID NO: 3184035 - DNA, 21 bp, Homo sapiens
ttgctacaaatttatgcattt

SEQ ID NO: 3184036 - DNA, 12 bp, Homo sapiens
ttgctaccagta

SEQ ID NO: 3184037 - DNA, 20 bp, Homo sapiens
ttgctaccagtatttagaag

SEQ ID NO: 3184038 - DNA, 20 bp, Homo sapiens
ttgctactataatcaaatga

SEQ ID NO: 3184039 - DNA, 16 bp, Homo sapiens
ttgctagacagccagg

SEQ ID NO: 3184040 - DNA, 20 bp, Homo sapiens
ttgctagccagcattccata

SEQ ID NO: 3184041 - DNA, 16 bp, Homo sapiens
ttgctagctatgtgac

SEQ ID NO: 3184042 - DNA, 15 bp, Homo sapiens
ttgctataatcatta

SEQ ID NO: 3184043 - DNA, 17 bp, Homo sapiens
ttgctataatcattagt

SEQ ID NO: 3184044 - DNA, 18 bp, Homo sapiens
ttgctatcaacaataaaa

SEQ ID NO: 3184045 - DNA, 16 bp, Homo sapiens
ttgctatgttactatt

SEQ ID NO: 3184046 - DNA, 23 bp, Homo sapiens
ttgctatgttactattttctaca

SEQ ID NO: 3184047 - DNA, 16 bp, Homo sapiens
ttgctcaaaaatctgt

SEQ ID NO: 3184048 - DNA, 23 bp, Homo sapiens
ttgctcatgcatagtcccagcta

SEQ ID NO: 3184049 - DNA, 16 bp, Homo sapiens
ttgctctcaattaaag

SEQ ID NO: 3184050 - DNA, 21 bp, Homo sapiens
ttgctctcccctgccctgctg

SEQ ID NO: 3184051 - DNA, 16 bp, Homo sapiens
ttgctctccctcttct

SEQ ID NO: 3184052 - DNA, 20 bp, Homo sapiens
ttgctctgttacccaggctg

SEQ ID NO: 3184053 - DNA, 22 bp, Homo sapiens
ttgctctgttacccaggctgga

SEQ ID NO: 3184054 - DNA, 16 bp, Homo sapiens
ttgctgaaattttata

SEQ ID NO: 3184055 - DNA, 19 bp, Homo sapiens
ttgctgaagggcattcttt

SEQ ID NO: 3184056 - DNA, 23 bp, Homo sapiens
ttgctgacaaccattaaagtcag

SEQ ID NO: 3184057 - DNA, 14 bp, Homo sapiens
ttgctgagcctctg

SEQ ID NO: 3184058 - DNA, 18 bp, Homo sapiens
ttgctgatggctgctaga

SEQ ID NO: 3184059 - DNA, 15 bp, Homo sapiens
ttgctgatggcttga

SEQ ID NO: 3184060 - DNA, 13 bp, Homo sapiens
ttgctgcaaacct

SEQ ID NO: 3184061 - DNA, 15 bp, Homo sapiens
ttgctgcaaacctga

SEQ ID NO: 3184062 - DNA, 23 bp, Homo sapiens
ttgctgccataattctaagttat

SEQ ID NO: 3184063 - DNA, 20 bp, Homo sapiens
ttgctgccattacagaggta

SEQ ID NO: 3184064 - DNA, 19 bp, Homo sapiens
ttgctgcgcaccaatgccc

SEQ ID NO: 3184065 - DNA, 20 bp, Homo sapiens
ttgctgcgcaccaatgccca

SEQ ID NO: 3184066 - DNA, 22 bp, Homo sapiens
ttgctgcgcaccaatgcccagc

SEQ ID NO: 3184067 - DNA, 11 bp, Homo sapiens
ttgctgctgct

SEQ ID NO: 3184068 - DNA, 23 bp, Homo sapiens
ttgctggacggggactggggatg

SEQ ID NO: 3184069 - DNA, 14 bp, Homo sapiens
ttgctggccccagc

SEQ ID NO: 3184070 - DNA, 16 bp, Homo sapiens
ttgctggctctgagaa

SEQ ID NO: 3184071 - DNA, 16 bp, Homo sapiens
ttgctgggaggactgg

SEQ ID NO: 3184072 - DNA, 22 bp, Homo sapiens
ttgctgggcatactttctctct

SEQ ID NO: 3184073 - DNA, 15 bp, Homo sapiens
ttgctggttgctgtg

SEQ ID NO: 3184074 - DNA, 14 bp, Homo sapiens
ttgctggttggatt

SEQ ID NO: 3184075 - DNA, 12 bp, Homo sapiens
ttgctgtctctg

SEQ ID NO: 3184076 - DNA, 14 bp, Homo sapiens
ttgctgtctctgct

SEQ ID NO: 3184077 - DNA, 16 bp, Homo sapiens
ttgctgtctctgctcg

SEQ ID NO: 3184078 - DNA, 18 bp, Homo sapiens
ttgctgtgaacaattgtc

SEQ ID NO: 3184079 - DNA, 18 bp, Homo sapiens
ttgctgtgaggctgtcct

SEQ ID NO: 3184080 - DNA, 15 bp, Homo sapiens
ttgctgtgtttaatt

SEQ ID NO: 3184081 - DNA, 18 bp, Homo sapiens
ttgctgtgtttaatttga

SEQ ID NO: 3184082 - DNA, 19 bp, Homo sapiens
ttgctgttgtttctaaaca

SEQ ID NO: 3184083 - DNA, 22 bp, Homo sapiens
ttgcttaaaattttacttttgt

SEQ ID NO: 3184084 - DNA, 22 bp, Homo sapiens
ttgcttagatgagggtgactgt

SEQ ID NO: 3184085 - DNA, 14 bp, Homo sapiens
ttgcttagtaaaat

SEQ ID NO: 3184086 - DNA, 15 bp, Homo sapiens
ttgcttagtaaaatt

SEQ ID NO: 3184087 - DNA, 13 bp, Homo sapiens
ttgcttatgacat

SEQ ID NO: 3184088 - DNA, 16 bp, Homo sapiens
ttgcttattgttccaa

SEQ ID NO: 3184089 - DNA, 22 bp, Homo sapiens
ttgcttcaccatggccttatga

SEQ ID NO: 3184090 - DNA, 17 bp, Homo sapiens
ttgcttcataaatgaag

SEQ ID NO: 3184091 - DNA, 20 bp, Homo sapiens
ttgcttcataaatgaagcag

SEQ ID NO: 3184092 - DNA, 15 bp, Homo sapiens
ttgcttcctcctccc

SEQ ID NO: 3184093 - DNA, 14 bp, Homo sapiens
ttgcttctgtagta

SEQ ID NO: 3184094 - DNA, 20 bp, Homo sapiens
tttaataacattaccttact

SEQ ID NO: 3184095 - DNA, 15 bp, Homo sapiens
tttaataataatcta

SEQ ID NO: 3184096 - DNA, 22 bp, Homo sapiens
tttaatagaaataaattcctaa

SEQ ID NO: 3184097 - DNA, 19 bp, Homo sapiens
tttaatagctatggaatca

SEQ ID NO: 3184098 - DNA, 13 bp, Homo sapiens
tttaatataaaag

SEQ ID NO: 3184099 - DNA, 17 bp, Homo sapiens
tttaatataaaagatat

SEQ ID NO: 3184100 - DNA, 23 bp, Homo sapiens
tttaatataaagtagtcctgtga

SEQ ID NO: 3184101 - DNA, 20 bp, Homo sapiens
tttaatattactgtctttat

SEQ ID NO: 3184102 - DNA, 18 bp, Homo sapiens
tttaatatttaaacagca

SEQ ID NO: 3184103 - DNA, 19 bp, Homo sapiens
tttaatcacagtcatcttt

SEQ ID NO: 3184104 - DNA, 14 bp, Homo sapiens
tttaatccattttt

SEQ ID NO: 3184105 - DNA, 15 bp, Homo sapiens
tttaatccattttta

SEQ ID NO: 3184106 - DNA, 22 bp, Homo sapiens
tttaatccctatgtttgtctca

SEQ ID NO: 3184107 - DNA, 19 bp, Homo sapiens
tttaatctctctctctttt

SEQ ID NO: 3184108 - DNA, 18 bp, Homo sapiens
tttaatctgttatgtact

SEQ ID NO: 3184109 - DNA, 15 bp, Homo sapiens
tttaatgatcaacaa

SEQ ID NO: 3184110 - DNA, 18 bp, Homo sapiens
tttaatgcattaaacctg

SEQ ID NO: 3184111 - DNA, 20 bp, Homo sapiens
tttaatgcattaaacctgtc

SEQ ID NO: 3184112 - DNA, 21 bp, Homo sapiens
tttaatgcattaaacctgtct

SEQ ID NO: 3184113 - DNA, 14 bp, Homo sapiens
tttaatggcagcta

SEQ ID NO: 3184114 - DNA, 15 bp, Homo sapiens
tttaatgtgaacttg

SEQ ID NO: 3184115 - DNA, 20 bp, Homo sapiens
tttaatgtgaacttgtagct

SEQ ID NO: 3184116 - DNA, 12 bp, Homo sapiens
tttaatgtgaag

SEQ ID NO: 3184117 - DNA, 19 bp, Homo sapiens
tttaattaaaaagaattct

SEQ ID NO: 3184118 - DNA, 14 bp, Homo sapiens
tttaattattattc

SEQ ID NO: 3184119 - DNA, 23 bp, Homo sapiens
tttaattattatttatatatgta

SEQ ID NO: 3184120 - DNA, 23 bp, Homo sapiens
tttaattcatcccaactgtcttt

SEQ ID NO: 3184121 - DNA, 16 bp, Homo sapiens
tttaattccaatatga

SEQ ID NO: 3184122 - DNA, 12 bp, Homo sapiens
tttaattgtaaa

SEQ ID NO: 3184123 - DNA, 21 bp, Homo sapiens
tttaattgtagttctgtgtac

SEQ ID NO: 3184124 - DNA, 12 bp, Homo sapiens
tttaattgtata

SEQ ID NO: 3184125 - DNA, 13 bp, Homo sapiens
tttaattgtataa

SEQ ID NO: 3184126 - DNA, 14 bp, Homo sapiens
tttaattgtataag

SEQ ID NO: 3184127 - DNA, 13 bp, Homo sapiens
tttaattgtcatg

SEQ ID NO: 3184128 - DNA, 14 bp, Homo sapiens
tttaattgtcatgg

SEQ ID NO: 3184129 - DNA, 21 bp, Homo sapiens
tttaattgttgtttctttcta

SEQ ID NO: 3184130 - DNA, 20 bp, Homo sapiens
tttaatttctgtcagaatgc

SEQ ID NO: 3184131 - DNA, 19 bp, Homo sapiens
tttaatttgatgaaagctg

SEQ ID NO: 3184132 - DNA, 21 bp, Homo sapiens
tttaatttgatgaaagctgat

SEQ ID NO: 3184133 - DNA, 20 bp, Homo sapiens
tttaattttgtgttgctaaa

SEQ ID NO: 3184134 - DNA, 19 bp, Homo sapiens
tttacaagaagtttattct

SEQ ID NO: 3184135 - DNA, 18 bp, Homo sapiens
tttacaagatccatttgc

SEQ ID NO: 3184136 - DNA, 21 bp, Homo sapiens
tttacaagtgtatatcagaaa

SEQ ID NO: 3184137 - DNA, 13 bp, Homo sapiens
tttacaatgtgaa

SEQ ID NO: 3184138 - DNA, 19 bp, Homo sapiens
tttacacacttgcatgaat

SEQ ID NO: 3184139 - DNA, 23 bp, Homo sapiens
tttacaccaatttggtaaaaatg

SEQ ID NO: 3184140 - DNA, 19 bp, Homo sapiens
tttacacttttgagacttt

SEQ ID NO: 3184141 - DNA, 17 bp, Homo sapiens
tttacagaaaaatcttg

SEQ ID NO: 3184142 - DNA, 13 bp, Homo sapiens
tttacagaaatgg

SEQ ID NO: 3184143 - DNA, 15 bp, Homo sapiens
tttacagcactactc

SEQ ID NO: 3184144 - DNA, 17 bp, Homo sapiens
tttacagcattgtcttt

SEQ ID NO: 3184145 - DNA, 13 bp, Homo sapiens
tttacagctgcct

SEQ ID NO: 3184146 - DNA, 23 bp, Homo sapiens
tttacagctttcatgattagcaa

SEQ ID NO: 3184147 - DNA, 13 bp, Homo sapiens
tttacaggccctg

SEQ ID NO: 3184148 - DNA, 20 bp, Homo sapiens
tttacagggagcctcctgcc

SEQ ID NO: 3184149 - DNA, 23 bp, Homo sapiens
tttacagggagcctcctgcccag

SEQ ID NO: 3184150 - DNA, 17 bp, Homo sapiens
tttacaggtttgaatta

SEQ ID NO: 3184151 - DNA, 19 bp, Homo sapiens
tttacagtctctttcttcc

SEQ ID NO: 3184152 - DNA, 21 bp, Homo sapiens
tttacagtctctttcttcctt

SEQ ID NO: 3184153 - DNA, 16 bp, Homo sapiens
tttacataagaaatgt

SEQ ID NO: 3184154 - DNA, 17 bp, Homo sapiens
tttacatacttttgcaa

SEQ ID NO: 3184155 - DNA, 14 bp, Homo sapiens
tttacatgtatggt

SEQ ID NO: 3184156 - DNA, 22 bp, Homo sapiens
tttacatgtatggttactaaaa

SEQ ID NO: 3184157 - DNA, 19 bp, Homo sapiens
tttacatttggattagaaa

SEQ ID NO: 3184158 - DNA, 13 bp, Homo sapiens
tttacattttata

SEQ ID NO: 3184159 - DNA, 22 bp, Homo sapiens
tttacattttatatttttgtac

SEQ ID NO: 3184160 - DNA, 20 bp, Homo sapiens
tttaccaaagagatattgat

SEQ ID NO: 3184161 - DNA, 11 bp, Homo sapiens
tttaccaaagc

SEQ ID NO: 3184162 - DNA, 13 bp, Homo sapiens
tttaccaaagcat

SEQ ID NO: 3184163 - DNA, 19 bp, Homo sapiens
tttaccagttaattactca

SEQ ID NO: 3184164 - DNA, 20 bp, Homo sapiens
tttaccagttaattactcag

SEQ ID NO: 3184165 - DNA, 20 bp, Homo sapiens
tttaccattagcataatttt

SEQ ID NO: 3184166 - DNA, 14 bp, Homo sapiens
tttaccatttgtaa

SEQ ID NO: 3184167 - DNA, 20 bp, Homo sapiens
tttaccatttgtaataaagt

SEQ ID NO: 3184168 - DNA, 18 bp, Homo sapiens
tttacccaaaaactaaat

SEQ ID NO: 3184169 - DNA, 16 bp, Homo sapiens
tttacccacctagaac

SEQ ID NO: 3184170 - DNA, 19 bp, Homo sapiens
tttacctaccacagtgtct

SEQ ID NO: 3184171 - DNA, 14 bp, Homo sapiens
tttacctagagaac

SEQ ID NO: 3184172 - DNA, 12 bp, Homo sapiens
tttaccttttaa

SEQ ID NO: 3184173 - DNA, 19 bp, Homo sapiens
tttacgtagtcatcaacaa

SEQ ID NO: 3184174 - DNA, 13 bp, Homo sapiens
tttactaaacata

SEQ ID NO: 3184175 - DNA, 14 bp, Homo sapiens
tttactaaacatat

SEQ ID NO: 3184176 - DNA, 14 bp, Homo sapiens
tttactatatatat

SEQ ID NO: 3184177 - DNA, 15 bp, Homo sapiens
tttactatatatata

SEQ ID NO: 3184178 - DNA, 12 bp, Homo sapiens
tttactatcatt

SEQ ID NO: 3184179 - DNA, 17 bp, Homo sapiens
tttactcattgaaatgt

SEQ ID NO: 3184180 - DNA, 17 bp, Homo sapiens
tttactgagcttctctg

SEQ ID NO: 3184181 - DNA, 18 bp, Homo sapiens
tttactgagcttctctgt

SEQ ID NO: 3184182 - DNA, 21 bp, Homo sapiens
tttactgagcttctctgtgaa

SEQ ID NO: 3184183 - DNA, 18 bp, Homo sapiens
tttactgtaactgtcagt

SEQ ID NO: 3184184 - DNA, 15 bp, Homo sapiens
tttactgtactaatt

SEQ ID NO: 3184185 - DNA, 19 bp, Homo sapiens
tttactgtcagattaaatt

SEQ ID NO: 3184186 - DNA, 18 bp, Homo sapiens
tttactgttttaattgta

SEQ ID NO: 3184187 - DNA, 12 bp, Homo sapiens
tttacttacaaa

SEQ ID NO: 3184188 - DNA, 23 bp, Homo sapiens
tttacttcaatgggctcttccaa

SEQ ID NO: 3184189 - DNA, 14 bp, Homo sapiens
tttacttcttatac

SEQ ID NO: 3184190 - DNA, 19 bp, Homo sapiens
tttacttcttatacatttg

SEQ ID NO: 3184191 - DNA, 22 bp, Homo sapiens
tttacttcttatacatttgata

SEQ ID NO: 3184192 - DNA, 15 bp, Homo sapiens
tttacttgttttgga

SEQ ID NO: 3184193 - DNA, 18 bp, Homo sapiens
tttactttagaagcctgc

SEQ ID NO: 3184194 - DNA, 15 bp, Homo sapiens
tttactttgtacttg

SEQ ID NO: 3184195 - DNA, 21 bp, Homo sapiens
tttagaaacctcattggccag

SEQ ID NO: 3184196 - DNA, 20 bp, Homo sapiens
tttagaaactgatttcttca

SEQ ID NO: 3184197 - DNA, 22 bp, Homo sapiens
tttagaaatactgcaagaaaat

SEQ ID NO: 3184198 - DNA, 13 bp, Homo sapiens
tttagaattaaaa

SEQ ID NO: 3184199 - DNA, 15 bp, Homo sapiens
tttagacaactagat

SEQ ID NO: 3184200 - DNA, 22 bp, Homo sapiens
tttagacaagagatgggaatga

SEQ ID NO: 3184201 - DNA, 14 bp, Homo sapiens
tttagacaccttca

SEQ ID NO: 3184202 - DNA, 16 bp, Homo sapiens
tttagacaccttcatt

SEQ ID NO: 3184203 - DNA, 14 bp, Homo sapiens
tttagaccaaggaa

SEQ ID NO: 3184204 - DNA, 15 bp, Homo sapiens
tttagaccatttatc

SEQ ID NO: 3184205 - DNA, 21 bp, Homo sapiens
tttagagaaaataaatttaac

SEQ ID NO: 3184206 - DNA, 15 bp, Homo sapiens
tttagaggcattgtt

SEQ ID NO: 3184207 - DNA, 18 bp, Homo sapiens
tttagagtaaataaactg

SEQ ID NO: 3184208 - DNA, 18 bp, Homo sapiens
tttagagtagcatgagag

SEQ ID NO: 3184209 - DNA, 16 bp, Homo sapiens
tttagataatttgaaa

SEQ ID NO: 3184210 - DNA, 18 bp, Homo sapiens
tttagataatttgaaaaa

SEQ ID NO: 3184211 - DNA, 13 bp, Homo sapiens
tttagatgctgat

SEQ ID NO: 3184212 - DNA, 20 bp, Homo sapiens
tttagatggttacactgtta

SEQ ID NO: 3184213 - DNA, 18 bp, Homo sapiens
tttagattgagaaatgtg

SEQ ID NO: 3184214 - DNA, 16 bp, Homo sapiens
tttagatttcaagaaa

SEQ ID NO: 3184215 - DNA, 22 bp, Homo sapiens
tttagcacgtttaaagttctgt

SEQ ID NO: 3184216 - DNA, 22 bp, Homo sapiens
tttagcagcagcctttaatgca

SEQ ID NO: 3184217 - DNA, 23 bp, Homo sapiens
tttagcagtccaaagaacaagaa

SEQ ID NO: 3184218 - DNA, 19 bp, Homo sapiens
tttagctagtatcttcaaa

SEQ ID NO: 3184219 - DNA, 22 bp, Homo sapiens
tttaggaaaatcactttgtcta

SEQ ID NO: 3184220 - DNA, 19 bp, Homo sapiens
tttcctgcaggcatccgtg

SEQ ID NO: 3184221 - DNA, 18 bp, Homo sapiens
tttcctgccgagtgctct

SEQ ID NO: 3184222 - DNA, 20 bp, Homo sapiens
tttcctgccgagtgctctga

SEQ ID NO: 3184223 - DNA, 15 bp, Homo sapiens
tttcctggatttata

SEQ ID NO: 3184224 - DNA, 18 bp, Homo sapiens
tttcctgggcctttgcaa

SEQ ID NO: 3184225 - DNA, 14 bp, Homo sapiens
tttcctggtgccaa

SEQ ID NO: 3184226 - DNA, 12 bp, Homo sapiens
tttcctgtacaa

SEQ ID NO: 3184227 - DNA, 20 bp, Homo sapiens
tttcctgtatgttgtacaat

SEQ ID NO: 3184228 - DNA, 15 bp, Homo sapiens
tttcctgttcagcat

SEQ ID NO: 3184229 - DNA, 17 bp, Homo sapiens
tttcctgtttccagggt

SEQ ID NO: 3184230 - DNA, 23 bp, Homo sapiens
tttccttaaactgtgtggactgt

SEQ ID NO: 3184231 - DNA, 14 bp, Homo sapiens
tttccttaccatac

SEQ ID NO: 3184232 - DNA, 15 bp, Homo sapiens
tttccttattccaca

SEQ ID NO: 3184233 - DNA, 15 bp, Homo sapiens
tttccttccatccct

SEQ ID NO: 3184234 - DNA, 19 bp, Homo sapiens
tttccttccatccctaccc

SEQ ID NO: 3184235 - DNA, 13 bp, Homo sapiens
tttccttgtgcaa

SEQ ID NO: 3184236 - DNA, 21 bp, Homo sapiens
tttccttgtggcagaggatgt

SEQ ID NO: 3184237 - DNA, 20 bp, Homo sapiens
tttcctttagatcaaggcaa

SEQ ID NO: 3184238 - DNA, 19 bp, Homo sapiens
tttcctttatatttagtga

SEQ ID NO: 3184239 - DNA, 16 bp, Homo sapiens
tttcctttccccagcc

SEQ ID NO: 3184240 - DNA, 13 bp, Homo sapiens
tttcctttcttaa

SEQ ID NO: 3184241 - DNA, 21 bp, Homo sapiens
tttcctttgtggttttatgga

SEQ ID NO: 3184242 - DNA, 13 bp, Homo sapiens
tttccttttcatt

SEQ ID NO: 3184243 - DNA, 19 bp, Homo sapiens
tttcctttttaatatgctt

SEQ ID NO: 3184244 - DNA, 15 bp, Homo sapiens
tttccttttttgtct

SEQ ID NO: 3184245 - DNA, 16 bp, Homo sapiens
tttccttttttgttat

SEQ ID NO: 3184246 - DNA, 17 bp, Homo sapiens
tttccttttttgttatt

SEQ ID NO: 3184247 - DNA, 17 bp, Homo sapiens
tttcgactggtccagct

SEQ ID NO: 3184248 - DNA, 13 bp, Homo sapiens
tttcgtatgaaaa

SEQ ID NO: 3184249 - DNA, 19 bp, Homo sapiens
tttcgtgtagtggaagagc

SEQ ID NO: 3184250 - DNA, 20 bp, Homo sapiens
tttctaaaaagattagcaag

SEQ ID NO: 3184251 - DNA, 20 bp, Homo sapiens
tttctaaaagaatattcaga

SEQ ID NO: 3184252 - DNA, 13 bp, Homo sapiens
tttctaaaagctt

SEQ ID NO: 3184253 - DNA, 15 bp, Homo sapiens
tttctaaagtgttgg

SEQ ID NO: 3184254 - DNA, 14 bp, Homo sapiens
tttctaaagttgtt

SEQ ID NO: 3184255 - DNA, 13 bp, Homo sapiens
tttctaaatgttt

SEQ ID NO: 3184256 - DNA, 18 bp, Homo sapiens
tttctaagattctaaagg

SEQ ID NO: 3184257 - DNA, 20 bp, Homo sapiens
tttctaaggaatgcacaaat

SEQ ID NO: 3184258 - DNA, 15 bp, Homo sapiens
tttctaagtatttaa

SEQ ID NO: 3184259 - DNA, 18 bp, Homo sapiens
tttctaagtgttcgtctt

SEQ ID NO: 3184260 - DNA, 13 bp, Homo sapiens
tttctaatcaaaa

SEQ ID NO: 3184261 - DNA, 20 bp, Homo sapiens
tttctaatggaatggtttgg

SEQ ID NO: 3184262 - DNA, 17 bp, Homo sapiens
tttctacaatgtgaact

SEQ ID NO: 3184263 - DNA, 19 bp, Homo sapiens
tttctacagtggttttata

SEQ ID NO: 3184264 - DNA, 20 bp, Homo sapiens
tttctacattattgcttatt

SEQ ID NO: 3184265 - DNA, 12 bp, Homo sapiens
tttctacctcag

SEQ ID NO: 3184266 - DNA, 18 bp, Homo sapiens
tttctactatatacatat

SEQ ID NO: 3184267 - DNA, 19 bp, Homo sapiens
tttctactgtaagaagagc

SEQ ID NO: 3184268 - DNA, 14 bp, Homo sapiens
tttctagaaatgtt

SEQ ID NO: 3184269 - DNA, 18 bp, Homo sapiens
tttctagaacagtaaaag

SEQ ID NO: 3184270 - DNA, 19 bp, Homo sapiens
tttctagaagcacatgtgt

SEQ ID NO: 3184271 - DNA, 21 bp, Homo sapiens
tttctagaatttatcacactt

SEQ ID NO: 3184272 - DNA, 16 bp, Homo sapiens
tttctagacttgtgct

SEQ ID NO: 3184273 - DNA, 15 bp, Homo sapiens
tttctagactttctg

SEQ ID NO: 3184274 - DNA, 16 bp, Homo sapiens
tttctagactttctgt

SEQ ID NO: 3184275 - DNA, 21 bp, Homo sapiens
tttctagaggtgctacatagt

SEQ ID NO: 3184276 - DNA, 21 bp, Homo sapiens
tttctagcaattttctttgtt

SEQ ID NO: 3184277 - DNA, 22 bp, Homo sapiens
tttctagcaattttctttgttt

SEQ ID NO: 3184278 - DNA, 19 bp, Homo sapiens
tttctagctagaaatatga

SEQ ID NO: 3184279 - DNA, 21 bp, Homo sapiens
tttctagctgttgagctgttt

SEQ ID NO: 3184280 - DNA, 18 bp, Homo sapiens
tttctagctttttaatta

SEQ ID NO: 3184281 - DNA, 15 bp, Homo sapiens
tttctagtccaaaat

SEQ ID NO: 3184282 - DNA, 14 bp, Homo sapiens
tttctagtggtctt

SEQ ID NO: 3184283 - DNA, 17 bp, Homo sapiens
tttctagtggtctttgt

SEQ ID NO: 3184284 - DNA, 16 bp, Homo sapiens
tttctagttctttcct

SEQ ID NO: 3184285 - DNA, 21 bp, Homo sapiens
tttctagtttcagtaaataat

SEQ ID NO: 3184286 - DNA, 15 bp, Homo sapiens
tttctataacagata

SEQ ID NO: 3184287 - DNA, 16 bp, Homo sapiens
tttctataacagatat

SEQ ID NO: 3184288 - DNA, 21 bp, Homo sapiens
tttctatagccaactgctaat

SEQ ID NO: 3184289 - DNA, 23 bp, Homo sapiens
tttctatataaaatgtattcaag

SEQ ID NO: 3184290 - DNA, 20 bp, Homo sapiens
tttctatcatttttgtacag

SEQ ID NO: 3184291 - DNA, 19 bp, Homo sapiens
tttctatggctttcaaagc

SEQ ID NO: 3184292 - DNA, 13 bp, Homo sapiens
tttctattccaaa

SEQ ID NO: 3184293 - DNA, 14 bp, Homo sapiens
tttctattccaaag

SEQ ID NO: 3184294 - DNA, 19 bp, Homo sapiens
tttctattccttctggcct

SEQ ID NO: 3184295 - DNA, 22 bp, Homo sapiens
tttctattctgtcagtgttaaa

SEQ ID NO: 3184296 - DNA, 13 bp, Homo sapiens
tttctattgttac

SEQ ID NO: 3184297 - DNA, 14 bp, Homo sapiens
tttctattgttact

SEQ ID NO: 3184298 - DNA, 15 bp, Homo sapiens
tttctattttaagac

SEQ ID NO: 3184299 - DNA, 23 bp, Homo sapiens
tttctattttgttttttaagtaa

SEQ ID NO: 3184300 - DNA, 13 bp, Homo sapiens
tttctcaaaagca

SEQ ID NO: 3184301 - DNA, 19 bp, Homo sapiens
tttctcaaaagcatttatc

SEQ ID NO: 3184302 - DNA, 13 bp, Homo sapiens
tttctcaaagttt

SEQ ID NO: 3184303 - DNA, 18 bp, Homo sapiens
tttctcaaagttttgaaa

SEQ ID NO: 3184304 - DNA, 22 bp, Homo sapiens
tttctcaacaaagcacagtgtt

SEQ ID NO: 3184305 - DNA, 23 bp, Homo sapiens
tttctcagtgtgcccttctctta

SEQ ID NO: 3184306 - DNA, 20 bp, Homo sapiens
tttctcagtgttggtatatt

SEQ ID NO: 3184307 - DNA, 20 bp, Homo sapiens
tttctcatgacggcttttgt

SEQ ID NO: 3184308 - DNA, 16 bp, Homo sapiens
tttctcattcttgttt

SEQ ID NO: 3184309 - DNA, 22 bp, Homo sapiens
tttctccaaataaaaattagat

SEQ ID NO: 3184310 - DNA, 13 bp, Homo sapiens
tttctccatatca

SEQ ID NO: 3184311 - DNA, 23 bp, Homo sapiens
tttctccatctttatagaaggaa

SEQ ID NO: 3184312 - DNA, 23 bp, Homo sapiens
tttctccccatccccttcctaaa

SEQ ID NO: 3184313 - DNA, 14 bp, Homo sapiens
tttctccccctggg

SEQ ID NO: 3184314 - DNA, 12 bp, Homo sapiens
tttctccccgct

SEQ ID NO: 3184315 - DNA, 17 bp, Homo sapiens
tttctccctaaactgta

SEQ ID NO: 3184316 - DNA, 21 bp, Homo sapiens
tttctccctgttcctttgagt

SEQ ID NO: 3184317 - DNA, 19 bp, Homo sapiens
tttctccctttatgtatct

SEQ ID NO: 3184318 - DNA, 15 bp, Homo sapiens
tttctcctcccagga

SEQ ID NO: 3184319 - DNA, 21 bp, Homo sapiens
tttctcctgtttattcccatc

SEQ ID NO: 3184320 - DNA, 22 bp, Homo sapiens
tttctctaacttcaaggcccat

SEQ ID NO: 3184321 - DNA, 15 bp, Homo sapiens
tttctctacactaag

SEQ ID NO: 3184322 - DNA, 21 bp, Homo sapiens
tttctctcagccttacatttg

SEQ ID NO: 3184323 - DNA, 20 bp, Homo sapiens
tttctctccagcctgacttg

SEQ ID NO: 3184324 - DNA, 13 bp, Homo sapiens
tttctctcttccc

SEQ ID NO: 3184325 - DNA, 14 bp, Homo sapiens
tttctctcttccct

SEQ ID NO: 3184326 - DNA, 16 bp, Homo sapiens
tttctctcttccctca

SEQ ID NO: 3184327 - DNA, 17 bp, Homo sapiens
tttctctcttccctcag

SEQ ID NO: 3184328 - DNA, 11 bp, Homo sapiens
tttctctgcca

SEQ ID NO: 3184329 - DNA, 16 bp, Homo sapiens
tttctctgtacttttc

SEQ ID NO: 3184330 - DNA, 17 bp, Homo sapiens
tttctctgtagttccta

SEQ ID NO: 3184331 - DNA, 22 bp, Homo sapiens
tttctctgtagttcctaatgga

SEQ ID NO: 3184332 - DNA, 15 bp, Homo sapiens
tttctcttgagctgg

SEQ ID NO: 3184333 - DNA, 11 bp, Homo sapiens
tttctcttgct

SEQ ID NO: 3184334 - DNA, 14 bp, Homo sapiens
tttctctttctcct

SEQ ID NO: 3184335 - DNA, 13 bp, Homo sapiens
tttctctttgtct

SEQ ID NO: 3184336 - DNA, 19 bp, Homo sapiens
tttctcttttgctttctgt

SEQ ID NO: 3184337 - DNA, 20 bp, Homo sapiens
tttctgaaagttacccactg

SEQ ID NO: 3184338 - DNA, 20 bp, Homo sapiens
tttctgaaatcgccgtgtta

SEQ ID NO: 3184339 - DNA, 21 bp, Homo sapiens
tttctgaaggaagagaagaca

SEQ ID NO: 3184340 - DNA, 15 bp, Homo sapiens
tttctgaatagaaat

SEQ ID NO: 3184341 - DNA, 11 bp, Homo sapiens
tttctgagccc

SEQ ID NO: 3184342 - DNA, 16 bp, Homo sapiens
tttctgagcttttcat

SEQ ID NO: 3184343 - DNA, 15 bp, Homo sapiens
tttctgatcagaggt

SEQ ID NO: 3184344 - DNA, 13 bp, Homo sapiens
tttctgattaata

SEQ ID NO: 3184345 - DNA, 13 bp, Homo sapiens
tttctgcagccct

SEQ ID NO: 3184346 - DNA, 15 bp, Homo sapiens
ttttaagggggaaaa

SEQ ID NO: 3184347 - DNA, 23 bp, Homo sapiens
ttttaagggtttgtggaaaatga

SEQ ID NO: 3184348 - DNA, 23 bp, Homo sapiens
ttttaaggtctttcagtactttt

SEQ ID NO: 3184349 - DNA, 15 bp, Homo sapiens
ttttaagtaacttaa

SEQ ID NO: 3184350 - DNA, 16 bp, Homo sapiens
ttttaagtaagacttt

SEQ ID NO: 3184351 - DNA, 15 bp, Homo sapiens
ttttaagtaatgtgg

SEQ ID NO: 3184352 - DNA, 15 bp, Homo sapiens
ttttaagtatttagg

SEQ ID NO: 3184353 - DNA, 18 bp, Homo sapiens
ttttaagtatttatatat

SEQ ID NO: 3184354 - DNA, 19 bp, Homo sapiens
ttttaagtatttatatatt

SEQ ID NO: 3184355 - DNA, 21 bp, Homo sapiens
ttttaatagaatataattatc

SEQ ID NO: 3184356 - DNA, 18 bp, Homo sapiens
ttttaatattactgtctt

SEQ ID NO: 3184357 - DNA, 21 bp, Homo sapiens
ttttaatgaatattgatgtta

SEQ ID NO: 3184358 - DNA, 16 bp, Homo sapiens
ttttaatgcagttgct

SEQ ID NO: 3184359 - DNA, 20 bp, Homo sapiens
ttttaatgctatttgaacaa

SEQ ID NO: 3184360 - DNA, 18 bp, Homo sapiens
ttttaattattttaaaat

SEQ ID NO: 3184361 - DNA, 14 bp, Homo sapiens
ttttaattgtcatg

SEQ ID NO: 3184362 - DNA, 15 bp, Homo sapiens
ttttaatttaaagct

SEQ ID NO: 3184363 - DNA, 18 bp, Homo sapiens
ttttaatttaacaaacta

SEQ ID NO: 3184364 - DNA, 22 bp, Homo sapiens
ttttaatttatttattaagatg

SEQ ID NO: 3184365 - DNA, 17 bp, Homo sapiens
ttttaattttgtgttgc

SEQ ID NO: 3184366 - DNA, 17 bp, Homo sapiens
ttttacaagaagtttat

SEQ ID NO: 3184367 - DNA, 12 bp, Homo sapiens
ttttacaataaa

SEQ ID NO: 3184368 - DNA, 19 bp, Homo sapiens
ttttacacattagatttta

SEQ ID NO: 3184369 - DNA, 23 bp, Homo sapiens
ttttacactgataaaagttttga

SEQ ID NO: 3184370 - DNA, 17 bp, Homo sapiens
ttttacagtgacctttt

SEQ ID NO: 3184371 - DNA, 16 bp, Homo sapiens
ttttacatacttttgc

SEQ ID NO: 3184372 - DNA, 18 bp, Homo sapiens
ttttacatacttttgcaa

SEQ ID NO: 3184373 - DNA, 21 bp, Homo sapiens
ttttacatgaagctgtataat

SEQ ID NO: 3184374 - DNA, 15 bp, Homo sapiens
ttttacatgtttcca

SEQ ID NO: 3184375 - DNA, 15 bp, Homo sapiens
ttttaccaaagcatc

SEQ ID NO: 3184376 - DNA, 15 bp, Homo sapiens
ttttaccaagagtaa

SEQ ID NO: 3184377 - DNA, 17 bp, Homo sapiens
ttttaccaagagtaact

SEQ ID NO: 3184378 - DNA, 22 bp, Homo sapiens
ttttaccactatttaagttatc

SEQ ID NO: 3184379 - DNA, 19 bp, Homo sapiens
ttttaccattagcataatt

SEQ ID NO: 3184380 - DNA, 23 bp, Homo sapiens
ttttacctagctggtagcataaa

SEQ ID NO: 3184381 - DNA, 14 bp, Homo sapiens
ttttacctttcata

SEQ ID NO: 3184382 - DNA, 17 bp, Homo sapiens
ttttacgtagtaaaagt

SEQ ID NO: 3184383 - DNA, 20 bp, Homo sapiens
ttttactaagttttcaaatt

SEQ ID NO: 3184384 - DNA, 13 bp, Homo sapiens
ttttactgtcaga

SEQ ID NO: 3184385 - DNA, 15 bp, Homo sapiens
ttttactgtcagatt

SEQ ID NO: 3184386 - DNA, 18 bp, Homo sapiens
ttttactgtcagattaaa

SEQ ID NO: 3184387 - DNA, 20 bp, Homo sapiens
ttttactgtcagattaaatt

SEQ ID NO: 3184388 - DNA, 15 bp, Homo sapiens
ttttacttacaaaaa

SEQ ID NO: 3184389 - DNA, 22 bp, Homo sapiens
ttttacttgcattgaatatatt

SEQ ID NO: 3184390 - DNA, 18 bp, Homo sapiens
ttttacttttaaactgtg

SEQ ID NO: 3184391 - DNA, 14 bp, Homo sapiens
ttttagaaaacagc

SEQ ID NO: 3184392 - DNA, 12 bp, Homo sapiens
ttttagagaaaa

SEQ ID NO: 3184393 - DNA, 17 bp, Homo sapiens
ttttagagactatggag

SEQ ID NO: 3184394 - DNA, 20 bp, Homo sapiens
ttttagatgagattgtttta

SEQ ID NO: 3184395 - DNA, 19 bp, Homo sapiens
ttttagatggttacactgt

SEQ ID NO: 3184396 - DNA, 22 bp, Homo sapiens
ttttagattttctggttctaac

SEQ ID NO: 3184397 - DNA, 16 bp, Homo sapiens
ttttagctctgttctt

SEQ ID NO: 3184398 - DNA, 21 bp, Homo sapiens
ttttagctgatgaacttattc

SEQ ID NO: 3184399 - DNA, 22 bp, Homo sapiens
ttttagctggtggcaataaata

SEQ ID NO: 3184400 - DNA, 19 bp, Homo sapiens
ttttaggcactgttcaata

SEQ ID NO: 3184401 - DNA, 16 bp, Homo sapiens
ttttaggtgttgattt

SEQ ID NO: 3184402 - DNA, 19 bp, Homo sapiens
ttttaggtgttgattttct

SEQ ID NO: 3184403 - DNA, 22 bp, Homo sapiens
ttttaggtgttgattttctgtt

SEQ ID NO: 3184404 - DNA, 13 bp, Homo sapiens
ttttaggttctaa

SEQ ID NO: 3184405 - DNA, 23 bp, Homo sapiens
ttttaggttctaaagttctaaga

SEQ ID NO: 3184406 - DNA, 19 bp, Homo sapiens
ttttagtaatctgtacatt

SEQ ID NO: 3184407 - DNA, 17 bp, Homo sapiens
ttttagttgcatgaaat

SEQ ID NO: 3184408 - DNA, 17 bp, Homo sapiens
ttttagttggtgctgat

SEQ ID NO: 3184409 - DNA, 13 bp, Homo sapiens
ttttagttttagt

SEQ ID NO: 3184410 - DNA, 22 bp, Homo sapiens
ttttataaaatggctgtaatca

SEQ ID NO: 3184411 - DNA, 12 bp, Homo sapiens
ttttataaagca

SEQ ID NO: 3184412 - DNA, 15 bp, Homo sapiens
ttttataaagcatgt

SEQ ID NO: 3184413 - DNA, 14 bp, Homo sapiens
ttttataagcaaat

SEQ ID NO: 3184414 - DNA, 19 bp, Homo sapiens
ttttataagttcacaaaat

SEQ ID NO: 3184415 - DNA, 12 bp, Homo sapiens
ttttataattgg

SEQ ID NO: 3184416 - DNA, 14 bp, Homo sapiens
ttttatacaaacct

SEQ ID NO: 3184417 - DNA, 18 bp, Homo sapiens
ttttatactctttctgta

SEQ ID NO: 3184418 - DNA, 19 bp, Homo sapiens
ttttatatagcttgaaaca

SEQ ID NO: 3184419 - DNA, 23 bp, Homo sapiens
ttttatattaaaataagcactgt

SEQ ID NO: 3184420 - DNA, 11 bp, Homo sapiens
ttttatattct

SEQ ID NO: 3184421 - DNA, 11 bp, Homo sapiens
ttttatattta

SEQ ID NO: 3184422 - DNA, 14 bp, Homo sapiens
ttttatatttaaaa

SEQ ID NO: 3184423 - DNA, 13 bp, Homo sapiens
ttttatatttagt

SEQ ID NO: 3184424 - DNA, 16 bp, Homo sapiens
ttttatatttgtatcg

SEQ ID NO: 3184425 - DNA, 17 bp, Homo sapiens
ttttatatttgtatcga

SEQ ID NO: 3184426 - DNA, 15 bp, Homo sapiens
ttttatcccaaagtt

SEQ ID NO: 3184427 - DNA, 17 bp, Homo sapiens
ttttatccctcacctgt

SEQ ID NO: 3184428 - DNA, 23 bp, Homo sapiens
ttttatcgtttttgtattttcat

SEQ ID NO: 3184429 - DNA, 13 bp, Homo sapiens
ttttatctcagat

SEQ ID NO: 3184430 - DNA, 20 bp, Homo sapiens
ttttatgaagaaaaagtaca

SEQ ID NO: 3184431 - DNA, 13 bp, Homo sapiens
ttttatgcagata

SEQ ID NO: 3184432 - DNA, 22 bp, Homo sapiens
ttttatgctcttttttactcat

SEQ ID NO: 3184433 - DNA, 19 bp, Homo sapiens
ttttatggagacctctcct

SEQ ID NO: 3184434 - DNA, 12 bp, Homo sapiens
ttttatggatga

SEQ ID NO: 3184435 - DNA, 19 bp, Homo sapiens
ttttatggatgattaaatt

SEQ ID NO: 3184436 - DNA, 19 bp, Homo sapiens
ttttatgtagtaattgaca

SEQ ID NO: 3184437 - DNA, 13 bp, Homo sapiens
ttttattattgtg

SEQ ID NO: 3184438 - DNA, 18 bp, Homo sapiens
ttttattcctgtatgttg

SEQ ID NO: 3184439 - DNA, 20 bp, Homo sapiens
ttttattgtataaactatca

SEQ ID NO: 3184440 - DNA, 17 bp, Homo sapiens
ttttatttataaactag

SEQ ID NO: 3184441 - DNA, 22 bp, Homo sapiens
ttttatttatagttaataatct

SEQ ID NO: 3184442 - DNA, 11 bp, Homo sapiens
ttttattttat

SEQ ID NO: 3184443 - DNA, 13 bp, Homo sapiens
ttttattttatgt

SEQ ID NO: 3184444 - DNA, 12 bp, Homo sapiens
ttttattttcaa

SEQ ID NO: 3184445 - DNA, 20 bp, Homo sapiens
ttttattttgaaaagcttct

SEQ ID NO: 3184446 - DNA, 13 bp, Homo sapiens
ttttattttgctg

SEQ ID NO: 3184447 - DNA, 12 bp, Homo sapiens
ttttatttttgc

SEQ ID NO: 3184448 - DNA, 18 bp, Homo sapiens
ttttattttttcttttgt

SEQ ID NO: 3184449 - DNA, 14 bp, Homo sapiens
ttttcaaattgtat

SEQ ID NO: 3184450 - DNA, 22 bp, Homo sapiens
ttttcaacaaatatcttgtgtt

SEQ ID NO: 3184451 - DNA, 13 bp, Homo sapiens
ttttcaagaaatg

SEQ ID NO: 3184452 - DNA, 15 bp, Homo sapiens
ttttcaagcagcatc

SEQ ID NO: 3184453 - DNA, 19 bp, Homo sapiens
ttttcaatatgcaagcagc

SEQ ID NO: 3184454 - DNA, 16 bp, Homo sapiens
ttttcaatatttatta

SEQ ID NO: 3184455 - DNA, 17 bp, Homo sapiens
ttttcacaatgtcagta

SEQ ID NO: 3184456 - DNA, 23 bp, Homo sapiens
ttttcacaggtgtggtgtaattt

SEQ ID NO: 3184457 - DNA, 13 bp, Homo sapiens
ttttcaccccacc

SEQ ID NO: 3184458 - DNA, 23 bp, Homo sapiens
ttttcacctgtttttaagctgtt

SEQ ID NO: 3184459 - DNA, 14 bp, Homo sapiens
ttttcactgcctgt

SEQ ID NO: 3184460 - DNA, 23 bp, Homo sapiens
ttttcagaaaatattatgtgttt

SEQ ID NO: 3184461 - DNA, 20 bp, Homo sapiens
ttttcagaagaaataaatat

SEQ ID NO: 3184462 - DNA, 13 bp, Homo sapiens
ttttcagaatctg

SEQ ID NO: 3184463 - DNA, 16 bp, Homo sapiens
ttttcagaatctgaat

SEQ ID NO: 3184464 - DNA, 18 bp, Homo sapiens
ttttcagcaaactctttt

SEQ ID NO: 3184465 - DNA, 21 bp, Homo sapiens
ttttcagcacccccacccacc

SEQ ID NO: 3184466 - DNA, 17 bp, Homo sapiens
ttttcagctctctgtat

SEQ ID NO: 3184467 - DNA, 21 bp, Homo sapiens
ttttcaggaaatctacttcct

SEQ ID NO: 3184468 - DNA, 17 bp, Homo sapiens
ttttcaggagcgcaaga

SEQ ID NO: 3184469 - DNA, 13 bp, Homo sapiens
ttttcagtgtgat

SEQ ID NO: 3184470 - DNA, 13 bp, Homo sapiens
ttttcatcactgg

SEQ ID NO: 3184471 - DNA, 15 bp, Homo sapiens
ttttcatctgttgtt

SEQ ID NO: 3184472 - DNA, 21 bp, Homo sapiens
tttttatatcatgcaaaatat

SEQ ID NO: 3184473 - DNA, 15 bp, Homo sapiens
tttttatattaatgt

SEQ ID NO: 3184474 - DNA, 22 bp, Homo sapiens
tttttatcatgtcgtaggtaaa

SEQ ID NO: 3184475 - DNA, 18 bp, Homo sapiens
tttttatctatataaaat

SEQ ID NO: 3184476 - DNA, 22 bp, Homo sapiens
tttttatctatataaaataact

SEQ ID NO: 3184477 - DNA, 14 bp, Homo sapiens
tttttatcttttta

SEQ ID NO: 3184478 - DNA, 13 bp, Homo sapiens
tttttatgaggca

SEQ ID NO: 3184479 - DNA, 17 bp, Homo sapiens
tttttattccctgccca

SEQ ID NO: 3184480 - DNA, 12 bp, Homo sapiens
tttttatttctt

SEQ ID NO: 3184481 - DNA, 20 bp, Homo sapiens
tttttcaaaaatgctgttaa

SEQ ID NO: 3184482 - DNA, 19 bp, Homo sapiens
tttttcaaagatgtgttgc

SEQ ID NO: 3184483 - DNA, 20 bp, Homo sapiens
tttttcaatcaactttactg

SEQ ID NO: 3184484 - DNA, 20 bp, Homo sapiens
tttttcaggagcgcaagata

SEQ ID NO: 3184485 - DNA, 14 bp, Homo sapiens
tttttcagttccaa

SEQ ID NO: 3184486 - DNA, 17 bp, Homo sapiens
tttttcagttccaagaa

SEQ ID NO: 3184487 - DNA, 20 bp, Homo sapiens
tttttcagttgttcttttta

SEQ ID NO: 3184488 - DNA, 13 bp, Homo sapiens
tttttcatattgt

SEQ ID NO: 3184489 - DNA, 19 bp, Homo sapiens
tttttcatattttctaaag

SEQ ID NO: 3184490 - DNA, 13 bp, Homo sapiens
tttttcatttgtt

SEQ ID NO: 3184491 - DNA, 14 bp, Homo sapiens
tttttccactttgt

SEQ ID NO: 3184492 - DNA, 14 bp, Homo sapiens
tttttccatcattt

SEQ ID NO: 3184493 - DNA, 13 bp, Homo sapiens
tttttccccccaa

SEQ ID NO: 3184494 - DNA, 23 bp, Homo sapiens
tttttcctaacaaaagatgaaag

SEQ ID NO: 3184495 - DNA, 15 bp, Homo sapiens
tttttcctagcctgt

SEQ ID NO: 3184496 - DNA, 16 bp, Homo sapiens
tttttcctcttcagaa

SEQ ID NO: 3184497 - DNA, 23 bp, Homo sapiens
tttttcctcttcagaacttgtca

SEQ ID NO: 3184498 - DNA, 15 bp, Homo sapiens
tttttctaagagaag

SEQ ID NO: 3184499 - DNA, 22 bp, Homo sapiens
tttttctacctgtacacattcc

SEQ ID NO: 3184500 - DNA, 14 bp, Homo sapiens
tttttctcatgtat

SEQ ID NO: 3184501 - DNA, 13 bp, Homo sapiens
tttttctgataaa

SEQ ID NO: 3184502 - DNA, 21 bp, Homo sapiens
tttttctggaccaaggtgaag

SEQ ID NO: 3184503 - DNA, 23 bp, Homo sapiens
tttttctgtgataactctgcaaa

SEQ ID NO: 3184504 - DNA, 17 bp, Homo sapiens
tttttctgttgtaactt

SEQ ID NO: 3184505 - DNA, 22 bp, Homo sapiens
tttttcttgagtactagaattt

SEQ ID NO: 3184506 - DNA, 19 bp, Homo sapiens
tttttcttgtattcatgaa

SEQ ID NO: 3184507 - DNA, 14 bp, Homo sapiens
tttttctttaagat

SEQ ID NO: 3184508 - DNA, 20 bp, Homo sapiens
tttttctttcacaaggtata

SEQ ID NO: 3184509 - DNA, 13 bp, Homo sapiens
tttttcttttgta

SEQ ID NO: 3184510 - DNA, 15 bp, Homo sapiens
tttttgaaacagcag

SEQ ID NO: 3184511 - DNA, 16 bp, Homo sapiens
tttttgaaatgaaatt

SEQ ID NO: 3184512 - DNA, 18 bp, Homo sapiens
tttttgaactttgtagga

SEQ ID NO: 3184513 - DNA, 15 bp, Homo sapiens
tttttgagtcattga

SEQ ID NO: 3184514 - DNA, 16 bp, Homo sapiens
tttttgatcaaaaact

SEQ ID NO: 3184515 - DNA, 20 bp, Homo sapiens
tttttgatcctctactgtgc

SEQ ID NO: 3184516 - DNA, 18 bp, Homo sapiens
tttttgatggtaagactg

SEQ ID NO: 3184517 - DNA, 20 bp, Homo sapiens
tttttgcacatgtttcctct

SEQ ID NO: 3184518 - DNA, 16 bp, Homo sapiens
tttttgcctaccattt

SEQ ID NO: 3184519 - DNA, 23 bp, Homo sapiens
tttttgctgctgcctctttccct

SEQ ID NO: 3184520 - DNA, 17 bp, Homo sapiens
tttttggaaagtcagaa

SEQ ID NO: 3184521 - DNA, 16 bp, Homo sapiens
tttttggcctgtttga

SEQ ID NO: 3184522 - DNA, 15 bp, Homo sapiens
tttttgggatgtctt

SEQ ID NO: 3184523 - DNA, 19 bp, Homo sapiens
tttttggggaaaaaagcac

SEQ ID NO: 3184524 - DNA, 15 bp, Homo sapiens
tttttggtataatgt

SEQ ID NO: 3184525 - DNA, 22 bp, Homo sapiens
tttttggtcgaggagtaacaat

SEQ ID NO: 3184526 - DNA, 19 bp, Homo sapiens
tttttggtgattcaaatgg

SEQ ID NO: 3184527 - DNA, 15 bp, Homo sapiens
tttttggtggatgta

SEQ ID NO: 3184528 - DNA, 18 bp, Homo sapiens
tttttggttgtcaatatt

SEQ ID NO: 3184529 - DNA, 23 bp, Homo sapiens
tttttgtaaactggaattaaaag

SEQ ID NO: 3184530 - DNA, 22 bp, Homo sapiens
tttttgtaaactgtatcaaatc

SEQ ID NO: 3184531 - DNA, 15 bp, Homo sapiens
tttttgtaactacaa

SEQ ID NO: 3184532 - DNA, 19 bp, Homo sapiens
tttttgtaactacaaagct

SEQ ID NO: 3184533 - DNA, 12 bp, Homo sapiens
tttttgtacact

SEQ ID NO: 3184534 - DNA, 11 bp, Homo sapiens
tttttgtacat

SEQ ID NO: 3184535 - DNA, 12 bp, Homo sapiens
tttttgtacatg

SEQ ID NO: 3184536 - DNA, 12 bp, Homo sapiens
tttttgtactgt

SEQ ID NO: 3184537 - DNA, 19 bp, Homo sapiens
tttttgtagagacagggtt

SEQ ID NO: 3184538 - DNA, 12 bp, Homo sapiens
tttttgtcatca

SEQ ID NO: 3184539 - DNA, 14 bp, Homo sapiens
tttttgtcatttta

SEQ ID NO: 3184540 - DNA, 17 bp, Homo sapiens
tttttgtgggagataaa

SEQ ID NO: 3184541 - DNA, 13 bp, Homo sapiens
tttttgtgtatgt

SEQ ID NO: 3184542 - DNA, 14 bp, Homo sapiens
tttttgtgttttct

SEQ ID NO: 3184543 - DNA, 15 bp, Homo sapiens
tttttgttagcaaag

SEQ ID NO: 3184544 - DNA, 20 bp, Homo sapiens
tttttgttcttaattgcact

SEQ ID NO: 3184545 - DNA, 22 bp, Homo sapiens
tttttgttcttaattgcactct

SEQ ID NO: 3184546 - DNA, 11 bp, Homo sapiens
tttttgtttgg

SEQ ID NO: 3184547 - DNA, 17 bp, Homo sapiens
tttttgttttacaatgt

SEQ ID NO: 3184548 - DNA, 18 bp, Homo sapiens
ttttttaaaaaaagaaaa

SEQ ID NO: 3184549 - DNA, 13 bp, Homo sapiens
ttttttaaaagaa

SEQ ID NO: 3184550 - DNA, 16 bp, Homo sapiens
ttttttaaacaaacat

SEQ ID NO: 3184551 - DNA, 13 bp, Homo sapiens
ttttttaaagaca

SEQ ID NO: 3184552 - DNA, 15 bp, Homo sapiens
ttttttaagcttcag

SEQ ID NO: 3184553 - DNA, 17 bp, Homo sapiens
ttttttaagtatttata

SEQ ID NO: 3184554 - DNA, 12 bp, Homo sapiens
ttttttaatgta

SEQ ID NO: 3184555 - DNA, 14 bp, Homo sapiens
ttttttacttttgt

SEQ ID NO: 3184556 - DNA, 16 bp, Homo sapiens
ttttttatgctaatca

SEQ ID NO: 3184557 - DNA, 15 bp, Homo sapiens
ttttttatgttttgt

SEQ ID NO: 3184558 - DNA, 21 bp, Homo sapiens
ttttttattagcattctgaaa

SEQ ID NO: 3184559 - DNA, 13 bp, Homo sapiens
ttttttcaatgtg

SEQ ID NO: 3184560 - DNA, 14 bp, Homo sapiens
ttttttccaaaatc

SEQ ID NO: 3184561 - DNA, 15 bp, Homo sapiens
ttttttctacctata

SEQ ID NO: 3184562 - DNA, 13 bp, Homo sapiens
ttttttgactaaa

SEQ ID NO: 3184563 - DNA, 17 bp, Homo sapiens
ttttttgcagtaactgt

SEQ ID NO: 3184564 - DNA, 14 bp, Homo sapiens
ttttttgtgtatgt

SEQ ID NO: 3184565 - DNA, 16 bp, Homo sapiens
ttttttgtttgtttgt

SEQ ID NO: 3184566 - DNA, 14 bp, Homo sapiens
tttttttcaatgtg

SEQ ID NO: 3184567 - DNA, 13 bp, Homo sapiens
tttttttccagca

SEQ ID NO: 3184568 - DNA, 12 bp, Homo sapiens
tttttttccatt

SEQ ID NO: 3184569 - DNA, 13 bp, Homo sapiens
tttttttcctttt

SEQ ID NO: 3184570 - DNA, 12 bp, Homo sapiens
tttttttctacc

SEQ ID NO: 3184571 - DNA, 10 bp, Homo sapiens
tttttttgca

SEQ ID NO: 3184572 - DNA, 11 bp, Homo sapiens
tttttttgcag

SEQ ID NO: 3184573 - DNA, 20 bp, Homo sapiens
aagaaaaagtacaatgaact

SEQ ID NO: 3184574 - DNA, 14 bp, Homo sapiens
aagaaaaatatgat

SEQ ID NO: 3184575 - DNA, 12 bp, Homo sapiens
aagaaaacaaac

SEQ ID NO: 3184576 - DNA, 14 bp, Homo sapiens
aagaaaagaccctg

SEQ ID NO: 3184577 - DNA, 12 bp, Homo sapiens
aagaaaagattt

SEQ ID NO: 3184578 - DNA, 15 bp, Homo sapiens
aagaaaagcactttt

SEQ ID NO: 3184579 - DNA, 18 bp, Homo sapiens
aagaaaagcacttttgtt

SEQ ID NO: 3184580 - DNA, 18 bp, Homo sapiens
aagaaaagcattttcagt

SEQ ID NO: 3184581 - DNA, 13 bp, Homo sapiens
aagaaaaggacaa

SEQ ID NO: 3184582 - DNA, 18 bp, Homo sapiens
aagaaaatacaataaact

SEQ ID NO: 3184583 - DNA, 12 bp, Homo sapiens
aagaaaatgaag

SEQ ID NO: 3184584 - DNA, 13 bp, Homo sapiens
aagaaaattgcct

SEQ ID NO: 3184585 - DNA, 14 bp, Homo sapiens
aagaaacaaagatg

SEQ ID NO: 3184586 - DNA, 15 bp, Homo sapiens
aagaaacaaagatgt

SEQ ID NO: 3184587 - DNA, 15 bp, Homo sapiens
aagaaacaagctgtg

SEQ ID NO: 3184588 - DNA, 16 bp, Homo sapiens
aagaaacaagctgtgc

SEQ ID NO: 3184589 - DNA, 12 bp, Homo sapiens
aagaaacactga

SEQ ID NO: 3184590 - DNA, 14 bp, Homo sapiens
aagaaacagccagc

SEQ ID NO: 3184591 - DNA, 17 bp, Homo sapiens
aagaaacccttgctgct

SEQ ID NO: 3184592 - DNA, 17 bp, Homo sapiens
aagaaacttgaagcttt

SEQ ID NO: 3184593 - DNA, 17 bp, Homo sapiens
aagaaacttgtgcttta

SEQ ID NO: 3184594 - DNA, 17 bp, Homo sapiens
aagaaacttttgtaaag

SEQ ID NO: 3184595 - DNA, 21 bp, Homo sapiens
aagaaagaatgcaagagtgga

SEQ ID NO: 3184596 - DNA, 22 bp, Homo sapiens
aagaaagactctattctcaaag

SEQ ID NO: 3184597 - DNA, 18 bp, Homo sapiens
aagaaagtgtatttggaa

SEQ ID NO: 3184598 - DNA, 13 bp, Homo sapiens
aagaaataaatca

SEQ ID NO: 3184599 - DNA, 15 bp, Homo sapiens
aagaaataaatcaga

SEQ ID NO: 3184600 - DNA, 12 bp, Homo sapiens
aagaaatagaat

SEQ ID NO: 3184601 - DNA, 22 bp, Homo sapiens
aagaaatgattcaaattgctgc

SEQ ID NO: 3184602 - DNA, 23 bp, Homo sapiens
aagaaatgattcaaattgctgct

SEQ ID NO: 3184603 - DNA, 18 bp, Homo sapiens
aagaaatgtattcctgaa

SEQ ID NO: 3184604 - DNA, 13 bp, Homo sapiens
aagaaattgcaat

SEQ ID NO: 3184605 - DNA, 17 bp, Homo sapiens
aagaacacagcatgtgc

SEQ ID NO: 3184606 - DNA, 23 bp, Homo sapiens
aagaacatccctgtcttaactgg

SEQ ID NO: 3184607 - DNA, 18 bp, Homo sapiens
aagaacatggacttgtat

SEQ ID NO: 3184608 - DNA, 19 bp, Homo sapiens
aagaacatggacttgtata

SEQ ID NO: 3184609 - DNA, 21 bp, Homo sapiens
aagaacatggacttgtatatt

SEQ ID NO: 3184610 - DNA, 14 bp, Homo sapiens
aagaaccatgcagg

SEQ ID NO: 3184611 - DNA, 15 bp, Homo sapiens
aagaaccatgcagga

SEQ ID NO: 3184612 - DNA, 19 bp, Homo sapiens
aagaaccttaatgacaaca

SEQ ID NO: 3184613 - DNA, 13 bp, Homo sapiens
aagaacgaacaca

SEQ ID NO: 3184614 - DNA, 21 bp, Homo sapiens
aagaacgttttttcctcagtg

SEQ ID NO: 3184615 - DNA, 24 bp, Homo sapiens
aagaactaattcgtacataataag

SEQ ID NO: 3184616 - DNA, 17 bp, Homo sapiens
aagaactccttattttg

SEQ ID NO: 3184617 - DNA, 14 bp, Homo sapiens
aagaactctctgga

SEQ ID NO: 3184618 - DNA, 18 bp, Homo sapiens
aagaactgcaggccctgg

SEQ ID NO: 3184619 - DNA, 21 bp, Homo sapiens
aagaactgcttcatgtgaaca

SEQ ID NO: 3184620 - DNA, 21 bp, Homo sapiens
aagaactgtttactgcttgat

SEQ ID NO: 3184621 - DNA, 15 bp, Homo sapiens
aagaacttgcatgga

SEQ ID NO: 3184622 - DNA, 12 bp, Homo sapiens
aagaagaaagca

SEQ ID NO: 3184623 - DNA, 15 bp, Homo sapiens
aagaagaagaagaag

SEQ ID NO: 3184624 - DNA, 13 bp, Homo sapiens
aagaagaagttca

SEQ ID NO: 3184625 - DNA, 12 bp, Homo sapiens
aagaagacatga

SEQ ID NO: 3184626 - DNA, 17 bp, Homo sapiens
aagaagatcacgctccc

SEQ ID NO: 3184627 - DNA, 16 bp, Homo sapiens
aagaagattcccaccc

SEQ ID NO: 3184628 - DNA, 14 bp, Homo sapiens
aagaagcaaatttt

SEQ ID NO: 3184629 - DNA, 16 bp, Homo sapiens
aagaagccccttattt

SEQ ID NO: 3184630 - DNA, 17 bp, Homo sapiens
aagaagccccttatttt

SEQ ID NO: 3184631 - DNA, 16 bp, Homo sapiens
aagaagccctgcagag

SEQ ID NO: 3184632 - DNA, 18 bp, Homo sapiens
aagaagccttaatttgca

SEQ ID NO: 3184633 - DNA, 20 bp, Homo sapiens
aagaagccttaatttgcaca

SEQ ID NO: 3184634 - DNA, 17 bp, Homo sapiens
aagaagctgcttctgcc

SEQ ID NO: 3184635 - DNA, 18 bp, Homo sapiens
aagaagctgttgtacatt

SEQ ID NO: 3184636 - DNA, 19 bp, Homo sapiens
aagaagctgttgtacattt

SEQ ID NO: 3184637 - DNA, 21 bp, Homo sapiens
aagaagctgttgtacatttat

SEQ ID NO: 3184638 - DNA, 23 bp, Homo sapiens
aagaagctgttgtacatttatga

SEQ ID NO: 3184639 - DNA, 15 bp, Homo sapiens
aagaagcttctaata

SEQ ID NO: 3184640 - DNA, 18 bp, Homo sapiens
aagaagcttctaataaat

SEQ ID NO: 3184641 - DNA, 16 bp, Homo sapiens
aagaagctttatttct

SEQ ID NO: 3184642 - DNA, 15 bp, Homo sapiens
aagaaggaaaaattt

SEQ ID NO: 3184643 - DNA, 17 bp, Homo sapiens
aagaaggaaaaatttga

SEQ ID NO: 3184644 - DNA, 14 bp, Homo sapiens
aagaaggaaagatg

SEQ ID NO: 3184645 - DNA, 21 bp, Homo sapiens
aagaaggagagcaagaaggaa

SEQ ID NO: 3184646 - DNA, 15 bp, Homo sapiens
aagaagggagaagaa

SEQ ID NO: 3184647 - DNA, 17 bp, Homo sapiens
aagaagggagaagaaag

SEQ ID NO: 3184648 - DNA, 13 bp, Homo sapiens
aagaaggggccat

SEQ ID NO: 3184649 - DNA, 18 bp, Homo sapiens
aagaaggggccatcacag

SEQ ID NO: 3184650 - DNA, 14 bp, Homo sapiens
aagaagttactttg

SEQ ID NO: 3184651 - DNA, 19 bp, Homo sapiens
aagaagttactttgtaatt

SEQ ID NO: 3184652 - DNA, 19 bp, Homo sapiens
aagaagtttattctcattt

SEQ ID NO: 3184653 - DNA, 15 bp, Homo sapiens
aagaataataaaatc

SEQ ID NO: 3184654 - DNA, 13 bp, Homo sapiens
aagaatagttcta

SEQ ID NO: 3184655 - DNA, 19 bp, Homo sapiens
aagaatagttctaaaattg

SEQ ID NO: 3184656 - DNA, 12 bp, Homo sapiens
aagaatatatat

SEQ ID NO: 3184657 - DNA, 18 bp, Homo sapiens
aagaatatgtttccttgt

SEQ ID NO: 3184658 - DNA, 16 bp, Homo sapiens
aagaatattcagagaa

SEQ ID NO: 3184659 - DNA, 13 bp, Homo sapiens
aagaatattcagg

SEQ ID NO: 3184660 - DNA, 17 bp, Homo sapiens
aagaatatttaagaaaa

SEQ ID NO: 3184661 - DNA, 17 bp, Homo sapiens
aagaatccacatttcta

SEQ ID NO: 3184662 - DNA, 19 bp, Homo sapiens
aagaatccacatttctaaa

SEQ ID NO: 3184663 - DNA, 15 bp, Homo sapiens
aagaatctttagaga

SEQ ID NO: 3184664 - DNA, 17 bp, Homo sapiens
aagaatgaaagctgttc

SEQ ID NO: 3184665 - DNA, 19 bp, Homo sapiens
aagaatgaaagctgttcct

SEQ ID NO: 3184666 - DNA, 16 bp, Homo sapiens
aagaatgactatataa

SEQ ID NO: 3184667 - DNA, 21 bp, Homo sapiens
aagaatgagaaggagtcagaa

SEQ ID NO: 3184668 - DNA, 20 bp, Homo sapiens
aagaatgcacaagaatggat

SEQ ID NO: 3184669 - DNA, 21 bp, Homo sapiens
aagaatgcagattcctgggcc

SEQ ID NO: 3184670 - DNA, 15 bp, Homo sapiens
aagaatggagaggaa

SEQ ID NO: 3184671 - DNA, 19 bp, Homo sapiens
aagaatgtctgtaccttga

SEQ ID NO: 3184672 - DNA, 14 bp, Homo sapiens
aagaatgttggttt

SEQ ID NO: 3184673 - DNA, 18 bp, Homo sapiens
aagaatgttggtttactt

SEQ ID NO: 3184674 - DNA, 19 bp, Homo sapiens
aagaatgttggtttacttt

SEQ ID NO: 3184675 - DNA, 21 bp, Homo sapiens
aagaatgttggtttactttca

SEQ ID NO: 3184676 - DNA, 15 bp, Homo sapiens
aagaatgtttatagc

SEQ ID NO: 3184677 - DNA, 14 bp, Homo sapiens
aagaattacagtac

SEQ ID NO: 3184678 - DNA, 19 bp, Homo sapiens
aagaattagaagtctttca

SEQ ID NO: 3184679 - DNA, 20 bp, Homo sapiens
aagaattctgattgatttga

SEQ ID NO: 3184680 - DNA, 19 bp, Homo sapiens
aagaattcttatacacatt

SEQ ID NO: 3184681 - DNA, 20 bp, Homo sapiens
aagaattgaccatctgcttt

SEQ ID NO: 3184682 - DNA, 15 bp, Homo sapiens
aagaattgagtaatg

SEQ ID NO: 3184683 - DNA, 19 bp, Homo sapiens
aagaatttagatcttatat

SEQ ID NO: 3184684 - DNA, 13 bp, Homo sapiens
aagacaaatgaca

SEQ ID NO: 3184685 - DNA, 17 bp, Homo sapiens
aagacaagtatgaatat

SEQ ID NO: 3184686 - DNA, 14 bp, Homo sapiens
aagacaccagagca

SEQ ID NO: 3184687 - DNA, 20 bp, Homo sapiens
aagacaccagagcagatgca

SEQ ID NO: 3184688 - DNA, 23 bp, Homo sapiens
aagacaccagagcagatgcagag

SEQ ID NO: 3184689 - DNA, 11 bp, Homo sapiens
aagacactgca

SEQ ID NO: 3184690 - DNA, 14 bp, Homo sapiens
aagacacttcagat

SEQ ID NO: 3184691 - DNA, 16 bp, Homo sapiens
aagacagatgccccag

SEQ ID NO: 3184692 - DNA, 17 bp, Homo sapiens
aagacagatgccccaga

SEQ ID NO: 3184693 - DNA, 22 bp, Homo sapiens
aagacagatgccccagagctgt

SEQ ID NO: 3184694 - DNA, 20 bp, Homo sapiens
aagacagcatttaaagttgt

SEQ ID NO: 3184695 - DNA, 15 bp, Homo sapiens
aagacagtgtacaaa

SEQ ID NO: 3184696 - DNA, 17 bp, Homo sapiens
aagacagtgtacaaaac

SEQ ID NO: 3184697 - DNA, 19 bp, Homo sapiens
aagacagtgtacaaaactg

SEQ ID NO: 3184698 - DNA, 23 bp, Homo sapiens
aagacagtgtacaaaactgtaaa

SEQ ID NO: 3184699 - DNA, 14 bp, Homo sapiens
aagacataacgttt

SEQ ID NO: 3184700 - DNA, 18 bp, Homo sapiens
aagacataacgtttttcc

SEQ ID NO: 3184701 - DNA, 20 bp, Homo sapiens
aagacataacgtttttcctt

SEQ ID NO: 3184702 - DNA, 16 bp, Homo sapiens
aagacatatctctaat

SEQ ID NO: 3184703 - DNA, 14 bp, Homo sapiens
aagacatgatttcc

SEQ ID NO: 3184704 - DNA, 15 bp, Homo sapiens
aagacatgatttcct

SEQ ID NO: 3184705 - DNA, 20 bp, Homo sapiens
aagacatgatttccttgaat

SEQ ID NO: 3184706 - DNA, 12 bp, Homo sapiens
aagacatgtctg

SEQ ID NO: 3184707 - DNA, 16 bp, Homo sapiens
aagacatgtctgttct

SEQ ID NO: 3184708 - DNA, 19 bp, Homo sapiens
aagacatgtctgttctaca

SEQ ID NO: 3184709 - DNA, 20 bp, Homo sapiens
aagacatgtgaggaggaaaa

SEQ ID NO: 3184710 - DNA, 14 bp, Homo sapiens
aagacattgtcaat

SEQ ID NO: 3184711 - DNA, 11 bp, Homo sapiens
aagacatttct

SEQ ID NO: 3184712 - DNA, 16 bp, Homo sapiens
aagacatttgatagaa

SEQ ID NO: 3184713 - DNA, 22 bp, Homo sapiens
aagacatttgatagaaaggaac

SEQ ID NO: 3184714 - DNA, 18 bp, Homo sapiens
aagacatttgtatattgt

SEQ ID NO: 3184715 - DNA, 11 bp, Homo sapiens
aagacattttc

SEQ ID NO: 3184716 - DNA, 18 bp, Homo sapiens
aagaccaaaatgacaatg

SEQ ID NO: 3184717 - DNA, 19 bp, Homo sapiens
aagaccaaaatgacaatga

SEQ ID NO: 3184718 - DNA, 13 bp, Homo sapiens
aagaccagcctgg

SEQ ID NO: 3184719 - DNA, 13 bp, Homo sapiens
aagaccccatctc

SEQ ID NO: 3184720 - DNA, 15 bp, Homo sapiens
aagacccccagcact

SEQ ID NO: 3184721 - DNA, 15 bp, Homo sapiens
aagacccctgactca

SEQ ID NO: 3184722 - DNA, 21 bp, Homo sapiens
aagaccctcttgcccatcctg

SEQ ID NO: 3184723 - DNA, 15 bp, Homo sapiens
aagaccgtgtcccaa

SEQ ID NO: 3184724 - DNA, 17 bp, Homo sapiens
aagacctactgttctaa

SEQ ID NO: 3184725 - DNA, 18 bp, Homo sapiens
aagacctactgttctaaa

SEQ ID NO: 3184726 - DNA, 20 bp, Homo sapiens
aagacctactgttctaaagc

SEQ ID NO: 3184727 - DNA, 21 bp, Homo sapiens
aagacctactgttctaaagct

SEQ ID NO: 3184728 - DNA, 16 bp, Homo sapiens
aagacctcacctagaa

SEQ ID NO: 3184729 - DNA, 16 bp, Homo sapiens
aagacctcatctgtgg

SEQ ID NO: 3184730 - DNA, 22 bp, Homo sapiens
aagacctcatctgtggagctgc

SEQ ID NO: 3184731 - DNA, 17 bp, Homo sapiens
aagacctgaataccact

SEQ ID NO: 3184732 - DNA, 19 bp, Homo sapiens
aagacctgttggttccaag

SEQ ID NO: 3184733 - DNA, 23 bp, Homo sapiens
aagaccttgcttatgattgcaga

SEQ ID NO: 3184734 - DNA, 14 bp, Homo sapiens
aagacgaggggcag

SEQ ID NO: 3184735 - DNA, 19 bp, Homo sapiens
aagacgaggggcagggaag

SEQ ID NO: 3184736 - DNA, 23 bp, Homo sapiens
aagacgaggggcagggaaggaca

SEQ ID NO: 3184737 - DNA, 21 bp, Homo sapiens
aagacgtttttgtgctgtggg

SEQ ID NO: 3184738 - DNA, 22 bp, Homo sapiens
aagacgtttttgtgctgtgggc

SEQ ID NO: 3184739 - DNA, 19 bp, Homo sapiens
aagactaatttaaaaaata

SEQ ID NO: 3184740 - DNA, 16 bp, Homo sapiens
aagactatctaaatgt

SEQ ID NO: 3184741 - DNA, 18 bp, Homo sapiens
aagactatctaaatgttg

SEQ ID NO: 3184742 - DNA, 16 bp, Homo sapiens
aagactcaaatgttct

SEQ ID NO: 3184743 - DNA, 19 bp, Homo sapiens
aagactcaaatgttctaag

SEQ ID NO: 3184744 - DNA, 14 bp, Homo sapiens
aagactcagtgttc

SEQ ID NO: 3184745 - DNA, 13 bp, Homo sapiens
aagactcctctgg

SEQ ID NO: 3184746 - DNA, 18 bp, Homo sapiens
aagactcctctgggcctg

SEQ ID NO: 3184747 - DNA, 13 bp, Homo sapiens
aagactctagagt

SEQ ID NO: 3184748 - DNA, 19 bp, Homo sapiens
aagactgaacatgtttaca

SEQ ID NO: 3184749 - DNA, 14 bp, Homo sapiens
aagactgagaactt

SEQ ID NO: 3184750 - DNA, 15 bp, Homo sapiens
aagactgagaacttt

SEQ ID NO: 3184751 - DNA, 20 bp, Homo sapiens
aagactggttttctgccaat

SEQ ID NO: 3184752 - DNA, 11 bp, Homo sapiens
aagactgtact

SEQ ID NO: 3184753 - DNA, 17 bp, Homo sapiens
aagactgtagatatgta

SEQ ID NO: 3184754 - DNA, 17 bp, Homo sapiens
aagactgttgctcaaat

SEQ ID NO: 3184755 - DNA, 17 bp, Homo sapiens
aagactgttgtgatctt

SEQ ID NO: 3184756 - DNA, 22 bp, Homo sapiens
aagactgttgtgatcttgcatt

SEQ ID NO: 3184757 - DNA, 23 bp, Homo sapiens
aagactgttgtgatcttgcattc

SEQ ID NO: 3184758 - DNA, 16 bp, Homo sapiens
aagactgtttttaagt

SEQ ID NO: 3184759 - DNA, 20 bp, Homo sapiens
aagactgtttttaagtaact

SEQ ID NO: 3184760 - DNA, 21 bp, Homo sapiens
aagactgtttttaagtaactt

SEQ ID NO: 3184761 - DNA, 14 bp, Homo sapiens
aagacttactctaa

SEQ ID NO: 3184762 - DNA, 15 bp, Homo sapiens
aagacttactctaag

SEQ ID NO: 3184763 - DNA, 18 bp, Homo sapiens
aagacttggcaacagaag

SEQ ID NO: 3184764 - DNA, 20 bp, Homo sapiens
aagagaaaaaccaatgattc

SEQ ID NO: 3184765 - DNA, 16 bp, Homo sapiens
aagagaaaattgcact

SEQ ID NO: 3184766 - DNA, 18 bp, Homo sapiens
aagagaaaattgcactaa

SEQ ID NO: 3184767 - DNA, 18 bp, Homo sapiens
aagagaaactttgtgcta

SEQ ID NO: 3184768 - DNA, 20 bp, Homo sapiens
aagagaactcgcgctcagta

SEQ ID NO: 3184769 - DNA, 13 bp, Homo sapiens
aagagaaggaagc

SEQ ID NO: 3184770 - DNA, 14 bp, Homo sapiens
aagagaagttattt

SEQ ID NO: 3184771 - DNA, 16 bp, Homo sapiens
aagagaatgagtcctt

SEQ ID NO: 3184772 - DNA, 10 bp, Homo sapiens
aagagaatgt

SEQ ID NO: 3184773 - DNA, 13 bp, Homo sapiens
aagagaatgtaga

SEQ ID NO: 3184774 - DNA, 19 bp, Homo sapiens
aagagacaaacacctccca

SEQ ID NO: 3184775 - DNA, 14 bp, Homo sapiens
aagagacagaatgt

SEQ ID NO: 3184776 - DNA, 16 bp, Homo sapiens
aagagacagaatgtat

SEQ ID NO: 3184777 - DNA, 16 bp, Homo sapiens
aagagacagcccagga

SEQ ID NO: 3184778 - DNA, 14 bp, Homo sapiens
aagagacagtgata

SEQ ID NO: 3184779 - DNA, 13 bp, Homo sapiens
aagagaccagcac

SEQ ID NO: 3184780 - DNA, 18 bp, Homo sapiens
aagagactgcgttctgca

SEQ ID NO: 3184781 - DNA, 19 bp, Homo sapiens
aagagacttaaaggacagg

SEQ ID NO: 3184782 - DNA, 20 bp, Homo sapiens
aagagacttctgcttttcaa

SEQ ID NO: 3184783 - DNA, 14 bp, Homo sapiens
aagagagaaaataa

SEQ ID NO: 3184784 - DNA, 21 bp, Homo sapiens
aagagagaaagaagtaggcat

SEQ ID NO: 3184785 - DNA, 18 bp, Homo sapiens
aagagagaagccagccac

SEQ ID NO: 3184786 - DNA, 19 bp, Homo sapiens
aagagagagagagaaaaaa

SEQ ID NO: 3184787 - DNA, 22 bp, Homo sapiens
aagagagagccatgaagcatta

SEQ ID NO: 3184788 - DNA, 22 bp, Homo sapiens
aagagagccttggttcatcagt

SEQ ID NO: 3184789 - DNA, 19 bp, Homo sapiens
aagagaggatgtgcaagcg

SEQ ID NO: 3184790 - DNA, 21 bp, Homo sapiens
aagagagggccatgcaattca

SEQ ID NO: 3184791 - DNA, 11 bp, Homo sapiens
aagagaggtta

SEQ ID NO: 3184792 - DNA, 22 bp, Homo sapiens
aagagagtatttttatacaaac

SEQ ID NO: 3184793 - DNA, 20 bp, Homo sapiens
aagagatattgatattgaag

SEQ ID NO: 3184794 - DNA, 14 bp, Homo sapiens
aagagatgtggcaa

SEQ ID NO: 3184795 - DNA, 17 bp, Homo sapiens
aagagattgttgtttgc

SEQ ID NO: 3184796 - DNA, 15 bp, Homo sapiens
aagagatttatcttt

SEQ ID NO: 3184797 - DNA, 15 bp, Homo sapiens
aagagatttcaacat

SEQ ID NO: 3184798 - DNA, 13 bp, Homo sapiens
aagagcaaaaata

SEQ ID NO: 3184799 - DNA, 14 bp, Homo sapiens
aagagcaaaaatat

SEQ ID NO: 3184800 - DNA, 16 bp, Homo sapiens
aagagcacaaacattt

SEQ ID NO: 3184801 - DNA, 21 bp, Homo sapiens
aagagcacaaacatttttcaa

SEQ ID NO: 3184802 - DNA, 19 bp, Homo sapiens
aagagcaccttcctcactt

SEQ ID NO: 3184803 - DNA, 17 bp, Homo sapiens
aagagcagagtctgggc

SEQ ID NO: 3184804 - DNA, 15 bp, Homo sapiens
aagagcagcctgatg

SEQ ID NO: 3184805 - DNA, 19 bp, Homo sapiens
aagagcagcctgatggcca

SEQ ID NO: 3184806 - DNA, 20 bp, Homo sapiens
aagagcagcctgatggccaa

SEQ ID NO: 3184807 - DNA, 13 bp, Homo sapiens
aagagcagcctgt

SEQ ID NO: 3184808 - DNA, 17 bp, Homo sapiens
aagagcagcctgtggca

SEQ ID NO: 3184809 - DNA, 22 bp, Homo sapiens
aagagcatggatgcatttcaaa

SEQ ID NO: 3184810 - DNA, 23 bp, Homo sapiens
aagagcatggatgcatttcaaat

SEQ ID NO: 3184811 - DNA, 20 bp, Homo sapiens
aagagccatataagtttgaa

SEQ ID NO: 3184812 - DNA, 19 bp, Homo sapiens
aagagccctgtggccgcca

SEQ ID NO: 3184813 - DNA, 20 bp, Homo sapiens
aagagcctgatctcttcctg

SEQ ID NO: 3184814 - DNA, 18 bp, Homo sapiens
aagagcgagagatcaaag

SEQ ID NO: 3184815 - DNA, 21 bp, Homo sapiens
aagagcgagagatcaaagatg

SEQ ID NO: 3184816 - DNA, 20 bp, Homo sapiens
aagagctattgccaaccagt

SEQ ID NO: 3184817 - DNA, 16 bp, Homo sapiens
aagagctgcctggatg

SEQ ID NO: 3184818 - DNA, 21 bp, Homo sapiens
aagagctgcctggatgagaaa

SEQ ID NO: 3184819 - DNA, 22 bp, Homo sapiens
aagagctgtctatgcagcctgc

SEQ ID NO: 3184820 - DNA, 20 bp, Homo sapiens
aagaggaacagcactgggga

SEQ ID NO: 3184821 - DNA, 21 bp, Homo sapiens
aagaggaatttataacaaata

SEQ ID NO: 3184822 - DNA, 19 bp, Homo sapiens
aagaggactcgcttgtaaa

SEQ ID NO: 3184823 - DNA, 23 bp, Homo sapiens
aagaggactcgcttgtaaatacc

SEQ ID NO: 3184824 - DNA, 17 bp, Homo sapiens
aagaggactgagactgg

SEQ ID NO: 3184825 - DNA, 14 bp, Homo sapiens
aagaggagaccctg

SEQ ID NO: 3184826 - DNA, 13 bp, Homo sapiens
aagaggagcactt

SEQ ID NO: 3184827 - DNA, 16 bp, Homo sapiens
aagaggcatcctgcct

SEQ ID NO: 3184828 - DNA, 15 bp, Homo sapiens
aagaggccaatgccc

SEQ ID NO: 3184829 - DNA, 23 bp, Homo sapiens
aagaggccacttagggaaagatg

SEQ ID NO: 3184830 - DNA, 21 bp, Homo sapiens
aagaggcctcatgcctgctga

SEQ ID NO: 3184831 - DNA, 20 bp, Homo sapiens
aagaggcgggccagccaggc

SEQ ID NO: 3184832 - DNA, 22 bp, Homo sapiens
aagaggcgggccagccaggcgg

SEQ ID NO: 3184833 - DNA, 22 bp, Homo sapiens
aagaggctgcccctctcaccaa

SEQ ID NO: 3184834 - DNA, 12 bp, Homo sapiens
aagaggctgctg

SEQ ID NO: 3184835 - DNA, 17 bp, Homo sapiens
aagaggcttctcctgtt

SEQ ID NO: 3184836 - DNA, 22 bp, Homo sapiens
aagagggaatccccgaaggtgc

SEQ ID NO: 3184837 - DNA, 11 bp, Homo sapiens
aagagggacag

SEQ ID NO: 3184838 - DNA, 14 bp, Homo sapiens
aagagggacaggct

SEQ ID NO: 3184839 - DNA, 13 bp, Homo sapiens
aagagggcaagtg

SEQ ID NO: 3184840 - DNA, 12 bp, Homo sapiens
aagagggcctgt

SEQ ID NO: 3184841 - DNA, 14 bp, Homo sapiens
aagaggggccgctg

SEQ ID NO: 3184842 - DNA, 13 bp, Homo sapiens
aagagggggtgga

SEQ ID NO: 3184843 - DNA, 16 bp, Homo sapiens
aagagggggtggaggg

SEQ ID NO: 3184844 - DNA, 17 bp, Homo sapiens
aagagggtgaaaggcag

SEQ ID NO: 3184845 - DNA, 21 bp, Homo sapiens
aagaggtatttatctttactt

SEQ ID NO: 3184846 - DNA, 14 bp, Homo sapiens
aagaggtctcccca

SEQ ID NO: 3184847 - DNA, 15 bp, Homo sapiens
aagaggtctgagccc

SEQ ID NO: 3184848 - DNA, 18 bp, Homo sapiens
aagaggtctgagccctgg

SEQ ID NO: 3184849 - DNA, 22 bp, Homo sapiens
aagaggtctgagccctggtgtg

SEQ ID NO: 3184850 - DNA, 17 bp, Homo sapiens
aagaggtgggagggccc

SEQ ID NO: 3184851 - DNA, 17 bp, Homo sapiens
aagaggtgttatttgga

SEQ ID NO: 3184852 - DNA, 23 bp, Homo sapiens
aagaggttgggcttccatgcctg

SEQ ID NO: 3184853 - DNA, 14 bp, Homo sapiens
aagagtaactttac

SEQ ID NO: 3184854 - DNA, 19 bp, Homo sapiens
aagagtagcatttcattct

SEQ ID NO: 3184855 - DNA, 16 bp, Homo sapiens
aagagtagtaatagag

SEQ ID NO: 3184856 - DNA, 18 bp, Homo sapiens
aagagtatccttccttca

SEQ ID NO: 3184857 - DNA, 20 bp, Homo sapiens
aagagtctagattcaaaggt

SEQ ID NO: 3184858 - DNA, 19 bp, Homo sapiens
aagagtgaagcgtttttct

SEQ ID NO: 3184859 - DNA, 16 bp, Homo sapiens
aagagtgacttatttt

SEQ ID NO: 3184860 - DNA, 18 bp, Homo sapiens
aagagtgacttattttgt

SEQ ID NO: 3184861 - DNA, 19 bp, Homo sapiens
aagagtggcatataatttt

SEQ ID NO: 3184862 - DNA, 20 bp, Homo sapiens
aagagtgggggagagcaggc

SEQ ID NO: 3184863 - DNA, 12 bp, Homo sapiens
aagagtgtagaa

SEQ ID NO: 3184864 - DNA, 15 bp, Homo sapiens
aagagtgtagaagca

SEQ ID NO: 3184865 - DNA, 13 bp, Homo sapiens
aagagtgtgtgtg

SEQ ID NO: 3184866 - DNA, 15 bp, Homo sapiens
aagagttaagaatgt

SEQ ID NO: 3184867 - DNA, 18 bp, Homo sapiens
aagagtttcagtttgttg

SEQ ID NO: 3184868 - DNA, 19 bp, Homo sapiens
aagagtttcagtttgttgg

SEQ ID NO: 3184869 - DNA, 15 bp, Homo sapiens
aagataaaaatcagt

SEQ ID NO: 3184870 - DNA, 22 bp, Homo sapiens
aagataaaccgtttttaacaca

SEQ ID NO: 3184871 - DNA, 18 bp, Homo sapiens
aagataaagaccagaaat

SEQ ID NO: 3184872 - DNA, 21 bp, Homo sapiens
aagataacaagatctttcagg

SEQ ID NO: 3184873 - DNA, 22 bp, Homo sapiens
aagataacaagatctttcagga

SEQ ID NO: 3184874 - DNA, 19 bp, Homo sapiens
aagataacttactgtatat

SEQ ID NO: 3184875 - DNA, 15 bp, Homo sapiens
aagataacttgagca

SEQ ID NO: 3184876 - DNA, 17 bp, Homo sapiens
aagataagcctgagcct

SEQ ID NO: 3184877 - DNA, 20 bp, Homo sapiens
aagataaggactagatacta

SEQ ID NO: 3184878 - DNA, 21 bp, Homo sapiens
aagataagtgtatttttcaat

SEQ ID NO: 3184879 - DNA, 13 bp, Homo sapiens
aagataattgcta

SEQ ID NO: 3184880 - DNA, 15 bp, Homo sapiens
aagatacaagtttca

SEQ ID NO: 3184881 - DNA, 14 bp, Homo sapiens
aagatacgacttta

SEQ ID NO: 3184882 - DNA, 21 bp, Homo sapiens
aagatacgactttattttctg

SEQ ID NO: 3184883 - DNA, 16 bp, Homo sapiens
aagatagatcctttta

SEQ ID NO: 3184884 - DNA, 16 bp, Homo sapiens
aagataggctctgcac

SEQ ID NO: 3184885 - DNA, 14 bp, Homo sapiens
aagatatacatgaa

SEQ ID NO: 3184886 - DNA, 16 bp, Homo sapiens
aagatatatatatata

SEQ ID NO: 3184887 - DNA, 22 bp, Homo sapiens
aagatatcagagctcttaatgt

SEQ ID NO: 3184888 - DNA, 15 bp, Homo sapiens
aagatatccatcttt

SEQ ID NO: 3184889 - DNA, 22 bp, Homo sapiens
aagatcaaaagcttattcatct

SEQ ID NO: 3184890 - DNA, 20 bp, Homo sapiens
aagatcaaaaggttaataaa

SEQ ID NO: 3184891 - DNA, 15 bp, Homo sapiens
aagatcactttctca

SEQ ID NO: 3184892 - DNA, 14 bp, Homo sapiens
aagatccaagaagg

SEQ ID NO: 3184893 - DNA, 16 bp, Homo sapiens
aagatccatttgcctt

SEQ ID NO: 3184894 - DNA, 22 bp, Homo sapiens
aagatcctagatcctaagggtc

SEQ ID NO: 3184895 - DNA, 14 bp, Homo sapiens
aagatcgttagtat

SEQ ID NO: 3184896 - DNA, 20 bp, Homo sapiens
aagatctgttttgaaggcaa

SEQ ID NO: 3184897 - DNA, 22 bp, Homo sapiens
aagatctgttttgaaggcaaaa

SEQ ID NO: 3184898 - DNA, 13 bp, Homo sapiens
aagatcttagatt

SEQ ID NO: 3184899 - DNA, 14 bp, Homo sapiens
aagatcttagattc

SEQ ID NO: 3184900 - DNA, 16 bp, Homo sapiens
aagatcttagattctc

SEQ ID NO: 3184901 - DNA, 23 bp, Homo sapiens
aagatcttagattctctgtgtct

SEQ ID NO: 3184902 - DNA, 23 bp, Homo sapiens
aagatgaaggagaggcaacatcc

SEQ ID NO: 3184903 - DNA, 13 bp, Homo sapiens
aagatgacacaag

SEQ ID NO: 3184904 - DNA, 19 bp, Homo sapiens
aagatgagatttgccagca

SEQ ID NO: 3184905 - DNA, 20 bp, Homo sapiens
aagatgcaaggaccaggact

SEQ ID NO: 3184906 - DNA, 15 bp, Homo sapiens
aagatgctcttctgt

SEQ ID NO: 3184907 - DNA, 16 bp, Homo sapiens
aagatggactctgaaa

SEQ ID NO: 3184908 - DNA, 14 bp, Homo sapiens
aagatggagtttct

SEQ ID NO: 3184909 - DNA, 15 bp, Homo sapiens
aagatggagtttcta

SEQ ID NO: 3184910 - DNA, 15 bp, Homo sapiens
aagatggatgtgctt

SEQ ID NO: 3184911 - DNA, 17 bp, Homo sapiens
aagatggattctcagat

SEQ ID NO: 3184912 - DNA, 19 bp, Homo sapiens
aagatggcataacctgtct

SEQ ID NO: 3184913 - DNA, 21 bp, Homo sapiens
aagatggctgtgcctctgcct

SEQ ID NO: 3184914 - DNA, 17 bp, Homo sapiens
aagatggtcgtgtgtgt

SEQ ID NO: 3184915 - DNA, 14 bp, Homo sapiens
aagatgtgatattc

SEQ ID NO: 3184916 - DNA, 18 bp, Homo sapiens
aagatgtgatattctaag

SEQ ID NO: 3184917 - DNA, 18 bp, Homo sapiens
aagatgtgggttcttttt

SEQ ID NO: 3184918 - DNA, 16 bp, Homo sapiens
aagatgtgttcttatt

SEQ ID NO: 3184919 - DNA, 18 bp, Homo sapiens
aagatgtgttcttatttt

SEQ ID NO: 3184920 - DNA, 21 bp, Homo sapiens
aagatgttgaagaatacagtt

SEQ ID NO: 3184921 - DNA, 16 bp, Homo sapiens
aagattaaaggaagga

SEQ ID NO: 3184922 - DNA, 17 bp, Homo sapiens
aagattaaaggaaggaa

SEQ ID NO: 3184923 - DNA, 18 bp, Homo sapiens
aagattaaaggaaggaaa

SEQ ID NO: 3184924 - DNA, 13 bp, Homo sapiens
aagattagaagct

SEQ ID NO: 3184925 - DNA, 21 bp, Homo sapiens
aagattagcaaggtcatttct

SEQ ID NO: 3184926 - DNA, 22 bp, Homo sapiens
aagattagttgaatataagaaa

SEQ ID NO: 3184927 - DNA, 14 bp, Homo sapiens
aagattatagattc

SEQ ID NO: 3184928 - DNA, 17 bp, Homo sapiens
aagattatagattctaa

SEQ ID NO: 3184929 - DNA, 21 bp, Homo sapiens
aagattatagattctaaagat

SEQ ID NO: 3184930 - DNA, 24 bp, Homo sapiens
aagattccggatcctaagcatcta

SEQ ID NO: 3184931 - DNA, 13 bp, Homo sapiens
aagattctaaagg

SEQ ID NO: 3184932 - DNA, 11 bp, Homo sapiens
aagattctaga

SEQ ID NO: 3184933 - DNA, 13 bp, Homo sapiens
aagattctagatg

SEQ ID NO: 3184934 - DNA, 15 bp, Homo sapiens
aagattctagatgat

SEQ ID NO: 3184935 - DNA, 17 bp, Homo sapiens
aagattctatagttcta

SEQ ID NO: 3184936 - DNA, 16 bp, Homo sapiens
aagattgctgaaattt

SEQ ID NO: 3184937 - DNA, 17 bp, Homo sapiens
aagattgtaaaaataat

SEQ ID NO: 3184938 - DNA, 22 bp, Homo sapiens
aagattgtacttagccagttca

SEQ ID NO: 3184939 - DNA, 23 bp, Homo sapiens
aagatttaccttttctgttgtac

SEQ ID NO: 3184940 - DNA, 16 bp, Homo sapiens
aagatttcctactttc

SEQ ID NO: 3184941 - DNA, 16 bp, Homo sapiens
aagatttccttgtgca

SEQ ID NO: 3184942 - DNA, 17 bp, Homo sapiens
aagatttgtaattacag

SEQ ID NO: 3184943 - DNA, 17 bp, Homo sapiens
aagattttaatcaagtt

SEQ ID NO: 3184944 - DNA, 23 bp, Homo sapiens
aagattttattgtataaaaagtt

SEQ ID NO: 3184945 - DNA, 16 bp, Homo sapiens
aagattttcctcttgt

SEQ ID NO: 3184946 - DNA, 15 bp, Homo sapiens
aagattttctaagga

SEQ ID NO: 3184947 - DNA, 17 bp, Homo sapiens
aagattttgaatgcttc

SEQ ID NO: 3184948 - DNA, 13 bp, Homo sapiens
aagatttttctca

SEQ ID NO: 3184949 - DNA, 20 bp, Homo sapiens
aagatttttctcaaagtttt

SEQ ID NO: 3184950 - DNA, 14 bp, Homo sapiens
aagcaaaagaaaaa

SEQ ID NO: 3184951 - DNA, 18 bp, Homo sapiens
aagcaaaaggctgagaag

SEQ ID NO: 3184952 - DNA, 13 bp, Homo sapiens
aagcaaaatatta

SEQ ID NO: 3184953 - DNA, 14 bp, Homo sapiens
aagcaaacatcaaa

SEQ ID NO: 3184954 - DNA, 22 bp, Homo sapiens
aagcaaacatcaaataaatttc

SEQ ID NO: 3184955 - DNA, 21 bp, Homo sapiens
aagcaaaccgccctgcagcat

SEQ ID NO: 3184956 - DNA, 13 bp, Homo sapiens
aagcaaagtgctg

SEQ ID NO: 3184957 - DNA, 22 bp, Homo sapiens
aagcaaagtgctttgacttctt

SEQ ID NO: 3184958 - DNA, 17 bp, Homo sapiens
aagcaaatgttaaaagt

SEQ ID NO: 3184959 - DNA, 22 bp, Homo sapiens
aagcaaatttcaaaagacatgt

SEQ ID NO: 3184960 - DNA, 14 bp, Homo sapiens
aagcaacaggtttt

SEQ ID NO: 3184961 - DNA, 18 bp, Homo sapiens
aactgtccgtaagcagta

SEQ ID NO: 3184962 - DNA, 14 bp, Homo sapiens
aactgtctcaaaag

SEQ ID NO: 3184963 - DNA, 19 bp, Homo sapiens
aactgtctttaaaagagag

SEQ ID NO: 3184964 - DNA, 19 bp, Homo sapiens
aactgtgaagtttacattg

SEQ ID NO: 3184965 - DNA, 21 bp, Homo sapiens
aactgtgctgaatgctttaga

SEQ ID NO: 3184966 - DNA, 11 bp, Homo sapiens
aactgtggata

SEQ ID NO: 3184967 - DNA, 20 bp, Homo sapiens
aactgtggccgttatctgga

SEQ ID NO: 3184968 - DNA, 19 bp, Homo sapiens
aactgtgggattctgattt

SEQ ID NO: 3184969 - DNA, 21 bp, Homo sapiens
aactgtgggattctgatttgt

SEQ ID NO: 3184970 - DNA, 12 bp, Homo sapiens
aactgtgttgta

SEQ ID NO: 3184971 - DNA, 15 bp, Homo sapiens
aactgtgttgtatta

SEQ ID NO: 3184972 - DNA, 17 bp, Homo sapiens
aactgtgttgtattaac

SEQ ID NO: 3184973 - DNA, 22 bp, Homo sapiens
aactgtgtttcaagttcaatcc

SEQ ID NO: 3184974 - DNA, 20 bp, Homo sapiens
aactgttaactatgacagat

SEQ ID NO: 3184975 - DNA, 15 bp, Homo sapiens
aactgttacctaaag

SEQ ID NO: 3184976 - DNA, 20 bp, Homo sapiens
aactgttacctaaagtattt

SEQ ID NO: 3184977 - DNA, 17 bp, Homo sapiens
aactgttagcactgttg

SEQ ID NO: 3184978 - DNA, 20 bp, Homo sapiens
aactgttagcactgttgatg

SEQ ID NO: 3184979 - DNA, 22 bp, Homo sapiens
aactgttagcactgttgatgta

SEQ ID NO: 3184980 - DNA, 14 bp, Homo sapiens
aactgttatgaaat

SEQ ID NO: 3184981 - DNA, 16 bp, Homo sapiens
aactgttatgaaataa

SEQ ID NO: 3184982 - DNA, 19 bp, Homo sapiens
aactgttgcctaattggaa

SEQ ID NO: 3184983 - DNA, 19 bp, Homo sapiens
aactgttggaatggatttt

SEQ ID NO: 3184984 - DNA, 16 bp, Homo sapiens
aactgtttatataaag

SEQ ID NO: 3184985 - DNA, 15 bp, Homo sapiens
aactgttttttaagt

SEQ ID NO: 3184986 - DNA, 16 bp, Homo sapiens
aacttaaaatatttta

SEQ ID NO: 3184987 - DNA, 13 bp, Homo sapiens
aacttaaataata

SEQ ID NO: 3184988 - DNA, 16 bp, Homo sapiens
aacttaacatatttac

SEQ ID NO: 3184989 - DNA, 15 bp, Homo sapiens
aacttaacatgggct

SEQ ID NO: 3184990 - DNA, 13 bp, Homo sapiens
aacttaactttaa

SEQ ID NO: 3184991 - DNA, 18 bp, Homo sapiens
aacttaagatgaatacat

SEQ ID NO: 3184992 - DNA, 18 bp, Homo sapiens
aacttaatagtatttatg

SEQ ID NO: 3184993 - DNA, 19 bp, Homo sapiens
aacttacacttggagcccg

SEQ ID NO: 3184994 - DNA, 19 bp, Homo sapiens
aacttacattgttcaatta

SEQ ID NO: 3184995 - DNA, 13 bp, Homo sapiens
aacttactgtata

SEQ ID NO: 3184996 - DNA, 14 bp, Homo sapiens
aacttactgtatat

SEQ ID NO: 3184997 - DNA, 17 bp, Homo sapiens
aacttactgtatatgta

SEQ ID NO: 3184998 - DNA, 12 bp, Homo sapiens
aacttagaccca

SEQ ID NO: 3184999 - DNA, 17 bp, Homo sapiens
aacttagacccatgctg

SEQ ID NO: 3185000 - DNA, 16 bp, Homo sapiens
aacttagaggaaaatg

SEQ ID NO: 3185001 - DNA, 19 bp, Homo sapiens
aacttagccagagttaggt

SEQ ID NO: 3185002 - DNA, 21 bp, Homo sapiens
aacttaggcatgcacagctgt

SEQ ID NO: 3185003 - DNA, 22 bp, Homo sapiens
aacttagtgcggacaagtttta

SEQ ID NO: 3185004 - DNA, 22 bp, Homo sapiens
aacttatagttaatattttgtt

SEQ ID NO: 3185005 - DNA, 15 bp, Homo sapiens
aacttatggccacag

SEQ ID NO: 3185006 - DNA, 18 bp, Homo sapiens
aacttatgtagatatttg

SEQ ID NO: 3185007 - DNA, 20 bp, Homo sapiens
aacttatgtagatatttggc

SEQ ID NO: 3185008 - DNA, 21 bp, Homo sapiens
aacttatgtagatatttggct

SEQ ID NO: 3185009 - DNA, 13 bp, Homo sapiens
aacttattatttt

SEQ ID NO: 3185010 - DNA, 13 bp, Homo sapiens
aacttattctgta

SEQ ID NO: 3185011 - DNA, 23 bp, Homo sapiens
aacttattctgtagattctgtgg

SEQ ID NO: 3185012 - DNA, 17 bp, Homo sapiens
aacttcaaaaactaaaa

SEQ ID NO: 3185013 - DNA, 13 bp, Homo sapiens
aacttcaagaagt

SEQ ID NO: 3185014 - DNA, 16 bp, Homo sapiens
aacttcacattaaaaa

SEQ ID NO: 3185015 - DNA, 17 bp, Homo sapiens
aacttcacattaaaaaa

SEQ ID NO: 3185016 - DNA, 18 bp, Homo sapiens
aacttcagcagtacctat

SEQ ID NO: 3185017 - DNA, 17 bp, Homo sapiens
aacttcagctgtacttc

SEQ ID NO: 3185018 - DNA, 17 bp, Homo sapiens
aacttcagtactcaaat

SEQ ID NO: 3185019 - DNA, 15 bp, Homo sapiens
aacttcataaatgtt

SEQ ID NO: 3185020 - DNA, 15 bp, Homo sapiens
aacttccaaagaaag

SEQ ID NO: 3185021 - DNA, 16 bp, Homo sapiens
aacttccaaagaaagt

SEQ ID NO: 3185022 - DNA, 10 bp, Homo sapiens
aacttccaag

SEQ ID NO: 3185023 - DNA, 15 bp, Homo sapiens
aacttccacaagagt

SEQ ID NO: 3185024 - DNA, 14 bp, Homo sapiens
aacttctaatatat

SEQ ID NO: 3185025 - DNA, 16 bp, Homo sapiens
aacttctatattttaa

SEQ ID NO: 3185026 - DNA, 22 bp, Homo sapiens
aacttctatattttaatagaaa

SEQ ID NO: 3185027 - DNA, 14 bp, Homo sapiens
aacttctctcagac

SEQ ID NO: 3185028 - DNA, 19 bp, Homo sapiens
aacttctgcaacaagcatg

SEQ ID NO: 3185029 - DNA, 17 bp, Homo sapiens
aacttcttatggaattg

SEQ ID NO: 3185030 - DNA, 15 bp, Homo sapiens
aacttcttcctgctg

SEQ ID NO: 3185031 - DNA, 16 bp, Homo sapiens
aacttcttcctgctgg

SEQ ID NO: 3185032 - DNA, 12 bp, Homo sapiens
aacttcttgctt

SEQ ID NO: 3185033 - DNA, 18 bp, Homo sapiens
aacttcttgcttctttct

SEQ ID NO: 3185034 - DNA, 19 bp, Homo sapiens
aacttcttgcttctttcta

SEQ ID NO: 3185035 - DNA, 22 bp, Homo sapiens
aacttcttgtcagacataaagc

SEQ ID NO: 3185036 - DNA, 23 bp, Homo sapiens
aacttcttgtcagacataaagcc

SEQ ID NO: 3185037 - DNA, 14 bp, Homo sapiens
aacttgaaaatata

SEQ ID NO: 3185038 - DNA, 22 bp, Homo sapiens
aacttgaaaatatatgatggct

SEQ ID NO: 3185039 - DNA, 24 bp, Homo sapiens
aacttgaaacagattcaggccagc

SEQ ID NO: 3185040 - DNA, 20 bp, Homo sapiens
aacttgagggcccagagcag

SEQ ID NO: 3185041 - DNA, 14 bp, Homo sapiens
aacttgatgcatgt

SEQ ID NO: 3185042 - DNA, 15 bp, Homo sapiens
aacttgatgcatgtg

SEQ ID NO: 3185043 - DNA, 14 bp, Homo sapiens
aacttgatttgcat

SEQ ID NO: 3185044 - DNA, 23 bp, Homo sapiens
aacttgcatattgttggcacaga

SEQ ID NO: 3185045 - DNA, 22 bp, Homo sapiens
aacttgcctggggtctgagcat

SEQ ID NO: 3185046 - DNA, 16 bp, Homo sapiens
aacttggcactttttc

SEQ ID NO: 3185047 - DNA, 21 bp, Homo sapiens
aacttggcactttttcgtgtg

SEQ ID NO: 3185048 - DNA, 12 bp, Homo sapiens
aacttggcattt

SEQ ID NO: 3185049 - DNA, 14 bp, Homo sapiens
aacttggcatttct

SEQ ID NO: 3185050 - DNA, 15 bp, Homo sapiens
aacttggcatttcta

SEQ ID NO: 3185051 - DNA, 21 bp, Homo sapiens
aacttggctcgaatctctgtg

SEQ ID NO: 3185052 - DNA, 20 bp, Homo sapiens
aacttggctttcctgtttct

SEQ ID NO: 3185053 - DNA, 13 bp, Homo sapiens
aacttggggaggc

SEQ ID NO: 3185054 - DNA, 16 bp, Homo sapiens
aacttggtcagagcca

SEQ ID NO: 3185055 - DNA, 15 bp, Homo sapiens
aacttgtaaatacac

SEQ ID NO: 3185056 - DNA, 15 bp, Homo sapiens
aacttgtaaatgctg

SEQ ID NO: 3185057 - DNA, 15 bp, Homo sapiens
aacttgtatttccaa

SEQ ID NO: 3185058 - DNA, 15 bp, Homo sapiens
aacttgtcaggcatg

SEQ ID NO: 3185059 - DNA, 11 bp, Homo sapiens
aacttgtgaat

SEQ ID NO: 3185060 - DNA, 16 bp, Homo sapiens
aacttgttgtggctct

SEQ ID NO: 3185061 - DNA, 20 bp, Homo sapiens
aacttgtttgctgtgaacaa

SEQ ID NO: 3185062 - DNA, 19 bp, Homo sapiens
aactttaaaaaatatttat

SEQ ID NO: 3185063 - DNA, 18 bp, Homo sapiens
aactttaagtttcaggat

SEQ ID NO: 3185064 - DNA, 20 bp, Homo sapiens
aactttacccaaaaactaaa

SEQ ID NO: 3185065 - DNA, 16 bp, Homo sapiens
aactttactctgtgtt

SEQ ID NO: 3185066 - DNA, 21 bp, Homo sapiens
aactttactctgtgtttaaaa

SEQ ID NO: 3185067 - DNA, 15 bp, Homo sapiens
aactttatgtactgc

SEQ ID NO: 3185068 - DNA, 13 bp, Homo sapiens
aactttatgtgta

SEQ ID NO: 3185069 - DNA, 17 bp, Homo sapiens
aactttattaaatacaa

SEQ ID NO: 3185070 - DNA, 20 bp, Homo sapiens
aactttatttgtaaaccatt

SEQ ID NO: 3185071 - DNA, 20 bp, Homo sapiens
aactttcagaagtgccactt

SEQ ID NO: 3185072 - DNA, 15 bp, Homo sapiens
aactttctgtaaact

SEQ ID NO: 3185073 - DNA, 22 bp, Homo sapiens
aactttggagagtgagctacag

SEQ ID NO: 3185074 - DNA, 22 bp, Homo sapiens
aactttgggaaaacatgttaat

SEQ ID NO: 3185075 - DNA, 21 bp, Homo sapiens
aactttgtaaaaatcttttga

SEQ ID NO: 3185076 - DNA, 20 bp, Homo sapiens
aactttgtcgtggttcttaa

SEQ ID NO: 3185077 - DNA, 19 bp, Homo sapiens
aactttgtggatgtcttcc

SEQ ID NO: 3185078 - DNA, 15 bp, Homo sapiens
aacttttaattactg

SEQ ID NO: 3185079 - DNA, 17 bp, Homo sapiens
aacttttatacttgggt

SEQ ID NO: 3185080 - DNA, 13 bp, Homo sapiens
aacttttgtgaat

SEQ ID NO: 3185081 - DNA, 21 bp, Homo sapiens
aactttttatttctaaatgag

SEQ ID NO: 3185082 - DNA, 18 bp, Homo sapiens
aacttttttatatctttt

SEQ ID NO: 3185083 - DNA, 18 bp, Homo sapiens
aacttttttgaggccttt

SEQ ID NO: 3185084 - DNA, 13 bp, Homo sapiens
aacttttttgtgt

SEQ ID NO: 3185085 - DNA, 20 bp, Homo sapiens
aacttttttgtgtatgtact

SEQ ID NO: 3185086 - DNA, 14 bp, Homo sapiens
aactttttttcaat

SEQ ID NO: 3185087 - DNA, 16 bp, Homo sapiens
aagaaaaaaaataaca

SEQ ID NO: 3185088 - DNA, 13 bp, Homo sapiens
aagaaaaaatcag

SEQ ID NO: 3185089 - DNA, 15 bp, Homo sapiens
aagaaaaagaagaac

SEQ ID NO: 3185090 - DNA, 12 bp, Homo sapiens
aagaaaaagatt

SEQ ID NO: 3185091 - DNA, 16 bp, Homo sapiens
aataaatcataaaact

SEQ ID NO: 3185092 - DNA, 17 bp, Homo sapiens
aataaatgctctatttt

SEQ ID NO: 3185093 - DNA, 14 bp, Homo sapiens
aataaatgtacctg

SEQ ID NO: 3185094 - DNA, 21 bp, Homo sapiens
aataaatgtatcttattcaca

SEQ ID NO: 3185095 - DNA, 14 bp, Homo sapiens
aataaatgtcttgc

SEQ ID NO: 3185096 - DNA, 12 bp, Homo sapiens
aataaattattt

SEQ ID NO: 3185097 - DNA, 23 bp, Homo sapiens
aataaattcaaaacctgcagtta

SEQ ID NO: 3185098 - DNA, 18 bp, Homo sapiens
aataaattggtgataagt

SEQ ID NO: 3185099 - DNA, 19 bp, Homo sapiens
aataaattggtgataagtg

SEQ ID NO: 3185100 - DNA, 13 bp, Homo sapiens
aataaatttctaa

SEQ ID NO: 3185101 - DNA, 13 bp, Homo sapiens
aataacaatatat

SEQ ID NO: 3185102 - DNA, 19 bp, Homo sapiens
aataacaatgtgctctcgg

SEQ ID NO: 3185103 - DNA, 20 bp, Homo sapiens
aataacaatgttaaggaaac

SEQ ID NO: 3185104 - DNA, 23 bp, Homo sapiens
aataacacagagagacagacttg

SEQ ID NO: 3185105 - DNA, 19 bp, Homo sapiens
aataacactaaaattttag

SEQ ID NO: 3185106 - DNA, 14 bp, Homo sapiens
aataacattacctt

SEQ ID NO: 3185107 - DNA, 21 bp, Homo sapiens
aataaccacaaggtccactcc

SEQ ID NO: 3185108 - DNA, 15 bp, Homo sapiens
aataacccagttact

SEQ ID NO: 3185109 - DNA, 17 bp, Homo sapiens
aataacccagttacttt

SEQ ID NO: 3185110 - DNA, 12 bp, Homo sapiens
aataacctctgg

SEQ ID NO: 3185111 - DNA, 19 bp, Homo sapiens
aataactactgtgttcctg

SEQ ID NO: 3185112 - DNA, 14 bp, Homo sapiens
aataactatgccag

SEQ ID NO: 3185113 - DNA, 18 bp, Homo sapiens
aataactcagaatattgt

SEQ ID NO: 3185114 - DNA, 21 bp, Homo sapiens
aataactgaaccaaattgcac

SEQ ID NO: 3185115 - DNA, 15 bp, Homo sapiens
aataactgaatttgg

SEQ ID NO: 3185116 - DNA, 20 bp, Homo sapiens
aataactggaacaaattatt

SEQ ID NO: 3185117 - DNA, 23 bp, Homo sapiens
aataacttagactctagtattta

SEQ ID NO: 3185118 - DNA, 13 bp, Homo sapiens
aataacttcagtc

SEQ ID NO: 3185119 - DNA, 15 bp, Homo sapiens
aataacttctgacct

SEQ ID NO: 3185120 - DNA, 15 bp, Homo sapiens
aataagaaagtttca

SEQ ID NO: 3185121 - DNA, 16 bp, Homo sapiens
aataagaattgaatgt

SEQ ID NO: 3185122 - DNA, 14 bp, Homo sapiens
aataagagaaagaa

SEQ ID NO: 3185123 - DNA, 15 bp, Homo sapiens
aataagagaaagaaa

SEQ ID NO: 3185124 - DNA, 14 bp, Homo sapiens
aataagattctaac

SEQ ID NO: 3185125 - DNA, 15 bp, Homo sapiens
aataagcaaataaac

SEQ ID NO: 3185126 - DNA, 18 bp, Homo sapiens
aataagcaggtggatcta

SEQ ID NO: 3185127 - DNA, 21 bp, Homo sapiens
aataagcccagtgctgctgta

SEQ ID NO: 3185128 - DNA, 13 bp, Homo sapiens
aataagctaaaga

SEQ ID NO: 3185129 - DNA, 14 bp, Homo sapiens
aataagctaaagag

SEQ ID NO: 3185130 - DNA, 19 bp, Homo sapiens
aataaggaggaggagggag

SEQ ID NO: 3185131 - DNA, 17 bp, Homo sapiens
aataagtggttatttct

SEQ ID NO: 3185132 - DNA, 22 bp, Homo sapiens
aataagttcaaattcttctgaa

SEQ ID NO: 3185133 - DNA, 21 bp, Homo sapiens
aataataaaagattcacctga

SEQ ID NO: 3185134 - DNA, 20 bp, Homo sapiens
aataataatttttatattta

SEQ ID NO: 3185135 - DNA, 13 bp, Homo sapiens
aataatacctcaa

SEQ ID NO: 3185136 - DNA, 14 bp, Homo sapiens
aataatagggaaaa

SEQ ID NO: 3185137 - DNA, 22 bp, Homo sapiens
aataataggtagggggctttca

SEQ ID NO: 3185138 - DNA, 11 bp, Homo sapiens
aataatatgca

SEQ ID NO: 3185139 - DNA, 17 bp, Homo sapiens
aataatattaatttatt

SEQ ID NO: 3185140 - DNA, 20 bp, Homo sapiens
aataatattgttgtataatt

SEQ ID NO: 3185141 - DNA, 22 bp, Homo sapiens
aataatattgtttttctttcta

SEQ ID NO: 3185142 - DNA, 14 bp, Homo sapiens
aataatcaagattt

SEQ ID NO: 3185143 - DNA, 15 bp, Homo sapiens
aataatcacattgac

SEQ ID NO: 3185144 - DNA, 17 bp, Homo sapiens
aataatcacattgactt

SEQ ID NO: 3185145 - DNA, 13 bp, Homo sapiens
aataatcttggct

SEQ ID NO: 3185146 - DNA, 20 bp, Homo sapiens
aataatgacagatggtgaag

SEQ ID NO: 3185147 - DNA, 21 bp, Homo sapiens
aataatggtcccatccaggca

SEQ ID NO: 3185148 - DNA, 19 bp, Homo sapiens
aataatgtacatctggcct

SEQ ID NO: 3185149 - DNA, 14 bp, Homo sapiens
aataatgtatgtac

SEQ ID NO: 3185150 - DNA, 19 bp, Homo sapiens
aataatgtatgtacagctg

SEQ ID NO: 3185151 - DNA, 19 bp, Homo sapiens
aataatgttaacatggaca

SEQ ID NO: 3185152 - DNA, 15 bp, Homo sapiens
aataattaaataaat

SEQ ID NO: 3185153 - DNA, 16 bp, Homo sapiens
aataattaaataaatg

SEQ ID NO: 3185154 - DNA, 22 bp, Homo sapiens
aataattaggttaacattgttg

SEQ ID NO: 3185155 - DNA, 18 bp, Homo sapiens
aataattatccagagttt

SEQ ID NO: 3185156 - DNA, 20 bp, Homo sapiens
aataattgatttcaagacct

SEQ ID NO: 3185157 - DNA, 23 bp, Homo sapiens
aataatttcatactgaaattatt

SEQ ID NO: 3185158 - DNA, 12 bp, Homo sapiens
aataatttctac

SEQ ID NO: 3185159 - DNA, 21 bp, Homo sapiens
aataattttaagaaatcaaag

SEQ ID NO: 3185160 - DNA, 21 bp, Homo sapiens
aataattttattagaataatt

SEQ ID NO: 3185161 - DNA, 20 bp, Homo sapiens
aatacaaaaattagccgggc

SEQ ID NO: 3185162 - DNA, 11 bp, Homo sapiens
aatacaaagta

SEQ ID NO: 3185163 - DNA, 14 bp, Homo sapiens
aatacaaagtaaat

SEQ ID NO: 3185164 - DNA, 19 bp, Homo sapiens
aatacaaagtaaatacaag

SEQ ID NO: 3185165 - DNA, 13 bp, Homo sapiens
aatacaaatggat

SEQ ID NO: 3185166 - DNA, 18 bp, Homo sapiens
aatacaaatggattttgg

SEQ ID NO: 3185167 - DNA, 18 bp, Homo sapiens
aatacaacttaaataata

SEQ ID NO: 3185168 - DNA, 13 bp, Homo sapiens
aatacaataaact

SEQ ID NO: 3185169 - DNA, 22 bp, Homo sapiens
aatacaattaaaggtcctgccc

SEQ ID NO: 3185170 - DNA, 18 bp, Homo sapiens
aatacaatttttatttct

SEQ ID NO: 3185171 - DNA, 22 bp, Homo sapiens
aatacaatttttatttctttta

SEQ ID NO: 3185172 - DNA, 15 bp, Homo sapiens
aatacacaacacaaa

SEQ ID NO: 3185173 - DNA, 15 bp, Homo sapiens
aatacacaagtaaac

SEQ ID NO: 3185174 - DNA, 21 bp, Homo sapiens
aatacacagtactttattgta

SEQ ID NO: 3185175 - DNA, 23 bp, Homo sapiens
aatacacatagcatgtaatggta

SEQ ID NO: 3185176 - DNA, 15 bp, Homo sapiens
aatacacatttgcta

SEQ ID NO: 3185177 - DNA, 21 bp, Homo sapiens
aatacaccacctcactcctgt

SEQ ID NO: 3185178 - DNA, 20 bp, Homo sapiens
aatacactaattcctttcta

SEQ ID NO: 3185179 - DNA, 17 bp, Homo sapiens
aatacactagttgtttc

SEQ ID NO: 3185180 - DNA, 14 bp, Homo sapiens
aatacacttctttt

SEQ ID NO: 3185181 - DNA, 20 bp, Homo sapiens
aatacagacactaagttata

SEQ ID NO: 3185182 - DNA, 18 bp, Homo sapiens
aatacagataattcattt

SEQ ID NO: 3185183 - DNA, 19 bp, Homo sapiens
aatacagataattcatttg

SEQ ID NO: 3185184 - DNA, 20 bp, Homo sapiens
aatacagataattcatttgt

SEQ ID NO: 3185185 - DNA, 22 bp, Homo sapiens
aatacagcttcattatctgagt

SEQ ID NO: 3185186 - DNA, 23 bp, Homo sapiens
aatacagggcatgcattttgcag

SEQ ID NO: 3185187 - DNA, 17 bp, Homo sapiens
aatacagtaagcatagt

SEQ ID NO: 3185188 - DNA, 19 bp, Homo sapiens
aatacagtaagctgctcta

SEQ ID NO: 3185189 - DNA, 15 bp, Homo sapiens
aatacagtattctgt

SEQ ID NO: 3185190 - DNA, 18 bp, Homo sapiens
aatacagtctagtttcct

SEQ ID NO: 3185191 - DNA, 15 bp, Homo sapiens
aatacagtgagctct

SEQ ID NO: 3185192 - DNA, 14 bp, Homo sapiens
aatacatacggtca

SEQ ID NO: 3185193 - DNA, 15 bp, Homo sapiens
aatacatacggtcag

SEQ ID NO: 3185194 - DNA, 21 bp, Homo sapiens
aatacatacggtcaggtttaa

SEQ ID NO: 3185195 - DNA, 22 bp, Homo sapiens
aataccagagccttcaagtgcc

SEQ ID NO: 3185196 - DNA, 21 bp, Homo sapiens
aataccattaaaactgctttt

SEQ ID NO: 3185197 - DNA, 16 bp, Homo sapiens
aataccattgacacat

SEQ ID NO: 3185198 - DNA, 18 bp, Homo sapiens
aataccatttagtaagaa

SEQ ID NO: 3185199 - DNA, 21 bp, Homo sapiens
aatacccttgtgagagcccat

SEQ ID NO: 3185200 - DNA, 15 bp, Homo sapiens
aatacctcatgcttc

SEQ ID NO: 3185201 - DNA, 14 bp, Homo sapiens
aatacctcatgttt

SEQ ID NO: 3185202 - DNA, 21 bp, Homo sapiens
aatacctcatgtttatgaaaa

SEQ ID NO: 3185203 - DNA, 23 bp, Homo sapiens
aatacctcatgtttatgaaaata

SEQ ID NO: 3185204 - DNA, 16 bp, Homo sapiens
aatacctctgtgtgct

SEQ ID NO: 3185205 - DNA, 14 bp, Homo sapiens
aatacgtattacaa

SEQ ID NO: 3185206 - DNA, 11 bp, Homo sapiens
aatactaaaag

SEQ ID NO: 3185207 - DNA, 13 bp, Homo sapiens
aatactaaaagca

SEQ ID NO: 3185208 - DNA, 18 bp, Homo sapiens
aatactaaaagcaaatct

SEQ ID NO: 3185209 - DNA, 21 bp, Homo sapiens
aatactaaaagcaaatctaca

SEQ ID NO: 3185210 - DNA, 23 bp, Homo sapiens
aatactaaaagcaaatctacaga

SEQ ID NO: 3185211 - DNA, 14 bp, Homo sapiens
aatactaaaatatg

SEQ ID NO: 3185212 - DNA, 21 bp, Homo sapiens
aatactaagaccctaattctt

SEQ ID NO: 3185213 - DNA, 12 bp, Homo sapiens
aatactacctct

SEQ ID NO: 3185214 - DNA, 20 bp, Homo sapiens
aatactcaaatgagtaacat

SEQ ID NO: 3185215 - DNA, 17 bp, Homo sapiens
aatactctatttttaca

SEQ ID NO: 3185216 - DNA, 17 bp, Homo sapiens
aatactgtgcagaataa

SEQ ID NO: 3185217 - DNA, 16 bp, Homo sapiens
aatatctatattctat

SEQ ID NO: 3185218 - DNA, 14 bp, Homo sapiens
aatatctattaata

SEQ ID NO: 3185219 - DNA, 15 bp, Homo sapiens
aatatctattaatat

SEQ ID NO: 3185220 - DNA, 20 bp, Homo sapiens
aatatctgaaaatgtatgtg

SEQ ID NO: 3185221 - DNA, 15 bp, Homo sapiens
aatatctggcactgt

SEQ ID NO: 3185222 - DNA, 22 bp, Homo sapiens
aatatctggcactgttaataca

SEQ ID NO: 3185223 - DNA, 17 bp, Homo sapiens
aatatctgtaatggtac

SEQ ID NO: 3185224 - DNA, 14 bp, Homo sapiens
aatatcttgtgttg

SEQ ID NO: 3185225 - DNA, 18 bp, Homo sapiens
aatatgaaccctttgttt

SEQ ID NO: 3185226 - DNA, 15 bp, Homo sapiens
aatatgaacctattt

SEQ ID NO: 3185227 - DNA, 18 bp, Homo sapiens
aatatgaacctattttca

SEQ ID NO: 3185228 - DNA, 22 bp, Homo sapiens
aatatgaattcaagaaaggaaa

SEQ ID NO: 3185229 - DNA, 11 bp, Homo sapiens
aatatgatgac

SEQ ID NO: 3185230 - DNA, 11 bp, Homo sapiens
aatatgattat

SEQ ID NO: 3185231 - DNA, 21 bp, Homo sapiens
aatatgattattaatcagaat

SEQ ID NO: 3185232 - DNA, 21 bp, Homo sapiens
aatatgattttttaaaagaaa

SEQ ID NO: 3185233 - DNA, 17 bp, Homo sapiens
aatatgcaagcagcttt

SEQ ID NO: 3185234 - DNA, 20 bp, Homo sapiens
aatatgcctagtaacacata

SEQ ID NO: 3185235 - DNA, 13 bp, Homo sapiens
aatatgctaattt

SEQ ID NO: 3185236 - DNA, 15 bp, Homo sapiens
aatatgctaatttgg

SEQ ID NO: 3185237 - DNA, 22 bp, Homo sapiens
aatatgcttaaaataagcaggt

SEQ ID NO: 3185238 - DNA, 20 bp, Homo sapiens
aatatggaacttctaatata

SEQ ID NO: 3185239 - DNA, 21 bp, Homo sapiens
aatatggacacttaatactac

SEQ ID NO: 3185240 - DNA, 16 bp, Homo sapiens
aatatggttgatagtt

SEQ ID NO: 3185241 - DNA, 22 bp, Homo sapiens
aatatgtacatttgtcttttta

SEQ ID NO: 3185242 - DNA, 13 bp, Homo sapiens
aatatgtcagatg

SEQ ID NO: 3185243 - DNA, 23 bp, Homo sapiens
aatatgttggggtttttttaaga

SEQ ID NO: 3185244 - DNA, 20 bp, Homo sapiens
aatatgtttaaaataaaatg

SEQ ID NO: 3185245 - DNA, 18 bp, Homo sapiens
aatatgtttccttgttta

SEQ ID NO: 3185246 - DNA, 13 bp, Homo sapiens
aatattaaaaaac

SEQ ID NO: 3185247 - DNA, 21 bp, Homo sapiens
aatattaaaaaacttcatgta

SEQ ID NO: 3185248 - DNA, 17 bp, Homo sapiens
aatattaaatacagaca

SEQ ID NO: 3185249 - DNA, 20 bp, Homo sapiens
aatattaaatacagacacta

SEQ ID NO: 3185250 - DNA, 21 bp, Homo sapiens
aatattaaatctgctggagtt

SEQ ID NO: 3185251 - DNA, 13 bp, Homo sapiens
aatattaccaaaa

SEQ ID NO: 3185252 - DNA, 21 bp, Homo sapiens
aatattactctcaaaatcttt

SEQ ID NO: 3185253 - DNA, 21 bp, Homo sapiens
aatattactgtctttattctt

SEQ ID NO: 3185254 - DNA, 20 bp, Homo sapiens
aatattactgtttatttctg

SEQ ID NO: 3185255 - DNA, 22 bp, Homo sapiens
aatattagtgattctgatttca

SEQ ID NO: 3185256 - DNA, 11 bp, Homo sapiens
aatattattat

SEQ ID NO: 3185257 - DNA, 14 bp, Homo sapiens
aatattcacatgtt

SEQ ID NO: 3185258 - DNA, 23 bp, Homo sapiens
aatattcctacttgcagtacatc

SEQ ID NO: 3185259 - DNA, 15 bp, Homo sapiens
aatattcctgaatga

SEQ ID NO: 3185260 - DNA, 15 bp, Homo sapiens
aatattcctgcattt

SEQ ID NO: 3185261 - DNA, 18 bp, Homo sapiens
aatattctctatttgaat

SEQ ID NO: 3185262 - DNA, 16 bp, Homo sapiens
aatattctctccgcca

SEQ ID NO: 3185263 - DNA, 14 bp, Homo sapiens
aatattgaaaattg

SEQ ID NO: 3185264 - DNA, 21 bp, Homo sapiens
aatattgaaaattgaaaagta

SEQ ID NO: 3185265 - DNA, 17 bp, Homo sapiens
aatattgacttgtatat

SEQ ID NO: 3185266 - DNA, 19 bp, Homo sapiens
aatattgagaaagaaacta

SEQ ID NO: 3185267 - DNA, 18 bp, Homo sapiens
aatattgatatgcttata

SEQ ID NO: 3185268 - DNA, 19 bp, Homo sapiens
aatattgatgtcagtattt

SEQ ID NO: 3185269 - DNA, 16 bp, Homo sapiens
aatattgattgggaaa

SEQ ID NO: 3185270 - DNA, 20 bp, Homo sapiens
aatattgattgggaaaacat

SEQ ID NO: 3185271 - DNA, 20 bp, Homo sapiens
aatattgctttggtcatatg

SEQ ID NO: 3185272 - DNA, 20 bp, Homo sapiens
aatattgtatatttttatct

SEQ ID NO: 3185273 - DNA, 16 bp, Homo sapiens
aatattgtcatgttta

SEQ ID NO: 3185274 - DNA, 22 bp, Homo sapiens
aatattgttgacaactgtgact

SEQ ID NO: 3185275 - DNA, 23 bp, Homo sapiens
aatattgtttctgcattcatttt

SEQ ID NO: 3185276 - DNA, 16 bp, Homo sapiens
aatattgtttggtaaa

SEQ ID NO: 3185277 - DNA, 14 bp, Homo sapiens
aatatttaaacagc

SEQ ID NO: 3185278 - DNA, 20 bp, Homo sapiens
aatatttaaacctttttctt

SEQ ID NO: 3185279 - DNA, 16 bp, Homo sapiens
aatatttaagaaaagc

SEQ ID NO: 3185280 - DNA, 19 bp, Homo sapiens
aatatttaagaaaagcact

SEQ ID NO: 3185281 - DNA, 20 bp, Homo sapiens
aatatttaagaaaagcactt

SEQ ID NO: 3185282 - DNA, 12 bp, Homo sapiens
aatatttaagac

SEQ ID NO: 3185283 - DNA, 11 bp, Homo sapiens
aatatttataa

SEQ ID NO: 3185284 - DNA, 19 bp, Homo sapiens
aatatttataaaacttctc

SEQ ID NO: 3185285 - DNA, 12 bp, Homo sapiens
aatatttataac

SEQ ID NO: 3185286 - DNA, 15 bp, Homo sapiens
aatatttatactata

SEQ ID NO: 3185287 - DNA, 14 bp, Homo sapiens
aatatttatatttc

SEQ ID NO: 3185288 - DNA, 23 bp, Homo sapiens
aatatttatgtctatttaagcct

SEQ ID NO: 3185289 - DNA, 12 bp, Homo sapiens
aatatttattac

SEQ ID NO: 3185290 - DNA, 14 bp, Homo sapiens
aatatttattacct

SEQ ID NO: 3185291 - DNA, 17 bp, Homo sapiens
aatatttattacctctg

SEQ ID NO: 3185292 - DNA, 14 bp, Homo sapiens
aatatttcaagtgc

SEQ ID NO: 3185293 - DNA, 23 bp, Homo sapiens
aatatttcaagtgcctagactgt

SEQ ID NO: 3185294 - DNA, 23 bp, Homo sapiens
aatatttccatatggattttcta

SEQ ID NO: 3185295 - DNA, 12 bp, Homo sapiens
aatatttctcta

SEQ ID NO: 3185296 - DNA, 17 bp, Homo sapiens
aatatttctgctttctt

SEQ ID NO: 3185297 - DNA, 11 bp, Homo sapiens
aatatttgaat

SEQ ID NO: 3185298 - DNA, 14 bp, Homo sapiens
aatatttgaataat

SEQ ID NO: 3185299 - DNA, 21 bp, Homo sapiens
aatatttgacttgcatgaaga

SEQ ID NO: 3185300 - DNA, 21 bp, Homo sapiens
aatatttggtctctatttcat

SEQ ID NO: 3185301 - DNA, 14 bp, Homo sapiens
aatatttgtacata

SEQ ID NO: 3185302 - DNA, 16 bp, Homo sapiens
aatattttctatttta

SEQ ID NO: 3185303 - DNA, 19 bp, Homo sapiens
aatattttctctgtacttt

SEQ ID NO: 3185304 - DNA, 22 bp, Homo sapiens
aatattttctctgtacttttca

SEQ ID NO: 3185305 - DNA, 18 bp, Homo sapiens
aatattttctttaatgct

SEQ ID NO: 3185306 - DNA, 19 bp, Homo sapiens
aatattttctttaatgctt

SEQ ID NO: 3185307 - DNA, 18 bp, Homo sapiens
aatattttgataataata

SEQ ID NO: 3185308 - DNA, 16 bp, Homo sapiens
aatattttggaaactg

SEQ ID NO: 3185309 - DNA, 21 bp, Homo sapiens
aatattttggaaactgctaaa

SEQ ID NO: 3185310 - DNA, 14 bp, Homo sapiens
aatatttttagata

SEQ ID NO: 3185311 - DNA, 22 bp, Homo sapiens
aatatttttagctctgttcttt

SEQ ID NO: 3185312 - DNA, 17 bp, Homo sapiens
aatattttttatatata

SEQ ID NO: 3185313 - DNA, 20 bp, Homo sapiens
aatattttttatttctaagt

SEQ ID NO: 3185314 - DNA, 21 bp, Homo sapiens
aatattttttatttctaagta

SEQ ID NO: 3185315 - DNA, 10 bp, Homo sapiens
aatcaaaact

SEQ ID NO: 3185316 - DNA, 20 bp, Homo sapiens
aatcaaaataacgccccaga

SEQ ID NO: 3185317 - DNA, 15 bp, Homo sapiens
aatcaaataagtatt

SEQ ID NO: 3185318 - DNA, 16 bp, Homo sapiens
aatcaaataagtattt

SEQ ID NO: 3185319 - DNA, 19 bp, Homo sapiens
aatcaaataagtatttata

SEQ ID NO: 3185320 - DNA, 15 bp, Homo sapiens
aatcaaatgatttca

SEQ ID NO: 3185321 - DNA, 21 bp, Homo sapiens
aatcaaatgatttcatattga

SEQ ID NO: 3185322 - DNA, 14 bp, Homo sapiens
aatcaaattgctta

SEQ ID NO: 3185323 - DNA, 18 bp, Homo sapiens
aatcaaattgcttaaaaa

SEQ ID NO: 3185324 - DNA, 13 bp, Homo sapiens
aatcaaccctctc

SEQ ID NO: 3185325 - DNA, 14 bp, Homo sapiens
aatcaactctaata

SEQ ID NO: 3185326 - DNA, 16 bp, Homo sapiens
aatcaacttgtgtact

SEQ ID NO: 3185327 - DNA, 13 bp, Homo sapiens
aatcaactttact

SEQ ID NO: 3185328 - DNA, 13 bp, Homo sapiens
aatcaagatttta

SEQ ID NO: 3185329 - DNA, 15 bp, Homo sapiens
aatcaagtaatgaat

SEQ ID NO: 3185330 - DNA, 14 bp, Homo sapiens
aatcaatacactag

SEQ ID NO: 3185331 - DNA, 12 bp, Homo sapiens
aatcaatagttg

SEQ ID NO: 3185332 - DNA, 13 bp, Homo sapiens
aatcaatgaaaaa

SEQ ID NO: 3185333 - DNA, 14 bp, Homo sapiens
aatcaatgaatatt

SEQ ID NO: 3185334 - DNA, 12 bp, Homo sapiens
aatcaatttaag

SEQ ID NO: 3185335 - DNA, 15 bp, Homo sapiens
aatcaccaaaggctc

SEQ ID NO: 3185336 - DNA, 16 bp, Homo sapiens
aatcacgctttcctga

SEQ ID NO: 3185337 - DNA, 17 bp, Homo sapiens
aatcactaaactttatt

SEQ ID NO: 3185338 - DNA, 18 bp, Homo sapiens
aatcactaaactttattt

SEQ ID NO: 3185339 - DNA, 15 bp, Homo sapiens
aatcactaacattat

SEQ ID NO: 3185340 - DNA, 16 bp, Homo sapiens
aatcactaggtaactt

SEQ ID NO: 3185341 - DNA, 21 bp, Homo sapiens
aatcactcccatttttactta

SEQ ID NO: 3185342 - DNA, 20 bp, Homo sapiens
aatcactctaattaattgta

SEQ ID NO: 3185343 - DNA, 23 bp, Homo sapiens
aatctagttttttttgtaaactg

SEQ ID NO: 3185344 - DNA, 13 bp, Homo sapiens
aatctattcagac

SEQ ID NO: 3185345 - DNA, 18 bp, Homo sapiens
aatctattcagacaagca

SEQ ID NO: 3185346 - DNA, 18 bp, Homo sapiens
aatctattctcaaagtta

SEQ ID NO: 3185347 - DNA, 16 bp, Homo sapiens
aatctattgggttcat

SEQ ID NO: 3185348 - DNA, 17 bp, Homo sapiens
aatctattgggttcatt

SEQ ID NO: 3185349 - DNA, 15 bp, Homo sapiens
aatctcaaataacta

SEQ ID NO: 3185350 - DNA, 16 bp, Homo sapiens
aatctcaaggaatctt

SEQ ID NO: 3185351 - DNA, 21 bp, Homo sapiens
aatctcaaggaatctttaagc

SEQ ID NO: 3185352 - DNA, 22 bp, Homo sapiens
aatctcaccccatcccacaccc

SEQ ID NO: 3185353 - DNA, 23 bp, Homo sapiens
aatctcagaggtagggctgccac

SEQ ID NO: 3185354 - DNA, 16 bp, Homo sapiens
aatctcagtgctttcc

SEQ ID NO: 3185355 - DNA, 19 bp, Homo sapiens
aatctcatacctctgacca

SEQ ID NO: 3185356 - DNA, 22 bp, Homo sapiens
aatctcatacctctgaccaaca

SEQ ID NO: 3185357 - DNA, 15 bp, Homo sapiens
aatctcatgctgtgt

SEQ ID NO: 3185358 - DNA, 15 bp, Homo sapiens
aatctccagtattct

SEQ ID NO: 3185359 - DNA, 16 bp, Homo sapiens
aatctcccattttgga

SEQ ID NO: 3185360 - DNA, 22 bp, Homo sapiens
aatctcccattttggaatttgc

SEQ ID NO: 3185361 - DNA, 18 bp, Homo sapiens
aatctcctcttttatctt

SEQ ID NO: 3185362 - DNA, 15 bp, Homo sapiens
aatctccttactgtg

SEQ ID NO: 3185363 - DNA, 19 bp, Homo sapiens
aatctctacccctttcttc

SEQ ID NO: 3185364 - DNA, 11 bp, Homo sapiens
aatctctctct

SEQ ID NO: 3185365 - DNA, 23 bp, Homo sapiens
aatctctctctgtgtctttctct

SEQ ID NO: 3185366 - DNA, 13 bp, Homo sapiens
aatctctgttatg

SEQ ID NO: 3185367 - DNA, 19 bp, Homo sapiens
aatctctgttatgtactgt

SEQ ID NO: 3185368 - DNA, 20 bp, Homo sapiens
aatctctgttatgtactgta

SEQ ID NO: 3185369 - DNA, 21 bp, Homo sapiens
aatctctgttatgtactgtac

SEQ ID NO: 3185370 - DNA, 15 bp, Homo sapiens
aatctcttgcttgtc

SEQ ID NO: 3185371 - DNA, 22 bp, Homo sapiens
aatctgaactctcaaaagtcta

SEQ ID NO: 3185372 - DNA, 13 bp, Homo sapiens
aatctgaatgtaa

SEQ ID NO: 3185373 - DNA, 14 bp, Homo sapiens
aatctgaatgtaat

SEQ ID NO: 3185374 - DNA, 19 bp, Homo sapiens
aatctgattggacattttc

SEQ ID NO: 3185375 - DNA, 13 bp, Homo sapiens
aatctgattttta

SEQ ID NO: 3185376 - DNA, 17 bp, Homo sapiens
aatctgcatttagcaca

SEQ ID NO: 3185377 - DNA, 20 bp, Homo sapiens
aatctgcatttagcacaaaa

SEQ ID NO: 3185378 - DNA, 18 bp, Homo sapiens
aatctgcattttaacaag

SEQ ID NO: 3185379 - DNA, 21 bp, Homo sapiens
aatctgctgttgccatagccc

SEQ ID NO: 3185380 - DNA, 22 bp, Homo sapiens
aatctgctttttaaagaatgct

SEQ ID NO: 3185381 - DNA, 16 bp, Homo sapiens
aatctggactcctctg

SEQ ID NO: 3185382 - DNA, 17 bp, Homo sapiens
aatctggactcctctgt

SEQ ID NO: 3185383 - DNA, 18 bp, Homo sapiens
aatctggactcctctgtc

SEQ ID NO: 3185384 - DNA, 14 bp, Homo sapiens
aatctggagaccag

SEQ ID NO: 3185385 - DNA, 14 bp, Homo sapiens
aatctggtcttgtt

SEQ ID NO: 3185386 - DNA, 19 bp, Homo sapiens
aatctggtcttgttagaaa

SEQ ID NO: 3185387 - DNA, 11 bp, Homo sapiens
aatctgtaatt

SEQ ID NO: 3185388 - DNA, 19 bp, Homo sapiens
aatctgtacattttgttgt

SEQ ID NO: 3185389 - DNA, 15 bp, Homo sapiens
aatctgtagggctgg

SEQ ID NO: 3185390 - DNA, 19 bp, Homo sapiens
aatctgtagggctggacct

SEQ ID NO: 3185391 - DNA, 18 bp, Homo sapiens
aatctgtatatgttgtaa

SEQ ID NO: 3185392 - DNA, 19 bp, Homo sapiens
aatctgtcaaaacactgtg

SEQ ID NO: 3185393 - DNA, 20 bp, Homo sapiens
aatctgtcaaaacactgtgg

SEQ ID NO: 3185394 - DNA, 23 bp, Homo sapiens
aatctgtcaaaacactgtggaac

SEQ ID NO: 3185395 - DNA, 23 bp, Homo sapiens
aatctgtgaattaaaaaagctca

SEQ ID NO: 3185396 - DNA, 17 bp, Homo sapiens
aatctgtgggtctggga

SEQ ID NO: 3185397 - DNA, 20 bp, Homo sapiens
aatctgtgtaagaaaacaaa

SEQ ID NO: 3185398 - DNA, 17 bp, Homo sapiens
aatctgtgtatattatt

SEQ ID NO: 3185399 - DNA, 18 bp, Homo sapiens
aatctgtgtatattattt

SEQ ID NO: 3185400 - DNA, 17 bp, Homo sapiens
aatctgtgtgtgccctg

SEQ ID NO: 3185401 - DNA, 23 bp, Homo sapiens
aatctgttatgtactagtgttct

SEQ ID NO: 3185402 - DNA, 19 bp, Homo sapiens
aatctgttctgggctcttt

SEQ ID NO: 3185403 - DNA, 17 bp, Homo sapiens
aatctgttgttccaaat

SEQ ID NO: 3185404 - DNA, 20 bp, Homo sapiens
aatctgtttcaggtttccat

SEQ ID NO: 3185405 - DNA, 21 bp, Homo sapiens
aatcttaaaaagttgttcaac

SEQ ID NO: 3185406 - DNA, 15 bp, Homo sapiens
aatcttaaacataat

SEQ ID NO: 3185407 - DNA, 17 bp, Homo sapiens
aatcttaccagatgcta

SEQ ID NO: 3185408 - DNA, 19 bp, Homo sapiens
aatcttaggggagagcttt

SEQ ID NO: 3185409 - DNA, 18 bp, Homo sapiens
aatcttagtgtatgatta

SEQ ID NO: 3185410 - DNA, 12 bp, Homo sapiens
aatcttatacaa

SEQ ID NO: 3185411 - DNA, 14 bp, Homo sapiens
aatcttatacaaca

SEQ ID NO: 3185412 - DNA, 19 bp, Homo sapiens
aatcttatagttctaggca

SEQ ID NO: 3185413 - DNA, 20 bp, Homo sapiens
aatcttattagggagaaaat

SEQ ID NO: 3185414 - DNA, 21 bp, Homo sapiens
aatcttattccgagcattcca

SEQ ID NO: 3185415 - DNA, 16 bp, Homo sapiens
aatcttcaaagccttc

SEQ ID NO: 3185416 - DNA, 14 bp, Homo sapiens
aatcttcaggtgaa

SEQ ID NO: 3185417 - DNA, 17 bp, Homo sapiens
aatcttcccatgcattc

SEQ ID NO: 3185418 - DNA, 12 bp, Homo sapiens
aatcttctactt

SEQ ID NO: 3185419 - DNA, 23 bp, Homo sapiens
aatcttgaggaataaatgccttt

SEQ ID NO: 3185420 - DNA, 19 bp, Homo sapiens
aatcttgtagacacttact

SEQ ID NO: 3185421 - DNA, 18 bp, Homo sapiens
aatcttgtgctagaatac

SEQ ID NO: 3185422 - DNA, 20 bp, Homo sapiens
aatcttgtgctagaatactt

SEQ ID NO: 3185423 - DNA, 14 bp, Homo sapiens
aatcttgttttgaa

SEQ ID NO: 3185424 - DNA, 16 bp, Homo sapiens
aatctttaagaatagt

SEQ ID NO: 3185425 - DNA, 22 bp, Homo sapiens
aatctttagagaagtatacata

SEQ ID NO: 3185426 - DNA, 16 bp, Homo sapiens
aatctttataaatgta

SEQ ID NO: 3185427 - DNA, 20 bp, Homo sapiens
aatctttattatgcattctt

SEQ ID NO: 3185428 - DNA, 21 bp, Homo sapiens
aatctttattcaaacttttat

SEQ ID NO: 3185429 - DNA, 22 bp, Homo sapiens
aatctttattcaaacttttatt

SEQ ID NO: 3185430 - DNA, 16 bp, Homo sapiens
aatctttcacttgaaa

SEQ ID NO: 3185431 - DNA, 18 bp, Homo sapiens
aatctttcacttgaaaga

SEQ ID NO: 3185432 - DNA, 16 bp, Homo sapiens
aatctttctatataaa

SEQ ID NO: 3185433 - DNA, 20 bp, Homo sapiens
aatctttctatataaaatgt

SEQ ID NO: 3185434 - DNA, 22 bp, Homo sapiens
aatctttcttttgattcttcct

SEQ ID NO: 3185435 - DNA, 11 bp, Homo sapiens
aatctttgctg

SEQ ID NO: 3185436 - DNA, 18 bp, Homo sapiens
aatctttgtaccaaaatt

SEQ ID NO: 3185437 - DNA, 15 bp, Homo sapiens
aatctttgtataaat

SEQ ID NO: 3185438 - DNA, 16 bp, Homo sapiens
aatctttgtgacagga

SEQ ID NO: 3185439 - DNA, 23 bp, Homo sapiens
aatctttgttgaagtttgaacca

SEQ ID NO: 3185440 - DNA, 21 bp, Homo sapiens
aatcttttacaactgcctcga

SEQ ID NO: 3185441 - DNA, 13 bp, Homo sapiens
aatcttttgaagc

SEQ ID NO: 3185442 - DNA, 15 bp, Homo sapiens
aatgaaaaacaacca

SEQ ID NO: 3185443 - DNA, 23 bp, Homo sapiens
aatgaaaaatgtaatttagaaac

SEQ ID NO: 3185444 - DNA, 18 bp, Homo sapiens
aatgaaaacattttattt

SEQ ID NO: 3185445 - DNA, 21 bp, Homo sapiens
aatgaaaagtcgttttccaaa

SEQ ID NO: 3185446 - DNA, 16 bp, Homo sapiens
aatgaaaataactgaa

SEQ ID NO: 3185447 - DNA, 15 bp, Homo sapiens
aatgaaaataagtga

SEQ ID NO: 3185448 - DNA, 16 bp, Homo sapiens
aatgaaaatgcagtcc

SEQ ID NO: 3185449 - DNA, 17 bp, Homo sapiens
aatgaaaatgcagtcct

SEQ ID NO: 3185450 - DNA, 12 bp, Homo sapiens
aatgaaaatgtc

SEQ ID NO: 3185451 - DNA, 17 bp, Homo sapiens
aatgaaaattgtattat

SEQ ID NO: 3185452 - DNA, 20 bp, Homo sapiens
aatgaaacaaataatcacat

SEQ ID NO: 3185453 - DNA, 19 bp, Homo sapiens
aatgaaacactcagttgtt

SEQ ID NO: 3185454 - DNA, 17 bp, Homo sapiens
aatgaaaccctatggag

SEQ ID NO: 3185455 - DNA, 19 bp, Homo sapiens
aatgaaagaaaattgagtt

SEQ ID NO: 3185456 - DNA, 20 bp, Homo sapiens
aatgaaagactgtacaaagt

SEQ ID NO: 3185457 - DNA, 21 bp, Homo sapiens
aatgaaagactgtacaaagta

SEQ ID NO: 3185458 - DNA, 12 bp, Homo sapiens
aatgaaagatta

SEQ ID NO: 3185459 - DNA, 15 bp, Homo sapiens
aatgaaagcatgtgg

SEQ ID NO: 3185460 - DNA, 18 bp, Homo sapiens
aatgaaagtgactttaaa

SEQ ID NO: 3185461 - DNA, 15 bp, Homo sapiens
aatgaaagtttgcac

SEQ ID NO: 3185462 - DNA, 23 bp, Homo sapiens
aatgaaatatgttggggtttttt

SEQ ID NO: 3185463 - DNA, 15 bp, Homo sapiens
aatgaaatgtatgtg

SEQ ID NO: 3185464 - DNA, 16 bp, Homo sapiens
aatgaaatgtatgtgc

SEQ ID NO: 3185465 - DNA, 20 bp, Homo sapiens
aatgaaattaacacaaagga

SEQ ID NO: 3185466 - DNA, 14 bp, Homo sapiens
aatgaacaaaatta

SEQ ID NO: 3185467 - DNA, 18 bp, Homo sapiens
aatgaacactcttttgct

SEQ ID NO: 3185468 - DNA, 16 bp, Homo sapiens
aatgctatttgaacaa

SEQ ID NO: 3185469 - DNA, 14 bp, Homo sapiens
aatgctcccagctg

SEQ ID NO: 3185470 - DNA, 19 bp, Homo sapiens
aatgctcccagctgtgctg

SEQ ID NO: 3185471 - DNA, 20 bp, Homo sapiens
aatgctccccacagcgtccc

SEQ ID NO: 3185472 - DNA, 19 bp, Homo sapiens
aatgctctgtcttcaatga

SEQ ID NO: 3185473 - DNA, 23 bp, Homo sapiens
aatgctctttacttcatggactt

SEQ ID NO: 3185474 - DNA, 18 bp, Homo sapiens
aatgctgatgaatcactg

SEQ ID NO: 3185475 - DNA, 17 bp, Homo sapiens
aatgctgcgcttcgctt

SEQ ID NO: 3185476 - DNA, 22 bp, Homo sapiens
aatgctggactggaggcccctg

SEQ ID NO: 3185477 - DNA, 21 bp, Homo sapiens
aatgctggttttcctaaatgc

SEQ ID NO: 3185478 - DNA, 17 bp, Homo sapiens
aatgctgtacatctatt

SEQ ID NO: 3185479 - DNA, 12 bp, Homo sapiens
aatgctgtactt

SEQ ID NO: 3185480 - DNA, 13 bp, Homo sapiens
aatgctgtgttaa

SEQ ID NO: 3185481 - DNA, 20 bp, Homo sapiens
aatgcttaatttctaaagat

SEQ ID NO: 3185482 - DNA, 18 bp, Homo sapiens
aatgcttcagatattatt

SEQ ID NO: 3185483 - DNA, 18 bp, Homo sapiens
aatgctttggaaaaatgg

SEQ ID NO: 3185484 - DNA, 20 bp, Homo sapiens
aatgctttgggaggccaagg

SEQ ID NO: 3185485 - DNA, 19 bp, Homo sapiens
aatgctttgtgtgattgaa

SEQ ID NO: 3185486 - DNA, 14 bp, Homo sapiens
aatgcttttagtgt

SEQ ID NO: 3185487 - DNA, 19 bp, Homo sapiens
aatgctttttatttctgca

SEQ ID NO: 3185488 - DNA, 11 bp, Homo sapiens
aatgctttttg

SEQ ID NO: 3185489 - DNA, 18 bp, Homo sapiens
aatggaaacattacagtt

SEQ ID NO: 3185490 - DNA, 14 bp, Homo sapiens
aatggaaacctcac

SEQ ID NO: 3185491 - DNA, 15 bp, Homo sapiens
aatggaaattttgct

SEQ ID NO: 3185492 - DNA, 19 bp, Homo sapiens
aatggaactactgtacttt

SEQ ID NO: 3185493 - DNA, 18 bp, Homo sapiens
aatggaagagaaatctca

SEQ ID NO: 3185494 - DNA, 16 bp, Homo sapiens
aatggaagcaaagtgc

SEQ ID NO: 3185495 - DNA, 18 bp, Homo sapiens
aatggaagcaaagtgctg

SEQ ID NO: 3185496 - DNA, 16 bp, Homo sapiens
aatggaagcaattgct

SEQ ID NO: 3185497 - DNA, 21 bp, Homo sapiens
aatggacacaaattttcaagt

SEQ ID NO: 3185498 - DNA, 22 bp, Homo sapiens
aatggacatcctgtataagcac

SEQ ID NO: 3185499 - DNA, 19 bp, Homo sapiens
aatggactggtttgagatt

SEQ ID NO: 3185500 - DNA, 13 bp, Homo sapiens
aatggagaggaac

SEQ ID NO: 3185501 - DNA, 20 bp, Homo sapiens
aatggagattcagttttcat

SEQ ID NO: 3185502 - DNA, 15 bp, Homo sapiens
aatggaggaatatga

SEQ ID NO: 3185503 - DNA, 13 bp, Homo sapiens
aatggatcacaag

SEQ ID NO: 3185504 - DNA, 16 bp, Homo sapiens
aatggattggattatt

SEQ ID NO: 3185505 - DNA, 21 bp, Homo sapiens
aatggattggattatttaata

SEQ ID NO: 3185506 - DNA, 22 bp, Homo sapiens
aatggattggattatttaataa

SEQ ID NO: 3185507 - DNA, 21 bp, Homo sapiens
aatggatttgatgctgtttga

SEQ ID NO: 3185508 - DNA, 17 bp, Homo sapiens
aatggatttttctttaa

SEQ ID NO: 3185509 - DNA, 18 bp, Homo sapiens
aatggcagctagactgga

SEQ ID NO: 3185510 - DNA, 16 bp, Homo sapiens
aatggcagctagtgcc

SEQ ID NO: 3185511 - DNA, 20 bp, Homo sapiens
aatggcaggggaagccttgc

SEQ ID NO: 3185512 - DNA, 15 bp, Homo sapiens
aatggcctcatgtgg

SEQ ID NO: 3185513 - DNA, 20 bp, Homo sapiens
aatggcctgccttgaagcca

SEQ ID NO: 3185514 - DNA, 14 bp, Homo sapiens
aatggctaataaac

SEQ ID NO: 3185515 - DNA, 15 bp, Homo sapiens
aatggctaataaact

SEQ ID NO: 3185516 - DNA, 19 bp, Homo sapiens
aatggctaataaactgtat

SEQ ID NO: 3185517 - DNA, 15 bp, Homo sapiens
aatggctagtactgt

SEQ ID NO: 3185518 - DNA, 16 bp, Homo sapiens
aatggctagtactgta

SEQ ID NO: 3185519 - DNA, 18 bp, Homo sapiens
aatggctatcaaaagaaa

SEQ ID NO: 3185520 - DNA, 18 bp, Homo sapiens
aatggctcaagtagaaaa

SEQ ID NO: 3185521 - DNA, 20 bp, Homo sapiens
aatggctgcacctttttgca

SEQ ID NO: 3185522 - DNA, 21 bp, Homo sapiens
aatggctgcacctttttgcat

SEQ ID NO: 3185523 - DNA, 17 bp, Homo sapiens
aatggctgtaatcattt

SEQ ID NO: 3185524 - DNA, 22 bp, Homo sapiens
aatgggaactgcctctttcctg

SEQ ID NO: 3185525 - DNA, 16 bp, Homo sapiens
aatgggaatattttat

SEQ ID NO: 3185526 - DNA, 18 bp, Homo sapiens
aatgggactggagtccct

SEQ ID NO: 3185527 - DNA, 18 bp, Homo sapiens
aatgggagatggtcagtg

SEQ ID NO: 3185528 - DNA, 15 bp, Homo sapiens
aatgggctcttccaa

SEQ ID NO: 3185529 - DNA, 21 bp, Homo sapiens
aatggggtagaaacattgtaa

SEQ ID NO: 3185530 - DNA, 12 bp, Homo sapiens
aatgggtaatat

SEQ ID NO: 3185531 - DNA, 23 bp, Homo sapiens
aatgggtcttttataggaaaaaa

SEQ ID NO: 3185532 - DNA, 17 bp, Homo sapiens
aatggtaggcatttcct

SEQ ID NO: 3185533 - DNA, 23 bp, Homo sapiens
aatggtagtaatcacagttggcc

SEQ ID NO: 3185534 - DNA, 18 bp, Homo sapiens
aatggtcagcgttgcatg

SEQ ID NO: 3185535 - DNA, 17 bp, Homo sapiens
aatggtcccatccaggc

SEQ ID NO: 3185536 - DNA, 22 bp, Homo sapiens
aatggtctttctaatgtgtgaa

SEQ ID NO: 3185537 - DNA, 16 bp, Homo sapiens
aatggtgatcactcca

SEQ ID NO: 3185538 - DNA, 19 bp, Homo sapiens
aatggtgatcctctatttt

SEQ ID NO: 3185539 - DNA, 22 bp, Homo sapiens
aatggtggggaactataaagaa

SEQ ID NO: 3185540 - DNA, 17 bp, Homo sapiens
aatggtgtttttttaat

SEQ ID NO: 3185541 - DNA, 23 bp, Homo sapiens
aatggttaataaaactgcacagt

SEQ ID NO: 3185542 - DNA, 15 bp, Homo sapiens
aatggttcagaatta

SEQ ID NO: 3185543 - DNA, 21 bp, Homo sapiens
aatggttccatgcctgagggt

SEQ ID NO: 3185544 - DNA, 16 bp, Homo sapiens
aatggttgatggaaaa

SEQ ID NO: 3185545 - DNA, 12 bp, Homo sapiens
aatgtaaaaaag

SEQ ID NO: 3185546 - DNA, 19 bp, Homo sapiens
aatgtaaaaaagaaaaaca

SEQ ID NO: 3185547 - DNA, 18 bp, Homo sapiens
aatgtaaaagaaaatttt

SEQ ID NO: 3185548 - DNA, 15 bp, Homo sapiens
aatgtaaaattgaaa

SEQ ID NO: 3185549 - DNA, 14 bp, Homo sapiens
aatgtaaactgcca

SEQ ID NO: 3185550 - DNA, 20 bp, Homo sapiens
aatgtaaagaacttaaatta

SEQ ID NO: 3185551 - DNA, 17 bp, Homo sapiens
aatgtaaaggagggaga

SEQ ID NO: 3185552 - DNA, 16 bp, Homo sapiens
aatgtaacatcataat

SEQ ID NO: 3185553 - DNA, 20 bp, Homo sapiens
aatgtaacatcataattaca

SEQ ID NO: 3185554 - DNA, 21 bp, Homo sapiens
aatgtaacatcataattacat

SEQ ID NO: 3185555 - DNA, 16 bp, Homo sapiens
aatgtaacttttgtaa

SEQ ID NO: 3185556 - DNA, 21 bp, Homo sapiens
aatgtaagattatagattcta

SEQ ID NO: 3185557 - DNA, 13 bp, Homo sapiens
aatgtaagctcta

SEQ ID NO: 3185558 - DNA, 14 bp, Homo sapiens
aatgtaagctgttt

SEQ ID NO: 3185559 - DNA, 16 bp, Homo sapiens
aatgtaattgaataaa

SEQ ID NO: 3185560 - DNA, 22 bp, Homo sapiens
aatgtaatttagaaactgattt

SEQ ID NO: 3185561 - DNA, 17 bp, Homo sapiens
aatgtaatttgtgtaat

SEQ ID NO: 3185562 - DNA, 17 bp, Homo sapiens
aatgtacatctggcctt

SEQ ID NO: 3185563 - DNA, 15 bp, Homo sapiens
aatgtacattaatta

SEQ ID NO: 3185564 - DNA, 19 bp, Homo sapiens
aatgtactgatttcagtaa

SEQ ID NO: 3185565 - DNA, 12 bp, Homo sapiens
aatgtactgcat

SEQ ID NO: 3185566 - DNA, 18 bp, Homo sapiens
aatgtactgcatatgaaa

SEQ ID NO: 3185567 - DNA, 19 bp, Homo sapiens
aatgtacttgtttctctgt

SEQ ID NO: 3185568 - DNA, 15 bp, Homo sapiens
aatgtacttttggat

SEQ ID NO: 3185569 - DNA, 16 bp, Homo sapiens
aatgtagaaattcttc

SEQ ID NO: 3185570 - DNA, 23 bp, Homo sapiens
aatgtagttgtcacactaaaatt

SEQ ID NO: 3185571 - DNA, 20 bp, Homo sapiens
aatgtataaagattgtactt

SEQ ID NO: 3185572 - DNA, 14 bp, Homo sapiens
aatgtataaatata

SEQ ID NO: 3185573 - DNA, 13 bp, Homo sapiens
aatgtatataaaa

SEQ ID NO: 3185574 - DNA, 14 bp, Homo sapiens
aatgtatataaaaa

SEQ ID NO: 3185575 - DNA, 15 bp, Homo sapiens
aatgtatatacacat

SEQ ID NO: 3185576 - DNA, 17 bp, Homo sapiens
aatgtatatacacatat

SEQ ID NO: 3185577 - DNA, 12 bp, Homo sapiens
aatgtatatatt

SEQ ID NO: 3185578 - DNA, 13 bp, Homo sapiens
aatgtatatattt

SEQ ID NO: 3185579 - DNA, 14 bp, Homo sapiens
aatgtatcaggaaa

SEQ ID NO: 3185580 - DNA, 15 bp, Homo sapiens
aatgtatcaggaaat

SEQ ID NO: 3185581 - DNA, 18 bp, Homo sapiens
aatgtatcatagaaatgt

SEQ ID NO: 3185582 - DNA, 22 bp, Homo sapiens
aatgtatcatagaaatgtaact

SEQ ID NO: 3185583 - DNA, 21 bp, Homo sapiens
aatgtatcccttctcacagca

SEQ ID NO: 3185584 - DNA, 14 bp, Homo sapiens
aatgtatctaagaa

SEQ ID NO: 3185585 - DNA, 13 bp, Homo sapiens
aatgtatctgtga

SEQ ID NO: 3185586 - DNA, 18 bp, Homo sapiens
aatgtatcttattcacat

SEQ ID NO: 3185587 - DNA, 20 bp, Homo sapiens
aatgtatggctcatttgctt

SEQ ID NO: 3185588 - DNA, 19 bp, Homo sapiens
aatgtatgtaatgtgtggt

SEQ ID NO: 3185589 - DNA, 13 bp, Homo sapiens
aatgtatgtgcac

SEQ ID NO: 3185590 - DNA, 20 bp, Homo sapiens
aatgtatgtgcactgtcact

SEQ ID NO: 3185591 - DNA, 14 bp, Homo sapiens
aatgtatgtgtaag

SEQ ID NO: 3185592 - DNA, 22 bp, Homo sapiens
aatgtattagtatggttcaaga

SEQ ID NO: 3185593 - DNA, 22 bp, Homo sapiens
aatgtattattctgcagcatga

SEQ ID NO: 3185594 - DNA, 17 bp, Homo sapiens
ctggactcctctgtcca

SEQ ID NO: 3185595 - DNA, 22 bp, Homo sapiens
ctggactcctctgtccaggcac

SEQ ID NO: 3185596 - DNA, 20 bp, Homo sapiens
ctggactcctgccaccagca

SEQ ID NO: 3185597 - DNA, 24 bp, Homo sapiens
ctggactcctgccaccagcatcca

SEQ ID NO: 3185598 - DNA, 14 bp, Homo sapiens
ctggactctgcccc

SEQ ID NO: 3185599 - DNA, 19 bp, Homo sapiens
ctggactgaagcctgcagg

SEQ ID NO: 3185600 - DNA, 23 bp, Homo sapiens
ctggactgagccaaggaggcctg

SEQ ID NO: 3185601 - DNA, 19 bp, Homo sapiens
ctggactggaggtgggcat

SEQ ID NO: 3185602 - DNA, 14 bp, Homo sapiens
ctggactggcgttc

SEQ ID NO: 3185603 - DNA, 15 bp, Homo sapiens
ctggactggctagag

SEQ ID NO: 3185604 - DNA, 13 bp, Homo sapiens
ctggactgggagg

SEQ ID NO: 3185605 - DNA, 21 bp, Homo sapiens
ctggactggtggcccctgcct

SEQ ID NO: 3185606 - DNA, 19 bp, Homo sapiens
ctggactgtcatagaaatt

SEQ ID NO: 3185607 - DNA, 16 bp, Homo sapiens
ctggactgttccaggc

SEQ ID NO: 3185608 - DNA, 21 bp, Homo sapiens
ctggactgttccaggccctcc

SEQ ID NO: 3185609 - DNA, 22 bp, Homo sapiens
ctggacttaagcatctggctct

SEQ ID NO: 3185610 - DNA, 19 bp, Homo sapiens
ctggacttctacctgccct

SEQ ID NO: 3185611 - DNA, 20 bp, Homo sapiens
ctggacttctacctgccctc

SEQ ID NO: 3185612 - DNA, 23 bp, Homo sapiens
ctggacttctacctgccctcaag

SEQ ID NO: 3185613 - DNA, 13 bp, Homo sapiens
ctggacttctgtg

SEQ ID NO: 3185614 - DNA, 19 bp, Homo sapiens
ctggacttctgtgggcccc

SEQ ID NO: 3185615 - DNA, 15 bp, Homo sapiens
ctggacttgcctctg

SEQ ID NO: 3185616 - DNA, 16 bp, Homo sapiens
ctggactttcctgcaa

SEQ ID NO: 3185617 - DNA, 17 bp, Homo sapiens
ctggagaaaaaaattgc

SEQ ID NO: 3185618 - DNA, 12 bp, Homo sapiens
ctggagaaagag

SEQ ID NO: 3185619 - DNA, 14 bp, Homo sapiens
ctggagaaagagct

SEQ ID NO: 3185620 - DNA, 19 bp, Homo sapiens
ctggagaaagagctgcctg

SEQ ID NO: 3185621 - DNA, 20 bp, Homo sapiens
ctggagaaagagctgcctgg

SEQ ID NO: 3185622 - DNA, 22 bp, Homo sapiens
ctggagaaagagctgcctggat

SEQ ID NO: 3185623 - DNA, 21 bp, Homo sapiens
ctggagaacagtggttgcctg

SEQ ID NO: 3185624 - DNA, 14 bp, Homo sapiens
ctggagaactagag

SEQ ID NO: 3185625 - DNA, 14 bp, Homo sapiens
ctggagaagagagg

SEQ ID NO: 3185626 - DNA, 11 bp, Homo sapiens
ctggagacagc

SEQ ID NO: 3185627 - DNA, 14 bp, Homo sapiens
ctggagacagcccc

SEQ ID NO: 3185628 - DNA, 18 bp, Homo sapiens
ctggagaccagggagcct

SEQ ID NO: 3185629 - DNA, 20 bp, Homo sapiens
ctggagaccatgcagagcgc

SEQ ID NO: 3185630 - DNA, 20 bp, Homo sapiens
ctggagacccaccccacctg

SEQ ID NO: 3185631 - DNA, 22 bp, Homo sapiens
ctggagagaaacaataaagaga

SEQ ID NO: 3185632 - DNA, 13 bp, Homo sapiens
ctggagagcgagg

SEQ ID NO: 3185633 - DNA, 23 bp, Homo sapiens
ctggagaggagggatgctgcctg

SEQ ID NO: 3185634 - DNA, 13 bp, Homo sapiens
ctggagagggtct

SEQ ID NO: 3185635 - DNA, 21 bp, Homo sapiens
ctggagaggttataggtcact

SEQ ID NO: 3185636 - DNA, 13 bp, Homo sapiens
ctggagatatgaa

SEQ ID NO: 3185637 - DNA, 18 bp, Homo sapiens
ctggagcagaccaccccg

SEQ ID NO: 3185638 - DNA, 14 bp, Homo sapiens
ctggagcaggagcc

SEQ ID NO: 3185639 - DNA, 17 bp, Homo sapiens
ctggagcaggagccccg

SEQ ID NO: 3185640 - DNA, 17 bp, Homo sapiens
ctggagccaactgctgc

SEQ ID NO: 3185641 - DNA, 13 bp, Homo sapiens
ctggagcccagga

SEQ ID NO: 3185642 - DNA, 15 bp, Homo sapiens
ctggagcccaggagt

SEQ ID NO: 3185643 - DNA, 12 bp, Homo sapiens
ctggagcccctg

SEQ ID NO: 3185644 - DNA, 14 bp, Homo sapiens
ctggagcccctggg

SEQ ID NO: 3185645 - DNA, 15 bp, Homo sapiens
ctggagcccctgggt

SEQ ID NO: 3185646 - DNA, 11 bp, Homo sapiens
ctggagccctg

SEQ ID NO: 3185647 - DNA, 23 bp, Homo sapiens
ctggagcgaagccttctgcagca

SEQ ID NO: 3185648 - DNA, 13 bp, Homo sapiens
ctggagcggctgc

SEQ ID NO: 3185649 - DNA, 18 bp, Homo sapiens
ctggagcttcattttggt

SEQ ID NO: 3185650 - DNA, 17 bp, Homo sapiens
ctggaggaaagggagga

SEQ ID NO: 3185651 - DNA, 20 bp, Homo sapiens
ctggaggaaagggaggagtg

SEQ ID NO: 3185652 - DNA, 18 bp, Homo sapiens
ctggaggagcagcttcct

SEQ ID NO: 3185653 - DNA, 22 bp, Homo sapiens
ctggaggagggtttgggcagag

SEQ ID NO: 3185654 - DNA, 12 bp, Homo sapiens
ctggaggcccag

SEQ ID NO: 3185655 - DNA, 19 bp, Homo sapiens
ctggaggcccaggctggga

SEQ ID NO: 3185656 - DNA, 14 bp, Homo sapiens
ctggaggcccctgg

SEQ ID NO: 3185657 - DNA, 17 bp, Homo sapiens
ctggaggcccctggagc

SEQ ID NO: 3185658 - DNA, 13 bp, Homo sapiens
ctggaggcctctg

SEQ ID NO: 3185659 - DNA, 14 bp, Homo sapiens
ctggaggcctctgg

SEQ ID NO: 3185660 - DNA, 21 bp, Homo sapiens
ctggaggctccaggactccac

SEQ ID NO: 3185661 - DNA, 15 bp, Homo sapiens
ctggaggggcccctg

SEQ ID NO: 3185662 - DNA, 23 bp, Homo sapiens
ctggaggggcccctgcttctcca

SEQ ID NO: 3185663 - DNA, 17 bp, Homo sapiens
ctggaggggtgttgtat

SEQ ID NO: 3185664 - DNA, 18 bp, Homo sapiens
ctggaggtctccaggggc

SEQ ID NO: 3185665 - DNA, 24 bp, Homo sapiens
ctggaggtctccaggggcctgcag

SEQ ID NO: 3185666 - DNA, 17 bp, Homo sapiens
ctggaggtgggagcagg

SEQ ID NO: 3185667 - DNA, 13 bp, Homo sapiens
ctggaggtgggca

SEQ ID NO: 3185668 - DNA, 14 bp, Homo sapiens
ctggaggtgggcat

SEQ ID NO: 3185669 - DNA, 16 bp, Homo sapiens
ctggaggtgggcatgc

SEQ ID NO: 3185670 - DNA, 23 bp, Homo sapiens
ctggaggtgggcatgccaccctc

SEQ ID NO: 3185671 - DNA, 24 bp, Homo sapiens
ctggaggtgggcatgccaccctca

SEQ ID NO: 3185672 - DNA, 20 bp, Homo sapiens
ctggaggtggggcgaggcag

SEQ ID NO: 3185673 - DNA, 19 bp, Homo sapiens
ctggagtccacacttgaat

SEQ ID NO: 3185674 - DNA, 22 bp, Homo sapiens
ctggagtcccgtccctgcccag

SEQ ID NO: 3185675 - DNA, 16 bp, Homo sapiens
ctggagtctggcttta

SEQ ID NO: 3185676 - DNA, 15 bp, Homo sapiens
ctggagtgaaccaga

SEQ ID NO: 3185677 - DNA, 16 bp, Homo sapiens
ctggagtgagcactca

SEQ ID NO: 3185678 - DNA, 13 bp, Homo sapiens
ctggagtgaggct

SEQ ID NO: 3185679 - DNA, 18 bp, Homo sapiens
ctggagtgaggcttccag

SEQ ID NO: 3185680 - DNA, 14 bp, Homo sapiens
ctggagtgcagtga

SEQ ID NO: 3185681 - DNA, 19 bp, Homo sapiens
ctggagtgcccaccctggg

SEQ ID NO: 3185682 - DNA, 18 bp, Homo sapiens
ctggagtgcgctcttggt

SEQ ID NO: 3185683 - DNA, 20 bp, Homo sapiens
ctggagtggaaggtctattg

SEQ ID NO: 3185684 - DNA, 13 bp, Homo sapiens
ctggagtgggcag

SEQ ID NO: 3185685 - DNA, 16 bp, Homo sapiens
ctggagtgggcagagc

SEQ ID NO: 3185686 - DNA, 17 bp, Homo sapiens
ctggagtggtaacagct

SEQ ID NO: 3185687 - DNA, 21 bp, Homo sapiens
ctggatataatgtattttcag

SEQ ID NO: 3185688 - DNA, 19 bp, Homo sapiens
ctggatatttgcacttatg

SEQ ID NO: 3185689 - DNA, 22 bp, Homo sapiens
ctggatatttgcacttatgtac

SEQ ID NO: 3185690 - DNA, 21 bp, Homo sapiens
ctggatattttcaaattgtat

SEQ ID NO: 3185691 - DNA, 13 bp, Homo sapiens
ctggatcagggaa

SEQ ID NO: 3185692 - DNA, 19 bp, Homo sapiens
ctggatccatcaggccact

SEQ ID NO: 3185693 - DNA, 23 bp, Homo sapiens
ctggatctcctcaagtccccaag

SEQ ID NO: 3185694 - DNA, 14 bp, Homo sapiens
ctggatgagaaaca

SEQ ID NO: 3185695 - DNA, 23 bp, Homo sapiens
ctggatgagaaacagctcagcca

SEQ ID NO: 3185696 - DNA, 13 bp, Homo sapiens
ctggatgagactt

SEQ ID NO: 3185697 - DNA, 20 bp, Homo sapiens
ctggatgatttcatcttctg

SEQ ID NO: 3185698 - DNA, 21 bp, Homo sapiens
ctggatgatttcatcttctgg

SEQ ID NO: 3185699 - DNA, 22 bp, Homo sapiens
ctggatgatttcatcttctgga

SEQ ID NO: 3185700 - DNA, 23 bp, Homo sapiens
ctggatgatttcatcttctggaa

SEQ ID NO: 3185701 - DNA, 19 bp, Homo sapiens
ctggatgccaaggagcccc

SEQ ID NO: 3185702 - DNA, 17 bp, Homo sapiens
ctggatggagcccaggc

SEQ ID NO: 3185703 - DNA, 21 bp, Homo sapiens
ctggatgggcattgggctgac

SEQ ID NO: 3185704 - DNA, 22 bp, Homo sapiens
ctggatggtcctcttaccaaca

SEQ ID NO: 3185705 - DNA, 14 bp, Homo sapiens
ctggattaaaacaa

SEQ ID NO: 3185706 - DNA, 19 bp, Homo sapiens
ctggattaatgttttgtac

SEQ ID NO: 3185707 - DNA, 21 bp, Homo sapiens
ctggattaatgttttgtacaa

SEQ ID NO: 3185708 - DNA, 20 bp, Homo sapiens
ctggattggctataacatgt

SEQ ID NO: 3185709 - DNA, 20 bp, Homo sapiens
ctggattgtccttggaggaa

SEQ ID NO: 3185710 - DNA, 15 bp, Homo sapiens
ctggattttaagtag

SEQ ID NO: 3185711 - DNA, 15 bp, Homo sapiens
ctggcaaaataaaac

SEQ ID NO: 3185712 - DNA, 14 bp, Homo sapiens
ctggcaaaggacca

SEQ ID NO: 3185713 - DNA, 17 bp, Homo sapiens
ctggcaaaggaccagcg

SEQ ID NO: 3185714 - DNA, 19 bp, Homo sapiens
ctggcaaaggaccagcgtc

SEQ ID NO: 3185715 - DNA, 23 bp, Homo sapiens
ctggcaaaggctggctgtgtata

SEQ ID NO: 3185716 - DNA, 15 bp, Homo sapiens
ctggcaacacagagg

SEQ ID NO: 3185717 - DNA, 21 bp, Homo sapiens
ctggcaagaggcctcatgcct

SEQ ID NO: 3185718 - DNA, 17 bp, Homo sapiens
ctggcaagcagggaaag

SEQ ID NO: 3185719 - DNA, 22 bp, Homo sapiens
ctggcaagcagggaaagctcca

SEQ ID NO: 3185720 - DNA, 12 bp, Homo sapiens
ctggcaataaac

SEQ ID NO: 3185721 - DNA, 13 bp, Homo sapiens
ctggcaataaact

SEQ ID NO: 3185722 - DNA, 14 bp, Homo sapiens
ctggcaataaactc

SEQ ID NO: 3185723 - DNA, 18 bp, Homo sapiens
ctggcaatcaatacagct

SEQ ID NO: 3185724 - DNA, 21 bp, Homo sapiens
ctggcaatgaaaaattctcag

SEQ ID NO: 3185725 - DNA, 22 bp, Homo sapiens
ctggcaatgaaaaattctcagt

SEQ ID NO: 3185726 - DNA, 14 bp, Homo sapiens
ctggcacaggactg

SEQ ID NO: 3185727 - DNA, 16 bp, Homo sapiens
ctggcacagggcagtg

SEQ ID NO: 3185728 - DNA, 13 bp, Homo sapiens
ctggcacatttca

SEQ ID NO: 3185729 - DNA, 19 bp, Homo sapiens
ctggcacatttcagggaga

SEQ ID NO: 3185730 - DNA, 17 bp, Homo sapiens
ctggcacccccacaagc

SEQ ID NO: 3185731 - DNA, 16 bp, Homo sapiens
ctggcacccggcccct

SEQ ID NO: 3185732 - DNA, 17 bp, Homo sapiens
ctggcacccggcccctg

SEQ ID NO: 3185733 - DNA, 18 bp, Homo sapiens
ctggcacccggcccctgc

SEQ ID NO: 3185734 - DNA, 21 bp, Homo sapiens
ctggcacgccctactccactg

SEQ ID NO: 3185735 - DNA, 22 bp, Homo sapiens
ctggcactataatgtaagctct

SEQ ID NO: 3185736 - DNA, 23 bp, Homo sapiens
ctggcactataatgtaagctcta

SEQ ID NO: 3185737 - DNA, 22 bp, Homo sapiens
ctggcactggtttgttccctgt

SEQ ID NO: 3185738 - DNA, 19 bp, Homo sapiens
ctggcacttagcccaagag

SEQ ID NO: 3185739 - DNA, 16 bp, Homo sapiens
ctggcagcagcaggtg

SEQ ID NO: 3185740 - DNA, 13 bp, Homo sapiens
ctggcagcccaga

SEQ ID NO: 3185741 - DNA, 22 bp, Homo sapiens
ctggcagcccagagactttgta

SEQ ID NO: 3185742 - DNA, 19 bp, Homo sapiens
ctggcagccgtgccttcag

SEQ ID NO: 3185743 - DNA, 16 bp, Homo sapiens
ctggcagctcctctcc

SEQ ID NO: 3185744 - DNA, 20 bp, Homo sapiens
ctggcagctcctctccttgg

SEQ ID NO: 3185745 - DNA, 21 bp, Homo sapiens
ctggcagctcctctccttggg

SEQ ID NO: 3185746 - DNA, 12 bp, Homo sapiens
ctggcagctctc

SEQ ID NO: 3185747 - DNA, 13 bp, Homo sapiens
ctggcagctctcc

SEQ ID NO: 3185748 - DNA, 12 bp, Homo sapiens
ctggcagctgag

SEQ ID NO: 3185749 - DNA, 19 bp, Homo sapiens
ctggcagctgagagccctg

SEQ ID NO: 3185750 - DNA, 23 bp, Homo sapiens
ctggcaggacacatcccggcctc

SEQ ID NO: 3185751 - DNA, 14 bp, Homo sapiens
ctggcaggagggtg

SEQ ID NO: 3185752 - DNA, 18 bp, Homo sapiens
ctggcaggatgaccctgc

SEQ ID NO: 3185753 - DNA, 14 bp, Homo sapiens
ctggcaggccagtg

SEQ ID NO: 3185754 - DNA, 17 bp, Homo sapiens
ctggcaggccagtgtct

SEQ ID NO: 3185755 - DNA, 20 bp, Homo sapiens
ctggcaggccagtgtctggg

SEQ ID NO: 3185756 - DNA, 22 bp, Homo sapiens
ctggcagggaggtcaggccctg

SEQ ID NO: 3185757 - DNA, 22 bp, Homo sapiens
ctggcaggggagacaggagcct

SEQ ID NO: 3185758 - DNA, 17 bp, Homo sapiens
ctggcagttgaacagag

SEQ ID NO: 3185759 - DNA, 20 bp, Homo sapiens
ctggcagttgaacagaggga

SEQ ID NO: 3185760 - DNA, 22 bp, Homo sapiens
ctggcatcaagaggtgggaggg

SEQ ID NO: 3185761 - DNA, 20 bp, Homo sapiens
ctggcatcgcaccattctga

SEQ ID NO: 3185762 - DNA, 17 bp, Homo sapiens
ctggcatctgacacaaa

SEQ ID NO: 3185763 - DNA, 22 bp, Homo sapiens
ctggcattaccctctgcagaac

SEQ ID NO: 3185764 - DNA, 18 bp, Homo sapiens
ctggcattagaattattt

SEQ ID NO: 3185765 - DNA, 22 bp, Homo sapiens
ctggcattagaattatttaaac

SEQ ID NO: 3185766 - DNA, 21 bp, Homo sapiens
ctggcattatgtccactgtgt

SEQ ID NO: 3185767 - DNA, 17 bp, Homo sapiens
ctggcattgtccctgtg

SEQ ID NO: 3185768 - DNA, 18 bp, Homo sapiens
ctggccaaacccttgctt

SEQ ID NO: 3185769 - DNA, 20 bp, Homo sapiens
ctggccaccaggctggcgca

SEQ ID NO: 3185770 - DNA, 21 bp, Homo sapiens
ctggccaccaggctggcgcag

SEQ ID NO: 3185771 - DNA, 18 bp, Homo sapiens
ctggccacctgaggtggg

SEQ ID NO: 3185772 - DNA, 15 bp, Homo sapiens
ctggccactgcacag

SEQ ID NO: 3185773 - DNA, 13 bp, Homo sapiens
ctggccagacgct

SEQ ID NO: 3185774 - DNA, 21 bp, Homo sapiens
ctggccagagagggcccagct

SEQ ID NO: 3185775 - DNA, 22 bp, Homo sapiens
ctggccagagagggcccagctg

SEQ ID NO: 3185776 - DNA, 16 bp, Homo sapiens
ctggccagatgcacca

SEQ ID NO: 3185777 - DNA, 18 bp, Homo sapiens
ctggccagatgcaccagc

SEQ ID NO: 3185778 - DNA, 18 bp, Homo sapiens
ctggccagatggcccgga

SEQ ID NO: 3185779 - DNA, 19 bp, Homo sapiens
ctggccagcaaggcaggtt

SEQ ID NO: 3185780 - DNA, 16 bp, Homo sapiens
ctggccagcaccctct

SEQ ID NO: 3185781 - DNA, 17 bp, Homo sapiens
ctggccagcctggggcc

SEQ ID NO: 3185782 - DNA, 21 bp, Homo sapiens
ctggccagcctggggcctggc

SEQ ID NO: 3185783 - DNA, 17 bp, Homo sapiens
ctggccaggagctcttc

SEQ ID NO: 3185784 - DNA, 22 bp, Homo sapiens
ctggccaggagctcttcaggcc

SEQ ID NO: 3185785 - DNA, 12 bp, Homo sapiens
ctggccaggatg

SEQ ID NO: 3185786 - DNA, 13 bp, Homo sapiens
ctggccaggcaga

SEQ ID NO: 3185787 - DNA, 13 bp, Homo sapiens
ctggccagggcag

SEQ ID NO: 3185788 - DNA, 15 bp, Homo sapiens
ctggccagggcaggg

SEQ ID NO: 3185789 - DNA, 17 bp, Homo sapiens
ctggccagggcagggcc

SEQ ID NO: 3185790 - DNA, 20 bp, Homo sapiens
ctggccagggcagggccacc

SEQ ID NO: 3185791 - DNA, 21 bp, Homo sapiens
ctggccagggcagggccaccc

SEQ ID NO: 3185792 - DNA, 18 bp, Homo sapiens
ctggccagggccacgctc

SEQ ID NO: 3185793 - DNA, 20 bp, Homo sapiens
ctggccagggccacgctcca

SEQ ID NO: 3185794 - DNA, 22 bp, Homo sapiens
ctggccagggccacgctccagc

SEQ ID NO: 3185795 - DNA, 23 bp, Homo sapiens
ctggccagggccacgctccagct

SEQ ID NO: 3185796 - DNA, 17 bp, Homo sapiens
ctggccagtccaggctg

SEQ ID NO: 3185797 - DNA, 22 bp, Homo sapiens
ctggccagtccaggctgccgtg

SEQ ID NO: 3185798 - DNA, 13 bp, Homo sapiens
ctggccagtgtca

SEQ ID NO: 3185799 - DNA, 16 bp, Homo sapiens
ctggccagttgcccag

SEQ ID NO: 3185800 - DNA, 17 bp, Homo sapiens
ctggccagttgcccaga

SEQ ID NO: 3185801 - DNA, 18 bp, Homo sapiens
ctggccagttgcccagag

SEQ ID NO: 3185802 - DNA, 19 bp, Homo sapiens
ctggccagttgcccagagc

SEQ ID NO: 3185803 - DNA, 22 bp, Homo sapiens
ctggccagttgcccagagcact

SEQ ID NO: 3185804 - DNA, 14 bp, Homo sapiens
ctggcccaaagcag

SEQ ID NO: 3185805 - DNA, 13 bp, Homo sapiens
ctggcccaccagg

SEQ ID NO: 3185806 - DNA, 14 bp, Homo sapiens
ctggcccaccaggg

SEQ ID NO: 3185807 - DNA, 10 bp, Homo sapiens
ctggcccagc

SEQ ID NO: 3185808 - DNA, 20 bp, Homo sapiens
ctggcccagccggcctctct

SEQ ID NO: 3185809 - DNA, 22 bp, Homo sapiens
ctggcccagccggcctctctgg

SEQ ID NO: 3185810 - DNA, 17 bp, Homo sapiens
ctggcccatagaaacat

SEQ ID NO: 3185811 - DNA, 19 bp, Homo sapiens
ctggcccatctcagcctcc

SEQ ID NO: 3185812 - DNA, 12 bp, Homo sapiens
ctggccccagcc

SEQ ID NO: 3185813 - DNA, 19 bp, Homo sapiens
ctggccccagccctgctgg

SEQ ID NO: 3185814 - DNA, 14 bp, Homo sapiens
ctggccccagggca

SEQ ID NO: 3185815 - DNA, 18 bp, Homo sapiens
ctggccccagggcaccct

SEQ ID NO: 3185816 - DNA, 18 bp, Homo sapiens
ctggcccccaacctcagg

SEQ ID NO: 3185817 - DNA, 19 bp, Homo sapiens
ctggccccggatcagagca

SEQ ID NO: 3185818 - DNA, 20 bp, Homo sapiens
ctggccccggatcagagcag

SEQ ID NO: 3185819 - DNA, 22 bp, Homo sapiens
ctggcccgtcatgttcctcaaa

SEQ ID NO: 3185820 - DNA, 14 bp, Homo sapiens
ctggccctatttag

SEQ ID NO: 3185821 - DNA, 23 bp, Homo sapiens
ctggccctcggtggctgcacaga

SEQ ID NO: 3185822 - DNA, 13 bp, Homo sapiens
ctggccctgaggt

SEQ ID NO: 3185823 - DNA, 15 bp, Homo sapiens
ctggccctgccctga

SEQ ID NO: 3185824 - DNA, 17 bp, Homo sapiens
ctggccctgccctgagg

SEQ ID NO: 3185825 - DNA, 15 bp, Homo sapiens
ctggccctgcctcat

SEQ ID NO: 3185826 - DNA, 15 bp, Homo sapiens
ctggccctgcctcct

SEQ ID NO: 3185827 - DNA, 22 bp, Homo sapiens
ctggccctgcctcctgggaaga

SEQ ID NO: 3185828 - DNA, 13 bp, Homo sapiens
ctggccctgtgta

SEQ ID NO: 3185829 - DNA, 22 bp, Homo sapiens
ctggccctgtgtaggggcaggg

SEQ ID NO: 3185830 - DNA, 12 bp, Homo sapiens
ctggcccttgga

SEQ ID NO: 3185831 - DNA, 15 bp, Homo sapiens
ctggccctttcccct

SEQ ID NO: 3185832 - DNA, 19 bp, Homo sapiens
ctggccctttccccttccc

SEQ ID NO: 3185833 - DNA, 20 bp, Homo sapiens
ctggccgagggtcctggctc

SEQ ID NO: 3185834 - DNA, 12 bp, Homo sapiens
ctggccgccacc

SEQ ID NO: 3185835 - DNA, 15 bp, Homo sapiens
ctggccgccaccccc

SEQ ID NO: 3185836 - DNA, 18 bp, Homo sapiens
ctggccgccacccccatc

SEQ ID NO: 3185837 - DNA, 13 bp, Homo sapiens
ctggccgccccct

SEQ ID NO: 3185838 - DNA, 14 bp, Homo sapiens
ctggccgccccctg

SEQ ID NO: 3185839 - DNA, 15 bp, Homo sapiens
ctggccgggcaggcg

SEQ ID NO: 3185840 - DNA, 18 bp, Homo sapiens
ctggccgggggaggtggg

SEQ ID NO: 3185841 - DNA, 22 bp, Homo sapiens
ctggccggtctgcaagtcagag

SEQ ID NO: 3185842 - DNA, 21 bp, Homo sapiens
ctggcctaaaatcttggaagt

SEQ ID NO: 3185843 - DNA, 19 bp, Homo sapiens
ctggcctatccgctgccag

SEQ ID NO: 3185844 - DNA, 21 bp, Homo sapiens
ctgggacttcttacccaaagc

SEQ ID NO: 3185845 - DNA, 22 bp, Homo sapiens
ctgggacttcttacccaaagca

SEQ ID NO: 3185846 - DNA, 14 bp, Homo sapiens
ctgggagaacctca

SEQ ID NO: 3185847 - DNA, 12 bp, Homo sapiens
ctgggagcagaa

SEQ ID NO: 3185848 - DNA, 13 bp, Homo sapiens
ctgggagcagaaa

SEQ ID NO: 3185849 - DNA, 15 bp, Homo sapiens
ctgggagcagaaaca

SEQ ID NO: 3185850 - DNA, 14 bp, Homo sapiens
ctgggagcatagca

SEQ ID NO: 3185851 - DNA, 18 bp, Homo sapiens
ctgggagcatagcagagg

SEQ ID NO: 3185852 - DNA, 18 bp, Homo sapiens
ctgggagccacttctccc

SEQ ID NO: 3185853 - DNA, 22 bp, Homo sapiens
ctgggagccacttctccccaga

SEQ ID NO: 3185854 - DNA, 13 bp, Homo sapiens
ctgggagccagtc

SEQ ID NO: 3185855 - DNA, 15 bp, Homo sapiens
ctgggagccagtcct

SEQ ID NO: 3185856 - DNA, 13 bp, Homo sapiens
ctgggagctctgc

SEQ ID NO: 3185857 - DNA, 14 bp, Homo sapiens
ctgggagctctgca

SEQ ID NO: 3185858 - DNA, 14 bp, Homo sapiens
ctgggaggacaggc

SEQ ID NO: 3185859 - DNA, 18 bp, Homo sapiens
ctgggaggacaggcaggc

SEQ ID NO: 3185860 - DNA, 21 bp, Homo sapiens
ctgggaggacaggcaggccag

SEQ ID NO: 3185861 - DNA, 14 bp, Homo sapiens
ctgggaggagggag

SEQ ID NO: 3185862 - DNA, 15 bp, Homo sapiens
ctgggaggagggaga

SEQ ID NO: 3185863 - DNA, 18 bp, Homo sapiens
ctgggaggcaagaaaagg

SEQ ID NO: 3185864 - DNA, 19 bp, Homo sapiens
ctgggaggcaagaaaagga

SEQ ID NO: 3185865 - DNA, 17 bp, Homo sapiens
ctgggaggcagaacagg

SEQ ID NO: 3185866 - DNA, 14 bp, Homo sapiens
ctgggagtcacaca

SEQ ID NO: 3185867 - DNA, 16 bp, Homo sapiens
ctgggagtcacacagt

SEQ ID NO: 3185868 - DNA, 14 bp, Homo sapiens
ctgggagtcagagc

SEQ ID NO: 3185869 - DNA, 18 bp, Homo sapiens
ctgggagtcagagccctg

SEQ ID NO: 3185870 - DNA, 13 bp, Homo sapiens
ctgggagtcccct

SEQ ID NO: 3185871 - DNA, 16 bp, Homo sapiens
ctgggagtgagctggt

SEQ ID NO: 3185872 - DNA, 16 bp, Homo sapiens
ctgggataactgattt

SEQ ID NO: 3185873 - DNA, 22 bp, Homo sapiens
ctgggatatggctgcccaggag

SEQ ID NO: 3185874 - DNA, 17 bp, Homo sapiens
ctgggatcagagcagga

SEQ ID NO: 3185875 - DNA, 21 bp, Homo sapiens
ctgggatgagccgctgtgagc

SEQ ID NO: 3185876 - DNA, 22 bp, Homo sapiens
ctgggatgagccgctgtgagcc

SEQ ID NO: 3185877 - DNA, 15 bp, Homo sapiens
ctgggatgaggggtg

SEQ ID NO: 3185878 - DNA, 19 bp, Homo sapiens
ctgggatgctagccccaga

SEQ ID NO: 3185879 - DNA, 15 bp, Homo sapiens
ctgggatgggaccag

SEQ ID NO: 3185880 - DNA, 19 bp, Homo sapiens
ctgggatgggaccagggat

SEQ ID NO: 3185881 - DNA, 20 bp, Homo sapiens
ctgggattacaggtgtgaac

SEQ ID NO: 3185882 - DNA, 15 bp, Homo sapiens
ctgggattattcttt

SEQ ID NO: 3185883 - DNA, 14 bp, Homo sapiens
ctgggattcctccc

SEQ ID NO: 3185884 - DNA, 20 bp, Homo sapiens
ctgggatttcttcgctgctc

SEQ ID NO: 3185885 - DNA, 21 bp, Homo sapiens
ctgggatttcttcgctgctct

SEQ ID NO: 3185886 - DNA, 23 bp, Homo sapiens
ctgggcaaagccacaaggctggc

SEQ ID NO: 3185887 - DNA, 17 bp, Homo sapiens
ctgggcacactctgcca

SEQ ID NO: 3185888 - DNA, 21 bp, Homo sapiens
ctgggcacactctgccagcaa

SEQ ID NO: 3185889 - DNA, 20 bp, Homo sapiens
ctgggcaccacaaaatatac

SEQ ID NO: 3185890 - DNA, 18 bp, Homo sapiens
ctgggcagacattatgta

SEQ ID NO: 3185891 - DNA, 13 bp, Homo sapiens
ctgggcagcccca

SEQ ID NO: 3185892 - DNA, 16 bp, Homo sapiens
ctgggcagccccagag

SEQ ID NO: 3185893 - DNA, 18 bp, Homo sapiens
ctgggcagccccagagag

SEQ ID NO: 3185894 - DNA, 22 bp, Homo sapiens
ctgggcagccccagagagagga

SEQ ID NO: 3185895 - DNA, 21 bp, Homo sapiens
ctgggcatggtaccagccctg

SEQ ID NO: 3185896 - DNA, 12 bp, Homo sapiens
ctgggcattgct

SEQ ID NO: 3185897 - DNA, 18 bp, Homo sapiens
ctgggcatttggtgagag

SEQ ID NO: 3185898 - DNA, 15 bp, Homo sapiens
ctgggccaagttcct

SEQ ID NO: 3185899 - DNA, 12 bp, Homo sapiens
ctgggccactgg

SEQ ID NO: 3185900 - DNA, 17 bp, Homo sapiens
ctgggccactggggact

SEQ ID NO: 3185901 - DNA, 19 bp, Homo sapiens
ctgggccagccctgcagcc

SEQ ID NO: 3185902 - DNA, 17 bp, Homo sapiens
ctgggccagggtctgtg

SEQ ID NO: 3185903 - DNA, 20 bp, Homo sapiens
ctgggccagggtctgtgtga

SEQ ID NO: 3185904 - DNA, 19 bp, Homo sapiens
ctgggccatgtccaaagag

SEQ ID NO: 3185905 - DNA, 22 bp, Homo sapiens
ctgggccatgtccaaagaggct

SEQ ID NO: 3185906 - DNA, 13 bp, Homo sapiens
ctgggcccagggg

SEQ ID NO: 3185907 - DNA, 24 bp, Homo sapiens
ctgggccccaaacgggctgccctg

SEQ ID NO: 3185908 - DNA, 15 bp, Homo sapiens
ctgggccccatgctc

SEQ ID NO: 3185909 - DNA, 22 bp, Homo sapiens
ctgggcccctccacgcctcctg

SEQ ID NO: 3185910 - DNA, 24 bp, Homo sapiens
ctgggcccctcttattcctctagg

SEQ ID NO: 3185911 - DNA, 12 bp, Homo sapiens
ctgggcccctgc

SEQ ID NO: 3185912 - DNA, 15 bp, Homo sapiens
ctgggccctctcttc

SEQ ID NO: 3185913 - DNA, 18 bp, Homo sapiens
ctgggccctctttccctg

SEQ ID NO: 3185914 - DNA, 23 bp, Homo sapiens
ctgggccctctttccctgcgaga

SEQ ID NO: 3185915 - DNA, 11 bp, Homo sapiens
ctgggccctgg

SEQ ID NO: 3185916 - DNA, 23 bp, Homo sapiens
ctgggccctggaggaattcagct

SEQ ID NO: 3185917 - DNA, 16 bp, Homo sapiens
ctgggccctgggctgg

SEQ ID NO: 3185918 - DNA, 16 bp, Homo sapiens
ctgggccgctgccacg

SEQ ID NO: 3185919 - DNA, 16 bp, Homo sapiens
ctgggcctctgcccct

SEQ ID NO: 3185920 - DNA, 20 bp, Homo sapiens
ctgggcctgaccaaacagcc

SEQ ID NO: 3185921 - DNA, 16 bp, Homo sapiens
ctgggcctgcccctgt

SEQ ID NO: 3185922 - DNA, 13 bp, Homo sapiens
ctgggcctgtccc

SEQ ID NO: 3185923 - DNA, 14 bp, Homo sapiens
ctgggcctgtgcag

SEQ ID NO: 3185924 - DNA, 20 bp, Homo sapiens
ctgggcctgtgcagcagccc

SEQ ID NO: 3185925 - DNA, 20 bp, Homo sapiens
ctgggcggggctcgaggctg

SEQ ID NO: 3185926 - DNA, 22 bp, Homo sapiens
ctgggcggggctcgaggctggt

SEQ ID NO: 3185927 - DNA, 15 bp, Homo sapiens
ctgggctaggggaca

SEQ ID NO: 3185928 - DNA, 15 bp, Homo sapiens
ctgggctcacaggcc

SEQ ID NO: 3185929 - DNA, 16 bp, Homo sapiens
ctgggctccctgatga

SEQ ID NO: 3185930 - DNA, 22 bp, Homo sapiens
ctgggctctgcaattcccctct

SEQ ID NO: 3185931 - DNA, 12 bp, Homo sapiens
ctgggctctgtc

SEQ ID NO: 3185932 - DNA, 14 bp, Homo sapiens
ctgggctggactgg

SEQ ID NO: 3185933 - DNA, 17 bp, Homo sapiens
ctgggctggactggagg

SEQ ID NO: 3185934 - DNA, 19 bp, Homo sapiens
ctgggctggactggaggtg

SEQ ID NO: 3185935 - DNA, 22 bp, Homo sapiens
ctgggctggccagttggaacca

SEQ ID NO: 3185936 - DNA, 21 bp, Homo sapiens
ctgggctgggccctctttccc

SEQ ID NO: 3185937 - DNA, 13 bp, Homo sapiens
ctgggctgggtgg

SEQ ID NO: 3185938 - DNA, 16 bp, Homo sapiens
ctgggctgggtggcac

SEQ ID NO: 3185939 - DNA, 18 bp, Homo sapiens
ctgggctgggtggcacac

SEQ ID NO: 3185940 - DNA, 22 bp, Homo sapiens
ctgggctgggtggcacaccacc

SEQ ID NO: 3185941 - DNA, 22 bp, Homo sapiens
ctgggctgtaacgtggcactgg

SEQ ID NO: 3185942 - DNA, 20 bp, Homo sapiens
ctgggctgtctgtcaccagc

SEQ ID NO: 3185943 - DNA, 15 bp, Homo sapiens
ctgggctgtgctgct

SEQ ID NO: 3185944 - DNA, 14 bp, Homo sapiens
ctgggctgttgttc

SEQ ID NO: 3185945 - DNA, 17 bp, Homo sapiens
ctgggcttcagtggcag

SEQ ID NO: 3185946 - DNA, 18 bp, Homo sapiens
ctgggcttcagtggcagc

SEQ ID NO: 3185947 - DNA, 19 bp, Homo sapiens
ctgggcttcagtggcagct

SEQ ID NO: 3185948 - DNA, 22 bp, Homo sapiens
ctgggcttcagtggcagctgct

SEQ ID NO: 3185949 - DNA, 19 bp, Homo sapiens
ctgggcttcatctggcaac

SEQ ID NO: 3185950 - DNA, 18 bp, Homo sapiens
ctgggcttgagctgcaga

SEQ ID NO: 3185951 - DNA, 19 bp, Homo sapiens
ctgggcttgagctgcagaa

SEQ ID NO: 3185952 - DNA, 14 bp, Homo sapiens
ctgggcttggcctg

SEQ ID NO: 3185953 - DNA, 15 bp, Homo sapiens
ctgggcttggcctgc

SEQ ID NO: 3185954 - DNA, 16 bp, Homo sapiens
ctgggcttggcctgct

SEQ ID NO: 3185955 - DNA, 20 bp, Homo sapiens
ctgggcttggcctgctgtga

SEQ ID NO: 3185956 - DNA, 20 bp, Homo sapiens
ctggggaaaactccaccttc

SEQ ID NO: 3185957 - DNA, 17 bp, Homo sapiens
ctggggaaggagccagt

SEQ ID NO: 3185958 - DNA, 20 bp, Homo sapiens
ctggggaccccaacctcaga

SEQ ID NO: 3185959 - DNA, 23 bp, Homo sapiens
ctggggaccccaacctcagaggc

SEQ ID NO: 3185960 - DNA, 20 bp, Homo sapiens
ctggggacctggtaccctcc

SEQ ID NO: 3185961 - DNA, 17 bp, Homo sapiens
ctggggactcagggacc

SEQ ID NO: 3185962 - DNA, 21 bp, Homo sapiens
ctggggactgttccaaagcca

SEQ ID NO: 3185963 - DNA, 23 bp, Homo sapiens
ctggggactgttccaaagccagt

SEQ ID NO: 3185964 - DNA, 17 bp, Homo sapiens
ctggggacttgtgtctg

SEQ ID NO: 3185965 - DNA, 21 bp, Homo sapiens
ctggggactttatttatttct

SEQ ID NO: 3185966 - DNA, 14 bp, Homo sapiens
ctggggagaaagta

SEQ ID NO: 3185967 - DNA, 12 bp, Homo sapiens
ctggggagctcc

SEQ ID NO: 3185968 - DNA, 14 bp, Homo sapiens
ctggggagctcctg

SEQ ID NO: 3185969 - DNA, 16 bp, Homo sapiens
ctggggagctcctggc

SEQ ID NO: 3185970 - DNA, 20 bp, Homo sapiens
ctggtgccaatttcaagttc

SEQ ID NO: 3185971 - DNA, 18 bp, Homo sapiens
ctggtgccccacagctac

SEQ ID NO: 3185972 - DNA, 19 bp, Homo sapiens
ctggtgccccacagctacc

SEQ ID NO: 3185973 - DNA, 20 bp, Homo sapiens
ctggtgccccacagctacct

SEQ ID NO: 3185974 - DNA, 14 bp, Homo sapiens
ctggtgcctccaga

SEQ ID NO: 3185975 - DNA, 15 bp, Homo sapiens
ctggtgcctccagag

SEQ ID NO: 3185976 - DNA, 16 bp, Homo sapiens
ctggtgcctccagagg

SEQ ID NO: 3185977 - DNA, 12 bp, Homo sapiens
ctggtgctgcca

SEQ ID NO: 3185978 - DNA, 22 bp, Homo sapiens
ctggtgctgccacacttcaggc

SEQ ID NO: 3185979 - DNA, 14 bp, Homo sapiens
ctggtgctgctgct

SEQ ID NO: 3185980 - DNA, 20 bp, Homo sapiens
ctggtgctggatattttcaa

SEQ ID NO: 3185981 - DNA, 22 bp, Homo sapiens
ctggtggaaagcgattcactgt

SEQ ID NO: 3185982 - DNA, 12 bp, Homo sapiens
ctggtggacagt

SEQ ID NO: 3185983 - DNA, 15 bp, Homo sapiens
ctggtggacagtcct

SEQ ID NO: 3185984 - DNA, 16 bp, Homo sapiens
ctggtggacagtcctg

SEQ ID NO: 3185985 - DNA, 18 bp, Homo sapiens
ctggtggacagtcctggg

SEQ ID NO: 3185986 - DNA, 18 bp, Homo sapiens
ctggtggcaccagatgca

SEQ ID NO: 3185987 - DNA, 11 bp, Homo sapiens
ctggtggcacg

SEQ ID NO: 3185988 - DNA, 13 bp, Homo sapiens
ctggtggcagctg

SEQ ID NO: 3185989 - DNA, 15 bp, Homo sapiens
ctggtggcagctgcg

SEQ ID NO: 3185990 - DNA, 19 bp, Homo sapiens
ctggtggcagtgggagctg

SEQ ID NO: 3185991 - DNA, 20 bp, Homo sapiens
ctggtggccccgtttctggt

SEQ ID NO: 3185992 - DNA, 22 bp, Homo sapiens
ctggtgggaggggcgcccacct

SEQ ID NO: 3185993 - DNA, 16 bp, Homo sapiens
ctggtgggcagctgag

SEQ ID NO: 3185994 - DNA, 22 bp, Homo sapiens
ctggtggggtgtgttccaactg

SEQ ID NO: 3185995 - DNA, 19 bp, Homo sapiens
ctggtggtaccattattat

SEQ ID NO: 3185996 - DNA, 20 bp, Homo sapiens
ctggtggtctgttggcaggc

SEQ ID NO: 3185997 - DNA, 22 bp, Homo sapiens
ctggtggtctgttggcaggctg

SEQ ID NO: 3185998 - DNA, 14 bp, Homo sapiens
ctggtgtccagctg

SEQ ID NO: 3185999 - DNA, 15 bp, Homo sapiens
ctggtgtcctgacca

SEQ ID NO: 3186000 - DNA, 22 bp, Homo sapiens
ctggtgtgaactcaccctggga

SEQ ID NO: 3186001 - DNA, 20 bp, Homo sapiens
ctggtgttcaccaaaaccaa

SEQ ID NO: 3186002 - DNA, 22 bp, Homo sapiens
ctggttaaccttgaagtgactg

SEQ ID NO: 3186003 - DNA, 13 bp, Homo sapiens
ctggttactcagg

SEQ ID NO: 3186004 - DNA, 14 bp, Homo sapiens
ctggttactcaggg

SEQ ID NO: 3186005 - DNA, 17 bp, Homo sapiens
ctggttactcagggttc

SEQ ID NO: 3186006 - DNA, 18 bp, Homo sapiens
ctggttactcagggttca

SEQ ID NO: 3186007 - DNA, 13 bp, Homo sapiens
ctggttccagggt

SEQ ID NO: 3186008 - DNA, 14 bp, Homo sapiens
ctggttccagggtc

SEQ ID NO: 3186009 - DNA, 23 bp, Homo sapiens
ctggttccagggtccctctgtgt

SEQ ID NO: 3186010 - DNA, 21 bp, Homo sapiens
ctggttcccgtttctccacct

SEQ ID NO: 3186011 - DNA, 16 bp, Homo sapiens
ctggttcctgactggc

SEQ ID NO: 3186012 - DNA, 22 bp, Homo sapiens
ctggttcttcatttattgagca

SEQ ID NO: 3186013 - DNA, 19 bp, Homo sapiens
ctggttgctccatttgaga

SEQ ID NO: 3186014 - DNA, 13 bp, Homo sapiens
ctggttgctgtgt

SEQ ID NO: 3186015 - DNA, 17 bp, Homo sapiens
ctggttggattaatctt

SEQ ID NO: 3186016 - DNA, 15 bp, Homo sapiens
ctggttgtatttcta

SEQ ID NO: 3186017 - DNA, 13 bp, Homo sapiens
ctggttgtcattt

SEQ ID NO: 3186018 - DNA, 14 bp, Homo sapiens
ctggttgtcatttt

SEQ ID NO: 3186019 - DNA, 16 bp, Homo sapiens
ctggttgttatgtgat

SEQ ID NO: 3186020 - DNA, 21 bp, Homo sapiens
ctggttgttgcaccatctgct

SEQ ID NO: 3186021 - DNA, 19 bp, Homo sapiens
ctggttgtttctgttccaa

SEQ ID NO: 3186022 - DNA, 23 bp, Homo sapiens
ctggtttcctatttgcagttact

SEQ ID NO: 3186023 - DNA, 18 bp, Homo sapiens
ctggtttctcattcttgt

SEQ ID NO: 3186024 - DNA, 16 bp, Homo sapiens
ctggtttgttccctgt

SEQ ID NO: 3186025 - DNA, 13 bp, Homo sapiens
ctggttttaacaa

SEQ ID NO: 3186026 - DNA, 18 bp, Homo sapiens
ctggttttacttacaaaa

SEQ ID NO: 3186027 - DNA, 20 bp, Homo sapiens
ctggttttacttacaaaaat

SEQ ID NO: 3186028 - DNA, 20 bp, Homo sapiens
ctggttttgtaagatgctgg

SEQ ID NO: 3186029 - DNA, 22 bp, Homo sapiens
ctggttttgtaagatgctgggt

SEQ ID NO: 3186030 - DNA, 19 bp, Homo sapiens
ctggttttgtacactgctg

SEQ ID NO: 3186031 - DNA, 23 bp, Homo sapiens
ctggttttgtacactgctgtacc

SEQ ID NO: 3186032 - DNA, 15 bp, Homo sapiens
ctgtaaaacaggtta

SEQ ID NO: 3186033 - DNA, 17 bp, Homo sapiens
ctgtaaaattataaact

SEQ ID NO: 3186034 - DNA, 20 bp, Homo sapiens
ctgtaaaattataaactttt

SEQ ID NO: 3186035 - DNA, 22 bp, Homo sapiens
ctgtaaacacaggggacacagc

SEQ ID NO: 3186036 - DNA, 24 bp, Homo sapiens
ctgtaaacacaggggacacagctt

SEQ ID NO: 3186037 - DNA, 12 bp, Homo sapiens
ctgtaaactgtg

SEQ ID NO: 3186038 - DNA, 20 bp, Homo sapiens
ctgtaaagagacctacctca

SEQ ID NO: 3186039 - DNA, 21 bp, Homo sapiens
ctgtaaagatgtttatttcag

SEQ ID NO: 3186040 - DNA, 14 bp, Homo sapiens
ctgtaaataaaatg

SEQ ID NO: 3186041 - DNA, 19 bp, Homo sapiens
ctgtaaataaaatgtgtac

SEQ ID NO: 3186042 - DNA, 20 bp, Homo sapiens
ctgtaaataaaatgtgtaca

SEQ ID NO: 3186043 - DNA, 22 bp, Homo sapiens
ctgtaaataaaatgtgtacagt

SEQ ID NO: 3186044 - DNA, 13 bp, Homo sapiens
ctgtaaataccat

SEQ ID NO: 3186045 - DNA, 11 bp, Homo sapiens
ctgtaaatcat

SEQ ID NO: 3186046 - DNA, 18 bp, Homo sapiens
ctgtaaatcctagacttg

SEQ ID NO: 3186047 - DNA, 21 bp, Homo sapiens
ctgtaaatggtgtacataatg

SEQ ID NO: 3186048 - DNA, 21 bp, Homo sapiens
ctgtaacatcactatccatgc

SEQ ID NO: 3186049 - DNA, 16 bp, Homo sapiens
ctgtaactactttata

SEQ ID NO: 3186050 - DNA, 14 bp, Homo sapiens
ctgtaactgctgag

SEQ ID NO: 3186051 - DNA, 17 bp, Homo sapiens
ctgtaactgctgagcca

SEQ ID NO: 3186052 - DNA, 14 bp, Homo sapiens
ctgtaactgtcagt

SEQ ID NO: 3186053 - DNA, 21 bp, Homo sapiens
ctgtaagaaaatgctgtcaca

SEQ ID NO: 3186054 - DNA, 20 bp, Homo sapiens
ctgtaagaagagactgggaa

SEQ ID NO: 3186055 - DNA, 19 bp, Homo sapiens
ctgtaagatgttgttttag

SEQ ID NO: 3186056 - DNA, 14 bp, Homo sapiens
ctgtaagccaaaga

SEQ ID NO: 3186057 - DNA, 19 bp, Homo sapiens
ctgtaagccaaagaaatga

SEQ ID NO: 3186058 - DNA, 13 bp, Homo sapiens
ctgtaagctcttt

SEQ ID NO: 3186059 - DNA, 13 bp, Homo sapiens
ctgtaaggctcta

SEQ ID NO: 3186060 - DNA, 18 bp, Homo sapiens
ctgtaaggctctagatca

SEQ ID NO: 3186061 - DNA, 18 bp, Homo sapiens
ctgtaagggcagtgccca

SEQ ID NO: 3186062 - DNA, 21 bp, Homo sapiens
ctgtaagttacatgaaggcag

SEQ ID NO: 3186063 - DNA, 15 bp, Homo sapiens
ctgtaataatacctc

SEQ ID NO: 3186064 - DNA, 19 bp, Homo sapiens
ctgtaatcagctctcctgg

SEQ ID NO: 3186065 - DNA, 20 bp, Homo sapiens
ctgtaatcagctctcctggc

SEQ ID NO: 3186066 - DNA, 22 bp, Homo sapiens
ctgtaatcagctctcctggctc

SEQ ID NO: 3186067 - DNA, 18 bp, Homo sapiens
ctgtaatcatttgtttac

SEQ ID NO: 3186068 - DNA, 14 bp, Homo sapiens
ctgtaatcccagct

SEQ ID NO: 3186069 - DNA, 23 bp, Homo sapiens
ctgtaatgatactgattatgaaa

SEQ ID NO: 3186070 - DNA, 18 bp, Homo sapiens
ctgtaattaagtaaacca

SEQ ID NO: 3186071 - DNA, 19 bp, Homo sapiens
ctgtaatttagttattgat

SEQ ID NO: 3186072 - DNA, 13 bp, Homo sapiens
ctgtaattttata

SEQ ID NO: 3186073 - DNA, 18 bp, Homo sapiens
ctgtacacacccgcctga

SEQ ID NO: 3186074 - DNA, 21 bp, Homo sapiens
ctgtacacacccgcctgacac

SEQ ID NO: 3186075 - DNA, 15 bp, Homo sapiens
ctgtacacactttat

SEQ ID NO: 3186076 - DNA, 20 bp, Homo sapiens
ctgtacacactttatttact

SEQ ID NO: 3186077 - DNA, 18 bp, Homo sapiens
ctgtacacgtgtcctgta

SEQ ID NO: 3186078 - DNA, 13 bp, Homo sapiens
ctgtacagtgtta

SEQ ID NO: 3186079 - DNA, 15 bp, Homo sapiens
ctgtacagtgttacc

SEQ ID NO: 3186080 - DNA, 16 bp, Homo sapiens
ctgtacatagcctata

SEQ ID NO: 3186081 - DNA, 19 bp, Homo sapiens
ctgtacatattactgttgc

SEQ ID NO: 3186082 - DNA, 23 bp, Homo sapiens
ctgtacatattactgttgcattt

SEQ ID NO: 3186083 - DNA, 18 bp, Homo sapiens
ctgtacattttgttgtaa

SEQ ID NO: 3186084 - DNA, 20 bp, Homo sapiens
ctgtacattttgttgtaaaa

SEQ ID NO: 3186085 - DNA, 16 bp, Homo sapiens
ctgtaccaaatctgac

SEQ ID NO: 3186086 - DNA, 15 bp, Homo sapiens
ctgtaccacatctgc

SEQ ID NO: 3186087 - DNA, 12 bp, Homo sapiens
ctgtaccagtta

SEQ ID NO: 3186088 - DNA, 17 bp, Homo sapiens
ctgtaccagttaatttt

SEQ ID NO: 3186089 - DNA, 14 bp, Homo sapiens
ctgtacccagatgc

SEQ ID NO: 3186090 - DNA, 15 bp, Homo sapiens
ctgtacccagatgcc

SEQ ID NO: 3186091 - DNA, 16 bp, Homo sapiens
ctgtacccagatgcct

SEQ ID NO: 3186092 - DNA, 15 bp, Homo sapiens
ctgtacccagctcct

SEQ ID NO: 3186093 - DNA, 20 bp, Homo sapiens
ctgtacctcaaatgaattct

SEQ ID NO: 3186094 - DNA, 14 bp, Homo sapiens
ctgtacgtctgaca

SEQ ID NO: 3186095 - DNA, 15 bp, Homo sapiens
ctgtacgtctgacag

SEQ ID NO: 3186096 - DNA, 22 bp, Homo sapiens
ttacattcaacttttctaagaa

SEQ ID NO: 3186097 - DNA, 16 bp, Homo sapiens
ttacattcctaactag

SEQ ID NO: 3186098 - DNA, 16 bp, Homo sapiens
ttacattgttcaatta

SEQ ID NO: 3186099 - DNA, 17 bp, Homo sapiens
ttacattgtttgtctgt

SEQ ID NO: 3186100 - DNA, 13 bp, Homo sapiens
ttacatttaaatc

SEQ ID NO: 3186101 - DNA, 13 bp, Homo sapiens
ttacatttatcta

SEQ ID NO: 3186102 - DNA, 12 bp, Homo sapiens
ttacattttcag

SEQ ID NO: 3186103 - DNA, 16 bp, Homo sapiens
ttacatttttacaata

SEQ ID NO: 3186104 - DNA, 21 bp, Homo sapiens
ttacatttttacaataaataa

SEQ ID NO: 3186105 - DNA, 16 bp, Homo sapiens
ttaccaaaaaagtatt

SEQ ID NO: 3186106 - DNA, 10 bp, Homo sapiens
ttaccaaagc

SEQ ID NO: 3186107 - DNA, 13 bp, Homo sapiens
ttaccaactttct

SEQ ID NO: 3186108 - DNA, 15 bp, Homo sapiens
ttaccaactttctgt

SEQ ID NO: 3186109 - DNA, 18 bp, Homo sapiens
ttaccaactttctgtaaa

SEQ ID NO: 3186110 - DNA, 18 bp, Homo sapiens
ttaccacacatctatgat

SEQ ID NO: 3186111 - DNA, 20 bp, Homo sapiens
ttaccagacaaaaaaattta

SEQ ID NO: 3186112 - DNA, 17 bp, Homo sapiens
ttaccagggatgtagat

SEQ ID NO: 3186113 - DNA, 21 bp, Homo sapiens
ttaccagtctttaaaggccca

SEQ ID NO: 3186114 - DNA, 16 bp, Homo sapiens
ttaccagttaattact

SEQ ID NO: 3186115 - DNA, 13 bp, Homo sapiens
ttaccattagcat

SEQ ID NO: 3186116 - DNA, 14 bp, Homo sapiens
ttaccattagcata

SEQ ID NO: 3186117 - DNA, 13 bp, Homo sapiens
ttaccattcacaa

SEQ ID NO: 3186118 - DNA, 14 bp, Homo sapiens
ttaccattcacaat

SEQ ID NO: 3186119 - DNA, 14 bp, Homo sapiens
ttaccatttacatg

SEQ ID NO: 3186120 - DNA, 20 bp, Homo sapiens
ttaccatttgtaataaagta

SEQ ID NO: 3186121 - DNA, 21 bp, Homo sapiens
ttaccattttaacgctgccta

SEQ ID NO: 3186122 - DNA, 14 bp, Homo sapiens
ttaccatttttcat

SEQ ID NO: 3186123 - DNA, 21 bp, Homo sapiens
ttaccccagcctacccttcct

SEQ ID NO: 3186124 - DNA, 22 bp, Homo sapiens
ttaccctagttctcttatcttt

SEQ ID NO: 3186125 - DNA, 22 bp, Homo sapiens
ttaccctcaggcataggcctgg

SEQ ID NO: 3186126 - DNA, 13 bp, Homo sapiens
ttacccttccctg

SEQ ID NO: 3186127 - DNA, 17 bp, Homo sapiens
ttacccttccctgcact

SEQ ID NO: 3186128 - DNA, 15 bp, Homo sapiens
ttacctaaagtattt

SEQ ID NO: 3186129 - DNA, 16 bp, Homo sapiens
ttacctaaagtatttt

SEQ ID NO: 3186130 - DNA, 14 bp, Homo sapiens
ttacctaagattac

SEQ ID NO: 3186131 - DNA, 18 bp, Homo sapiens
ttacctaccacagtgtct

SEQ ID NO: 3186132 - DNA, 21 bp, Homo sapiens
ttacctaccacagtgtctgta

SEQ ID NO: 3186133 - DNA, 21 bp, Homo sapiens
ttacctactgtgtcttggaat

SEQ ID NO: 3186134 - DNA, 14 bp, Homo sapiens
ttacctcaaattaa

SEQ ID NO: 3186135 - DNA, 15 bp, Homo sapiens
ttacctccaacagaa

SEQ ID NO: 3186136 - DNA, 22 bp, Homo sapiens
ttacctccaacagaactaaatg

SEQ ID NO: 3186137 - DNA, 20 bp, Homo sapiens
ttacctcttaacaatttctg

SEQ ID NO: 3186138 - DNA, 16 bp, Homo sapiens
ttacctgacctcttgc

SEQ ID NO: 3186139 - DNA, 17 bp, Homo sapiens
ttacctgacctcttgct

SEQ ID NO: 3186140 - DNA, 19 bp, Homo sapiens
ttacctgtgaagtgttact

SEQ ID NO: 3186141 - DNA, 23 bp, Homo sapiens
ttacctgttttcgcacctaccat

SEQ ID NO: 3186142 - DNA, 16 bp, Homo sapiens
ttaccttgtatactgt

SEQ ID NO: 3186143 - DNA, 18 bp, Homo sapiens
ttaccttttctgttgtac

SEQ ID NO: 3186144 - DNA, 18 bp, Homo sapiens
ttacctttttatttgcat

SEQ ID NO: 3186145 - DNA, 13 bp, Homo sapiens
ttacgaagacaaa

SEQ ID NO: 3186146 - DNA, 13 bp, Homo sapiens
ttacgctttgatt

SEQ ID NO: 3186147 - DNA, 19 bp, Homo sapiens
ttacgtatgcaagtctgtg

SEQ ID NO: 3186148 - DNA, 17 bp, Homo sapiens
ttacgtttgttattcct

SEQ ID NO: 3186149 - DNA, 19 bp, Homo sapiens
ttacgtttgttattcctag

SEQ ID NO: 3186150 - DNA, 18 bp, Homo sapiens
ttactaaacatatgattt

SEQ ID NO: 3186151 - DNA, 22 bp, Homo sapiens
ttactaaagatatcagagctct

SEQ ID NO: 3186152 - DNA, 20 bp, Homo sapiens
ttactaagccacaagaaatt

SEQ ID NO: 3186153 - DNA, 18 bp, Homo sapiens
ttactaagttttcaaatt

SEQ ID NO: 3186154 - DNA, 17 bp, Homo sapiens
ttactaattatactact

SEQ ID NO: 3186155 - DNA, 14 bp, Homo sapiens
ttactacaaaattt

SEQ ID NO: 3186156 - DNA, 13 bp, Homo sapiens
ttactacagttgt

SEQ ID NO: 3186157 - DNA, 13 bp, Homo sapiens
ttactattaaaat

SEQ ID NO: 3186158 - DNA, 19 bp, Homo sapiens
ttactattaagcagtaaaa

SEQ ID NO: 3186159 - DNA, 21 bp, Homo sapiens
ttactattccctttgacttca

SEQ ID NO: 3186160 - DNA, 21 bp, Homo sapiens
ttactattttgacagttattt

SEQ ID NO: 3186161 - DNA, 15 bp, Homo sapiens
ttactcacagcactt

SEQ ID NO: 3186162 - DNA, 21 bp, Homo sapiens
ttactcagggctcctcccagc

SEQ ID NO: 3186163 - DNA, 12 bp, Homo sapiens
ttactcagggtt

SEQ ID NO: 3186164 - DNA, 19 bp, Homo sapiens
ttactcagtgttagagaaa

SEQ ID NO: 3186165 - DNA, 20 bp, Homo sapiens
ttactcagtgttagagaaat

SEQ ID NO: 3186166 - DNA, 15 bp, Homo sapiens
ttactcattgaaatg

SEQ ID NO: 3186167 - DNA, 16 bp, Homo sapiens
ttactcattgaaatgt

SEQ ID NO: 3186168 - DNA, 19 bp, Homo sapiens
ttactcattgaaatgtcac

SEQ ID NO: 3186169 - DNA, 19 bp, Homo sapiens
ttactcattgcccccacct

SEQ ID NO: 3186170 - DNA, 14 bp, Homo sapiens
ttactcccttcctg

SEQ ID NO: 3186171 - DNA, 15 bp, Homo sapiens
ttactctgagcccag

SEQ ID NO: 3186172 - DNA, 16 bp, Homo sapiens
ttactctgagcccagg

SEQ ID NO: 3186173 - DNA, 18 bp, Homo sapiens
ttactctgagcccaggcc

SEQ ID NO: 3186174 - DNA, 13 bp, Homo sapiens
ttactctttgcaa

SEQ ID NO: 3186175 - DNA, 12 bp, Homo sapiens
ttactgaaaaag

SEQ ID NO: 3186176 - DNA, 23 bp, Homo sapiens
ttactgaagaaatctttccagtt

SEQ ID NO: 3186177 - DNA, 16 bp, Homo sapiens
ttactgagcttctctg

SEQ ID NO: 3186178 - DNA, 23 bp, Homo sapiens
ttactgatatattttacaatttt

SEQ ID NO: 3186179 - DNA, 18 bp, Homo sapiens
ttactgatcatgcattgt

SEQ ID NO: 3186180 - DNA, 21 bp, Homo sapiens
ttactgatcatgcattgttga

SEQ ID NO: 3186181 - DNA, 13 bp, Homo sapiens
ttactgattattt

SEQ ID NO: 3186182 - DNA, 16 bp, Homo sapiens
ttactgcaaattgatt

SEQ ID NO: 3186183 - DNA, 22 bp, Homo sapiens
ttactgcagcctttgcctcccc

SEQ ID NO: 3186184 - DNA, 21 bp, Homo sapiens
ttactgcatggggaaagagat

SEQ ID NO: 3186185 - DNA, 14 bp, Homo sapiens
ttactggacctgaa

SEQ ID NO: 3186186 - DNA, 16 bp, Homo sapiens
ttactggacctgaaat

SEQ ID NO: 3186187 - DNA, 13 bp, Homo sapiens
ttactggcctttt

SEQ ID NO: 3186188 - DNA, 23 bp, Homo sapiens
ttactgggccttagtgggccagg

SEQ ID NO: 3186189 - DNA, 18 bp, Homo sapiens
ttactgtaacctgttgct

SEQ ID NO: 3186190 - DNA, 14 bp, Homo sapiens
ttactgtctttatt

SEQ ID NO: 3186191 - DNA, 16 bp, Homo sapiens
ttactgtcttttctat

SEQ ID NO: 3186192 - DNA, 14 bp, Homo sapiens
ttactgtggaggaa

SEQ ID NO: 3186193 - DNA, 16 bp, Homo sapiens
ttactgtggaggaagg

SEQ ID NO: 3186194 - DNA, 20 bp, Homo sapiens
ttactgtggaggaaggattg

SEQ ID NO: 3186195 - DNA, 19 bp, Homo sapiens
ttactgtgtaaatatatgt

SEQ ID NO: 3186196 - DNA, 13 bp, Homo sapiens
ttactgtgtaatt

SEQ ID NO: 3186197 - DNA, 20 bp, Homo sapiens
ttactgtgtaattagtgcca

SEQ ID NO: 3186198 - DNA, 18 bp, Homo sapiens
ttactgttagtcatttgc

SEQ ID NO: 3186199 - DNA, 11 bp, Homo sapiens
ttactgttctt

SEQ ID NO: 3186200 - DNA, 13 bp, Homo sapiens
ttactgttcttgc

SEQ ID NO: 3186201 - DNA, 15 bp, Homo sapiens
ttactgttcttgctg

SEQ ID NO: 3186202 - DNA, 16 bp, Homo sapiens
ttactgttcttgctgc

SEQ ID NO: 3186203 - DNA, 19 bp, Homo sapiens
ttactgttcttgctgctag

SEQ ID NO: 3186204 - DNA, 20 bp, Homo sapiens
ttactgttcttgctgctaga

SEQ ID NO: 3186205 - DNA, 15 bp, Homo sapiens
ttactgtttatttct

SEQ ID NO: 3186206 - DNA, 21 bp, Homo sapiens
ttactgttttaattgtagttc

SEQ ID NO: 3186207 - DNA, 17 bp, Homo sapiens
ttacttacaaaaatggg

SEQ ID NO: 3186208 - DNA, 17 bp, Homo sapiens
ttacttaggttattttg

SEQ ID NO: 3186209 - DNA, 20 bp, Homo sapiens
ttacttaggttattttgctt

SEQ ID NO: 3186210 - DNA, 11 bp, Homo sapiens
ttacttcatat

SEQ ID NO: 3186211 - DNA, 11 bp, Homo sapiens
ttacttctctt

SEQ ID NO: 3186212 - DNA, 23 bp, Homo sapiens
ttacttcttatacatttgataaa

SEQ ID NO: 3186213 - DNA, 14 bp, Homo sapiens
ttacttgacctcct

SEQ ID NO: 3186214 - DNA, 15 bp, Homo sapiens
ttacttgatgatttt

SEQ ID NO: 3186215 - DNA, 13 bp, Homo sapiens
ttacttgcttctc

SEQ ID NO: 3186216 - DNA, 15 bp, Homo sapiens
ttacttgcttctcta

SEQ ID NO: 3186217 - DNA, 19 bp, Homo sapiens
ttacttgtggtgtgaccat

SEQ ID NO: 3186218 - DNA, 15 bp, Homo sapiens
ttacttgttttggat

SEQ ID NO: 3186219 - DNA, 21 bp, Homo sapiens
ttactttggaatgactataaa

SEQ ID NO: 3186220 - DNA, 12 bp, Homo sapiens
ttactttgtaat

SEQ ID NO: 3186221 - DNA, 15 bp, Homo sapiens
ttactttgtaatttt

SEQ ID NO: 3186222 - DNA, 19 bp, Homo sapiens
ttactttgtacttgtgttt

SEQ ID NO: 3186223 - DNA, 14 bp, Homo sapiens
ttagggcttttatt

SEQ ID NO: 3186224 - DNA, 17 bp, Homo sapiens
ttagggcttttattttt

SEQ ID NO: 3186225 - DNA, 15 bp, Homo sapiens
ttagggtacatttat

SEQ ID NO: 3186226 - DNA, 13 bp, Homo sapiens
ttagggtcagcca

SEQ ID NO: 3186227 - DNA, 23 bp, Homo sapiens
ttagggtcagccatttttaatga

SEQ ID NO: 3186228 - DNA, 15 bp, Homo sapiens
ttagggttttgcaat

SEQ ID NO: 3186229 - DNA, 23 bp, Homo sapiens
ttaggtaagaagttttaaaaagc

SEQ ID NO: 3186230 - DNA, 15 bp, Homo sapiens
ttaggtagaaaaaca

SEQ ID NO: 3186231 - DNA, 14 bp, Homo sapiens
ttaggttattttgc

SEQ ID NO: 3186232 - DNA, 16 bp, Homo sapiens
ttaggttattttgctt

SEQ ID NO: 3186233 - DNA, 16 bp, Homo sapiens
ttaggttctaaagttc

SEQ ID NO: 3186234 - DNA, 18 bp, Homo sapiens
ttaggttctaaagttcta

SEQ ID NO: 3186235 - DNA, 16 bp, Homo sapiens
ttagtaatctgtacat

SEQ ID NO: 3186236 - DNA, 17 bp, Homo sapiens
ttagtaatctgtacatt

SEQ ID NO: 3186237 - DNA, 21 bp, Homo sapiens
ttagtaatctgtacattttgt

SEQ ID NO: 3186238 - DNA, 12 bp, Homo sapiens
ttagtacatttt

SEQ ID NO: 3186239 - DNA, 13 bp, Homo sapiens
ttagtagagacag

SEQ ID NO: 3186240 - DNA, 14 bp, Homo sapiens
ttagtagagacagg

SEQ ID NO: 3186241 - DNA, 18 bp, Homo sapiens
ttagtatctaacatgtat

SEQ ID NO: 3186242 - DNA, 19 bp, Homo sapiens
ttagtatgacgctgataca

SEQ ID NO: 3186243 - DNA, 13 bp, Homo sapiens
ttagtattatctt

SEQ ID NO: 3186244 - DNA, 22 bp, Homo sapiens
ttagtatttatttaatgttatg

SEQ ID NO: 3186245 - DNA, 18 bp, Homo sapiens
ttagtattttaatcctgt

SEQ ID NO: 3186246 - DNA, 14 bp, Homo sapiens
ttagtatttttact

SEQ ID NO: 3186247 - DNA, 17 bp, Homo sapiens
ttagtccctcatgcaaa

SEQ ID NO: 3186248 - DNA, 21 bp, Homo sapiens
ttagtctcagtttgtgtgtct

SEQ ID NO: 3186249 - DNA, 14 bp, Homo sapiens
ttagtcttctcata

SEQ ID NO: 3186250 - DNA, 15 bp, Homo sapiens
ttagtgacaaaatag

SEQ ID NO: 3186251 - DNA, 14 bp, Homo sapiens
ttagtgagttattc

SEQ ID NO: 3186252 - DNA, 16 bp, Homo sapiens
ttagtgattgtgtctg

SEQ ID NO: 3186253 - DNA, 12 bp, Homo sapiens
ttagtgccctgc

SEQ ID NO: 3186254 - DNA, 14 bp, Homo sapiens
ttagtgccctgccc

SEQ ID NO: 3186255 - DNA, 15 bp, Homo sapiens
ttagtgctaaacaag

SEQ ID NO: 3186256 - DNA, 14 bp, Homo sapiens
ttagtgctttacat

SEQ ID NO: 3186257 - DNA, 15 bp, Homo sapiens
ttagtgggccagggc

SEQ ID NO: 3186258 - DNA, 16 bp, Homo sapiens
ttagtgggccagggct

SEQ ID NO: 3186259 - DNA, 15 bp, Homo sapiens
ttagtggtatgtctc

SEQ ID NO: 3186260 - DNA, 18 bp, Homo sapiens
ttagtggtatgtctcttt

SEQ ID NO: 3186261 - DNA, 23 bp, Homo sapiens
ttagtgtcacttacctagattta

SEQ ID NO: 3186262 - DNA, 18 bp, Homo sapiens
ttagtgttaatgactctt

SEQ ID NO: 3186263 - DNA, 13 bp, Homo sapiens
ttagttaatatat

SEQ ID NO: 3186264 - DNA, 13 bp, Homo sapiens
ttagttaccttat

SEQ ID NO: 3186265 - DNA, 18 bp, Homo sapiens
ttagttatagtttcagat

SEQ ID NO: 3186266 - DNA, 15 bp, Homo sapiens
ttagttcaatacagt

SEQ ID NO: 3186267 - DNA, 17 bp, Homo sapiens
ttagttcaatacagtga

SEQ ID NO: 3186268 - DNA, 15 bp, Homo sapiens
ttagttctttgttat

SEQ ID NO: 3186269 - DNA, 19 bp, Homo sapiens
ttagttgaaaaatctagtt

SEQ ID NO: 3186270 - DNA, 13 bp, Homo sapiens
ttagtttagtgtg

SEQ ID NO: 3186271 - DNA, 20 bp, Homo sapiens
ttagtttcctttttaatatg

SEQ ID NO: 3186272 - DNA, 14 bp, Homo sapiens
ttagtttggattct

SEQ ID NO: 3186273 - DNA, 18 bp, Homo sapiens
ttagtttttggttgggaa

SEQ ID NO: 3186274 - DNA, 13 bp, Homo sapiens
ttataaaaaatgt

SEQ ID NO: 3186275 - DNA, 17 bp, Homo sapiens
ttataaaaaatgtaaca

SEQ ID NO: 3186276 - DNA, 19 bp, Homo sapiens
ttataaaaaggtgttttga

SEQ ID NO: 3186277 - DNA, 21 bp, Homo sapiens
ttataaaaataaagggaagaa

SEQ ID NO: 3186278 - DNA, 17 bp, Homo sapiens
ttataaaaataaataga

SEQ ID NO: 3186279 - DNA, 20 bp, Homo sapiens
ttataaaaataaatagaaaa

SEQ ID NO: 3186280 - DNA, 21 bp, Homo sapiens
ttataaaaatattaagacaat

SEQ ID NO: 3186281 - DNA, 13 bp, Homo sapiens
ttataaaacttct

SEQ ID NO: 3186282 - DNA, 13 bp, Homo sapiens
ttataaaatggct

SEQ ID NO: 3186283 - DNA, 15 bp, Homo sapiens
ttataaacacattga

SEQ ID NO: 3186284 - DNA, 19 bp, Homo sapiens
ttataaacagacaatatgt

SEQ ID NO: 3186285 - DNA, 13 bp, Homo sapiens
ttataaagcatgt

SEQ ID NO: 3186286 - DNA, 19 bp, Homo sapiens
ttataaataaactgttgct

SEQ ID NO: 3186287 - DNA, 17 bp, Homo sapiens
ttataaatcatattgat

SEQ ID NO: 3186288 - DNA, 15 bp, Homo sapiens
ttataaatgagcaaa

SEQ ID NO: 3186289 - DNA, 24 bp, Homo sapiens
ttataaatgcattaaataagagtt

SEQ ID NO: 3186290 - DNA, 23 bp, Homo sapiens
ttataaatgtaccagagagagtt

SEQ ID NO: 3186291 - DNA, 17 bp, Homo sapiens
ttataacagcattcttg

SEQ ID NO: 3186292 - DNA, 13 bp, Homo sapiens
ttataacagttat

SEQ ID NO: 3186293 - DNA, 19 bp, Homo sapiens
ttataactaacatgtcctg

SEQ ID NO: 3186294 - DNA, 17 bp, Homo sapiens
ttataactcatcataaa

SEQ ID NO: 3186295 - DNA, 19 bp, Homo sapiens
ttataactcatcataaaat

SEQ ID NO: 3186296 - DNA, 21 bp, Homo sapiens
ttataactcatcataaaataa

SEQ ID NO: 3186297 - DNA, 22 bp, Homo sapiens
ttataactcatcataaaataaa

SEQ ID NO: 3186298 - DNA, 19 bp, Homo sapiens
ttataactctgcactactc

SEQ ID NO: 3186299 - DNA, 18 bp, Homo sapiens
ttataactgtaaagatgt

SEQ ID NO: 3186300 - DNA, 17 bp, Homo sapiens
ttataacttaaaatatt

SEQ ID NO: 3186301 - DNA, 17 bp, Homo sapiens
ttataacttattagcag

SEQ ID NO: 3186302 - DNA, 13 bp, Homo sapiens
ttataagactctc

SEQ ID NO: 3186303 - DNA, 20 bp, Homo sapiens
ttataagactctcacactca

SEQ ID NO: 3186304 - DNA, 14 bp, Homo sapiens
ttataagcagattt

SEQ ID NO: 3186305 - DNA, 16 bp, Homo sapiens
ttataagcagatttaa

SEQ ID NO: 3186306 - DNA, 17 bp, Homo sapiens
ttataagtgaagtgata

SEQ ID NO: 3186307 - DNA, 15 bp, Homo sapiens
ttataagttcacaaa

SEQ ID NO: 3186308 - DNA, 15 bp, Homo sapiens
ttataatactctgtt

SEQ ID NO: 3186309 - DNA, 15 bp, Homo sapiens
ttataatgaatactt

SEQ ID NO: 3186310 - DNA, 18 bp, Homo sapiens
ttataatgaatactttct

SEQ ID NO: 3186311 - DNA, 15 bp, Homo sapiens
ttataatgaatgaaa

SEQ ID NO: 3186312 - DNA, 20 bp, Homo sapiens
ttataattggtgctatttga

SEQ ID NO: 3186313 - DNA, 23 bp, Homo sapiens
ttataattggtgctatttgaaga

SEQ ID NO: 3186314 - DNA, 16 bp, Homo sapiens
ttatacaaaagagcat

SEQ ID NO: 3186315 - DNA, 22 bp, Homo sapiens
ttatacaaaagagcatggatgc

SEQ ID NO: 3186316 - DNA, 19 bp, Homo sapiens
ttatacaaattagaaaatg

SEQ ID NO: 3186317 - DNA, 22 bp, Homo sapiens
ttatacaataacccagttactt

SEQ ID NO: 3186318 - DNA, 23 bp, Homo sapiens
ttatacaataacccagttacttt

SEQ ID NO: 3186319 - DNA, 15 bp, Homo sapiens
ttatacagtgccttg

SEQ ID NO: 3186320 - DNA, 17 bp, Homo sapiens
ttatacagttataaaat

SEQ ID NO: 3186321 - DNA, 22 bp, Homo sapiens
ttatacccccaggaaactagct

SEQ ID NO: 3186322 - DNA, 15 bp, Homo sapiens
ttatacctacctgtg

SEQ ID NO: 3186323 - DNA, 16 bp, Homo sapiens
ttatacctacctgtgt

SEQ ID NO: 3186324 - DNA, 14 bp, Homo sapiens
ttatacgcttttct

SEQ ID NO: 3186325 - DNA, 11 bp, Homo sapiens
ttatactaact

SEQ ID NO: 3186326 - DNA, 16 bp, Homo sapiens
ttatactctttctgta

SEQ ID NO: 3186327 - DNA, 13 bp, Homo sapiens
ttatactgattat

SEQ ID NO: 3186328 - DNA, 24 bp, Homo sapiens
ttatactgggacaccattaccaaa

SEQ ID NO: 3186329 - DNA, 18 bp, Homo sapiens
ttatactgtatttctaag

SEQ ID NO: 3186330 - DNA, 13 bp, Homo sapiens
ttatacttcaaaa

SEQ ID NO: 3186331 - DNA, 21 bp, Homo sapiens
ttatactttgcaatccaaata

SEQ ID NO: 3186332 - DNA, 22 bp, Homo sapiens
ttatagaacatattttccttta

SEQ ID NO: 3186333 - DNA, 12 bp, Homo sapiens
ttatagaataaa

SEQ ID NO: 3186334 - DNA, 16 bp, Homo sapiens
ttatagaataaaagct

SEQ ID NO: 3186335 - DNA, 18 bp, Homo sapiens
ttatagaataaaagctat

SEQ ID NO: 3186336 - DNA, 19 bp, Homo sapiens
ttatagaataaaagctata

SEQ ID NO: 3186337 - DNA, 23 bp, Homo sapiens
ttatagaatatttattacctctg

SEQ ID NO: 3186338 - DNA, 14 bp, Homo sapiens
ttatagattctaaa

SEQ ID NO: 3186339 - DNA, 15 bp, Homo sapiens
ttatagattctaaag

SEQ ID NO: 3186340 - DNA, 16 bp, Homo sapiens
ttatagattctaaaga

SEQ ID NO: 3186341 - DNA, 21 bp, Homo sapiens
ttatagcaagatattgatcaa

SEQ ID NO: 3186342 - DNA, 23 bp, Homo sapiens
ttatagcactttgaaatacctca

SEQ ID NO: 3186343 - DNA, 16 bp, Homo sapiens
ttatagctcagtttat

SEQ ID NO: 3186344 - DNA, 16 bp, Homo sapiens
ttatagcttaactaat

SEQ ID NO: 3186345 - DNA, 17 bp, Homo sapiens
ttataggaaaaaaactg

SEQ ID NO: 3186346 - DNA, 18 bp, Homo sapiens
ttataggtcactcctggg

SEQ ID NO: 3186347 - DNA, 15 bp, Homo sapiens
ttatagtgaatactg

SEQ ID NO: 3186348 - DNA, 12 bp, Homo sapiens
ttatagtttctg

SEQ ID NO: 3186349 - DNA, 20 bp, Homo sapiens
ttatagtttgctttgctttt

SEQ ID NO: 3186350 - DNA, 21 bp, Homo sapiens
ttatggaattgatttgcattg

SEQ ID NO: 3186351 - DNA, 14 bp, Homo sapiens
ttatggatgattaa

SEQ ID NO: 3186352 - DNA, 11 bp, Homo sapiens
ttatggatgca

SEQ ID NO: 3186353 - DNA, 16 bp, Homo sapiens
ttatggcagaagggaa

SEQ ID NO: 3186354 - DNA, 15 bp, Homo sapiens
ttatggcctcagctg

SEQ ID NO: 3186355 - DNA, 18 bp, Homo sapiens
ttatggcctcagctgcct

SEQ ID NO: 3186356 - DNA, 20 bp, Homo sapiens
ttatggcctttttaagtatt

SEQ ID NO: 3186357 - DNA, 23 bp, Homo sapiens
ttatgggaaccccttcatcctct

SEQ ID NO: 3186358 - DNA, 19 bp, Homo sapiens
ttatgggaataattgcttt

SEQ ID NO: 3186359 - DNA, 17 bp, Homo sapiens
ttatgggatgtaaacaa

SEQ ID NO: 3186360 - DNA, 22 bp, Homo sapiens
ttatgggcattgacaaatctgt

SEQ ID NO: 3186361 - DNA, 22 bp, Homo sapiens
ttatggtaactgctttctgttc

SEQ ID NO: 3186362 - DNA, 22 bp, Homo sapiens
ttatggtcaatcccaaaagtca

SEQ ID NO: 3186363 - DNA, 17 bp, Homo sapiens
ttatggtgtgttcctaa

SEQ ID NO: 3186364 - DNA, 13 bp, Homo sapiens
ttatgtaaaagaa

SEQ ID NO: 3186365 - DNA, 20 bp, Homo sapiens
ttatgtaaatgtttgttaaa

SEQ ID NO: 3186366 - DNA, 18 bp, Homo sapiens
ttatgtaatatattgtac

SEQ ID NO: 3186367 - DNA, 20 bp, Homo sapiens
ttatgtaatatattgtacaa

SEQ ID NO: 3186368 - DNA, 14 bp, Homo sapiens
ttatgtactgctgt

SEQ ID NO: 3186369 - DNA, 12 bp, Homo sapiens
ttatgtactgta

SEQ ID NO: 3186370 - DNA, 22 bp, Homo sapiens
ttatgtagatatttggcttaaa

SEQ ID NO: 3186371 - DNA, 16 bp, Homo sapiens
ttatgtagcacataaa

SEQ ID NO: 3186372 - DNA, 16 bp, Homo sapiens
ttatgtagtaattgac

SEQ ID NO: 3186373 - DNA, 15 bp, Homo sapiens
ttatgtctcttctga

SEQ ID NO: 3186374 - DNA, 17 bp, Homo sapiens
ttatgtcttcttttgtg

SEQ ID NO: 3186375 - DNA, 13 bp, Homo sapiens
ttatgtcttttat

SEQ ID NO: 3186376 - DNA, 23 bp, Homo sapiens
ttatgtgaatgatctctctgaat

SEQ ID NO: 3186377 - DNA, 14 bp, Homo sapiens
ttatgtgatcaatt

SEQ ID NO: 3186378 - DNA, 19 bp, Homo sapiens
ttatgtgggttgcctggtg

SEQ ID NO: 3186379 - DNA, 19 bp, Homo sapiens
ttatgtggttttagatttt

SEQ ID NO: 3186380 - DNA, 22 bp, Homo sapiens
ttatgtgtagttgtctctcttc

SEQ ID NO: 3186381 - DNA, 18 bp, Homo sapiens
ttatgtgtatgtgccatt

SEQ ID NO: 3186382 - DNA, 21 bp, Homo sapiens
ttatgtgtgcatgtgtgtata

SEQ ID NO: 3186383 - DNA, 12 bp, Homo sapiens
ttatgttaaaat

SEQ ID NO: 3186384 - DNA, 20 bp, Homo sapiens
ttatgttatcaccttccaaa

SEQ ID NO: 3186385 - DNA, 14 bp, Homo sapiens
ttatgtttattaca

SEQ ID NO: 3186386 - DNA, 16 bp, Homo sapiens
ttatgttttgtttctg

SEQ ID NO: 3186387 - DNA, 21 bp, Homo sapiens
ttattaaaatgattgtaaaat

SEQ ID NO: 3186388 - DNA, 14 bp, Homo sapiens
ttattaaacatttt

SEQ ID NO: 3186389 - DNA, 12 bp, Homo sapiens
ttattaaataaa

SEQ ID NO: 3186390 - DNA, 16 bp, Homo sapiens
ttattaaataaaatca

SEQ ID NO: 3186391 - DNA, 21 bp, Homo sapiens
ttattaacgatgtccaacccg

SEQ ID NO: 3186392 - DNA, 21 bp, Homo sapiens
ttattaactaatatgggcatt

SEQ ID NO: 3186393 - DNA, 15 bp, Homo sapiens
ttattaactacattt

SEQ ID NO: 3186394 - DNA, 15 bp, Homo sapiens
ttattaactttaatg

SEQ ID NO: 3186395 - DNA, 19 bp, Homo sapiens
ttattaagatggattctca

SEQ ID NO: 3186396 - DNA, 24 bp, Homo sapiens
ttattaagtctgggatgtagaact

SEQ ID NO: 3186397 - DNA, 13 bp, Homo sapiens
ttattaagtgatt

SEQ ID NO: 3186398 - DNA, 17 bp, Homo sapiens
ttattaatgttttcaaa

SEQ ID NO: 3186399 - DNA, 12 bp, Homo sapiens
ttattacaattt

SEQ ID NO: 3186400 - DNA, 13 bp, Homo sapiens
ttattacatttaa

SEQ ID NO: 3186401 - DNA, 14 bp, Homo sapiens
ttattactattatt

SEQ ID NO: 3186402 - DNA, 13 bp, Homo sapiens
ttattacttctgt

SEQ ID NO: 3186403 - DNA, 14 bp, Homo sapiens
ttattacttctgtt

SEQ ID NO: 3186404 - DNA, 20 bp, Homo sapiens
ttattacttgttgcaaaggt

SEQ ID NO: 3186405 - DNA, 12 bp, Homo sapiens
ttattagaaacc

SEQ ID NO: 3186406 - DNA, 22 bp, Homo sapiens
ttattagccagtgaaacacttg

SEQ ID NO: 3186407 - DNA, 20 bp, Homo sapiens
ttattagtaaatgcttatca

SEQ ID NO: 3186408 - DNA, 24 bp, Homo sapiens
ttattagtaccatagtaccattta

SEQ ID NO: 3186409 - DNA, 22 bp, Homo sapiens
ttattagttccccaaatacaaa

SEQ ID NO: 3186410 - DNA, 14 bp, Homo sapiens
ttattataaattct

SEQ ID NO: 3186411 - DNA, 21 bp, Homo sapiens
ttattataaattctactaagt

SEQ ID NO: 3186412 - DNA, 13 bp, Homo sapiens
ttattataatggt

SEQ ID NO: 3186413 - DNA, 12 bp, Homo sapiens
ttattataattg

SEQ ID NO: 3186414 - DNA, 15 bp, Homo sapiens
ttattataattgtat

SEQ ID NO: 3186415 - DNA, 18 bp, Homo sapiens
ttattataattgtatcag

SEQ ID NO: 3186416 - DNA, 20 bp, Homo sapiens
ttattataattgtatcagag

SEQ ID NO: 3186417 - DNA, 14 bp, Homo sapiens
ttattatgcattat

SEQ ID NO: 3186418 - DNA, 13 bp, Homo sapiens
ttattatggcttg

SEQ ID NO: 3186419 - DNA, 13 bp, Homo sapiens
ttattatgtagct

SEQ ID NO: 3186420 - DNA, 14 bp, Homo sapiens
ttattattgtggta

SEQ ID NO: 3186421 - DNA, 16 bp, Homo sapiens
ttattattttcacctg

SEQ ID NO: 3186422 - DNA, 16 bp, Homo sapiens
ttattcaagttattgt

SEQ ID NO: 3186423 - DNA, 16 bp, Homo sapiens
ttattcacatatatca

SEQ ID NO: 3186424 - DNA, 20 bp, Homo sapiens
ttattcaggaagataaaaat

SEQ ID NO: 3186425 - DNA, 24 bp, Homo sapiens
ttattcataatgaattataacagt

SEQ ID NO: 3186426 - DNA, 11 bp, Homo sapiens
ttattcattgg

SEQ ID NO: 3186427 - DNA, 14 bp, Homo sapiens
ttattcatttgagt

SEQ ID NO: 3186428 - DNA, 19 bp, Homo sapiens
ttattccatattcatgtaa

SEQ ID NO: 3186429 - DNA, 13 bp, Homo sapiens
ttattccatcaat

SEQ ID NO: 3186430 - DNA, 20 bp, Homo sapiens
ttattccccattcttcctag

SEQ ID NO: 3186431 - DNA, 15 bp, Homo sapiens
ttattccctcatcct

SEQ ID NO: 3186432 - DNA, 16 bp, Homo sapiens
ttattcctcttattgg

SEQ ID NO: 3186433 - DNA, 17 bp, Homo sapiens
ttattcctgataataat

SEQ ID NO: 3186434 - DNA, 13 bp, Homo sapiens
ttattcctgtatg

SEQ ID NO: 3186435 - DNA, 19 bp, Homo sapiens
ttattcctgtatgttgtcc

SEQ ID NO: 3186436 - DNA, 16 bp, Homo sapiens
ttattccttgatcatt

SEQ ID NO: 3186437 - DNA, 20 bp, Homo sapiens
ttattctaagccctttgcca

SEQ ID NO: 3186438 - DNA, 15 bp, Homo sapiens
ttattctaataaata

SEQ ID NO: 3186439 - DNA, 22 bp, Homo sapiens
ttattctagggtttcttaaata

SEQ ID NO: 3186440 - DNA, 16 bp, Homo sapiens
ttattctcaaagcagg

SEQ ID NO: 3186441 - DNA, 23 bp, Homo sapiens
ttattctgggcaccacaaaatat

SEQ ID NO: 3186442 - DNA, 20 bp, Homo sapiens
ttattctgtagattctgtgg

SEQ ID NO: 3186443 - DNA, 17 bp, Homo sapiens
ttattcttattactatt

SEQ ID NO: 3186444 - DNA, 13 bp, Homo sapiens
ttattcttctaga

SEQ ID NO: 3186445 - DNA, 14 bp, Homo sapiens
ttattcttctagag

SEQ ID NO: 3186446 - DNA, 12 bp, Homo sapiens
ttattcttctca

SEQ ID NO: 3186447 - DNA, 16 bp, Homo sapiens
ttattcttgctgggca

SEQ ID NO: 3186448 - DNA, 16 bp, Homo sapiens
ttattctttgaaaaca

SEQ ID NO: 3186449 - DNA, 21 bp, Homo sapiens
ttattgaaaaaaaaaatgttg

SEQ ID NO: 3186450 - DNA, 22 bp, Homo sapiens
ttattgaaggaagccaaattta

SEQ ID NO: 3186451 - DNA, 23 bp, Homo sapiens
ttattgaaggaagccaaatttat

SEQ ID NO: 3186452 - DNA, 19 bp, Homo sapiens
ttattgaatatttatacta

SEQ ID NO: 3186453 - DNA, 16 bp, Homo sapiens
ttattgaatcttaatt

SEQ ID NO: 3186454 - DNA, 14 bp, Homo sapiens
ttattgacacagaa

SEQ ID NO: 3186455 - DNA, 13 bp, Homo sapiens
ttattgaccattt

SEQ ID NO: 3186456 - DNA, 22 bp, Homo sapiens
ttattgaccattttttaattta

SEQ ID NO: 3186457 - DNA, 22 bp, Homo sapiens
ttattgagggtcattctttatt

SEQ ID NO: 3186458 - DNA, 17 bp, Homo sapiens
ttattgcttagtaaaat

SEQ ID NO: 3186459 - DNA, 17 bp, Homo sapiens
ttattgcttattgctta

SEQ ID NO: 3186460 - DNA, 17 bp, Homo sapiens
ttattggaaatgtactt

SEQ ID NO: 3186461 - DNA, 19 bp, Homo sapiens
ttattggaagtgttcaaga

SEQ ID NO: 3186462 - DNA, 13 bp, Homo sapiens
ttattggaattaa

SEQ ID NO: 3186463 - DNA, 16 bp, Homo sapiens
ttattggaattaacct

SEQ ID NO: 3186464 - DNA, 22 bp, Homo sapiens
ttattggatatttgatatttgg

SEQ ID NO: 3186465 - DNA, 14 bp, Homo sapiens
ttattggctgagat

SEQ ID NO: 3186466 - DNA, 16 bp, Homo sapiens
ttattggctgagatat

SEQ ID NO: 3186467 - DNA, 23 bp, Homo sapiens
ttattgggatgtgagccccaggg

SEQ ID NO: 3186468 - DNA, 19 bp, Homo sapiens
ttattgggcaagtgattga

SEQ ID NO: 3186469 - DNA, 20 bp, Homo sapiens
ttattgggcaagtgattgaa

SEQ ID NO: 3186470 - DNA, 12 bp, Homo sapiens
ttattgtaaatt

SEQ ID NO: 3186471 - DNA, 20 bp, Homo sapiens
ttattgtaagttgtacaaat

SEQ ID NO: 3186472 - DNA, 21 bp, Homo sapiens
ttattgtaagttgtacaaatg

SEQ ID NO: 3186473 - DNA, 23 bp, Homo sapiens
ttattgtaagttgtacaaatgta

SEQ ID NO: 3186474 - DNA, 19 bp, Homo sapiens
ttattgtacagctgtttaa

SEQ ID NO: 3186475 - DNA, 12 bp, Homo sapiens
ttattgtacctc

SEQ ID NO: 3186476 - DNA, 20 bp, Homo sapiens
ttcaagcctgtgcaatgcat

SEQ ID NO: 3186477 - DNA, 14 bp, Homo sapiens
ttcaagcctgtggg

SEQ ID NO: 3186478 - DNA, 16 bp, Homo sapiens
ttcaaggaatttctta

SEQ ID NO: 3186479 - DNA, 18 bp, Homo sapiens
ttcaaggagaatatgata

SEQ ID NO: 3186480 - DNA, 14 bp, Homo sapiens
ttcaaggcactcta

SEQ ID NO: 3186481 - DNA, 16 bp, Homo sapiens
ttcaaggcactctaga

SEQ ID NO: 3186482 - DNA, 21 bp, Homo sapiens
ttcaagggaagaaacactctt

SEQ ID NO: 3186483 - DNA, 14 bp, Homo sapiens
ttcaaggtgacaga

SEQ ID NO: 3186484 - DNA, 16 bp, Homo sapiens
ttcaagtaattgtgaa

SEQ ID NO: 3186485 - DNA, 11 bp, Homo sapiens
ttcaagtgcct

SEQ ID NO: 3186486 - DNA, 20 bp, Homo sapiens
ttcaagtgccttttgctgcg

SEQ ID NO: 3186487 - DNA, 23 bp, Homo sapiens
ttcaagtgccttttgctgcgcac

SEQ ID NO: 3186488 - DNA, 24 bp, Homo sapiens
ttcaagtgccttttgctgcgcacc

SEQ ID NO: 3186489 - DNA, 14 bp, Homo sapiens
ttcaagttcaatcc

SEQ ID NO: 3186490 - DNA, 23 bp, Homo sapiens
ttcaagttccaagttgctaatac

SEQ ID NO: 3186491 - DNA, 13 bp, Homo sapiens
ttcaagttgtaaa

SEQ ID NO: 3186492 - DNA, 14 bp, Homo sapiens
ttcaagttttaaag

SEQ ID NO: 3186493 - DNA, 18 bp, Homo sapiens
ttcaagttttaaagttca

SEQ ID NO: 3186494 - DNA, 20 bp, Homo sapiens
ttcaagttttgggtatgttt

SEQ ID NO: 3186495 - DNA, 21 bp, Homo sapiens
ttcaataaaagataaattatt

SEQ ID NO: 3186496 - DNA, 20 bp, Homo sapiens
ttcaataaagcatttataaa

SEQ ID NO: 3186497 - DNA, 13 bp, Homo sapiens
ttcaataaatctt

SEQ ID NO: 3186498 - DNA, 19 bp, Homo sapiens
ttcaataaatctttggaaa

SEQ ID NO: 3186499 - DNA, 21 bp, Homo sapiens
ttcaatacagtgaaggtcttt

SEQ ID NO: 3186500 - DNA, 14 bp, Homo sapiens
ttcaatagaactgt

SEQ ID NO: 3186501 - DNA, 12 bp, Homo sapiens
ttcaatatgcaa

SEQ ID NO: 3186502 - DNA, 15 bp, Homo sapiens
ttcaatctgtaaact

SEQ ID NO: 3186503 - DNA, 16 bp, Homo sapiens
ttcaatctgtaaactg

SEQ ID NO: 3186504 - DNA, 16 bp, Homo sapiens
ttcaatgatagtaaga

SEQ ID NO: 3186505 - DNA, 19 bp, Homo sapiens
ttcaatgattatttgtatt

SEQ ID NO: 3186506 - DNA, 16 bp, Homo sapiens
ttcaatgattcttcct

SEQ ID NO: 3186507 - DNA, 18 bp, Homo sapiens
ttcaatgcgttttgttgt

SEQ ID NO: 3186508 - DNA, 21 bp, Homo sapiens
ttcaatgtgtataaattgtct

SEQ ID NO: 3186509 - DNA, 13 bp, Homo sapiens
ttcaatgttccat

SEQ ID NO: 3186510 - DNA, 15 bp, Homo sapiens
ttcaatgtttgaaat

SEQ ID NO: 3186511 - DNA, 13 bp, Homo sapiens
ttcaattaatgct

SEQ ID NO: 3186512 - DNA, 21 bp, Homo sapiens
ttcaattacaaagcagttact

SEQ ID NO: 3186513 - DNA, 16 bp, Homo sapiens
ttcaattacggactct

SEQ ID NO: 3186514 - DNA, 14 bp, Homo sapiens
ttcaattcctgggc

SEQ ID NO: 3186515 - DNA, 18 bp, Homo sapiens
ttcaattctcatttgtca

SEQ ID NO: 3186516 - DNA, 12 bp, Homo sapiens
ttcaattgtaaa

SEQ ID NO: 3186517 - DNA, 17 bp, Homo sapiens
ttcacaaacttttatac

SEQ ID NO: 3186518 - DNA, 13 bp, Homo sapiens
ttcacaataaaag

SEQ ID NO: 3186519 - DNA, 16 bp, Homo sapiens
ttcacaattattaaat

SEQ ID NO: 3186520 - DNA, 19 bp, Homo sapiens
ttcacaattattaaattgt

SEQ ID NO: 3186521 - DNA, 16 bp, Homo sapiens
ttcacaattattccaa

SEQ ID NO: 3186522 - DNA, 17 bp, Homo sapiens
ttcacaccccaggccct

SEQ ID NO: 3186523 - DNA, 14 bp, Homo sapiens
ttcacacctgactc

SEQ ID NO: 3186524 - DNA, 21 bp, Homo sapiens
ttcacacctgactctgaaatc

SEQ ID NO: 3186525 - DNA, 13 bp, Homo sapiens
ttcacaggcactc

SEQ ID NO: 3186526 - DNA, 17 bp, Homo sapiens
ttcacaggcagtgcatg

SEQ ID NO: 3186527 - DNA, 18 bp, Homo sapiens
ttcacaggcagtgcatgt

SEQ ID NO: 3186528 - DNA, 21 bp, Homo sapiens
ttcacaggctgtaaattgaac

SEQ ID NO: 3186529 - DNA, 15 bp, Homo sapiens
ttcacagtagagcca

SEQ ID NO: 3186530 - DNA, 19 bp, Homo sapiens
ttcacagtagagccagctt

SEQ ID NO: 3186531 - DNA, 17 bp, Homo sapiens
ttcacagtcccaggttt

SEQ ID NO: 3186532 - DNA, 13 bp, Homo sapiens
ttcacagtttttc

SEQ ID NO: 3186533 - DNA, 19 bp, Homo sapiens
ttcacatgagctatttcca

SEQ ID NO: 3186534 - DNA, 20 bp, Homo sapiens
ttcacattaatggtctaaaa

SEQ ID NO: 3186535 - DNA, 17 bp, Homo sapiens
ttcacattgtgtgaata

SEQ ID NO: 3186536 - DNA, 19 bp, Homo sapiens
ttcacattgtttgctgcta

SEQ ID NO: 3186537 - DNA, 15 bp, Homo sapiens
ttcaccaaaaccaaa

SEQ ID NO: 3186538 - DNA, 13 bp, Homo sapiens
ttcaccaaaatta

SEQ ID NO: 3186539 - DNA, 17 bp, Homo sapiens
ttcaccaggggtgctca

SEQ ID NO: 3186540 - DNA, 16 bp, Homo sapiens
ttcaccagtctgtcta

SEQ ID NO: 3186541 - DNA, 19 bp, Homo sapiens
ttcaccagtctgtctactg

SEQ ID NO: 3186542 - DNA, 20 bp, Homo sapiens
ttcaccagtctgtctactgt

SEQ ID NO: 3186543 - DNA, 14 bp, Homo sapiens
ttcacccaccatgc

SEQ ID NO: 3186544 - DNA, 16 bp, Homo sapiens
ttcacccatcttatca

SEQ ID NO: 3186545 - DNA, 18 bp, Homo sapiens
ttcacccatcttatcaag

SEQ ID NO: 3186546 - DNA, 17 bp, Homo sapiens
ttcaccccccactcacc

SEQ ID NO: 3186547 - DNA, 16 bp, Homo sapiens
ttcaccccctttcctg

SEQ ID NO: 3186548 - DNA, 17 bp, Homo sapiens
ttcacccctgcacttca

SEQ ID NO: 3186549 - DNA, 22 bp, Homo sapiens
ttcaccctgtcaagttaacaag

SEQ ID NO: 3186550 - DNA, 19 bp, Homo sapiens
ttcaccgtgttagccagga

SEQ ID NO: 3186551 - DNA, 14 bp, Homo sapiens
ttcacctctatcca

SEQ ID NO: 3186552 - DNA, 17 bp, Homo sapiens
ttcacctgtaaacctga

SEQ ID NO: 3186553 - DNA, 18 bp, Homo sapiens
ttcacctgttatgtatga

SEQ ID NO: 3186554 - DNA, 23 bp, Homo sapiens
ttcacctgttatgtatgaaggaa

SEQ ID NO: 3186555 - DNA, 19 bp, Homo sapiens
ttcacctgtttttaagctg

SEQ ID NO: 3186556 - DNA, 21 bp, Homo sapiens
ttcacctgtttttaagctgtt

SEQ ID NO: 3186557 - DNA, 14 bp, Homo sapiens
ttcacgcccttggc

SEQ ID NO: 3186558 - DNA, 16 bp, Homo sapiens
ttcacggcagaccaga

SEQ ID NO: 3186559 - DNA, 20 bp, Homo sapiens
ttcacgtaagatacaagttt

SEQ ID NO: 3186560 - DNA, 14 bp, Homo sapiens
ttcactaaagcagt

SEQ ID NO: 3186561 - DNA, 19 bp, Homo sapiens
ttcactagagacaaatctt

SEQ ID NO: 3186562 - DNA, 18 bp, Homo sapiens
ttcactataaatggtgtt

SEQ ID NO: 3186563 - DNA, 12 bp, Homo sapiens
ttcactatttaa

SEQ ID NO: 3186564 - DNA, 20 bp, Homo sapiens
ttcactatttttatttatat

SEQ ID NO: 3186565 - DNA, 15 bp, Homo sapiens
ttcactcaagcactg

SEQ ID NO: 3186566 - DNA, 17 bp, Homo sapiens
ttcactccccctaaacc

SEQ ID NO: 3186567 - DNA, 22 bp, Homo sapiens
ttcactccggtgtgcctgcagc

SEQ ID NO: 3186568 - DNA, 24 bp, Homo sapiens
ttcactccggtgtgcctgcagccc

SEQ ID NO: 3186569 - DNA, 12 bp, Homo sapiens
ttcactgagctc

SEQ ID NO: 3186570 - DNA, 21 bp, Homo sapiens
ttcactgagctccccagatct

SEQ ID NO: 3186571 - DNA, 20 bp, Homo sapiens
ttcactgccatgatagctgg

SEQ ID NO: 3186572 - DNA, 24 bp, Homo sapiens
ttcactgccatgatagctggggct

SEQ ID NO: 3186573 - DNA, 19 bp, Homo sapiens
ttcactgctggctgcctta

SEQ ID NO: 3186574 - DNA, 22 bp, Homo sapiens
ttcactggcccctactttgtgg

SEQ ID NO: 3186575 - DNA, 15 bp, Homo sapiens
ttcactgtataaact

SEQ ID NO: 3186576 - DNA, 22 bp, Homo sapiens
ttcactgttagctttttaaaac

SEQ ID NO: 3186577 - DNA, 12 bp, Homo sapiens
ttcacttcaaaa

SEQ ID NO: 3186578 - DNA, 20 bp, Homo sapiens
ttcacttcgggctgtgtaaa

SEQ ID NO: 3186579 - DNA, 17 bp, Homo sapiens
ttcacttgtattgactt

SEQ ID NO: 3186580 - DNA, 16 bp, Homo sapiens
ttcactttagatgctg

SEQ ID NO: 3186581 - DNA, 17 bp, Homo sapiens
ttcactttagatgctga

SEQ ID NO: 3186582 - DNA, 17 bp, Homo sapiens
ttcactttcaaaaacat

SEQ ID NO: 3186583 - DNA, 19 bp, Homo sapiens
ttcactttcacatagatgt

SEQ ID NO: 3186584 - DNA, 15 bp, Homo sapiens
ttcagaaactacaga

SEQ ID NO: 3186585 - DNA, 21 bp, Homo sapiens
ttcagaaatataacacatttt

SEQ ID NO: 3186586 - DNA, 13 bp, Homo sapiens
ttcagaaatatgt

SEQ ID NO: 3186587 - DNA, 13 bp, Homo sapiens
ttcagaaattgga

SEQ ID NO: 3186588 - DNA, 17 bp, Homo sapiens
ttcagaacctcttcccc

SEQ ID NO: 3186589 - DNA, 23 bp, Homo sapiens
ttcagaactgcccttgctgcccg

SEQ ID NO: 3186590 - DNA, 16 bp, Homo sapiens
ttcagaagaaataaat

SEQ ID NO: 3186591 - DNA, 12 bp, Homo sapiens
ttcagaagagat

SEQ ID NO: 3186592 - DNA, 16 bp, Homo sapiens
ttcagaagctattttt

SEQ ID NO: 3186593 - DNA, 14 bp, Homo sapiens
ttcagaatatctta

SEQ ID NO: 3186594 - DNA, 17 bp, Homo sapiens
ttcagaattaaactttt

SEQ ID NO: 3186595 - DNA, 15 bp, Homo sapiens
ttcagacaagcaaca

SEQ ID NO: 3186596 - DNA, 20 bp, Homo sapiens
ttcagacacctgttcacaga

SEQ ID NO: 3186597 - DNA, 22 bp, Homo sapiens
ttcagacacctgttcacagaaa

SEQ ID NO: 3186598 - DNA, 16 bp, Homo sapiens
ttcagacactttggaa

SEQ ID NO: 3186599 - DNA, 10 bp, Homo sapiens
ttcagacagg

SEQ ID NO: 3186600 - DNA, 15 bp, Homo sapiens
ttcagacccctgcct

SEQ ID NO: 3186601 - DNA, 16 bp, Homo sapiens
ttcagacccctgcctg

SEQ ID NO: 3186602 - DNA, 14 bp, Homo sapiens
agcccttctgcctt

SEQ ID NO: 3186603 - DNA, 15 bp, Homo sapiens
agcccttctgccttt

SEQ ID NO: 3186604 - DNA, 17 bp, Homo sapiens
agcccttctgcctttct

SEQ ID NO: 3186605 - DNA, 14 bp, Homo sapiens
agcccttgccccca

SEQ ID NO: 3186606 - DNA, 14 bp, Homo sapiens
agccctttaaaacg

SEQ ID NO: 3186607 - DNA, 21 bp, Homo sapiens
agccctttacttgacctccta

SEQ ID NO: 3186608 - DNA, 13 bp, Homo sapiens
agccctttctgtg

SEQ ID NO: 3186609 - DNA, 18 bp, Homo sapiens
agccctttctgtgtgcac

SEQ ID NO: 3186610 - DNA, 15 bp, Homo sapiens
agccctttggagaac

SEQ ID NO: 3186611 - DNA, 23 bp, Homo sapiens
agccctttggagaacgccagtct

SEQ ID NO: 3186612 - DNA, 12 bp, Homo sapiens
agccgactctgg

SEQ ID NO: 3186613 - DNA, 16 bp, Homo sapiens
agccgactctggccct

SEQ ID NO: 3186614 - DNA, 17 bp, Homo sapiens
agccgactctggccctg

SEQ ID NO: 3186615 - DNA, 19 bp, Homo sapiens
agccgactctggccctggc

SEQ ID NO: 3186616 - DNA, 17 bp, Homo sapiens
agccgactgcgctgctt

SEQ ID NO: 3186617 - DNA, 17 bp, Homo sapiens
agccgagatcacgccac

SEQ ID NO: 3186618 - DNA, 21 bp, Homo sapiens
agccgagattgcgccactgca

SEQ ID NO: 3186619 - DNA, 17 bp, Homo sapiens
agccgagccgggcctgg

SEQ ID NO: 3186620 - DNA, 14 bp, Homo sapiens
agccgcagcctccc

SEQ ID NO: 3186621 - DNA, 18 bp, Homo sapiens
agccgcagcctccctctg

SEQ ID NO: 3186622 - DNA, 15 bp, Homo sapiens
agccgccagctggga

SEQ ID NO: 3186623 - DNA, 20 bp, Homo sapiens
agccgccattgccaccagga

SEQ ID NO: 3186624 - DNA, 21 bp, Homo sapiens
agccgccattgccaccaggag

SEQ ID NO: 3186625 - DNA, 22 bp, Homo sapiens
agccgccattgccaccaggaga

SEQ ID NO: 3186626 - DNA, 15 bp, Homo sapiens
agccgccccagcccc

SEQ ID NO: 3186627 - DNA, 15 bp, Homo sapiens
agccgctaggagaga

SEQ ID NO: 3186628 - DNA, 21 bp, Homo sapiens
agccgctgcagggctcccatg

SEQ ID NO: 3186629 - DNA, 16 bp, Homo sapiens
agccgctgtgagcccc

SEQ ID NO: 3186630 - DNA, 23 bp, Homo sapiens
agccggcctctctggcctcccac

SEQ ID NO: 3186631 - DNA, 17 bp, Homo sapiens
agccgggcccctgggct

SEQ ID NO: 3186632 - DNA, 20 bp, Homo sapiens
agccggggagtttctttcct

SEQ ID NO: 3186633 - DNA, 22 bp, Homo sapiens
agccggtgcctggcgcccctgc

SEQ ID NO: 3186634 - DNA, 15 bp, Homo sapiens
agccgtattttacat

SEQ ID NO: 3186635 - DNA, 16 bp, Homo sapiens
agccgtcagccaaatg

SEQ ID NO: 3186636 - DNA, 19 bp, Homo sapiens
agccgtcagccaaatgtaa

SEQ ID NO: 3186637 - DNA, 20 bp, Homo sapiens
agccgtcagccaaatgtaat

SEQ ID NO: 3186638 - DNA, 18 bp, Homo sapiens
agccgtctgactccagag

SEQ ID NO: 3186639 - DNA, 17 bp, Homo sapiens
agccgtgatgctcaggc

SEQ ID NO: 3186640 - DNA, 18 bp, Homo sapiens
agccgtgatgctcaggct

SEQ ID NO: 3186641 - DNA, 19 bp, Homo sapiens
agccgtgatgctcaggctt

SEQ ID NO: 3186642 - DNA, 16 bp, Homo sapiens
agccgtgccttcagct

SEQ ID NO: 3186643 - DNA, 21 bp, Homo sapiens
agccgtggcttcccgctcagc

SEQ ID NO: 3186644 - DNA, 22 bp, Homo sapiens
agccgtggcttcccgctcagcc

SEQ ID NO: 3186645 - DNA, 22 bp, Homo sapiens
agcctaaatgccttagaaatgt

SEQ ID NO: 3186646 - DNA, 19 bp, Homo sapiens
agcctaaggctcctgtttt

SEQ ID NO: 3186647 - DNA, 13 bp, Homo sapiens
agcctactctcct

SEQ ID NO: 3186648 - DNA, 14 bp, Homo sapiens
agcctactctcctt

SEQ ID NO: 3186649 - DNA, 13 bp, Homo sapiens
agcctagcggagc

SEQ ID NO: 3186650 - DNA, 20 bp, Homo sapiens
agcctagcggagcccagcct

SEQ ID NO: 3186651 - DNA, 17 bp, Homo sapiens
agcctagctcctgccac

SEQ ID NO: 3186652 - DNA, 18 bp, Homo sapiens
agcctaggaccactcagc

SEQ ID NO: 3186653 - DNA, 22 bp, Homo sapiens
agcctaggaccactcagcccct

SEQ ID NO: 3186654 - DNA, 17 bp, Homo sapiens
agcctaggtgacagagt

SEQ ID NO: 3186655 - DNA, 19 bp, Homo sapiens
agcctagtttttaatagct

SEQ ID NO: 3186656 - DNA, 17 bp, Homo sapiens
agcctatgagcatcctg

SEQ ID NO: 3186657 - DNA, 13 bp, Homo sapiens
agcctatgttgtg

SEQ ID NO: 3186658 - DNA, 15 bp, Homo sapiens
agcctatttacctgc

SEQ ID NO: 3186659 - DNA, 20 bp, Homo sapiens
agcctatttacctgcaggct

SEQ ID NO: 3186660 - DNA, 21 bp, Homo sapiens
agcctatttacctgcaggctg

SEQ ID NO: 3186661 - DNA, 17 bp, Homo sapiens
agcctcaacctcctggg

SEQ ID NO: 3186662 - DNA, 21 bp, Homo sapiens
agcctcaaggttttaggttct

SEQ ID NO: 3186663 - DNA, 22 bp, Homo sapiens
agcctcaaggttttaggttcta

SEQ ID NO: 3186664 - DNA, 14 bp, Homo sapiens
agcctcaccaaggt

SEQ ID NO: 3186665 - DNA, 14 bp, Homo sapiens
agcctcacccttgc

SEQ ID NO: 3186666 - DNA, 22 bp, Homo sapiens
agcctcacttgaatgtgtcact

SEQ ID NO: 3186667 - DNA, 16 bp, Homo sapiens
agcctcacttgccctc

SEQ ID NO: 3186668 - DNA, 18 bp, Homo sapiens
agcctcagaccccaggtc

SEQ ID NO: 3186669 - DNA, 23 bp, Homo sapiens
agcctcagaccccaggtcagcat

SEQ ID NO: 3186670 - DNA, 17 bp, Homo sapiens
agcctcagaggagctct

SEQ ID NO: 3186671 - DNA, 16 bp, Homo sapiens
agcctcagcatcctgg

SEQ ID NO: 3186672 - DNA, 18 bp, Homo sapiens
agcctcagtcctcccctc

SEQ ID NO: 3186673 - DNA, 15 bp, Homo sapiens
agcctcatatttaaa

SEQ ID NO: 3186674 - DNA, 20 bp, Homo sapiens
agcctcattctgaggcctga

SEQ ID NO: 3186675 - DNA, 13 bp, Homo sapiens
agcctccaagggt

SEQ ID NO: 3186676 - DNA, 14 bp, Homo sapiens
agcctccacggaga

SEQ ID NO: 3186677 - DNA, 18 bp, Homo sapiens
agcctccacggagagccc

SEQ ID NO: 3186678 - DNA, 12 bp, Homo sapiens
agcctccagagc

SEQ ID NO: 3186679 - DNA, 14 bp, Homo sapiens
agcctccagggccc

SEQ ID NO: 3186680 - DNA, 17 bp, Homo sapiens
agcctccatgctgcctc

SEQ ID NO: 3186681 - DNA, 14 bp, Homo sapiens
agcctcccaaagtg

SEQ ID NO: 3186682 - DNA, 13 bp, Homo sapiens
agcctcccacccc

SEQ ID NO: 3186683 - DNA, 18 bp, Homo sapiens
agcctcccgaatagctgg

SEQ ID NO: 3186684 - DNA, 17 bp, Homo sapiens
agcctcccgagtagctg

SEQ ID NO: 3186685 - DNA, 13 bp, Homo sapiens
agcctccctctga

SEQ ID NO: 3186686 - DNA, 15 bp, Homo sapiens
agcctccctctgacc

SEQ ID NO: 3186687 - DNA, 11 bp, Homo sapiens
agcctccctga

SEQ ID NO: 3186688 - DNA, 18 bp, Homo sapiens
agcctccgagagggagag

SEQ ID NO: 3186689 - DNA, 20 bp, Homo sapiens
agcctccgccaagatctaca

SEQ ID NO: 3186690 - DNA, 15 bp, Homo sapiens
agcctccggaagctg

SEQ ID NO: 3186691 - DNA, 23 bp, Homo sapiens
agcctccgtttatgggccttgct

SEQ ID NO: 3186692 - DNA, 13 bp, Homo sapiens
agcctcctcctga

SEQ ID NO: 3186693 - DNA, 12 bp, Homo sapiens
agcctcctctgg

SEQ ID NO: 3186694 - DNA, 14 bp, Homo sapiens
agcctcctctggac

SEQ ID NO: 3186695 - DNA, 12 bp, Homo sapiens
agcctcctgagc

SEQ ID NO: 3186696 - DNA, 13 bp, Homo sapiens
agcctcctgagcc

SEQ ID NO: 3186697 - DNA, 16 bp, Homo sapiens
agcctcctgagcctgt

SEQ ID NO: 3186698 - DNA, 20 bp, Homo sapiens
agcctcctgtacctcagtgg

SEQ ID NO: 3186699 - DNA, 23 bp, Homo sapiens
agcctctccaggcaccatctccc

SEQ ID NO: 3186700 - DNA, 22 bp, Homo sapiens
agcctctccccaggtccagctc

SEQ ID NO: 3186701 - DNA, 13 bp, Homo sapiens
agcctctcccggc

SEQ ID NO: 3186702 - DNA, 14 bp, Homo sapiens
agcctctcccggct

SEQ ID NO: 3186703 - DNA, 18 bp, Homo sapiens
agcctctcccggctgcct

SEQ ID NO: 3186704 - DNA, 19 bp, Homo sapiens
agcctctcccggctgcctg

SEQ ID NO: 3186705 - DNA, 22 bp, Homo sapiens
agcctctcccggctgcctgccg

SEQ ID NO: 3186706 - DNA, 18 bp, Homo sapiens
agcctctgacccctcctc

SEQ ID NO: 3186707 - DNA, 21 bp, Homo sapiens
agcctctgacccctcctcact

SEQ ID NO: 3186708 - DNA, 12 bp, Homo sapiens
agcctctgctgc

SEQ ID NO: 3186709 - DNA, 13 bp, Homo sapiens
agcctctgctgcc

SEQ ID NO: 3186710 - DNA, 18 bp, Homo sapiens
agcctctgctgccatggc

SEQ ID NO: 3186711 - DNA, 13 bp, Homo sapiens
agcctctggctag

SEQ ID NO: 3186712 - DNA, 13 bp, Homo sapiens
agcctctggctcc

SEQ ID NO: 3186713 - DNA, 14 bp, Homo sapiens
agcctctggctcca

SEQ ID NO: 3186714 - DNA, 23 bp, Homo sapiens
agcctcttaaagctgcctgtagt

SEQ ID NO: 3186715 - DNA, 12 bp, Homo sapiens
agcctgagcctt

SEQ ID NO: 3186716 - DNA, 15 bp, Homo sapiens
agcctgagccttagc

SEQ ID NO: 3186717 - DNA, 16 bp, Homo sapiens
agcctgagccttagct

SEQ ID NO: 3186718 - DNA, 21 bp, Homo sapiens
agcctgaggcagccacttcgg

SEQ ID NO: 3186719 - DNA, 19 bp, Homo sapiens
agcctgagtcacctgcaga

SEQ ID NO: 3186720 - DNA, 20 bp, Homo sapiens
agcctgagtcagggcccaga

SEQ ID NO: 3186721 - DNA, 20 bp, Homo sapiens
agcctgatctcttcctgttt

SEQ ID NO: 3186722 - DNA, 23 bp, Homo sapiens
agcctgatggccaagggggtgga

SEQ ID NO: 3186723 - DNA, 15 bp, Homo sapiens
agcctgattgaaaag

SEQ ID NO: 3186724 - DNA, 15 bp, Homo sapiens
agcctgcattgagct

SEQ ID NO: 3186725 - DNA, 18 bp, Homo sapiens
agcctgcccgctgcaatg

SEQ ID NO: 3186726 - DNA, 18 bp, Homo sapiens
agcctgcctaaccaggcc

SEQ ID NO: 3186727 - DNA, 21 bp, Homo sapiens
agcctgcctaaccaggcccag

SEQ ID NO: 3186728 - DNA, 20 bp, Homo sapiens
agcctgcctcagtggcagca

SEQ ID NO: 3186729 - DNA, 14 bp, Homo sapiens
agcctgcctggcag

SEQ ID NO: 3186730 - DNA, 16 bp, Homo sapiens
agcctgctgagagccc

SEQ ID NO: 3186731 - DNA, 14 bp, Homo sapiens
agcctgctggctgc

SEQ ID NO: 3186732 - DNA, 19 bp, Homo sapiens
agcctgctggctgcggccc

SEQ ID NO: 3186733 - DNA, 19 bp, Homo sapiens
agcctgcttcccacctccc

SEQ ID NO: 3186734 - DNA, 23 bp, Homo sapiens
agcctgcttcccacctccctgcc

SEQ ID NO: 3186735 - DNA, 15 bp, Homo sapiens
agcctggacccccag

SEQ ID NO: 3186736 - DNA, 14 bp, Homo sapiens
agcctggactctgc

SEQ ID NO: 3186737 - DNA, 16 bp, Homo sapiens
agcctggactctgccc

SEQ ID NO: 3186738 - DNA, 17 bp, Homo sapiens
agcctggactctgcccc

SEQ ID NO: 3186739 - DNA, 18 bp, Homo sapiens
agcctggactctgcccca

SEQ ID NO: 3186740 - DNA, 20 bp, Homo sapiens
agcctggatgccaaggagcc

SEQ ID NO: 3186741 - DNA, 17 bp, Homo sapiens
agcctggcacagggcag

SEQ ID NO: 3186742 - DNA, 18 bp, Homo sapiens
agcctggcacagggcagt

SEQ ID NO: 3186743 - DNA, 20 bp, Homo sapiens
agcctggcacagggcagtgg

SEQ ID NO: 3186744 - DNA, 14 bp, Homo sapiens
agcctggccaacat

SEQ ID NO: 3186745 - DNA, 16 bp, Homo sapiens
agcctggccctgaagc

SEQ ID NO: 3186746 - DNA, 15 bp, Homo sapiens
agcctggcttctgga

SEQ ID NO: 3186747 - DNA, 18 bp, Homo sapiens
agcctggcttctggagcc

SEQ ID NO: 3186748 - DNA, 16 bp, Homo sapiens
agcctgggagcccaga

SEQ ID NO: 3186749 - DNA, 15 bp, Homo sapiens
agcctgggcagccag

SEQ ID NO: 3186750 - DNA, 18 bp, Homo sapiens
agcctgggcagccaggct

SEQ ID NO: 3186751 - DNA, 19 bp, Homo sapiens
agcctgggcagccaggctg

SEQ ID NO: 3186752 - DNA, 15 bp, Homo sapiens
agcctgggccagaga

SEQ ID NO: 3186753 - DNA, 15 bp, Homo sapiens
agcctgggcgacaga

SEQ ID NO: 3186754 - DNA, 16 bp, Homo sapiens
agcctggggcctggca

SEQ ID NO: 3186755 - DNA, 12 bp, Homo sapiens
agcctggggctc

SEQ ID NO: 3186756 - DNA, 14 bp, Homo sapiens
agcctggggctccc

SEQ ID NO: 3186757 - DNA, 16 bp, Homo sapiens
agcctggggtgttctc

SEQ ID NO: 3186758 - DNA, 14 bp, Homo sapiens
agcctggtgctgct

SEQ ID NO: 3186759 - DNA, 16 bp, Homo sapiens
agcctggtgctgctgc

SEQ ID NO: 3186760 - DNA, 17 bp, Homo sapiens
agcctgtaagcctgcaa

SEQ ID NO: 3186761 - DNA, 16 bp, Homo sapiens
agcctgtcatccttgg

SEQ ID NO: 3186762 - DNA, 21 bp, Homo sapiens
agcctgtgcatgtatgtcttg

SEQ ID NO: 3186763 - DNA, 18 bp, Homo sapiens
agcctgtgcctctgggac

SEQ ID NO: 3186764 - DNA, 20 bp, Homo sapiens
agcctgtgctgtggcataga

SEQ ID NO: 3186765 - DNA, 21 bp, Homo sapiens
agcctgtgctgtggcatagac

SEQ ID NO: 3186766 - DNA, 22 bp, Homo sapiens
agcctgtggcagtaaagagaaa

SEQ ID NO: 3186767 - DNA, 23 bp, Homo sapiens
agcctgtggcagtaaagagaaac

SEQ ID NO: 3186768 - DNA, 21 bp, Homo sapiens
agcctgtggcatctttgcctt

SEQ ID NO: 3186769 - DNA, 11 bp, Homo sapiens
agcctgtggga

SEQ ID NO: 3186770 - DNA, 14 bp, Homo sapiens
agcctgttcccctc

SEQ ID NO: 3186771 - DNA, 18 bp, Homo sapiens
agcctgtttcttcctgtt

SEQ ID NO: 3186772 - DNA, 13 bp, Homo sapiens
agccttaagctta

SEQ ID NO: 3186773 - DNA, 12 bp, Homo sapiens
agccttaatttt

SEQ ID NO: 3186774 - DNA, 20 bp, Homo sapiens
agccttagaagtcacacagt

SEQ ID NO: 3186775 - DNA, 22 bp, Homo sapiens
agccttagaagtcacacagtat

SEQ ID NO: 3186776 - DNA, 15 bp, Homo sapiens
agccttagctgccag

SEQ ID NO: 3186777 - DNA, 20 bp, Homo sapiens
agccttagggaagctggcct

SEQ ID NO: 3186778 - DNA, 21 bp, Homo sapiens
agccttataaaccaatcttaa

SEQ ID NO: 3186779 - DNA, 17 bp, Homo sapiens
agccttatcaagtgtct

SEQ ID NO: 3186780 - DNA, 16 bp, Homo sapiens
agccttattctaaggt

SEQ ID NO: 3186781 - DNA, 17 bp, Homo sapiens
agccttattctaaggtg

SEQ ID NO: 3186782 - DNA, 13 bp, Homo sapiens
agccttcaagtgc

SEQ ID NO: 3186783 - DNA, 14 bp, Homo sapiens
agccttcagctcca

SEQ ID NO: 3186784 - DNA, 19 bp, Homo sapiens
agccttccccctcccaggg

SEQ ID NO: 3186785 - DNA, 16 bp, Homo sapiens
agccttctccctagct

SEQ ID NO: 3186786 - DNA, 15 bp, Homo sapiens
agccttctgatgtct

SEQ ID NO: 3186787 - DNA, 14 bp, Homo sapiens
agccttctgcagca

SEQ ID NO: 3186788 - DNA, 15 bp, Homo sapiens
agccttctgcagcag

SEQ ID NO: 3186789 - DNA, 17 bp, Homo sapiens
agccttgatttgttctt

SEQ ID NO: 3186790 - DNA, 21 bp, Homo sapiens
agccttgcctaaatttaatgc

SEQ ID NO: 3186791 - DNA, 13 bp, Homo sapiens
agccttggggcat

SEQ ID NO: 3186792 - DNA, 23 bp, Homo sapiens
agccttgggttccaaccaggcag

SEQ ID NO: 3186793 - DNA, 13 bp, Homo sapiens
agccttgtgccct

SEQ ID NO: 3186794 - DNA, 17 bp, Homo sapiens
agccttgtgccctgccc

SEQ ID NO: 3186795 - DNA, 10 bp, Homo sapiens
agccttgtgt

SEQ ID NO: 3186796 - DNA, 14 bp, Homo sapiens
agccttgtgtatat

SEQ ID NO: 3186797 - DNA, 22 bp, Homo sapiens
agccttgtgtatatttgtatat

SEQ ID NO: 3186798 - DNA, 13 bp, Homo sapiens
agccttgttgtga

SEQ ID NO: 3186799 - DNA, 19 bp, Homo sapiens
agcctttagtatcagtgtt

SEQ ID NO: 3186800 - DNA, 14 bp, Homo sapiens
agcctttccataag

SEQ ID NO: 3186801 - DNA, 15 bp, Homo sapiens
agcctttgcctcccc

SEQ ID NO: 3186802 - DNA, 16 bp, Homo sapiens
agcctttgcctccccg

SEQ ID NO: 3186803 - DNA, 16 bp, Homo sapiens
agcctttggctctgga

SEQ ID NO: 3186804 - DNA, 23 bp, Homo sapiens
agcctttggctctggagacagcc

SEQ ID NO: 3186805 - DNA, 17 bp, Homo sapiens
agccttttatactgatt

SEQ ID NO: 3186806 - DNA, 14 bp, Homo sapiens
agccttttatctgc

SEQ ID NO: 3186807 - DNA, 17 bp, Homo sapiens
agccttttatctgcaga

SEQ ID NO: 3186808 - DNA, 16 bp, Homo sapiens
agcgaagccttctgca

SEQ ID NO: 3186809 - DNA, 20 bp, Homo sapiens
agcgaagggggtcaaaggaa

SEQ ID NO: 3186810 - DNA, 17 bp, Homo sapiens
agcgaagtagcttgctc

SEQ ID NO: 3186811 - DNA, 20 bp, Homo sapiens
agcgaagtctcatgggaagc

SEQ ID NO: 3186812 - DNA, 19 bp, Homo sapiens
agcgaagtctttgccttct

SEQ ID NO: 3186813 - DNA, 19 bp, Homo sapiens
agcgacatagcccatccct

SEQ ID NO: 3186814 - DNA, 21 bp, Homo sapiens
agcgacatagcccatccctgc

SEQ ID NO: 3186815 - DNA, 19 bp, Homo sapiens
agcgagccctggtggcagt

SEQ ID NO: 3186816 - DNA, 15 bp, Homo sapiens
agcgagggcagctgc

SEQ ID NO: 3186817 - DNA, 13 bp, Homo sapiens
agcgagtcatttc

SEQ ID NO: 3186818 - DNA, 15 bp, Homo sapiens
agcgatatacagatg

SEQ ID NO: 3186819 - DNA, 20 bp, Homo sapiens
agcgatatacagatgaaaat

SEQ ID NO: 3186820 - DNA, 17 bp, Homo sapiens
agcgatctctcctggcc

SEQ ID NO: 3186821 - DNA, 19 bp, Homo sapiens
agcgatctctcctggccta

SEQ ID NO: 3186822 - DNA, 18 bp, Homo sapiens
agcgatgaatttggagac

SEQ ID NO: 3186823 - DNA, 19 bp, Homo sapiens
agcgatgaatttggagact

SEQ ID NO: 3186824 - DNA, 19 bp, Homo sapiens
agcgattcttctgcttcag

SEQ ID NO: 3186825 - DNA, 19 bp, Homo sapiens
agcgcagcagccctccccg

SEQ ID NO: 3186826 - DNA, 16 bp, Homo sapiens
agcgccaagcaacctg

SEQ ID NO: 3186827 - DNA, 14 bp, Homo sapiens
agcgcccagttggg

SEQ ID NO: 3186828 - DNA, 22 bp, Homo sapiens
agcgcccagttgggtggatgcc

SEQ ID NO: 3186829 - DNA, 14 bp, Homo sapiens
agcgcccctgctgt

SEQ ID NO: 3186830 - DNA, 16 bp, Homo sapiens
agcgcccctgctgtct

SEQ ID NO: 3186831 - DNA, 23 bp, Homo sapiens
agcgccgtgagttctcagggctc

SEQ ID NO: 3186832 - DNA, 18 bp, Homo sapiens
agcgcctccatccaaggc

SEQ ID NO: 3186833 - DNA, 20 bp, Homo sapiens
agcgcctccatccaaggcca

SEQ ID NO: 3186834 - DNA, 23 bp, Homo sapiens
agcgcctccatccaaggccaggt

SEQ ID NO: 3186835 - DNA, 22 bp, Homo sapiens
agcgcgccactcgcttccccca

SEQ ID NO: 3186836 - DNA, 13 bp, Homo sapiens
agcgcggaggagg

SEQ ID NO: 3186837 - DNA, 12 bp, Homo sapiens
agcgcggccagc

SEQ ID NO: 3186838 - DNA, 16 bp, Homo sapiens
agcgcggccagcgtcc

SEQ ID NO: 3186839 - DNA, 12 bp, Homo sapiens
agcgctcccagc

SEQ ID NO: 3186840 - DNA, 13 bp, Homo sapiens
agcgctcccagcc

SEQ ID NO: 3186841 - DNA, 14 bp, Homo sapiens
agcgctcccagcct

SEQ ID NO: 3186842 - DNA, 15 bp, Homo sapiens
agcgctcccagcctg

SEQ ID NO: 3186843 - DNA, 20 bp, Homo sapiens
agcgctcccagcctgccctc

SEQ ID NO: 3186844 - DNA, 16 bp, Homo sapiens
agcgctcctcctgtgt

SEQ ID NO: 3186845 - DNA, 18 bp, Homo sapiens
agcgctcctcctgtgtga

SEQ ID NO: 3186846 - DNA, 22 bp, Homo sapiens
agcgctcctcctgtgtgactgg

SEQ ID NO: 3186847 - DNA, 12 bp, Homo sapiens
agcgctctgcct

SEQ ID NO: 3186848 - DNA, 15 bp, Homo sapiens
agcggaaaagttgtc

SEQ ID NO: 3186849 - DNA, 13 bp, Homo sapiens
agcggagcccagc

SEQ ID NO: 3186850 - DNA, 18 bp, Homo sapiens
agcggagcccagcctggg

SEQ ID NO: 3186851 - DNA, 22 bp, Homo sapiens
agcggaggttgcagtgagctga

SEQ ID NO: 3186852 - DNA, 17 bp, Homo sapiens
agcggccctaagggagt

SEQ ID NO: 3186853 - DNA, 16 bp, Homo sapiens
agcggccgcagagact

SEQ ID NO: 3186854 - DNA, 18 bp, Homo sapiens
agcggcgaccgccctccg

SEQ ID NO: 3186855 - DNA, 11 bp, Homo sapiens
agcggctgctc

SEQ ID NO: 3186856 - DNA, 20 bp, Homo sapiens
agcggctgctcgcccaggaa

SEQ ID NO: 3186857 - DNA, 21 bp, Homo sapiens
agcggctgctcgcccaggaag

SEQ ID NO: 3186858 - DNA, 17 bp, Homo sapiens
agcgggagacctgtgct

SEQ ID NO: 3186859 - DNA, 14 bp, Homo sapiens
agcgggagcccgtg

SEQ ID NO: 3186860 - DNA, 12 bp, Homo sapiens
agcgggcacagg

SEQ ID NO: 3186861 - DNA, 14 bp, Homo sapiens
agcgggcacagggc

SEQ ID NO: 3186862 - DNA, 23 bp, Homo sapiens
agcgggcaggttctgcctgcttt

SEQ ID NO: 3186863 - DNA, 16 bp, Homo sapiens
agcggggacagctcct

SEQ ID NO: 3186864 - DNA, 19 bp, Homo sapiens
agcggggacagctccttct

SEQ ID NO: 3186865 - DNA, 22 bp, Homo sapiens
agcggggacagctccttctgtc

SEQ ID NO: 3186866 - DNA, 21 bp, Homo sapiens
agcggtggccctgtccctccc

SEQ ID NO: 3186867 - DNA, 19 bp, Homo sapiens
agcggtttggggagcagag

SEQ ID NO: 3186868 - DNA, 21 bp, Homo sapiens
agcgtcagctgctccctggca

SEQ ID NO: 3186869 - DNA, 21 bp, Homo sapiens
agcgtcagggttggtgtgctg

SEQ ID NO: 3186870 - DNA, 15 bp, Homo sapiens
agcgtccagaaatgg

SEQ ID NO: 3186871 - DNA, 22 bp, Homo sapiens
agcgtcccctgctactcctgtg

SEQ ID NO: 3186872 - DNA, 16 bp, Homo sapiens
agcgtccctagcagtg

SEQ ID NO: 3186873 - DNA, 17 bp, Homo sapiens
agcgtccctagcagtga

SEQ ID NO: 3186874 - DNA, 18 bp, Homo sapiens
agcgtccctagcagtgaa

SEQ ID NO: 3186875 - DNA, 14 bp, Homo sapiens
agcgtccctggcgc

SEQ ID NO: 3186876 - DNA, 20 bp, Homo sapiens
agcgtcctcgttcaaaacat

SEQ ID NO: 3186877 - DNA, 22 bp, Homo sapiens
agcgtcctcgttcaaaacattc

SEQ ID NO: 3186878 - DNA, 16 bp, Homo sapiens
agcgtccttccccctg

SEQ ID NO: 3186879 - DNA, 17 bp, Homo sapiens
agcgtgagccactgcac

SEQ ID NO: 3186880 - DNA, 19 bp, Homo sapiens
agcgtgagccactgcaccg

SEQ ID NO: 3186881 - DNA, 15 bp, Homo sapiens
agcgtgcataagtta

SEQ ID NO: 3186882 - DNA, 14 bp, Homo sapiens
agcgtgtgtatccg

SEQ ID NO: 3186883 - DNA, 21 bp, Homo sapiens
agcgtgtgtatccgactctaa

SEQ ID NO: 3186884 - DNA, 18 bp, Homo sapiens
agcgtgtttacatgtgta

SEQ ID NO: 3186885 - DNA, 15 bp, Homo sapiens
agcgttaagggcaga

SEQ ID NO: 3186886 - DNA, 13 bp, Homo sapiens
agcgttcccagca

SEQ ID NO: 3186887 - DNA, 16 bp, Homo sapiens
agcgttggatgtagca

SEQ ID NO: 3186888 - DNA, 18 bp, Homo sapiens
agcgtttttaacctgttt

SEQ ID NO: 3186889 - DNA, 13 bp, Homo sapiens
agctaaaagacaa

SEQ ID NO: 3186890 - DNA, 14 bp, Homo sapiens
agctaaaatatata

SEQ ID NO: 3186891 - DNA, 16 bp, Homo sapiens
agctaaaatgatttta

SEQ ID NO: 3186892 - DNA, 20 bp, Homo sapiens
agctaaaatgattttatctg

SEQ ID NO: 3186893 - DNA, 18 bp, Homo sapiens
agctaaattacaattgtc

SEQ ID NO: 3186894 - DNA, 22 bp, Homo sapiens
agctaacattttaaataaaaga

SEQ ID NO: 3186895 - DNA, 15 bp, Homo sapiens
agctaactgtaaatc

SEQ ID NO: 3186896 - DNA, 10 bp, Homo sapiens
agctaaggct

SEQ ID NO: 3186897 - DNA, 13 bp, Homo sapiens
agctaaggctcta

SEQ ID NO: 3186898 - DNA, 20 bp, Homo sapiens
agctaaggctctatgagtct

SEQ ID NO: 3186899 - DNA, 22 bp, Homo sapiens
agctaagggtgggtgctcagaa

SEQ ID NO: 3186900 - DNA, 12 bp, Homo sapiens
agctaataaatc

SEQ ID NO: 3186901 - DNA, 20 bp, Homo sapiens
agctaataaatctcttcttt

SEQ ID NO: 3186902 - DNA, 21 bp, Homo sapiens
agctaatcagcattctcactc

SEQ ID NO: 3186903 - DNA, 13 bp, Homo sapiens
agctaatctgtag

SEQ ID NO: 3186904 - DNA, 19 bp, Homo sapiens
agctaatctgtagggctgg

SEQ ID NO: 3186905 - DNA, 20 bp, Homo sapiens
agctaatctgtagggctgga

SEQ ID NO: 3186906 - DNA, 23 bp, Homo sapiens
agctaatctgtagggctggacct

SEQ ID NO: 3186907 - DNA, 15 bp, Homo sapiens
agctaatgggacact

SEQ ID NO: 3186908 - DNA, 13 bp, Homo sapiens
agctaatttgcat

SEQ ID NO: 3186909 - DNA, 20 bp, Homo sapiens
agctaatttgcattaaattc

SEQ ID NO: 3186910 - DNA, 20 bp, Homo sapiens
agctacacagtgcagaggct

SEQ ID NO: 3186911 - DNA, 14 bp, Homo sapiens
agctacaggaagca

SEQ ID NO: 3186912 - DNA, 14 bp, Homo sapiens
agctacataagact

SEQ ID NO: 3186913 - DNA, 16 bp, Homo sapiens
agctacccaaaagaga

SEQ ID NO: 3186914 - DNA, 17 bp, Homo sapiens
agctacccaaaagagaa

SEQ ID NO: 3186915 - DNA, 20 bp, Homo sapiens
agctacccaaaagagaaaaa

SEQ ID NO: 3186916 - DNA, 13 bp, Homo sapiens
agctaccccttct

SEQ ID NO: 3186917 - DNA, 15 bp, Homo sapiens
agctacccttttcct

SEQ ID NO: 3186918 - DNA, 20 bp, Homo sapiens
agctaccctttttctccagc

SEQ ID NO: 3186919 - DNA, 16 bp, Homo sapiens
agctactaatgatgtt

SEQ ID NO: 3186920 - DNA, 21 bp, Homo sapiens
agctactcagaagcctgaggc

SEQ ID NO: 3186921 - DNA, 16 bp, Homo sapiens
agctactctgtccagg

SEQ ID NO: 3186922 - DNA, 17 bp, Homo sapiens
agctactctgtccaggc

SEQ ID NO: 3186923 - DNA, 20 bp, Homo sapiens
agctactctgtccaggccac

SEQ ID NO: 3186924 - DNA, 21 bp, Homo sapiens
agctactctgtccaggccact

SEQ ID NO: 3186925 - DNA, 23 bp, Homo sapiens
agctactctgtccaggccactgt

SEQ ID NO: 3186926 - DNA, 23 bp, Homo sapiens
agctactgatttcctttggagct

SEQ ID NO: 3186927 - DNA, 18 bp, Homo sapiens
agctactgcggaaaagga

SEQ ID NO: 3186928 - DNA, 23 bp, Homo sapiens
agctactgtgtgtgtgaatgaac

SEQ ID NO: 3186929 - DNA, 15 bp, Homo sapiens
agctacttaagagaa

SEQ ID NO: 3186930 - DNA, 15 bp, Homo sapiens
agctacttcctcctc

SEQ ID NO: 3186931 - DNA, 16 bp, Homo sapiens
agctacttcctcctcc

SEQ ID NO: 3186932 - DNA, 21 bp, Homo sapiens
agctacttcctcctccccact

SEQ ID NO: 3186933 - DNA, 17 bp, Homo sapiens
agctactttccatttgg

SEQ ID NO: 3186934 - DNA, 17 bp, Homo sapiens
agctagactggagtgag

SEQ ID NO: 3186935 - DNA, 21 bp, Homo sapiens
agctagactggagtgaggctt

SEQ ID NO: 3186936 - DNA, 15 bp, Homo sapiens
agctagcctgaagga

SEQ ID NO: 3186937 - DNA, 16 bp, Homo sapiens
agctagcctgaaggat

SEQ ID NO: 3186938 - DNA, 18 bp, Homo sapiens
agctaggaagagcaggac

SEQ ID NO: 3186939 - DNA, 13 bp, Homo sapiens
agctaggaatgaa

SEQ ID NO: 3186940 - DNA, 13 bp, Homo sapiens
agctaggactgag

SEQ ID NO: 3186941 - DNA, 17 bp, Homo sapiens
agctaggccccagaggc

SEQ ID NO: 3186942 - DNA, 22 bp, Homo sapiens
agctaggccccagaggccctgg

SEQ ID NO: 3186943 - DNA, 22 bp, Homo sapiens
agctagtatcttcaaactttca

SEQ ID NO: 3186944 - DNA, 12 bp, Homo sapiens
agctagtgcctt

SEQ ID NO: 3186945 - DNA, 19 bp, Homo sapiens
agctagtggcttcaaaata

SEQ ID NO: 3186946 - DNA, 16 bp, Homo sapiens
agctagtgtacctcct

SEQ ID NO: 3186947 - DNA, 19 bp, Homo sapiens
agctagtgtacctcctctc

SEQ ID NO: 3186948 - DNA, 21 bp, Homo sapiens
agctagtgtacctcctctcag

SEQ ID NO: 3186949 - DNA, 18 bp, Homo sapiens
agctagttcgtagctttc

SEQ ID NO: 3186950 - DNA, 15 bp, Homo sapiens
agctatatccatgta

SEQ ID NO: 3186951 - DNA, 17 bp, Homo sapiens
agctatatccatgtact

SEQ ID NO: 3186952 - DNA, 23 bp, Homo sapiens
agctatcctaaatttgaaatagt

SEQ ID NO: 3186953 - DNA, 16 bp, Homo sapiens
agctatctaaagtttg

SEQ ID NO: 3186954 - DNA, 17 bp, Homo sapiens
agctatgcgcaatgtgg

SEQ ID NO: 3186955 - DNA, 18 bp, Homo sapiens
agctatgcgcaatgtggc

SEQ ID NO: 3186956 - DNA, 22 bp, Homo sapiens
agctatggagagaattaaaact

SEQ ID NO: 3186957 - DNA, 17 bp, Homo sapiens
agctatgggagccccag

SEQ ID NO: 3186958 - DNA, 15 bp, Homo sapiens
agctattactgtctg

SEQ ID NO: 3186959 - DNA, 18 bp, Homo sapiens
agctattagccaggatca

SEQ ID NO: 3186960 - DNA, 22 bp, Homo sapiens
agctattagccaggatcatggt

SEQ ID NO: 3186961 - DNA, 19 bp, Homo sapiens
agctattctcatgcctcag

SEQ ID NO: 3186962 - DNA, 14 bp, Homo sapiens
agctatttaagggg

SEQ ID NO: 3186963 - DNA, 18 bp, Homo sapiens
agctatttccattccaga

SEQ ID NO: 3186964 - DNA, 20 bp, Homo sapiens
agctcaagcaggaagttcaa

SEQ ID NO: 3186965 - DNA, 19 bp, Homo sapiens
agctcaagcccttggggag

SEQ ID NO: 3186966 - DNA, 13 bp, Homo sapiens
agctcaagtttaa

SEQ ID NO: 3186967 - DNA, 18 bp, Homo sapiens
agctcaagtttaaaagcc

SEQ ID NO: 3186968 - DNA, 19 bp, Homo sapiens
agctcaagtttaaaagcca

SEQ ID NO: 3186969 - DNA, 22 bp, Homo sapiens
agctcaagtttaaaagccatgt

SEQ ID NO: 3186970 - DNA, 13 bp, Homo sapiens
agctcaatgcagt

SEQ ID NO: 3186971 - DNA, 20 bp, Homo sapiens
agctcaattgttaatgtgat

SEQ ID NO: 3186972 - DNA, 15 bp, Homo sapiens
agctcaccagcccca

SEQ ID NO: 3186973 - DNA, 20 bp, Homo sapiens
agctcaccagccccagtgcc

SEQ ID NO: 3186974 - DNA, 22 bp, Homo sapiens
agctcaccagccccagtgccca

SEQ ID NO: 3186975 - DNA, 23 bp, Homo sapiens
agctcaccagccccagtgcccac

SEQ ID NO: 3186976 - DNA, 14 bp, Homo sapiens
agctcacccctggg

SEQ ID NO: 3186977 - DNA, 17 bp, Homo sapiens
agctcacccctgggcag

SEQ ID NO: 3186978 - DNA, 15 bp, Homo sapiens
agctcaccctgcccg

SEQ ID NO: 3186979 - DNA, 23 bp, Homo sapiens
agctcacttctgggcttcatctg

SEQ ID NO: 3186980 - DNA, 14 bp, Homo sapiens
agctcagaacccag

SEQ ID NO: 3186981 - DNA, 18 bp, Homo sapiens
agctcagaacccagggct

SEQ ID NO: 3186982 - DNA, 21 bp, Homo sapiens
agctcagaatagatctgatgg

SEQ ID NO: 3186983 - DNA, 16 bp, Homo sapiens
agctcagcatttccac

SEQ ID NO: 3186984 - DNA, 23 bp, Homo sapiens
agctcagccccgagctgtccccg

SEQ ID NO: 3186985 - DNA, 12 bp, Homo sapiens
agctcagcgcca

SEQ ID NO: 3186986 - DNA, 17 bp, Homo sapiens
agctcagcttcttccta

SEQ ID NO: 3186987 - DNA, 21 bp, Homo sapiens
agctcagcttcttcctaggtc

SEQ ID NO: 3186988 - DNA, 20 bp, Homo sapiens
agctcaggaagaagagatgc

SEQ ID NO: 3186989 - DNA, 15 bp, Homo sapiens
agctcaggaggcgcc

SEQ ID NO: 3186990 - DNA, 17 bp, Homo sapiens
agctcaggaggcttgga

SEQ ID NO: 3186991 - DNA, 16 bp, Homo sapiens
agctcaggggcagctc

SEQ ID NO: 3186992 - DNA, 16 bp, Homo sapiens
agctcaggtgggcgtg

SEQ ID NO: 3186993 - DNA, 22 bp, Homo sapiens
agctcaggtgtccctgcacttg

SEQ ID NO: 3186994 - DNA, 19 bp, Homo sapiens
agctcagtttatccaaggt

SEQ ID NO: 3186995 - DNA, 17 bp, Homo sapiens
agctcataaaatggaag

SEQ ID NO: 3186996 - DNA, 17 bp, Homo sapiens
agctcatctccaaggat

SEQ ID NO: 3186997 - DNA, 22 bp, Homo sapiens
agctccaacactttgagcattt

SEQ ID NO: 3186998 - DNA, 19 bp, Homo sapiens
agctccacggtgcgtggct

SEQ ID NO: 3186999 - DNA, 13 bp, Homo sapiens
agctccactctgc

SEQ ID NO: 3187000 - DNA, 16 bp, Homo sapiens
agctccactctgcttc

SEQ ID NO: 3187001 - DNA, 23 bp, Homo sapiens
agctccactctgcttctctgact

SEQ ID NO: 3187002 - DNA, 23 bp, Homo sapiens
agctccactgtcaccctccacct

SEQ ID NO: 3187003 - DNA, 13 bp, Homo sapiens
agctccagagcaa

SEQ ID NO: 3187004 - DNA, 13 bp, Homo sapiens
agctccagctcac

SEQ ID NO: 3187005 - DNA, 21 bp, Homo sapiens
agctccagctcaccagcccca

SEQ ID NO: 3187006 - DNA, 13 bp, Homo sapiens
agctccaggggcc

SEQ ID NO: 3187007 - DNA, 20 bp, Homo sapiens
agctccaggggcccttggga

SEQ ID NO: 3187008 - DNA, 21 bp, Homo sapiens
agctccccctgtcccctcagc

SEQ ID NO: 3187009 - DNA, 14 bp, Homo sapiens
agctccctcccgca

SEQ ID NO: 3187010 - DNA, 11 bp, Homo sapiens
agctccctgcc

SEQ ID NO: 3187011 - DNA, 13 bp, Homo sapiens
agctccctgcccc

SEQ ID NO: 3187012 - DNA, 14 bp, Homo sapiens
agctccctgcccca

SEQ ID NO: 3187013 - DNA, 14 bp, Homo sapiens
agctccctggagcc

SEQ ID NO: 3187014 - DNA, 16 bp, Homo sapiens
agctccctggagccct

SEQ ID NO: 3187015 - DNA, 17 bp, Homo sapiens
agctccctggagccctg

SEQ ID NO: 3187016 - DNA, 17 bp, Homo sapiens
agctcccttccctgcag

SEQ ID NO: 3187017 - DNA, 13 bp, Homo sapiens
agctcccttctct

SEQ ID NO: 3187018 - DNA, 17 bp, Homo sapiens
agctccgcctcccgggt

SEQ ID NO: 3187019 - DNA, 16 bp, Homo sapiens
agctccgcctctgtcc

SEQ ID NO: 3187020 - DNA, 20 bp, Homo sapiens
agctccgctttctacccagc

SEQ ID NO: 3187021 - DNA, 21 bp, Homo sapiens
agctccgctttctacccagcg

SEQ ID NO: 3187022 - DNA, 13 bp, Homo sapiens
agctcctcccctt

SEQ ID NO: 3187023 - DNA, 15 bp, Homo sapiens
agctcctctccttgg

SEQ ID NO: 3187024 - DNA, 20 bp, Homo sapiens
agctcctctccttgggctcc

SEQ ID NO: 3187025 - DNA, 24 bp, Homo sapiens
agctcctctccttgggctcctggc

SEQ ID NO: 3187026 - DNA, 20 bp, Homo sapiens
agctcctcttaccgtagcct

SEQ ID NO: 3187027 - DNA, 22 bp, Homo sapiens
agctcctgctgcggaggagctg

SEQ ID NO: 3187028 - DNA, 12 bp, Homo sapiens
agctcctgtcct

SEQ ID NO: 3187029 - DNA, 14 bp, Homo sapiens
agctcctgtcctcc

SEQ ID NO: 3187030 - DNA, 16 bp, Homo sapiens
agctcctgtggcccca

SEQ ID NO: 3187031 - DNA, 19 bp, Homo sapiens
agctcctgtggccccaccc

SEQ ID NO: 3187032 - DNA, 12 bp, Homo sapiens
agctccttctgt

SEQ ID NO: 3187033 - DNA, 19 bp, Homo sapiens
agctccttgagtaaaaagg

SEQ ID NO: 3187034 - DNA, 14 bp, Homo sapiens
agctccttggagca

SEQ ID NO: 3187035 - DNA, 17 bp, Homo sapiens
agctcctttctcctgtg

SEQ ID NO: 3187036 - DNA, 20 bp, Homo sapiens
agctcctttctcctgtgaat

SEQ ID NO: 3187037 - DNA, 18 bp, Homo sapiens
agctccttttgtccccag

SEQ ID NO: 3187038 - DNA, 23 bp, Homo sapiens
agctccttttgtccccagggccc

SEQ ID NO: 3187039 - DNA, 19 bp, Homo sapiens
agctcgtttttcagcaccc

SEQ ID NO: 3187040 - DNA, 23 bp, Homo sapiens
agctcgtttttcagcacccccac

SEQ ID NO: 3187041 - DNA, 22 bp, Homo sapiens
agctctaataaaacagctgtct

SEQ ID NO: 3187042 - DNA, 16 bp, Homo sapiens
agctctaccctgctcc

SEQ ID NO: 3187043 - DNA, 19 bp, Homo sapiens
agctctagttttcagcctt

SEQ ID NO: 3187044 - DNA, 12 bp, Homo sapiens
agctctcctggc

SEQ ID NO: 3187045 - DNA, 13 bp, Homo sapiens
agctctctaggcc

SEQ ID NO: 3187046 - DNA, 17 bp, Homo sapiens
agctctctaggcctctc

SEQ ID NO: 3187047 - DNA, 18 bp, Homo sapiens
agctctctaggcctctcc

SEQ ID NO: 3187048 - DNA, 22 bp, Homo sapiens
agctctctaggcctctccagtt

SEQ ID NO: 3187049 - DNA, 21 bp, Homo sapiens
agctctctgtataaacattaa

SEQ ID NO: 3187050 - DNA, 20 bp, Homo sapiens
agctctgacatcccttcctg

SEQ ID NO: 3187051 - DNA, 19 bp, Homo sapiens
agctctgacccttgggcct

SEQ ID NO: 3187052 - DNA, 15 bp, Homo sapiens
agctctgagccagat

SEQ ID NO: 3187053 - DNA, 17 bp, Homo sapiens
agctctgagccagatta

SEQ ID NO: 3187054 - DNA, 17 bp, Homo sapiens
agctctgaggggagggg

SEQ ID NO: 3187055 - DNA, 21 bp, Homo sapiens
agctctgcagagcaggaaaca

SEQ ID NO: 3187056 - DNA, 12 bp, Homo sapiens
agctctgcaggc

SEQ ID NO: 3187057 - DNA, 12 bp, Homo sapiens
agctctgcatta

SEQ ID NO: 3187058 - DNA, 12 bp, Homo sapiens
agctctggagaa

SEQ ID NO: 3187059 - DNA, 13 bp, Homo sapiens
agctctggagaac

SEQ ID NO: 3187060 - DNA, 18 bp, Homo sapiens
agctctggaggggagggg

SEQ ID NO: 3187061 - DNA, 19 bp, Homo sapiens
agctctggaggggaggggg

SEQ ID NO: 3187062 - DNA, 22 bp, Homo sapiens
agctctggccacaacagggcat

SEQ ID NO: 3187063 - DNA, 17 bp, Homo sapiens
agctctggctgaaccct

SEQ ID NO: 3187064 - DNA, 19 bp, Homo sapiens
agctctggctgaaccctgt

SEQ ID NO: 3187065 - DNA, 20 bp, Homo sapiens
agctctggctgaaccctgtg

SEQ ID NO: 3187066 - DNA, 21 bp, Homo sapiens
agctctggctgaaccctgtgc

SEQ ID NO: 3187067 - DNA, 20 bp, Homo sapiens
agctctggcttccagaaaac

SEQ ID NO: 3187068 - DNA, 11 bp, Homo sapiens
agctctggggg

SEQ ID NO: 3187069 - DNA, 12 bp, Homo sapiens
agctctgggggg

SEQ ID NO: 3187070 - DNA, 18 bp, Homo sapiens
agctctggggggcagttg

SEQ ID NO: 3187071 - DNA, 14 bp, Homo sapiens
agctctggggtggg

SEQ ID NO: 3187072 - DNA, 20 bp, Homo sapiens
agctctggggtgggcagttt

SEQ ID NO: 3187073 - DNA, 16 bp, Homo sapiens
agctctgtcctgggag

SEQ ID NO: 3187074 - DNA, 13 bp, Homo sapiens
agctctgtggcct

SEQ ID NO: 3187075 - DNA, 14 bp, Homo sapiens
agctctgtggcctg

SEQ ID NO: 3187076 - DNA, 19 bp, Homo sapiens
agctctgtggcctgtgtcc

SEQ ID NO: 3187077 - DNA, 20 bp, Homo sapiens
agctctgtggcctgtgtcca

SEQ ID NO: 3187078 - DNA, 16 bp, Homo sapiens
agctcttcaggcctcc

SEQ ID NO: 3187079 - DNA, 14 bp, Homo sapiens
agctcttcattcca

SEQ ID NO: 3187080 - DNA, 17 bp, Homo sapiens
agctcttctccaggctg

SEQ ID NO: 3187081 - DNA, 15 bp, Homo sapiens
agctcttgcccttcc

SEQ ID NO: 3187082 - DNA, 19 bp, Homo sapiens
agctcttgcccttccctgt

SEQ ID NO: 3187083 - DNA, 13 bp, Homo sapiens
agctcttgctaat

SEQ ID NO: 3187084 - DNA, 19 bp, Homo sapiens
agctcttgctaatcagtgt

SEQ ID NO: 3187085 - DNA, 14 bp, Homo sapiens
agctcttggccttt

SEQ ID NO: 3187086 - DNA, 23 bp, Homo sapiens
agctgaacaataggctgttccca

SEQ ID NO: 3187087 - DNA, 18 bp, Homo sapiens
agctgaagaattgaaaag

SEQ ID NO: 3187088 - DNA, 20 bp, Homo sapiens
agctgaatattttttatttc

SEQ ID NO: 3187089 - DNA, 17 bp, Homo sapiens
agctgaatgcctcctgt

SEQ ID NO: 3187090 - DNA, 23 bp, Homo sapiens
agctgacccagccccttgagaaa

SEQ ID NO: 3187091 - DNA, 17 bp, Homo sapiens
agctgacgggaggcccc

SEQ ID NO: 3187092 - DNA, 19 bp, Homo sapiens
agctgacgggaggccccag

SEQ ID NO: 3187093 - DNA, 22 bp, Homo sapiens
agctgacgggaggccccagctc

SEQ ID NO: 3187094 - DNA, 13 bp, Homo sapiens
agctgactgtggc

SEQ ID NO: 3187095 - DNA, 14 bp, Homo sapiens
agctgactgtggcc

SEQ ID NO: 3187096 - DNA, 19 bp, Homo sapiens
agctgactgtggccccctc

SEQ ID NO: 3187097 - DNA, 18 bp, Homo sapiens
agctgacttggcacttaa

SEQ ID NO: 3187098 - DNA, 20 bp, Homo sapiens
agctgacttggcacttaagt

SEQ ID NO: 3187099 - DNA, 19 bp, Homo sapiens
agctgagactacaagtgtg

SEQ ID NO: 3187100 - DNA, 14 bp, Homo sapiens
agctgagagacttt

SEQ ID NO: 3187101 - DNA, 22 bp, Homo sapiens
agctgagagccctgctgtggga

SEQ ID NO: 3187102 - DNA, 21 bp, Homo sapiens
agctgagcacttagcaggcac

SEQ ID NO: 3187103 - DNA, 13 bp, Homo sapiens
agctgagccctgg

SEQ ID NO: 3187104 - DNA, 14 bp, Homo sapiens
agctgagccctggg

SEQ ID NO: 3187105 - DNA, 15 bp, Homo sapiens
agctgagccctgggg

SEQ ID NO: 3187106 - DNA, 20 bp, Homo sapiens
agctgagctggaaggggcca

SEQ ID NO: 3187107 - DNA, 18 bp, Homo sapiens
agctgaggactctgcaag

SEQ ID NO: 3187108 - DNA, 23 bp, Homo sapiens
agctgaggtctcttgagggagct

SEQ ID NO: 3187109 - DNA, 16 bp, Homo sapiens
agctgaggtttcaccc

SEQ ID NO: 3187110 - DNA, 18 bp, Homo sapiens
agctgaggtttcaccctt

SEQ ID NO: 3187111 - DNA, 14 bp, Homo sapiens
agctgagtggccag

SEQ ID NO: 3187112 - DNA, 21 bp, Homo sapiens
agctgagttacttgtctgagg

SEQ ID NO: 3187113 - DNA, 16 bp, Homo sapiens
agctgatacttcattt

SEQ ID NO: 3187114 - DNA, 18 bp, Homo sapiens
agctgatataaattctgt

SEQ ID NO: 3187115 - DNA, 20 bp, Homo sapiens
agctgatcataagtgaattt

SEQ ID NO: 3187116 - DNA, 22 bp, Homo sapiens
agctgatgaaactcacaaatga

SEQ ID NO: 3187117 - DNA, 19 bp, Homo sapiens
agctgattactgtcaataa

SEQ ID NO: 3187118 - DNA, 20 bp, Homo sapiens
agctgattactgtcaataaa

SEQ ID NO: 3187119 - DNA, 20 bp, Homo sapiens
agctgatttccaggcccctg

SEQ ID NO: 3187120 - DNA, 21 bp, Homo sapiens
agctgatttccaggcccctga

SEQ ID NO: 3187121 - DNA, 21 bp, Homo sapiens
agctgcaaggtactctggtga

SEQ ID NO: 3187122 - DNA, 16 bp, Homo sapiens
agctgcaccagagcaa

SEQ ID NO: 3187123 - DNA, 22 bp, Homo sapiens
agctgcacctgccagcctggct

SEQ ID NO: 3187124 - DNA, 19 bp, Homo sapiens
agctgcactgatcacccaa

SEQ ID NO: 3187125 - DNA, 17 bp, Homo sapiens
agctgcacttggcctca

SEQ ID NO: 3187126 - DNA, 19 bp, Homo sapiens
agctgcacttggcctcagc

SEQ ID NO: 3187127 - DNA, 22 bp, Homo sapiens
agctgcacttggcctcagctgg

SEQ ID NO: 3187128 - DNA, 13 bp, Homo sapiens
agctgcagctggg

SEQ ID NO: 3187129 - DNA, 15 bp, Homo sapiens
agctgcagctgggcc

SEQ ID NO: 3187130 - DNA, 22 bp, Homo sapiens
agctgcagctgggccccatgct

SEQ ID NO: 3187131 - DNA, 13 bp, Homo sapiens
agctgcagtgagc

SEQ ID NO: 3187132 - DNA, 20 bp, Homo sapiens
agctgcatcatccttgcagg

SEQ ID NO: 3187133 - DNA, 21 bp, Homo sapiens
agctgccacagagaagtttgt

SEQ ID NO: 3187134 - DNA, 17 bp, Homo sapiens
agctgccagcccagaac

SEQ ID NO: 3187135 - DNA, 15 bp, Homo sapiens
agctgccagtgctgg

SEQ ID NO: 3187136 - DNA, 14 bp, Homo sapiens
agctgccatggcta

SEQ ID NO: 3187137 - DNA, 14 bp, Homo sapiens
agctgccccagcca

SEQ ID NO: 3187138 - DNA, 23 bp, Homo sapiens
agctgccctcccctccggactgg

SEQ ID NO: 3187139 - DNA, 17 bp, Homo sapiens
agctgccgaccagagcc

SEQ ID NO: 3187140 - DNA, 18 bp, Homo sapiens
agctgccgaccagagccc

SEQ ID NO: 3187141 - DNA, 17 bp, Homo sapiens
agctgccgacttggaga

SEQ ID NO: 3187142 - DNA, 19 bp, Homo sapiens
agctgcctagcaagctggc

SEQ ID NO: 3187143 - DNA, 20 bp, Homo sapiens
agctgcctagcaagctggcc

SEQ ID NO: 3187144 - DNA, 21 bp, Homo sapiens
agctgcctagcaagctggcct

SEQ ID NO: 3187145 - DNA, 13 bp, Homo sapiens
agctgcctcactt

SEQ ID NO: 3187146 - DNA, 14 bp, Homo sapiens
agctgcctctgctc

SEQ ID NO: 3187147 - DNA, 16 bp, Homo sapiens
agctgcctctgctccc

SEQ ID NO: 3187148 - DNA, 20 bp, Homo sapiens
agctgcctctgctccctctg

SEQ ID NO: 3187149 - DNA, 18 bp, Homo sapiens
agctgcctgaaacagcca

SEQ ID NO: 3187150 - DNA, 20 bp, Homo sapiens
agctgcctggagagggtctc

SEQ ID NO: 3187151 - DNA, 13 bp, Homo sapiens
agctgcctggatg

SEQ ID NO: 3187152 - DNA, 15 bp, Homo sapiens
agctgcctggatgag

SEQ ID NO: 3187153 - DNA, 20 bp, Homo sapiens
agctgcctggatgagaaaca

SEQ ID NO: 3187154 - DNA, 23 bp, Homo sapiens
agctgcctgtagttaggaaataa

SEQ ID NO: 3187155 - DNA, 14 bp, Homo sapiens
agctgcctgttcag

SEQ ID NO: 3187156 - DNA, 10 bp, Homo sapiens
agctgccttc

SEQ ID NO: 3187157 - DNA, 14 bp, Homo sapiens
agctgccttcccta

SEQ ID NO: 3187158 - DNA, 17 bp, Homo sapiens
agctgccttggctcaga

SEQ ID NO: 3187159 - DNA, 18 bp, Homo sapiens
agctgcgcttgcttttct

SEQ ID NO: 3187160 - DNA, 13 bp, Homo sapiens
agctgcggtccac

SEQ ID NO: 3187161 - DNA, 13 bp, Homo sapiens
agctgctaaatct

SEQ ID NO: 3187162 - DNA, 15 bp, Homo sapiens
agctgctaaatctcc

SEQ ID NO: 3187163 - DNA, 22 bp, Homo sapiens
agctgctaaatctcctattttt

SEQ ID NO: 3187164 - DNA, 21 bp, Homo sapiens
agctgctatccccatctccct

SEQ ID NO: 3187165 - DNA, 22 bp, Homo sapiens
agctgctatccccatctccctg

SEQ ID NO: 3187166 - DNA, 21 bp, Homo sapiens
agctgctctgaaatctccttt

SEQ ID NO: 3187167 - DNA, 12 bp, Homo sapiens
agctgctctgcc

SEQ ID NO: 3187168 - DNA, 19 bp, Homo sapiens
agctgctcttagtgcccgc

SEQ ID NO: 3187169 - DNA, 14 bp, Homo sapiens
agctgctgacagtg

SEQ ID NO: 3187170 - DNA, 17 bp, Homo sapiens
agctgctggcttgcagt

SEQ ID NO: 3187171 - DNA, 14 bp, Homo sapiens
agctgcttctgccc

SEQ ID NO: 3187172 - DNA, 23 bp, Homo sapiens
agctgcttttgtctatgggactc

SEQ ID NO: 3187173 - DNA, 16 bp, Homo sapiens
agctggaacatttgat

SEQ ID NO: 3187174 - DNA, 13 bp, Homo sapiens
agctggaaggggc

SEQ ID NO: 3187175 - DNA, 18 bp, Homo sapiens
agctggaaggggccacgt

SEQ ID NO: 3187176 - DNA, 20 bp, Homo sapiens
agctggaaggggccacgtgg

SEQ ID NO: 3187177 - DNA, 14 bp, Homo sapiens
agctggaccctgct

SEQ ID NO: 3187178 - DNA, 18 bp, Homo sapiens
agctggaccctgcttcac

SEQ ID NO: 3187179 - DNA, 19 bp, Homo sapiens
agctggactctgcatccca

SEQ ID NO: 3187180 - DNA, 14 bp, Homo sapiens
agctggacttctgt

SEQ ID NO: 3187181 - DNA, 18 bp, Homo sapiens
agctggacttctgtgggc

SEQ ID NO: 3187182 - DNA, 20 bp, Homo sapiens
agctggacttctgtgggccc

SEQ ID NO: 3187183 - DNA, 15 bp, Homo sapiens
agctggaggctccag

SEQ ID NO: 3187184 - DNA, 16 bp, Homo sapiens
agctggaggctccagg

SEQ ID NO: 3187185 - DNA, 17 bp, Homo sapiens
agctggaggctccagga

SEQ ID NO: 3187186 - DNA, 19 bp, Homo sapiens
agctggaggctccaggact

SEQ ID NO: 3187187 - DNA, 19 bp, Homo sapiens
agctggcaggacacatccc

SEQ ID NO: 3187188 - DNA, 15 bp, Homo sapiens
agctggcattacagc

SEQ ID NO: 3187189 - DNA, 21 bp, Homo sapiens
agctggcattacagctggaga

SEQ ID NO: 3187190 - DNA, 16 bp, Homo sapiens
agctggccctgcctcc

SEQ ID NO: 3187191 - DNA, 23 bp, Homo sapiens
agctggccctgcctcctgggaag

SEQ ID NO: 3187192 - DNA, 21 bp, Homo sapiens
agctggccgagggtcctggct

SEQ ID NO: 3187193 - DNA, 23 bp, Homo sapiens
agctggccgagggtcctggctcc

SEQ ID NO: 3187194 - DNA, 14 bp, Homo sapiens
agctggcctctacc

SEQ ID NO: 3187195 - DNA, 12 bp, Homo sapiens
agctggcctgag

SEQ ID NO: 3187196 - DNA, 21 bp, Homo sapiens
agctggcctgagaggggaagc

SEQ ID NO: 3187197 - DNA, 13 bp, Homo sapiens
agctggctctgag

SEQ ID NO: 3187198 - DNA, 14 bp, Homo sapiens
agctggctctgagc

SEQ ID NO: 3187199 - DNA, 18 bp, Homo sapiens
agctggctctgtgagggt

SEQ ID NO: 3187200 - DNA, 22 bp, Homo sapiens
agctggctctgtgagggtgctg

SEQ ID NO: 3187201 - DNA, 16 bp, Homo sapiens
agctgggactacaggc

SEQ ID NO: 3187202 - DNA, 20 bp, Homo sapiens
agctgggactacaggcaccc

SEQ ID NO: 3187203 - DNA, 23 bp, Homo sapiens
agctgggactacaggcacccacc

SEQ ID NO: 3187204 - DNA, 16 bp, Homo sapiens
agctgggactacaggt

SEQ ID NO: 3187205 - DNA, 17 bp, Homo sapiens
agctgggactacaggtg

SEQ ID NO: 3187206 - DNA, 19 bp, Homo sapiens
agctgggactacaggtgtg

SEQ ID NO: 3187207 - DNA, 14 bp, Homo sapiens
agctgggaggcatg

SEQ ID NO: 3187208 - DNA, 16 bp, Homo sapiens
agctgggaggcatggc

SEQ ID NO: 3187209 - DNA, 19 bp, Homo sapiens
agctgggaggcatggccct

SEQ ID NO: 3187210 - DNA, 20 bp, Homo sapiens
agctgggaggcatggccctg

SEQ ID NO: 3187211 - DNA, 21 bp, Homo sapiens
agctgggaggcatggccctgg

SEQ ID NO: 3187212 - DNA, 22 bp, Homo sapiens
agctgggaggcatggccctggg

SEQ ID NO: 3187213 - DNA, 17 bp, Homo sapiens
agctgggccccacctac

SEQ ID NO: 3187214 - DNA, 19 bp, Homo sapiens
agctgggccccatgctctg

SEQ ID NO: 3187215 - DNA, 14 bp, Homo sapiens
agctgggcccctgc

SEQ ID NO: 3187216 - DNA, 22 bp, Homo sapiens
agctgggcccctgcacaggcac

SEQ ID NO: 3187217 - DNA, 15 bp, Homo sapiens
agctgggctctgcaa

SEQ ID NO: 3187218 - DNA, 16 bp, Homo sapiens
agctgggctggggagg

SEQ ID NO: 3187219 - DNA, 20 bp, Homo sapiens
agctgggctggggaggacct

SEQ ID NO: 3187220 - DNA, 14 bp, Homo sapiens
agctggggacctgg

SEQ ID NO: 3187221 - DNA, 20 bp, Homo sapiens
agctggggcgtggggagggc

SEQ ID NO: 3187222 - DNA, 22 bp, Homo sapiens
agctgggtgtcaagagggtctg

SEQ ID NO: 3187223 - DNA, 15 bp, Homo sapiens
agctggtcccactca

SEQ ID NO: 3187224 - DNA, 16 bp, Homo sapiens
agctggtcccactcag

SEQ ID NO: 3187225 - DNA, 18 bp, Homo sapiens
agctggtcccactcagtc

SEQ ID NO: 3187226 - DNA, 10 bp, Homo sapiens
agctggtgca

SEQ ID NO: 3187227 - DNA, 14 bp, Homo sapiens
agctggtgcattac

SEQ ID NO: 3187228 - DNA, 19 bp, Homo sapiens
agctggtgcattacagaga

SEQ ID NO: 3187229 - DNA, 21 bp, Homo sapiens
agctggtgcattacagagagg

SEQ ID NO: 3187230 - DNA, 16 bp, Homo sapiens
agctggtggtttcacg

SEQ ID NO: 3187231 - DNA, 16 bp, Homo sapiens
agctggttactcaggg

SEQ ID NO: 3187232 - DNA, 22 bp, Homo sapiens
agctggtttcctcattcctgaa

SEQ ID NO: 3187233 - DNA, 22 bp, Homo sapiens
agctgtaagaagagactgggaa

SEQ ID NO: 3187234 - DNA, 23 bp, Homo sapiens
agctgtaagaagagactgggaag

SEQ ID NO: 3187235 - DNA, 13 bp, Homo sapiens
agctgtaagggca

SEQ ID NO: 3187236 - DNA, 15 bp, Homo sapiens
agctgtaagggcagt

SEQ ID NO: 3187237 - DNA, 18 bp, Homo sapiens
agctgtaagggcagtgcc

SEQ ID NO: 3187238 - DNA, 24 bp, Homo sapiens
agctgtaagggcagtgcccatgtg

SEQ ID NO: 3187239 - DNA, 18 bp, Homo sapiens
agctgtacgcgtttgtct

SEQ ID NO: 3187240 - DNA, 13 bp, Homo sapiens
agctgtactataa

SEQ ID NO: 3187241 - DNA, 14 bp, Homo sapiens
agctgtactcagag

SEQ ID NO: 3187242 - DNA, 15 bp, Homo sapiens
agctgtactcagagc

SEQ ID NO: 3187243 - DNA, 18 bp, Homo sapiens
agctgtactcagagcaga

SEQ ID NO: 3187244 - DNA, 20 bp, Homo sapiens
agctgtactcagagcagagc

SEQ ID NO: 3187245 - DNA, 20 bp, Homo sapiens
agctgtagtagccctttctg

SEQ ID NO: 3187246 - DNA, 11 bp, Homo sapiens
agctgtagtgg

SEQ ID NO: 3187247 - DNA, 13 bp, Homo sapiens
agctgtatgattt

SEQ ID NO: 3187248 - DNA, 16 bp, Homo sapiens
agctgtattgtctgaa

SEQ ID NO: 3187249 - DNA, 17 bp, Homo sapiens
agctgtcaccaaggaaa

SEQ ID NO: 3187250 - DNA, 20 bp, Homo sapiens
agctgtcacttttgctccga

SEQ ID NO: 3187251 - DNA, 14 bp, Homo sapiens
agctgtccagagaa

SEQ ID NO: 3187252 - DNA, 12 bp, Homo sapiens
agctgtccctgc

SEQ ID NO: 3187253 - DNA, 13 bp, Homo sapiens
agctgtccctgca

SEQ ID NO: 3187254 - DNA, 15 bp, Homo sapiens
agctgtccctgcagg

SEQ ID NO: 3187255 - DNA, 16 bp, Homo sapiens
agctgtccctgcaggg

SEQ ID NO: 3187256 - DNA, 14 bp, Homo sapiens
agctgtcctgcagc

SEQ ID NO: 3187257 - DNA, 22 bp, Homo sapiens
agctgtctatgcagcctgctct

SEQ ID NO: 3187258 - DNA, 11 bp, Homo sapiens
agctgtctgct

SEQ ID NO: 3187259 - DNA, 17 bp, Homo sapiens
agctgtctgctcagaca

SEQ ID NO: 3187260 - DNA, 14 bp, Homo sapiens
agctgtgcaggcat

SEQ ID NO: 3187261 - DNA, 17 bp, Homo sapiens
agctgtgcaggcatggt

SEQ ID NO: 3187262 - DNA, 20 bp, Homo sapiens
agctgtgctctggacaggca

SEQ ID NO: 3187263 - DNA, 21 bp, Homo sapiens
agctgtgctctggacaggcat

SEQ ID NO: 3187264 - DNA, 23 bp, Homo sapiens
agctgtgctctggacaggcatgt

SEQ ID NO: 3187265 - DNA, 15 bp, Homo sapiens
agctgtggcctcacc

SEQ ID NO: 3187266 - DNA, 14 bp, Homo sapiens
agctgtgttgaaac

SEQ ID NO: 3187267 - DNA, 18 bp, Homo sapiens
agctgtgttgaaacagaa

SEQ ID NO: 3187268 - DNA, 19 bp, Homo sapiens
agctgttaaactgttagca

SEQ ID NO: 3187269 - DNA, 19 bp, Homo sapiens
agctgttaccattcacaat

SEQ ID NO: 3187270 - DNA, 15 bp, Homo sapiens
agctgttactttctt

SEQ ID NO: 3187271 - DNA, 16 bp, Homo sapiens
agctgttcctgttcag

SEQ ID NO: 3187272 - DNA, 18 bp, Homo sapiens
agctgttcctgttcagta

SEQ ID NO: 3187273 - DNA, 14 bp, Homo sapiens
agctgttgagctgt

SEQ ID NO: 3187274 - DNA, 15 bp, Homo sapiens
agctgttgagctgtt

SEQ ID NO: 3187275 - DNA, 19 bp, Homo sapiens
agctgtttatggcctcagc

SEQ ID NO: 3187276 - DNA, 13 bp, Homo sapiens
agctgtttatgtt

SEQ ID NO: 3187277 - DNA, 17 bp, Homo sapiens
agctgtttatgttttta

SEQ ID NO: 3187278 - DNA, 19 bp, Homo sapiens
agctgtttattttatatta

SEQ ID NO: 3187279 - DNA, 14 bp, Homo sapiens
agctgtttccatag

SEQ ID NO: 3187280 - DNA, 16 bp, Homo sapiens
agcttaaattcctact

SEQ ID NO: 3187281 - DNA, 13 bp, Homo sapiens
agcttaacaatgc

SEQ ID NO: 3187282 - DNA, 17 bp, Homo sapiens
agcttaagcgttcatat

SEQ ID NO: 3187283 - DNA, 21 bp, Homo sapiens
agcttaatagccctccccctc

SEQ ID NO: 3187284 - DNA, 14 bp, Homo sapiens
agcttaatgctaca

SEQ ID NO: 3187285 - DNA, 20 bp, Homo sapiens
agcttagagtatacctccta

SEQ ID NO: 3187286 - DNA, 17 bp, Homo sapiens
agcttagccaatgtggg

SEQ ID NO: 3187287 - DNA, 21 bp, Homo sapiens
agcttatagaataaaagctat

SEQ ID NO: 3187288 - DNA, 11 bp, Homo sapiens
agcttatctct

SEQ ID NO: 3187289 - DNA, 22 bp, Homo sapiens
agcttatctcttttatatttgt

SEQ ID NO: 3187290 - DNA, 23 bp, Homo sapiens
agcttatctcttttatatttgta

SEQ ID NO: 3187291 - DNA, 16 bp, Homo sapiens
agcttatctttctttc

SEQ ID NO: 3187292 - DNA, 18 bp, Homo sapiens
agcttatctttctttcca

SEQ ID NO: 3187293 - DNA, 22 bp, Homo sapiens
agcttatctttctttccattta

SEQ ID NO: 3187294 - DNA, 20 bp, Homo sapiens
agcttatgggatccttgtct

SEQ ID NO: 3187295 - DNA, 22 bp, Homo sapiens
agcttattcatctgtttttctt

SEQ ID NO: 3187296 - DNA, 14 bp, Homo sapiens
agcttcaagtgcct

SEQ ID NO: 3187297 - DNA, 23 bp, Homo sapiens
agcttcagacttttatcaaaatc

SEQ ID NO: 3187298 - DNA, 18 bp, Homo sapiens
agcttcagctagctttta

SEQ ID NO: 3187299 - DNA, 16 bp, Homo sapiens
agcttcaggcaccagc

SEQ ID NO: 3187300 - DNA, 19 bp, Homo sapiens
agcttcagttgcttgtctt

SEQ ID NO: 3187301 - DNA, 21 bp, Homo sapiens
agcttcatgcctttgtaagtt

SEQ ID NO: 3187302 - DNA, 16 bp, Homo sapiens
agcttcattctccttg

SEQ ID NO: 3187303 - DNA, 13 bp, Homo sapiens
agcttcatttgtg

SEQ ID NO: 3187304 - DNA, 15 bp, Homo sapiens
agcttccaaatctca

SEQ ID NO: 3187305 - DNA, 17 bp, Homo sapiens
agcttcccagccatgcc

SEQ ID NO: 3187306 - DNA, 21 bp, Homo sapiens
agcttcccagccatgcccagg

SEQ ID NO: 3187307 - DNA, 19 bp, Homo sapiens
agcttccgctttgaaagaa

SEQ ID NO: 3187308 - DNA, 19 bp, Homo sapiens
agcttccttctgtgaaagt

SEQ ID NO: 3187309 - DNA, 18 bp, Homo sapiens
agcttcggttctccagaa

SEQ ID NO: 3187310 - DNA, 22 bp, Homo sapiens
agcttcggttctccagaatgta

SEQ ID NO: 3187311 - DNA, 17 bp, Homo sapiens
agcttctaaatggtgct

SEQ ID NO: 3187312 - DNA, 13 bp, Homo sapiens
agcttctcctgcg

SEQ ID NO: 3187313 - DNA, 23 bp, Homo sapiens
agcttctcctgcgccccgcccac

SEQ ID NO: 3187314 - DNA, 13 bp, Homo sapiens
agcttctctgcag

SEQ ID NO: 3187315 - DNA, 21 bp, Homo sapiens
agcttctctgctagatttcta

SEQ ID NO: 3187316 - DNA, 21 bp, Homo sapiens
agcttctgcttttctgccctg

SEQ ID NO: 3187317 - DNA, 22 bp, Homo sapiens
agcttctgcttttctgccctgg

SEQ ID NO: 3187318 - DNA, 23 bp, Homo sapiens
agcttctgcttttctgccctggc

SEQ ID NO: 3187319 - DNA, 14 bp, Homo sapiens
agcttctggtactc

SEQ ID NO: 3187320 - DNA, 16 bp, Homo sapiens
agcttctggtactctc

SEQ ID NO: 3187321 - DNA, 21 bp, Homo sapiens
agcttcttaattaatttgatt

SEQ ID NO: 3187322 - DNA, 14 bp, Homo sapiens
agcttcttcctagg

SEQ ID NO: 3187323 - DNA, 22 bp, Homo sapiens
agcttgaagatcgttagtatct

SEQ ID NO: 3187324 - DNA, 13 bp, Homo sapiens
agcttgactccca

SEQ ID NO: 3187325 - DNA, 12 bp, Homo sapiens
agcttgagcctc

SEQ ID NO: 3187326 - DNA, 13 bp, Homo sapiens
agcttgagcctcc

SEQ ID NO: 3187327 - DNA, 16 bp, Homo sapiens
agcttgctccctgtgt

SEQ ID NO: 3187328 - DNA, 18 bp, Homo sapiens
agcttgggagagcccctg

SEQ ID NO: 3187329 - DNA, 20 bp, Homo sapiens
agcttggggccaccaaagct

SEQ ID NO: 3187330 - DNA, 22 bp, Homo sapiens
agcttggggctttttccatctt

SEQ ID NO: 3187331 - DNA, 21 bp, Homo sapiens
agcttgtaaatagctcaggtg

SEQ ID NO: 3187332 - DNA, 17 bp, Homo sapiens
agcttgtaggagctgag

SEQ ID NO: 3187333 - DNA, 21 bp, Homo sapiens
agcttgtatagtgtaaaataa

SEQ ID NO: 3187334 - DNA, 17 bp, Homo sapiens
agcttgtcttttctgct

SEQ ID NO: 3187335 - DNA, 21 bp, Homo sapiens
agcttgtgaaaaaataaagaa

SEQ ID NO: 3187336 - DNA, 13 bp, Homo sapiens
agcttgtggccaa

SEQ ID NO: 3187337 - DNA, 14 bp, Homo sapiens
agcttgtggcccct

SEQ ID NO: 3187338 - DNA, 20 bp, Homo sapiens
agctttaccctcaggcatag

SEQ ID NO: 3187339 - DNA, 22 bp, Homo sapiens
agctttagaccctgggtgggct

SEQ ID NO: 3187340 - DNA, 16 bp, Homo sapiens
agctttattatggctt

SEQ ID NO: 3187341 - DNA, 21 bp, Homo sapiens
agctttattatggcttgtgaa

SEQ ID NO: 3187342 - DNA, 13 bp, Homo sapiens
agctttatttcta

SEQ ID NO: 3187343 - DNA, 17 bp, Homo sapiens
agctttcaaagaaggaa

SEQ ID NO: 3187344 - DNA, 17 bp, Homo sapiens
agctttcaagtgccttt

SEQ ID NO: 3187345 - DNA, 19 bp, Homo sapiens
agctttcagagccagtgaa

SEQ ID NO: 3187346 - DNA, 21 bp, Homo sapiens
agctttcccaaataaactcta

SEQ ID NO: 3187347 - DNA, 12 bp, Homo sapiens
agctttccctgc

SEQ ID NO: 3187348 - DNA, 16 bp, Homo sapiens
agctttccctgtgcca

SEQ ID NO: 3187349 - DNA, 12 bp, Homo sapiens
agctttcctgcc

SEQ ID NO: 3187350 - DNA, 14 bp, Homo sapiens
agctttcctgcccc

SEQ ID NO: 3187351 - DNA, 12 bp, Homo sapiens
agctttcctggt

SEQ ID NO: 3187352 - DNA, 14 bp, Homo sapiens
agctttcctggtcc

SEQ ID NO: 3187353 - DNA, 16 bp, Homo sapiens
agctttcctgtttcca

SEQ ID NO: 3187354 - DNA, 16 bp, Homo sapiens
agctttccttctccag

SEQ ID NO: 3187355 - DNA, 13 bp, Homo sapiens
agctttctctcag

SEQ ID NO: 3187356 - DNA, 17 bp, Homo sapiens
agctttctctcagaaat

SEQ ID NO: 3187357 - DNA, 20 bp, Homo sapiens
agctttctgtccttttggca

SEQ ID NO: 3187358 - DNA, 19 bp, Homo sapiens
agctttgactctataagca

SEQ ID NO: 3187359 - DNA, 17 bp, Homo sapiens
agctttgagaagccttc

SEQ ID NO: 3187360 - DNA, 19 bp, Homo sapiens
agctttgagaagccttcag

SEQ ID NO: 3187361 - DNA, 21 bp, Homo sapiens
agctttgaggttgacctgttt

SEQ ID NO: 3187362 - DNA, 16 bp, Homo sapiens
agctttgctaccaaag

SEQ ID NO: 3187363 - DNA, 21 bp, Homo sapiens
agctttgctctttggtagaaa

SEQ ID NO: 3187364 - DNA, 23 bp, Homo sapiens
agctttgctctttggtagaaaag

SEQ ID NO: 3187365 - DNA, 15 bp, Homo sapiens
agcttttattgtata

SEQ ID NO: 3187366 - DNA, 17 bp, Homo sapiens
agcttttcatggaagtg

SEQ ID NO: 3187367 - DNA, 17 bp, Homo sapiens
agctttttaaaacatta

SEQ ID NO: 3187368 - DNA, 14 bp, Homo sapiens
agctttttaattgt

SEQ ID NO: 3187369 - DNA, 15 bp, Homo sapiens
agctttttaattgtt

SEQ ID NO: 3187370 - DNA, 16 bp, Homo sapiens
agctttttattccctg

SEQ ID NO: 3187371 - DNA, 21 bp, Homo sapiens
agcttttttccttaatccagc

SEQ ID NO: 3187372 - DNA, 19 bp, Homo sapiens
aggaaaaaaaaacagccac

SEQ ID NO: 3187373 - DNA, 20 bp, Homo sapiens
aggaaaaacaaaacaaagaa

SEQ ID NO: 3187374 - DNA, 13 bp, Homo sapiens
aggaaaaacaggt

SEQ ID NO: 3187375 - DNA, 14 bp, Homo sapiens
aggaaaaacaggtc

SEQ ID NO: 3187376 - DNA, 15 bp, Homo sapiens
aggaaaaataatcaa

SEQ ID NO: 3187377 - DNA, 18 bp, Homo sapiens
aggaaaacaaatcactgt

SEQ ID NO: 3187378 - DNA, 19 bp, Homo sapiens
aggaaaaccaagccgtggc

SEQ ID NO: 3187379 - DNA, 20 bp, Homo sapiens
aggaaaaccaagccgtggct

SEQ ID NO: 3187380 - DNA, 14 bp, Homo sapiens
aggaaaagaaacct

SEQ ID NO: 3187381 - DNA, 23 bp, Homo sapiens
aggaaaagaacaaacaaaactta

SEQ ID NO: 3187382 - DNA, 15 bp, Homo sapiens
aggaaaagaggccca

SEQ ID NO: 3187383 - DNA, 17 bp, Homo sapiens
aggaaaaggttgaataa

SEQ ID NO: 3187384 - DNA, 16 bp, Homo sapiens
aggaaaagtacattta

SEQ ID NO: 3187385 - DNA, 22 bp, Homo sapiens
aggaaaagtacatttaatacag

SEQ ID NO: 3187386 - DNA, 22 bp, Homo sapiens
aggaaaagttaaactaaaaaaa

SEQ ID NO: 3187387 - DNA, 19 bp, Homo sapiens
aggaaaatagtttaggaga

SEQ ID NO: 3187388 - DNA, 17 bp, Homo sapiens
aggaaacaatatttata

SEQ ID NO: 3187389 - DNA, 12 bp, Homo sapiens
aggaaacagtta

SEQ ID NO: 3187390 - DNA, 13 bp, Homo sapiens
aggaaaccaacac

SEQ ID NO: 3187391 - DNA, 11 bp, Homo sapiens
aggaaaccaag

SEQ ID NO: 3187392 - DNA, 23 bp, Homo sapiens
aggaaacgccccgggcaaagggt

SEQ ID NO: 3187393 - DNA, 16 bp, Homo sapiens
aggaaactaagcattg

SEQ ID NO: 3187394 - DNA, 19 bp, Homo sapiens
aggaaactaagcattgtat

SEQ ID NO: 3187395 - DNA, 19 bp, Homo sapiens
aggaaactccacatctgcc

SEQ ID NO: 3187396 - DNA, 18 bp, Homo sapiens
aggaaactcttatctcag

SEQ ID NO: 3187397 - DNA, 21 bp, Homo sapiens
aggaaacttcagttgatcttc

SEQ ID NO: 3187398 - DNA, 16 bp, Homo sapiens
aggaaagaagggggcc

SEQ ID NO: 3187399 - DNA, 23 bp, Homo sapiens
aggaaagaagggggccctgctac

SEQ ID NO: 3187400 - DNA, 12 bp, Homo sapiens
aggaaagagagc

SEQ ID NO: 3187401 - DNA, 17 bp, Homo sapiens
aggaaagagtcttcaac

SEQ ID NO: 3187402 - DNA, 16 bp, Homo sapiens
aggaaagcaataaatg

SEQ ID NO: 3187403 - DNA, 13 bp, Homo sapiens
aggaaagccctcc

SEQ ID NO: 3187404 - DNA, 17 bp, Homo sapiens
aggaaagccctccccct

SEQ ID NO: 3187405 - DNA, 14 bp, Homo sapiens
aggaaaggagatca

SEQ ID NO: 3187406 - DNA, 19 bp, Homo sapiens
aggaaaggattttaccaaa

SEQ ID NO: 3187407 - DNA, 21 bp, Homo sapiens
aggaaaggattttaccaaagc

SEQ ID NO: 3187408 - DNA, 14 bp, Homo sapiens
aggaaagggaggag

SEQ ID NO: 3187409 - DNA, 22 bp, Homo sapiens
aggaaagggaggagtggaggtg

SEQ ID NO: 3187410 - DNA, 19 bp, Homo sapiens
aggaaagggggtcccagtg

SEQ ID NO: 3187411 - DNA, 18 bp, Homo sapiens
aggaaagtgatatgcatt

SEQ ID NO: 3187412 - DNA, 21 bp, Homo sapiens
aggaaataaaaaagtctctat

SEQ ID NO: 3187413 - DNA, 22 bp, Homo sapiens
aggaaataaaacctttcaaatt

SEQ ID NO: 3187414 - DNA, 16 bp, Homo sapiens
aggaaatccattgttt

SEQ ID NO: 3187415 - DNA, 20 bp, Homo sapiens
aggaaatccattgtttaaag

SEQ ID NO: 3187416 - DNA, 22 bp, Homo sapiens
aggaaatttgtttgtatttttt

SEQ ID NO: 3187417 - DNA, 23 bp, Homo sapiens
aggaacacccgactcctcaaaag

SEQ ID NO: 3187418 - DNA, 13 bp, Homo sapiens
aggaacacctgat

SEQ ID NO: 3187419 - DNA, 22 bp, Homo sapiens
aggaacacctgatcttacagaa

SEQ ID NO: 3187420 - DNA, 21 bp, Homo sapiens
aggaacacgtttttacatact

SEQ ID NO: 3187421 - DNA, 21 bp, Homo sapiens
aggaacagctatgggagcccc

SEQ ID NO: 3187422 - DNA, 21 bp, Homo sapiens
aggaacagtgtggtttgggaa

SEQ ID NO: 3187423 - DNA, 16 bp, Homo sapiens
aggaacatatgaaaat

SEQ ID NO: 3187424 - DNA, 12 bp, Homo sapiens
aggaacctggga

SEQ ID NO: 3187425 - DNA, 21 bp, Homo sapiens
aggaacgctaacaatttctca

SEQ ID NO: 3187426 - DNA, 14 bp, Homo sapiens
aggaactccttggc

SEQ ID NO: 3187427 - DNA, 14 bp, Homo sapiens
aggaactctggacc

SEQ ID NO: 3187428 - DNA, 18 bp, Homo sapiens
aggaactgggcctgttgc

SEQ ID NO: 3187429 - DNA, 15 bp, Homo sapiens
aggaactgtccagag

SEQ ID NO: 3187430 - DNA, 16 bp, Homo sapiens
aggaactgtccagaga

SEQ ID NO: 3187431 - DNA, 19 bp, Homo sapiens
aggaactgtccagagagca

SEQ ID NO: 3187432 - DNA, 20 bp, Homo sapiens
aggaactgtccagagagcaa

SEQ ID NO: 3187433 - DNA, 20 bp, Homo sapiens
aggaactgtctcaaaaggat

SEQ ID NO: 3187434 - DNA, 13 bp, Homo sapiens
aggaacttcagag

SEQ ID NO: 3187435 - DNA, 21 bp, Homo sapiens
aggaagaacgcggtgtgtaac

SEQ ID NO: 3187436 - DNA, 17 bp, Homo sapiens
aggaagaagtggtacta

SEQ ID NO: 3187437 - DNA, 20 bp, Homo sapiens
aggaagaagtggtactagtg

SEQ ID NO: 3187438 - DNA, 14 bp, Homo sapiens
aggaagagaaacca

SEQ ID NO: 3187439 - DNA, 12 bp, Homo sapiens
aggaagagcagg

SEQ ID NO: 3187440 - DNA, 23 bp, Homo sapiens
aggaagagcaggcacatggagga

SEQ ID NO: 3187441 - DNA, 17 bp, Homo sapiens
aggaagagggctgagct

SEQ ID NO: 3187442 - DNA, 18 bp, Homo sapiens
aggaagagggctgagctg

SEQ ID NO: 3187443 - DNA, 22 bp, Homo sapiens
aggaagatatacatgaaaattt

SEQ ID NO: 3187444 - DNA, 18 bp, Homo sapiens
aggaagatgggggcaaga

SEQ ID NO: 3187445 - DNA, 19 bp, Homo sapiens
aggaagcaggtgtcctttc

SEQ ID NO: 3187446 - DNA, 22 bp, Homo sapiens
aggaagcaggtgtcctttcccc

SEQ ID NO: 3187447 - DNA, 18 bp, Homo sapiens
aggaagcattcagagagc

SEQ ID NO: 3187448 - DNA, 19 bp, Homo sapiens
aggaagcccaattgctgga

SEQ ID NO: 3187449 - DNA, 11 bp, Homo sapiens
aggaagcccac

SEQ ID NO: 3187450 - DNA, 16 bp, Homo sapiens
aggaagcccacactat

SEQ ID NO: 3187451 - DNA, 21 bp, Homo sapiens
aggaagcccggtggcgtggca

SEQ ID NO: 3187452 - DNA, 11 bp, Homo sapiens
aggaaggaaaa

SEQ ID NO: 3187453 - DNA, 20 bp, Homo sapiens
aggaaggacagactggccgg

SEQ ID NO: 3187454 - DNA, 15 bp, Homo sapiens
aggaaggagattcca

SEQ ID NO: 3187455 - DNA, 17 bp, Homo sapiens
aggaaggattgtaaaaa

SEQ ID NO: 3187456 - DNA, 13 bp, Homo sapiens
aggaaggcaagag

SEQ ID NO: 3187457 - DNA, 14 bp, Homo sapiens
aggaaggcagctgc

SEQ ID NO: 3187458 - DNA, 15 bp, Homo sapiens
aggaaggcaggaggg

SEQ ID NO: 3187459 - DNA, 21 bp, Homo sapiens
aggaaggctgaactcttcaga

SEQ ID NO: 3187460 - DNA, 14 bp, Homo sapiens
aggaaggtagaaat

SEQ ID NO: 3187461 - DNA, 15 bp, Homo sapiens
aggaaggtgctgagc

SEQ ID NO: 3187462 - DNA, 15 bp, Homo sapiens
aggaaggtggatggc

SEQ ID NO: 3187463 - DNA, 15 bp, Homo sapiens
aggaagttttctgta

SEQ ID NO: 3187464 - DNA, 16 bp, Homo sapiens
aggaagttttctgtag

SEQ ID NO: 3187465 - DNA, 16 bp, Homo sapiens
aggaataaatgccttt

SEQ ID NO: 3187466 - DNA, 12 bp, Homo sapiens
aggaataagaat

SEQ ID NO: 3187467 - DNA, 19 bp, Homo sapiens
aggaataaggcccagagcg

SEQ ID NO: 3187468 - DNA, 17 bp, Homo sapiens
aggaatagccagagagg

SEQ ID NO: 3187469 - DNA, 17 bp, Homo sapiens
aggaatagttgagcccc

SEQ ID NO: 3187470 - DNA, 20 bp, Homo sapiens
aggaatatgacggaagaaca

SEQ ID NO: 3187471 - DNA, 16 bp, Homo sapiens
aggaatattttccaaa

SEQ ID NO: 3187472 - DNA, 22 bp, Homo sapiens
aggaatcatgtcaggcctgtgt

SEQ ID NO: 3187473 - DNA, 21 bp, Homo sapiens
aggaatcattccagtgctaga

SEQ ID NO: 3187474 - DNA, 14 bp, Homo sapiens
aggaatgaacttgt

SEQ ID NO: 3187475 - DNA, 23 bp, Homo sapiens
aggaatgaacttgttacttgcag

SEQ ID NO: 3187476 - DNA, 15 bp, Homo sapiens
aggaatgcacaaatt

SEQ ID NO: 3187477 - DNA, 23 bp, Homo sapiens
aggaatgcacaaattgaaaacac

SEQ ID NO: 3187478 - DNA, 13 bp, Homo sapiens
aggaatgcctgtg

SEQ ID NO: 3187479 - DNA, 17 bp, Homo sapiens
aggaatgctggactgga

SEQ ID NO: 3187480 - DNA, 18 bp, Homo sapiens
aggaatgtagctggtttc

SEQ ID NO: 3187481 - DNA, 12 bp, Homo sapiens
aggaattatgtc

SEQ ID NO: 3187482 - DNA, 18 bp, Homo sapiens
aggaattccaattaaatt

SEQ ID NO: 3187483 - DNA, 19 bp, Homo sapiens
aggaatttaaaattaagta

SEQ ID NO: 3187484 - DNA, 13 bp, Homo sapiens
aggaatttcttaa

SEQ ID NO: 3187485 - DNA, 19 bp, Homo sapiens
aggaatttgtacttcttat

SEQ ID NO: 3187486 - DNA, 23 bp, Homo sapiens
aggaatttgtacttcttattgca

SEQ ID NO: 3187487 - DNA, 18 bp, Homo sapiens
aggaattttattttgctg

SEQ ID NO: 3187488 - DNA, 14 bp, Homo sapiens
aggacaaaacttct

SEQ ID NO: 3187489 - DNA, 17 bp, Homo sapiens
aggacaaaacttcttgt

SEQ ID NO: 3187490 - DNA, 17 bp, Homo sapiens
aggacaatcagtcccct

SEQ ID NO: 3187491 - DNA, 19 bp, Homo sapiens
aggacaatcagtcccctcc

SEQ ID NO: 3187492 - DNA, 21 bp, Homo sapiens
aggacaatcagtcccctccca

SEQ ID NO: 3187493 - DNA, 22 bp, Homo sapiens
aggacaatcagtcccctcccat

SEQ ID NO: 3187494 - DNA, 23 bp, Homo sapiens
aggacaatcagtcccctcccatc

SEQ ID NO: 3187495 - DNA, 23 bp, Homo sapiens
aggacacaccccacaccccagcc

SEQ ID NO: 3187496 - DNA, 13 bp, Homo sapiens
aggacacactaat

SEQ ID NO: 3187497 - DNA, 23 bp, Homo sapiens
aggacacactaatcgaactatga

SEQ ID NO: 3187498 - DNA, 13 bp, Homo sapiens
aggacacatcccg

SEQ ID NO: 3187499 - DNA, 18 bp, Homo sapiens
aggacacatcccggcctc

SEQ ID NO: 3187500 - DNA, 19 bp, Homo sapiens
aggacaccacacccagcct

SEQ ID NO: 3187501 - DNA, 21 bp, Homo sapiens
aggacaccacacccagcctca

SEQ ID NO: 3187502 - DNA, 22 bp, Homo sapiens
aggacaccacacccagcctcag

SEQ ID NO: 3187503 - DNA, 23 bp, Homo sapiens
aggacaccacacccagcctcagt

SEQ ID NO: 3187504 - DNA, 20 bp, Homo sapiens
aggacaccagtgaaagaagc

SEQ ID NO: 3187505 - DNA, 16 bp, Homo sapiens
aggacacgtggcctgc

SEQ ID NO: 3187506 - DNA, 23 bp, Homo sapiens
aggacactaaccacgctggacct

SEQ ID NO: 3187507 - DNA, 21 bp, Homo sapiens
aggacagagcaggggctccag

SEQ ID NO: 3187508 - DNA, 20 bp, Homo sapiens
aggacaggaccctcaggaat

SEQ ID NO: 3187509 - DNA, 13 bp, Homo sapiens
aggacaggcaggc

SEQ ID NO: 3187510 - DNA, 21 bp, Homo sapiens
aggacagtgcttcagcctgag

SEQ ID NO: 3187511 - DNA, 20 bp, Homo sapiens
aggacataaattagaggtct

SEQ ID NO: 3187512 - DNA, 17 bp, Homo sapiens
aggacatactgcatgta

SEQ ID NO: 3187513 - DNA, 21 bp, Homo sapiens
aggacatagcctgcaaagctg

SEQ ID NO: 3187514 - DNA, 22 bp, Homo sapiens
aggacatgcaataaaatttaaa

SEQ ID NO: 3187515 - DNA, 16 bp, Homo sapiens
aggacatgtttttgtt

SEQ ID NO: 3187516 - DNA, 21 bp, Homo sapiens
aggacatgtttttgttttctt

SEQ ID NO: 3187517 - DNA, 15 bp, Homo sapiens
aggacattgcggaca

SEQ ID NO: 3187518 - DNA, 17 bp, Homo sapiens
aggaccaagcatcttgg

SEQ ID NO: 3187519 - DNA, 18 bp, Homo sapiens
aggaccacacagtcccca

SEQ ID NO: 3187520 - DNA, 20 bp, Homo sapiens
aggaccacacagtccccaga

SEQ ID NO: 3187521 - DNA, 22 bp, Homo sapiens
aggaccacagtgggtggcacct

SEQ ID NO: 3187522 - DNA, 15 bp, Homo sapiens
aggaccactcagccc

SEQ ID NO: 3187523 - DNA, 13 bp, Homo sapiens
aggaccagctggg

SEQ ID NO: 3187524 - DNA, 13 bp, Homo sapiens
aggaccaggactc

SEQ ID NO: 3187525 - DNA, 18 bp, Homo sapiens
aggaccaggactccctcc

SEQ ID NO: 3187526 - DNA, 16 bp, Homo sapiens
aggacccacccatctt

SEQ ID NO: 3187527 - DNA, 17 bp, Homo sapiens
aggacccaggccctcca

SEQ ID NO: 3187528 - DNA, 20 bp, Homo sapiens
aggacccggaggggcctggc

SEQ ID NO: 3187529 - DNA, 17 bp, Homo sapiens
aggaccctcaggaattc

SEQ ID NO: 3187530 - DNA, 20 bp, Homo sapiens
aggaccctcaggaattcagt

SEQ ID NO: 3187531 - DNA, 14 bp, Homo sapiens
aggaccctgaccct

SEQ ID NO: 3187532 - DNA, 19 bp, Homo sapiens
aggaccgtggccctgccct

SEQ ID NO: 3187533 - DNA, 13 bp, Homo sapiens
aggacctcccttc

SEQ ID NO: 3187534 - DNA, 15 bp, Homo sapiens
aggacctcccttccg

SEQ ID NO: 3187535 - DNA, 17 bp, Homo sapiens
aggacctgaaattccaa

SEQ ID NO: 3187536 - DNA, 20 bp, Homo sapiens
aggacctgaaattccaaagt

SEQ ID NO: 3187537 - DNA, 19 bp, Homo sapiens
aggacctggcatcatggtg

SEQ ID NO: 3187538 - DNA, 15 bp, Homo sapiens
aggaccttatctgtg

SEQ ID NO: 3187539 - DNA, 18 bp, Homo sapiens
aggaccttcgggctgtgc

SEQ ID NO: 3187540 - DNA, 22 bp, Homo sapiens
aggacctttccaccacagccag

SEQ ID NO: 3187541 - DNA, 17 bp, Homo sapiens
aggacgcaccgccgcca

SEQ ID NO: 3187542 - DNA, 24 bp, Homo sapiens
aggacgcaccgccgccaccagccc

SEQ ID NO: 3187543 - DNA, 21 bp, Homo sapiens
aggacgcacgctcgctgccat

SEQ ID NO: 3187544 - DNA, 17 bp, Homo sapiens
aggacgctctctggcct

SEQ ID NO: 3187545 - DNA, 14 bp, Homo sapiens
aggacgcttctgaa

SEQ ID NO: 3187546 - DNA, 17 bp, Homo sapiens
aggactagatactactt

SEQ ID NO: 3187547 - DNA, 17 bp, Homo sapiens
aggactccactggacag

SEQ ID NO: 3187548 - DNA, 18 bp, Homo sapiens
aggactccactggacaga

SEQ ID NO: 3187549 - DNA, 23 bp, Homo sapiens
aggactccactggacagacccag

SEQ ID NO: 3187550 - DNA, 17 bp, Homo sapiens
aggactcccaaccctgg

SEQ ID NO: 3187551 - DNA, 14 bp, Homo sapiens
aggactccctcctc

SEQ ID NO: 3187552 - DNA, 21 bp, Homo sapiens
aggactcctcctttttccatg

SEQ ID NO: 3187553 - DNA, 14 bp, Homo sapiens
aggactcgcttgta

SEQ ID NO: 3187554 - DNA, 13 bp, Homo sapiens
aggactctgaggc

SEQ ID NO: 3187555 - DNA, 16 bp, Homo sapiens
aggactctgcctcctc

SEQ ID NO: 3187556 - DNA, 19 bp, Homo sapiens
aggactctgcctcctcttc

SEQ ID NO: 3187557 - DNA, 24 bp, Homo sapiens
aggactgagccccgcagacctccc

SEQ ID NO: 3187558 - DNA, 14 bp, Homo sapiens
aggactgaggagtg

SEQ ID NO: 3187559 - DNA, 15 bp, Homo sapiens
aggactgtaaagatt

SEQ ID NO: 3187560 - DNA, 15 bp, Homo sapiens
aggactgtataagta

SEQ ID NO: 3187561 - DNA, 15 bp, Homo sapiens
aggactgtggctgca

SEQ ID NO: 3187562 - DNA, 18 bp, Homo sapiens
aggacttaacggctccag

SEQ ID NO: 3187563 - DNA, 20 bp, Homo sapiens
aggacttaacggctccagga

SEQ ID NO: 3187564 - DNA, 11 bp, Homo sapiens
aggactttgca

SEQ ID NO: 3187565 - DNA, 17 bp, Homo sapiens
aggacttttctttgtgg

SEQ ID NO: 3187566 - DNA, 22 bp, Homo sapiens
aggacttttctttgtggcttcc

SEQ ID NO: 3187567 - DNA, 23 bp, Homo sapiens
aggacttttctttgtggcttcct

SEQ ID NO: 3187568 - DNA, 15 bp, Homo sapiens
aggagaaaaaaaacc

SEQ ID NO: 3187569 - DNA, 14 bp, Homo sapiens
aggagaaacacatc

SEQ ID NO: 3187570 - DNA, 19 bp, Homo sapiens
aggagaaacacattcttat

SEQ ID NO: 3187571 - DNA, 16 bp, Homo sapiens
aggagaaacagagaca

SEQ ID NO: 3187572 - DNA, 22 bp, Homo sapiens
aggagaaccaaatctggaagcc

SEQ ID NO: 3187573 - DNA, 15 bp, Homo sapiens
aggagaaccactaca

SEQ ID NO: 3187574 - DNA, 13 bp, Homo sapiens
aggagaagaggca

SEQ ID NO: 3187575 - DNA, 21 bp, Homo sapiens
aggagaagaggcatcctgcct

SEQ ID NO: 3187576 - DNA, 16 bp, Homo sapiens
aggagaatgaaatgta

SEQ ID NO: 3187577 - DNA, 18 bp, Homo sapiens
aggagacagttcaagaaa

SEQ ID NO: 3187578 - DNA, 19 bp, Homo sapiens
aggagactgaggcttagag

SEQ ID NO: 3187579 - DNA, 12 bp, Homo sapiens
aggagactgcgt

SEQ ID NO: 3187580 - DNA, 11 bp, Homo sapiens
aggagagaccg

SEQ ID NO: 3187581 - DNA, 17 bp, Homo sapiens
aggagagactgaaagca

SEQ ID NO: 3187582 - DNA, 19 bp, Homo sapiens
aggagagactgaaagcagc

SEQ ID NO: 3187583 - DNA, 22 bp, Homo sapiens
aggagagactgaaagcagcagc

SEQ ID NO: 3187584 - DNA, 22 bp, Homo sapiens
aggagagactgagcagccgcca

SEQ ID NO: 3187585 - DNA, 19 bp, Homo sapiens
aggagagagaaagccaggc

SEQ ID NO: 3187586 - DNA, 13 bp, Homo sapiens
aggagagagccag

SEQ ID NO: 3187587 - DNA, 14 bp, Homo sapiens
aggagagagccagg

SEQ ID NO: 3187588 - DNA, 14 bp, Homo sapiens
aggagagaggcaga

SEQ ID NO: 3187589 - DNA, 11 bp, Homo sapiens
aggagagcagc

SEQ ID NO: 3187590 - DNA, 12 bp, Homo sapiens
aggagagcagcg

SEQ ID NO: 3187591 - DNA, 24 bp, Homo sapiens
aggagagccaacctcggcttgtgg

SEQ ID NO: 3187592 - DNA, 16 bp, Homo sapiens
aggagagcccttcatt

SEQ ID NO: 3187593 - DNA, 13 bp, Homo sapiens
aggagagcctgct

SEQ ID NO: 3187594 - DNA, 14 bp, Homo sapiens
aggagagcctgctg

SEQ ID NO: 3187595 - DNA, 15 bp, Homo sapiens
aggagagcctgctgc

SEQ ID NO: 3187596 - DNA, 15 bp, Homo sapiens
aggagaggagagagg

SEQ ID NO: 3187597 - DNA, 18 bp, Homo sapiens
aggagaggagagaggcag

SEQ ID NO: 3187598 - DNA, 13 bp, Homo sapiens
aggagaggagggt

SEQ ID NO: 3187599 - DNA, 17 bp, Homo sapiens
aggagaggatgagagcc

SEQ ID NO: 3187600 - DNA, 19 bp, Homo sapiens
aggagaggatgagagccca

SEQ ID NO: 3187601 - DNA, 15 bp, Homo sapiens
aggagaggcagcatg

SEQ ID NO: 3187602 - DNA, 13 bp, Homo sapiens
aggagaggctggg

SEQ ID NO: 3187603 - DNA, 18 bp, Homo sapiens
aggagaggggaagggcca

SEQ ID NO: 3187604 - DNA, 14 bp, Homo sapiens
aggagatatctgag

SEQ ID NO: 3187605 - DNA, 17 bp, Homo sapiens
aggagatgaccagggat

SEQ ID NO: 3187606 - DNA, 20 bp, Homo sapiens
aggagatggaagttgcagtg

SEQ ID NO: 3187607 - DNA, 22 bp, Homo sapiens
aggagatggccataggagagga

SEQ ID NO: 3187608 - DNA, 12 bp, Homo sapiens
gcagacaggcaa

SEQ ID NO: 3187609 - DNA, 20 bp, Homo sapiens
gcagacaggccatgtgagcc

SEQ ID NO: 3187610 - DNA, 22 bp, Homo sapiens
gcagacaggccatgtgagccac

SEQ ID NO: 3187611 - DNA, 19 bp, Homo sapiens
gcagacctacctgcagtgg

SEQ ID NO: 3187612 - DNA, 17 bp, Homo sapiens
gcagacctccccagccc

SEQ ID NO: 3187613 - DNA, 22 bp, Homo sapiens
gcagacctccccagcccctagc

SEQ ID NO: 3187614 - DNA, 20 bp, Homo sapiens
gcagacgggcaagaagctgc

SEQ ID NO: 3187615 - DNA, 14 bp, Homo sapiens
gcagacgtccatca

SEQ ID NO: 3187616 - DNA, 15 bp, Homo sapiens
gcagactacacagga

SEQ ID NO: 3187617 - DNA, 16 bp, Homo sapiens
gcagactacacaggat

SEQ ID NO: 3187618 - DNA, 17 bp, Homo sapiens
gcagactcagtttgtca

SEQ ID NO: 3187619 - DNA, 23 bp, Homo sapiens
gcagactggcggagaaggagagg

SEQ ID NO: 3187620 - DNA, 20 bp, Homo sapiens
gcagactggggcatcctgtg

SEQ ID NO: 3187621 - DNA, 15 bp, Homo sapiens
gcagacttcccagct

SEQ ID NO: 3187622 - DNA, 18 bp, Homo sapiens
gcagacttcccagctagg

SEQ ID NO: 3187623 - DNA, 14 bp, Homo sapiens
gcagagaagctgga

SEQ ID NO: 3187624 - DNA, 16 bp, Homo sapiens
gcagagaagctggact

SEQ ID NO: 3187625 - DNA, 15 bp, Homo sapiens
gcagagaaggcctct

SEQ ID NO: 3187626 - DNA, 20 bp, Homo sapiens
gcagagaatgaaagggccca

SEQ ID NO: 3187627 - DNA, 22 bp, Homo sapiens
gcagagaatgaaagggcccaga

SEQ ID NO: 3187628 - DNA, 13 bp, Homo sapiens
gcagagacactaa

SEQ ID NO: 3187629 - DNA, 15 bp, Homo sapiens
gcagagagccatttt

SEQ ID NO: 3187630 - DNA, 21 bp, Homo sapiens
gcagagagccattttgtgaat

SEQ ID NO: 3187631 - DNA, 18 bp, Homo sapiens
gcagagagggatgggttc

SEQ ID NO: 3187632 - DNA, 23 bp, Homo sapiens
gcagagatttctcattgactttt

SEQ ID NO: 3187633 - DNA, 19 bp, Homo sapiens
gcagagcaaatgagggagg

SEQ ID NO: 3187634 - DNA, 20 bp, Homo sapiens
gcagagcacaaacttcagaa

SEQ ID NO: 3187635 - DNA, 14 bp, Homo sapiens
gcagagccatgggc

SEQ ID NO: 3187636 - DNA, 16 bp, Homo sapiens
gcagagccatgggcct

SEQ ID NO: 3187637 - DNA, 18 bp, Homo sapiens
gcagagccatgggcctgg

SEQ ID NO: 3187638 - DNA, 20 bp, Homo sapiens
gcagagccatgggcctgggc

SEQ ID NO: 3187639 - DNA, 23 bp, Homo sapiens
gcagagcgccgtgagttctcagg

SEQ ID NO: 3187640 - DNA, 14 bp, Homo sapiens
gcagagctggctct

SEQ ID NO: 3187641 - DNA, 15 bp, Homo sapiens
gcagagctggctctg

SEQ ID NO: 3187642 - DNA, 17 bp, Homo sapiens
gcagagctggctctgag

SEQ ID NO: 3187643 - DNA, 13 bp, Homo sapiens
gcagaggaccaca

SEQ ID NO: 3187644 - DNA, 20 bp, Homo sapiens
gcagaggaggtgagagtggg

SEQ ID NO: 3187645 - DNA, 21 bp, Homo sapiens
gcagagggaatgttccctgca

SEQ ID NO: 3187646 - DNA, 22 bp, Homo sapiens
gcagagggaatgttccctgcac

SEQ ID NO: 3187647 - DNA, 12 bp, Homo sapiens
gcagagggacca

SEQ ID NO: 3187648 - DNA, 18 bp, Homo sapiens
gcagagggctggaggccc

SEQ ID NO: 3187649 - DNA, 19 bp, Homo sapiens
gcagagggctggaggccca

SEQ ID NO: 3187650 - DNA, 14 bp, Homo sapiens
gcagaggggcagcc

SEQ ID NO: 3187651 - DNA, 15 bp, Homo sapiens
gcagaggggcagccg

SEQ ID NO: 3187652 - DNA, 16 bp, Homo sapiens
gcagaggggcagccgc

SEQ ID NO: 3187653 - DNA, 16 bp, Homo sapiens
gcagaggggccaggcc

SEQ ID NO: 3187654 - DNA, 17 bp, Homo sapiens
gcagaggggccaggccc

SEQ ID NO: 3187655 - DNA, 19 bp, Homo sapiens
gcagagtcgttggagactg

SEQ ID NO: 3187656 - DNA, 21 bp, Homo sapiens
gcagagtcgttggagactgaa

SEQ ID NO: 3187657 - DNA, 12 bp, Homo sapiens
gcagagtctggg

SEQ ID NO: 3187658 - DNA, 16 bp, Homo sapiens
gcagagtctgggcctc

SEQ ID NO: 3187659 - DNA, 17 bp, Homo sapiens
gcagagtgagcaagggg

SEQ ID NO: 3187660 - DNA, 22 bp, Homo sapiens
gcagagtgagcaagggggccca

SEQ ID NO: 3187661 - DNA, 15 bp, Homo sapiens
gcagagtgcacagct

SEQ ID NO: 3187662 - DNA, 17 bp, Homo sapiens
gcagagtggactgcatt

SEQ ID NO: 3187663 - DNA, 13 bp, Homo sapiens
gcagagttaaatc

SEQ ID NO: 3187664 - DNA, 19 bp, Homo sapiens
gcagagttttcattaaatc

SEQ ID NO: 3187665 - DNA, 16 bp, Homo sapiens
gcagataatcagcctc

SEQ ID NO: 3187666 - DNA, 16 bp, Homo sapiens
gcagataattctggac

SEQ ID NO: 3187667 - DNA, 18 bp, Homo sapiens
gcagataattctggacca

SEQ ID NO: 3187668 - DNA, 19 bp, Homo sapiens
gcagataattctggaccag

SEQ ID NO: 3187669 - DNA, 15 bp, Homo sapiens
gcagatgcagagagc

SEQ ID NO: 3187670 - DNA, 17 bp, Homo sapiens
gcagatgccaccctagc

SEQ ID NO: 3187671 - DNA, 15 bp, Homo sapiens
gcagatggaaagagg

SEQ ID NO: 3187672 - DNA, 23 bp, Homo sapiens
gcagatggacagcgatgagggga

SEQ ID NO: 3187673 - DNA, 13 bp, Homo sapiens
gcagattcctggg

SEQ ID NO: 3187674 - DNA, 14 bp, Homo sapiens
gcagattcctgggc

SEQ ID NO: 3187675 - DNA, 16 bp, Homo sapiens
gcagattcctgggcct

SEQ ID NO: 3187676 - DNA, 17 bp, Homo sapiens
gcagattttacaaaaga

SEQ ID NO: 3187677 - DNA, 14 bp, Homo sapiens
gcagcaaattttca

SEQ ID NO: 3187678 - DNA, 19 bp, Homo sapiens
gcagcaaggccctgctgcc

SEQ ID NO: 3187679 - DNA, 23 bp, Homo sapiens
gcagcaatatattaccagcaaga

SEQ ID NO: 3187680 - DNA, 15 bp, Homo sapiens
gcagcacagcccagg

SEQ ID NO: 3187681 - DNA, 16 bp, Homo sapiens
gcagcacagcccaggg

SEQ ID NO: 3187682 - DNA, 20 bp, Homo sapiens
gcagcacagcccagggcctg

SEQ ID NO: 3187683 - DNA, 13 bp, Homo sapiens
gcagcaccctccc

SEQ ID NO: 3187684 - DNA, 22 bp, Homo sapiens
gcagcagaggacagtctggaga

SEQ ID NO: 3187685 - DNA, 21 bp, Homo sapiens
gcagcagagtgagcaaggggg

SEQ ID NO: 3187686 - DNA, 13 bp, Homo sapiens
gcagcagcaggtg

SEQ ID NO: 3187687 - DNA, 15 bp, Homo sapiens
gcagcagcaggtgat

SEQ ID NO: 3187688 - DNA, 12 bp, Homo sapiens
gcagcagcccag

SEQ ID NO: 3187689 - DNA, 12 bp, Homo sapiens
gcagcagctagg

SEQ ID NO: 3187690 - DNA, 20 bp, Homo sapiens
gcagcagctaggactgagga

SEQ ID NO: 3187691 - DNA, 19 bp, Homo sapiens
gcagcagctctgagccaga

SEQ ID NO: 3187692 - DNA, 21 bp, Homo sapiens
gcagcaggtgattggaccagg

SEQ ID NO: 3187693 - DNA, 13 bp, Homo sapiens
gcagcagtagctt

SEQ ID NO: 3187694 - DNA, 12 bp, Homo sapiens
gcagcatcttct

SEQ ID NO: 3187695 - DNA, 17 bp, Homo sapiens
gcagcatgacctgtgac

SEQ ID NO: 3187696 - DNA, 18 bp, Homo sapiens
gcagcatgcttgggctga

SEQ ID NO: 3187697 - DNA, 22 bp, Homo sapiens
gcagcatgttgctgaggagtga

SEQ ID NO: 3187698 - DNA, 18 bp, Homo sapiens
gcagccacatggccccat

SEQ ID NO: 3187699 - DNA, 11 bp, Homo sapiens
gcagccaccca

SEQ ID NO: 3187700 - DNA, 20 bp, Homo sapiens
gcagccacccaagcctgctg

SEQ ID NO: 3187701 - DNA, 23 bp, Homo sapiens
gcagccacccaagcctgctggct

SEQ ID NO: 3187702 - DNA, 19 bp, Homo sapiens
gcagccagaccagcaggct

SEQ ID NO: 3187703 - DNA, 12 bp, Homo sapiens
gcagccagccag

SEQ ID NO: 3187704 - DNA, 17 bp, Homo sapiens
gcagccagccagtcttg

SEQ ID NO: 3187705 - DNA, 20 bp, Homo sapiens
gcagccagccagtcttgcct

SEQ ID NO: 3187706 - DNA, 18 bp, Homo sapiens
gcagccagccggtgcctg

SEQ ID NO: 3187707 - DNA, 13 bp, Homo sapiens
gcagccaggctgc

SEQ ID NO: 3187708 - DNA, 14 bp, Homo sapiens
gcagccatgcctca

SEQ ID NO: 3187709 - DNA, 16 bp, Homo sapiens
gcagccatgcctcatg

SEQ ID NO: 3187710 - DNA, 23 bp, Homo sapiens
gcagccatgcctcatgccacacc

SEQ ID NO: 3187711 - DNA, 20 bp, Homo sapiens
gcagcccagcttcctggtgt

SEQ ID NO: 3187712 - DNA, 13 bp, Homo sapiens
gcagcccatgccc

SEQ ID NO: 3187713 - DNA, 20 bp, Homo sapiens
gcagcccatgcccacctgcc

SEQ ID NO: 3187714 - DNA, 22 bp, Homo sapiens
gcagcccatggcctctggccag

SEQ ID NO: 3187715 - DNA, 13 bp, Homo sapiens
gcagccccagaga

SEQ ID NO: 3187716 - DNA, 15 bp, Homo sapiens
gcagccccagagaga

SEQ ID NO: 3187717 - DNA, 21 bp, Homo sapiens
gcagccccattctgcctgccc

SEQ ID NO: 3187718 - DNA, 12 bp, Homo sapiens
gcagccccctcc

SEQ ID NO: 3187719 - DNA, 14 bp, Homo sapiens
gcagccccctccac

SEQ ID NO: 3187720 - DNA, 14 bp, Homo sapiens
gcagccccgggagg

SEQ ID NO: 3187721 - DNA, 22 bp, Homo sapiens
gcagccctaaggatctctcagg

SEQ ID NO: 3187722 - DNA, 19 bp, Homo sapiens
gcagccctcaacaggccca

SEQ ID NO: 3187723 - DNA, 14 bp, Homo sapiens
gcagccctgctttg

SEQ ID NO: 3187724 - DNA, 23 bp, Homo sapiens
gcagcccttgctttcggagctcc

SEQ ID NO: 3187725 - DNA, 14 bp, Homo sapiens
gcagcccttgggca

SEQ ID NO: 3187726 - DNA, 13 bp, Homo sapiens
gcagccgccagct

SEQ ID NO: 3187727 - DNA, 16 bp, Homo sapiens
gcagccgctaggagag

SEQ ID NO: 3187728 - DNA, 18 bp, Homo sapiens
gcagccgtgccttcagct

SEQ ID NO: 3187729 - DNA, 21 bp, Homo sapiens
gcagcctcaaaacgggtcagt

SEQ ID NO: 3187730 - DNA, 18 bp, Homo sapiens
gcagcctccagagccagc

SEQ ID NO: 3187731 - DNA, 23 bp, Homo sapiens
gcagcctccctctgacctgcagg

SEQ ID NO: 3187732 - DNA, 14 bp, Homo sapiens
gcagcctcctcctg

SEQ ID NO: 3187733 - DNA, 12 bp, Homo sapiens
gcagcctctccc

SEQ ID NO: 3187734 - DNA, 17 bp, Homo sapiens
gcagggaagagggcagt

SEQ ID NO: 3187735 - DNA, 21 bp, Homo sapiens
gcagggaaggacaggaccctc

SEQ ID NO: 3187736 - DNA, 22 bp, Homo sapiens
gcagggagccgagatcacgcca

SEQ ID NO: 3187737 - DNA, 14 bp, Homo sapiens
gcagggaggggact

SEQ ID NO: 3187738 - DNA, 16 bp, Homo sapiens
gcagggagtgatgatt

SEQ ID NO: 3187739 - DNA, 17 bp, Homo sapiens
gcagggatgggggtggc

SEQ ID NO: 3187740 - DNA, 15 bp, Homo sapiens
gcagggcagagggaa

SEQ ID NO: 3187741 - DNA, 12 bp, Homo sapiens
gcagggcagccc

SEQ ID NO: 3187742 - DNA, 16 bp, Homo sapiens
gcagggccaggctggt

SEQ ID NO: 3187743 - DNA, 20 bp, Homo sapiens
gcagggcccttggggctggg

SEQ ID NO: 3187744 - DNA, 18 bp, Homo sapiens
gcagggcgcccctgggag

SEQ ID NO: 3187745 - DNA, 17 bp, Homo sapiens
gcagggcgggcagaggg

SEQ ID NO: 3187746 - DNA, 21 bp, Homo sapiens
gcagggctcagcggggacagc

SEQ ID NO: 3187747 - DNA, 21 bp, Homo sapiens
gcagggctggccccagggcac

SEQ ID NO: 3187748 - DNA, 19 bp, Homo sapiens
gcaggggagacaggagcct

SEQ ID NO: 3187749 - DNA, 20 bp, Homo sapiens
gcaggggagacaggagccta

SEQ ID NO: 3187750 - DNA, 15 bp, Homo sapiens
gcaggggcaccttcc

SEQ ID NO: 3187751 - DNA, 17 bp, Homo sapiens
gcaggggctacaagagg

SEQ ID NO: 3187752 - DNA, 20 bp, Homo sapiens
gcaggggctctggagagaaa

SEQ ID NO: 3187753 - DNA, 23 bp, Homo sapiens
gcagggggccccgccagggctgg

SEQ ID NO: 3187754 - DNA, 16 bp, Homo sapiens
gcaggggggctgtgcc

SEQ ID NO: 3187755 - DNA, 17 bp, Homo sapiens
gcaggggggctgtgcca

SEQ ID NO: 3187756 - DNA, 12 bp, Homo sapiens
gcaggggtcccc

SEQ ID NO: 3187757 - DNA, 13 bp, Homo sapiens
gcaggggtccctg

SEQ ID NO: 3187758 - DNA, 16 bp, Homo sapiens
gcaggggtccctgcta

SEQ ID NO: 3187759 - DNA, 13 bp, Homo sapiens
gcagggtaccctt

SEQ ID NO: 3187760 - DNA, 16 bp, Homo sapiens
gcagggtaccctttgg

SEQ ID NO: 3187761 - DNA, 16 bp, Homo sapiens
gcagggtctcactctg

SEQ ID NO: 3187762 - DNA, 18 bp, Homo sapiens
gcagggtctcactctgtc

SEQ ID NO: 3187763 - DNA, 21 bp, Homo sapiens
gcagggtctgtttggactgca

SEQ ID NO: 3187764 - DNA, 17 bp, Homo sapiens
gcagggtgggcagccta

SEQ ID NO: 3187765 - DNA, 23 bp, Homo sapiens
gcaggtacttcctcctgatggcc

SEQ ID NO: 3187766 - DNA, 20 bp, Homo sapiens
gcaggtagatcgcttgagcc

SEQ ID NO: 3187767 - DNA, 22 bp, Homo sapiens
gcaggtagatcgcttgagccca

SEQ ID NO: 3187768 - DNA, 21 bp, Homo sapiens
gcaggtagccagggggactag

SEQ ID NO: 3187769 - DNA, 13 bp, Homo sapiens
gcaggtgcctcca

SEQ ID NO: 3187770 - DNA, 21 bp, Homo sapiens
gcaggtgcctgttgaatctga

SEQ ID NO: 3187771 - DNA, 13 bp, Homo sapiens
gcaggtggatcta

SEQ ID NO: 3187772 - DNA, 19 bp, Homo sapiens
gcaggtggatctatttcat

SEQ ID NO: 3187773 - DNA, 20 bp, Homo sapiens
gcaggtggatctatttcatg

SEQ ID NO: 3187774 - DNA, 21 bp, Homo sapiens
gcaggtgggcagacagtgacc

SEQ ID NO: 3187775 - DNA, 14 bp, Homo sapiens
gcaggtggtggcac

SEQ ID NO: 3187776 - DNA, 20 bp, Homo sapiens
gcaggtggtggcactgagcc

SEQ ID NO: 3187777 - DNA, 21 bp, Homo sapiens
gcaggtgtcatatgactgatt

SEQ ID NO: 3187778 - DNA, 13 bp, Homo sapiens
gcaggtgtggtgg

SEQ ID NO: 3187779 - DNA, 14 bp, Homo sapiens
gcaggttccccaag

SEQ ID NO: 3187780 - DNA, 16 bp, Homo sapiens
gcaggttggaaggggc

SEQ ID NO: 3187781 - DNA, 22 bp, Homo sapiens
gcaggttggaaggggccttgct

SEQ ID NO: 3187782 - DNA, 14 bp, Homo sapiens
gcaggttggacccc

SEQ ID NO: 3187783 - DNA, 15 bp, Homo sapiens
gcaggttggacccca

SEQ ID NO: 3187784 - DNA, 13 bp, Homo sapiens
gcaggttggatgg

SEQ ID NO: 3187785 - DNA, 15 bp, Homo sapiens
gcagtaaaacacatt

SEQ ID NO: 3187786 - DNA, 13 bp, Homo sapiens
gcagtaacattct

SEQ ID NO: 3187787 - DNA, 13 bp, Homo sapiens
gcagtacatggga

SEQ ID NO: 3187788 - DNA, 23 bp, Homo sapiens
gcagtacctataaagtaaagcta

SEQ ID NO: 3187789 - DNA, 22 bp, Homo sapiens
gcagtacctgggaaaggaccca

SEQ ID NO: 3187790 - DNA, 17 bp, Homo sapiens
gcagtacttttgttgta

SEQ ID NO: 3187791 - DNA, 19 bp, Homo sapiens
gcagtagaaataatatgca

SEQ ID NO: 3187792 - DNA, 20 bp, Homo sapiens
gcagtagaaataatatgcat

SEQ ID NO: 3187793 - DNA, 21 bp, Homo sapiens
gcagtagaaataatatgcatt

SEQ ID NO: 3187794 - DNA, 21 bp, Homo sapiens
gcagtagaggctatggacagg

SEQ ID NO: 3187795 - DNA, 18 bp, Homo sapiens
gcagtagagtcatctcca

SEQ ID NO: 3187796 - DNA, 15 bp, Homo sapiens
gcagtagatgtgctt

SEQ ID NO: 3187797 - DNA, 16 bp, Homo sapiens
gcagtatggccagacg

SEQ ID NO: 3187798 - DNA, 17 bp, Homo sapiens
gcagtcagggtgggaag

SEQ ID NO: 3187799 - DNA, 19 bp, Homo sapiens
gcagtccccagcccttctg

SEQ ID NO: 3187800 - DNA, 23 bp, Homo sapiens
gcagtccccagcccttctgcctt

SEQ ID NO: 3187801 - DNA, 14 bp, Homo sapiens
gcagtcctgaggag

SEQ ID NO: 3187802 - DNA, 17 bp, Homo sapiens
gcagtcctgcctcagcc

SEQ ID NO: 3187803 - DNA, 15 bp, Homo sapiens
gcagtcctttgtaaa

SEQ ID NO: 3187804 - DNA, 12 bp, Homo sapiens
gcagtcgcagga

SEQ ID NO: 3187805 - DNA, 23 bp, Homo sapiens
gcagtcgcaggatccgctgccac

SEQ ID NO: 3187806 - DNA, 17 bp, Homo sapiens
gcagtcgggggctggcc

SEQ ID NO: 3187807 - DNA, 17 bp, Homo sapiens
gcagtctccttcagcac

SEQ ID NO: 3187808 - DNA, 20 bp, Homo sapiens
gcagtctgcccacgcagagg

SEQ ID NO: 3187809 - DNA, 21 bp, Homo sapiens
gcagtctgcccacgcagagga

SEQ ID NO: 3187810 - DNA, 14 bp, Homo sapiens
gcagtgagctgtgt

SEQ ID NO: 3187811 - DNA, 22 bp, Homo sapiens
gcagtgaggggtatatctgggc

SEQ ID NO: 3187812 - DNA, 15 bp, Homo sapiens
gcagtgagtgagcct

SEQ ID NO: 3187813 - DNA, 19 bp, Homo sapiens
gcagtgagtgagcctggct

SEQ ID NO: 3187814 - DNA, 21 bp, Homo sapiens
gcagtgagtgagcctggctct

SEQ ID NO: 3187815 - DNA, 19 bp, Homo sapiens
gcagtgatatggcagaaga

SEQ ID NO: 3187816 - DNA, 14 bp, Homo sapiens
gcagtgatggcgcg

SEQ ID NO: 3187817 - DNA, 22 bp, Homo sapiens
gcagtgcatgtgaagcatgctt

SEQ ID NO: 3187818 - DNA, 18 bp, Homo sapiens
gcagtgcctcgaggcacc

SEQ ID NO: 3187819 - DNA, 16 bp, Homo sapiens
gcagtgccttccataa

SEQ ID NO: 3187820 - DNA, 17 bp, Homo sapiens
gcagtgctgggaccaga

SEQ ID NO: 3187821 - DNA, 23 bp, Homo sapiens
gcagtgcttccaaggatggacca

SEQ ID NO: 3187822 - DNA, 13 bp, Homo sapiens
gcagtggcagaga

SEQ ID NO: 3187823 - DNA, 18 bp, Homo sapiens
gcagtggcaggggagcag

SEQ ID NO: 3187824 - DNA, 16 bp, Homo sapiens
gcagtggctcacgcct

SEQ ID NO: 3187825 - DNA, 14 bp, Homo sapiens
gcagtggctggtcc

SEQ ID NO: 3187826 - DNA, 20 bp, Homo sapiens
gcagtggctggtccagggct

SEQ ID NO: 3187827 - DNA, 15 bp, Homo sapiens
gcagtggcttttcat

SEQ ID NO: 3187828 - DNA, 21 bp, Homo sapiens
gcagtgggacagggcatggcc

SEQ ID NO: 3187829 - DNA, 12 bp, Homo sapiens
gcagtgggagct

SEQ ID NO: 3187830 - DNA, 17 bp, Homo sapiens
gcagtgggagctgcctg

SEQ ID NO: 3187831 - DNA, 18 bp, Homo sapiens
gcagtggtgcgatctggg

SEQ ID NO: 3187832 - DNA, 19 bp, Homo sapiens
gcagtggtgcgatctgggt

SEQ ID NO: 3187833 - DNA, 18 bp, Homo sapiens
gcagtgtagcccacactt

SEQ ID NO: 3187834 - DNA, 18 bp, Homo sapiens
gcagtgtcatcagaagat

SEQ ID NO: 3187835 - DNA, 11 bp, Homo sapiens
gcagtgtcttc

SEQ ID NO: 3187836 - DNA, 15 bp, Homo sapiens
gcagtgtcttccata

SEQ ID NO: 3187837 - DNA, 22 bp, Homo sapiens
gcagtgtgccccccagccccgg

SEQ ID NO: 3187838 - DNA, 22 bp, Homo sapiens
gcagtgttcgcttggctccatg

SEQ ID NO: 3187839 - DNA, 22 bp, Homo sapiens
gcagttactccctacactgatg

SEQ ID NO: 3187840 - DNA, 23 bp, Homo sapiens
gcagttactccctacactgatgc

SEQ ID NO: 3187841 - DNA, 14 bp, Homo sapiens
gcagttataacaga

SEQ ID NO: 3187842 - DNA, 17 bp, Homo sapiens
gcagttataacagatgt

SEQ ID NO: 3187843 - DNA, 18 bp, Homo sapiens
gcagttataacagatgtg

SEQ ID NO: 3187844 - DNA, 14 bp, Homo sapiens
gcagttatagaaaa

SEQ ID NO: 3187845 - DNA, 17 bp, Homo sapiens
gcagttattaacactaa

SEQ ID NO: 3187846 - DNA, 17 bp, Homo sapiens
gcagttcagcaccaccc

SEQ ID NO: 3187847 - DNA, 12 bp, Homo sapiens
gcagttgcagtg

SEQ ID NO: 3187848 - DNA, 13 bp, Homo sapiens
gcagttgtgtcag

SEQ ID NO: 3187849 - DNA, 13 bp, Homo sapiens
gcagtttattata

SEQ ID NO: 3187850 - DNA, 17 bp, Homo sapiens
gcagtttcttcatctca

SEQ ID NO: 3187851 - DNA, 21 bp, Homo sapiens
gcataaagctcaaatgaaatg

SEQ ID NO: 3187852 - DNA, 15 bp, Homo sapiens
gcataaattgcatca

SEQ ID NO: 3187853 - DNA, 23 bp, Homo sapiens
gcataacaccaatcccagggctg

SEQ ID NO: 3187854 - DNA, 15 bp, Homo sapiens
gcataactgtagctc

SEQ ID NO: 3187855 - DNA, 13 bp, Homo sapiens
gcataagattaaa

SEQ ID NO: 3187856 - DNA, 17 bp, Homo sapiens
gcataatgctttggaaa

SEQ ID NO: 3187857 - DNA, 20 bp, Homo sapiens
gcataatgctttggaaaaat

SEQ ID NO: 3187858 - DNA, 23 bp, Homo sapiens
gcatacacacatgccctcctgga

SEQ ID NO: 3187859 - DNA, 17 bp, Homo sapiens
gcatacatttataatgt

SEQ ID NO: 3187860 - DNA, 13 bp, Homo sapiens
gcatggtggcatg

SEQ ID NO: 3187861 - DNA, 17 bp, Homo sapiens
gcatggtggctcatgcc

SEQ ID NO: 3187862 - DNA, 15 bp, Homo sapiens
gcatggtgttttcat

SEQ ID NO: 3187863 - DNA, 17 bp, Homo sapiens
gcatgtaaaagcggaaa

SEQ ID NO: 3187864 - DNA, 21 bp, Homo sapiens
gcatgtacggattttcagtta

SEQ ID NO: 3187865 - DNA, 18 bp, Homo sapiens
gcatgtagaggcttgttt

SEQ ID NO: 3187866 - DNA, 20 bp, Homo sapiens
gcatgtagaggcttgtttac

SEQ ID NO: 3187867 - DNA, 14 bp, Homo sapiens
gcatgtatgtcttg

SEQ ID NO: 3187868 - DNA, 15 bp, Homo sapiens
gcatgtatgtcttgg

SEQ ID NO: 3187869 - DNA, 14 bp, Homo sapiens
gcatgtcgcacaat

SEQ ID NO: 3187870 - DNA, 19 bp, Homo sapiens
gcatgtgaagcatgctttg

SEQ ID NO: 3187871 - DNA, 21 bp, Homo sapiens
gcatgtgaagcatgctttgct

SEQ ID NO: 3187872 - DNA, 12 bp, Homo sapiens
gcatgtgccaag

SEQ ID NO: 3187873 - DNA, 16 bp, Homo sapiens
gcatgtggcctgtggc

SEQ ID NO: 3187874 - DNA, 17 bp, Homo sapiens
gcatgtggcctgtggcc

SEQ ID NO: 3187875 - DNA, 17 bp, Homo sapiens
gcatgtggcttttttaa

SEQ ID NO: 3187876 - DNA, 19 bp, Homo sapiens
gcatgtggtttggttcctc

SEQ ID NO: 3187877 - DNA, 20 bp, Homo sapiens
gcatgtggtttggttcctct

SEQ ID NO: 3187878 - DNA, 23 bp, Homo sapiens
gcatgtggtttggttcctctctg

SEQ ID NO: 3187879 - DNA, 12 bp, Homo sapiens
gcatgtgtatgt

SEQ ID NO: 3187880 - DNA, 21 bp, Homo sapiens
gcatgtgtatttccagtgcaa

SEQ ID NO: 3187881 - DNA, 18 bp, Homo sapiens
gcatgtgtgcctgtggca

SEQ ID NO: 3187882 - DNA, 20 bp, Homo sapiens
gcatgtgtgcctgtggcaga

SEQ ID NO: 3187883 - DNA, 12 bp, Homo sapiens
gcatgtgtgtat

SEQ ID NO: 3187884 - DNA, 15 bp, Homo sapiens
gcatgttctctgagg

SEQ ID NO: 3187885 - DNA, 15 bp, Homo sapiens
gcatgtttcatgttt

SEQ ID NO: 3187886 - DNA, 20 bp, Homo sapiens
gcatgtttcatgttttgtga

SEQ ID NO: 3187887 - DNA, 17 bp, Homo sapiens
gcatgttttgtatacaa

SEQ ID NO: 3187888 - DNA, 12 bp, Homo sapiens
gcattaaacctg

SEQ ID NO: 3187889 - DNA, 13 bp, Homo sapiens
gcattaaacctgt

SEQ ID NO: 3187890 - DNA, 14 bp, Homo sapiens
gcattaactaatct

SEQ ID NO: 3187891 - DNA, 14 bp, Homo sapiens
gcattaacttctct

SEQ ID NO: 3187892 - DNA, 14 bp, Homo sapiens
gcattacagagagg

SEQ ID NO: 3187893 - DNA, 18 bp, Homo sapiens
gcattacttgctttcaat

SEQ ID NO: 3187894 - DNA, 19 bp, Homo sapiens
gcattacttgctttcaatt

SEQ ID NO: 3187895 - DNA, 21 bp, Homo sapiens
gcattaggcttttaagaaaca

SEQ ID NO: 3187896 - DNA, 18 bp, Homo sapiens
gcattagggatgcctcct

SEQ ID NO: 3187897 - DNA, 19 bp, Homo sapiens
gcattatataccatttatc

SEQ ID NO: 3187898 - DNA, 23 bp, Homo sapiens
gcattatgtccactgtgtataga

SEQ ID NO: 3187899 - DNA, 12 bp, Homo sapiens
gcattattcatt

SEQ ID NO: 3187900 - DNA, 16 bp, Homo sapiens
gcattattcctccagg

SEQ ID NO: 3187901 - DNA, 13 bp, Homo sapiens
gcattcagagagc

SEQ ID NO: 3187902 - DNA, 23 bp, Homo sapiens
gcattcattttctgacatgcatt

SEQ ID NO: 3187903 - DNA, 15 bp, Homo sapiens
gcattcatttttata

SEQ ID NO: 3187904 - DNA, 22 bp, Homo sapiens
gcattcatttttatagcaacaa

SEQ ID NO: 3187905 - DNA, 19 bp, Homo sapiens
gcattccagcccctctggt

SEQ ID NO: 3187906 - DNA, 22 bp, Homo sapiens
gcattccagtaacttttttgtg

SEQ ID NO: 3187907 - DNA, 21 bp, Homo sapiens
gcattcctgtaacttttaatc

SEQ ID NO: 3187908 - DNA, 22 bp, Homo sapiens
gcattccttctttgataatgtt

SEQ ID NO: 3187909 - DNA, 23 bp, Homo sapiens
gcattccttctttgataatgtta

SEQ ID NO: 3187910 - DNA, 19 bp, Homo sapiens
gcattcgaagaaacccttg

SEQ ID NO: 3187911 - DNA, 19 bp, Homo sapiens
gcattctctcccatcctgg

SEQ ID NO: 3187912 - DNA, 18 bp, Homo sapiens
gcattctttcccagtgag

SEQ ID NO: 3187913 - DNA, 20 bp, Homo sapiens
gcattctttggtaatttttt

SEQ ID NO: 3187914 - DNA, 11 bp, Homo sapiens
gcattgaaatt

SEQ ID NO: 3187915 - DNA, 23 bp, Homo sapiens
gcattgaacacaaactgtaaata

SEQ ID NO: 3187916 - DNA, 16 bp, Homo sapiens
gcattgaatatattat

SEQ ID NO: 3187917 - DNA, 16 bp, Homo sapiens
gcattgagcttgcatg

SEQ ID NO: 3187918 - DNA, 18 bp, Homo sapiens
gcattgaggaagagtctt

SEQ ID NO: 3187919 - DNA, 13 bp, Homo sapiens
gcattgataatct

SEQ ID NO: 3187920 - DNA, 15 bp, Homo sapiens
gcattgataatcttc

SEQ ID NO: 3187921 - DNA, 17 bp, Homo sapiens
gcattgataatcttcag

SEQ ID NO: 3187922 - DNA, 21 bp, Homo sapiens
gcattgataatcttcaggtga

SEQ ID NO: 3187923 - DNA, 18 bp, Homo sapiens
gcattgattgcacttgat

SEQ ID NO: 3187924 - DNA, 20 bp, Homo sapiens
gcattgccaatatcctgtat

SEQ ID NO: 3187925 - DNA, 18 bp, Homo sapiens
gcattggatattttttac

SEQ ID NO: 3187926 - DNA, 20 bp, Homo sapiens
gcattgggctgacacctacc

SEQ ID NO: 3187927 - DNA, 16 bp, Homo sapiens
gcattggggggccggg

SEQ ID NO: 3187928 - DNA, 13 bp, Homo sapiens
gcattggtgactc

SEQ ID NO: 3187929 - DNA, 14 bp, Homo sapiens
gcattggtgactca

SEQ ID NO: 3187930 - DNA, 12 bp, Homo sapiens
gcattgtctctc

SEQ ID NO: 3187931 - DNA, 14 bp, Homo sapiens
gcattgtcttgttc

SEQ ID NO: 3187932 - DNA, 13 bp, Homo sapiens
gcattgtctttgc

SEQ ID NO: 3187933 - DNA, 17 bp, Homo sapiens
gcattgtgattggcctg

SEQ ID NO: 3187934 - DNA, 22 bp, Homo sapiens
gcattgtgattggcctgtagag

SEQ ID NO: 3187935 - DNA, 19 bp, Homo sapiens
gcattgttattgtggaaga

SEQ ID NO: 3187936 - DNA, 14 bp, Homo sapiens
gcattgttggctat

SEQ ID NO: 3187937 - DNA, 20 bp, Homo sapiens
gcattgttggctatttgaaa

SEQ ID NO: 3187938 - DNA, 18 bp, Homo sapiens
gcattgtttgcttattgt

SEQ ID NO: 3187939 - DNA, 20 bp, Homo sapiens
gcattgtttgcttattgttc

SEQ ID NO: 3187940 - DNA, 18 bp, Homo sapiens
gcatttaaaacagacact

SEQ ID NO: 3187941 - DNA, 19 bp, Homo sapiens
gcatttaaagttgtataaa

SEQ ID NO: 3187942 - DNA, 21 bp, Homo sapiens
gcatttaaagttgtataaaaa

SEQ ID NO: 3187943 - DNA, 23 bp, Homo sapiens
gcatttaaagttgtataaaaaca

SEQ ID NO: 3187944 - DNA, 14 bp, Homo sapiens
gcatttaataaaga

SEQ ID NO: 3187945 - DNA, 17 bp, Homo sapiens
gcatttaataaagatga

SEQ ID NO: 3187946 - DNA, 18 bp, Homo sapiens
gcatttaatggcagctag

SEQ ID NO: 3187947 - DNA, 18 bp, Homo sapiens
gcatttactttgtgttca

SEQ ID NO: 3187948 - DNA, 22 bp, Homo sapiens
gcatttagaactttctgctttg

SEQ ID NO: 3187949 - DNA, 22 bp, Homo sapiens
gcatttcaagcagctgaagaaa

SEQ ID NO: 3187950 - DNA, 21 bp, Homo sapiens
gcatttcctatcacctatttc

SEQ ID NO: 3187951 - DNA, 11 bp, Homo sapiens
gcatttctctt

SEQ ID NO: 3187952 - DNA, 13 bp, Homo sapiens
gcatttctcttct

SEQ ID NO: 3187953 - DNA, 18 bp, Homo sapiens
gcatttctgaatagaaat

SEQ ID NO: 3187954 - DNA, 20 bp, Homo sapiens
gcatttcttgatgttgctta

SEQ ID NO: 3187955 - DNA, 15 bp, Homo sapiens
gcatttggtgagagt

SEQ ID NO: 3187956 - DNA, 22 bp, Homo sapiens
gcatttggtgagagtcaaagct

SEQ ID NO: 3187957 - DNA, 16 bp, Homo sapiens
gcatttgtattttgtg

SEQ ID NO: 3187958 - DNA, 12 bp, Homo sapiens
gcatttgtgaaa

SEQ ID NO: 3187959 - DNA, 13 bp, Homo sapiens
gcatttgtgaggc

SEQ ID NO: 3187960 - DNA, 22 bp, Homo sapiens
gcattttgggggtttttaatct

SEQ ID NO: 3187961 - DNA, 20 bp, Homo sapiens
gccaaaaaccttagctccct

SEQ ID NO: 3187962 - DNA, 16 bp, Homo sapiens
gccaaaagctagacag

SEQ ID NO: 3187963 - DNA, 21 bp, Homo sapiens
gccaaaagctagacagatccc

SEQ ID NO: 3187964 - DNA, 23 bp, Homo sapiens
gccaaacaaaaaggttctcaggt

SEQ ID NO: 3187965 - DNA, 18 bp, Homo sapiens
gccaaaccaggaccctgt

SEQ ID NO: 3187966 - DNA, 15 bp, Homo sapiens
gccaaaccctgtctg

SEQ ID NO: 3187967 - DNA, 19 bp, Homo sapiens
gccaaacccttgctttcct

SEQ ID NO: 3187968 - DNA, 23 bp, Homo sapiens
gccaaacccttgctttcctgggc

SEQ ID NO: 3187969 - DNA, 17 bp, Homo sapiens
gccaaacctgggacccc

SEQ ID NO: 3187970 - DNA, 12 bp, Homo sapiens
gccaaactgctg

SEQ ID NO: 3187971 - DNA, 13 bp, Homo sapiens
gccaaagaaatga

SEQ ID NO: 3187972 - DNA, 15 bp, Homo sapiens
gccaaagataaaagg

SEQ ID NO: 3187973 - DNA, 13 bp, Homo sapiens
gccaaagccaaag

SEQ ID NO: 3187974 - DNA, 17 bp, Homo sapiens
gccaaaggatgtgatat

SEQ ID NO: 3187975 - DNA, 15 bp, Homo sapiens
gccaaagtacagaat

SEQ ID NO: 3187976 - DNA, 18 bp, Homo sapiens
gccaaataaacagctatt

SEQ ID NO: 3187977 - DNA, 17 bp, Homo sapiens
gccaaatatgtcctggg

SEQ ID NO: 3187978 - DNA, 12 bp, Homo sapiens
gccaaatgaaac

SEQ ID NO: 3187979 - DNA, 15 bp, Homo sapiens
gccaaattatttgtg

SEQ ID NO: 3187980 - DNA, 19 bp, Homo sapiens
gccaaattatttgtgtaat

SEQ ID NO: 3187981 - DNA, 23 bp, Homo sapiens
gccaaattatttgtgtaatagaa

SEQ ID NO: 3187982 - DNA, 19 bp, Homo sapiens
gccaaatttatcaaagcat

SEQ ID NO: 3187983 - DNA, 14 bp, Homo sapiens
gccaaattttggcc

SEQ ID NO: 3187984 - DNA, 22 bp, Homo sapiens
gccaacatcgtgaaaccctgtc

SEQ ID NO: 3187985 - DNA, 13 bp, Homo sapiens
gccaaccagcccg

SEQ ID NO: 3187986 - DNA, 20 bp, Homo sapiens
gccacctctgcggaccccag

SEQ ID NO: 3187987 - DNA, 21 bp, Homo sapiens
gccacctctgcggaccccagc

SEQ ID NO: 3187988 - DNA, 21 bp, Homo sapiens
gccacctgaggtgggcccagg

SEQ ID NO: 3187989 - DNA, 13 bp, Homo sapiens
gccacctggatct

SEQ ID NO: 3187990 - DNA, 20 bp, Homo sapiens
gccacctgtagccatctgca

SEQ ID NO: 3187991 - DNA, 21 bp, Homo sapiens
gccacctgtagccatctgcac

SEQ ID NO: 3187992 - DNA, 23 bp, Homo sapiens
gccacctttcaccctcatgaaaa

SEQ ID NO: 3187993 - DNA, 14 bp, Homo sapiens
gccacgaccagccc

SEQ ID NO: 3187994 - DNA, 22 bp, Homo sapiens
gccacgaccagccccttcctgg

SEQ ID NO: 3187995 - DNA, 15 bp, Homo sapiens
gccacgcactgggcc

SEQ ID NO: 3187996 - DNA, 17 bp, Homo sapiens
gccacgcactgggccac

SEQ ID NO: 3187997 - DNA, 17 bp, Homo sapiens
gccacgcattttgcact

SEQ ID NO: 3187998 - DNA, 15 bp, Homo sapiens
gccacgccccagccc

SEQ ID NO: 3187999 - DNA, 13 bp, Homo sapiens
gccacgctccagc

SEQ ID NO: 3188000 - DNA, 14 bp, Homo sapiens
gccacgctccagct

SEQ ID NO: 3188001 - DNA, 15 bp, Homo sapiens
gccacgctgtcctct

SEQ ID NO: 3188002 - DNA, 19 bp, Homo sapiens
gccacgctgtcctctcgag

SEQ ID NO: 3188003 - DNA, 15 bp, Homo sapiens
gccacggaggaggga

SEQ ID NO: 3188004 - DNA, 20 bp, Homo sapiens
gccacggaggagggatgctg

SEQ ID NO: 3188005 - DNA, 21 bp, Homo sapiens
gccacggaggagggatgctgc

SEQ ID NO: 3188006 - DNA, 17 bp, Homo sapiens
gccacggcctggctggt

SEQ ID NO: 3188007 - DNA, 20 bp, Homo sapiens
gccacggcctggctggtggg

SEQ ID NO: 3188008 - DNA, 15 bp, Homo sapiens
gccacgtcccagcat

SEQ ID NO: 3188009 - DNA, 18 bp, Homo sapiens
gccacgtcccagcatccc

SEQ ID NO: 3188010 - DNA, 22 bp, Homo sapiens
gccacgtcccagcatccctgga

SEQ ID NO: 3188011 - DNA, 24 bp, Homo sapiens
gccacgtggtcactgtgcactgcc

SEQ ID NO: 3188012 - DNA, 18 bp, Homo sapiens
gccactacactccagcct

SEQ ID NO: 3188013 - DNA, 21 bp, Homo sapiens
gccactagactcttcactgtt

SEQ ID NO: 3188014 - DNA, 14 bp, Homo sapiens
gccactcactaggc

SEQ ID NO: 3188015 - DNA, 15 bp, Homo sapiens
gccactcactaggcc

SEQ ID NO: 3188016 - DNA, 20 bp, Homo sapiens
gccactcagccatttccccc

SEQ ID NO: 3188017 - DNA, 16 bp, Homo sapiens
gccactccagacccct

SEQ ID NO: 3188018 - DNA, 19 bp, Homo sapiens
gccactccagacccctggc

SEQ ID NO: 3188019 - DNA, 21 bp, Homo sapiens
gccactccagacccctggctt

SEQ ID NO: 3188020 - DNA, 22 bp, Homo sapiens
gccactccagacccctggcttt

SEQ ID NO: 3188021 - DNA, 12 bp, Homo sapiens
gccactcctccc

SEQ ID NO: 3188022 - DNA, 17 bp, Homo sapiens
gccactcctgtcccgcc

SEQ ID NO: 3188023 - DNA, 22 bp, Homo sapiens
gccactcgcagtcgcaggatcc

SEQ ID NO: 3188024 - DNA, 14 bp, Homo sapiens
gccactcgcttccc

SEQ ID NO: 3188025 - DNA, 18 bp, Homo sapiens
gccactcgcttcccccat

SEQ ID NO: 3188026 - DNA, 14 bp, Homo sapiens
gccactgaagctgg

SEQ ID NO: 3188027 - DNA, 15 bp, Homo sapiens
gccactgaagctggg

SEQ ID NO: 3188028 - DNA, 15 bp, Homo sapiens
gccactgagcctggc

SEQ ID NO: 3188029 - DNA, 16 bp, Homo sapiens
gccactgcacagagct

SEQ ID NO: 3188030 - DNA, 17 bp, Homo sapiens
gccactgcaccgggcca

SEQ ID NO: 3188031 - DNA, 21 bp, Homo sapiens
gccactgcaccgggccacaga

SEQ ID NO: 3188032 - DNA, 21 bp, Homo sapiens
gccactgcactatagcctagg

SEQ ID NO: 3188033 - DNA, 12 bp, Homo sapiens
gccactgcactc

SEQ ID NO: 3188034 - DNA, 19 bp, Homo sapiens
gccactgcactccaatctg

SEQ ID NO: 3188035 - DNA, 21 bp, Homo sapiens
gccactgcactccagcctggg

SEQ ID NO: 3188036 - DNA, 12 bp, Homo sapiens
gccactgccagg

SEQ ID NO: 3188037 - DNA, 13 bp, Homo sapiens
gccactgccaggc

SEQ ID NO: 3188038 - DNA, 16 bp, Homo sapiens
gccactgccaggcacc

SEQ ID NO: 3188039 - DNA, 21 bp, Homo sapiens
gccactgccaggcacctggcc

SEQ ID NO: 3188040 - DNA, 15 bp, Homo sapiens
gccactgtggccaga

SEQ ID NO: 3188041 - DNA, 17 bp, Homo sapiens
gccactgtggccagagc

SEQ ID NO: 3188042 - DNA, 18 bp, Homo sapiens
gccactgtggccagagct

SEQ ID NO: 3188043 - DNA, 21 bp, Homo sapiens
gccactgtggccagagctgga

SEQ ID NO: 3188044 - DNA, 16 bp, Homo sapiens
gccactgtggtggcag

SEQ ID NO: 3188045 - DNA, 13 bp, Homo sapiens
gccacttaatgta

SEQ ID NO: 3188046 - DNA, 13 bp, Homo sapiens
gccacttatttca

SEQ ID NO: 3188047 - DNA, 14 bp, Homo sapiens
gccacttcctttgt

SEQ ID NO: 3188048 - DNA, 13 bp, Homo sapiens
gccacttctcccc

SEQ ID NO: 3188049 - DNA, 22 bp, Homo sapiens
gccacttcttaaaggcctggaa

SEQ ID NO: 3188050 - DNA, 15 bp, Homo sapiens
gccacttgaaatgtt

SEQ ID NO: 3188051 - DNA, 16 bp, Homo sapiens
gccacttggtttttgg

SEQ ID NO: 3188052 - DNA, 19 bp, Homo sapiens
gccactttaagagagaaat

SEQ ID NO: 3188053 - DNA, 22 bp, Homo sapiens
gccactttaagagagaaatctg

SEQ ID NO: 3188054 - DNA, 23 bp, Homo sapiens
gccactttacccacctagaacac

SEQ ID NO: 3188055 - DNA, 23 bp, Homo sapiens
gccactttcagagcccccagccc

SEQ ID NO: 3188056 - DNA, 15 bp, Homo sapiens
gccactttgactcag

SEQ ID NO: 3188057 - DNA, 21 bp, Homo sapiens
gccactttggtacatggccag

SEQ ID NO: 3188058 - DNA, 21 bp, Homo sapiens
gccagaaacagtgggagccct

SEQ ID NO: 3188059 - DNA, 22 bp, Homo sapiens
gccagaaacagtgggagccctg

SEQ ID NO: 3188060 - DNA, 19 bp, Homo sapiens
gccagaaggaatcttctca

SEQ ID NO: 3188061 - DNA, 14 bp, Homo sapiens
gccagaaggagggc

SEQ ID NO: 3188062 - DNA, 16 bp, Homo sapiens
gccagaaggagggcag

SEQ ID NO: 3188063 - DNA, 20 bp, Homo sapiens
gccagaaggagggcagagcc

SEQ ID NO: 3188064 - DNA, 23 bp, Homo sapiens
gccagaaggagggcagagccatg

SEQ ID NO: 3188065 - DNA, 16 bp, Homo sapiens
gccagagaagataatg

SEQ ID NO: 3188066 - DNA, 20 bp, Homo sapiens
gccagagaatagatcagtat

SEQ ID NO: 3188067 - DNA, 13 bp, Homo sapiens
gccagagaggagc

SEQ ID NO: 3188068 - DNA, 23 bp, Homo sapiens
gccagagaggagcacctgaaccc

SEQ ID NO: 3188069 - DNA, 18 bp, Homo sapiens
gccagagagggcccagct

SEQ ID NO: 3188070 - DNA, 19 bp, Homo sapiens
gccagagagggcccagctg

SEQ ID NO: 3188071 - DNA, 15 bp, Homo sapiens
gccagagctggaagg

SEQ ID NO: 3188072 - DNA, 18 bp, Homo sapiens
gccagagctggaaggcag

SEQ ID NO: 3188073 - DNA, 16 bp, Homo sapiens
gccagagctgggtggg

SEQ ID NO: 3188074 - DNA, 22 bp, Homo sapiens
gccagagctgggtggggacagt

SEQ ID NO: 3188075 - DNA, 15 bp, Homo sapiens
gccagagctttgttt

SEQ ID NO: 3188076 - DNA, 21 bp, Homo sapiens
gccagaggaactgtccagaga

SEQ ID NO: 3188077 - DNA, 23 bp, Homo sapiens
gccagaggaactgtccagagagc

SEQ ID NO: 3188078 - DNA, 16 bp, Homo sapiens
gccagaggaaggaaaa

SEQ ID NO: 3188079 - DNA, 17 bp, Homo sapiens
gccagaggaatcctggc

SEQ ID NO: 3188080 - DNA, 18 bp, Homo sapiens
gccagaggaatcctggca

SEQ ID NO: 3188081 - DNA, 14 bp, Homo sapiens
gccagaggccccca

SEQ ID NO: 3188082 - DNA, 18 bp, Homo sapiens
gccagaggcccccagccc

SEQ ID NO: 3188083 - DNA, 15 bp, Homo sapiens
gccagaggtgcttca

SEQ ID NO: 3188084 - DNA, 19 bp, Homo sapiens
gccagaggtgcttcaccct

SEQ ID NO: 3188085 - DNA, 16 bp, Homo sapiens
gccagaggtgggcagg

SEQ ID NO: 3188086 - DNA, 15 bp, Homo sapiens
gccagagtggcctgg

SEQ ID NO: 3188087 - DNA, 23 bp, Homo sapiens
gccagagttaggttgtctccagg

SEQ ID NO: 3188088 - DNA, 13 bp, Homo sapiens
gccagagttcctg

SEQ ID NO: 3188089 - DNA, 22 bp, Homo sapiens
gccagagttcctgcggagtgaa

SEQ ID NO: 3188090 - DNA, 16 bp, Homo sapiens
gccagataaaatgttc

SEQ ID NO: 3188091 - DNA, 22 bp, Homo sapiens
gccagatgcacatccctggaag

SEQ ID NO: 3188092 - DNA, 16 bp, Homo sapiens
gccagatgcaccagcc

SEQ ID NO: 3188093 - DNA, 15 bp, Homo sapiens
gccagatgcaggaca

SEQ ID NO: 3188094 - DNA, 18 bp, Homo sapiens
gccagatgcaggacagga

SEQ ID NO: 3188095 - DNA, 23 bp, Homo sapiens
gccagattacaggaatgaagaac

SEQ ID NO: 3188096 - DNA, 13 bp, Homo sapiens
gccagattctctt

SEQ ID NO: 3188097 - DNA, 16 bp, Homo sapiens
gccagattctcttgaa

SEQ ID NO: 3188098 - DNA, 21 bp, Homo sapiens
gccagattctcttgaataaag

SEQ ID NO: 3188099 - DNA, 23 bp, Homo sapiens
gccagcaaagaggactcgcttgt

SEQ ID NO: 3188100 - DNA, 16 bp, Homo sapiens
gccagcaacacagagc

SEQ ID NO: 3188101 - DNA, 17 bp, Homo sapiens
gccagcaacacagagca

SEQ ID NO: 3188102 - DNA, 18 bp, Homo sapiens
gccagcaacgcttgtaga

SEQ ID NO: 3188103 - DNA, 20 bp, Homo sapiens
gccagcaatgacatctcagg

SEQ ID NO: 3188104 - DNA, 16 bp, Homo sapiens
gccagcaccctctcct

SEQ ID NO: 3188105 - DNA, 20 bp, Homo sapiens
gccagcaccctctcctgggg

SEQ ID NO: 3188106 - DNA, 15 bp, Homo sapiens
gccagcacgcctggc

SEQ ID NO: 3188107 - DNA, 16 bp, Homo sapiens
gccagcacttgtatat

SEQ ID NO: 3188108 - DNA, 16 bp, Homo sapiens
gccagcagcagcaggt

SEQ ID NO: 3188109 - DNA, 18 bp, Homo sapiens
gccagcattccagacttc

SEQ ID NO: 3188110 - DNA, 9 bp, Homo sapiens
gccagccac

SEQ ID NO: 3188111 - DNA, 14 bp, Homo sapiens
ctacctgccctcaa

SEQ ID NO: 3188112 - DNA, 15 bp, Homo sapiens
ctacctgctggacag

SEQ ID NO: 3188113 - DNA, 16 bp, Homo sapiens
ctacctgctggacagc

SEQ ID NO: 3188114 - DNA, 18 bp, Homo sapiens
ctacctgctggacagcct

SEQ ID NO: 3188115 - DNA, 23 bp, Homo sapiens
ctacctgctggacagcctccgcc

SEQ ID NO: 3188116 - DNA, 18 bp, Homo sapiens
ctaccttcatttcaggag

SEQ ID NO: 3188117 - DNA, 20 bp, Homo sapiens
ctacgagggaggaacacctg

SEQ ID NO: 3188118 - DNA, 21 bp, Homo sapiens
ctacgtgaattagctttttct

SEQ ID NO: 3188119 - DNA, 13 bp, Homo sapiens
ctactaaaaatac

SEQ ID NO: 3188120 - DNA, 12 bp, Homo sapiens
ctactaaagtgc

SEQ ID NO: 3188121 - DNA, 13 bp, Homo sapiens
ctactaaatccct

SEQ ID NO: 3188122 - DNA, 18 bp, Homo sapiens
ctactaatagaataaagg

SEQ ID NO: 3188123 - DNA, 14 bp, Homo sapiens
ctactaatgatgtt

SEQ ID NO: 3188124 - DNA, 17 bp, Homo sapiens
ctactaattccacacct

SEQ ID NO: 3188125 - DNA, 10 bp, Homo sapiens
ctactacctc

SEQ ID NO: 3188126 - DNA, 15 bp, Homo sapiens
ctactagattgacta

SEQ ID NO: 3188127 - DNA, 13 bp, Homo sapiens
ctactatatacat

SEQ ID NO: 3188128 - DNA, 13 bp, Homo sapiens
ctactattcatgt

SEQ ID NO: 3188129 - DNA, 18 bp, Homo sapiens
ctactcaatactacctct

SEQ ID NO: 3188130 - DNA, 15 bp, Homo sapiens
ctactcacagtctct

SEQ ID NO: 3188131 - DNA, 19 bp, Homo sapiens
ctactcagaagcctgaggc

SEQ ID NO: 3188132 - DNA, 17 bp, Homo sapiens
ctactccactgccctgg

SEQ ID NO: 3188133 - DNA, 19 bp, Homo sapiens
ctactccactgccctggca

SEQ ID NO: 3188134 - DNA, 16 bp, Homo sapiens
ctactccctcttcact

SEQ ID NO: 3188135 - DNA, 17 bp, Homo sapiens
ctactccctcttccaaa

SEQ ID NO: 3188136 - DNA, 17 bp, Homo sapiens
ctactccctgcagatgc

SEQ ID NO: 3188137 - DNA, 15 bp, Homo sapiens
ctactcctacctcag

SEQ ID NO: 3188138 - DNA, 18 bp, Homo sapiens
ctactcctacctcagcct

SEQ ID NO: 3188139 - DNA, 16 bp, Homo sapiens
ctactcctgtgctctg

SEQ ID NO: 3188140 - DNA, 23 bp, Homo sapiens
ctactcgggaggctgaggcagga

SEQ ID NO: 3188141 - DNA, 23 bp, Homo sapiens
ctactctccccacgagggctggc

SEQ ID NO: 3188142 - DNA, 15 bp, Homo sapiens
ctactctgtccaggc

SEQ ID NO: 3188143 - DNA, 19 bp, Homo sapiens
ctactctgtccaggccact

SEQ ID NO: 3188144 - DNA, 20 bp, Homo sapiens
gatgtcttctgcctgttata

SEQ ID NO: 3188145 - DNA, 21 bp, Homo sapiens
gatgtgaagataatttgcata

SEQ ID NO: 3188146 - DNA, 18 bp, Homo sapiens
gatgtgacccaccagtgc

SEQ ID NO: 3188147 - DNA, 19 bp, Homo sapiens
gatgtgacccaccagtgcc

SEQ ID NO: 3188148 - DNA, 12 bp, Homo sapiens
gatgtgagcccc

SEQ ID NO: 3188149 - DNA, 14 bp, Homo sapiens
gatgtgagccccag

SEQ ID NO: 3188150 - DNA, 15 bp, Homo sapiens
gatgtgatattctaa

SEQ ID NO: 3188151 - DNA, 21 bp, Homo sapiens
gatgtgcatttttgtgaaatg

SEQ ID NO: 3188152 - DNA, 23 bp, Homo sapiens
gatgtgcatttttgtgaaatgaa

SEQ ID NO: 3188153 - DNA, 12 bp, Homo sapiens
gatgtgcttctg

SEQ ID NO: 3188154 - DNA, 21 bp, Homo sapiens
gatgtgctttgcattcctaca

SEQ ID NO: 3188155 - DNA, 17 bp, Homo sapiens
gatgtggaaagcacttt

SEQ ID NO: 3188156 - DNA, 17 bp, Homo sapiens
gatgtggcaaagtgctg

SEQ ID NO: 3188157 - DNA, 14 bp, Homo sapiens
gatgtgggtgtcct

SEQ ID NO: 3188158 - DNA, 22 bp, Homo sapiens
gatgtggtgcctgaggtctgta

SEQ ID NO: 3188159 - DNA, 13 bp, Homo sapiens
gatgtgtcctcag

SEQ ID NO: 3188160 - DNA, 15 bp, Homo sapiens
gatgtgtggggcatg

SEQ ID NO: 3188161 - DNA, 17 bp, Homo sapiens
gatgtgtgttgtcagcc

SEQ ID NO: 3188162 - DNA, 18 bp, Homo sapiens
gatgtgttcattcaagct

SEQ ID NO: 3188163 - DNA, 15 bp, Homo sapiens
gatgtgttcctcctg

SEQ ID NO: 3188164 - DNA, 20 bp, Homo sapiens
gatgttaaaataaatggttt

SEQ ID NO: 3188165 - DNA, 14 bp, Homo sapiens
gatgttaaccagaa

SEQ ID NO: 3188166 - DNA, 20 bp, Homo sapiens
gatgttcagcactgtccctt

SEQ ID NO: 3188167 - DNA, 22 bp, Homo sapiens
gatgttcagcactgtcccttgc

SEQ ID NO: 3188168 - DNA, 13 bp, Homo sapiens
gatgtttccagac

SEQ ID NO: 3188169 - DNA, 17 bp, Homo sapiens
gatgtttgtggcctcag

SEQ ID NO: 3188170 - DNA, 22 bp, Homo sapiens
gatgtttttaaaagtttcaatg

SEQ ID NO: 3188171 - DNA, 16 bp, Homo sapiens
gattaaacgtgcagac

SEQ ID NO: 3188172 - DNA, 14 bp, Homo sapiens
gattaaaggaagga

SEQ ID NO: 3188173 - DNA, 17 bp, Homo sapiens
gattaaataagattcta

SEQ ID NO: 3188174 - DNA, 18 bp, Homo sapiens
gattaaataagattctaa

SEQ ID NO: 3188175 - DNA, 14 bp, Homo sapiens
gattaacaaatatg

SEQ ID NO: 3188176 - DNA, 21 bp, Homo sapiens
gattaacaaatatgctaattt

SEQ ID NO: 3188177 - DNA, 19 bp, Homo sapiens
gattaacttatttagagat

SEQ ID NO: 3188178 - DNA, 12 bp, Homo sapiens
gattaagatttt

SEQ ID NO: 3188179 - DNA, 17 bp, Homo sapiens
gattaaggtgatgtgat

SEQ ID NO: 3188180 - DNA, 13 bp, Homo sapiens
gattaatcaaagg

SEQ ID NO: 3188181 - DNA, 20 bp, Homo sapiens
gattaatctgggcagacatt

SEQ ID NO: 3188182 - DNA, 16 bp, Homo sapiens
gattaatggcactgat

SEQ ID NO: 3188183 - DNA, 17 bp, Homo sapiens
gattaatgttttcatta

SEQ ID NO: 3188184 - DNA, 19 bp, Homo sapiens
gattaattagttgattgct

SEQ ID NO: 3188185 - DNA, 19 bp, Homo sapiens
gattacaaatcagaagtca

SEQ ID NO: 3188186 - DNA, 18 bp, Homo sapiens
gattacagaaactgatgc

SEQ ID NO: 3188187 - DNA, 14 bp, Homo sapiens
gattacaggcgtga

SEQ ID NO: 3188188 - DNA, 20 bp, Homo sapiens
gattacaggtgtgaaccacc

SEQ ID NO: 3188189 - DNA, 14 bp, Homo sapiens
gattacatgcatgt

SEQ ID NO: 3188190 - DNA, 14 bp, Homo sapiens
gattacctgccaat

SEQ ID NO: 3188191 - DNA, 18 bp, Homo sapiens
gattactcagagcagatg

SEQ ID NO: 3188192 - DNA, 21 bp, Homo sapiens
gattagaaatgaccaatatta

SEQ ID NO: 3188193 - DNA, 20 bp, Homo sapiens
gattagaaattacctgtgga

SEQ ID NO: 3188194 - DNA, 17 bp, Homo sapiens
gattagaagctgaaaac

SEQ ID NO: 3188195 - DNA, 13 bp, Homo sapiens
gattagagggagg

SEQ ID NO: 3188196 - DNA, 20 bp, Homo sapiens
gattagagggaggtgtttaa

SEQ ID NO: 3188197 - DNA, 19 bp, Homo sapiens
gattagcaaggtcatttct

SEQ ID NO: 3188198 - DNA, 20 bp, Homo sapiens
gattagcaaggtcatttctt

SEQ ID NO: 3188199 - DNA, 19 bp, Homo sapiens
gattagctttattatggct

SEQ ID NO: 3188200 - DNA, 21 bp, Homo sapiens
gattagctttattatggcttg

SEQ ID NO: 3188201 - DNA, 14 bp, Homo sapiens
gattaggattaaaa

SEQ ID NO: 3188202 - DNA, 13 bp, Homo sapiens
gattaggtaacgt

SEQ ID NO: 3188203 - DNA, 15 bp, Homo sapiens
gattataaaaaatgt

SEQ ID NO: 3188204 - DNA, 16 bp, Homo sapiens
gattataaaaaatgta

SEQ ID NO: 3188205 - DNA, 20 bp, Homo sapiens
gattataaaaaatgtaacat

SEQ ID NO: 3188206 - DNA, 23 bp, Homo sapiens
gattataaaaaatgtaacatcat

SEQ ID NO: 3188207 - DNA, 21 bp, Homo sapiens
gattatacaaaagagcatgga

SEQ ID NO: 3188208 - DNA, 14 bp, Homo sapiens
gattatagattcta

SEQ ID NO: 3188209 - DNA, 22 bp, Homo sapiens
gattatagattctaaagattct

SEQ ID NO: 3188210 - DNA, 21 bp, Homo sapiens
gattatagttgtgggtgggag

SEQ ID NO: 3188211 - DNA, 17 bp, Homo sapiens
gattatggaaaaataaa

SEQ ID NO: 3188212 - DNA, 14 bp, Homo sapiens
gattatggagcttt

SEQ ID NO: 3188213 - DNA, 18 bp, Homo sapiens
ctaagaaacttttgtaaa

SEQ ID NO: 3188214 - DNA, 21 bp, Homo sapiens
ctaagaaatcaagtaatgaat

SEQ ID NO: 3188215 - DNA, 22 bp, Homo sapiens
ctaagaaatcaagtaatgaatc

SEQ ID NO: 3188216 - DNA, 14 bp, Homo sapiens
ctaagaagcttcta

SEQ ID NO: 3188217 - DNA, 23 bp, Homo sapiens
ctaagaagcttctaataaattat

SEQ ID NO: 3188218 - DNA, 17 bp, Homo sapiens
ctaagaattcaaactgg

SEQ ID NO: 3188219 - DNA, 22 bp, Homo sapiens
ctaagacatgtgaggaggaaaa

SEQ ID NO: 3188220 - DNA, 23 bp, Homo sapiens
ctaagacatgtgaggaggaaaag

SEQ ID NO: 3188221 - DNA, 16 bp, Homo sapiens
ctaagactcaaatgtt

SEQ ID NO: 3188222 - DNA, 20 bp, Homo sapiens
ctaagactcaaatgttctaa

SEQ ID NO: 3188223 - DNA, 18 bp, Homo sapiens
ctaagacttactctaaga

SEQ ID NO: 3188224 - DNA, 19 bp, Homo sapiens
ctaagacttactctaagat

SEQ ID NO: 3188225 - DNA, 22 bp, Homo sapiens
ctaagacttactctaagatctt

SEQ ID NO: 3188226 - DNA, 23 bp, Homo sapiens
ctaagacttactctaagatctta

SEQ ID NO: 3188227 - DNA, 20 bp, Homo sapiens
ctaagagaaaattgcactaa

SEQ ID NO: 3188228 - DNA, 22 bp, Homo sapiens
ctaagagaagttattttctaca

SEQ ID NO: 3188229 - DNA, 11 bp, Homo sapiens
ctaagagattt

SEQ ID NO: 3188230 - DNA, 11 bp, Homo sapiens
ctaagaggctg

SEQ ID NO: 3188231 - DNA, 14 bp, Homo sapiens
ctaagaggctgctg

SEQ ID NO: 3188232 - DNA, 14 bp, Homo sapiens
ctaagaggtgggag

SEQ ID NO: 3188233 - DNA, 12 bp, Homo sapiens
ctaagatcttag

SEQ ID NO: 3188234 - DNA, 20 bp, Homo sapiens
ctaagatgagatttgccagc

SEQ ID NO: 3188235 - DNA, 22 bp, Homo sapiens
ctaagatgagatttgccagcac

SEQ ID NO: 3188236 - DNA, 22 bp, Homo sapiens
ctaagatgtgatattctaagac

SEQ ID NO: 3188237 - DNA, 18 bp, Homo sapiens
ctaagatgtgttcttatt

SEQ ID NO: 3188238 - DNA, 20 bp, Homo sapiens
ctaagatgtgttcttatttt

SEQ ID NO: 3188239 - DNA, 21 bp, Homo sapiens
ctaagattacaaatcagaagt

SEQ ID NO: 3188240 - DNA, 15 bp, Homo sapiens
ctaagattctaaagg

SEQ ID NO: 3188241 - DNA, 18 bp, Homo sapiens
ctaagattctaaaggtcc

SEQ ID NO: 3188242 - DNA, 13 bp, Homo sapiens
ctaagattctaat

SEQ ID NO: 3188243 - DNA, 15 bp, Homo sapiens
ctaagattctagatc

SEQ ID NO: 3188244 - DNA, 18 bp, Homo sapiens
ctaagattctagatcaga

SEQ ID NO: 3188245 - DNA, 22 bp, Homo sapiens
ctaagattctagatcagatgct

SEQ ID NO: 3188246 - DNA, 11 bp, Homo sapiens
ctaagattctg

SEQ ID NO: 3188247 - DNA, 21 bp, Homo sapiens
ctaagattcttttaaattaga

SEQ ID NO: 3188248 - DNA, 14 bp, Homo sapiens
ctaagcatctaagt

SEQ ID NO: 3188249 - DNA, 18 bp, Homo sapiens
ctaagccagttttcattt

SEQ ID NO: 3188250 - DNA, 20 bp, Homo sapiens
ctaagccctcgaaccaaggc

SEQ ID NO: 3188251 - DNA, 21 bp, Homo sapiens
ctaagccctcgaaccaaggca

SEQ ID NO: 3188252 - DNA, 21 bp, Homo sapiens
ctaagccctgtcgagacactt

SEQ ID NO: 3188253 - DNA, 11 bp, Homo sapiens
ctaagcccttt

SEQ ID NO: 3188254 - DNA, 17 bp, Homo sapiens
ctaagccctttgccatc

SEQ ID NO: 3188255 - DNA, 13 bp, Homo sapiens
ctaagcctctgct

SEQ ID NO: 3188256 - DNA, 22 bp, Homo sapiens
ctaagcgcacattcatgtgggc

SEQ ID NO: 3188257 - DNA, 17 bp, Homo sapiens
ctaagctaggaatgaaa

SEQ ID NO: 3188258 - DNA, 19 bp, Homo sapiens
ctaagctattcagtaataa

SEQ ID NO: 3188259 - DNA, 17 bp, Homo sapiens
ctaagctggctctgttt

SEQ ID NO: 3188260 - DNA, 14 bp, Homo sapiens
ctaagctgtgtgca

SEQ ID NO: 3188261 - DNA, 15 bp, Homo sapiens
ctaattccacacctt

SEQ ID NO: 3188262 - DNA, 18 bp, Homo sapiens
ctaattcccattttgcaa

SEQ ID NO: 3188263 - DNA, 16 bp, Homo sapiens
ctaattcttctgtcct

SEQ ID NO: 3188264 - DNA, 16 bp, Homo sapiens
ctaattgcatctcaaa

SEQ ID NO: 3188265 - DNA, 19 bp, Homo sapiens
ctaattgcatctcaaaatt

SEQ ID NO: 3188266 - DNA, 19 bp, Homo sapiens
ctaattggaaagtgccagc

SEQ ID NO: 3188267 - DNA, 17 bp, Homo sapiens
ctaattgtcagtgattt

SEQ ID NO: 3188268 - DNA, 12 bp, Homo sapiens
ctaattgtggat

SEQ ID NO: 3188269 - DNA, 14 bp, Homo sapiens
ctaatttaaaaaat

SEQ ID NO: 3188270 - DNA, 15 bp, Homo sapiens
ctaatttaaagagac

SEQ ID NO: 3188271 - DNA, 17 bp, Homo sapiens
ctaatttaacccagctc

SEQ ID NO: 3188272 - DNA, 12 bp, Homo sapiens
ctaatttataaa

SEQ ID NO: 3188273 - DNA, 14 bp, Homo sapiens
ctaatttataaaaa

SEQ ID NO: 3188274 - DNA, 22 bp, Homo sapiens
ctaatttattaatctaaaaaag

SEQ ID NO: 3188275 - DNA, 21 bp, Homo sapiens
ctaatttcaaaaatataactt

SEQ ID NO: 3188276 - DNA, 16 bp, Homo sapiens
ctaatttcccttcttg

SEQ ID NO: 3188277 - DNA, 14 bp, Homo sapiens
ctaatttctcctcc

SEQ ID NO: 3188278 - DNA, 18 bp, Homo sapiens
ctaatttctcctcccttc

SEQ ID NO: 3188279 - DNA, 19 bp, Homo sapiens
ctaatttctcctcccttcc

SEQ ID NO: 3188280 - DNA, 16 bp, Homo sapiens
ctaatttgaggctcag

SEQ ID NO: 3188281 - DNA, 12 bp, Homo sapiens
ctaatttgcatt

SEQ ID NO: 3188282 - DNA, 21 bp, Homo sapiens
ctaatttgcattaaattcaca

SEQ ID NO: 3188283 - DNA, 22 bp, Homo sapiens
ctaatttgcattaaattcacaa

SEQ ID NO: 3188284 - DNA, 15 bp, Homo sapiens
ctaattttaaataat

SEQ ID NO: 3188285 - DNA, 22 bp, Homo sapiens
ctaattttctcaaaagcattta

SEQ ID NO: 3188286 - DNA, 15 bp, Homo sapiens
ctaattttggatgga

SEQ ID NO: 3188287 - DNA, 17 bp, Homo sapiens
ctaattttgttgaaaat

SEQ ID NO: 3188288 - DNA, 18 bp, Homo sapiens
ctaatttttgtattattt

SEQ ID NO: 3188289 - DNA, 16 bp, Homo sapiens
ctacaaaaaataaaat

SEQ ID NO: 3188290 - DNA, 21 bp, Homo sapiens
ctacaaaaaggtataaataat

SEQ ID NO: 3188291 - DNA, 22 bp, Homo sapiens
ctacaaaaaggtataaataata

SEQ ID NO: 3188292 - DNA, 21 bp, Homo sapiens
ctacaaaacctgatgttaaaa

SEQ ID NO: 3188293 - DNA, 17 bp, Homo sapiens
ctacaaatttatgcatt

SEQ ID NO: 3188294 - DNA, 12 bp, Homo sapiens
ctacaaccaatt

SEQ ID NO: 3188295 - DNA, 20 bp, Homo sapiens
ctacaaccatccctgccaca

SEQ ID NO: 3188296 - DNA, 21 bp, Homo sapiens
ctacaaccatccctgccacat

SEQ ID NO: 3188297 - DNA, 19 bp, Homo sapiens
ctacaactggagttttttt

SEQ ID NO: 3188298 - DNA, 17 bp, Homo sapiens
ctacaacttcagcagta

SEQ ID NO: 3188299 - DNA, 19 bp, Homo sapiens
ctacaagagcagcctgtgg

SEQ ID NO: 3188300 - DNA, 12 bp, Homo sapiens
ctacaagatttc

SEQ ID NO: 3188301 - DNA, 19 bp, Homo sapiens
ctacaagatttccttaaaa

SEQ ID NO: 3188302 - DNA, 18 bp, Homo sapiens
caggagagagaaagccag

SEQ ID NO: 3188303 - DNA, 19 bp, Homo sapiens
caggagagagaaagccagg

SEQ ID NO: 3188304 - DNA, 11 bp, Homo sapiens
caggagagagc

SEQ ID NO: 3188305 - DNA, 22 bp, Homo sapiens
caggagagcagcggggcgaagc

SEQ ID NO: 3188306 - DNA, 12 bp, Homo sapiens
caggagagggaa

SEQ ID NO: 3188307 - DNA, 20 bp, Homo sapiens
caggagatggaagttgcagt

SEQ ID NO: 3188308 - DNA, 21 bp, Homo sapiens
caggagattgagaaggagaga

SEQ ID NO: 3188309 - DNA, 17 bp, Homo sapiens
caggagcacaggcagct

SEQ ID NO: 3188310 - DNA, 18 bp, Homo sapiens
caggagcaggcacgggtg

SEQ ID NO: 3188311 - DNA, 16 bp, Homo sapiens
caggagccccgaggcc

SEQ ID NO: 3188312 - DNA, 19 bp, Homo sapiens
caggagcctagcggagccc

SEQ ID NO: 3188313 - DNA, 22 bp, Homo sapiens
caggagcctagcggagcccagc

SEQ ID NO: 3188314 - DNA, 12 bp, Homo sapiens
caggagcctggc

SEQ ID NO: 3188315 - DNA, 15 bp, Homo sapiens
caggagcctgtgcct

SEQ ID NO: 3188316 - DNA, 14 bp, Homo sapiens
caggagcgtgaagg

SEQ ID NO: 3188317 - DNA, 16 bp, Homo sapiens
caggagcgtgaaggac

SEQ ID NO: 3188318 - DNA, 19 bp, Homo sapiens
caggagcgtgaaggactta

SEQ ID NO: 3188319 - DNA, 23 bp, Homo sapiens
caggagctcttcaggcctccctc

SEQ ID NO: 3188320 - DNA, 19 bp, Homo sapiens
caggagctgtcaccaagga

SEQ ID NO: 3188321 - DNA, 14 bp, Homo sapiens
caggagcttttgtg

SEQ ID NO: 3188322 - DNA, 23 bp, Homo sapiens
caggaggaatcatgtcaggcctg

SEQ ID NO: 3188323 - DNA, 18 bp, Homo sapiens
caggaggaggagatggcc

SEQ ID NO: 3188324 - DNA, 21 bp, Homo sapiens
caggaggcagagggttgcagt

SEQ ID NO: 3188325 - DNA, 15 bp, Homo sapiens
caggaggccaataaa

SEQ ID NO: 3188326 - DNA, 19 bp, Homo sapiens
caggaggccaataaaaagt

SEQ ID NO: 3188327 - DNA, 21 bp, Homo sapiens
caggaggccaataaaaagttc

SEQ ID NO: 3188328 - DNA, 22 bp, Homo sapiens
caggaggccaataaaaagttca

SEQ ID NO: 3188329 - DNA, 23 bp, Homo sapiens
caggaggccaataaaaagttcag

SEQ ID NO: 3188330 - DNA, 17 bp, Homo sapiens
caggaggcggcccggcc

SEQ ID NO: 3188331 - DNA, 13 bp, Homo sapiens
caggaggctgagg

SEQ ID NO: 3188332 - DNA, 15 bp, Homo sapiens
caggaggctgagggg

SEQ ID NO: 3188333 - DNA, 13 bp, Homo sapiens
caggaggctggag

SEQ ID NO: 3188334 - DNA, 15 bp, Homo sapiens
caggaggctggagga

SEQ ID NO: 3188335 - DNA, 21 bp, Homo sapiens
caggaggcttggaaagcatca

SEQ ID NO: 3188336 - DNA, 19 bp, Homo sapiens
caggagggaggtttgtgag

SEQ ID NO: 3188337 - DNA, 23 bp, Homo sapiens
caggagggaggtttgtgagagcg

SEQ ID NO: 3188338 - DNA, 22 bp, Homo sapiens
caggagggattggccgcttggc

SEQ ID NO: 3188339 - DNA, 16 bp, Homo sapiens
caggagggccctacct

SEQ ID NO: 3188340 - DNA, 20 bp, Homo sapiens
caggaggggaactgagtcac

SEQ ID NO: 3188341 - DNA, 21 bp, Homo sapiens
caggaggggaactgagtcacg

SEQ ID NO: 3188342 - DNA, 20 bp, Homo sapiens
caggaggggtctcatgtcct

SEQ ID NO: 3188343 - DNA, 20 bp, Homo sapiens
caggaggtggaggttgcagt

SEQ ID NO: 3188344 - DNA, 14 bp, Homo sapiens
caggaggtgtgaat

SEQ ID NO: 3188345 - DNA, 18 bp, Homo sapiens
caggaggttggtgactga

SEQ ID NO: 3188346 - DNA, 20 bp, Homo sapiens
caggaggttggtgactgaaa

SEQ ID NO: 3188347 - DNA, 13 bp, Homo sapiens
caggagtcagtgt

SEQ ID NO: 3188348 - DNA, 16 bp, Homo sapiens
caggagtcagtgtctg

SEQ ID NO: 3188349 - DNA, 21 bp, Homo sapiens
caggagtcagtgtctggcttt

SEQ ID NO: 3188350 - DNA, 15 bp, Homo sapiens
caggagtctgtgctc

SEQ ID NO: 3188351 - DNA, 12 bp, Homo sapiens
caggagtgagca

SEQ ID NO: 3188352 - DNA, 17 bp, Homo sapiens
caggagtgtcctcttcc

SEQ ID NO: 3188353 - DNA, 21 bp, Homo sapiens
caggagtgtcctcttccctct

SEQ ID NO: 3188354 - DNA, 19 bp, Homo sapiens
caggagttcgagaccagcc

SEQ ID NO: 3188355 - DNA, 22 bp, Homo sapiens
caggagttcgagaccagcctcg

SEQ ID NO: 3188356 - DNA, 23 bp, Homo sapiens
caggagttcgagaccagcctcgc

SEQ ID NO: 3188357 - DNA, 22 bp, Homo sapiens
caggagttggaatgttgtagtt

SEQ ID NO: 3188358 - DNA, 20 bp, Homo sapiens
caggagttgtttctgaccca

SEQ ID NO: 3188359 - DNA, 21 bp, Homo sapiens
caggagtttaagaccagcctg

SEQ ID NO: 3188360 - DNA, 23 bp, Homo sapiens
caggagtttgagacaagccctgg

SEQ ID NO: 3188361 - DNA, 17 bp, Homo sapiens
caggataaggagactga

SEQ ID NO: 3188362 - DNA, 17 bp, Homo sapiens
caggatactctgtcaga

SEQ ID NO: 3188363 - DNA, 15 bp, Homo sapiens
caggatactggcaca

SEQ ID NO: 3188364 - DNA, 16 bp, Homo sapiens
caggatcatggtgtaa

SEQ ID NO: 3188365 - DNA, 23 bp, Homo sapiens
caggatcatggtgtaataagaca

SEQ ID NO: 3188366 - DNA, 17 bp, Homo sapiens
caggatccaagctaagc

SEQ ID NO: 3188367 - DNA, 16 bp, Homo sapiens
caggatccgctgccac

SEQ ID NO: 3188368 - DNA, 13 bp, Homo sapiens
caggatcctgcag

SEQ ID NO: 3188369 - DNA, 15 bp, Homo sapiens
caggatcctgcagga

SEQ ID NO: 3188370 - DNA, 17 bp, Homo sapiens
caggatctttgactgaa

SEQ ID NO: 3188371 - DNA, 16 bp, Homo sapiens
caggatgacctggata

SEQ ID NO: 3188372 - DNA, 13 bp, Homo sapiens
caggatgccagcc

SEQ ID NO: 3188373 - DNA, 20 bp, Homo sapiens
caggatgccagcccctgcct

SEQ ID NO: 3188374 - DNA, 13 bp, Homo sapiens
caggatgcccaga

SEQ ID NO: 3188375 - DNA, 17 bp, Homo sapiens
caggatgcccagatgaa

SEQ ID NO: 3188376 - DNA, 23 bp, Homo sapiens
caggatgctaacatctaaaaata

SEQ ID NO: 3188377 - DNA, 17 bp, Homo sapiens
caggatggactcttctc

SEQ ID NO: 3188378 - DNA, 23 bp, Homo sapiens
caggatggaggggtggtcctgac

SEQ ID NO: 3188379 - DNA, 17 bp, Homo sapiens
caggattcagccggagg

SEQ ID NO: 3188380 - DNA, 22 bp, Homo sapiens
caggattttaacaaaagcaaga

SEQ ID NO: 3188381 - DNA, 18 bp, Homo sapiens
caggcaaaaaagggacag

SEQ ID NO: 3188382 - DNA, 17 bp, Homo sapiens
caggcaaaacacgcaag

SEQ ID NO: 3188383 - DNA, 17 bp, Homo sapiens
caggcaacttcagtcct

SEQ ID NO: 3188384 - DNA, 20 bp, Homo sapiens
caggcaacttcagtcctggg

SEQ ID NO: 3188385 - DNA, 21 bp, Homo sapiens
caggcaacttcagtcctggga

SEQ ID NO: 3188386 - DNA, 14 bp, Homo sapiens
caggcaagcacctc

SEQ ID NO: 3188387 - DNA, 13 bp, Homo sapiens
caggcaagcccct

SEQ ID NO: 3188388 - DNA, 17 bp, Homo sapiens
caggcaagcccctcagc

SEQ ID NO: 3188389 - DNA, 14 bp, Homo sapiens
caggcaatgctggc

SEQ ID NO: 3188390 - DNA, 16 bp, Homo sapiens
caggcaatgctggctg

SEQ ID NO: 3188391 - DNA, 17 bp, Homo sapiens
caggcaatgctggctgt

SEQ ID NO: 3188392 - DNA, 16 bp, Homo sapiens
caggcaatgctgtact

SEQ ID NO: 3188393 - DNA, 15 bp, Homo sapiens
caggcacacagcagc

SEQ ID NO: 3188394 - DNA, 20 bp, Homo sapiens
caggcacacagctactctcc

SEQ ID NO: 3188395 - DNA, 12 bp, Homo sapiens
caggcacagggc

SEQ ID NO: 3188396 - DNA, 14 bp, Homo sapiens
caggcacagggccc

SEQ ID NO: 3188397 - DNA, 18 bp, Homo sapiens
caggcacagggcccgcag

SEQ ID NO: 3188398 - DNA, 14 bp, Homo sapiens
caggcaccagcatc

SEQ ID NO: 3188399 - DNA, 20 bp, Homo sapiens
caggcaccaggactagggct

SEQ ID NO: 3188400 - DNA, 23 bp, Homo sapiens
caggcacccaccatcatgtctgg

SEQ ID NO: 3188401 - DNA, 23 bp, Homo sapiens
caggcacccggggccagagacat

SEQ ID NO: 3188402 - DNA, 13 bp, Homo sapiens
caggcacccttct

SEQ ID NO: 3188403 - DNA, 21 bp, Homo sapiens
caggcacccttctttcctctt

SEQ ID NO: 3188404 - DNA, 13 bp, Homo sapiens
caggcaccgagaa

SEQ ID NO: 3188405 - DNA, 23 bp, Homo sapiens
caggcaccgccacgtcccagcat

SEQ ID NO: 3188406 - DNA, 24 bp, Homo sapiens
caggcaccgccacgtcccagcatc

SEQ ID NO: 3188407 - DNA, 16 bp, Homo sapiens
caggcacctggcctgc

SEQ ID NO: 3188408 - DNA, 17 bp, Homo sapiens
caggcacctggcctgct

SEQ ID NO: 3188409 - DNA, 20 bp, Homo sapiens
caggcacctggcctgctggg

SEQ ID NO: 3188410 - DNA, 18 bp, Homo sapiens
caggcacgggtggtcccc

SEQ ID NO: 3188411 - DNA, 19 bp, Homo sapiens
caggcacgggtggtccccg

SEQ ID NO: 3188412 - DNA, 18 bp, Homo sapiens
caggcactgccttctcct

SEQ ID NO: 3188413 - DNA, 21 bp, Homo sapiens
caggcactgccttctcctctc

SEQ ID NO: 3188414 - DNA, 17 bp, Homo sapiens
caggcactggtggcatc

SEQ ID NO: 3188415 - DNA, 21 bp, Homo sapiens
caggcacttaagcacaagcag

SEQ ID NO: 3188416 - DNA, 21 bp, Homo sapiens
caggcagagctgacgggaggc

SEQ ID NO: 3188417 - DNA, 13 bp, Homo sapiens
caggcagatctgt

SEQ ID NO: 3188418 - DNA, 16 bp, Homo sapiens
caggcagatctgtgcc

SEQ ID NO: 3188419 - DNA, 19 bp, Homo sapiens
caggcagatctgtgcccca

SEQ ID NO: 3188420 - DNA, 15 bp, Homo sapiens
caggcagcgccaagc

SEQ ID NO: 3188421 - DNA, 20 bp, Homo sapiens
caggcagcgccaagtgcgtg

SEQ ID NO: 3188422 - DNA, 14 bp, Homo sapiens
caggcagctttcta

SEQ ID NO: 3188423 - DNA, 19 bp, Homo sapiens
caggcaggccagatggccc

SEQ ID NO: 3188424 - DNA, 22 bp, Homo sapiens
caggcaggctttctgggtgtga

SEQ ID NO: 3188425 - DNA, 21 bp, Homo sapiens
caggcaggggtgggggtggag

SEQ ID NO: 3188426 - DNA, 22 bp, Homo sapiens
caggcaggggtgggggtggagg

SEQ ID NO: 3188427 - DNA, 13 bp, Homo sapiens
caggcaggtccag

SEQ ID NO: 3188428 - DNA, 20 bp, Homo sapiens
caggcagtcgggggctggcc

SEQ ID NO: 3188429 - DNA, 20 bp, Homo sapiens
caggcataaaatagagtaaa

SEQ ID NO: 3188430 - DNA, 21 bp, Homo sapiens
aaaatgaatgcaaaattgttt

SEQ ID NO: 3188431 - DNA, 15 bp, Homo sapiens
aaaatgacaacagaa

SEQ ID NO: 3188432 - DNA, 17 bp, Homo sapiens
aaaatgacagatgttga

SEQ ID NO: 3188433 - DNA, 13 bp, Homo sapiens
aaaatgagaattt

SEQ ID NO: 3188434 - DNA, 22 bp, Homo sapiens
aaaatgagccgtgccaaagtct

SEQ ID NO: 3188435 - DNA, 23 bp, Homo sapiens
aaaatgattcctggacatcacca

SEQ ID NO: 3188436 - DNA, 19 bp, Homo sapiens
aaaatgattgtaaaatagc

SEQ ID NO: 3188437 - DNA, 14 bp, Homo sapiens
aaaatgattttatc

SEQ ID NO: 3188438 - DNA, 14 bp, Homo sapiens
aaaatgcaaagctg

SEQ ID NO: 3188439 - DNA, 17 bp, Homo sapiens
aaaatgcccttaaatca

SEQ ID NO: 3188440 - DNA, 11 bp, Homo sapiens
aaaatgccttt

SEQ ID NO: 3188441 - DNA, 18 bp, Homo sapiens
aaaatgcggttataaaaa

SEQ ID NO: 3188442 - DNA, 22 bp, Homo sapiens
aaaatgctttttatttctgcat

SEQ ID NO: 3188443 - DNA, 15 bp, Homo sapiens
aaaatggaaaaaaac

SEQ ID NO: 3188444 - DNA, 16 bp, Homo sapiens
aaaatggaaaaaaaca

SEQ ID NO: 3188445 - DNA, 14 bp, Homo sapiens
aaaatggaaagaat

SEQ ID NO: 3188446 - DNA, 21 bp, Homo sapiens
aaaatggcagggggtggaatt

SEQ ID NO: 3188447 - DNA, 19 bp, Homo sapiens
aaaatggccatttgctttt

SEQ ID NO: 3188448 - DNA, 15 bp, Homo sapiens
aaaatggctaataaa

SEQ ID NO: 3188449 - DNA, 22 bp, Homo sapiens
aaaatggctaataaactgtatt

SEQ ID NO: 3188450 - DNA, 21 bp, Homo sapiens
aaaatgggaaaaataaaagaa

SEQ ID NO: 3188451 - DNA, 18 bp, Homo sapiens
aaaatggtatcaaaatta

SEQ ID NO: 3188452 - DNA, 20 bp, Homo sapiens
aaaatggttgatggaaaata

SEQ ID NO: 3188453 - DNA, 22 bp, Homo sapiens
aaaatggttgatggaaaataaa

SEQ ID NO: 3188454 - DNA, 18 bp, Homo sapiens
aaaatgtaaaggagggag

SEQ ID NO: 3188455 - DNA, 22 bp, Homo sapiens
aaaatgtaagattatagattct

SEQ ID NO: 3188456 - DNA, 18 bp, Homo sapiens
aaaatgtaatttaaatga

SEQ ID NO: 3188457 - DNA, 10 bp, Homo sapiens
aaaatgtact

SEQ ID NO: 3188458 - DNA, 16 bp, Homo sapiens
aaaatgtatatattta

SEQ ID NO: 3188459 - DNA, 18 bp, Homo sapiens
aaaatgtatgtgtaagta

SEQ ID NO: 3188460 - DNA, 13 bp, Homo sapiens
aaaatgtattttt

SEQ ID NO: 3188461 - DNA, 22 bp, Homo sapiens
aaaatgtcaaagagaaaactta

SEQ ID NO: 3188462 - DNA, 16 bp, Homo sapiens
aaaatgtcctgccttt

SEQ ID NO: 3188463 - DNA, 21 bp, Homo sapiens
aaaatgtctgtagctcctcaa

SEQ ID NO: 3188464 - DNA, 15 bp, Homo sapiens
aaaatgtgaaatctc

SEQ ID NO: 3188465 - DNA, 22 bp, Homo sapiens
aaaatgtgaaatctcagaattt

SEQ ID NO: 3188466 - DNA, 15 bp, Homo sapiens
aaaatgtgatgttct

SEQ ID NO: 3188467 - DNA, 21 bp, Homo sapiens
aaaatgtgatgttctaaggct

SEQ ID NO: 3188468 - DNA, 19 bp, Homo sapiens
aaaatgtgctatactgcat

SEQ ID NO: 3188469 - DNA, 14 bp, Homo sapiens
aaaatgtgtacagt

SEQ ID NO: 3188470 - DNA, 18 bp, Homo sapiens
aaaatgtgtacagtgaat

SEQ ID NO: 3188471 - DNA, 13 bp, Homo sapiens
aaaatgtgttgaa

SEQ ID NO: 3188472 - DNA, 22 bp, Homo sapiens
aaaatgttatcttctcaagttc

SEQ ID NO: 3188473 - DNA, 12 bp, Homo sapiens
aaaatgttcttt

SEQ ID NO: 3188474 - DNA, 22 bp, Homo sapiens
aaaatgttgagaagcgttttta

SEQ ID NO: 3188475 - DNA, 12 bp, Homo sapiens
aaaatgttttaa

SEQ ID NO: 3188476 - DNA, 14 bp, Homo sapiens
aaaattacagatgt

SEQ ID NO: 3188477 - DNA, 22 bp, Homo sapiens
aaaattacagatgtgaaaataa

SEQ ID NO: 3188478 - DNA, 21 bp, Homo sapiens
aaaattacgtttgttattcct

SEQ ID NO: 3188479 - DNA, 23 bp, Homo sapiens
aaaattagactgtgattcagaaa

SEQ ID NO: 3188480 - DNA, 22 bp, Homo sapiens
aaaattatactaacttatttat

SEQ ID NO: 3188481 - DNA, 16 bp, Homo sapiens
aaaattatcctctttg

SEQ ID NO: 3188482 - DNA, 22 bp, Homo sapiens
aaaattatgaatctgattttta

SEQ ID NO: 3188483 - DNA, 17 bp, Homo sapiens
aaaattcaaaaagtgtt

SEQ ID NO: 3188484 - DNA, 22 bp, Homo sapiens
aaaattcaaagcatggacattt

SEQ ID NO: 3188485 - DNA, 14 bp, Homo sapiens
aaaattcaattgta

SEQ ID NO: 3188486 - DNA, 17 bp, Homo sapiens
aaaattcaattgtaaat

SEQ ID NO: 3188487 - DNA, 16 bp, Homo sapiens
aaaattcagagtcctt

SEQ ID NO: 3188488 - DNA, 13 bp, Homo sapiens
aaaattcagtgga

SEQ ID NO: 3188489 - DNA, 13 bp, Homo sapiens
aaaattcagtttt

SEQ ID NO: 3188490 - DNA, 15 bp, Homo sapiens
aaaattcagtttttg

SEQ ID NO: 3188491 - DNA, 23 bp, Homo sapiens
aaaattcagtttttgtatcttgg

SEQ ID NO: 3188492 - DNA, 22 bp, Homo sapiens
aaaattcgcccgagctgtttat

SEQ ID NO: 3188493 - DNA, 19 bp, Homo sapiens
aaaattctagctgtatgat

SEQ ID NO: 3188494 - DNA, 15 bp, Homo sapiens
aaaattctgaatgta

SEQ ID NO: 3188495 - DNA, 14 bp, Homo sapiens
aaaattctgtgcct

SEQ ID NO: 3188496 - DNA, 22 bp, Homo sapiens
aaaattctgttgttccatttta

SEQ ID NO: 3188497 - DNA, 12 bp, Homo sapiens
aaaattgatgtg

SEQ ID NO: 3188498 - DNA, 12 bp, Homo sapiens
aaaattgatttt

SEQ ID NO: 3188499 - DNA, 15 bp, Homo sapiens
aaaattgcaaatctt

SEQ ID NO: 3188500 - DNA, 20 bp, Homo sapiens
aaaattgtctaaaatgtcag

SEQ ID NO: 3188501 - DNA, 12 bp, Homo sapiens
aaaattgtttca

SEQ ID NO: 3188502 - DNA, 17 bp, Homo sapiens
aaaattgtttcttgaca

SEQ ID NO: 3188503 - DNA, 12 bp, Homo sapiens
aaaattgttttc

SEQ ID NO: 3188504 - DNA, 22 bp, Homo sapiens
aaaatttaaagggtgtacttat

SEQ ID NO: 3188505 - DNA, 18 bp, Homo sapiens
aaaatttagccctttaaa

SEQ ID NO: 3188506 - DNA, 19 bp, Homo sapiens
aaaatttagtttttgttct

SEQ ID NO: 3188507 - DNA, 16 bp, Homo sapiens
aaaatttgttttgacg

SEQ ID NO: 3188508 - DNA, 22 bp, Homo sapiens
aaaatttgttttgacggatgat

SEQ ID NO: 3188509 - DNA, 13 bp, Homo sapiens
aaaattttacttc

SEQ ID NO: 3188510 - DNA, 23 bp, Homo sapiens
aaaattttctagaaatacacttt

SEQ ID NO: 3188511 - DNA, 14 bp, Homo sapiens
aaacaaaatctgaa

SEQ ID NO: 3188512 - DNA, 17 bp, Homo sapiens
aaacaaaatttgactaa

SEQ ID NO: 3188513 - DNA, 15 bp, Homo sapiens
aaacaaacattgtgt

SEQ ID NO: 3188514 - DNA, 19 bp, Homo sapiens
aaacaaagtttcagagtat

SEQ ID NO: 3188515 - DNA, 16 bp, Homo sapiens
aaacaaataatcacat

SEQ ID NO: 3188516 - DNA, 19 bp, Homo sapiens
aaacaaattcatattctgt

SEQ ID NO: 3188517 - DNA, 22 bp, Homo sapiens
aaacaacagctcgatccaaatt

SEQ ID NO: 3188518 - DNA, 22 bp, Homo sapiens
aaacaacgtgtatagtgcctaa

SEQ ID NO: 3188519 - DNA, 17 bp, Homo sapiens
aaacaactttctcttgt

SEQ ID NO: 3188520 - DNA, 17 bp, Homo sapiens
aaacaagaaccatttgc

SEQ ID NO: 3188521 - DNA, 12 bp, Homo sapiens
aaacaagaatgt

SEQ ID NO: 3188522 - DNA, 22 bp, Homo sapiens
aaacaagagttttcttccttgt

SEQ ID NO: 3188523 - DNA, 15 bp, Homo sapiens
aaacaagctgtgcag

SEQ ID NO: 3188524 - DNA, 20 bp, Homo sapiens
aaacaaggggctgttacata

SEQ ID NO: 3188525 - DNA, 15 bp, Homo sapiens
aaacaataaagagat

SEQ ID NO: 3188526 - DNA, 16 bp, Homo sapiens
aaacaataaatgtgca

SEQ ID NO: 3188527 - DNA, 12 bp, Homo sapiens
aaacaatatcat

SEQ ID NO: 3188528 - DNA, 15 bp, Homo sapiens
aaacaatcccaatct

SEQ ID NO: 3188529 - DNA, 22 bp, Homo sapiens
aaacaatcccaatctttctata

SEQ ID NO: 3188530 - DNA, 14 bp, Homo sapiens
aaacaatctgtaat

SEQ ID NO: 3188531 - DNA, 12 bp, Homo sapiens
aaacaatcttat

SEQ ID NO: 3188532 - DNA, 13 bp, Homo sapiens
aaacaatgtaaag

SEQ ID NO: 3188533 - DNA, 13 bp, Homo sapiens
aaacaatgtataa

SEQ ID NO: 3188534 - DNA, 14 bp, Homo sapiens
aaacaatgtataaa

SEQ ID NO: 3188535 - DNA, 21 bp, Homo sapiens
aaacaatgtataaagattgta

SEQ ID NO: 3188536 - DNA, 22 bp, Homo sapiens
aaacaatgtataaagattgtac

SEQ ID NO: 3188537 - DNA, 16 bp, Homo sapiens
aaacaatgttgtccaa

SEQ ID NO: 3188538 - DNA, 18 bp, Homo sapiens
aaacacaccaggctgtgg

SEQ ID NO: 3188539 - DNA, 23 bp, Homo sapiens
aaacacaccaggctgtgggcctc

SEQ ID NO: 3188540 - DNA, 19 bp, Homo sapiens
aaacacactcaaaagacaa

SEQ ID NO: 3188541 - DNA, 17 bp, Homo sapiens
aaacacactgaaagctc

SEQ ID NO: 3188542 - DNA, 18 bp, Homo sapiens
aaacacatctttcctgtc

SEQ ID NO: 3188543 - DNA, 14 bp, Homo sapiens
aaacacattgaatg

SEQ ID NO: 3188544 - DNA, 23 bp, Homo sapiens
aaacacattgcctaactactagt

SEQ ID NO: 3188545 - DNA, 17 bp, Homo sapiens
aaacacctccccagccc

SEQ ID NO: 3188546 - DNA, 18 bp, Homo sapiens
aaacacctcctcatgtac

SEQ ID NO: 3188547 - DNA, 13 bp, Homo sapiens
aaacacgaaactt

SEQ ID NO: 3188548 - DNA, 15 bp, Homo sapiens
aaacacgaaacttgt

SEQ ID NO: 3188549 - DNA, 18 bp, Homo sapiens
aaacacgaaacttgttat

SEQ ID NO: 3188550 - DNA, 23 bp, Homo sapiens
aaacacgaaacttgttattgtga

SEQ ID NO: 3188551 - DNA, 15 bp, Homo sapiens
aaacacgtggtcatg

SEQ ID NO: 3188552 - DNA, 22 bp, Homo sapiens
aaacacgtggtcatgaatagaa

SEQ ID NO: 3188553 - DNA, 14 bp, Homo sapiens
aaacactaaaagca

SEQ ID NO: 3188554 - DNA, 13 bp, Homo sapiens
aaacactcatccc

SEQ ID NO: 3188555 - DNA, 17 bp, Homo sapiens
aaacactcggcatttca

SEQ ID NO: 3188556 - DNA, 20 bp, Homo sapiens
aaacactcggcatttcaaat

SEQ ID NO: 3188557 - DNA, 23 bp, Homo sapiens
aaacactgccatcttagtttgga

SEQ ID NO: 3188558 - DNA, 17 bp, Homo sapiens
aaacactggtgccaacc

SEQ ID NO: 3188559 - DNA, 17 bp, Homo sapiens
gatttccatcttaatgt

SEQ ID NO: 3188560 - DNA, 14 bp, Homo sapiens
gatttcctaaacat

SEQ ID NO: 3188561 - DNA, 22 bp, Homo sapiens
gatttccttgaatgtggcttga

SEQ ID NO: 3188562 - DNA, 16 bp, Homo sapiens
gatttctaatcaaaag

SEQ ID NO: 3188563 - DNA, 17 bp, Homo sapiens
gatttctacattaactt

SEQ ID NO: 3188564 - DNA, 18 bp, Homo sapiens
gatttctacctcagcagc

SEQ ID NO: 3188565 - DNA, 14 bp, Homo sapiens
gatttctatggctt

SEQ ID NO: 3188566 - DNA, 20 bp, Homo sapiens
gatttctatggctttcaaag

SEQ ID NO: 3188567 - DNA, 16 bp, Homo sapiens
gatttctcattgactt

SEQ ID NO: 3188568 - DNA, 14 bp, Homo sapiens
gatttcttaaattt

SEQ ID NO: 3188569 - DNA, 17 bp, Homo sapiens
gatttcttcgctgctct

SEQ ID NO: 3188570 - DNA, 19 bp, Homo sapiens
gatttcttcgctgctctag

SEQ ID NO: 3188571 - DNA, 20 bp, Homo sapiens
gatttctttaaaagaatgac

SEQ ID NO: 3188572 - DNA, 22 bp, Homo sapiens
gatttctttctttgcaccaaag

SEQ ID NO: 3188573 - DNA, 18 bp, Homo sapiens
gatttcttttcttcctgg

SEQ ID NO: 3188574 - DNA, 19 bp, Homo sapiens
gatttcttttcttcctggc

SEQ ID NO: 3188575 - DNA, 16 bp, Homo sapiens
gatttgatatttgcat

SEQ ID NO: 3188576 - DNA, 19 bp, Homo sapiens
gatttgatgagttaactgt

SEQ ID NO: 3188577 - DNA, 21 bp, Homo sapiens
gatttgatgagttaactgtga

SEQ ID NO: 3188578 - DNA, 21 bp, Homo sapiens
gatttgcattgaacacaaact

SEQ ID NO: 3188579 - DNA, 12 bp, Homo sapiens
gatttgccagca

SEQ ID NO: 3188580 - DNA, 15 bp, Homo sapiens
gatttgccagcacag

SEQ ID NO: 3188581 - DNA, 19 bp, Homo sapiens
gatttggcactagccaaag

SEQ ID NO: 3188582 - DNA, 14 bp, Homo sapiens
gatttgtactgaaa

SEQ ID NO: 3188583 - DNA, 19 bp, Homo sapiens
gatttgtagcataactgta

SEQ ID NO: 3188584 - DNA, 23 bp, Homo sapiens
gatttgtaggaaggtctcattct

SEQ ID NO: 3188585 - DNA, 14 bp, Homo sapiens
gatttgtcccagcc

SEQ ID NO: 3188586 - DNA, 16 bp, Homo sapiens
gatttgtcccagcctg

SEQ ID NO: 3188587 - DNA, 14 bp, Homo sapiens
gatttgtcccaggt

SEQ ID NO: 3188588 - DNA, 20 bp, Homo sapiens
gatttgtgaaataaaacagg

SEQ ID NO: 3188589 - DNA, 14 bp, Homo sapiens
gatttgtgaactgg

SEQ ID NO: 3188590 - DNA, 20 bp, Homo sapiens
gatttgttcctgccccaccc

SEQ ID NO: 3188591 - DNA, 23 bp, Homo sapiens
gatttgttcctgccccaccctaa

SEQ ID NO: 3188592 - DNA, 19 bp, Homo sapiens
gatttgtttttgtattttt

SEQ ID NO: 3188593 - DNA, 14 bp, Homo sapiens
gattttaaaggcag

SEQ ID NO: 3188594 - DNA, 21 bp, Homo sapiens
gattttaaattcacaatagaa

SEQ ID NO: 3188595 - DNA, 20 bp, Homo sapiens
gattttaacaaaagcaagac

SEQ ID NO: 3188596 - DNA, 17 bp, Homo sapiens
gattttaacaataacta

SEQ ID NO: 3188597 - DNA, 23 bp, Homo sapiens
gattttaacaataactactgtgt

SEQ ID NO: 3188598 - DNA, 14 bp, Homo sapiens
gattttaattgtca

SEQ ID NO: 3188599 - DNA, 19 bp, Homo sapiens
gattttaatttatttgttt

SEQ ID NO: 3188600 - DNA, 16 bp, Homo sapiens
gattttaccaaagcat

SEQ ID NO: 3188601 - DNA, 19 bp, Homo sapiens
gattttaccaaagcatcaa

SEQ ID NO: 3188602 - DNA, 19 bp, Homo sapiens
gattttaggagctaaggct

SEQ ID NO: 3188603 - DNA, 20 bp, Homo sapiens
gattttatctgtgaattcag

SEQ ID NO: 3188604 - DNA, 15 bp, Homo sapiens
gattttctggttcta

SEQ ID NO: 3188605 - DNA, 16 bp, Homo sapiens
gattttctggttctaa

SEQ ID NO: 3188606 - DNA, 13 bp, Homo sapiens
gattttgaaaagt

SEQ ID NO: 3188607 - DNA, 15 bp, Homo sapiens
gattttgctgtatat

SEQ ID NO: 3188608 - DNA, 22 bp, Homo sapiens
gattttgggagtgactcaagaa

SEQ ID NO: 3188609 - DNA, 19 bp, Homo sapiens
gattattaacgatgtccaa

SEQ ID NO: 3188610 - DNA, 20 bp, Homo sapiens
gattattagccaggtaatgt

SEQ ID NO: 3188611 - DNA, 14 bp, Homo sapiens
gattattatctaaa

SEQ ID NO: 3188612 - DNA, 16 bp, Homo sapiens
gattattatgtttatt

SEQ ID NO: 3188613 - DNA, 19 bp, Homo sapiens
gattattatgtttattaca

SEQ ID NO: 3188614 - DNA, 13 bp, Homo sapiens
gattattcattta

SEQ ID NO: 3188615 - DNA, 14 bp, Homo sapiens
gattattcatttaa

SEQ ID NO: 3188616 - DNA, 19 bp, Homo sapiens
gattattcatttaaaatga

SEQ ID NO: 3188617 - DNA, 21 bp, Homo sapiens
gattattgagttccagttgaa

SEQ ID NO: 3188618 - DNA, 12 bp, Homo sapiens
gattatttaata

SEQ ID NO: 3188619 - DNA, 22 bp, Homo sapiens
gattatttaataacattacctt

SEQ ID NO: 3188620 - DNA, 22 bp, Homo sapiens
gattatttcactttagatgctg

SEQ ID NO: 3188621 - DNA, 20 bp, Homo sapiens
gattatttgtatttacagtt

SEQ ID NO: 3188622 - DNA, 17 bp, Homo sapiens
gattattttttttttct

SEQ ID NO: 3188623 - DNA, 14 bp, Homo sapiens
gattcaatctgtaa

SEQ ID NO: 3188624 - DNA, 20 bp, Homo sapiens
gattcaatctgtaaactgtg

SEQ ID NO: 3188625 - DNA, 21 bp, Homo sapiens
gattcaatctgtaaactgtgt

SEQ ID NO: 3188626 - DNA, 21 bp, Homo sapiens
gattcacacctgactctgaaa

SEQ ID NO: 3188627 - DNA, 14 bp, Homo sapiens
gattcacatctgca

SEQ ID NO: 3188628 - DNA, 19 bp, Homo sapiens
gattcactgtgcttcgagc

SEQ ID NO: 3188629 - DNA, 15 bp, Homo sapiens
gattcaggccagccc

SEQ ID NO: 3188630 - DNA, 16 bp, Homo sapiens
gattcaggccagccca

SEQ ID NO: 3188631 - DNA, 19 bp, Homo sapiens
gattcaggccagcccagcc

SEQ ID NO: 3188632 - DNA, 18 bp, Homo sapiens
gattcaggggctgggggt

SEQ ID NO: 3188633 - DNA, 22 bp, Homo sapiens
gattcagttttcatttggttca

SEQ ID NO: 3188634 - DNA, 11 bp, Homo sapiens
gattcataaca

SEQ ID NO: 3188635 - DNA, 14 bp, Homo sapiens
gattcataacaatg

SEQ ID NO: 3188636 - DNA, 16 bp, Homo sapiens
gattcatagtaacttc

SEQ ID NO: 3188637 - DNA, 17 bp, Homo sapiens
gattcatatttacttct

SEQ ID NO: 3188638 - DNA, 19 bp, Homo sapiens
gattcatatttacttctta

SEQ ID NO: 3188639 - DNA, 23 bp, Homo sapiens
gattccaaagagtagaattgcat

SEQ ID NO: 3188640 - DNA, 17 bp, Homo sapiens
gattccactacacctgg

SEQ ID NO: 3188641 - DNA, 20 bp, Homo sapiens
gattccagagagtggctcct

SEQ ID NO: 3188642 - DNA, 20 bp, Homo sapiens
gattcccaagctctgctcct

SEQ ID NO: 3188643 - DNA, 11 bp, Homo sapiens
gattcccccag

SEQ ID NO: 3188644 - DNA, 22 bp, Homo sapiens
gattcctaagccacttgaaatg

SEQ ID NO: 3188645 - DNA, 21 bp, Homo sapiens
gattcctcacatctttaactt

SEQ ID NO: 3188646 - DNA, 19 bp, Homo sapiens
gattcctcttgcctctctc

SEQ ID NO: 3188647 - DNA, 15 bp, Homo sapiens
gattcctgacccagg

SEQ ID NO: 3188648 - DNA, 18 bp, Homo sapiens
gattcctgacccaggccg

SEQ ID NO: 3188649 - DNA, 13 bp, Homo sapiens
gattctaaagatt

SEQ ID NO: 3188650 - DNA, 17 bp, Homo sapiens
gattctaaagattctat

SEQ ID NO: 3188651 - DNA, 19 bp, Homo sapiens
gattctaatttttaagcaa

SEQ ID NO: 3188652 - DNA, 17 bp, Homo sapiens
gattctactcttgtcat

SEQ ID NO: 3188653 - DNA, 18 bp, Homo sapiens
gattctactttaagcact

SEQ ID NO: 3188654 - DNA, 20 bp, Homo sapiens
gattctagccaaactattct

SEQ ID NO: 3188655 - DNA, 22 bp, Homo sapiens
gattctatattattatatatat

SEQ ID NO: 3188656 - DNA, 15 bp, Homo sapiens
gattctattatatat

SEQ ID NO: 3188657 - DNA, 20 bp, Homo sapiens
gattctatttatatgtacat

SEQ ID NO: 3188658 - DNA, 14 bp, Homo sapiens
gattctcctgcctc

SEQ ID NO: 3188659 - DNA, 21 bp, Homo sapiens
gattctcctgcctcagcctcc

SEQ ID NO: 3188660 - DNA, 22 bp, Homo sapiens
gattctctgtgtctaagattct

SEQ ID NO: 3188661 - DNA, 15 bp, Homo sapiens
gattctgacatttat

SEQ ID NO: 3188662 - DNA, 16 bp, Homo sapiens
gattctgcagtaaatc

SEQ ID NO: 3188663 - DNA, 19 bp, Homo sapiens
gattctgcagtaaatcttt

SEQ ID NO: 3188664 - DNA, 20 bp, Homo sapiens
gattctggctttaagccttc

SEQ ID NO: 3188665 - DNA, 23 bp, Homo sapiens
gattctgggaagcttgagcctcc

SEQ ID NO: 3188666 - DNA, 15 bp, Homo sapiens
gattctgggaggaag

SEQ ID NO: 3188667 - DNA, 21 bp, Homo sapiens
gattctgggaggcaagaaaag

SEQ ID NO: 3188668 - DNA, 23 bp, Homo sapiens
gattcttatgtagcaggaaataa

SEQ ID NO: 3188669 - DNA, 12 bp, Homo sapiens
gattcttctgct

SEQ ID NO: 3188670 - DNA, 21 bp, Homo sapiens
gattcttctgcttcagcctcc

SEQ ID NO: 3188671 - DNA, 20 bp, Homo sapiens
gattctttcagttctttgga

SEQ ID NO: 3188672 - DNA, 20 bp, Homo sapiens
gattctttttaaagtgtttc

SEQ ID NO: 3188673 - DNA, 17 bp, Homo sapiens
gattgagaaggagagaa

SEQ ID NO: 3188674 - DNA, 13 bp, Homo sapiens
gattgatcattct

SEQ ID NO: 3188675 - DNA, 17 bp, Homo sapiens
gattgatttgaagaaca

SEQ ID NO: 3188676 - DNA, 16 bp, Homo sapiens
gattgcaacaggctgg

SEQ ID NO: 3188677 - DNA, 20 bp, Homo sapiens
gattgcaacaggctgggctt

SEQ ID NO: 3188678 - DNA, 18 bp, Homo sapiens
gattgcaatatctgaagc

SEQ ID NO: 3188679 - DNA, 21 bp, Homo sapiens
gattgcaatatctgaagccct

SEQ ID NO: 3188680 - DNA, 19 bp, Homo sapiens
gattgcacgtggcctcttg

SEQ ID NO: 3188681 - DNA, 19 bp, Homo sapiens
gattgcagaaaattctgtg

SEQ ID NO: 3188682 - DNA, 13 bp, Homo sapiens
gattgctgggagg

SEQ ID NO: 3188683 - DNA, 16 bp, Homo sapiens
gattgcttctgtagta

SEQ ID NO: 3188684 - DNA, 14 bp, Homo sapiens
gattggaccaggcc

SEQ ID NO: 3188685 - DNA, 23 bp, Homo sapiens
gattggacggcctgatgctccct

SEQ ID NO: 3188686 - DNA, 21 bp, Homo sapiens
gattggattatttaataacat

SEQ ID NO: 3188687 - DNA, 22 bp, Homo sapiens
gattggattatttaataacatt

SEQ ID NO: 3188688 - DNA, 11 bp, Homo sapiens
gattggcctgt

SEQ ID NO: 3188689 - DNA, 23 bp, Homo sapiens
gattggcctgtagagttgctgag

SEQ ID NO: 3188690 - DNA, 18 bp, Homo sapiens
gattggcttgtgtgtttc

SEQ ID NO: 3188691 - DNA, 14 bp, Homo sapiens
gattggtgggctga

SEQ ID NO: 3188692 - DNA, 22 bp, Homo sapiens
gattggtgggctgatttacatg

SEQ ID NO: 3188693 - DNA, 16 bp, Homo sapiens
gattggtgttttatct

SEQ ID NO: 3188694 - DNA, 18 bp, Homo sapiens
gattggttttattttatg

SEQ ID NO: 3188695 - DNA, 13 bp, Homo sapiens
gattgtaaaaaaa

SEQ ID NO: 3188696 - DNA, 14 bp, Homo sapiens
gattgtaaaaataa

SEQ ID NO: 3188697 - DNA, 20 bp, Homo sapiens
gattgtaggtgcaagatgga

SEQ ID NO: 3188698 - DNA, 16 bp, Homo sapiens
gattgtattactttaa

SEQ ID NO: 3188699 - DNA, 12 bp, Homo sapiens
gattgtcttgca

SEQ ID NO: 3188700 - DNA, 16 bp, Homo sapiens
gattgtcttgcaactt

SEQ ID NO: 3188701 - DNA, 16 bp, Homo sapiens
gattgtggaaaaccag

SEQ ID NO: 3188702 - DNA, 18 bp, Homo sapiens
gattgttatgtaaaactc

SEQ ID NO: 3188703 - DNA, 15 bp, Homo sapiens
gattgtttctataca

SEQ ID NO: 3188704 - DNA, 19 bp, Homo sapiens
gatttaaattttcacctgt

SEQ ID NO: 3188705 - DNA, 19 bp, Homo sapiens
gatttaacagtcatttaaa

SEQ ID NO: 3188706 - DNA, 13 bp, Homo sapiens
gatttaataaaat

SEQ ID NO: 3188707 - DNA, 17 bp, Homo sapiens
gatttaataaaataatt

SEQ ID NO: 3188708 - DNA, 15 bp, Homo sapiens
gatttaatccatttt

SEQ ID NO: 3188709 - DNA, 14 bp, Homo sapiens
gatttacatgtatg

SEQ ID NO: 3188710 - DNA, 16 bp, Homo sapiens
gatttacatgtatggt

SEQ ID NO: 3188711 - DNA, 22 bp, Homo sapiens
gatttacccagaatgtcagatt

SEQ ID NO: 3188712 - DNA, 20 bp, Homo sapiens
gatttaccttttctgttgta

SEQ ID NO: 3188713 - DNA, 21 bp, Homo sapiens
gatttagaaaaaagtttacaa

SEQ ID NO: 3188714 - DNA, 15 bp, Homo sapiens
gatttaggtagcctt

SEQ ID NO: 3188715 - DNA, 16 bp, Homo sapiens
gatttagtttcagtag

SEQ ID NO: 3188716 - DNA, 16 bp, Homo sapiens
gatttatataaatgta

SEQ ID NO: 3188717 - DNA, 19 bp, Homo sapiens
gatttatataaatgtaaaa

SEQ ID NO: 3188718 - DNA, 20 bp, Homo sapiens
gatttatattactgtctttt

SEQ ID NO: 3188719 - DNA, 12 bp, Homo sapiens
gatttatctttc

SEQ ID NO: 3188720 - DNA, 12 bp, Homo sapiens
gatttatttcta

SEQ ID NO: 3188721 - DNA, 14 bp, Homo sapiens
gatttcaaaatcag

SEQ ID NO: 3188722 - DNA, 20 bp, Homo sapiens
gatttcaaattgtctggtac

SEQ ID NO: 3188723 - DNA, 21 bp, Homo sapiens
gatttcaacatgagtgtattt

SEQ ID NO: 3188724 - DNA, 19 bp, Homo sapiens
gatttcaagaaaaaataaa

SEQ ID NO: 3188725 - DNA, 15 bp, Homo sapiens
gatttcaagatcctc

SEQ ID NO: 3188726 - DNA, 14 bp, Homo sapiens
gatttcagaagaga

SEQ ID NO: 3188727 - DNA, 15 bp, Homo sapiens
gatttcagtttttca

SEQ ID NO: 3188728 - DNA, 18 bp, Homo sapiens
gatttcagtttttcattt

SEQ ID NO: 3188729 - DNA, 20 bp, Homo sapiens
gatttcagtttttcatttgt

SEQ ID NO: 3188730 - DNA, 21 bp, Homo sapiens
gatttcagtttttcatttgtt

SEQ ID NO: 3188731 - DNA, 23 bp, Homo sapiens
gatttcatattgatctttttatc

SEQ ID NO: 3188732 - DNA, 16 bp, Homo sapiens
gatttcatcttctgga

SEQ ID NO: 3188733 - DNA, 19 bp, Homo sapiens
gatttcatcttctggaata

SEQ ID NO: 3188734 - DNA, 20 bp, Homo sapiens
gatttccaagtaatataatg

SEQ ID NO: 3188735 - DNA, 19 bp, Homo sapiens
gatttccagaaccacactt

SEQ ID NO: 3188736 - DNA, 22 bp, Homo sapiens
gatttccagaaccacacttgaa

SEQ ID NO: 3188737 - DNA, 19 bp, Homo sapiens
tgctctcgcacctttccaa

SEQ ID NO: 3188738 - DNA, 14 bp, Homo sapiens
tgctctctgggctt

SEQ ID NO: 3188739 - DNA, 12 bp, Homo sapiens
tgctctctgtgg

SEQ ID NO: 3188740 - DNA, 17 bp, Homo sapiens
tgctctgaaatctcctt

SEQ ID NO: 3188741 - DNA, 18 bp, Homo sapiens
tgctctgagaagaggagc

SEQ ID NO: 3188742 - DNA, 20 bp, Homo sapiens
tgctctgagaagaggagccc

SEQ ID NO: 3188743 - DNA, 19 bp, Homo sapiens
tgctctgatcatccactgt

SEQ ID NO: 3188744 - DNA, 22 bp, Homo sapiens
tgctctgatcatccactgtgcc

SEQ ID NO: 3188745 - DNA, 20 bp, Homo sapiens
tgctctgccccttgggcatc

SEQ ID NO: 3188746 - DNA, 22 bp, Homo sapiens
tgctctggaataaagttgcaga

SEQ ID NO: 3188747 - DNA, 17 bp, Homo sapiens
tgctctggacaggcatg

SEQ ID NO: 3188748 - DNA, 15 bp, Homo sapiens
tgctctggaggctgc

SEQ ID NO: 3188749 - DNA, 13 bp, Homo sapiens
tgctctggcggct

SEQ ID NO: 3188750 - DNA, 21 bp, Homo sapiens
tgctctggcggcttcctgtcc

SEQ ID NO: 3188751 - DNA, 18 bp, Homo sapiens
tgctctggttgtttctgt

SEQ ID NO: 3188752 - DNA, 19 bp, Homo sapiens
tgctctggttgtttctgtt

SEQ ID NO: 3188753 - DNA, 21 bp, Homo sapiens
tgctctggttgtttctgttcc

SEQ ID NO: 3188754 - DNA, 17 bp, Homo sapiens
tgctctgtgttcccaga

SEQ ID NO: 3188755 - DNA, 22 bp, Homo sapiens
tgctctgtgttcccagaggcag

SEQ ID NO: 3188756 - DNA, 17 bp, Homo sapiens
tgctctgttacccaggc

SEQ ID NO: 3188757 - DNA, 20 bp, Homo sapiens
tgctcttaagaaactatgaa

SEQ ID NO: 3188758 - DNA, 23 bp, Homo sapiens
tgctcttaagaaactatgaagat

SEQ ID NO: 3188759 - DNA, 15 bp, Homo sapiens
tgctcttaagcctaa

SEQ ID NO: 3188760 - DNA, 19 bp, Homo sapiens
tgctcttactacactgagg

SEQ ID NO: 3188761 - DNA, 13 bp, Homo sapiens
tgctcttctgtgg

SEQ ID NO: 3188762 - DNA, 14 bp, Homo sapiens
tgctcttgtcccac

SEQ ID NO: 3188763 - DNA, 16 bp, Homo sapiens
tgctcttgtcccacgt

SEQ ID NO: 3188764 - DNA, 15 bp, Homo sapiens
tgctcttgtttttat

SEQ ID NO: 3188765 - DNA, 12 bp, Homo sapiens
tgctctttccct

SEQ ID NO: 3188766 - DNA, 15 bp, Homo sapiens
tgctctttccctttt

SEQ ID NO: 3188767 - DNA, 23 bp, Homo sapiens
tgctctttcccttttctgtttag

SEQ ID NO: 3188768 - DNA, 16 bp, Homo sapiens
tgctctttctactctg

SEQ ID NO: 3188769 - DNA, 14 bp, Homo sapiens
tgctctttctctgc

SEQ ID NO: 3188770 - DNA, 21 bp, Homo sapiens
tgctctttctctgccagtgac

SEQ ID NO: 3188771 - DNA, 23 bp, Homo sapiens
tgctcttttctcctcactgtatc

SEQ ID NO: 3188772 - DNA, 18 bp, Homo sapiens
tgctcttttttactcatt

SEQ ID NO: 3188773 - DNA, 22 bp, Homo sapiens
tgctcttttttactcattgaaa

SEQ ID NO: 3188774 - DNA, 22 bp, Homo sapiens
tgctgaaaaccatctggcctgg

SEQ ID NO: 3188775 - DNA, 23 bp, Homo sapiens
tgctgaaaaccatctggcctggc

SEQ ID NO: 3188776 - DNA, 18 bp, Homo sapiens
tgctgaaacagacatgaa

SEQ ID NO: 3188777 - DNA, 20 bp, Homo sapiens
tgctgaacaaaaaataaaaa

SEQ ID NO: 3188778 - DNA, 16 bp, Homo sapiens
tgctgaacaccttgtg

SEQ ID NO: 3188779 - DNA, 13 bp, Homo sapiens
tgctgaagggcat

SEQ ID NO: 3188780 - DNA, 23 bp, Homo sapiens
tgctgaatgcctcgctcccttca

SEQ ID NO: 3188781 - DNA, 18 bp, Homo sapiens
tgctgaatggttttcaaa

SEQ ID NO: 3188782 - DNA, 17 bp, Homo sapiens
tgctgaatgtaaaagaa

SEQ ID NO: 3188783 - DNA, 15 bp, Homo sapiens
tgctgacagacacag

SEQ ID NO: 3188784 - DNA, 13 bp, Homo sapiens
tgctgacagctct

SEQ ID NO: 3188785 - DNA, 22 bp, Homo sapiens
tgctgactgtactcctcccagg

SEQ ID NO: 3188786 - DNA, 13 bp, Homo sapiens
tgctgactgtcaa

SEQ ID NO: 3188787 - DNA, 15 bp, Homo sapiens
tgctgagaaaacatg

SEQ ID NO: 3188788 - DNA, 14 bp, Homo sapiens
tgctgagagaaata

SEQ ID NO: 3188789 - DNA, 13 bp, Homo sapiens
tgctgagccactc

SEQ ID NO: 3188790 - DNA, 12 bp, Homo sapiens
tgctgagcctct

SEQ ID NO: 3188791 - DNA, 15 bp, Homo sapiens
tgctgagctgggccc

SEQ ID NO: 3188792 - DNA, 19 bp, Homo sapiens
tgctgagctgggcccagcc

SEQ ID NO: 3188793 - DNA, 24 bp, Homo sapiens
tgctgagctgggcccagcccctcc

SEQ ID NO: 3188794 - DNA, 17 bp, Homo sapiens
tgctgagcttagccttg

SEQ ID NO: 3188795 - DNA, 20 bp, Homo sapiens
tgctgagcttgtcttttctg

SEQ ID NO: 3188796 - DNA, 23 bp, Homo sapiens
tgctgagggtgtttcttcctgca

SEQ ID NO: 3188797 - DNA, 16 bp, Homo sapiens
tgctgagtctcccaag

SEQ ID NO: 3188798 - DNA, 17 bp, Homo sapiens
tgctgagtctcccaagg

SEQ ID NO: 3188799 - DNA, 17 bp, Homo sapiens
tgctgagttgttctaac

SEQ ID NO: 3188800 - DNA, 15 bp, Homo sapiens
tgctgatggctgcta

SEQ ID NO: 3188801 - DNA, 20 bp, Homo sapiens
tgctgatggctgctagattt

SEQ ID NO: 3188802 - DNA, 13 bp, Homo sapiens
tgctgatggcttg

SEQ ID NO: 3188803 - DNA, 24 bp, Homo sapiens
tgctgatggcttgacatgtgcaat

SEQ ID NO: 3188804 - DNA, 18 bp, Homo sapiens
tgctgatttggtgaccaa

SEQ ID NO: 3188805 - DNA, 13 bp, Homo sapiens
tgctgcaaacctg

SEQ ID NO: 3188806 - DNA, 20 bp, Homo sapiens
tgctgcaaacctgacccctg

SEQ ID NO: 3188807 - DNA, 13 bp, Homo sapiens
tgctgcaccagag

SEQ ID NO: 3188808 - DNA, 16 bp, Homo sapiens
tgctgcaccagagtga

SEQ ID NO: 3188809 - DNA, 12 bp, Homo sapiens
tgctgcagcaga

SEQ ID NO: 3188810 - DNA, 16 bp, Homo sapiens
tgctgcaggtggcaga

SEQ ID NO: 3188811 - DNA, 20 bp, Homo sapiens
tgctgcatagctctatttta

SEQ ID NO: 3188812 - DNA, 14 bp, Homo sapiens
taactaaattttaa

SEQ ID NO: 3188813 - DNA, 15 bp, Homo sapiens
taactaactggcagg

SEQ ID NO: 3188814 - DNA, 14 bp, Homo sapiens
taactaatgttatt

SEQ ID NO: 3188815 - DNA, 16 bp, Homo sapiens
taactacaaagctttg

SEQ ID NO: 3188816 - DNA, 12 bp, Homo sapiens
taactacattta

SEQ ID NO: 3188817 - DNA, 14 bp, Homo sapiens
taactacatttatg

SEQ ID NO: 3188818 - DNA, 17 bp, Homo sapiens
taactactttataacta

SEQ ID NO: 3188819 - DNA, 21 bp, Homo sapiens
taactagaattagtatgtctg

SEQ ID NO: 3188820 - DNA, 22 bp, Homo sapiens
taactagaattagtatgtctgt

SEQ ID NO: 3188821 - DNA, 18 bp, Homo sapiens
taactagaatttattcaa

SEQ ID NO: 3188822 - DNA, 20 bp, Homo sapiens
taactagacaccaaagttct

SEQ ID NO: 3188823 - DNA, 19 bp, Homo sapiens
taactatatgtacagctct

SEQ ID NO: 3188824 - DNA, 15 bp, Homo sapiens
taactcaaatacaca

SEQ ID NO: 3188825 - DNA, 18 bp, Homo sapiens
taactcaaatacacattt

SEQ ID NO: 3188826 - DNA, 21 bp, Homo sapiens
taactcaaatacacatttgct

SEQ ID NO: 3188827 - DNA, 15 bp, Homo sapiens
taactcaccgtgctg

SEQ ID NO: 3188828 - DNA, 14 bp, Homo sapiens
taactcactggaat

SEQ ID NO: 3188829 - DNA, 19 bp, Homo sapiens
taactcatacctttaaagg

SEQ ID NO: 3188830 - DNA, 14 bp, Homo sapiens
taactcatcataaa

SEQ ID NO: 3188831 - DNA, 20 bp, Homo sapiens
taactcatttgttaaaatta

SEQ ID NO: 3188832 - DNA, 23 bp, Homo sapiens
taactcccctgtttcaatcactg

SEQ ID NO: 3188833 - DNA, 14 bp, Homo sapiens
taactccttcttgt

SEQ ID NO: 3188834 - DNA, 19 bp, Homo sapiens
taactctgcaaaggcctgg

SEQ ID NO: 3188835 - DNA, 21 bp, Homo sapiens
taactctgcactactcctctg

SEQ ID NO: 3188836 - DNA, 16 bp, Homo sapiens
taactcttgtctattt

SEQ ID NO: 3188837 - DNA, 18 bp, Homo sapiens
taactcttttctattttg

SEQ ID NO: 3188838 - DNA, 14 bp, Homo sapiens
taactgaaaatgtg

SEQ ID NO: 3188839 - DNA, 14 bp, Homo sapiens
taactgaaccaaat

SEQ ID NO: 3188840 - DNA, 18 bp, Homo sapiens
taactgaaccaaattgca

SEQ ID NO: 3188841 - DNA, 19 bp, Homo sapiens
taactgatttctatggctt

SEQ ID NO: 3188842 - DNA, 21 bp, Homo sapiens
taactgatttctatggctttc

SEQ ID NO: 3188843 - DNA, 12 bp, Homo sapiens
taactgcaattt

SEQ ID NO: 3188844 - DNA, 16 bp, Homo sapiens
taactgcatttttaga

SEQ ID NO: 3188845 - DNA, 17 bp, Homo sapiens
taactgctgagccactc

SEQ ID NO: 3188846 - DNA, 14 bp, Homo sapiens
taactgctttctgt

SEQ ID NO: 3188847 - DNA, 17 bp, Homo sapiens
taactgctttctgttcc

SEQ ID NO: 3188848 - DNA, 21 bp, Homo sapiens
taactgctttctgttccaaat

SEQ ID NO: 3188849 - DNA, 15 bp, Homo sapiens
taactgtaaagatgt

SEQ ID NO: 3188850 - DNA, 20 bp, Homo sapiens
taactgtagctcaagtttaa

SEQ ID NO: 3188851 - DNA, 17 bp, Homo sapiens
taactgtgaagtttaca

SEQ ID NO: 3188852 - DNA, 15 bp, Homo sapiens
taactgtgctgaatg

SEQ ID NO: 3188853 - DNA, 11 bp, Homo sapiens
taactgtgtat

SEQ ID NO: 3188854 - DNA, 14 bp, Homo sapiens
taactgtgtatgta

SEQ ID NO: 3188855 - DNA, 15 bp, Homo sapiens
taactgtgtatgtac

SEQ ID NO: 3188856 - DNA, 18 bp, Homo sapiens
taactgtgtatgtacata

SEQ ID NO: 3188857 - DNA, 19 bp, Homo sapiens
taactgtgtatgtacatat

SEQ ID NO: 3188858 - DNA, 20 bp, Homo sapiens
taactgtgtatgtacatata

SEQ ID NO: 3188859 - DNA, 18 bp, Homo sapiens
taacttaaaaaaatgaca

SEQ ID NO: 3188860 - DNA, 21 bp, Homo sapiens
taacttaaaataattaaataa

SEQ ID NO: 3188861 - DNA, 15 bp, Homo sapiens
taacttactgtatat

SEQ ID NO: 3188862 - DNA, 21 bp, Homo sapiens
taacttagactctagtattta

SEQ ID NO: 3188863 - DNA, 13 bp, Homo sapiens
taacttagtattt

SEQ ID NO: 3188864 - DNA, 13 bp, Homo sapiens
taacttattagca

SEQ ID NO: 3188865 - DNA, 16 bp, Homo sapiens
taacttatttagagat

SEQ ID NO: 3188866 - DNA, 21 bp, Homo sapiens
taacttatttatgttaaaaga

SEQ ID NO: 3188867 - DNA, 23 bp, Homo sapiens
taacttatttatgttaaaagatt

SEQ ID NO: 3188868 - DNA, 18 bp, Homo sapiens
taacttcacattaaaaaa

SEQ ID NO: 3188869 - DNA, 22 bp, Homo sapiens
taacttcacattaaaaaatgaa

SEQ ID NO: 3188870 - DNA, 17 bp, Homo sapiens
taacttccaatttacat

SEQ ID NO: 3188871 - DNA, 17 bp, Homo sapiens
taacttcttatggaatt

SEQ ID NO: 3188872 - DNA, 18 bp, Homo sapiens
taacttcttatggaattg

SEQ ID NO: 3188873 - DNA, 22 bp, Homo sapiens
tgcctggagagggtctcgctgt

SEQ ID NO: 3188874 - DNA, 19 bp, Homo sapiens
tgcctggagtcccgtccct

SEQ ID NO: 3188875 - DNA, 23 bp, Homo sapiens
tgcctggagtgtatgactgcaca

SEQ ID NO: 3188876 - DNA, 22 bp, Homo sapiens
tgcctggatgagaaacagctca

SEQ ID NO: 3188877 - DNA, 21 bp, Homo sapiens
tgcctggatgaggcacttctg

SEQ ID NO: 3188878 - DNA, 12 bp, Homo sapiens
tgcctggccagg

SEQ ID NO: 3188879 - DNA, 14 bp, Homo sapiens
tgcctggccaggca

SEQ ID NO: 3188880 - DNA, 16 bp, Homo sapiens
tgcctggcctggcaca

SEQ ID NO: 3188881 - DNA, 17 bp, Homo sapiens
tgcctggcctggcacac

SEQ ID NO: 3188882 - DNA, 18 bp, Homo sapiens
tgcctggccttcctgtct

SEQ ID NO: 3188883 - DNA, 11 bp, Homo sapiens
tgcctggctgt

SEQ ID NO: 3188884 - DNA, 12 bp, Homo sapiens
tgcctggctgtg

SEQ ID NO: 3188885 - DNA, 18 bp, Homo sapiens
tgcctggctgtggaggcc

SEQ ID NO: 3188886 - DNA, 19 bp, Homo sapiens
tgcctggctgtggaggcct

SEQ ID NO: 3188887 - DNA, 20 bp, Homo sapiens
tgcctggctgtggaggcctg

SEQ ID NO: 3188888 - DNA, 15 bp, Homo sapiens
tgcctgggcctgtgc

SEQ ID NO: 3188889 - DNA, 12 bp, Homo sapiens
tgcctggggtct

SEQ ID NO: 3188890 - DNA, 20 bp, Homo sapiens
tgcctggtgcttccaaatat

SEQ ID NO: 3188891 - DNA, 14 bp, Homo sapiens
tgcctggtggcagc

SEQ ID NO: 3188892 - DNA, 19 bp, Homo sapiens
tgcctggtggcagctgcgg

SEQ ID NO: 3188893 - DNA, 21 bp, Homo sapiens
tgcctggtggtcagatgcagg

SEQ ID NO: 3188894 - DNA, 15 bp, Homo sapiens
tgcctgtaaacatag

SEQ ID NO: 3188895 - DNA, 17 bp, Homo sapiens
tgcctgtagtcccaggc

SEQ ID NO: 3188896 - DNA, 22 bp, Homo sapiens
tgcctgtagttaggaaataaaa

SEQ ID NO: 3188897 - DNA, 14 bp, Homo sapiens
tgcctgtattttcg

SEQ ID NO: 3188898 - DNA, 17 bp, Homo sapiens
tgcctgtgactgtaaag

SEQ ID NO: 3188899 - DNA, 16 bp, Homo sapiens
tgcctgtgccacccac

SEQ ID NO: 3188900 - DNA, 13 bp, Homo sapiens
tgcctgtgcctgc

SEQ ID NO: 3188901 - DNA, 15 bp, Homo sapiens
tgcctgtgcctgcca

SEQ ID NO: 3188902 - DNA, 18 bp, Homo sapiens
tgcctgtggcagaaaaga

SEQ ID NO: 3188903 - DNA, 11 bp, Homo sapiens
tgcctgtggcg

SEQ ID NO: 3188904 - DNA, 22 bp, Homo sapiens
tgcctgtggcgccgtctccagg

SEQ ID NO: 3188905 - DNA, 19 bp, Homo sapiens
tgcctgttataactctgca

SEQ ID NO: 3188906 - DNA, 20 bp, Homo sapiens
tgcctgttataactctgcac

SEQ ID NO: 3188907 - DNA, 17 bp, Homo sapiens
tgcctgttcagctccag

SEQ ID NO: 3188908 - DNA, 14 bp, Homo sapiens
tgcctgttcccatt

SEQ ID NO: 3188909 - DNA, 15 bp, Homo sapiens
tgccttaaaaccaaa

SEQ ID NO: 3188910 - DNA, 16 bp, Homo sapiens
tgccttaaaaccaaag

SEQ ID NO: 3188911 - DNA, 18 bp, Homo sapiens
tgccttaaaaccaaagag

SEQ ID NO: 3188912 - DNA, 19 bp, Homo sapiens
tgccttactcttcttgaaa

SEQ ID NO: 3188913 - DNA, 22 bp, Homo sapiens
tgccttactggtttccccaggg

SEQ ID NO: 3188914 - DNA, 14 bp, Homo sapiens
tgccttagaacctt

SEQ ID NO: 3188915 - DNA, 17 bp, Homo sapiens
tgccttagaacctttct

SEQ ID NO: 3188916 - DNA, 14 bp, Homo sapiens
tgccttatcttgca

SEQ ID NO: 3188917 - DNA, 17 bp, Homo sapiens
tgccttcagctctacag

SEQ ID NO: 3188918 - DNA, 13 bp, Homo sapiens
tgccttccataat

SEQ ID NO: 3188919 - DNA, 23 bp, Homo sapiens
cagcttcaggcaccagcatccac

SEQ ID NO: 3188920 - DNA, 14 bp, Homo sapiens
cagcttcaggttat

SEQ ID NO: 3188921 - DNA, 21 bp, Homo sapiens
cagcttcatgcctttgtaagt

SEQ ID NO: 3188922 - DNA, 18 bp, Homo sapiens
cagcttcattatctgagt

SEQ ID NO: 3188923 - DNA, 16 bp, Homo sapiens
ggacgctctctggcct

SEQ ID NO: 3188924 - DNA, 21 bp, Homo sapiens
ggacggcctgatgctccctcc

SEQ ID NO: 3188925 - DNA, 13 bp, Homo sapiens
ggacggggaggct

SEQ ID NO: 3188926 - DNA, 23 bp, Homo sapiens
ggacggttttgctttatggctag

SEQ ID NO: 3188927 - DNA, 22 bp, Homo sapiens
ggacgtcatcggaggctgggcc

SEQ ID NO: 3188928 - DNA, 16 bp, Homo sapiens
ggacgtccctgcccat

SEQ ID NO: 3188929 - DNA, 23 bp, Homo sapiens
ggacgtcctatctcccccaaccc

SEQ ID NO: 3188930 - DNA, 12 bp, Homo sapiens
ggacgttggcct

SEQ ID NO: 3188931 - DNA, 12 bp, Homo sapiens
ggacgtttctca

SEQ ID NO: 3188932 - DNA, 12 bp, Homo sapiens
ggactaagcaat

SEQ ID NO: 3188933 - DNA, 18 bp, Homo sapiens
gttgtaacttatgtagat

SEQ ID NO: 3188934 - DNA, 21 bp, Homo sapiens
gttgtaaggatataaaaagta

SEQ ID NO: 3188935 - DNA, 21 bp, Homo sapiens
gttgtacaatcaaaacacact

SEQ ID NO: 3188936 - DNA, 19 bp, Homo sapiens
gttgtacaattaagttaca

SEQ ID NO: 3188937 - DNA, 23 bp, Homo sapiens
gttgtacatttatgatttaataa

SEQ ID NO: 3188938 - DNA, 15 bp, Homo sapiens
gttgtagacaaagta

SEQ ID NO: 3188939 - DNA, 15 bp, Homo sapiens
gttgtataaaaacat

SEQ ID NO: 3188940 - DNA, 13 bp, Homo sapiens
gttgtattaacaa

SEQ ID NO: 3188941 - DNA, 21 bp, Homo sapiens
gttgtattcttctgtatttct

SEQ ID NO: 3188942 - DNA, 17 bp, Homo sapiens
gttgtcaagtctctgct

SEQ ID NO: 3188943 - DNA, 15 bp, Homo sapiens
gttgtcaatattaaa

SEQ ID NO: 3188944 - DNA, 20 bp, Homo sapiens
gttgtcattgtaaacaaact

SEQ ID NO: 3188945 - DNA, 12 bp, Homo sapiens
gttgtccaggaa

SEQ ID NO: 3188946 - DNA, 19 bp, Homo sapiens
gttgtctagtcattgtcat

SEQ ID NO: 3188947 - DNA, 14 bp, Homo sapiens
gttgtgaatgttgt

SEQ ID NO: 3188948 - DNA, 16 bp, Homo sapiens
gttgtgatcttgcatt

SEQ ID NO: 3188949 - DNA, 14 bp, Homo sapiens
gttgtggccaatgt

SEQ ID NO: 3188950 - DNA, 12 bp, Homo sapiens
gttgtggctctt

SEQ ID NO: 3188951 - DNA, 15 bp, Homo sapiens
gttgtgggtgggaga

SEQ ID NO: 3188952 - DNA, 22 bp, Homo sapiens
gttgtgtctgtgccctccaaag

SEQ ID NO: 3188953 - DNA, 12 bp, Homo sapiens
gttgtgttgtca

SEQ ID NO: 3188954 - DNA, 23 bp, Homo sapiens
gttgtgttgttttttgttcaatg

SEQ ID NO: 3188955 - DNA, 16 bp, Homo sapiens
gttgttaatgaaaatg

SEQ ID NO: 3188956 - DNA, 19 bp, Homo sapiens
gttgttaatgaaaatgtca

SEQ ID NO: 3188957 - DNA, 15 bp, Homo sapiens
gttgttcaactattt

SEQ ID NO: 3188958 - DNA, 16 bp, Homo sapiens
gttgttcaactatttt

SEQ ID NO: 3188959 - DNA, 19 bp, Homo sapiens
gttgttccattttatgcag

SEQ ID NO: 3188960 - DNA, 15 bp, Homo sapiens
gttgtttcctcgctg

SEQ ID NO: 3188961 - DNA, 17 bp, Homo sapiens
ggtagaggctccccagg

SEQ ID NO: 3188962 - DNA, 23 bp, Homo sapiens
ggtagatccagatccagactgta

SEQ ID NO: 3188963 - DNA, 16 bp, Homo sapiens
ggtagatcgcttgagc

SEQ ID NO: 3188964 - DNA, 20 bp, Homo sapiens
ggtagatcgcttgagcccag

SEQ ID NO: 3188965 - DNA, 22 bp, Homo sapiens
ggtagatcgcttgagcccagga

SEQ ID NO: 3188966 - DNA, 20 bp, Homo sapiens
ggtagatgcatgacttgtgt

SEQ ID NO: 3188967 - DNA, 23 bp, Homo sapiens
ggtagatgggtgggggctcctgg

SEQ ID NO: 3188968 - DNA, 13 bp, Homo sapiens
ggtagcagctgga

SEQ ID NO: 3188969 - DNA, 14 bp, Homo sapiens
ggtagcagctggac

SEQ ID NO: 3188970 - DNA, 22 bp, Homo sapiens
ggtagcatgggtccaagagaca

SEQ ID NO: 3188971 - DNA, 23 bp, Homo sapiens
ggtagccatgatttgtcccagcc

SEQ ID NO: 3188972 - DNA, 18 bp, Homo sapiens
ggtagccttgtgttctga

SEQ ID NO: 3188973 - DNA, 17 bp, Homo sapiens
ggtagctcaggtgggcg

SEQ ID NO: 3188974 - DNA, 18 bp, Homo sapiens
ggtagctgggaaagcata

SEQ ID NO: 3188975 - DNA, 14 bp, Homo sapiens
ggtaggcccttgtc

SEQ ID NO: 3188976 - DNA, 20 bp, Homo sapiens
ggtaggccttttaacatttt

SEQ ID NO: 3188977 - DNA, 16 bp, Homo sapiens
ggtagggaaataatag

SEQ ID NO: 3188978 - DNA, 18 bp, Homo sapiens
ggtaggttcagccaaggt

SEQ ID NO: 3188979 - DNA, 19 bp, Homo sapiens
ggtagttagtagcatgttg

SEQ ID NO: 3188980 - DNA, 22 bp, Homo sapiens
ggtataggtctcatctcttcag

SEQ ID NO: 3188981 - DNA, 23 bp, Homo sapiens
ggtatatctgggctggccagttg

SEQ ID NO: 3188982 - DNA, 19 bp, Homo sapiens
ggtatcattcaactctcca

SEQ ID NO: 3188983 - DNA, 19 bp, Homo sapiens
ggtatctcagaaagtgcct

SEQ ID NO: 3188984 - DNA, 14 bp, Homo sapiens
ggtatgcaatcaaa

SEQ ID NO: 3188985 - DNA, 13 bp, Homo sapiens
ggtatgctggcca

SEQ ID NO: 3188986 - DNA, 14 bp, Homo sapiens
ggtatgctggccag

SEQ ID NO: 3188987 - DNA, 18 bp, Homo sapiens
ggtatgctggccagcacc

SEQ ID NO: 3188988 - DNA, 18 bp, Homo sapiens
ggtatgtagccagctgtg

SEQ ID NO: 3188989 - DNA, 19 bp, Homo sapiens
ggtattaaaactaaatttc

SEQ ID NO: 3188990 - DNA, 16 bp, Homo sapiens
ggtattaataaaaaga

SEQ ID NO: 3188991 - DNA, 21 bp, Homo sapiens
ggtattttattttggcttcat

SEQ ID NO: 3188992 - DNA, 16 bp, Homo sapiens
ggtattttttcctttt

SEQ ID NO: 3188993 - DNA, 18 bp, Homo sapiens
ggtcaacagctatgctgg

SEQ ID NO: 3188994 - DNA, 19 bp, Homo sapiens
ggtcaacatggtgaaaccc

SEQ ID NO: 3188995 - DNA, 14 bp, Homo sapiens
ggtcaagaaacagc

SEQ ID NO: 3188996 - DNA, 21 bp, Homo sapiens
ggtcaagaaacagccagcaag

SEQ ID NO: 3188997 - DNA, 23 bp, Homo sapiens
ggtcaaggcagtagaactccagg

SEQ ID NO: 3188998 - DNA, 21 bp, Homo sapiens
ggtcaataaacttagaggaaa

SEQ ID NO: 3188999 - DNA, 14 bp, Homo sapiens
ggtcacacactgat

SEQ ID NO: 3189000 - DNA, 16 bp, Homo sapiens
ggtcacaggactctgc

SEQ ID NO: 3189001 - DNA, 16 bp, Homo sapiens
ggtcacaggcccagaa

SEQ ID NO: 3189002 - DNA, 13 bp, Homo sapiens
ggtcactgctgtc

SEQ ID NO: 3189003 - DNA, 15 bp, Homo sapiens
ggtcactggaaaggg

SEQ ID NO: 3189004 - DNA, 18 bp, Homo sapiens
ggtcactggctctccaag

SEQ ID NO: 3189005 - DNA, 16 bp, Homo sapiens
ggtcactgtgcactgc

SEQ ID NO: 3189006 - DNA, 18 bp, Homo sapiens
ggtcactgtgcactgccc

SEQ ID NO: 3189007 - DNA, 21 bp, Homo sapiens
ggtcactgtgcactgccctgt

SEQ ID NO: 3189008 - DNA, 14 bp, Homo sapiens
ggtcagagcctgca

SEQ ID NO: 3189009 - DNA, 15 bp, Homo sapiens
ggtcagagcctgcag

SEQ ID NO: 3189010 - DNA, 16 bp, Homo sapiens
ggtcagagcctgcagt

SEQ ID NO: 3189011 - DNA, 14 bp, Homo sapiens
ggtcagagtgccac

SEQ ID NO: 3189012 - DNA, 11 bp, Homo sapiens
ggtcagatgca

SEQ ID NO: 3189013 - DNA, 15 bp, Homo sapiens
ggtcagccattttta

SEQ ID NO: 3189014 - DNA, 18 bp, Homo sapiens
gtgtggactcaagtcctt

SEQ ID NO: 3189015 - DNA, 11 bp, Homo sapiens
gtgtggcctca

SEQ ID NO: 3189016 - DNA, 12 bp, Homo sapiens
gtgtggcctcag

SEQ ID NO: 3189017 - DNA, 21 bp, Homo sapiens
gtgtggcctcagccctcagaa

SEQ ID NO: 3189018 - DNA, 15 bp, Homo sapiens
gtgtgggactgtaca

SEQ ID NO: 3189019 - DNA, 18 bp, Homo sapiens
gtgtgggtttggttagag

SEQ ID NO: 3189020 - DNA, 18 bp, Homo sapiens
gtgtggtgcagtgtgaaa

SEQ ID NO: 3189021 - DNA, 19 bp, Homo sapiens
gtgtggtgcagtgtgaaaa

SEQ ID NO: 3189022 - DNA, 19 bp, Homo sapiens
gtgtggtgtcgtctgtgaa

SEQ ID NO: 3189023 - DNA, 15 bp, Homo sapiens
gtgtggtgtgtttgc

SEQ ID NO: 3189024 - DNA, 19 bp, Homo sapiens
gtgtgtaaatatgtacatt

SEQ ID NO: 3189025 - DNA, 21 bp, Homo sapiens
gtgtgtaacactgtgtacacc

SEQ ID NO: 3189026 - DNA, 19 bp, Homo sapiens
gtgtgtagacaaatatttg

SEQ ID NO: 3189027 - DNA, 16 bp, Homo sapiens
gtgtgtagagttaaga

SEQ ID NO: 3189028 - DNA, 22 bp, Homo sapiens
gtgtgtataagtgcacacagaa

SEQ ID NO: 3189029 - DNA, 23 bp, Homo sapiens
gtgtgtatccgactctaagctgt

SEQ ID NO: 3189030 - DNA, 11 bp, Homo sapiens
gtgtgtatgag

SEQ ID NO: 3189031 - DNA, 21 bp, Homo sapiens
gtgtgtatttgtattaataaa

SEQ ID NO: 3189032 - DNA, 23 bp, Homo sapiens
gtgtgtatttgtattaataaagc

SEQ ID NO: 3189033 - DNA, 15 bp, Homo sapiens
gtgtgtccctggaca

SEQ ID NO: 3189034 - DNA, 16 bp, Homo sapiens
gtgtgtccctggacac

SEQ ID NO: 3189035 - DNA, 13 bp, Homo sapiens
gtgtgtctgtcct

SEQ ID NO: 3189036 - DNA, 22 bp, Homo sapiens
gtgtgtctgttcacttttcctc

SEQ ID NO: 3189037 - DNA, 17 bp, Homo sapiens
gtgtgtgacaattctgt

SEQ ID NO: 3189038 - DNA, 11 bp, Homo sapiens
gtgtgtgccct

SEQ ID NO: 3189039 - DNA, 21 bp, Homo sapiens
gtgtgtgcgcctacaggagtg

SEQ ID NO: 3189040 - DNA, 9 bp, Homo sapiens
gtgtgtgtg

SEQ ID NO: 3189041 - DNA, 12 bp, Homo sapiens
gtgtgtgtgtgt

SEQ ID NO: 3189042 - DNA, 15 bp, Homo sapiens
gtgtgtgtgtgtgtg

SEQ ID NO: 3189043 - DNA, 18 bp, Homo sapiens
gtgtgttgtcttgaaaga

SEQ ID NO: 3189044 - DNA, 16 bp, Homo sapiens
gtgtgtttgtgtgtgt

SEQ ID NO: 3189045 - DNA, 19 bp, Homo sapiens
gtgtgtttttgggatgtct

SEQ ID NO: 3189046 - DNA, 21 bp, Homo sapiens
gtgttacacagcccaagagga

SEQ ID NO: 3189047 - DNA, 16 bp, Homo sapiens
gtgttacttatggaag

SEQ ID NO: 3189048 - DNA, 13 bp, Homo sapiens
gtgttagccagga

SEQ ID NO: 3189049 - DNA, 20 bp, Homo sapiens
gtgttataatgggtaatata

SEQ ID NO: 3189050 - DNA, 16 bp, Homo sapiens
gtgttcactgaagacg

SEQ ID NO: 3189051 - DNA, 17 bp, Homo sapiens
gtgttcctcagtagctt

SEQ ID NO: 3189052 - DNA, 12 bp, Homo sapiens
gtgttcctcctg

SEQ ID NO: 3189053 - DNA, 12 bp, Homo sapiens
gtgttcctggaa

SEQ ID NO: 3189054 - DNA, 21 bp, Homo sapiens
gtgttcctttttaaatgtgaa

SEQ ID NO: 3189055 - DNA, 23 bp, Homo sapiens
gtgttctatccaaacatgtattt

SEQ ID NO: 3189056 - DNA, 11 bp, Homo sapiens
gtgttctcctt

SEQ ID NO: 3189057 - DNA, 17 bp, Homo sapiens
gtgttctgtttgttaaa

SEQ ID NO: 3189058 - DNA, 23 bp, Homo sapiens
gtgttctgtttgttattgttttg

SEQ ID NO: 3189059 - DNA, 16 bp, Homo sapiens
gtgttcttcaagccag

SEQ ID NO: 3189060 - DNA, 11 bp, Homo sapiens
gtgttgacatt

SEQ ID NO: 3189061 - DNA, 12 bp, Homo sapiens
gtgttgatctta

SEQ ID NO: 3189062 - DNA, 13 bp, Homo sapiens
gtgttgattgcca

SEQ ID NO: 3189063 - DNA, 13 bp, Homo sapiens
gtgttgctgttta

SEQ ID NO: 3189064 - DNA, 14 bp, Homo sapiens
gtgttgctgtttag

SEQ ID NO: 3189065 - DNA, 15 bp, Homo sapiens
gtgttggtctttcta

SEQ ID NO: 3189066 - DNA, 18 bp, Homo sapiens
gtgttggtctttctaatg

SEQ ID NO: 3189067 - DNA, 20 bp, Homo sapiens
gtgttggtctttctaatgta

SEQ ID NO: 3189068 - DNA, 21 bp, Homo sapiens
gtgttgtcattgtaaacaaac

SEQ ID NO: 3189069 - DNA, 15 bp, Homo sapiens
gtgttgtctcttgag

SEQ ID NO: 3189070 - DNA, 18 bp, Homo sapiens
gtgttgtcttgaaagatt

SEQ ID NO: 3189071 - DNA, 20 bp, Homo sapiens
gtgttgtgatagctaacatt

SEQ ID NO: 3189072 - DNA, 14 bp, Homo sapiens
gtgttgtgtctgtg

SEQ ID NO: 3189073 - DNA, 12 bp, Homo sapiens
gtgtttaaaaaa

SEQ ID NO: 3189074 - DNA, 14 bp, Homo sapiens
gtgtttacagacag

SEQ ID NO: 3189075 - DNA, 18 bp, Homo sapiens
gtgtttccacagcctgca

SEQ ID NO: 3189076 - DNA, 21 bp, Homo sapiens
gtgtttgactttcaaaatata

SEQ ID NO: 3189077 - DNA, 20 bp, Homo sapiens
gtgtttgcagcctgctctag

SEQ ID NO: 3189078 - DNA, 20 bp, Homo sapiens
gtgtttgctgccttgctcct

SEQ ID NO: 3189079 - DNA, 21 bp, Homo sapiens
gtgtttgggtcacccctccag

SEQ ID NO: 3189080 - DNA, 14 bp, Homo sapiens
gtgtttgtctgtgt

SEQ ID NO: 3189081 - DNA, 16 bp, Homo sapiens
gtgttttaaagagaat

SEQ ID NO: 3189082 - DNA, 13 bp, Homo sapiens
gtgttttaattta

SEQ ID NO: 3189083 - DNA, 15 bp, Homo sapiens
gtgttttcataataa

SEQ ID NO: 3189084 - DNA, 20 bp, Homo sapiens
gtgttttgtggggctccccg

SEQ ID NO: 3189085 - DNA, 18 bp, Homo sapiens
gtgttttgttttttaagg

SEQ ID NO: 3189086 - DNA, 15 bp, Homo sapiens
gtgtttttcatttct

SEQ ID NO: 3189087 - DNA, 20 bp, Homo sapiens
gtgtttttgaaacccacagt

SEQ ID NO: 3189088 - DNA, 18 bp, Homo sapiens
gtgtttttgggatgtctt

SEQ ID NO: 3189089 - DNA, 15 bp, Homo sapiens
gtgttttttaagatg

SEQ ID NO: 3189090 - DNA, 13 bp, Homo sapiens
gttaaaaaaaaaa

SEQ ID NO: 3189091 - DNA, 14 bp, Homo sapiens
gttaaaaaggccaa

SEQ ID NO: 3189092 - DNA, 21 bp, Homo sapiens
gttaaaaaggccaaagataaa

SEQ ID NO: 3189093 - DNA, 20 bp, Homo sapiens
gttaaaaatggctcaagtag

SEQ ID NO: 3189094 - DNA, 20 bp, Homo sapiens
gttaaaactgtacatttaaa

SEQ ID NO: 3189095 - DNA, 22 bp, Homo sapiens
gttaaaagcattttaatactaa

SEQ ID NO: 3189096 - DNA, 14 bp, Homo sapiens
gttaaaagtaaaat

SEQ ID NO: 3189097 - DNA, 13 bp, Homo sapiens
gttaaactgttag

SEQ ID NO: 3189098 - DNA, 21 bp, Homo sapiens
gttaaactgttagcactgttg

SEQ ID NO: 3189099 - DNA, 22 bp, Homo sapiens
gttaaactgttagcactgttga

SEQ ID NO: 3189100 - DNA, 20 bp, Homo sapiens
gttaaataagcaaataaaca

SEQ ID NO: 3189101 - DNA, 13 bp, Homo sapiens
gttaaatactgtg

SEQ ID NO: 3189102 - DNA, 19 bp, Homo sapiens
gttaaatactgtgcagaat

SEQ ID NO: 3189103 - DNA, 20 bp, Homo sapiens
gttaaatactgtgcagaata

SEQ ID NO: 3189104 - DNA, 20 bp, Homo sapiens
gttaaatactgtgtggaact

SEQ ID NO: 3189105 - DNA, 21 bp, Homo sapiens
gttaaatagagtatatgcact

SEQ ID NO: 3189106 - DNA, 13 bp, Homo sapiens
gttaaatttgtaa

SEQ ID NO: 3189107 - DNA, 15 bp, Homo sapiens
gttaaatttgtaagt

SEQ ID NO: 3189108 - DNA, 16 bp, Homo sapiens
gttaaatttgtaagtt

SEQ ID NO: 3189109 - DNA, 17 bp, Homo sapiens
gttaaatttgtaagttt

SEQ ID NO: 3189110 - DNA, 19 bp, Homo sapiens
gttaacaggatattagaca

SEQ ID NO: 3189111 - DNA, 17 bp, Homo sapiens
gttaacctcagtgtcat

SEQ ID NO: 3189112 - DNA, 18 bp, Homo sapiens
gttaactatgacagatat

SEQ ID NO: 3189113 - DNA, 18 bp, Homo sapiens
gttaactgtgaaatacca

SEQ ID NO: 3189114 - DNA, 18 bp, Homo sapiens
gttaactgttaactatga

SEQ ID NO: 3189115 - DNA, 16 bp, Homo sapiens
gttaacttggtcagag

SEQ ID NO: 3189116 - DNA, 13 bp, Homo sapiens
gttaagaagctgt

SEQ ID NO: 3189117 - DNA, 20 bp, Homo sapiens
gttaagaagctgttgtacat

SEQ ID NO: 3189118 - DNA, 21 bp, Homo sapiens
gttaagaagctgttgtacatt

SEQ ID NO: 3189119 - DNA, 19 bp, Homo sapiens
gttaagacatgatttcctt

SEQ ID NO: 3189120 - DNA, 19 bp, Homo sapiens
gttaaggacttctgcagct

SEQ ID NO: 3189121 - DNA, 14 bp, Homo sapiens
gttaagtatgtgta

SEQ ID NO: 3189122 - DNA, 23 bp, Homo sapiens
gttaagttggcttctgtttctag

SEQ ID NO: 3189123 - DNA, 18 bp, Homo sapiens
gttaataacagctccttt

SEQ ID NO: 3189124 - DNA, 20 bp, Homo sapiens
gttaatacacagtactttat

SEQ ID NO: 3189125 - DNA, 15 bp, Homo sapiens
gttaatatttaagac

SEQ ID NO: 3189126 - DNA, 22 bp, Homo sapiens
gttaatctctgttatgtactgt

SEQ ID NO: 3189127 - DNA, 23 bp, Homo sapiens
gttaatgatggttgatgggttct

SEQ ID NO: 3189128 - DNA, 17 bp, Homo sapiens
gttaatgctctatgttt

SEQ ID NO: 3189129 - DNA, 16 bp, Homo sapiens
gttaatgtatataaaa

SEQ ID NO: 3189130 - DNA, 15 bp, Homo sapiens
gtctcctccctcagc

SEQ ID NO: 3189131 - DNA, 21 bp, Homo sapiens
gtctccttactctgagcccag

SEQ ID NO: 3189132 - DNA, 23 bp, Homo sapiens
gtctccttactctgagcccaggc

SEQ ID NO: 3189133 - DNA, 16 bp, Homo sapiens
gtctccttcagcacgg

SEQ ID NO: 3189134 - DNA, 21 bp, Homo sapiens
gtctcctttctcagccacaaa

SEQ ID NO: 3189135 - DNA, 15 bp, Homo sapiens
gtctcgctgtcactg

SEQ ID NO: 3189136 - DNA, 23 bp, Homo sapiens
gtctcgctttgttgcccaggctg

SEQ ID NO: 3189137 - DNA, 22 bp, Homo sapiens
gtctcggatgacaccctggcct

SEQ ID NO: 3189138 - DNA, 16 bp, Homo sapiens
gtctctatattatgtc

SEQ ID NO: 3189139 - DNA, 14 bp, Homo sapiens
gtctctatttaaat

SEQ ID NO: 3189140 - DNA, 19 bp, Homo sapiens
gtctctatttaaattcttt

SEQ ID NO: 3189141 - DNA, 11 bp, Homo sapiens
gtctctccttt

SEQ ID NO: 3189142 - DNA, 19 bp, Homo sapiens
gtctctccttttcttttgt

SEQ ID NO: 3189143 - DNA, 20 bp, Homo sapiens
gtctctccttttcttttgtt

SEQ ID NO: 3189144 - DNA, 13 bp, Homo sapiens
gtctctctgtgaa

SEQ ID NO: 3189145 - DNA, 16 bp, Homo sapiens
gtctctctgtgaatac

SEQ ID NO: 3189146 - DNA, 18 bp, Homo sapiens
gtctctctgtgaatacaa

SEQ ID NO: 3189147 - DNA, 20 bp, Homo sapiens
gtctctcttcagactctcag

SEQ ID NO: 3189148 - DNA, 15 bp, Homo sapiens
gtctctcttctctcc

SEQ ID NO: 3189149 - DNA, 20 bp, Homo sapiens
gtctctcttctctccagctg

SEQ ID NO: 3189150 - DNA, 19 bp, Homo sapiens
gtctctgaatgaagctgaa

SEQ ID NO: 3189151 - DNA, 14 bp, Homo sapiens
gtctctgcatctga

SEQ ID NO: 3189152 - DNA, 23 bp, Homo sapiens
gtctctgccctgcctacttttag

SEQ ID NO: 3189153 - DNA, 17 bp, Homo sapiens
gtctctgccggctcttt

SEQ ID NO: 3189154 - DNA, 16 bp, Homo sapiens
gtctctgctggcccag

SEQ ID NO: 3189155 - DNA, 20 bp, Homo sapiens
gtctctgctggcccagccaa

SEQ ID NO: 3189156 - DNA, 21 bp, Homo sapiens
gtctctggggcaggctgcttc

SEQ ID NO: 3189157 - DNA, 16 bp, Homo sapiens
gtctctgttcagatgt

SEQ ID NO: 3189158 - DNA, 21 bp, Homo sapiens
gtctctgttcagatgtgcatt

SEQ ID NO: 3189159 - DNA, 18 bp, Homo sapiens
gtctcttccacaggaagt

SEQ ID NO: 3189160 - DNA, 22 bp, Homo sapiens
gtctcttccttcggtcttttgt

SEQ ID NO: 3189161 - DNA, 16 bp, Homo sapiens
gtctcttctccactgg

SEQ ID NO: 3189162 - DNA, 17 bp, Homo sapiens
gtctcttctccactgga

SEQ ID NO: 3189163 - DNA, 17 bp, Homo sapiens
gtctcttctcccagaat

SEQ ID NO: 3189164 - DNA, 13 bp, Homo sapiens
gtctcttgaggga

SEQ ID NO: 3189165 - DNA, 20 bp, Homo sapiens
gtctcttgtagaagatggac

SEQ ID NO: 3189166 - DNA, 18 bp, Homo sapiens
gtctctttaatgtcacag

SEQ ID NO: 3189167 - DNA, 19 bp, Homo sapiens
gtctctttaatgtcacagg

SEQ ID NO: 3189168 - DNA, 14 bp, Homo sapiens
gtctctttcttcct

SEQ ID NO: 3189169 - DNA, 17 bp, Homo sapiens
gtctctttcttcctttc

SEQ ID NO: 3189170 - DNA, 23 bp, Homo sapiens
gtctcttttctttagagcattgc

SEQ ID NO: 3189171 - DNA, 15 bp, Homo sapiens
gtctgaaacatttca

SEQ ID NO: 3189172 - DNA, 15 bp, Homo sapiens
gtctgaacagctgta

SEQ ID NO: 3189173 - DNA, 22 bp, Homo sapiens
gtctgaaggactggattggcca

SEQ ID NO: 3189174 - DNA, 14 bp, Homo sapiens
gtctgaatgtattt

SEQ ID NO: 3189175 - DNA, 15 bp, Homo sapiens
gtctgaatgtattta

SEQ ID NO: 3189176 - DNA, 13 bp, Homo sapiens
gtctgaatgttct

SEQ ID NO: 3189177 - DNA, 14 bp, Homo sapiens
gtctgaatgttctg

SEQ ID NO: 3189178 - DNA, 17 bp, Homo sapiens
gtctgaatgttctgaca

SEQ ID NO: 3189179 - DNA, 18 bp, Homo sapiens
gtctgaatgttctgacat

SEQ ID NO: 3189180 - DNA, 13 bp, Homo sapiens
gtctgaatttatt

SEQ ID NO: 3189181 - DNA, 12 bp, Homo sapiens
gtctgacaggca

SEQ ID NO: 3189182 - DNA, 13 bp, Homo sapiens
gtctgacaggcaa

SEQ ID NO: 3189183 - DNA, 15 bp, Homo sapiens
gtctgacaggcaatg

SEQ ID NO: 3189184 - DNA, 21 bp, Homo sapiens
gtctgacaggcaatgctggct

SEQ ID NO: 3189185 - DNA, 23 bp, Homo sapiens
gtctgaccccagtggaaaacaaa

SEQ ID NO: 3189186 - DNA, 14 bp, Homo sapiens
gtctgactccagag

SEQ ID NO: 3189187 - DNA, 22 bp, Homo sapiens
gtctgactccagagtctgagcc

SEQ ID NO: 3189188 - DNA, 13 bp, Homo sapiens
gtctgagccctgg

SEQ ID NO: 3189189 - DNA, 21 bp, Homo sapiens
gtctgaggaatccagacccgg

SEQ ID NO: 3189190 - DNA, 18 bp, Homo sapiens
gtctgagtcctgtctctg

SEQ ID NO: 3189191 - DNA, 18 bp, Homo sapiens
gtctgagtctgagtcctg

SEQ ID NO: 3189192 - DNA, 18 bp, Homo sapiens
gtctgatattaatcaaaa

SEQ ID NO: 3189193 - DNA, 17 bp, Homo sapiens
gtctgattcccaagctc

SEQ ID NO: 3189194 - DNA, 14 bp, Homo sapiens
gtctgattggcttg

SEQ ID NO: 3189195 - DNA, 18 bp, Homo sapiens
gtctgatttttaaagtac

SEQ ID NO: 3189196 - DNA, 15 bp, Homo sapiens
gtctgcaactttaag

SEQ ID NO: 3189197 - DNA, 19 bp, Homo sapiens
gtctgcaagtcagaggatg

SEQ ID NO: 3189198 - DNA, 19 bp, Homo sapiens
gtctgcagcccggcgccac

SEQ ID NO: 3189199 - DNA, 14 bp, Homo sapiens
gtctgccaggccca

SEQ ID NO: 3189200 - DNA, 22 bp, Homo sapiens
gtctgccaggcccatctcaggt

SEQ ID NO: 3189201 - DNA, 13 bp, Homo sapiens
gtctgccttaaag

SEQ ID NO: 3189202 - DNA, 15 bp, Homo sapiens
gtctgctaggcgctg

SEQ ID NO: 3189203 - DNA, 23 bp, Homo sapiens
gtctgctcagacagaacccctac

SEQ ID NO: 3189204 - DNA, 19 bp, Homo sapiens
gtctgctctttctctgcca

SEQ ID NO: 3189205 - DNA, 22 bp, Homo sapiens
gtctgctttaaagggcctgcct

SEQ ID NO: 3189206 - DNA, 16 bp, Homo sapiens
gtctggaatgcagtgg

SEQ ID NO: 3189207 - DNA, 12 bp, Homo sapiens
gtctggaccccg

SEQ ID NO: 3189208 - DNA, 23 bp, Homo sapiens
gtctggaggggcccctgcttctc

SEQ ID NO: 3189209 - DNA, 18 bp, Homo sapiens
gtctggagtgggcagagc

SEQ ID NO: 3189210 - DNA, 23 bp, Homo sapiens
gtctggagtggtaacagctctct

SEQ ID NO: 3189211 - DNA, 14 bp, Homo sapiens
gtctggccaggcac

SEQ ID NO: 3189212 - DNA, 18 bp, Homo sapiens
gtctgggacttccttgct

SEQ ID NO: 3189213 - DNA, 20 bp, Homo sapiens
gtctgggacttccttgctct

SEQ ID NO: 3189214 - DNA, 24 bp, Homo sapiens
gtctgggacttccttgctctccct

SEQ ID NO: 3189215 - DNA, 19 bp, Homo sapiens
gtctgggatgtagaacttc

SEQ ID NO: 3189216 - DNA, 11 bp, Homo sapiens
gtctgggcctc

SEQ ID NO: 3189217 - DNA, 12 bp, Homo sapiens
gtctgggcctct

SEQ ID NO: 3189218 - DNA, 19 bp, Homo sapiens
gtctgggtttttcttgtgg

SEQ ID NO: 3189219 - DNA, 13 bp, Homo sapiens
gtctggtgttcca

SEQ ID NO: 3189220 - DNA, 13 bp, Homo sapiens
gtctggtttctag

SEQ ID NO: 3189221 - DNA, 14 bp, Homo sapiens
gtctggtttctaga

SEQ ID NO: 3189222 - DNA, 23 bp, Homo sapiens
gtctggttttgtcccttccagga

SEQ ID NO: 3189223 - DNA, 12 bp, Homo sapiens
gtctgtaatgac

SEQ ID NO: 3189224 - DNA, 20 bp, Homo sapiens
gtctgtacacgtgtcctgta

SEQ ID NO: 3189225 - DNA, 17 bp, Homo sapiens
gtctgtatttcatgtgg

SEQ ID NO: 3189226 - DNA, 20 bp, Homo sapiens
gtctgtcaccagctatctgt

SEQ ID NO: 3189227 - DNA, 17 bp, Homo sapiens
gtctgtcatcctctgga

SEQ ID NO: 3189228 - DNA, 21 bp, Homo sapiens
gtctgtcccggggtcctgtgg

SEQ ID NO: 3189229 - DNA, 24 bp, Homo sapiens
gtctgtcccggggtcctgtggcag

SEQ ID NO: 3189230 - DNA, 16 bp, Homo sapiens
gtctgtctacatttct

SEQ ID NO: 3189231 - DNA, 17 bp, Homo sapiens
gtctgtctactgtggtg

SEQ ID NO: 3189232 - DNA, 22 bp, Homo sapiens
gtctgtcttcacagctctgtgt

SEQ ID NO: 3189233 - DNA, 16 bp, Homo sapiens
gtctgtctttcctgaa

SEQ ID NO: 3189234 - DNA, 20 bp, Homo sapiens
gtctgtctttcctgaaccat

SEQ ID NO: 3189235 - DNA, 21 bp, Homo sapiens
gtctgtgaacagagagaccct

SEQ ID NO: 3189236 - DNA, 13 bp, Homo sapiens
gtctgtgaagagc

SEQ ID NO: 3189237 - DNA, 14 bp, Homo sapiens
gtctgtgaatgcta

SEQ ID NO: 3189238 - DNA, 15 bp, Homo sapiens
gtctgtgagatgcta

SEQ ID NO: 3189239 - DNA, 16 bp, Homo sapiens
gtctgtgagatgctag

SEQ ID NO: 3189240 - DNA, 23 bp, Homo sapiens
gtctgtgagatgctagaactccc

SEQ ID NO: 3189241 - DNA, 14 bp, Homo sapiens
gtctgtgctgtgcc

SEQ ID NO: 3189242 - DNA, 15 bp, Homo sapiens
gtctgtgctgtgcct

SEQ ID NO: 3189243 - DNA, 19 bp, Homo sapiens
gtctgtgctgtgcctgcta

SEQ ID NO: 3189244 - DNA, 14 bp, Homo sapiens
gtctgtggggaggg

SEQ ID NO: 3189245 - DNA, 13 bp, Homo sapiens
gtctgtgtgaatg

SEQ ID NO: 3189246 - DNA, 15 bp, Homo sapiens
gtctgtgtgaatgtg

SEQ ID NO: 3189247 - DNA, 18 bp, Homo sapiens
gtctgtgtgggactgtac

SEQ ID NO: 3189248 - DNA, 15 bp, Homo sapiens
gtctgtgtgtgttct

SEQ ID NO: 3189249 - DNA, 17 bp, Homo sapiens
gtctgtgtgtgttcttc

SEQ ID NO: 3189250 - DNA, 21 bp, Homo sapiens
gtctgttctgcacaataaaca

SEQ ID NO: 3189251 - DNA, 12 bp, Homo sapiens
gtctgttttcct

SEQ ID NO: 3189252 - DNA, 15 bp, Homo sapiens
gtctgtttttgtatc

SEQ ID NO: 3189253 - DNA, 22 bp, Homo sapiens
gtcttaacaaaccaacatcttt

SEQ ID NO: 3189254 - DNA, 20 bp, Homo sapiens
gtcttacaatcaaatctcct

SEQ ID NO: 3189255 - DNA, 15 bp, Homo sapiens
gtcttagatgtatat

SEQ ID NO: 3189256 - DNA, 18 bp, Homo sapiens
gtcttaggatgtctgtaa

SEQ ID NO: 3189257 - DNA, 16 bp, Homo sapiens
gtcttatcaactggtt

SEQ ID NO: 3189258 - DNA, 12 bp, Homo sapiens
gtcttattctta

SEQ ID NO: 3189259 - DNA, 20 bp, Homo sapiens
gggtcctgtggcaggcagcg

SEQ ID NO: 3189260 - DNA, 19 bp, Homo sapiens
gggtccttttgacactgct

SEQ ID NO: 3189261 - DNA, 14 bp, Homo sapiens
gggtcgaaagctct

SEQ ID NO: 3189262 - DNA, 22 bp, Homo sapiens
gggtcgtttgcttttcagggtt

SEQ ID NO: 3189263 - DNA, 12 bp, Homo sapiens
gggtctaccagg

SEQ ID NO: 3189264 - DNA, 12 bp, Homo sapiens
gggtctcactct

SEQ ID NO: 3189265 - DNA, 13 bp, Homo sapiens
gggtctccctggc

SEQ ID NO: 3189266 - DNA, 16 bp, Homo sapiens
gggtctccctggctcc

SEQ ID NO: 3189267 - DNA, 21 bp, Homo sapiens
gggtctccctggctccctcct

SEQ ID NO: 3189268 - DNA, 18 bp, Homo sapiens
gggtctctccctcaggtg

SEQ ID NO: 3189269 - DNA, 12 bp, Homo sapiens
gggtctgaggaa

SEQ ID NO: 3189270 - DNA, 22 bp, Homo sapiens
gggtctgtgctgtgcctgctag

SEQ ID NO: 3189271 - DNA, 20 bp, Homo sapiens
gggtcttcagcattccctcc

SEQ ID NO: 3189272 - DNA, 22 bp, Homo sapiens
gggtcttttttcatttcttcct

SEQ ID NO: 3189273 - DNA, 19 bp, Homo sapiens
gggtgaagagaaccgagca

SEQ ID NO: 3189274 - DNA, 13 bp, Homo sapiens
gggtgacagtcat

SEQ ID NO: 3189275 - DNA, 20 bp, Homo sapiens
gggtgacagtcatcatcagg

SEQ ID NO: 3189276 - DNA, 22 bp, Homo sapiens
gggtgacagtcatcatcagggc

SEQ ID NO: 3189277 - DNA, 18 bp, Homo sapiens
gggtgacagtgccttctc

SEQ ID NO: 3189278 - DNA, 15 bp, Homo sapiens
gggtgagatgctgga

SEQ ID NO: 3189279 - DNA, 18 bp, Homo sapiens
gggtgagatgctggagaa

SEQ ID NO: 3189280 - DNA, 20 bp, Homo sapiens
gggtgagatgctggagaaga

SEQ ID NO: 3189281 - DNA, 23 bp, Homo sapiens
gggtgattttatgatcagtgttg

SEQ ID NO: 3189282 - DNA, 15 bp, Homo sapiens
gggtgcagctgagaa

SEQ ID NO: 3189283 - DNA, 15 bp, Homo sapiens
gggtgcatcctcctc

SEQ ID NO: 3189284 - DNA, 17 bp, Homo sapiens
gggtgctgccctgtgta

SEQ ID NO: 3189285 - DNA, 22 bp, Homo sapiens
gggtgcttttatagaggctagc

SEQ ID NO: 3189286 - DNA, 16 bp, Homo sapiens
gggtggaagggctggg

SEQ ID NO: 3189287 - DNA, 20 bp, Homo sapiens
gggtggacgcaattgtggga

SEQ ID NO: 3189288 - DNA, 12 bp, Homo sapiens
gggtggcacacc

SEQ ID NO: 3189289 - DNA, 16 bp, Homo sapiens
gggtggcacctcctga

SEQ ID NO: 3189290 - DNA, 17 bp, Homo sapiens
gggtggcacctcctgag

SEQ ID NO: 3189291 - DNA, 22 bp, Homo sapiens
gggtggcaggcacacagcagcc

SEQ ID NO: 3189292 - DNA, 18 bp, Homo sapiens
gggtggcatcctccggag

SEQ ID NO: 3189293 - DNA, 21 bp, Homo sapiens
gggtggccgctgagtggcagg

SEQ ID NO: 3189294 - DNA, 19 bp, Homo sapiens
gggtgggagagcccagcca

SEQ ID NO: 3189295 - DNA, 13 bp, Homo sapiens
gggtgggcccaga

SEQ ID NO: 3189296 - DNA, 15 bp, Homo sapiens
gggtgggcccagaac

SEQ ID NO: 3189297 - DNA, 20 bp, Homo sapiens
gggtgggcctggcctgagct

SEQ ID NO: 3189298 - DNA, 19 bp, Homo sapiens
gggtgggggctcctggtgg

SEQ ID NO: 3189299 - DNA, 20 bp, Homo sapiens
gggtgggggctcctggtggc

SEQ ID NO: 3189300 - DNA, 20 bp, Homo sapiens
gggtggggggtgcaggtggg

SEQ ID NO: 3189301 - DNA, 12 bp, Homo sapiens
gggtggggtgga

SEQ ID NO: 3189302 - DNA, 14 bp, Homo sapiens
gggtgggtgctcag

SEQ ID NO: 3189303 - DNA, 15 bp, Homo sapiens
gggtgggtgctcaga

SEQ ID NO: 3189304 - DNA, 16 bp, Homo sapiens
gggtgggtgctcagaa

SEQ ID NO: 3189305 - DNA, 12 bp, Homo sapiens
gggtggtgacct

SEQ ID NO: 3189306 - DNA, 12 bp, Homo sapiens
gggtggtgggga

SEQ ID NO: 3189307 - DNA, 13 bp, Homo sapiens
gggtggtggggag

SEQ ID NO: 3189308 - DNA, 19 bp, Homo sapiens
gggtggtggggaggggcgc

SEQ ID NO: 3189309 - DNA, 10 bp, Homo sapiens
gggtggttcc

SEQ ID NO: 3189310 - DNA, 24 bp, Homo sapiens
gggtgtcaaacattcgtgagctgg

SEQ ID NO: 3189311 - DNA, 19 bp, Homo sapiens
gggtgtggcctcagccctc

SEQ ID NO: 3189312 - DNA, 11 bp, Homo sapiens
gggtgtgggtt

SEQ ID NO: 3189313 - DNA, 22 bp, Homo sapiens
gggtgttttgtggggctccccg

SEQ ID NO: 3189314 - DNA, 20 bp, Homo sapiens
gtgcctcactgggggctttg

SEQ ID NO: 3189315 - DNA, 12 bp, Homo sapiens
gtgcctcagact

SEQ ID NO: 3189316 - DNA, 17 bp, Homo sapiens
gtgcctccaccaccact

SEQ ID NO: 3189317 - DNA, 22 bp, Homo sapiens
gtgcctccaccaccactggcca

SEQ ID NO: 3189318 - DNA, 20 bp, Homo sapiens
gtgcctcccacacttgctgg

SEQ ID NO: 3189319 - DNA, 19 bp, Homo sapiens
gtgcctcctcaaacccagt

SEQ ID NO: 3189320 - DNA, 19 bp, Homo sapiens
gtgcctcctcagaggacag

SEQ ID NO: 3189321 - DNA, 14 bp, Homo sapiens
gtgcctcgaggcac

SEQ ID NO: 3189322 - DNA, 15 bp, Homo sapiens
gtgcctcgaggcacc

SEQ ID NO: 3189323 - DNA, 22 bp, Homo sapiens
gtgcctcgaggcaccggcgctg

SEQ ID NO: 3189324 - DNA, 12 bp, Homo sapiens
gtgcctctgcct

SEQ ID NO: 3189325 - DNA, 15 bp, Homo sapiens
gtgcctctgcctgtc

SEQ ID NO: 3189326 - DNA, 18 bp, Homo sapiens
gtgcctctgcggggcagg

SEQ ID NO: 3189327 - DNA, 21 bp, Homo sapiens
gtgcctctgcggggcagggcc

SEQ ID NO: 3189328 - DNA, 15 bp, Homo sapiens
gtgcctctgggactg

SEQ ID NO: 3189329 - DNA, 21 bp, Homo sapiens
gtgcctgacacactaaccaag

SEQ ID NO: 3189330 - DNA, 14 bp, Homo sapiens
gtgcctgagaggca

SEQ ID NO: 3189331 - DNA, 18 bp, Homo sapiens
gtgcctgagaggcaggca

SEQ ID NO: 3189332 - DNA, 18 bp, Homo sapiens
gtgcctgcaccaggagac

SEQ ID NO: 3189333 - DNA, 19 bp, Homo sapiens
gtgcctgcaccaggagaca

SEQ ID NO: 3189334 - DNA, 19 bp, Homo sapiens
gtgcctgccatgggccagc

SEQ ID NO: 3189335 - DNA, 22 bp, Homo sapiens
gtgcctgccatgggccagccta

SEQ ID NO: 3189336 - DNA, 16 bp, Homo sapiens
gtgcctgctagagcaa

SEQ ID NO: 3189337 - DNA, 17 bp, Homo sapiens
gtgcctgctagagcaac

SEQ ID NO: 3189338 - DNA, 22 bp, Homo sapiens
gtgcctggacatttgccttgct

SEQ ID NO: 3189339 - DNA, 12 bp, Homo sapiens
gtgcctggcctg

SEQ ID NO: 3189340 - DNA, 15 bp, Homo sapiens
gtgcctgggaatgta

SEQ ID NO: 3189341 - DNA, 14 bp, Homo sapiens
gtgcctgggggagt

SEQ ID NO: 3189342 - DNA, 22 bp, Homo sapiens
gtgcctgtgtccatgcgctcag

SEQ ID NO: 3189343 - DNA, 17 bp, Homo sapiens
gtgccttccataattat

SEQ ID NO: 3189344 - DNA, 19 bp, Homo sapiens
gtgccttctccttccccag

SEQ ID NO: 3189345 - DNA, 11 bp, Homo sapiens
gtgccttctct

SEQ ID NO: 3189346 - DNA, 19 bp, Homo sapiens
gtgccttggggaatttcct

SEQ ID NO: 3189347 - DNA, 18 bp, Homo sapiens
gtgccttttatagctatt

SEQ ID NO: 3189348 - DNA, 19 bp, Homo sapiens
gtgccttttgcacccctcc

SEQ ID NO: 3189349 - DNA, 21 bp, Homo sapiens
gtgccttttgcacccctccca

SEQ ID NO: 3189350 - DNA, 15 bp, Homo sapiens
gtgccttttgtgtga

SEQ ID NO: 3189351 - DNA, 18 bp, Homo sapiens
gtgccttttgtgtgatgc

SEQ ID NO: 3189352 - DNA, 14 bp, Homo sapiens
gtgcgcctacagga

SEQ ID NO: 3189353 - DNA, 19 bp, Homo sapiens
gtgcgctcttggtccctgg

SEQ ID NO: 3189354 - DNA, 15 bp, Homo sapiens
gtgcggcgtggagac

SEQ ID NO: 3189355 - DNA, 17 bp, Homo sapiens
gtgcgggcacaataaat

SEQ ID NO: 3189356 - DNA, 13 bp, Homo sapiens
gtgcgtcccagct

SEQ ID NO: 3189357 - DNA, 14 bp, Homo sapiens
gtgcgtgaaacaca

SEQ ID NO: 3189358 - DNA, 16 bp, Homo sapiens
gtgcgtgcgtgtgtgt

SEQ ID NO: 3189359 - DNA, 13 bp, Homo sapiens
gtgcgtgtgtaga

SEQ ID NO: 3189360 - DNA, 15 bp, Homo sapiens
gtgctaaggttctaa

SEQ ID NO: 3189361 - DNA, 17 bp, Homo sapiens
gtgctaaggttctaagg

SEQ ID NO: 3189362 - DNA, 16 bp, Homo sapiens
gtgctaagtctttccc

SEQ ID NO: 3189363 - DNA, 21 bp, Homo sapiens
gtgctaataacagtgcatatt

SEQ ID NO: 3189364 - DNA, 21 bp, Homo sapiens
gtgctacatgacgacaaagct

SEQ ID NO: 3189365 - DNA, 18 bp, Homo sapiens
gtgctactccatgcaggg

SEQ ID NO: 3189366 - DNA, 20 bp, Homo sapiens
gtgctactccatgcaggggt

SEQ ID NO: 3189367 - DNA, 21 bp, Homo sapiens
gtgctagaaaatttagccctt

SEQ ID NO: 3189368 - DNA, 14 bp, Homo sapiens
gtgctagtgagctg

SEQ ID NO: 3189369 - DNA, 23 bp, Homo sapiens
gtgctataatctgtttttacgta

SEQ ID NO: 3189370 - DNA, 21 bp, Homo sapiens
gtgctatactgcatacttttt

SEQ ID NO: 3189371 - DNA, 20 bp, Homo sapiens
gtgctatatatataaatatt

SEQ ID NO: 3189372 - DNA, 13 bp, Homo sapiens
gtgctatttgaag

SEQ ID NO: 3189373 - DNA, 17 bp, Homo sapiens
gtgctcacgctcccccg

SEQ ID NO: 3189374 - DNA, 20 bp, Homo sapiens
gtgctcacgctcccccgcag

SEQ ID NO: 3189375 - DNA, 12 bp, Homo sapiens
gtgctcagaaga

SEQ ID NO: 3189376 - DNA, 16 bp, Homo sapiens
gtgctcagaagaggaa

SEQ ID NO: 3189377 - DNA, 18 bp, Homo sapiens
gtgctccgtgcctccacc

SEQ ID NO: 3189378 - DNA, 22 bp, Homo sapiens
gtgctccgtgcctccaccacca

SEQ ID NO: 3189379 - DNA, 16 bp, Homo sapiens
gtgctcctgaaagaaa

SEQ ID NO: 3189380 - DNA, 15 bp, Homo sapiens
gtgctctcaccagct

SEQ ID NO: 3189381 - DNA, 19 bp, Homo sapiens
gtgctctggcggcttcctg

SEQ ID NO: 3189382 - DNA, 13 bp, Homo sapiens
gtgctctgtgttc

SEQ ID NO: 3189383 - DNA, 20 bp, Homo sapiens
gtgctcttttctcctcactg

SEQ ID NO: 3189384 - DNA, 19 bp, Homo sapiens
gtgctctttttttaaaagg

SEQ ID NO: 3189385 - DNA, 21 bp, Homo sapiens
gtgctgaacagtggaggaaga

SEQ ID NO: 3189386 - DNA, 14 bp, Homo sapiens
gtgctgagattaca

SEQ ID NO: 3189387 - DNA, 22 bp, Homo sapiens
gtgctgatcgtgctaaattttc

SEQ ID NO: 3189388 - DNA, 12 bp, Homo sapiens
gtgctgcaggag

SEQ ID NO: 3189389 - DNA, 23 bp, Homo sapiens
gtgctgcaggagtgtcctgccca

SEQ ID NO: 3189390 - DNA, 21 bp, Homo sapiens
gtgctgccacacttcaggctc

SEQ ID NO: 3189391 - DNA, 15 bp, Homo sapiens
gtgctgccatccagg

SEQ ID NO: 3189392 - DNA, 16 bp, Homo sapiens
gtgctgccatgccact

SEQ ID NO: 3189393 - DNA, 23 bp, Homo sapiens
gtgctgccatgccactgccaggc

SEQ ID NO: 3189394 - DNA, 18 bp, Homo sapiens
gtgctgcttttgagcctc

SEQ ID NO: 3189395 - DNA, 12 bp, Homo sapiens
gtgctggactgt

SEQ ID NO: 3189396 - DNA, 20 bp, Homo sapiens
gtgctggaggattttccagt

SEQ ID NO: 3189397 - DNA, 24 bp, Homo sapiens
gtgctggaggtgggagcaggagat

SEQ ID NO: 3189398 - DNA, 21 bp, Homo sapiens
gtgctggatattttactacca

SEQ ID NO: 3189399 - DNA, 20 bp, Homo sapiens
gtgctggatggacagtgggc

SEQ ID NO: 3189400 - DNA, 23 bp, Homo sapiens
gtgctggatggacagtgggcatc

SEQ ID NO: 3189401 - DNA, 19 bp, Homo sapiens
gtgctggattgtccttgga

SEQ ID NO: 3189402 - DNA, 12 bp, Homo sapiens
gtgctggccccc

SEQ ID NO: 3189403 - DNA, 15 bp, Homo sapiens
gtgctggctgcccag

SEQ ID NO: 3189404 - DNA, 15 bp, Homo sapiens
gtgctgggaccagag

SEQ ID NO: 3189405 - DNA, 17 bp, Homo sapiens
gtgctgggaccagagcc

SEQ ID NO: 3189406 - DNA, 18 bp, Homo sapiens
gtgctgggaccagagcca

SEQ ID NO: 3189407 - DNA, 19 bp, Homo sapiens
gtgctgggaccagagccag

SEQ ID NO: 3189408 - DNA, 20 bp, Homo sapiens
gtgctgggaccagagccaga

SEQ ID NO: 3189409 - DNA, 22 bp, Homo sapiens
gtgctgggagctccactctgct

SEQ ID NO: 3189410 - DNA, 23 bp, Homo sapiens
gtgctgggagctccactctgctt

SEQ ID NO: 3189411 - DNA, 15 bp, Homo sapiens
gtgctgggaggaggg

SEQ ID NO: 3189412 - DNA, 22 bp, Homo sapiens
gtgctgggattacaagcgtgag

SEQ ID NO: 3189413 - DNA, 20 bp, Homo sapiens
gtgctgggattacaggcgtg

SEQ ID NO: 3189414 - DNA, 20 bp, Homo sapiens
gtgctgggattacaggtgtg

SEQ ID NO: 3189415 - DNA, 17 bp, Homo sapiens
gtgctgggtgcctccca

SEQ ID NO: 3189416 - DNA, 16 bp, Homo sapiens
gtgctggtcccctcct

SEQ ID NO: 3189417 - DNA, 20 bp, Homo sapiens
gtgctggtcccctcctcagt

SEQ ID NO: 3189418 - DNA, 20 bp, Homo sapiens
gtgctggtgtcctgaccacc

SEQ ID NO: 3189419 - DNA, 18 bp, Homo sapiens
gtgctgtcttctggtctg

SEQ ID NO: 3189420 - DNA, 21 bp, Homo sapiens
gtgctgtcttctggtctgtgt

SEQ ID NO: 3189421 - DNA, 18 bp, Homo sapiens
gtgctgtgcctgctagag

SEQ ID NO: 3189422 - DNA, 19 bp, Homo sapiens
gtgctgtggcctgggcaag

SEQ ID NO: 3189423 - DNA, 17 bp, Homo sapiens
gtgcttaagcagaagca

SEQ ID NO: 3189424 - DNA, 22 bp, Homo sapiens
gtgcttacagtaactaattttg

SEQ ID NO: 3189425 - DNA, 19 bp, Homo sapiens
gtgcttattctcaaagcag

SEQ ID NO: 3189426 - DNA, 15 bp, Homo sapiens
gtgcttcaattaata

SEQ ID NO: 3189427 - DNA, 14 bp, Homo sapiens
gtgcttcagagttt

SEQ ID NO: 3189428 - DNA, 21 bp, Homo sapiens
gtgcttcagagtttgtgtgta

SEQ ID NO: 3189429 - DNA, 15 bp, Homo sapiens
gtgcttcgagccaac

SEQ ID NO: 3189430 - DNA, 16 bp, Homo sapiens
gtgcttgggctccacg

SEQ ID NO: 3189431 - DNA, 17 bp, Homo sapiens
gtgcttgttagagagaa

SEQ ID NO: 3189432 - DNA, 20 bp, Homo sapiens
gtgcttgttccctctccctg

SEQ ID NO: 3189433 - DNA, 18 bp, Homo sapiens
gtgcttttatagaggcta

SEQ ID NO: 3189434 - DNA, 19 bp, Homo sapiens
gtgcttttcctatttgttt

SEQ ID NO: 3189435 - DNA, 21 bp, Homo sapiens
gtggaaaacttatgctgattt

SEQ ID NO: 3189436 - DNA, 23 bp, Homo sapiens
gtggaaaatggactggcttggcc

SEQ ID NO: 3189437 - DNA, 13 bp, Homo sapiens
gtggctcttattt

SEQ ID NO: 3189438 - DNA, 11 bp, Homo sapiens
gtggctgaaaa

SEQ ID NO: 3189439 - DNA, 20 bp, Homo sapiens
gtggctggaagatcctgcgg

SEQ ID NO: 3189440 - DNA, 18 bp, Homo sapiens
gtggctgggactcctggt

SEQ ID NO: 3189441 - DNA, 19 bp, Homo sapiens
gtggctgggactcctggtg

SEQ ID NO: 3189442 - DNA, 12 bp, Homo sapiens
gtggctgggtgg

SEQ ID NO: 3189443 - DNA, 12 bp, Homo sapiens
gtggctgtggca

SEQ ID NO: 3189444 - DNA, 15 bp, Homo sapiens
gtggctgtggcacag

SEQ ID NO: 3189445 - DNA, 22 bp, Homo sapiens
gtggcttaaaacaacactcaca

SEQ ID NO: 3189446 - DNA, 22 bp, Homo sapiens
gtggcttgagaaatatggacac

SEQ ID NO: 3189447 - DNA, 15 bp, Homo sapiens
gtggctttaattgta

SEQ ID NO: 3189448 - DNA, 19 bp, Homo sapiens
gtggctttaattgtataag

SEQ ID NO: 3189449 - DNA, 21 bp, Homo sapiens
gtgggaagaccaaaggaagga

SEQ ID NO: 3189450 - DNA, 20 bp, Homo sapiens
gtgggaaggacttggcgcgc

SEQ ID NO: 3189451 - DNA, 16 bp, Homo sapiens
gtgggacagcctcttc

SEQ ID NO: 3189452 - DNA, 19 bp, Homo sapiens
gtgggaccctgtccggccc

SEQ ID NO: 3189453 - DNA, 19 bp, Homo sapiens
gtgggacggtgcccaagcc

SEQ ID NO: 3189454 - DNA, 13 bp, Homo sapiens
gtgggagagccca

SEQ ID NO: 3189455 - DNA, 14 bp, Homo sapiens
gtgggagcaggaga

SEQ ID NO: 3189456 - DNA, 12 bp, Homo sapiens
gtgggagccctg

SEQ ID NO: 3189457 - DNA, 14 bp, Homo sapiens
gtgggagctgagct

SEQ ID NO: 3189458 - DNA, 15 bp, Homo sapiens
gtgggagctgcctgt

SEQ ID NO: 3189459 - DNA, 18 bp, Homo sapiens
gtgggagctgcctgttca

SEQ ID NO: 3189460 - DNA, 14 bp, Homo sapiens
gtgggaggggcagg

SEQ ID NO: 3189461 - DNA, 16 bp, Homo sapiens
gtgggaggtcttgcta

SEQ ID NO: 3189462 - DNA, 15 bp, Homo sapiens
gtgggatacttagtg

SEQ ID NO: 3189463 - DNA, 14 bp, Homo sapiens
gtgggatcctccct

SEQ ID NO: 3189464 - DNA, 13 bp, Homo sapiens
gtgggcacctcag

SEQ ID NO: 3189465 - DNA, 14 bp, Homo sapiens
gtgggcacctcaga

SEQ ID NO: 3189466 - DNA, 15 bp, Homo sapiens
gtgggcactggagca

SEQ ID NO: 3189467 - DNA, 21 bp, Homo sapiens
gtgggcagaggtggcgcccag

SEQ ID NO: 3189468 - DNA, 23 bp, Homo sapiens
gtgggcagcctatgggggctctc

SEQ ID NO: 3189469 - DNA, 12 bp, Homo sapiens
gtgggcagctgg

SEQ ID NO: 3189470 - DNA, 14 bp, Homo sapiens
gtgggcagctgggc

SEQ ID NO: 3189471 - DNA, 15 bp, Homo sapiens
gtgggcagctgggcc

SEQ ID NO: 3189472 - DNA, 16 bp, Homo sapiens
gtgggcagctgggccc

SEQ ID NO: 3189473 - DNA, 17 bp, Homo sapiens
gtgggcaggtggtggca

SEQ ID NO: 3189474 - DNA, 14 bp, Homo sapiens
gtgggcagtgccac

SEQ ID NO: 3189475 - DNA, 19 bp, Homo sapiens
gtgggcagtgccacccgca

SEQ ID NO: 3189476 - DNA, 14 bp, Homo sapiens
gtgggcccaggacc

SEQ ID NO: 3189477 - DNA, 20 bp, Homo sapiens
gtgggcccaggaccagctgg

SEQ ID NO: 3189478 - DNA, 21 bp, Homo sapiens
gtgggcccaggaccagctggg

SEQ ID NO: 3189479 - DNA, 22 bp, Homo sapiens
gtgggcccaggaccagctgggg

SEQ ID NO: 3189480 - DNA, 23 bp, Homo sapiens
gtgggcccaggaccagctggggc

SEQ ID NO: 3189481 - DNA, 23 bp, Homo sapiens
gtgggcccataatagttagccct

SEQ ID NO: 3189482 - DNA, 19 bp, Homo sapiens
gtgggcctcaaggacttga

SEQ ID NO: 3189483 - DNA, 15 bp, Homo sapiens
gtgggcctggcctga

SEQ ID NO: 3189484 - DNA, 16 bp, Homo sapiens
gtgggcctggcctgag

SEQ ID NO: 3189485 - DNA, 22 bp, Homo sapiens
gtgggcctgtcgtgccagtcct

SEQ ID NO: 3189486 - DNA, 13 bp, Homo sapiens
gtgggcgggccat

SEQ ID NO: 3189487 - DNA, 18 bp, Homo sapiens
gtgggcgttgggagccta

SEQ ID NO: 3189488 - DNA, 23 bp, Homo sapiens
gtgggctgatttacatgtatggt

SEQ ID NO: 3189489 - DNA, 19 bp, Homo sapiens
gtgggctggacttctacct

SEQ ID NO: 3189490 - DNA, 13 bp, Homo sapiens
gtgggctggtgcc

SEQ ID NO: 3189491 - DNA, 18 bp, Homo sapiens
gtgggctggtgccccaca

SEQ ID NO: 3189492 - DNA, 20 bp, Homo sapiens
gtgggctggtgccccacagc

SEQ ID NO: 3189493 - DNA, 13 bp, Homo sapiens
gtgggctgtgagt

SEQ ID NO: 3189494 - DNA, 22 bp, Homo sapiens
gtggggagggacaagggattct

SEQ ID NO: 3189495 - DNA, 13 bp, Homo sapiens
gtggggagggccg

SEQ ID NO: 3189496 - DNA, 19 bp, Homo sapiens
gtggggatctcaggggctg

SEQ ID NO: 3189497 - DNA, 13 bp, Homo sapiens
gtggggcagcttg

SEQ ID NO: 3189498 - DNA, 17 bp, Homo sapiens
gtggggcagcttgaggg

SEQ ID NO: 3189499 - DNA, 17 bp, Homo sapiens
gtggggccaggccagga

SEQ ID NO: 3189500 - DNA, 19 bp, Homo sapiens
gtggggccaggccaggacc

SEQ ID NO: 3189501 - DNA, 13 bp, Homo sapiens
gtggggccctgcc

SEQ ID NO: 3189502 - DNA, 19 bp, Homo sapiens
gtggggcctgtggaatgag

SEQ ID NO: 3189503 - DNA, 17 bp, Homo sapiens
gtggggctcgccatgcc

SEQ ID NO: 3189504 - DNA, 12 bp, Homo sapiens
gtggggcttggc

SEQ ID NO: 3189505 - DNA, 14 bp, Homo sapiens
gtgggggctcctgg

SEQ ID NO: 3189506 - DNA, 19 bp, Homo sapiens
gtggggggtgcaggtgggc

SEQ ID NO: 3189507 - DNA, 15 bp, Homo sapiens
gtgggggtggaggct

SEQ ID NO: 3189508 - DNA, 21 bp, Homo sapiens
gtgggggtggccatccctggg

SEQ ID NO: 3189509 - DNA, 18 bp, Homo sapiens
gtggggtacatttctctg

SEQ ID NO: 3189510 - DNA, 17 bp, Homo sapiens
gtggggtgaggaccact

SEQ ID NO: 3189511 - DNA, 15 bp, Homo sapiens
gtggggtgctgccct

SEQ ID NO: 3189512 - DNA, 15 bp, Homo sapiens
gtggggttctaggca

SEQ ID NO: 3189513 - DNA, 22 bp, Homo sapiens
gtgggtaagactaaatctgtaa

SEQ ID NO: 3189514 - DNA, 19 bp, Homo sapiens
gtgggtccaggaaggcagc

SEQ ID NO: 3189515 - DNA, 20 bp, Homo sapiens
gtgggtccaggaaggcagct

SEQ ID NO: 3189516 - DNA, 18 bp, Homo sapiens
gtgggtcccgcactctgc

SEQ ID NO: 3189517 - DNA, 13 bp, Homo sapiens
gtgggtctgggag

SEQ ID NO: 3189518 - DNA, 18 bp, Homo sapiens
gtgggtcttatgcttcca

SEQ ID NO: 3189519 - DNA, 20 bp, Homo sapiens
gtgggtgaaggcctggctgg

SEQ ID NO: 3189520 - DNA, 16 bp, Homo sapiens
gtgggtgacaagagcc

SEQ ID NO: 3189521 - DNA, 15 bp, Homo sapiens
gtgggtgagatgctg

SEQ ID NO: 3189522 - DNA, 13 bp, Homo sapiens
gtgggtgagccag

SEQ ID NO: 3189523 - DNA, 15 bp, Homo sapiens
gtgggtgctcagaat

SEQ ID NO: 3189524 - DNA, 16 bp, Homo sapiens
gtgggtgctgccctgt

SEQ ID NO: 3189525 - DNA, 14 bp, Homo sapiens
gtgggtgtagccag

SEQ ID NO: 3189526 - DNA, 15 bp, Homo sapiens
gtgggtgtgggtgga

SEQ ID NO: 3189527 - DNA, 17 bp, Homo sapiens
gtgggttatcagttaac

SEQ ID NO: 3189528 - DNA, 13 bp, Homo sapiens
gtggtaacagctc

SEQ ID NO: 3189529 - DNA, 16 bp, Homo sapiens
gtggtagaggcctggg

SEQ ID NO: 3189530 - DNA, 16 bp, Homo sapiens
gtggtatcctgtgaca

SEQ ID NO: 3189531 - DNA, 21 bp, Homo sapiens
gtggtatgtaatttatgcaag

SEQ ID NO: 3189532 - DNA, 13 bp, Homo sapiens
gtggtatgtgaca

SEQ ID NO: 3189533 - DNA, 23 bp, Homo sapiens
gtggtatttgctgtcacatagtt

SEQ ID NO: 3189534 - DNA, 13 bp, Homo sapiens
gtggtcagatgca

SEQ ID NO: 3189535 - DNA, 14 bp, Homo sapiens
gtggtcagatgcag

SEQ ID NO: 3189536 - DNA, 22 bp, Homo sapiens
gtggtcatattattattaattt

SEQ ID NO: 3189537 - DNA, 13 bp, Homo sapiens
gtggtctcaggat

SEQ ID NO: 3189538 - DNA, 23 bp, Homo sapiens
gtggtctccttgcactttctcag

SEQ ID NO: 3189539 - DNA, 13 bp, Homo sapiens
gtggtctgaatgt

SEQ ID NO: 3189540 - DNA, 21 bp, Homo sapiens
gtggtctgagccaaagagaat

SEQ ID NO: 3189541 - DNA, 14 bp, Homo sapiens
gtggtctgtgtcac

SEQ ID NO: 3189542 - DNA, 17 bp, Homo sapiens
gtggtctgttggcaggc

SEQ ID NO: 3189543 - DNA, 19 bp, Homo sapiens
gtggtctttgtaagagtgt

SEQ ID NO: 3189544 - DNA, 14 bp, Homo sapiens
gtggtgacctctgc

SEQ ID NO: 3189545 - DNA, 17 bp, Homo sapiens
gtggtgacctctgcctg

SEQ ID NO: 3189546 - DNA, 14 bp, Homo sapiens
gtggtggagggggc

SEQ ID NO: 3189547 - DNA, 15 bp, Homo sapiens
gtggtggagggggct

SEQ ID NO: 3189548 - DNA, 21 bp, Homo sapiens
gtggtggagggggctgggctc

SEQ ID NO: 3189549 - DNA, 13 bp, Homo sapiens
gtggtggcctcag

SEQ ID NO: 3189550 - DNA, 18 bp, Homo sapiens
gtggtggcgggcgcctgt

SEQ ID NO: 3189551 - DNA, 22 bp, Homo sapiens
gtggtggggaggggcgctggcc

SEQ ID NO: 3189552 - DNA, 22 bp, Homo sapiens
gtggtggttcctttgcaccctg

SEQ ID NO: 3189553 - DNA, 16 bp, Homo sapiens
gtggtgtaaagctggc

SEQ ID NO: 3189554 - DNA, 19 bp, Homo sapiens
gtggtgtaaagctggccct

SEQ ID NO: 3189555 - DNA, 18 bp, Homo sapiens
gtggtgtgaccatgttca

SEQ ID NO: 3189556 - DNA, 18 bp, Homo sapiens
gtggtgtgtccctggaca

SEQ ID NO: 3189557 - DNA, 17 bp, Homo sapiens
gtgtgatgaactttctc

SEQ ID NO: 3189558 - DNA, 16 bp, Homo sapiens
gtgtgattgaatctga

SEQ ID NO: 3189559 - DNA, 19 bp, Homo sapiens
gtgtgcaatgtctgagtga

SEQ ID NO: 3189560 - DNA, 17 bp, Homo sapiens
gtgtgcacaccaccctc

SEQ ID NO: 3189561 - DNA, 18 bp, Homo sapiens
gtgtgcacaccaccctcc

SEQ ID NO: 3189562 - DNA, 22 bp, Homo sapiens
gtgtgcatggaggccctcctgt

SEQ ID NO: 3189563 - DNA, 14 bp, Homo sapiens
gtgtgcctgcagcc

SEQ ID NO: 3189564 - DNA, 13 bp, Homo sapiens
gtgtgcctggaag

SEQ ID NO: 3189565 - DNA, 16 bp, Homo sapiens
gtgtgcctgggggagt

SEQ ID NO: 3189566 - DNA, 23 bp, Homo sapiens
gtgtgcctgggggagttttcctc

SEQ ID NO: 3189567 - DNA, 15 bp, Homo sapiens
gtgtgcctgtggcag

SEQ ID NO: 3189568 - DNA, 16 bp, Homo sapiens
gtgtgcctgtggcaga

SEQ ID NO: 3189569 - DNA, 12 bp, Homo sapiens
gtgtgctgggag

SEQ ID NO: 3189570 - DNA, 13 bp, Homo sapiens
gtccctctgtgta

SEQ ID NO: 3189571 - DNA, 21 bp, Homo sapiens
gtccctctgtgtctgctctca

SEQ ID NO: 3189572 - DNA, 18 bp, Homo sapiens
gtccctgactctctgtga

SEQ ID NO: 3189573 - DNA, 19 bp, Homo sapiens
gtccctgcacttgcagact

SEQ ID NO: 3189574 - DNA, 16 bp, Homo sapiens
gtccctgcagggccat

SEQ ID NO: 3189575 - DNA, 12 bp, Homo sapiens
gtccctgctagt

SEQ ID NO: 3189576 - DNA, 14 bp, Homo sapiens
gtccctggacacag

SEQ ID NO: 3189577 - DNA, 17 bp, Homo sapiens
gtccctggacacagctc

SEQ ID NO: 3189578 - DNA, 18 bp, Homo sapiens
gtccctggacacagctct

SEQ ID NO: 3189579 - DNA, 17 bp, Homo sapiens
gtccctgggccagggtc

SEQ ID NO: 3189580 - DNA, 18 bp, Homo sapiens
gtccctgggccagggtct

SEQ ID NO: 3189581 - DNA, 13 bp, Homo sapiens
gtccctggtccct

SEQ ID NO: 3189582 - DNA, 18 bp, Homo sapiens
gtccctgtcatttgaacc

SEQ ID NO: 3189583 - DNA, 16 bp, Homo sapiens
gtccctgtccttccct

SEQ ID NO: 3189584 - DNA, 22 bp, Homo sapiens
gtccctgtgtgtaggctggggc

SEQ ID NO: 3189585 - DNA, 15 bp, Homo sapiens
gtccctgttttctga

SEQ ID NO: 3189586 - DNA, 20 bp, Homo sapiens
gtccctgttttctgagcccg

SEQ ID NO: 3189587 - DNA, 22 bp, Homo sapiens
gtcccttccacttctaactcca

SEQ ID NO: 3189588 - DNA, 16 bp, Homo sapiens
gtcccttccaggagga

SEQ ID NO: 3189589 - DNA, 12 bp, Homo sapiens
gtcccttcccct

SEQ ID NO: 3189590 - DNA, 17 bp, Homo sapiens
gtcccttcccctccctg

SEQ ID NO: 3189591 - DNA, 22 bp, Homo sapiens
gtcccttcccctccctggctcc

SEQ ID NO: 3189592 - DNA, 19 bp, Homo sapiens
gtcccttctcttaatttaa

SEQ ID NO: 3189593 - DNA, 13 bp, Homo sapiens
gtccctttcccta

SEQ ID NO: 3189594 - DNA, 15 bp, Homo sapiens
gtccctttcttggcc

SEQ ID NO: 3189595 - DNA, 15 bp, Homo sapiens
gtccgataatatctt

SEQ ID NO: 3189596 - DNA, 13 bp, Homo sapiens
gtccgcaccagct

SEQ ID NO: 3189597 - DNA, 14 bp, Homo sapiens
gtccgcaccagctg

SEQ ID NO: 3189598 - DNA, 16 bp, Homo sapiens
gtccgcaccagctgct

SEQ ID NO: 3189599 - DNA, 12 bp, Homo sapiens
gtccgccctgct

SEQ ID NO: 3189600 - DNA, 21 bp, Homo sapiens
gtccgccctgctcctccctgg

SEQ ID NO: 3189601 - DNA, 17 bp, Homo sapiens
gtccggtgttctaagat

SEQ ID NO: 3189602 - DNA, 18 bp, Homo sapiens
gtccgtggtagaggcctg

SEQ ID NO: 3189603 - DNA, 19 bp, Homo sapiens
gtccgtggtagaggcctgg

SEQ ID NO: 3189604 - DNA, 13 bp, Homo sapiens
gtcctaaaacacc

SEQ ID NO: 3189605 - DNA, 18 bp, Homo sapiens
gtcctaaggaaccttcct

SEQ ID NO: 3189606 - DNA, 19 bp, Homo sapiens
gtcctaaggacacactaat

SEQ ID NO: 3189607 - DNA, 19 bp, Homo sapiens
gtcctaattcttctgtcct

SEQ ID NO: 3189608 - DNA, 15 bp, Homo sapiens
gtcctacccaccctc

SEQ ID NO: 3189609 - DNA, 16 bp, Homo sapiens
gtcctacccaccctcc

SEQ ID NO: 3189610 - DNA, 13 bp, Homo sapiens
gtcctactctgtg

SEQ ID NO: 3189611 - DNA, 13 bp, Homo sapiens
gtcctatctcccc

SEQ ID NO: 3189612 - DNA, 15 bp, Homo sapiens
gtcctatggaaaaaa

SEQ ID NO: 3189613 - DNA, 20 bp, Homo sapiens
gtcctatggacaacttattt

SEQ ID NO: 3189614 - DNA, 14 bp, Homo sapiens
gtcctcacccctgt

SEQ ID NO: 3189615 - DNA, 20 bp, Homo sapiens
gtcctcacccctgtcctcac

SEQ ID NO: 3189616 - DNA, 21 bp, Homo sapiens
gtcctcacccctgtcctcact

SEQ ID NO: 3189617 - DNA, 22 bp, Homo sapiens
gtcctcacccctgtcctcactg

SEQ ID NO: 3189618 - DNA, 17 bp, Homo sapiens
gtcctcactcccagtcc

SEQ ID NO: 3189619 - DNA, 20 bp, Homo sapiens
gtcctcactgctccctgaag

SEQ ID NO: 3189620 - DNA, 19 bp, Homo sapiens
gtcctcagcagtccacaaa

SEQ ID NO: 3189621 - DNA, 16 bp, Homo sapiens
gtcctcagggagcagg

SEQ ID NO: 3189622 - DNA, 22 bp, Homo sapiens
gtcctcagggagcagggaaggc

SEQ ID NO: 3189623 - DNA, 13 bp, Homo sapiens
gtcctccagaagc

SEQ ID NO: 3189624 - DNA, 22 bp, Homo sapiens
gtcctccagaagcctctggcta

SEQ ID NO: 3189625 - DNA, 23 bp, Homo sapiens
gtcctccatcccaacagccatgc

SEQ ID NO: 3189626 - DNA, 16 bp, Homo sapiens
gtcctcccatcccctg

SEQ ID NO: 3189627 - DNA, 11 bp, Homo sapiens
gtcctcccctc

SEQ ID NO: 3189628 - DNA, 15 bp, Homo sapiens
gtcctcccctcacag

SEQ ID NO: 3189629 - DNA, 17 bp, Homo sapiens
gtcctcccctcacagcc

SEQ ID NO: 3189630 - DNA, 20 bp, Homo sapiens
gtcctcccctcacagcctct

SEQ ID NO: 3189631 - DNA, 14 bp, Homo sapiens
gtcctcctggaagg

SEQ ID NO: 3189632 - DNA, 17 bp, Homo sapiens
gtcctcgttcaaaacat

SEQ ID NO: 3189633 - DNA, 18 bp, Homo sapiens
gtcctcgttcaaaacatt

SEQ ID NO: 3189634 - DNA, 17 bp, Homo sapiens
gtcctctagcaggccta

SEQ ID NO: 3189635 - DNA, 18 bp, Homo sapiens
gtcctctcccctccagcc

SEQ ID NO: 3189636 - DNA, 18 bp, Homo sapiens
gtcctctccctgccaagt

SEQ ID NO: 3189637 - DNA, 16 bp, Homo sapiens
gtcctctcgagcccag

SEQ ID NO: 3189638 - DNA, 19 bp, Homo sapiens
gtcctcttccctctctgca

SEQ ID NO: 3189639 - DNA, 20 bp, Homo sapiens
gtcctcttccctctctgcag

SEQ ID NO: 3189640 - DNA, 23 bp, Homo sapiens
gtcctgaagaggcgggccagcca

SEQ ID NO: 3189641 - DNA, 12 bp, Homo sapiens
gtcctgaccacc

SEQ ID NO: 3189642 - DNA, 21 bp, Homo sapiens
gtcctgaccaccctcccctct

SEQ ID NO: 3189643 - DNA, 23 bp, Homo sapiens
gtcctgaccaccctcccctctct

SEQ ID NO: 3189644 - DNA, 16 bp, Homo sapiens
gtcctgacgccctgcg

SEQ ID NO: 3189645 - DNA, 17 bp, Homo sapiens
gtcctgacgccctgcgt

SEQ ID NO: 3189646 - DNA, 16 bp, Homo sapiens
gtcctgacggcgcccc

SEQ ID NO: 3189647 - DNA, 21 bp, Homo sapiens
gtcctgacggcgcccccagtg

SEQ ID NO: 3189648 - DNA, 21 bp, Homo sapiens
gtcctgagggtccccacctgg

SEQ ID NO: 3189649 - DNA, 16 bp, Homo sapiens
gtcctgcagaggacca

SEQ ID NO: 3189650 - DNA, 13 bp, Homo sapiens
gtcctgcaggagt

SEQ ID NO: 3189651 - DNA, 17 bp, Homo sapiens
gtcctgccagctgcctt

SEQ ID NO: 3189652 - DNA, 23 bp, Homo sapiens
gtcctgcccatgtgtcccctcac

SEQ ID NO: 3189653 - DNA, 19 bp, Homo sapiens
gtcctgccggtgggaccct

SEQ ID NO: 3189654 - DNA, 15 bp, Homo sapiens
gtcctgcctcagcct

SEQ ID NO: 3189655 - DNA, 13 bp, Homo sapiens
gtcctgcctggcc

SEQ ID NO: 3189656 - DNA, 19 bp, Homo sapiens
gtcctgcctggccaggcag

SEQ ID NO: 3189657 - DNA, 11 bp, Homo sapiens
gtcctgcctgt

SEQ ID NO: 3189658 - DNA, 14 bp, Homo sapiens
gtcctgcctgtggc

SEQ ID NO: 3189659 - DNA, 22 bp, Homo sapiens
gtcctgcctgtggcgccgtctc

SEQ ID NO: 3189660 - DNA, 11 bp, Homo sapiens
gtcctgctcca

SEQ ID NO: 3189661 - DNA, 12 bp, Homo sapiens
gtcctgctccag

SEQ ID NO: 3189662 - DNA, 19 bp, Homo sapiens
gtcctggagcagaccaccc

SEQ ID NO: 3189663 - DNA, 17 bp, Homo sapiens
gtcctggatgttgtgtg

SEQ ID NO: 3189664 - DNA, 21 bp, Homo sapiens
gtcctggccagatggcccgga

SEQ ID NO: 3189665 - DNA, 11 bp, Homo sapiens
gtcctggctcc

SEQ ID NO: 3189666 - DNA, 17 bp, Homo sapiens
gtcctggctcctgaggg

SEQ ID NO: 3189667 - DNA, 19 bp, Homo sapiens
gtcctggctcctgaggggc

SEQ ID NO: 3189668 - DNA, 17 bp, Homo sapiens
gtcctgggagacccatg

SEQ ID NO: 3189669 - DNA, 17 bp, Homo sapiens
gtcctgggagtgagctg

SEQ ID NO: 3189670 - DNA, 16 bp, Homo sapiens
gtcctggggctctgtg

SEQ ID NO: 3189671 - DNA, 18 bp, Homo sapiens
gtcctggtccctctgagg

SEQ ID NO: 3189672 - DNA, 16 bp, Homo sapiens
gtcctggtgtcactta

SEQ ID NO: 3189673 - DNA, 11 bp, Homo sapiens
gtcctgtccca

SEQ ID NO: 3189674 - DNA, 12 bp, Homo sapiens
gtcctgtcccag

SEQ ID NO: 3189675 - DNA, 14 bp, Homo sapiens
gtcctgtcccagag

SEQ ID NO: 3189676 - DNA, 18 bp, Homo sapiens
gtcctgtgaatgccactg

SEQ ID NO: 3189677 - DNA, 16 bp, Homo sapiens
gtcctgtggcaggcag

SEQ ID NO: 3189678 - DNA, 18 bp, Homo sapiens
gtccttaggcctctgaga

SEQ ID NO: 3189679 - DNA, 13 bp, Homo sapiens
gtccttcaaaggc

SEQ ID NO: 3189680 - DNA, 14 bp, Homo sapiens
gtccttccaggccc

SEQ ID NO: 3189681 - DNA, 22 bp, Homo sapiens
gtccttccctcaaagaggcctt

SEQ ID NO: 3189682 - DNA, 20 bp, Homo sapiens
gtccttccctgttctccctt

SEQ ID NO: 3189683 - DNA, 17 bp, Homo sapiens
gtcgaattaatagcttt

SEQ ID NO: 3189684 - DNA, 14 bp, Homo sapiens
gtcgaggggctctc

SEQ ID NO: 3189685 - DNA, 19 bp, Homo sapiens
gtcgaggggctctcagctc

SEQ ID NO: 3189686 - DNA, 19 bp, Homo sapiens
gtcgcaggatccgctgcca

SEQ ID NO: 3189687 - DNA, 21 bp, Homo sapiens
gtcgcaggatccgctgccacc

SEQ ID NO: 3189688 - DNA, 18 bp, Homo sapiens
gtcgccccaggccctccc

SEQ ID NO: 3189689 - DNA, 12 bp, Homo sapiens
gtcgcctctgca

SEQ ID NO: 3189690 - DNA, 17 bp, Homo sapiens
gtcgccttagcatgttt

SEQ ID NO: 3189691 - DNA, 20 bp, Homo sapiens
gtcgccttagcatgtttgct

SEQ ID NO: 3189692 - DNA, 18 bp, Homo sapiens
gtcgctctgctggcctgg

SEQ ID NO: 3189693 - DNA, 13 bp, Homo sapiens
gtcggaaaagcgt

SEQ ID NO: 3189694 - DNA, 15 bp, Homo sapiens
gtcggaacagcagat

SEQ ID NO: 3189695 - DNA, 17 bp, Homo sapiens
gtcggctgaccatgctc

SEQ ID NO: 3189696 - DNA, 18 bp, Homo sapiens
gtcgggcaccagccagcg

SEQ ID NO: 3189697 - DNA, 14 bp, Homo sapiens
gtcgggcagccagc

SEQ ID NO: 3189698 - DNA, 15 bp, Homo sapiens
gtcgggcagccagca

SEQ ID NO: 3189699 - DNA, 18 bp, Homo sapiens
gtcgggggctgaggggca

SEQ ID NO: 3189700 - DNA, 19 bp, Homo sapiens
gtcgtcgcacagtctctct

SEQ ID NO: 3189701 - DNA, 11 bp, Homo sapiens
gtcgtctgtga

SEQ ID NO: 3189702 - DNA, 13 bp, Homo sapiens
gtcgtctgtgaat

SEQ ID NO: 3189703 - DNA, 17 bp, Homo sapiens
gtcgtctgtgaatgcta

SEQ ID NO: 3189704 - DNA, 18 bp, Homo sapiens
gtcgtctgtgaatgctaa

SEQ ID NO: 3189705 - DNA, 22 bp, Homo sapiens
gtcgtggcagataatcagcctc

SEQ ID NO: 3189706 - DNA, 17 bp, Homo sapiens
gtcgtggggtgtgctgg

SEQ ID NO: 3189707 - DNA, 21 bp, Homo sapiens
gtcgtggggtgtgctgggagc

SEQ ID NO: 3189708 - DNA, 15 bp, Homo sapiens
gtcgtggttcttaaa

SEQ ID NO: 3189709 - DNA, 20 bp, Homo sapiens
gtcgtggttcttaaatgttt

SEQ ID NO: 3189710 - DNA, 17 bp, Homo sapiens
gtcgttttccaaactga

SEQ ID NO: 3189711 - DNA, 22 bp, Homo sapiens
gtctaaagatggagtttctaag

SEQ ID NO: 3189712 - DNA, 15 bp, Homo sapiens
gtctaaatgctgaaa

SEQ ID NO: 3189713 - DNA, 13 bp, Homo sapiens
gtctaaatttgaa

SEQ ID NO: 3189714 - DNA, 23 bp, Homo sapiens
gtctaacacaccactttctgctt

SEQ ID NO: 3189715 - DNA, 15 bp, Homo sapiens
gtctacaaatataag

SEQ ID NO: 3189716 - DNA, 20 bp, Homo sapiens
gtctacaagtatatgtgaaa

SEQ ID NO: 3189717 - DNA, 21 bp, Homo sapiens
gtctaccaccgaatccctagt

SEQ ID NO: 3189718 - DNA, 13 bp, Homo sapiens
gtctacctctgac

SEQ ID NO: 3189719 - DNA, 16 bp, Homo sapiens
gtctacctgctggaca

SEQ ID NO: 3189720 - DNA, 17 bp, Homo sapiens
gtctacctgctggacag

SEQ ID NO: 3189721 - DNA, 20 bp, Homo sapiens
gtctacctgctggacagcct

SEQ ID NO: 3189722 - DNA, 21 bp, Homo sapiens
gtctagaaatgcggtctggtc

SEQ ID NO: 3189723 - DNA, 20 bp, Homo sapiens
gtctagagtcatgtgagcct

SEQ ID NO: 3189724 - DNA, 14 bp, Homo sapiens
gtctagagttgatg

SEQ ID NO: 3189725 - DNA, 22 bp, Homo sapiens
gtctagatgtttattcttctag

SEQ ID NO: 3189726 - DNA, 19 bp, Homo sapiens
gtctagattcaaaggttct

SEQ ID NO: 3189727 - DNA, 22 bp, Homo sapiens
gtctagattcaaaggttctagg

SEQ ID NO: 3189728 - DNA, 17 bp, Homo sapiens
gtctaggattgggcctc

SEQ ID NO: 3189729 - DNA, 16 bp, Homo sapiens
gtctagggcacaaaga

SEQ ID NO: 3189730 - DNA, 21 bp, Homo sapiens
gtctataatcccagcactttg

SEQ ID NO: 3189731 - DNA, 18 bp, Homo sapiens
gtctatagagaaaaactt

SEQ ID NO: 3189732 - DNA, 15 bp, Homo sapiens
gtctatccacagaga

SEQ ID NO: 3189733 - DNA, 9 bp, Homo sapiens
gtctatgaa

SEQ ID NO: 3189734 - DNA, 15 bp, Homo sapiens
gtctatgaagttgct

SEQ ID NO: 3189735 - DNA, 20 bp, Homo sapiens
gtctatgaagttgctgttta

SEQ ID NO: 3189736 - DNA, 22 bp, Homo sapiens
gtctatgaagttgctgtttatt

SEQ ID NO: 3189737 - DNA, 17 bp, Homo sapiens
gtctatgattgtacttt

SEQ ID NO: 3189738 - DNA, 16 bp, Homo sapiens
gtctatgcagcctgct

SEQ ID NO: 3189739 - DNA, 13 bp, Homo sapiens
gtctattcagctt

SEQ ID NO: 3189740 - DNA, 14 bp, Homo sapiens
gtctattctgagcc

SEQ ID NO: 3189741 - DNA, 16 bp, Homo sapiens
gtctattctgagcctt

SEQ ID NO: 3189742 - DNA, 17 bp, Homo sapiens
gtctattctgagccttg

SEQ ID NO: 3189743 - DNA, 18 bp, Homo sapiens
gtctattctgagccttga

SEQ ID NO: 3189744 - DNA, 12 bp, Homo sapiens
gtctatttaagc

SEQ ID NO: 3189745 - DNA, 11 bp, Homo sapiens
gtctattttaa

SEQ ID NO: 3189746 - DNA, 16 bp, Homo sapiens
gtctattttaaaataa

SEQ ID NO: 3189747 - DNA, 12 bp, Homo sapiens
gtctattttatt

SEQ ID NO: 3189748 - DNA, 16 bp, Homo sapiens
gtctatttttgtctta

SEQ ID NO: 3189749 - DNA, 14 bp, Homo sapiens
gtctcaaaaaaaca

SEQ ID NO: 3189750 - DNA, 16 bp, Homo sapiens
gtctcaaaaatacaaa

SEQ ID NO: 3189751 - DNA, 22 bp, Homo sapiens
gtctcaaactcttgacctcagg

SEQ ID NO: 3189752 - DNA, 15 bp, Homo sapiens
gtctcaagagggcac

SEQ ID NO: 3189753 - DNA, 19 bp, Homo sapiens
gtctcactatgttgcccag

SEQ ID NO: 3189754 - DNA, 16 bp, Homo sapiens
gtctcactctgtcgcc

SEQ ID NO: 3189755 - DNA, 18 bp, Homo sapiens
gtctcactctgtcgccca

SEQ ID NO: 3189756 - DNA, 19 bp, Homo sapiens
gtctcactctgtcgcccag

SEQ ID NO: 3189757 - DNA, 23 bp, Homo sapiens
gtctcactgtgggaaggccagct

SEQ ID NO: 3189758 - DNA, 13 bp, Homo sapiens
gtctcactgttct

SEQ ID NO: 3189759 - DNA, 15 bp, Homo sapiens
gtctcactgttctgc

SEQ ID NO: 3189760 - DNA, 16 bp, Homo sapiens
gtctcactgttctgca

SEQ ID NO: 3189761 - DNA, 16 bp, Homo sapiens
gtctcactgttgccca

SEQ ID NO: 3189762 - DNA, 17 bp, Homo sapiens
gtctcactgttgcccag

SEQ ID NO: 3189763 - DNA, 18 bp, Homo sapiens
gtctcactgttgcccagg

SEQ ID NO: 3189764 - DNA, 22 bp, Homo sapiens
gtctcactttttacccagaaca

SEQ ID NO: 3189765 - DNA, 11 bp, Homo sapiens
gtctcagaaga

SEQ ID NO: 3189766 - DNA, 23 bp, Homo sapiens
gtctcagacactaaatgcagaca

SEQ ID NO: 3189767 - DNA, 20 bp, Homo sapiens
gtctcagacttttgtacatc

SEQ ID NO: 3189768 - DNA, 18 bp, Homo sapiens
gtctcagatatcatactg

SEQ ID NO: 3189769 - DNA, 20 bp, Homo sapiens
gtctcaggtttgttttgtga

SEQ ID NO: 3189770 - DNA, 22 bp, Homo sapiens
gtctcaggtttgttttgtgaat

SEQ ID NO: 3189771 - DNA, 14 bp, Homo sapiens
gtctcatctcttca

SEQ ID NO: 3189772 - DNA, 14 bp, Homo sapiens
gtctcatcttctct

SEQ ID NO: 3189773 - DNA, 18 bp, Homo sapiens
gtctcatgtcctgctggc

SEQ ID NO: 3189774 - DNA, 20 bp, Homo sapiens
gtctcatgtcctgctggctt

SEQ ID NO: 3189775 - DNA, 17 bp, Homo sapiens
gtctcattcgcctttgt

SEQ ID NO: 3189776 - DNA, 18 bp, Homo sapiens
gtctcattcgcctttgtc

SEQ ID NO: 3189777 - DNA, 18 bp, Homo sapiens
gtctcattgcttctgact

SEQ ID NO: 3189778 - DNA, 18 bp, Homo sapiens
gtctccacctgagaccct

SEQ ID NO: 3189779 - DNA, 19 bp, Homo sapiens
gtctccactgtgcctttgc

SEQ ID NO: 3189780 - DNA, 18 bp, Homo sapiens
gtctccaggggcctgcag

SEQ ID NO: 3189781 - DNA, 15 bp, Homo sapiens
gtctccaggggctgc

SEQ ID NO: 3189782 - DNA, 16 bp, Homo sapiens
gtctccaggggctgct

SEQ ID NO: 3189783 - DNA, 19 bp, Homo sapiens
gtctccaggggctgcttcc

SEQ ID NO: 3189784 - DNA, 20 bp, Homo sapiens
gtctccaggggctgcttcct

SEQ ID NO: 3189785 - DNA, 13 bp, Homo sapiens
gtctccatgtttg

SEQ ID NO: 3189786 - DNA, 17 bp, Homo sapiens
gtctcccaggccccctg

SEQ ID NO: 3189787 - DNA, 19 bp, Homo sapiens
gtctcccaggccccctgca

SEQ ID NO: 3189788 - DNA, 20 bp, Homo sapiens
gtctcccagttatgaatcag

SEQ ID NO: 3189789 - DNA, 13 bp, Homo sapiens
gtctccccatccc

SEQ ID NO: 3189790 - DNA, 12 bp, Homo sapiens
gtctccctggct

SEQ ID NO: 3189791 - DNA, 15 bp, Homo sapiens
gtctccctggctccc

SEQ ID NO: 3189792 - DNA, 14 bp, Homo sapiens
gtctcccttctgtt

SEQ ID NO: 3189793 - DNA, 17 bp, Homo sapiens
gtctcctactcctgact

SEQ ID NO: 3189794 - DNA, 23 bp, Homo sapiens
gtctcctcaatttttgtctcaga

SEQ ID NO: 3189795 - DNA, 21 bp, Homo sapiens
gtctcctcactctgtccctgt

SEQ ID NO: 3189796 - DNA, 14 bp, Homo sapiens
gtctcctccccttc

SEQ ID NO: 3189797 - DNA, 23 bp, Homo sapiens
gtagagtttttatgcctttctct

SEQ ID NO: 3189798 - DNA, 12 bp, Homo sapiens
gtagatagaaat

SEQ ID NO: 3189799 - DNA, 13 bp, Homo sapiens
gtagatattactt

SEQ ID NO: 3189800 - DNA, 17 bp, Homo sapiens
gtagatattactttatc

SEQ ID NO: 3189801 - DNA, 18 bp, Homo sapiens
gtagatattactttatca

SEQ ID NO: 3189802 - DNA, 22 bp, Homo sapiens
gtagatccagatccagactgta

SEQ ID NO: 3189803 - DNA, 15 bp, Homo sapiens
gtagatcctgagatg

SEQ ID NO: 3189804 - DNA, 21 bp, Homo sapiens
gtagatctatattagatcaaa

SEQ ID NO: 3189805 - DNA, 22 bp, Homo sapiens
gtagatgggtgggggctcctgg

SEQ ID NO: 3189806 - DNA, 23 bp, Homo sapiens
gtagatgggtgggggctcctggt

SEQ ID NO: 3189807 - DNA, 21 bp, Homo sapiens
gtagatgtgcatttttgtgaa

SEQ ID NO: 3189808 - DNA, 15 bp, Homo sapiens
gtagattaggattaa

SEQ ID NO: 3189809 - DNA, 16 bp, Homo sapiens
gtagattctgtggaac

SEQ ID NO: 3189810 - DNA, 19 bp, Homo sapiens
gtagattctgtggaacaag

SEQ ID NO: 3189811 - DNA, 13 bp, Homo sapiens
gtagattgcagaa

SEQ ID NO: 3189812 - DNA, 14 bp, Homo sapiens
gtagattttccaaa

SEQ ID NO: 3189813 - DNA, 13 bp, Homo sapiens
gtagcacttactg

SEQ ID NO: 3189814 - DNA, 15 bp, Homo sapiens
gtagcagagttaaat

SEQ ID NO: 3189815 - DNA, 11 bp, Homo sapiens
gtagcagctgg

SEQ ID NO: 3189816 - DNA, 14 bp, Homo sapiens
gtagcagctggact

SEQ ID NO: 3189817 - DNA, 18 bp, Homo sapiens
gtagcataaataaaactg

SEQ ID NO: 3189818 - DNA, 12 bp, Homo sapiens
gtagcatgagag

SEQ ID NO: 3189819 - DNA, 20 bp, Homo sapiens
gtagcatgggtccaagagac

SEQ ID NO: 3189820 - DNA, 15 bp, Homo sapiens
gtagcatttcattct

SEQ ID NO: 3189821 - DNA, 14 bp, Homo sapiens
gtagccagcacctg

SEQ ID NO: 3189822 - DNA, 22 bp, Homo sapiens
gtagccagggggactagcccct

SEQ ID NO: 3189823 - DNA, 15 bp, Homo sapiens
gtagccatctgcaca

SEQ ID NO: 3189824 - DNA, 17 bp, Homo sapiens
gtagcccatccttccct

SEQ ID NO: 3189825 - DNA, 16 bp, Homo sapiens
gtagccccctggcctc

SEQ ID NO: 3189826 - DNA, 19 bp, Homo sapiens
gtagccccctggcctctgt

SEQ ID NO: 3189827 - DNA, 14 bp, Homo sapiens
gtagcctaaagggc

SEQ ID NO: 3189828 - DNA, 15 bp, Homo sapiens
gtagcctaaagggca

SEQ ID NO: 3189829 - DNA, 17 bp, Homo sapiens
gtagcctaaagggcagg

SEQ ID NO: 3189830 - DNA, 16 bp, Homo sapiens
gtagcctatgttgtgg

SEQ ID NO: 3189831 - DNA, 20 bp, Homo sapiens
gtagcctatttttttagatt

SEQ ID NO: 3189832 - DNA, 22 bp, Homo sapiens
gtagcctccgtttatgggcctt

SEQ ID NO: 3189833 - DNA, 15 bp, Homo sapiens
gtagccttgcccgga

SEQ ID NO: 3189834 - DNA, 22 bp, Homo sapiens
gtagctacctacatgctgaaaa

SEQ ID NO: 3189835 - DNA, 16 bp, Homo sapiens
gtagctatatctatat

SEQ ID NO: 3189836 - DNA, 12 bp, Homo sapiens
gtagctattttt

SEQ ID NO: 3189837 - DNA, 15 bp, Homo sapiens
gtagctatttttctt

SEQ ID NO: 3189838 - DNA, 15 bp, Homo sapiens
gtagctcaagtttaa

SEQ ID NO: 3189839 - DNA, 14 bp, Homo sapiens
gtagctctgcctcc

SEQ ID NO: 3189840 - DNA, 18 bp, Homo sapiens
gtagctgggactacaggc

SEQ ID NO: 3189841 - DNA, 16 bp, Homo sapiens
gtagctgtaaaacgct

SEQ ID NO: 3189842 - DNA, 16 bp, Homo sapiens
gtagctgtaagggcag

SEQ ID NO: 3189843 - DNA, 20 bp, Homo sapiens
gtagctgtaagggcagtgcc

SEQ ID NO: 3189844 - DNA, 16 bp, Homo sapiens
gtagctgtggcctcac

SEQ ID NO: 3189845 - DNA, 21 bp, Homo sapiens
gtagctgtggcctcaccctga

SEQ ID NO: 3189846 - DNA, 22 bp, Homo sapiens
gtagcttaccagaagcttccat

SEQ ID NO: 3189847 - DNA, 18 bp, Homo sapiens
gtagcttacctgacacaa

SEQ ID NO: 3189848 - DNA, 19 bp, Homo sapiens
gtagcttgctccctgtgtc

SEQ ID NO: 3189849 - DNA, 17 bp, Homo sapiens
gtagctttcccaaataa

SEQ ID NO: 3189850 - DNA, 19 bp, Homo sapiens
gtaggaaaaataaaaacag

SEQ ID NO: 3189851 - DNA, 18 bp, Homo sapiens
gtaggaaggttaatgttc

SEQ ID NO: 3189852 - DNA, 19 bp, Homo sapiens
gtaggaccaagcatcttgg

SEQ ID NO: 3189853 - DNA, 22 bp, Homo sapiens
gtaggagctgccttggctcaga

SEQ ID NO: 3189854 - DNA, 23 bp, Homo sapiens
gtaggagctgccttggctcagac

SEQ ID NO: 3189855 - DNA, 18 bp, Homo sapiens
gtaggcccttgtcctgcc

SEQ ID NO: 3189856 - DNA, 20 bp, Homo sapiens
gtaggcccttgtcctgccag

SEQ ID NO: 3189857 - DNA, 23 bp, Homo sapiens
gtaggcccttgtcctgccagctg

SEQ ID NO: 3189858 - DNA, 18 bp, Homo sapiens
gtaggccttttaacattt

SEQ ID NO: 3189859 - DNA, 19 bp, Homo sapiens
gtaggccttttaacatttt

SEQ ID NO: 3189860 - DNA, 23 bp, Homo sapiens
gtaggctcctgccagtgtggaac

SEQ ID NO: 3189861 - DNA, 14 bp, Homo sapiens
gtaggctggggcgg

SEQ ID NO: 3189862 - DNA, 15 bp, Homo sapiens
gtagggaactctggg

SEQ ID NO: 3189863 - DNA, 21 bp, Homo sapiens
gtagggaagaaaactatcctg

SEQ ID NO: 3189864 - DNA, 14 bp, Homo sapiens
gtagggaggcagcc

SEQ ID NO: 3189865 - DNA, 13 bp, Homo sapiens
gtagggagggcgg

SEQ ID NO: 3189866 - DNA, 18 bp, Homo sapiens
gtagggagtacctgctgc

SEQ ID NO: 3189867 - DNA, 21 bp, Homo sapiens
gtagggcgggaggatgttctg

SEQ ID NO: 3189868 - DNA, 23 bp, Homo sapiens
gtagggcgggaggatgttctggg

SEQ ID NO: 3189869 - DNA, 22 bp, Homo sapiens
gtaggggaggggttgccacagg

SEQ ID NO: 3189870 - DNA, 15 bp, Homo sapiens
gtaggggccacctcc

SEQ ID NO: 3189871 - DNA, 15 bp, Homo sapiens
gtagggtgggagtgg

SEQ ID NO: 3189872 - DNA, 14 bp, Homo sapiens
gtaggtaaaatgta

SEQ ID NO: 3189873 - DNA, 19 bp, Homo sapiens
gtaggttgggacaccaggg

SEQ ID NO: 3189874 - DNA, 19 bp, Homo sapiens
gtagtaaaagtcataaatg

SEQ ID NO: 3189875 - DNA, 24 bp, Homo sapiens
gtagtaatttattgtctgtctaca

SEQ ID NO: 3189876 - DNA, 22 bp, Homo sapiens
gtagtactcctgcaaaatttta

SEQ ID NO: 3189877 - DNA, 20 bp, Homo sapiens
gtagtagccctttctgtgtg

SEQ ID NO: 3189878 - DNA, 22 bp, Homo sapiens
gtagtagtctcattacttttga

SEQ ID NO: 3189879 - DNA, 14 bp, Homo sapiens
gtagtattaaaagt

SEQ ID NO: 3189880 - DNA, 14 bp, Homo sapiens
gtagtcaataaaac

SEQ ID NO: 3189881 - DNA, 12 bp, Homo sapiens
gtagtcctgtga

SEQ ID NO: 3189882 - DNA, 16 bp, Homo sapiens
gtagtcctttctgcct

SEQ ID NO: 3189883 - DNA, 20 bp, Homo sapiens
gtagtcctttctgccttggc

SEQ ID NO: 3189884 - DNA, 12 bp, Homo sapiens
gtagtctcctgg

SEQ ID NO: 3189885 - DNA, 12 bp, Homo sapiens
gtagtcttgatg

SEQ ID NO: 3189886 - DNA, 18 bp, Homo sapiens
gtagtggcttcttttgaa

SEQ ID NO: 3189887 - DNA, 13 bp, Homo sapiens
gtagttaggaaat

SEQ ID NO: 3189888 - DNA, 20 bp, Homo sapiens
gtagttaggaaataaaacct

SEQ ID NO: 3189889 - DNA, 16 bp, Homo sapiens
gtagttagtagcatgt

SEQ ID NO: 3189890 - DNA, 22 bp, Homo sapiens
gtagttgtattcttctgtattt

SEQ ID NO: 3189891 - DNA, 18 bp, Homo sapiens
gtagtttggatatttttg

SEQ ID NO: 3189892 - DNA, 20 bp, Homo sapiens
gtagtttttatatgttgtaa

SEQ ID NO: 3189893 - DNA, 19 bp, Homo sapiens
gtataaaactttcctcgcc

SEQ ID NO: 3189894 - DNA, 14 bp, Homo sapiens
gtataaacaaagtt

SEQ ID NO: 3189895 - DNA, 19 bp, Homo sapiens
gtattaaaggggggagggg

SEQ ID NO: 3189896 - DNA, 15 bp, Homo sapiens
gtattaaatcttaaa

SEQ ID NO: 3189897 - DNA, 12 bp, Homo sapiens
gtattaataaaa

SEQ ID NO: 3189898 - DNA, 14 bp, Homo sapiens
gtattaataaaaag

SEQ ID NO: 3189899 - DNA, 15 bp, Homo sapiens
gtattaatactaaaa

SEQ ID NO: 3189900 - DNA, 21 bp, Homo sapiens
gtattaatactaaaatatgtc

SEQ ID NO: 3189901 - DNA, 22 bp, Homo sapiens
gtattaatactaaaatatgtct

SEQ ID NO: 3189902 - DNA, 16 bp, Homo sapiens
gtattaatttagaatg

SEQ ID NO: 3189903 - DNA, 13 bp, Homo sapiens
gtattacttctgc

SEQ ID NO: 3189904 - DNA, 15 bp, Homo sapiens
gtattactttctctg

SEQ ID NO: 3189905 - DNA, 19 bp, Homo sapiens
gtattactttctctgtagt

SEQ ID NO: 3189906 - DNA, 13 bp, Homo sapiens
gtattagcaaagc

SEQ ID NO: 3189907 - DNA, 20 bp, Homo sapiens
gtattatcttgttcaggaaa

SEQ ID NO: 3189908 - DNA, 15 bp, Homo sapiens
gtattattctgcagc

SEQ ID NO: 3189909 - DNA, 16 bp, Homo sapiens
gtattattctgcagca

SEQ ID NO: 3189910 - DNA, 14 bp, Homo sapiens
gtattatttggagt

SEQ ID NO: 3189911 - DNA, 17 bp, Homo sapiens
gtattcccttgtatttt

SEQ ID NO: 3189912 - DNA, 22 bp, Homo sapiens
gtattcctgaaaagctgcattt

SEQ ID NO: 3189913 - DNA, 23 bp, Homo sapiens
gtattccttttgtgtacagtgtg

SEQ ID NO: 3189914 - DNA, 18 bp, Homo sapiens
gtattctagttttgtcaa

SEQ ID NO: 3189915 - DNA, 13 bp, Homo sapiens
gtattctcagagc

SEQ ID NO: 3189916 - DNA, 14 bp, Homo sapiens
gtattctcagagca

SEQ ID NO: 3189917 - DNA, 17 bp, Homo sapiens
gtattctgttctggagg

SEQ ID NO: 3189918 - DNA, 15 bp, Homo sapiens
gtattcttcaacctc

SEQ ID NO: 3189919 - DNA, 19 bp, Homo sapiens
gtattgaaaacttcaaagc

SEQ ID NO: 3189920 - DNA, 14 bp, Homo sapiens
gtattgaatattgt

SEQ ID NO: 3189921 - DNA, 13 bp, Homo sapiens
gtcactgtttctc

SEQ ID NO: 3189922 - DNA, 16 bp, Homo sapiens
gtcacttactgtttct

SEQ ID NO: 3189923 - DNA, 18 bp, Homo sapiens
gtcacttactgtttctgt

SEQ ID NO: 3189924 - DNA, 16 bp, Homo sapiens
gtcactttgctctggg

SEQ ID NO: 3189925 - DNA, 17 bp, Homo sapiens
gtcactttgctctgggt

SEQ ID NO: 3189926 - DNA, 23 bp, Homo sapiens
gtcactttgctctgggtggaagt

SEQ ID NO: 3189927 - DNA, 22 bp, Homo sapiens
gtcactttttttttttttcccc

SEQ ID NO: 3189928 - DNA, 15 bp, Homo sapiens
gtcagaaaacagaga

SEQ ID NO: 3189929 - DNA, 23 bp, Homo sapiens
gtcagaaaattggcagtggcaga

SEQ ID NO: 3189930 - DNA, 18 bp, Homo sapiens
gtcagaaaccctggtctc

SEQ ID NO: 3189931 - DNA, 12 bp, Homo sapiens
gtcagaacatgt

SEQ ID NO: 3189932 - DNA, 15 bp, Homo sapiens
gtcagacagatgtca

SEQ ID NO: 3189933 - DNA, 20 bp, Homo sapiens
gtcagacagatgtcagcttc

SEQ ID NO: 3189934 - DNA, 21 bp, Homo sapiens
gtcagacagatgtcagcttcc

SEQ ID NO: 3189935 - DNA, 16 bp, Homo sapiens
gtcagacagcaaggaa

SEQ ID NO: 3189936 - DNA, 14 bp, Homo sapiens
gtcagacataaagc

SEQ ID NO: 3189937 - DNA, 20 bp, Homo sapiens
gtcagacataaagccatgtt

SEQ ID NO: 3189938 - DNA, 20 bp, Homo sapiens
gtcagacatccatgtttgta

SEQ ID NO: 3189939 - DNA, 14 bp, Homo sapiens
gtcagactgctggg

SEQ ID NO: 3189940 - DNA, 18 bp, Homo sapiens
gtcagactggctggctgc

SEQ ID NO: 3189941 - DNA, 16 bp, Homo sapiens
gtcagagccctggctg

SEQ ID NO: 3189942 - DNA, 17 bp, Homo sapiens
gtcagagccctggctgg

SEQ ID NO: 3189943 - DNA, 22 bp, Homo sapiens
gtcagagccctggctgggttca

SEQ ID NO: 3189944 - DNA, 14 bp, Homo sapiens
gtcagagcctgcag

SEQ ID NO: 3189945 - DNA, 23 bp, Homo sapiens
gtcagaggagtgattgaaccagc

SEQ ID NO: 3189946 - DNA, 16 bp, Homo sapiens
gtcagaggatggccag

SEQ ID NO: 3189947 - DNA, 19 bp, Homo sapiens
gtcagaggatggccagtgt

SEQ ID NO: 3189948 - DNA, 21 bp, Homo sapiens
gtcagaggatggccagtgtct

SEQ ID NO: 3189949 - DNA, 15 bp, Homo sapiens
gtcagatgagaacaa

SEQ ID NO: 3189950 - DNA, 16 bp, Homo sapiens
gtcagatgagaacaaa

SEQ ID NO: 3189951 - DNA, 21 bp, Homo sapiens
gtcagatgagaacaaagctgt

SEQ ID NO: 3189952 - DNA, 12 bp, Homo sapiens
gtcagattaaat

SEQ ID NO: 3189953 - DNA, 12 bp, Homo sapiens
gtcagattcctt

SEQ ID NO: 3189954 - DNA, 16 bp, Homo sapiens
gtcagattcctttccc

SEQ ID NO: 3189955 - DNA, 19 bp, Homo sapiens
gtcagatttttaaagtttt

SEQ ID NO: 3189956 - DNA, 21 bp, Homo sapiens
gtcagatttttaaagttttgt

SEQ ID NO: 3189957 - DNA, 15 bp, Homo sapiens
gtcagcagcagctct

SEQ ID NO: 3189958 - DNA, 21 bp, Homo sapiens
gtcagcagcagctctgagcca

SEQ ID NO: 3189959 - DNA, 22 bp, Homo sapiens
gtcagcagcagctctgagccag

SEQ ID NO: 3189960 - DNA, 18 bp, Homo sapiens
gtcagcatgcttcccaga

SEQ ID NO: 3189961 - DNA, 12 bp, Homo sapiens
gtcagccagccg

SEQ ID NO: 3189962 - DNA, 20 bp, Homo sapiens
gtcagccaggagctgtcacc

SEQ ID NO: 3189963 - DNA, 18 bp, Homo sapiens
gtcagccatcgtcctggg

SEQ ID NO: 3189964 - DNA, 16 bp, Homo sapiens
gtcagccgagccgggc

SEQ ID NO: 3189965 - DNA, 14 bp, Homo sapiens
gtcagcctgtgctg

SEQ ID NO: 3189966 - DNA, 22 bp, Homo sapiens
gtcagcctgtgctgtggcatag

SEQ ID NO: 3189967 - DNA, 21 bp, Homo sapiens
gtcagcgttctaccaggcaaa

SEQ ID NO: 3189968 - DNA, 19 bp, Homo sapiens
gtcagcgttgcatgtcgtg

SEQ ID NO: 3189969 - DNA, 15 bp, Homo sapiens
gtcagctcccttctc

SEQ ID NO: 3189970 - DNA, 17 bp, Homo sapiens
gtcagctgctccctggc

SEQ ID NO: 3189971 - DNA, 20 bp, Homo sapiens
gtcagctgctccctggcatt

SEQ ID NO: 3189972 - DNA, 15 bp, Homo sapiens
gtcagcttcccagcc

SEQ ID NO: 3189973 - DNA, 19 bp, Homo sapiens
gtcagctttcagagccagt

SEQ ID NO: 3189974 - DNA, 19 bp, Homo sapiens
gtcaggaacagtggctggg

SEQ ID NO: 3189975 - DNA, 20 bp, Homo sapiens
gtcaggaacagtggctgggt

SEQ ID NO: 3189976 - DNA, 22 bp, Homo sapiens
gtcaggaacagtggctgggtgg

SEQ ID NO: 3189977 - DNA, 18 bp, Homo sapiens
gtcaggacaccagcctgg

SEQ ID NO: 3189978 - DNA, 21 bp, Homo sapiens
gtcaggagatcgagaccatcc

SEQ ID NO: 3189979 - DNA, 22 bp, Homo sapiens
gtcaggagttgtttctgaccca

SEQ ID NO: 3189980 - DNA, 11 bp, Homo sapiens
gtcaggccctg

SEQ ID NO: 3189981 - DNA, 13 bp, Homo sapiens
gtcaggccctgga

SEQ ID NO: 3189982 - DNA, 13 bp, Homo sapiens
gtcaggcctgtgt

SEQ ID NO: 3189983 - DNA, 23 bp, Homo sapiens
gtcaggcctgtgtgtgaaaggaa

SEQ ID NO: 3189984 - DNA, 16 bp, Homo sapiens
gtcaggctctggccct

SEQ ID NO: 3189985 - DNA, 20 bp, Homo sapiens
gtcaggctgggcagccccag

SEQ ID NO: 3189986 - DNA, 23 bp, Homo sapiens
gtcaggctgggcagccccagaga

SEQ ID NO: 3189987 - DNA, 14 bp, Homo sapiens
gtcagggacttgga

SEQ ID NO: 3189988 - DNA, 16 bp, Homo sapiens
gtcagggccagactgg

SEQ ID NO: 3189989 - DNA, 12 bp, Homo sapiens
gtcagggcccaa

SEQ ID NO: 3189990 - DNA, 15 bp, Homo sapiens
gtcagggcccaagtc

SEQ ID NO: 3189991 - DNA, 21 bp, Homo sapiens
gtcagggcccagaggctgagt

SEQ ID NO: 3189992 - DNA, 19 bp, Homo sapiens
gtcaggttatactcctcct

SEQ ID NO: 3189993 - DNA, 17 bp, Homo sapiens
gtcagtaggtccaaggg

SEQ ID NO: 3189994 - DNA, 19 bp, Homo sapiens
gtcagtaggtccaagggcc

SEQ ID NO: 3189995 - DNA, 21 bp, Homo sapiens
gtcagtaggtccaagggccat

SEQ ID NO: 3189996 - DNA, 21 bp, Homo sapiens
gtcagtatctgtatctctctc

SEQ ID NO: 3189997 - DNA, 16 bp, Homo sapiens
gtcagtatttcaactg

SEQ ID NO: 3189998 - DNA, 18 bp, Homo sapiens
gtcagtatttcaactgct

SEQ ID NO: 3189999 - DNA, 17 bp, Homo sapiens
gtcagtctctttctgta

SEQ ID NO: 3190000 - DNA, 16 bp, Homo sapiens
gtcagtctttttctgt

SEQ ID NO: 3190001 - DNA, 17 bp, Homo sapiens
gtcagtctttttctgtt

SEQ ID NO: 3190002 - DNA, 16 bp, Homo sapiens
gtcagtgcagcagagg

SEQ ID NO: 3190003 - DNA, 21 bp, Homo sapiens
gtcagtgtacacgtctggacc

SEQ ID NO: 3190004 - DNA, 15 bp, Homo sapiens
gtcagtgtggagagg

SEQ ID NO: 3190005 - DNA, 19 bp, Homo sapiens
gtcagtgttaaagattttg

SEQ ID NO: 3190006 - DNA, 19 bp, Homo sapiens
gtcagttcccggagcacag

SEQ ID NO: 3190007 - DNA, 15 bp, Homo sapiens
gtcagttcttggtgc

SEQ ID NO: 3190008 - DNA, 20 bp, Homo sapiens
gtcatcatcagggcctgggg

SEQ ID NO: 3190009 - DNA, 21 bp, Homo sapiens
gtcatcatcagggcctggggc

SEQ ID NO: 3190010 - DNA, 19 bp, Homo sapiens
gtcatctccatcagctgta

SEQ ID NO: 3190011 - DNA, 23 bp, Homo sapiens
gtcatctctctggggccctgggc

SEQ ID NO: 3190012 - DNA, 13 bp, Homo sapiens
gtcatctgtttaa

SEQ ID NO: 3190013 - DNA, 18 bp, Homo sapiens
gtcatcttgctaccagta

SEQ ID NO: 3190014 - DNA, 19 bp, Homo sapiens
gtcatgcagttcctggccc

SEQ ID NO: 3190015 - DNA, 19 bp, Homo sapiens
gtcatgcataaatatgcag

SEQ ID NO: 3190016 - DNA, 21 bp, Homo sapiens
gtcatggagaatctgctgcat

SEQ ID NO: 3190017 - DNA, 20 bp, Homo sapiens
gtcatggggatcaattttca

SEQ ID NO: 3190018 - DNA, 14 bp, Homo sapiens
gtcatgtgtgaaca

SEQ ID NO: 3190019 - DNA, 16 bp, Homo sapiens
gtcatgttgaaggtgc

SEQ ID NO: 3190020 - DNA, 22 bp, Homo sapiens
gtcattacaaaaaaacacgtgg

SEQ ID NO: 3190021 - DNA, 13 bp, Homo sapiens
gtcattatattct

SEQ ID NO: 3190022 - DNA, 15 bp, Homo sapiens
gtcattatattctaa

SEQ ID NO: 3190023 - DNA, 20 bp, Homo sapiens
gtcattatattctaattaaa

SEQ ID NO: 3190024 - DNA, 23 bp, Homo sapiens
gtcattatattctaattaaaatt

SEQ ID NO: 3190025 - DNA, 16 bp, Homo sapiens
gtcattgacctctcag

SEQ ID NO: 3190026 - DNA, 21 bp, Homo sapiens
ggtggaggttgcagtgagcca

SEQ ID NO: 3190027 - DNA, 16 bp, Homo sapiens
ggtggagtgagactga

SEQ ID NO: 3190028 - DNA, 16 bp, Homo sapiens
ggtggatcacctgagg

SEQ ID NO: 3190029 - DNA, 13 bp, Homo sapiens
ggtggatgcctgg

SEQ ID NO: 3190030 - DNA, 17 bp, Homo sapiens
ggtggcaatgcttaaac

SEQ ID NO: 3190031 - DNA, 15 bp, Homo sapiens
ggtggcactgagccc

SEQ ID NO: 3190032 - DNA, 20 bp, Homo sapiens
ggtggcactgagccccccca

SEQ ID NO: 3190033 - DNA, 16 bp, Homo sapiens
ggtggcactttttcat

SEQ ID NO: 3190034 - DNA, 18 bp, Homo sapiens
ggtggcagccctgtaggg

SEQ ID NO: 3190035 - DNA, 12 bp, Homo sapiens
ggtggcagctgc

SEQ ID NO: 3190036 - DNA, 13 bp, Homo sapiens
ggtggcagctgcg

SEQ ID NO: 3190037 - DNA, 21 bp, Homo sapiens
ggtggcaggcacacagcagcc

SEQ ID NO: 3190038 - DNA, 16 bp, Homo sapiens
ggtggcagtgggagct

SEQ ID NO: 3190039 - DNA, 19 bp, Homo sapiens
ggtggcagtgggagctgcc

SEQ ID NO: 3190040 - DNA, 19 bp, Homo sapiens
ggtggcatgtgcctatagt

SEQ ID NO: 3190041 - DNA, 14 bp, Homo sapiens
ggtggccatccctg

SEQ ID NO: 3190042 - DNA, 21 bp, Homo sapiens
ggtggccatccctgggcccct

SEQ ID NO: 3190043 - DNA, 22 bp, Homo sapiens
ggtggccatccctgggcccctc

SEQ ID NO: 3190044 - DNA, 19 bp, Homo sapiens
ggtggcccgacagcctggc

SEQ ID NO: 3190045 - DNA, 23 bp, Homo sapiens
ggtggccctgtccctcccacctc

SEQ ID NO: 3190046 - DNA, 22 bp, Homo sapiens
ggtggcctcgggacacctgccc

SEQ ID NO: 3190047 - DNA, 20 bp, Homo sapiens
ggtggccttctgctgcccag

SEQ ID NO: 3190048 - DNA, 19 bp, Homo sapiens
ggtggcggcagggccaggc

SEQ ID NO: 3190049 - DNA, 22 bp, Homo sapiens
ggtggctggagacgggtgggcg

SEQ ID NO: 3190050 - DNA, 18 bp, Homo sapiens
ggtggctgggactcctgg

SEQ ID NO: 3190051 - DNA, 11 bp, Homo sapiens
ggtggctgggc

SEQ ID NO: 3190052 - DNA, 23 bp, Homo sapiens
ggtggctttccttgtggcagagg

SEQ ID NO: 3190053 - DNA, 15 bp, Homo sapiens
ggtgggaagaaagaa

SEQ ID NO: 3190054 - DNA, 15 bp, Homo sapiens
ggtgggacagcctct

SEQ ID NO: 3190055 - DNA, 16 bp, Homo sapiens
ggtgggagcaggagat

SEQ ID NO: 3190056 - DNA, 12 bp, Homo sapiens
ggtgggcagctg

SEQ ID NO: 3190057 - DNA, 14 bp, Homo sapiens
ggtgggcccagaac

SEQ ID NO: 3190058 - DNA, 17 bp, Homo sapiens
ggtgggcccaggaccag

SEQ ID NO: 3190059 - DNA, 18 bp, Homo sapiens
ggtgggcccaggaccagc

SEQ ID NO: 3190060 - DNA, 15 bp, Homo sapiens
ggtgggcctggcctg

SEQ ID NO: 3190061 - DNA, 16 bp, Homo sapiens
ggtgggcctggcctga

SEQ ID NO: 3190062 - DNA, 19 bp, Homo sapiens
ggtgggcctggcctgagct

SEQ ID NO: 3190063 - DNA, 13 bp, Homo sapiens
ggtgggctgagcc

SEQ ID NO: 3190064 - DNA, 18 bp, Homo sapiens
ggtgggctgatttacatg

SEQ ID NO: 3190065 - DNA, 16 bp, Homo sapiens
ggtgggctggtatctc

SEQ ID NO: 3190066 - DNA, 14 bp, Homo sapiens
ggtggggaggggcg

SEQ ID NO: 3190067 - DNA, 17 bp, Homo sapiens
ggtggggcagcttgagg

SEQ ID NO: 3190068 - DNA, 17 bp, Homo sapiens
ggtggggccaggccagg

SEQ ID NO: 3190069 - DNA, 12 bp, Homo sapiens
ggtgggggagga

SEQ ID NO: 3190070 - DNA, 15 bp, Homo sapiens
ggttccatgcctgag

SEQ ID NO: 3190071 - DNA, 14 bp, Homo sapiens
ggttccccaagggc

SEQ ID NO: 3190072 - DNA, 19 bp, Homo sapiens
ggttccccaagggccctgg

SEQ ID NO: 3190073 - DNA, 20 bp, Homo sapiens
ggttccccaagggccctggc

SEQ ID NO: 3190074 - DNA, 18 bp, Homo sapiens
ggttccctgttcttcctc

SEQ ID NO: 3190075 - DNA, 22 bp, Homo sapiens
ggttccctttccttccatccct

SEQ ID NO: 3190076 - DNA, 22 bp, Homo sapiens
ggttcctatggctggccactgc

SEQ ID NO: 3190077 - DNA, 13 bp, Homo sapiens
ggttcctctctgg

SEQ ID NO: 3190078 - DNA, 18 bp, Homo sapiens
ggttcctgactggcaaag

SEQ ID NO: 3190079 - DNA, 18 bp, Homo sapiens
ggttcctggtgactcctg

SEQ ID NO: 3190080 - DNA, 15 bp, Homo sapiens
ggttccttccctggg

SEQ ID NO: 3190081 - DNA, 12 bp, Homo sapiens
ggttctaaagtt

SEQ ID NO: 3190082 - DNA, 22 bp, Homo sapiens
ggttctaaagttctaagattct

SEQ ID NO: 3190083 - DNA, 17 bp, Homo sapiens
ggttctaatattcacat

SEQ ID NO: 3190084 - DNA, 23 bp, Homo sapiens
ggttctacagccttgtccccctc

SEQ ID NO: 3190085 - DNA, 21 bp, Homo sapiens
ggttctaggcatctctgtact

SEQ ID NO: 3190086 - DNA, 15 bp, Homo sapiens
ggttctaggtttcaa

SEQ ID NO: 3190087 - DNA, 12 bp, Homo sapiens
ggttctatttta

SEQ ID NO: 3190088 - DNA, 13 bp, Homo sapiens
ggttctattttct

SEQ ID NO: 3190089 - DNA, 18 bp, Homo sapiens
ggttctcaggtgttgcca

SEQ ID NO: 3190090 - DNA, 21 bp, Homo sapiens
ggttctccgttagctcctgtg

SEQ ID NO: 3190091 - DNA, 17 bp, Homo sapiens
ggttcttaaaaaggaac

SEQ ID NO: 3190092 - DNA, 13 bp, Homo sapiens
ggttcttcctcac

SEQ ID NO: 3190093 - DNA, 17 bp, Homo sapiens
ggttctttcttcctctg

SEQ ID NO: 3190094 - DNA, 18 bp, Homo sapiens
ggttgaaaatgtgtttgc

SEQ ID NO: 3190095 - DNA, 16 bp, Homo sapiens
ggttgaaggcagtctg

SEQ ID NO: 3190096 - DNA, 21 bp, Homo sapiens
ggttgaaggcagtctgaaccc

SEQ ID NO: 3190097 - DNA, 15 bp, Homo sapiens
ggttgaatatagcct

SEQ ID NO: 3190098 - DNA, 17 bp, Homo sapiens
ggttgaatatagcctgc

SEQ ID NO: 3190099 - DNA, 18 bp, Homo sapiens
ggttgaatatagcctgcc

SEQ ID NO: 3190100 - DNA, 22 bp, Homo sapiens
ggttgacaccattctcctgcct

SEQ ID NO: 3190101 - DNA, 13 bp, Homo sapiens
ggttgagaaatga

SEQ ID NO: 3190102 - DNA, 20 bp, Homo sapiens
ggttgagttacattaaaata

SEQ ID NO: 3190103 - DNA, 13 bp, Homo sapiens
ggttgcagggagc

SEQ ID NO: 3190104 - DNA, 16 bp, Homo sapiens
ggttgctcacagctgt

SEQ ID NO: 3190105 - DNA, 18 bp, Homo sapiens
ggttgctggttgctgtgt

SEQ ID NO: 3190106 - DNA, 16 bp, Homo sapiens
ggttggacagccccct

SEQ ID NO: 3190107 - DNA, 15 bp, Homo sapiens
ggttggcaccccagc

SEQ ID NO: 3190108 - DNA, 14 bp, Homo sapiens
ggttggcagtaagg

SEQ ID NO: 3190109 - DNA, 16 bp, Homo sapiens
ggttggtagggtggga

SEQ ID NO: 3190110 - DNA, 17 bp, Homo sapiens
ggttggtgcacagtgat

SEQ ID NO: 3190111 - DNA, 16 bp, Homo sapiens
ggttgtatttctatat

SEQ ID NO: 3190112 - DNA, 13 bp, Homo sapiens
ggttgtctccagg

SEQ ID NO: 3190113 - DNA, 20 bp, Homo sapiens
ggtttaaacttgtttgctgt

SEQ ID NO: 3190114 - DNA, 20 bp, Homo sapiens
ggtttaaagagtctagattc

SEQ ID NO: 3190115 - DNA, 22 bp, Homo sapiens
ggtttaaagagtctagattcaa

SEQ ID NO: 3190116 - DNA, 15 bp, Homo sapiens
ggtttacccagtggg

SEQ ID NO: 3190117 - DNA, 17 bp, Homo sapiens
ggtttacctagagaaca

SEQ ID NO: 3190118 - DNA, 17 bp, Homo sapiens
ggtttactttcaaaaga

SEQ ID NO: 3190119 - DNA, 20 bp, Homo sapiens
ggtttcaaagatgctgtgag

SEQ ID NO: 3190120 - DNA, 17 bp, Homo sapiens
ggtttcaagaaaatctt

SEQ ID NO: 3190121 - DNA, 22 bp, Homo sapiens
ggtttcacccttaacccaagga

SEQ ID NO: 3190122 - DNA, 23 bp, Homo sapiens
ggtttcagttctgtgtacatttt

SEQ ID NO: 3190123 - DNA, 11 bp, Homo sapiens
ggtttcctgca

SEQ ID NO: 3190124 - DNA, 13 bp, Homo sapiens
ggtttcctgcagg

SEQ ID NO: 3190125 - DNA, 15 bp, Homo sapiens
ggtttccttttggaa

SEQ ID NO: 3190126 - DNA, 18 bp, Homo sapiens
ggtttctagatcactgtg

SEQ ID NO: 3190127 - DNA, 15 bp, Homo sapiens
ggtttctctctacag

SEQ ID NO: 3190128 - DNA, 20 bp, Homo sapiens
ggtttctctctacagtgcca

SEQ ID NO: 3190129 - DNA, 12 bp, Homo sapiens
ggtttggacccc

SEQ ID NO: 3190130 - DNA, 19 bp, Homo sapiens
ggtttggaccccagctggg

SEQ ID NO: 3190131 - DNA, 22 bp, Homo sapiens
ggtttggcaagaacttgtttac

SEQ ID NO: 3190132 - DNA, 19 bp, Homo sapiens
ggtttgggcccctcagagc

SEQ ID NO: 3190133 - DNA, 15 bp, Homo sapiens
ggtttggtctgggac

SEQ ID NO: 3190134 - DNA, 23 bp, Homo sapiens
ggtttgtcgggcaccagccagcg

SEQ ID NO: 3190135 - DNA, 17 bp, Homo sapiens
ggttttaggtagaaaaa

SEQ ID NO: 3190136 - DNA, 15 bp, Homo sapiens
ggttttaggttctaa

SEQ ID NO: 3190137 - DNA, 17 bp, Homo sapiens
ggttttataaggctgat

SEQ ID NO: 3190138 - DNA, 13 bp, Homo sapiens
ggttttccacgct

SEQ ID NO: 3190139 - DNA, 15 bp, Homo sapiens
ggttttctgggtgtc

SEQ ID NO: 3190140 - DNA, 20 bp, Homo sapiens
ggttttgccccaagtcctca

SEQ ID NO: 3190141 - DNA, 19 bp, Homo sapiens
ggttttgctattagactgt

SEQ ID NO: 3190142 - DNA, 17 bp, Homo sapiens
ggttttgtaagatgctg

SEQ ID NO: 3190143 - DNA, 18 bp, Homo sapiens
ggttttgtacactgctgt

SEQ ID NO: 3190144 - DNA, 19 bp, Homo sapiens
ggttttgtacactgctgta

SEQ ID NO: 3190145 - DNA, 15 bp, Homo sapiens
ggttttgtattcttt

SEQ ID NO: 3190146 - DNA, 13 bp, Homo sapiens
ggttttgtatttt

SEQ ID NO: 3190147 - DNA, 15 bp, Homo sapiens
ggtttttattagtac

SEQ ID NO: 3190148 - DNA, 13 bp, Homo sapiens
ggtttttgctctc

SEQ ID NO: 3190149 - DNA, 22 bp, Homo sapiens
ggttttttttcagttgttcttt

SEQ ID NO: 3190150 - DNA, 19 bp, Homo sapiens
gtaaaaaaaaatgcctttg

SEQ ID NO: 3190151 - DNA, 11 bp, Homo sapiens
gtaaaaaaagc

SEQ ID NO: 3190152 - DNA, 21 bp, Homo sapiens
gtaaaaacagcattgctttct

SEQ ID NO: 3190153 - DNA, 23 bp, Homo sapiens
gtaaaaacagcattgctttctga

SEQ ID NO: 3190154 - DNA, 12 bp, Homo sapiens
gtaaaaagaaaa

SEQ ID NO: 3190155 - DNA, 16 bp, Homo sapiens
gtaaaaatgctgctct

SEQ ID NO: 3190156 - DNA, 19 bp, Homo sapiens
gtaaaacgctgtcaaaagt

SEQ ID NO: 3190157 - DNA, 21 bp, Homo sapiens
gtaaaacgctgtcaaaagttg

SEQ ID NO: 3190158 - DNA, 17 bp, Homo sapiens
gtaaaactcgcttttat

SEQ ID NO: 3190159 - DNA, 17 bp, Homo sapiens
gtaaaagataacaagat

SEQ ID NO: 3190160 - DNA, 17 bp, Homo sapiens
gtaaaaggtattaaatt

SEQ ID NO: 3190161 - DNA, 18 bp, Homo sapiens
gtaaaatgtatttttcta

SEQ ID NO: 3190162 - DNA, 18 bp, Homo sapiens
gtaaaattataaactttt

SEQ ID NO: 3190163 - DNA, 17 bp, Homo sapiens
gtaaacaaaatttagtt

SEQ ID NO: 3190164 - DNA, 20 bp, Homo sapiens
gtaaacagaagcctgtttca

SEQ ID NO: 3190165 - DNA, 20 bp, Homo sapiens
gtaaacagatggcactttga

SEQ ID NO: 3190166 - DNA, 14 bp, Homo sapiens
gtaaaccagatctg

SEQ ID NO: 3190167 - DNA, 15 bp, Homo sapiens
gtaaactatttatct

SEQ ID NO: 3190168 - DNA, 21 bp, Homo sapiens
gtaaactcaaaacttaacata

SEQ ID NO: 3190169 - DNA, 20 bp, Homo sapiens
gtaaactgtatcaaatctgt

SEQ ID NO: 3190170 - DNA, 20 bp, Homo sapiens
gtaaactgtgtattccaaga

SEQ ID NO: 3190171 - DNA, 15 bp, Homo sapiens
gtaaagaaatttact

SEQ ID NO: 3190172 - DNA, 19 bp, Homo sapiens
gtaaagaaatttactatat

SEQ ID NO: 3190173 - DNA, 19 bp, Homo sapiens
gtaaagaacttaaattatg

SEQ ID NO: 3190174 - DNA, 20 bp, Homo sapiens
gtaaagaacttaaattatgt

SEQ ID NO: 3190175 - DNA, 12 bp, Homo sapiens
gtaaagaattta

SEQ ID NO: 3190176 - DNA, 16 bp, Homo sapiens
gtaaagactgtagaag

SEQ ID NO: 3190177 - DNA, 22 bp, Homo sapiens
gtaaagagacctacctcaggtt

SEQ ID NO: 3190178 - DNA, 12 bp, Homo sapiens
gtaaagctggcc

SEQ ID NO: 3190179 - DNA, 15 bp, Homo sapiens
gtaaaggcctcctcc

SEQ ID NO: 3190180 - DNA, 16 bp, Homo sapiens
gtaaaggcctcctccc

SEQ ID NO: 3190181 - DNA, 18 bp, Homo sapiens
gtaaaggcctcctccccc

SEQ ID NO: 3190182 - DNA, 15 bp, Homo sapiens
gtaaagggcaaataa

SEQ ID NO: 3190183 - DNA, 18 bp, Homo sapiens
gtaaagttacacttttat

SEQ ID NO: 3190184 - DNA, 17 bp, Homo sapiens
gtaaataaaagtacaaa

SEQ ID NO: 3190185 - DNA, 15 bp, Homo sapiens
gtaaataaaatgtgt

SEQ ID NO: 3190186 - DNA, 17 bp, Homo sapiens
gtaaataaaatgtgtac

SEQ ID NO: 3190187 - DNA, 18 bp, Homo sapiens
gtaaataaaatgtgtaca

SEQ ID NO: 3190188 - DNA, 20 bp, Homo sapiens
gtaaataaaatgtgtacagt

SEQ ID NO: 3190189 - DNA, 11 bp, Homo sapiens
gtaaataaact

SEQ ID NO: 3190190 - DNA, 20 bp, Homo sapiens
gtaaataaactgtttatata

SEQ ID NO: 3190191 - DNA, 11 bp, Homo sapiens
gtaaataagag

SEQ ID NO: 3190192 - DNA, 13 bp, Homo sapiens
gtaaataagagat

SEQ ID NO: 3190193 - DNA, 11 bp, Homo sapiens
gtaaataattt

SEQ ID NO: 3190194 - DNA, 12 bp, Homo sapiens
gtaaataatttt

SEQ ID NO: 3190195 - DNA, 18 bp, Homo sapiens
gtaaatacaagactgttg

SEQ ID NO: 3190196 - DNA, 14 bp, Homo sapiens
gtaaatacaggtag

SEQ ID NO: 3190197 - DNA, 15 bp, Homo sapiens
gtaaatagtatttga

SEQ ID NO: 3190198 - DNA, 17 bp, Homo sapiens
gtaaatagtatttgaga

SEQ ID NO: 3190199 - DNA, 16 bp, Homo sapiens
gtaaatatgaatctgc

SEQ ID NO: 3190200 - DNA, 12 bp, Homo sapiens
ggggctgtgcca

SEQ ID NO: 3190201 - DNA, 22 bp, Homo sapiens
ggggcttagggtcggaacccaa

SEQ ID NO: 3190202 - DNA, 19 bp, Homo sapiens
ggggcttggcgtggagcag

SEQ ID NO: 3190203 - DNA, 10 bp, Homo sapiens
gggggagccc

SEQ ID NO: 3190204 - DNA, 14 bp, Homo sapiens
gggggagggggagg

SEQ ID NO: 3190205 - DNA, 16 bp, Homo sapiens
gggggagtagccaagc

SEQ ID NO: 3190206 - DNA, 13 bp, Homo sapiens
gggggcaatctct

SEQ ID NO: 3190207 - DNA, 17 bp, Homo sapiens
gggggcaatctctctct

SEQ ID NO: 3190208 - DNA, 15 bp, Homo sapiens
gggggcactcagcca

SEQ ID NO: 3190209 - DNA, 22 bp, Homo sapiens
gggggccccgccagggctgggg

SEQ ID NO: 3190210 - DNA, 12 bp, Homo sapiens
gggggccctgct

SEQ ID NO: 3190211 - DNA, 13 bp, Homo sapiens
gggggccctgcta

SEQ ID NO: 3190212 - DNA, 23 bp, Homo sapiens
gggggcgctcaggacccaggccc

SEQ ID NO: 3190213 - DNA, 21 bp, Homo sapiens
gggggctatttctctccccac

SEQ ID NO: 3190214 - DNA, 14 bp, Homo sapiens
gggggctcctggtg

SEQ ID NO: 3190215 - DNA, 21 bp, Homo sapiens
gggggctcctggtggccttct

SEQ ID NO: 3190216 - DNA, 23 bp, Homo sapiens
gggggctcctggtggccttctgc

SEQ ID NO: 3190217 - DNA, 18 bp, Homo sapiens
gggggctgtgccaacctg

SEQ ID NO: 3190218 - DNA, 14 bp, Homo sapiens
gggggctttgggcc

SEQ ID NO: 3190219 - DNA, 13 bp, Homo sapiens
gggggtggaggct

SEQ ID NO: 3190220 - DNA, 10 bp, Homo sapiens
gggggtggca

SEQ ID NO: 3190221 - DNA, 23 bp, Homo sapiens
gggggtggccgctgagtggcagg

SEQ ID NO: 3190222 - DNA, 18 bp, Homo sapiens
ggggtaagccagagcctg

SEQ ID NO: 3190223 - DNA, 14 bp, Homo sapiens
ggggtcaaaggaag

SEQ ID NO: 3190224 - DNA, 14 bp, Homo sapiens
ggggtcacaggccc

SEQ ID NO: 3190225 - DNA, 15 bp, Homo sapiens
ggggtcacaggccca

SEQ ID NO: 3190226 - DNA, 15 bp, Homo sapiens
ggggtcaggctccat

SEQ ID NO: 3190227 - DNA, 13 bp, Homo sapiens
ggggtcccagtgg

SEQ ID NO: 3190228 - DNA, 19 bp, Homo sapiens
ggggtccgtggtagaggcc

SEQ ID NO: 3190229 - DNA, 22 bp, Homo sapiens
ggggtccgtggtagaggcctgg

SEQ ID NO: 3190230 - DNA, 15 bp, Homo sapiens
ggggtcctgtggcag

SEQ ID NO: 3190231 - DNA, 13 bp, Homo sapiens
ggggtctcatgtc

SEQ ID NO: 3190232 - DNA, 13 bp, Homo sapiens
ggggtctgtgctg

SEQ ID NO: 3190233 - DNA, 12 bp, Homo sapiens
ggggtctttgtg

SEQ ID NO: 3190234 - DNA, 21 bp, Homo sapiens
ggggtgacagtcatcatcagg

SEQ ID NO: 3190235 - DNA, 18 bp, Homo sapiens
ggggtgacgcctgccctc

SEQ ID NO: 3190236 - DNA, 18 bp, Homo sapiens
ggggtgacggccctcatc

SEQ ID NO: 3190237 - DNA, 15 bp, Homo sapiens
ggggtgcagcagtga

SEQ ID NO: 3190238 - DNA, 13 bp, Homo sapiens
ggggtgccccctc

SEQ ID NO: 3190239 - DNA, 15 bp, Homo sapiens
ggggtggagtttctg

SEQ ID NO: 3190240 - DNA, 13 bp, Homo sapiens
ggggtggtggagg

SEQ ID NO: 3190241 - DNA, 20 bp, Homo sapiens
ggggttcataggtcactggc

SEQ ID NO: 3190242 - DNA, 15 bp, Homo sapiens
gggtaaaatactttt

SEQ ID NO: 3190243 - DNA, 21 bp, Homo sapiens
gggtaaaatacttttactctg

SEQ ID NO: 3190244 - DNA, 18 bp, Homo sapiens
gggtaagccagagcctgg

SEQ ID NO: 3190245 - DNA, 16 bp, Homo sapiens
gggtaagggatttctt

SEQ ID NO: 3190246 - DNA, 22 bp, Homo sapiens
gggtaatcagcattattcttca

SEQ ID NO: 3190247 - DNA, 17 bp, Homo sapiens
gggtacatttctctgag

SEQ ID NO: 3190248 - DNA, 18 bp, Homo sapiens
gggtacccactgctctgg

SEQ ID NO: 3190249 - DNA, 20 bp, Homo sapiens
gggtactcttgatgtgaaga

SEQ ID NO: 3190250 - DNA, 20 bp, Homo sapiens
gggtagaatgattaatcaaa

SEQ ID NO: 3190251 - DNA, 19 bp, Homo sapiens
gggtagagggtggggcccg

SEQ ID NO: 3190252 - DNA, 13 bp, Homo sapiens
gggtagcagctgg

SEQ ID NO: 3190253 - DNA, 23 bp, Homo sapiens
gggtataaaactttcctcgcctg

SEQ ID NO: 3190254 - DNA, 16 bp, Homo sapiens
gggtatatctgggctg

SEQ ID NO: 3190255 - DNA, 21 bp, Homo sapiens
gggtatgaagagcttgctttg

SEQ ID NO: 3190256 - DNA, 22 bp, Homo sapiens
gggtatgtttaatctgttatgt

SEQ ID NO: 3190257 - DNA, 16 bp, Homo sapiens
gggtcacaggcccaga

SEQ ID NO: 3190258 - DNA, 11 bp, Homo sapiens
gggtcaggaac

SEQ ID NO: 3190259 - DNA, 17 bp, Homo sapiens
gggtcagtggaagcccc

SEQ ID NO: 3190260 - DNA, 23 bp, Homo sapiens
gggtcattgacctctcagggcct

SEQ ID NO: 3190261 - DNA, 21 bp, Homo sapiens
gggtccaggaaggcagctgct

SEQ ID NO: 3190262 - DNA, 16 bp, Homo sapiens
gggtcccagtgggagg

SEQ ID NO: 3190263 - DNA, 22 bp, Homo sapiens
gggtcccagtgggaggggcagg

SEQ ID NO: 3190264 - DNA, 17 bp, Homo sapiens
gggtccccatcatccca

SEQ ID NO: 3190265 - DNA, 22 bp, Homo sapiens
gggtccccatcatcccagctgc

SEQ ID NO: 3190266 - DNA, 11 bp, Homo sapiens
gggtccctgct

SEQ ID NO: 3190267 - DNA, 21 bp, Homo sapiens
gggtcccttgaaggaagaggg

SEQ ID NO: 3190268 - DNA, 17 bp, Homo sapiens
gggtccgcaccagctgc

SEQ ID NO: 3190269 - DNA, 20 bp, Homo sapiens
gggtccgtggtagaggcctg

SEQ ID NO: 3190270 - DNA, 23 bp, Homo sapiens
gggtccgtggtagaggcctgggg

SEQ ID NO: 3190271 - DNA, 20 bp, Homo sapiens
gggtcctaattaccagtctt

SEQ ID NO: 3190272 - DNA, 20 bp, Homo sapiens
ggcatgttttctttgtttcc

SEQ ID NO: 3190273 - DNA, 12 bp, Homo sapiens
ggcatgttttga

SEQ ID NO: 3190274 - DNA, 20 bp, Homo sapiens
ggcattaccctctgcagaac

SEQ ID NO: 3190275 - DNA, 23 bp, Homo sapiens
ggcattaccctctgcagaacagt

SEQ ID NO: 3190276 - DNA, 20 bp, Homo sapiens
ggcattagaattatttaaac

SEQ ID NO: 3190277 - DNA, 18 bp, Homo sapiens
ggcattcgggccacaggg

SEQ ID NO: 3190278 - DNA, 17 bp, Homo sapiens
ggcattgcactgcttat

SEQ ID NO: 3190279 - DNA, 13 bp, Homo sapiens
ggcattgggctga

SEQ ID NO: 3190280 - DNA, 15 bp, Homo sapiens
ggcattgggctgaca

SEQ ID NO: 3190281 - DNA, 13 bp, Homo sapiens
ggcattgggttct

SEQ ID NO: 3190282 - DNA, 20 bp, Homo sapiens
ggcatttgcagggtcctctt

SEQ ID NO: 3190283 - DNA, 19 bp, Homo sapiens
ggccaaacatcagacctgt

SEQ ID NO: 3190284 - DNA, 14 bp, Homo sapiens
ggccaaactgctgg

SEQ ID NO: 3190285 - DNA, 14 bp, Homo sapiens
ggccaaagataaaa

SEQ ID NO: 3190286 - DNA, 13 bp, Homo sapiens
ggccaaagtgtta

SEQ ID NO: 3190287 - DNA, 21 bp, Homo sapiens
ggccaaattatttgtgtaata

SEQ ID NO: 3190288 - DNA, 22 bp, Homo sapiens
ggccaactgcaaaaaaagcctc

SEQ ID NO: 3190289 - DNA, 18 bp, Homo sapiens
ggccaagaatacttgaag

SEQ ID NO: 3190290 - DNA, 15 bp, Homo sapiens
ggccaagacttggca

SEQ ID NO: 3190291 - DNA, 16 bp, Homo sapiens
ggccaaggtcctgctc

SEQ ID NO: 3190292 - DNA, 12 bp, Homo sapiens
ggccaaggtgcc

SEQ ID NO: 3190293 - DNA, 16 bp, Homo sapiens
ggccaaggtgccacca

SEQ ID NO: 3190294 - DNA, 22 bp, Homo sapiens
ggccacactattaccatgagaa

SEQ ID NO: 3190295 - DNA, 15 bp, Homo sapiens
ggccacagccccctt

SEQ ID NO: 3190296 - DNA, 14 bp, Homo sapiens
ggccacagccgcct

SEQ ID NO: 3190297 - DNA, 23 bp, Homo sapiens
ggccacagggcgagactccgtct

SEQ ID NO: 3190298 - DNA, 20 bp, Homo sapiens
ggccacagtagtcttgatga

SEQ ID NO: 3190299 - DNA, 15 bp, Homo sapiens
ggccaccaaagctgc

SEQ ID NO: 3190300 - DNA, 15 bp, Homo sapiens
ggccaccagatgctg

SEQ ID NO: 3190301 - DNA, 16 bp, Homo sapiens
ggccaccaggctggcg

SEQ ID NO: 3190302 - DNA, 21 bp, Homo sapiens
ggccaccaggctggcgcagcc

SEQ ID NO: 3190303 - DNA, 15 bp, Homo sapiens
ggccaccatgtctgg

SEQ ID NO: 3190304 - DNA, 18 bp, Homo sapiens
ggccaccccactctacct

SEQ ID NO: 3190305 - DNA, 19 bp, Homo sapiens
ggccaccccactctacctc

SEQ ID NO: 3190306 - DNA, 21 bp, Homo sapiens
ggccaccccactctacctcct

SEQ ID NO: 3190307 - DNA, 15 bp, Homo sapiens
ggccacccctcccca

SEQ ID NO: 3190308 - DNA, 21 bp, Homo sapiens
ggccacccgttctgctggcct

SEQ ID NO: 3190309 - DNA, 23 bp, Homo sapiens
ggccacccgttctgctggcctgg

SEQ ID NO: 3190310 - DNA, 24 bp, Homo sapiens
ggccacccgttctgctggcctgga

SEQ ID NO: 3190311 - DNA, 13 bp, Homo sapiens
ggccacctcccca

SEQ ID NO: 3190312 - DNA, 17 bp, Homo sapiens
ggccacctccccagcat

SEQ ID NO: 3190313 - DNA, 19 bp, Homo sapiens
ggccacctcctccccctgt

SEQ ID NO: 3190314 - DNA, 18 bp, Homo sapiens
ggccacctctccaagggc

SEQ ID NO: 3190315 - DNA, 23 bp, Homo sapiens
ggccacctctgcggaccccagct

SEQ ID NO: 3190316 - DNA, 17 bp, Homo sapiens
ggccacctgaggtgggc

SEQ ID NO: 3190317 - DNA, 21 bp, Homo sapiens
ggccacctgaggtgggcccag

SEQ ID NO: 3190318 - DNA, 22 bp, Homo sapiens
ggccacctgaggtgggcccagg

SEQ ID NO: 3190319 - DNA, 15 bp, Homo sapiens
ggccacgccccagcc

SEQ ID NO: 3190320 - DNA, 16 bp, Homo sapiens
ggccacgccccagccc

SEQ ID NO: 3190321 - DNA, 14 bp, Homo sapiens
ggccacgctccagc

SEQ ID NO: 3190322 - DNA, 18 bp, Homo sapiens
ggccacgctccagctgcc

SEQ ID NO: 3190323 - DNA, 23 bp, Homo sapiens
ggccacgtgggcaaacaggcagt

SEQ ID NO: 3190324 - DNA, 19 bp, Homo sapiens
ggccactgcacagagctct

SEQ ID NO: 3190325 - DNA, 14 bp, Homo sapiens
ggccactgtggcca

SEQ ID NO: 3190326 - DNA, 15 bp, Homo sapiens
ggccactgtggccag

SEQ ID NO: 3190327 - DNA, 20 bp, Homo sapiens
ggccactgtggccagagctg

SEQ ID NO: 3190328 - DNA, 21 bp, Homo sapiens
ggccactttcagagcccccag

SEQ ID NO: 3190329 - DNA, 15 bp, Homo sapiens
ggccacttttgacta

SEQ ID NO: 3190330 - DNA, 14 bp, Homo sapiens
ggccagaaggaggg

SEQ ID NO: 3190331 - DNA, 15 bp, Homo sapiens
ggccagaaggagggc

SEQ ID NO: 3190332 - DNA, 16 bp, Homo sapiens
ggccagaaggagggca

SEQ ID NO: 3190333 - DNA, 23 bp, Homo sapiens
ggccagaaggagggcagagccat

SEQ ID NO: 3190334 - DNA, 14 bp, Homo sapiens
ggccagacgctgcc

SEQ ID NO: 3190335 - DNA, 16 bp, Homo sapiens
ggccagacgctgccgc

SEQ ID NO: 3190336 - DNA, 17 bp, Homo sapiens
ggccagacgctgccgct

SEQ ID NO: 3190337 - DNA, 22 bp, Homo sapiens
ggccagagagcctggtgctgct

SEQ ID NO: 3190338 - DNA, 20 bp, Homo sapiens
ggccagagagggcccagctg

SEQ ID NO: 3190339 - DNA, 18 bp, Homo sapiens
ggccagagctggaaggca

SEQ ID NO: 3190340 - DNA, 16 bp, Homo sapiens
ggccagagctgggagg

SEQ ID NO: 3190341 - DNA, 21 bp, Homo sapiens
ggccagagctgggaggcatgg

SEQ ID NO: 3190342 - DNA, 13 bp, Homo sapiens
ggccagagggagc

SEQ ID NO: 3190343 - DNA, 17 bp, Homo sapiens
ggccagagggagtgaca

SEQ ID NO: 3190344 - DNA, 19 bp, Homo sapiens
ggccagagggagtgacaga

SEQ ID NO: 3190345 - DNA, 23 bp, Homo sapiens
ggccagagggagtgacagaggca

SEQ ID NO: 3190346 - DNA, 19 bp, Homo sapiens
ggccagagtggcctggcca

SEQ ID NO: 3190347 - DNA, 18 bp, Homo sapiens
ggccagatggcccctcca

SEQ ID NO: 3190348 - DNA, 23 bp, Homo sapiens
ggccagatggcccggatgctgct

SEQ ID NO: 3190349 - DNA, 15 bp, Homo sapiens
ggccagcaaggcagg

SEQ ID NO: 3190350 - DNA, 16 bp, Homo sapiens
ggccagcaaggcaggt

SEQ ID NO: 3190351 - DNA, 23 bp, Homo sapiens
ggccagcaccctctcctgggggt

SEQ ID NO: 3190352 - DNA, 13 bp, Homo sapiens
ggccagccaggcg

SEQ ID NO: 3190353 - DNA, 16 bp, Homo sapiens
ggccagccaggcgggc

SEQ ID NO: 3190354 - DNA, 15 bp, Homo sapiens
ggccagccagtgcca

SEQ ID NO: 3190355 - DNA, 17 bp, Homo sapiens
ggccagccagtgccatt

SEQ ID NO: 3190356 - DNA, 13 bp, Homo sapiens
ggccagccccacc

SEQ ID NO: 3190357 - DNA, 16 bp, Homo sapiens
ggccagccccacccag

SEQ ID NO: 3190358 - DNA, 21 bp, Homo sapiens
ggccagccccacccaggaggg

SEQ ID NO: 3190359 - DNA, 21 bp, Homo sapiens
ggccagccccacccccagcca

SEQ ID NO: 3190360 - DNA, 18 bp, Homo sapiens
ggccagcccggctggttt

SEQ ID NO: 3190361 - DNA, 16 bp, Homo sapiens
ggccagccctgcagcc

SEQ ID NO: 3190362 - DNA, 13 bp, Homo sapiens
ggccagcccttcc

SEQ ID NO: 3190363 - DNA, 22 bp, Homo sapiens
ggccagcctagcccttgtccct

SEQ ID NO: 3190364 - DNA, 16 bp, Homo sapiens
ggccagcctcaccctt

SEQ ID NO: 3190365 - DNA, 17 bp, Homo sapiens
ggccagcctcacccttg

SEQ ID NO: 3190366 - DNA, 16 bp, Homo sapiens
ggccagcctccgagag

SEQ ID NO: 3190367 - DNA, 22 bp, Homo sapiens
ggccagcctccgagagggagag

SEQ ID NO: 3190368 - DNA, 15 bp, Homo sapiens
ggccagcctggggcc

SEQ ID NO: 3190369 - DNA, 17 bp, Homo sapiens
ggccagcgtcccagggt

SEQ ID NO: 3190370 - DNA, 19 bp, Homo sapiens
ggccagcgtcccagggtac

SEQ ID NO: 3190371 - DNA, 13 bp, Homo sapiens
ggccagcgtggct

SEQ ID NO: 3190372 - DNA, 20 bp, Homo sapiens
ggccagctgcctgtgcctgc

SEQ ID NO: 3190373 - DNA, 18 bp, Homo sapiens
ggccaggaccacacagtc

SEQ ID NO: 3190374 - DNA, 14 bp, Homo sapiens
ggccaggcacaggg

SEQ ID NO: 3190375 - DNA, 13 bp, Homo sapiens
ggcggagccggcc

SEQ ID NO: 3190376 - DNA, 20 bp, Homo sapiens
ggcggaggggatccagccac

SEQ ID NO: 3190377 - DNA, 21 bp, Homo sapiens
ggcggaggggatccagccact

SEQ ID NO: 3190378 - DNA, 14 bp, Homo sapiens
ggcggcagcagcca

SEQ ID NO: 3190379 - DNA, 12 bp, Homo sapiens
ggcggccaggca

SEQ ID NO: 3190380 - DNA, 19 bp, Homo sapiens
ggcggccaggcacagggcc

SEQ ID NO: 3190381 - DNA, 19 bp, Homo sapiens
ggcggcccggccagcgggc

SEQ ID NO: 3190382 - DNA, 20 bp, Homo sapiens
ggcggcccggccagcgggca

SEQ ID NO: 3190383 - DNA, 22 bp, Homo sapiens
ggcggcccggccagcgggcaca

SEQ ID NO: 3190384 - DNA, 18 bp, Homo sapiens
ggcggcttcctgtccact

SEQ ID NO: 3190385 - DNA, 21 bp, Homo sapiens
ggcggcttcctgtccactctc

SEQ ID NO: 3190386 - DNA, 16 bp, Homo sapiens
ggcgggatgggccacc

SEQ ID NO: 3190387 - DNA, 13 bp, Homo sapiens
ggcgggcacctgt

SEQ ID NO: 3190388 - DNA, 17 bp, Homo sapiens
ggcgggccagccaggcg

SEQ ID NO: 3190389 - DNA, 23 bp, Homo sapiens
ggcgggccatgagggacagggtc

SEQ ID NO: 3190390 - DNA, 14 bp, Homo sapiens
ggcgggcccctcat

SEQ ID NO: 3190391 - DNA, 21 bp, Homo sapiens
ggcggggggggcgcctggaga

SEQ ID NO: 3190392 - DNA, 20 bp, Homo sapiens
ggcgggtacagcgcggagga

SEQ ID NO: 3190393 - DNA, 23 bp, Homo sapiens
ggcggtcacagcatggaggagga

SEQ ID NO: 3190394 - DNA, 15 bp, Homo sapiens
ggcgtaatgggcctg

SEQ ID NO: 3190395 - DNA, 14 bp, Homo sapiens
ggcgtgactcagca

SEQ ID NO: 3190396 - DNA, 15 bp, Homo sapiens
ggcgtggagactggc

SEQ ID NO: 3190397 - DNA, 16 bp, Homo sapiens
ggcgtggagccaggga

SEQ ID NO: 3190398 - DNA, 18 bp, Homo sapiens
ggcgtgggagccagcctc

SEQ ID NO: 3190399 - DNA, 14 bp, Homo sapiens
ggcgttatttatgg

SEQ ID NO: 3190400 - DNA, 21 bp, Homo sapiens
ggcgttatttatggaccactt

SEQ ID NO: 3190401 - DNA, 17 bp, Homo sapiens
ggcgttcacctccctgc

SEQ ID NO: 3190402 - DNA, 17 bp, Homo sapiens
ggcgttggtgccacttc

SEQ ID NO: 3190403 - DNA, 21 bp, Homo sapiens
ggctaaacatccaatattttc

SEQ ID NO: 3190404 - DNA, 18 bp, Homo sapiens
ggctaaaggggagaaact

SEQ ID NO: 3190405 - DNA, 19 bp, Homo sapiens
ggctaacctggacctggaa

SEQ ID NO: 3190406 - DNA, 19 bp, Homo sapiens
ggctaacgggaggctgggc

SEQ ID NO: 3190407 - DNA, 22 bp, Homo sapiens
ggctaataaactgtattaaatc

SEQ ID NO: 3190408 - DNA, 17 bp, Homo sapiens
ggctacacagacccctc

SEQ ID NO: 3190409 - DNA, 12 bp, Homo sapiens
ggctaccctccc

SEQ ID NO: 3190410 - DNA, 13 bp, Homo sapiens
ggctactggcagc

SEQ ID NO: 3190411 - DNA, 15 bp, Homo sapiens
ggctactggcagctc

SEQ ID NO: 3190412 - DNA, 20 bp, Homo sapiens
ggctagaggccagccccacc

SEQ ID NO: 3190413 - DNA, 13 bp, Homo sapiens
ggctagagtcctc

SEQ ID NO: 3190414 - DNA, 14 bp, Homo sapiens
ggctagagtcctca

SEQ ID NO: 3190415 - DNA, 20 bp, Homo sapiens
ggctagagtcctcactccca

SEQ ID NO: 3190416 - DNA, 22 bp, Homo sapiens
ggctagcttctgcttttctgcc

SEQ ID NO: 3190417 - DNA, 23 bp, Homo sapiens
ggctaggtatcattcaactctcc

SEQ ID NO: 3190418 - DNA, 13 bp, Homo sapiens
ggctagtactgta

SEQ ID NO: 3190419 - DNA, 20 bp, Homo sapiens
ggctagtgacttgtgtccca

SEQ ID NO: 3190420 - DNA, 23 bp, Homo sapiens
ggctagtgacttgtgtcccatga

SEQ ID NO: 3190421 - DNA, 20 bp, Homo sapiens
ggctagtgtgagtggcagcc

SEQ ID NO: 3190422 - DNA, 23 bp, Homo sapiens
ggctagtgtgagtggcagccatg

SEQ ID NO: 3190423 - DNA, 15 bp, Homo sapiens
ggctagttgggcttc

SEQ ID NO: 3190424 - DNA, 16 bp, Homo sapiens
ggctagttgggcttcc

SEQ ID NO: 3190425 - DNA, 20 bp, Homo sapiens
ggctatagctacaggaagca

SEQ ID NO: 3190426 - DNA, 18 bp, Homo sapiens
ggctatggcaagggggtg

SEQ ID NO: 3190427 - DNA, 19 bp, Homo sapiens
ggctatggttgccacccca

SEQ ID NO: 3190428 - DNA, 17 bp, Homo sapiens
ggctatttgtgtgtatg

SEQ ID NO: 3190429 - DNA, 16 bp, Homo sapiens
ggctatttgttcagag

SEQ ID NO: 3190430 - DNA, 18 bp, Homo sapiens
ggctatttgttcagagag

SEQ ID NO: 3190431 - DNA, 18 bp, Homo sapiens
ggctcacacacctgtagc

SEQ ID NO: 3190432 - DNA, 17 bp, Homo sapiens
ggctcacaggcctctct

SEQ ID NO: 3190433 - DNA, 20 bp, Homo sapiens
ggctcacgcctatgatccca

SEQ ID NO: 3190434 - DNA, 13 bp, Homo sapiens
ggctcacgcctgt

SEQ ID NO: 3190435 - DNA, 23 bp, Homo sapiens
ggctcacgcctgtaatcccagca

SEQ ID NO: 3190436 - DNA, 17 bp, Homo sapiens
ggctcactgcagcctca

SEQ ID NO: 3190437 - DNA, 21 bp, Homo sapiens
ggctcactgccaggccagcct

SEQ ID NO: 3190438 - DNA, 21 bp, Homo sapiens
ggctcagatcggccacagggc

SEQ ID NO: 3190439 - DNA, 17 bp, Homo sapiens
ggctcagatgaaatgca

SEQ ID NO: 3190440 - DNA, 19 bp, Homo sapiens
ggctcagcggggacagctc

SEQ ID NO: 3190441 - DNA, 22 bp, Homo sapiens
ggctcagcggggacagctcctt

SEQ ID NO: 3190442 - DNA, 19 bp, Homo sapiens
ggctcaggcaagcccctca

SEQ ID NO: 3190443 - DNA, 16 bp, Homo sapiens
ggctcagggctggagt

SEQ ID NO: 3190444 - DNA, 16 bp, Homo sapiens
ggctcaggtcacataa

SEQ ID NO: 3190445 - DNA, 12 bp, Homo sapiens
ggctcatgcctg

SEQ ID NO: 3190446 - DNA, 16 bp, Homo sapiens
ggctccacacctccac

SEQ ID NO: 3190447 - DNA, 14 bp, Homo sapiens
ggctccacttggtc

SEQ ID NO: 3190448 - DNA, 19 bp, Homo sapiens
ggctccagcatccagcctg

SEQ ID NO: 3190449 - DNA, 20 bp, Homo sapiens
ggctccagcatccagcctgt

SEQ ID NO: 3190450 - DNA, 14 bp, Homo sapiens
ggctccaggctcct

SEQ ID NO: 3190451 - DNA, 15 bp, Homo sapiens
ggctccaggctcctt

SEQ ID NO: 3190452 - DNA, 16 bp, Homo sapiens
ggctccaggctccttt

SEQ ID NO: 3190453 - DNA, 13 bp, Homo sapiens
ggctccaggctgg

SEQ ID NO: 3190454 - DNA, 17 bp, Homo sapiens
ggctccatgcctctgga

SEQ ID NO: 3190455 - DNA, 18 bp, Homo sapiens
ggctccatgcctctggag

SEQ ID NO: 3190456 - DNA, 18 bp, Homo sapiens
ggctccatgctcctcact

SEQ ID NO: 3190457 - DNA, 18 bp, Homo sapiens
ggctcccacaggcccttc

SEQ ID NO: 3190458 - DNA, 19 bp, Homo sapiens
ggctcccacaggcccttcc

SEQ ID NO: 3190459 - DNA, 22 bp, Homo sapiens
ggctcccaggggtctccctggc

SEQ ID NO: 3190460 - DNA, 21 bp, Homo sapiens
ggctcctgagaaaggtgagga

SEQ ID NO: 3190461 - DNA, 12 bp, Homo sapiens
ggctcctgaggg

SEQ ID NO: 3190462 - DNA, 12 bp, Homo sapiens
ggctcctgccag

SEQ ID NO: 3190463 - DNA, 17 bp, Homo sapiens
ggctcctgccttctgtc

SEQ ID NO: 3190464 - DNA, 19 bp, Homo sapiens
ggctcctgccttctgtcct

SEQ ID NO: 3190465 - DNA, 13 bp, Homo sapiens
ggctcctggaaag

SEQ ID NO: 3190466 - DNA, 18 bp, Homo sapiens
ggctcctggctgccaggc

SEQ ID NO: 3190467 - DNA, 15 bp, Homo sapiens
ggctcctgttttgca

SEQ ID NO: 3190468 - DNA, 13 bp, Homo sapiens
ggctcctttctcc

SEQ ID NO: 3190469 - DNA, 17 bp, Homo sapiens
ggctcctttctccagcc

SEQ ID NO: 3190470 - DNA, 20 bp, Homo sapiens
ggctcctttctccagccagc

SEQ ID NO: 3190471 - DNA, 13 bp, Homo sapiens
ggctcgaatctct

SEQ ID NO: 3190472 - DNA, 15 bp, Homo sapiens
ggctcgaatctctgt

SEQ ID NO: 3190473 - DNA, 13 bp, Homo sapiens
ggctcgtggcctt

SEQ ID NO: 3190474 - DNA, 11 bp, Homo sapiens
ggctctagatc

SEQ ID NO: 3190475 - DNA, 14 bp, Homo sapiens
ggctctagcccaag

SEQ ID NO: 3190476 - DNA, 19 bp, Homo sapiens
ggctctagggttgctggag

SEQ ID NO: 3190477 - DNA, 18 bp, Homo sapiens
ggctctatgagtctagat

SEQ ID NO: 3190478 - DNA, 21 bp, Homo sapiens
ggctctcacccccatccctgg

SEQ ID NO: 3190479 - DNA, 12 bp, Homo sapiens
ggctctcagctc

SEQ ID NO: 3190480 - DNA, 19 bp, Homo sapiens
ggctctccaaaggggctgc

SEQ ID NO: 3190481 - DNA, 18 bp, Homo sapiens
ggctctccaagtgccaga

SEQ ID NO: 3190482 - DNA, 14 bp, Homo sapiens
ggctctctcttcct

SEQ ID NO: 3190483 - DNA, 20 bp, Homo sapiens
ggctctgagagtctagattc

SEQ ID NO: 3190484 - DNA, 14 bp, Homo sapiens
ggctctgagcgcct

SEQ ID NO: 3190485 - DNA, 20 bp, Homo sapiens
ggctctgcaatgggcactgg

SEQ ID NO: 3190486 - DNA, 19 bp, Homo sapiens
ggctctgcaattcccctct

SEQ ID NO: 3190487 - DNA, 19 bp, Homo sapiens
ggctctgcacagacaagca

SEQ ID NO: 3190488 - DNA, 19 bp, Homo sapiens
ggctctgccagtggatccc

SEQ ID NO: 3190489 - DNA, 12 bp, Homo sapiens
ggctctgcccca

SEQ ID NO: 3190490 - DNA, 14 bp, Homo sapiens
ggctctgccccagc

SEQ ID NO: 3190491 - DNA, 21 bp, Homo sapiens
ggctctgccccagctctggct

SEQ ID NO: 3190492 - DNA, 18 bp, Homo sapiens
ggctctggactctaaaga

SEQ ID NO: 3190493 - DNA, 12 bp, Homo sapiens
ggctctggagac

SEQ ID NO: 3190494 - DNA, 20 bp, Homo sapiens
ggctctggcccttgcctttg

SEQ ID NO: 3190495 - DNA, 18 bp, Homo sapiens
ggctctgggctcagggct

SEQ ID NO: 3190496 - DNA, 19 bp, Homo sapiens
ggctctgggctcagggctg

SEQ ID NO: 3190497 - DNA, 16 bp, Homo sapiens
ggctctgtttgatgct

SEQ ID NO: 3190498 - DNA, 14 bp, Homo sapiens
ggctcttaagcagc

SEQ ID NO: 3190499 - DNA, 23 bp, Homo sapiens
ggctcttaagcagcatggaaaaa

SEQ ID NO: 3190500 - DNA, 18 bp, Homo sapiens
ggctcttagcagcttcca

SEQ ID NO: 3190501 - DNA, 21 bp, Homo sapiens
ggctcttagcagcttccagat

SEQ ID NO: 3190502 - DNA, 14 bp, Homo sapiens
ggctcttcctggac

SEQ ID NO: 3190503 - DNA, 15 bp, Homo sapiens
ggctcttcctggacc

SEQ ID NO: 3190504 - DNA, 20 bp, Homo sapiens
ggacaatcagtcccctccca

SEQ ID NO: 3190505 - DNA, 19 bp, Homo sapiens
ggacaatcatgaaatatgc

SEQ ID NO: 3190506 - DNA, 20 bp, Homo sapiens
ggacacaaaactccgccccc

SEQ ID NO: 3190507 - DNA, 22 bp, Homo sapiens
ggacacaaaactccgcccccag

SEQ ID NO: 3190508 - DNA, 13 bp, Homo sapiens
ggacacaaatttt

SEQ ID NO: 3190509 - DNA, 20 bp, Homo sapiens
ggacacaacagcagtctcct

SEQ ID NO: 3190510 - DNA, 24 bp, Homo sapiens
ggacacaacagcagtctccttcag

SEQ ID NO: 3190511 - DNA, 21 bp, Homo sapiens
ggacacaataggtctttctct

SEQ ID NO: 3190512 - DNA, 12 bp, Homo sapiens
ggacacactaat

SEQ ID NO: 3190513 - DNA, 19 bp, Homo sapiens
ggacacagatcccactgga

SEQ ID NO: 3190514 - DNA, 21 bp, Homo sapiens
ggacacagatcccactggaag

SEQ ID NO: 3190515 - DNA, 22 bp, Homo sapiens
ggacacagatcccactggaaga

SEQ ID NO: 3190516 - DNA, 13 bp, Homo sapiens
ggccagtgtctgt

SEQ ID NO: 3190517 - DNA, 22 bp, Homo sapiens
ggccagtgtctgtcccggggtc

SEQ ID NO: 3190518 - DNA, 19 bp, Homo sapiens
ggccagtgtgatcccaagt

SEQ ID NO: 3190519 - DNA, 14 bp, Homo sapiens
ggccagttgcccag

SEQ ID NO: 3190520 - DNA, 15 bp, Homo sapiens
ggccagttgcccaga

SEQ ID NO: 3190521 - DNA, 17 bp, Homo sapiens
ggccataaacggttcct

SEQ ID NO: 3190522 - DNA, 20 bp, Homo sapiens
ggccataaacggttcctggt

SEQ ID NO: 3190523 - DNA, 21 bp, Homo sapiens
ggccataaacggttcctggtg

SEQ ID NO: 3190524 - DNA, 13 bp, Homo sapiens
ggccatactgcct

SEQ ID NO: 3190525 - DNA, 14 bp, Homo sapiens
ggccatactgcctt

SEQ ID NO: 3190526 - DNA, 19 bp, Homo sapiens
ggccatcacaggatgccag

SEQ ID NO: 3190527 - DNA, 13 bp, Homo sapiens
ggccatccctggg

SEQ ID NO: 3190528 - DNA, 14 bp, Homo sapiens
ggccatccctgggc

SEQ ID NO: 3190529 - DNA, 21 bp, Homo sapiens
ggccatccctgggcccctcca

SEQ ID NO: 3190530 - DNA, 14 bp, Homo sapiens
ggccatctcaggag

SEQ ID NO: 3190531 - DNA, 22 bp, Homo sapiens
ggccatctgactgccaagccag

SEQ ID NO: 3190532 - DNA, 16 bp, Homo sapiens
ggccatgggcctcctg

SEQ ID NO: 3190533 - DNA, 22 bp, Homo sapiens
ggccatgtccaaagaggctgcc

SEQ ID NO: 3190534 - DNA, 15 bp, Homo sapiens
ggccatgtgagccac

SEQ ID NO: 3190535 - DNA, 14 bp, Homo sapiens
ggccattctgccgc

SEQ ID NO: 3190536 - DNA, 21 bp, Homo sapiens
ggccattctttttttcttggc

SEQ ID NO: 3190537 - DNA, 12 bp, Homo sapiens
ggcccaaagcag

SEQ ID NO: 3190538 - DNA, 17 bp, Homo sapiens
ggcccaagagccctgtg

SEQ ID NO: 3190539 - DNA, 18 bp, Homo sapiens
ggcccaagccccatctca

SEQ ID NO: 3190540 - DNA, 17 bp, Homo sapiens
ggcccaaggtcccctcc

SEQ ID NO: 3190541 - DNA, 14 bp, Homo sapiens
ggcccaagtccctg

SEQ ID NO: 3190542 - DNA, 22 bp, Homo sapiens
ggcccaccatcaccaccgcctc

SEQ ID NO: 3190543 - DNA, 14 bp, Homo sapiens
ggcccacctggcca

SEQ ID NO: 3190544 - DNA, 19 bp, Homo sapiens
ggcccacctggccacctga

SEQ ID NO: 3190545 - DNA, 22 bp, Homo sapiens
ggcccacgccctccctctccca

SEQ ID NO: 3190546 - DNA, 12 bp, Homo sapiens
ggcccagaactg

SEQ ID NO: 3190547 - DNA, 16 bp, Homo sapiens
ggcccagaactgcccc

SEQ ID NO: 3190548 - DNA, 17 bp, Homo sapiens
ggcccagaactgccccc

SEQ ID NO: 3190549 - DNA, 19 bp, Homo sapiens
ggcccagaactgcccccac

SEQ ID NO: 3190550 - DNA, 11 bp, Homo sapiens
ggcccagagag

SEQ ID NO: 3190551 - DNA, 12 bp, Homo sapiens
ggcccagagagg

SEQ ID NO: 3190552 - DNA, 13 bp, Homo sapiens
ggcccagaggctg

SEQ ID NO: 3190553 - DNA, 14 bp, Homo sapiens
ggcccagaggctga

SEQ ID NO: 3190554 - DNA, 18 bp, Homo sapiens
ggcccagccaggagcaga

SEQ ID NO: 3190555 - DNA, 19 bp, Homo sapiens
ggcccagccagttggtggg

SEQ ID NO: 3190556 - DNA, 12 bp, Homo sapiens
ggcccagcccag

SEQ ID NO: 3190557 - DNA, 12 bp, Homo sapiens
ggcccagcccct

SEQ ID NO: 3190558 - DNA, 24 bp, Homo sapiens
ggcccagcccctagaaacccaagc

SEQ ID NO: 3190559 - DNA, 13 bp, Homo sapiens
ggcccagcccctc

SEQ ID NO: 3190560 - DNA, 18 bp, Homo sapiens
ggcccagcgcggccagcg

SEQ ID NO: 3190561 - DNA, 15 bp, Homo sapiens
ggcccaggaagccca

SEQ ID NO: 3190562 - DNA, 16 bp, Homo sapiens
ggcccaggaagcccac

SEQ ID NO: 3190563 - DNA, 17 bp, Homo sapiens
ggcccaggaagcccaca

SEQ ID NO: 3190564 - DNA, 19 bp, Homo sapiens
ggcccaggaagcccacact

SEQ ID NO: 3190565 - DNA, 16 bp, Homo sapiens
ggcccaggaccagctg

SEQ ID NO: 3190566 - DNA, 17 bp, Homo sapiens
ggcccaggaccagctgg

SEQ ID NO: 3190567 - DNA, 18 bp, Homo sapiens
ggcccaggaccagctggg

SEQ ID NO: 3190568 - DNA, 16 bp, Homo sapiens
ggcccaggcagagctg

SEQ ID NO: 3190569 - DNA, 15 bp, Homo sapiens
ggcccaggcctgggt

SEQ ID NO: 3190570 - DNA, 20 bp, Homo sapiens
ggcccagtgacaaagactcc

SEQ ID NO: 3190571 - DNA, 21 bp, Homo sapiens
ggcccagtgacaaagactcct

SEQ ID NO: 3190572 - DNA, 22 bp, Homo sapiens
ggcccagtgacaaagactcctc

SEQ ID NO: 3190573 - DNA, 19 bp, Homo sapiens
ggcccagtgtcaagttgtg

SEQ ID NO: 3190574 - DNA, 21 bp, Homo sapiens
ggcccataatagttagccctc

SEQ ID NO: 3190575 - DNA, 24 bp, Homo sapiens
ggcccatatctgtgaaatgctggc

SEQ ID NO: 3190576 - DNA, 13 bp, Homo sapiens
ggcccatctcagg

SEQ ID NO: 3190577 - DNA, 22 bp, Homo sapiens
ggcccatctcaggtgccactcc

SEQ ID NO: 3190578 - DNA, 13 bp, Homo sapiens
ggccccaccctgg

SEQ ID NO: 3190579 - DNA, 17 bp, Homo sapiens
ggccccaccctgggccc

SEQ ID NO: 3190580 - DNA, 21 bp, Homo sapiens
ggccccaccctgggccctggg

SEQ ID NO: 3190581 - DNA, 21 bp, Homo sapiens
ggccccacctacttgtgactg

SEQ ID NO: 3190582 - DNA, 23 bp, Homo sapiens
ggccccactcccttgctggcccc

SEQ ID NO: 3190583 - DNA, 16 bp, Homo sapiens
ggccccagaccccagg

SEQ ID NO: 3190584 - DNA, 20 bp, Homo sapiens
ggccccagaccccagggcag

SEQ ID NO: 3190585 - DNA, 19 bp, Homo sapiens
ggccccagacgcatagact

SEQ ID NO: 3190586 - DNA, 16 bp, Homo sapiens
ggccccagaggccctg

SEQ ID NO: 3190587 - DNA, 17 bp, Homo sapiens
ggccccagaggccctgg

SEQ ID NO: 3190588 - DNA, 19 bp, Homo sapiens
ggccccagaggccctggag

SEQ ID NO: 3190589 - DNA, 22 bp, Homo sapiens
ggccccagatctgcctgggcct

SEQ ID NO: 3190590 - DNA, 11 bp, Homo sapiens
ggccccagcca

SEQ ID NO: 3190591 - DNA, 12 bp, Homo sapiens
ggccccagccag

SEQ ID NO: 3190592 - DNA, 13 bp, Homo sapiens
ggccccagccaga

SEQ ID NO: 3190593 - DNA, 15 bp, Homo sapiens
ggccccagccctgct

SEQ ID NO: 3190594 - DNA, 18 bp, Homo sapiens
ggccccagccctgctggg

SEQ ID NO: 3190595 - DNA, 12 bp, Homo sapiens
ggccccagctct

SEQ ID NO: 3190596 - DNA, 15 bp, Homo sapiens
ggccccagctctgag

SEQ ID NO: 3190597 - DNA, 23 bp, Homo sapiens
ggccccatccaaccactgtacac

SEQ ID NO: 3190598 - DNA, 17 bp, Homo sapiens
ggccccatcctcatccc

SEQ ID NO: 3190599 - DNA, 13 bp, Homo sapiens
ggccccatgctct

SEQ ID NO: 3190600 - DNA, 18 bp, Homo sapiens
ggccccatgctctgcccc

SEQ ID NO: 3190601 - DNA, 23 bp, Homo sapiens
ggcccccaaacatagcccctgcc

SEQ ID NO: 3190602 - DNA, 20 bp, Homo sapiens
ggcccccaacctcagggctc

SEQ ID NO: 3190603 - DNA, 17 bp, Homo sapiens
ggcccccaataaaggca

SEQ ID NO: 3190604 - DNA, 18 bp, Homo sapiens
ggcccccaataaaggcag

SEQ ID NO: 3190605 - DNA, 22 bp, Homo sapiens
ggcccccaataaaggcagctgc

SEQ ID NO: 3190606 - DNA, 16 bp, Homo sapiens
ggcccccacttgcctc

SEQ ID NO: 3190607 - DNA, 20 bp, Homo sapiens
ggcccccagcccagggctcc

SEQ ID NO: 3190608 - DNA, 16 bp, Homo sapiens
ggccccccaaatccca

SEQ ID NO: 3190609 - DNA, 19 bp, Homo sapiens
ggccccccagctcaggggc

SEQ ID NO: 3190610 - DNA, 22 bp, Homo sapiens
ggccccccgcgctcgcccagca

SEQ ID NO: 3190611 - DNA, 16 bp, Homo sapiens
ggccccctccctggat

SEQ ID NO: 3190612 - DNA, 14 bp, Homo sapiens
ggccccgccagggc

SEQ ID NO: 3190613 - DNA, 16 bp, Homo sapiens
ggccccgccagggctg

SEQ ID NO: 3190614 - DNA, 17 bp, Homo sapiens
ggccccggatcagagca

SEQ ID NO: 3190615 - DNA, 13 bp, Homo sapiens
ggccccggcccca

SEQ ID NO: 3190616 - DNA, 17 bp, Homo sapiens
ggccccggccccagcca

SEQ ID NO: 3190617 - DNA, 16 bp, Homo sapiens
ggcctcagctggctgt

SEQ ID NO: 3190618 - DNA, 15 bp, Homo sapiens
ggcctcagggccagg

SEQ ID NO: 3190619 - DNA, 16 bp, Homo sapiens
ggcctcagggccagga

SEQ ID NO: 3190620 - DNA, 17 bp, Homo sapiens
ggcctcagggccaggaa

SEQ ID NO: 3190621 - DNA, 18 bp, Homo sapiens
ggcctcagggccaggaag

SEQ ID NO: 3190622 - DNA, 17 bp, Homo sapiens
ggcctcagggcgctcag

SEQ ID NO: 3190623 - DNA, 24 bp, Homo sapiens
ggcctcagggcgctcagacggcgg

SEQ ID NO: 3190624 - DNA, 18 bp, Homo sapiens
ggcctcagttcccagctc

SEQ ID NO: 3190625 - DNA, 20 bp, Homo sapiens
ggcctcagtttctccatcag

SEQ ID NO: 3190626 - DNA, 15 bp, Homo sapiens
ggcctcatccctcgg

SEQ ID NO: 3190627 - DNA, 14 bp, Homo sapiens
ggcctcatgcctgc

SEQ ID NO: 3190628 - DNA, 19 bp, Homo sapiens
ggcctcatgtggctggaag

SEQ ID NO: 3190629 - DNA, 20 bp, Homo sapiens
ggcctccaacgcccctgtgg

SEQ ID NO: 3190630 - DNA, 21 bp, Homo sapiens
ggcctccaacgcccctgtggc

SEQ ID NO: 3190631 - DNA, 14 bp, Homo sapiens
ggcctccactcccc

SEQ ID NO: 3190632 - DNA, 20 bp, Homo sapiens
ggcctccagaactcactggg

SEQ ID NO: 3190633 - DNA, 16 bp, Homo sapiens
ggcctccagcctctcc

SEQ ID NO: 3190634 - DNA, 14 bp, Homo sapiens
ggcctccatcctga

SEQ ID NO: 3190635 - DNA, 13 bp, Homo sapiens
ggcctcccaccag

SEQ ID NO: 3190636 - DNA, 12 bp, Homo sapiens
ggcctcccaccc

SEQ ID NO: 3190637 - DNA, 13 bp, Homo sapiens
ggcctcccacccg

SEQ ID NO: 3190638 - DNA, 14 bp, Homo sapiens
ggcctcccacccga

SEQ ID NO: 3190639 - DNA, 15 bp, Homo sapiens
ggcctcccctccatg

SEQ ID NO: 3190640 - DNA, 21 bp, Homo sapiens
ggcctcccctccatgggcgtc

SEQ ID NO: 3190641 - DNA, 17 bp, Homo sapiens
ggcctcccctgccacca

SEQ ID NO: 3190642 - DNA, 22 bp, Homo sapiens
ggcctcccctgccaccaggcca

SEQ ID NO: 3190643 - DNA, 19 bp, Homo sapiens
ggcctcccgaggaggggcc

SEQ ID NO: 3190644 - DNA, 16 bp, Homo sapiens
ggcctccctccttggg

SEQ ID NO: 3190645 - DNA, 23 bp, Homo sapiens
ggcctccctctctcttctgctcc

SEQ ID NO: 3190646 - DNA, 17 bp, Homo sapiens
ggcctcccttgggctgg

SEQ ID NO: 3190647 - DNA, 21 bp, Homo sapiens
ggcctccgtccaggagcctgg

SEQ ID NO: 3190648 - DNA, 14 bp, Homo sapiens
ggcctcctccccca

SEQ ID NO: 3190649 - DNA, 22 bp, Homo sapiens
ggcctcctcggagagcagcagc

SEQ ID NO: 3190650 - DNA, 22 bp, Homo sapiens
ggcctcctcttcaccccggcag

SEQ ID NO: 3190651 - DNA, 19 bp, Homo sapiens
ggcctccttcccatgcctg

SEQ ID NO: 3190652 - DNA, 22 bp, Homo sapiens
ggcctccttcccatgcctgtct

SEQ ID NO: 3190653 - DNA, 19 bp, Homo sapiens
ggcctcgcctccccaccct

SEQ ID NO: 3190654 - DNA, 22 bp, Homo sapiens
ggcctcgggacacctgccctgc

SEQ ID NO: 3190655 - DNA, 14 bp, Homo sapiens
ggcctcgtgccatg

SEQ ID NO: 3190656 - DNA, 12 bp, Homo sapiens
ggcctctccagt

SEQ ID NO: 3190657 - DNA, 13 bp, Homo sapiens
ggcctctctagca

SEQ ID NO: 3190658 - DNA, 14 bp, Homo sapiens
ggcctctctccctc

SEQ ID NO: 3190659 - DNA, 19 bp, Homo sapiens
ggcctctctggcctcccac

SEQ ID NO: 3190660 - DNA, 17 bp, Homo sapiens
ggcctctcttttccccg

SEQ ID NO: 3190661 - DNA, 16 bp, Homo sapiens
ggcctctgtgccttct

SEQ ID NO: 3190662 - DNA, 18 bp, Homo sapiens
ggcctcttgagcagtggc

SEQ ID NO: 3190663 - DNA, 17 bp, Homo sapiens
ggcctgaactgaggaga

SEQ ID NO: 3190664 - DNA, 13 bp, Homo sapiens
ggcctgagagaat

SEQ ID NO: 3190665 - DNA, 21 bp, Homo sapiens
ggcctgagagaattggctcaa

SEQ ID NO: 3190666 - DNA, 18 bp, Homo sapiens
ggcctgagaggggaagcg

SEQ ID NO: 3190667 - DNA, 15 bp, Homo sapiens
ggcctgagctggggc

SEQ ID NO: 3190668 - DNA, 17 bp, Homo sapiens
ggcctgagctggggcca

SEQ ID NO: 3190669 - DNA, 19 bp, Homo sapiens
ggcctgaggcctgtgcctg

SEQ ID NO: 3190670 - DNA, 15 bp, Homo sapiens
ggcctgatgctccct

SEQ ID NO: 3190671 - DNA, 17 bp, Homo sapiens
ggcctgatgctccctcc

SEQ ID NO: 3190672 - DNA, 15 bp, Homo sapiens
ggcctgatgctgccc

SEQ ID NO: 3190673 - DNA, 16 bp, Homo sapiens
ggcctgatgctgcccc

SEQ ID NO: 3190674 - DNA, 13 bp, Homo sapiens
ggcctgcaaacct

SEQ ID NO: 3190675 - DNA, 12 bp, Homo sapiens
ggcctgcacaca

SEQ ID NO: 3190676 - DNA, 12 bp, Homo sapiens
ggcctgcctggc

SEQ ID NO: 3190677 - DNA, 11 bp, Homo sapiens
ggcctgcctgt

SEQ ID NO: 3190678 - DNA, 21 bp, Homo sapiens
ggcctgctgccagtgcagcca

SEQ ID NO: 3190679 - DNA, 22 bp, Homo sapiens
ggcctgctgggaaccccgcagc

SEQ ID NO: 3190680 - DNA, 16 bp, Homo sapiens
ggcctgcttttccagg

SEQ ID NO: 3190681 - DNA, 17 bp, Homo sapiens
ggcctgcttttccagga

SEQ ID NO: 3190682 - DNA, 19 bp, Homo sapiens
ggcctgcttttccaggatc

SEQ ID NO: 3190683 - DNA, 24 bp, Homo sapiens
ggcctggaaccagggaggagagga

SEQ ID NO: 3190684 - DNA, 18 bp, Homo sapiens
ggcctggactttcctgca

SEQ ID NO: 3190685 - DNA, 21 bp, Homo sapiens
ggcctggactttcctgcaact

SEQ ID NO: 3190686 - DNA, 11 bp, Homo sapiens
ggcctggagat

SEQ ID NO: 3190687 - DNA, 18 bp, Homo sapiens
ggcctggagatcctcctg

SEQ ID NO: 3190688 - DNA, 20 bp, Homo sapiens
ggcctggagatcctcctgca

SEQ ID NO: 3190689 - DNA, 23 bp, Homo sapiens
ggcctggagccccatcggccaag

SEQ ID NO: 3190690 - DNA, 21 bp, Homo sapiens
ggcctggatctccccactcta

SEQ ID NO: 3190691 - DNA, 14 bp, Homo sapiens
ggcctggcaggcca

SEQ ID NO: 3190692 - DNA, 17 bp, Homo sapiens
ggcctggcaggccagtg

SEQ ID NO: 3190693 - DNA, 15 bp, Homo sapiens
ggcctggccagatgc

SEQ ID NO: 3190694 - DNA, 16 bp, Homo sapiens
ggcctggccagatgca

SEQ ID NO: 3190695 - DNA, 21 bp, Homo sapiens
ggcctggccagatgcaccagc

SEQ ID NO: 3190696 - DNA, 14 bp, Homo sapiens
ggcctggccaggag

SEQ ID NO: 3190697 - DNA, 18 bp, Homo sapiens
ggcctggccaggagctct

SEQ ID NO: 3190698 - DNA, 14 bp, Homo sapiens
ggcctggccctgcc

SEQ ID NO: 3190699 - DNA, 21 bp, Homo sapiens
ggcctggccggcaaccccagt

SEQ ID NO: 3190700 - DNA, 13 bp, Homo sapiens
ggcctggcctgag

SEQ ID NO: 3190701 - DNA, 15 bp, Homo sapiens
ggcctggcctgagct

SEQ ID NO: 3190702 - DNA, 20 bp, Homo sapiens
ggcctggctggtgggaaggc

SEQ ID NO: 3190703 - DNA, 16 bp, Homo sapiens
ggcctggcttgctcca

SEQ ID NO: 3190704 - DNA, 15 bp, Homo sapiens
ggcctgggacccagc

SEQ ID NO: 3190705 - DNA, 20 bp, Homo sapiens
ggcctgggacccagctactc

SEQ ID NO: 3190706 - DNA, 22 bp, Homo sapiens
ggcctgggacccagctactctg

SEQ ID NO: 3190707 - DNA, 22 bp, Homo sapiens
ggcctgggagggttcccctggc

SEQ ID NO: 3190708 - DNA, 21 bp, Homo sapiens
ggcctgggatgctagccccag

SEQ ID NO: 3190709 - DNA, 23 bp, Homo sapiens
ggcctgggatgctagccccagag

SEQ ID NO: 3190710 - DNA, 18 bp, Homo sapiens
ggcctggggcctgagaga

SEQ ID NO: 3190711 - DNA, 14 bp, Homo sapiens
ggcctggggctcct

SEQ ID NO: 3190712 - DNA, 18 bp, Homo sapiens
ggcctggggctcctttct

SEQ ID NO: 3190713 - DNA, 23 bp, Homo sapiens
ggcctggggctcctttctccagc

SEQ ID NO: 3190714 - DNA, 15 bp, Homo sapiens
ggcctgggggcagtg

SEQ ID NO: 3190715 - DNA, 17 bp, Homo sapiens
ggcctgggggcagtgac

SEQ ID NO: 3190716 - DNA, 19 bp, Homo sapiens
ggcctgggtctgtgtctct

SEQ ID NO: 3190717 - DNA, 14 bp, Homo sapiens
ggcctggtccctgt

SEQ ID NO: 3190718 - DNA, 23 bp, Homo sapiens
ggcctgtaatcagctctcctggc

SEQ ID NO: 3190719 - DNA, 17 bp, Homo sapiens
ggcctgtcccccaaggt

SEQ ID NO: 3190720 - DNA, 18 bp, Homo sapiens
ggcctgtctcatccccag

SEQ ID NO: 3190721 - DNA, 20 bp, Homo sapiens
ggcctgtctcatccccaggg

SEQ ID NO: 3190722 - DNA, 14 bp, Homo sapiens
ggcctgtgcagcag

SEQ ID NO: 3190723 - DNA, 16 bp, Homo sapiens
ggcctgtgcagcagcc

SEQ ID NO: 3190724 - DNA, 17 bp, Homo sapiens
ggcctgtgcagcagccc

SEQ ID NO: 3190725 - DNA, 18 bp, Homo sapiens
ggcctgtgcagcagccca

SEQ ID NO: 3190726 - DNA, 20 bp, Homo sapiens
ggcctgtgcagcagcccagc

SEQ ID NO: 3190727 - DNA, 20 bp, Homo sapiens
ggcctgtggcctgtgtccca

SEQ ID NO: 3190728 - DNA, 17 bp, Homo sapiens
ggcctgtgtccagcagc

SEQ ID NO: 3190729 - DNA, 18 bp, Homo sapiens
ggcctgtgtccagcagct

SEQ ID NO: 3190730 - DNA, 19 bp, Homo sapiens
ggcctgtgtccagcagctg

SEQ ID NO: 3190731 - DNA, 21 bp, Homo sapiens
ggcctgtgtccagcagctgcg

SEQ ID NO: 3190732 - DNA, 15 bp, Homo sapiens
ggcctgttgcccttt

SEQ ID NO: 3190733 - DNA, 21 bp, Homo sapiens
ggcctgtttctgcagcccttg

SEQ ID NO: 3190734 - DNA, 12 bp, Homo sapiens
ggcctgtttgat

SEQ ID NO: 3190735 - DNA, 19 bp, Homo sapiens
ggcctgtttgatgtatgtg

SEQ ID NO: 3190736 - DNA, 19 bp, Homo sapiens
ggccttaaagagggacagg

SEQ ID NO: 3190737 - DNA, 12 bp, Homo sapiens
ggccttaagctt

SEQ ID NO: 3190738 - DNA, 20 bp, Homo sapiens
ggccttagggcactgggctg

SEQ ID NO: 3190739 - DNA, 22 bp, Homo sapiens
ggccttccccttttgcctggct

SEQ ID NO: 3190740 - DNA, 16 bp, Homo sapiens
ggccttcggcctccat

SEQ ID NO: 3190741 - DNA, 15 bp, Homo sapiens
ggccttctgctgccc

SEQ ID NO: 3190742 - DNA, 20 bp, Homo sapiens
ggccttctgctgcccaggcc

SEQ ID NO: 3190743 - DNA, 13 bp, Homo sapiens
ggcaaaattgcaa

SEQ ID NO: 3190744 - DNA, 13 bp, Homo sapiens
ggcaaacaggcag

SEQ ID NO: 3190745 - DNA, 23 bp, Homo sapiens
ggcaaacaggcagttggccagag

SEQ ID NO: 3190746 - DNA, 19 bp, Homo sapiens
ggcaaagccacaaggctgg

SEQ ID NO: 3190747 - DNA, 17 bp, Homo sapiens
ggcaaaggaaggtggat

SEQ ID NO: 3190748 - DNA, 12 bp, Homo sapiens
ggcaaagggtct

SEQ ID NO: 3190749 - DNA, 11 bp, Homo sapiens
ggcaaatctgc

SEQ ID NO: 3190750 - DNA, 21 bp, Homo sapiens
ggcaaatgacatgcactgacc

SEQ ID NO: 3190751 - DNA, 19 bp, Homo sapiens
ggcaaattaaacaatataa

SEQ ID NO: 3190752 - DNA, 16 bp, Homo sapiens
ggcaaattaacttgag

SEQ ID NO: 3190753 - DNA, 17 bp, Homo sapiens
ggcaacaggacagagtt

SEQ ID NO: 3190754 - DNA, 16 bp, Homo sapiens
ggcaaccactaagaat

SEQ ID NO: 3190755 - DNA, 23 bp, Homo sapiens
ggcaaccccagttctgctcctct

SEQ ID NO: 3190756 - DNA, 16 bp, Homo sapiens
ggcaacccccagcctg

SEQ ID NO: 3190757 - DNA, 15 bp, Homo sapiens
ggcaacgaagaaaaa

SEQ ID NO: 3190758 - DNA, 17 bp, Homo sapiens
ggcaacgaagaaaaaaa

SEQ ID NO: 3190759 - DNA, 16 bp, Homo sapiens
ggcaactattaataat

SEQ ID NO: 3190760 - DNA, 15 bp, Homo sapiens
ggcaacttttaaagc

SEQ ID NO: 3190761 - DNA, 21 bp, Homo sapiens
ggcaagactgcaaactttttt

SEQ ID NO: 3190762 - DNA, 16 bp, Homo sapiens
ggcaagaggcctcatg

SEQ ID NO: 3190763 - DNA, 12 bp, Homo sapiens
ggcaagaggggt

SEQ ID NO: 3190764 - DNA, 17 bp, Homo sapiens
ggcaagagggtgacagc

SEQ ID NO: 3190765 - DNA, 17 bp, Homo sapiens
ggcaagcacctcctgcc

SEQ ID NO: 3190766 - DNA, 13 bp, Homo sapiens
ggcaagcagcggg

SEQ ID NO: 3190767 - DNA, 12 bp, Homo sapiens
ggcaagcaggga

SEQ ID NO: 3190768 - DNA, 18 bp, Homo sapiens
ggcaagcccctcagccct

SEQ ID NO: 3190769 - DNA, 19 bp, Homo sapiens
ggcaagctaggccccagag

SEQ ID NO: 3190770 - DNA, 10 bp, Homo sapiens
ggcaaggaaa

SEQ ID NO: 3190771 - DNA, 14 bp, Homo sapiens
ggcaaggcaggtgc

SEQ ID NO: 3190772 - DNA, 22 bp, Homo sapiens
ggcaaggcaggtgcctccaggt

SEQ ID NO: 3190773 - DNA, 13 bp, Homo sapiens
ggcaagtgattga

SEQ ID NO: 3190774 - DNA, 10 bp, Homo sapiens
ggcaataaac

SEQ ID NO: 3190775 - DNA, 12 bp, Homo sapiens
ggcaataaactc

SEQ ID NO: 3190776 - DNA, 20 bp, Homo sapiens
ggcaatagaccgagactccg

SEQ ID NO: 3190777 - DNA, 18 bp, Homo sapiens
ggcaatagtgtgttctga

SEQ ID NO: 3190778 - DNA, 23 bp, Homo sapiens
ggcaatgctggctgttggctggg

SEQ ID NO: 3190779 - DNA, 19 bp, Homo sapiens
ggcaattccaatatttctg

SEQ ID NO: 3190780 - DNA, 12 bp, Homo sapiens
ggcaattggaac

SEQ ID NO: 3190781 - DNA, 18 bp, Homo sapiens
ggcacaagtcctggatgt

SEQ ID NO: 3190782 - DNA, 23 bp, Homo sapiens
ggcacaagtcctggatgttgtgt

SEQ ID NO: 3190783 - DNA, 11 bp, Homo sapiens
ggcacaataaa

SEQ ID NO: 3190784 - DNA, 12 bp, Homo sapiens
ggcacaataaat

SEQ ID NO: 3190785 - DNA, 18 bp, Homo sapiens
ggcacaatgaatgtatat

SEQ ID NO: 3190786 - DNA, 14 bp, Homo sapiens
ggcacacagcagcc

SEQ ID NO: 3190787 - DNA, 16 bp, Homo sapiens
ggcacacagcagcccc

SEQ ID NO: 3190788 - DNA, 22 bp, Homo sapiens
ggcacacagcagccccccagca

SEQ ID NO: 3190789 - DNA, 23 bp, Homo sapiens
ggcacaccacccgaggggggccc

SEQ ID NO: 3190790 - DNA, 14 bp, Homo sapiens
ggcacaccactgcc

SEQ ID NO: 3190791 - DNA, 16 bp, Homo sapiens
ggcacaccactgccct

SEQ ID NO: 3190792 - DNA, 23 bp, Homo sapiens
ggcacaccactgccctgcctgcc

SEQ ID NO: 3190793 - DNA, 18 bp, Homo sapiens
ggcacagacttctggaag

SEQ ID NO: 3190794 - DNA, 11 bp, Homo sapiens
ggcacagattg

SEQ ID NO: 3190795 - DNA, 23 bp, Homo sapiens
ggcacagccctcagcgtcagaca

SEQ ID NO: 3190796 - DNA, 14 bp, Homo sapiens
ggcacagccctccg

SEQ ID NO: 3190797 - DNA, 17 bp, Homo sapiens
ggcacagggcaccagag

SEQ ID NO: 3190798 - DNA, 19 bp, Homo sapiens
ggcacagggcaccagaggc

SEQ ID NO: 3190799 - DNA, 13 bp, Homo sapiens
ggcacagggcccg

SEQ ID NO: 3190800 - DNA, 21 bp, Homo sapiens
ggcacagggcccgcagtgctg

SEQ ID NO: 3190801 - DNA, 17 bp, Homo sapiens
ggcacagtgggagctga

SEQ ID NO: 3190802 - DNA, 21 bp, Homo sapiens
ggcacagtgggagctgagctg

SEQ ID NO: 3190803 - DNA, 23 bp, Homo sapiens
ggcacagttgtctattctgagcc

SEQ ID NO: 3190804 - DNA, 19 bp, Homo sapiens
ggcacatgctgagtctccc

SEQ ID NO: 3190805 - DNA, 15 bp, Homo sapiens
ggcacatgctggccg

SEQ ID NO: 3190806 - DNA, 17 bp, Homo sapiens
ggcacatttcagggaga

SEQ ID NO: 3190807 - DNA, 15 bp, Homo sapiens
ggcaccaaagatgca

SEQ ID NO: 3190808 - DNA, 18 bp, Homo sapiens
ggcaccaaagatgcagcc

SEQ ID NO: 3190809 - DNA, 14 bp, Homo sapiens
ggcaccagccagcg

SEQ ID NO: 3190810 - DNA, 18 bp, Homo sapiens
ggcaccagccccctggat

SEQ ID NO: 3190811 - DNA, 13 bp, Homo sapiens
ggcaccagctctg

SEQ ID NO: 3190812 - DNA, 19 bp, Homo sapiens
ggcaccagctctgtggcct

SEQ ID NO: 3190813 - DNA, 20 bp, Homo sapiens
ggcaccagctctgtggcctg

SEQ ID NO: 3190814 - DNA, 14 bp, Homo sapiens
ggcaccatctccct

SEQ ID NO: 3190815 - DNA, 20 bp, Homo sapiens
ggcacccacaagtgccactg

SEQ ID NO: 3190816 - DNA, 18 bp, Homo sapiens
ggcacccggcccctgctg

SEQ ID NO: 3190817 - DNA, 15 bp, Homo sapiens
ggcaccggcgctgca

SEQ ID NO: 3190818 - DNA, 14 bp, Homo sapiens
ggcacctcagaaag

SEQ ID NO: 3190819 - DNA, 14 bp, Homo sapiens
ggcacctcctgaga

SEQ ID NO: 3190820 - DNA, 18 bp, Homo sapiens
ggcacctggcctgctggg

SEQ ID NO: 3190821 - DNA, 20 bp, Homo sapiens
ggcacgccctactccactgc

SEQ ID NO: 3190822 - DNA, 23 bp, Homo sapiens
ggcacgccctactccactgccct

SEQ ID NO: 3190823 - DNA, 21 bp, Homo sapiens
ggcacgcttgcgtatgtctgt

SEQ ID NO: 3190824 - DNA, 14 bp, Homo sapiens
ggcacgggtggtcc

SEQ ID NO: 3190825 - DNA, 16 bp, Homo sapiens
ggcactagccaaagcg

SEQ ID NO: 3190826 - DNA, 19 bp, Homo sapiens
ggcactcaactctgagccc

SEQ ID NO: 3190827 - DNA, 23 bp, Homo sapiens
ggcactcacagacctggagcccc

SEQ ID NO: 3190828 - DNA, 23 bp, Homo sapiens
ggcactcagaagacactgatggg

SEQ ID NO: 3190829 - DNA, 14 bp, Homo sapiens
ggcactcagccacg

SEQ ID NO: 3190830 - DNA, 21 bp, Homo sapiens
ggcactgagatttaaatgcaa

SEQ ID NO: 3190831 - DNA, 19 bp, Homo sapiens
ggcactggccacccctccc

SEQ ID NO: 3190832 - DNA, 20 bp, Homo sapiens
ggcactgggatgagccgctg

SEQ ID NO: 3190833 - DNA, 22 bp, Homo sapiens
ggcactgggctgttgttccatt

SEQ ID NO: 3190834 - DNA, 20 bp, Homo sapiens
ggcactgtagttctaagact

SEQ ID NO: 3190835 - DNA, 16 bp, Homo sapiens
ggcacttaatttgtaa

SEQ ID NO: 3190836 - DNA, 11 bp, Homo sapiens
ggcacttgtat

SEQ ID NO: 3190837 - DNA, 18 bp, Homo sapiens
ggcacttgtatttaattc

SEQ ID NO: 3190838 - DNA, 22 bp, Homo sapiens
ggcactttgaaggggcctcacc

SEQ ID NO: 3190839 - DNA, 13 bp, Homo sapiens
ggcagaaaacaga

SEQ ID NO: 3190840 - DNA, 23 bp, Homo sapiens
ggcagaaaacggagagtgcttgg

SEQ ID NO: 3190841 - DNA, 15 bp, Homo sapiens
ggcagaaaagaggag

SEQ ID NO: 3190842 - DNA, 12 bp, Homo sapiens
ggcagaagacac

SEQ ID NO: 3190843 - DNA, 18 bp, Homo sapiens
ggcagaagacaccagagc

SEQ ID NO: 3190844 - DNA, 19 bp, Homo sapiens
ggcagaagacaccagagca

SEQ ID NO: 3190845 - DNA, 20 bp, Homo sapiens
ggcagaagacaccagagcag

SEQ ID NO: 3190846 - DNA, 12 bp, Homo sapiens
ggcagacacaac

SEQ ID NO: 3190847 - DNA, 14 bp, Homo sapiens
ggcagactgtgaac

SEQ ID NO: 3190848 - DNA, 15 bp, Homo sapiens
ggcagagaaggcctc

SEQ ID NO: 3190849 - DNA, 9 bp, Homo sapiens
ggcagagag

SEQ ID NO: 3190850 - DNA, 12 bp, Homo sapiens
ggcagagagaga

SEQ ID NO: 3190851 - DNA, 14 bp, Homo sapiens
ggcagagagagaga

SEQ ID NO: 3190852 - DNA, 16 bp, Homo sapiens
ggcagagagagagaaa

SEQ ID NO: 3190853 - DNA, 12 bp, Homo sapiens
ggcagagcattt

SEQ ID NO: 3190854 - DNA, 14 bp, Homo sapiens
ggcagagggctgga

SEQ ID NO: 3190855 - DNA, 20 bp, Homo sapiens
ggcagagggctggaggccca

SEQ ID NO: 3190856 - DNA, 21 bp, Homo sapiens
ggcagagtcgttggagactga

SEQ ID NO: 3190857 - DNA, 22 bp, Homo sapiens
ggcagagtcgttggagactgaa

SEQ ID NO: 3190858 - DNA, 18 bp, Homo sapiens
ggcagagttacagttctg

SEQ ID NO: 3190859 - DNA, 20 bp, Homo sapiens
ggcagatctgtgccccatgc

SEQ ID NO: 3190860 - DNA, 19 bp, Homo sapiens
ggcagcacagcccagggcc

SEQ ID NO: 3190861 - DNA, 20 bp, Homo sapiens
ggcagcacagtgtgtgaact

SEQ ID NO: 3190862 - DNA, 14 bp, Homo sapiens
ggcagcaccctccc

SEQ ID NO: 3190863 - DNA, 19 bp, Homo sapiens
ggcagcaccctcccccgca

SEQ ID NO: 3190864 - DNA, 24 bp, Homo sapiens
ggcagcactccccagagctgtgcc

SEQ ID NO: 3190865 - DNA, 12 bp, Homo sapiens
ggcagcagccat

SEQ ID NO: 3190866 - DNA, 12 bp, Homo sapiens
ggcagccaccca

SEQ ID NO: 3190867 - DNA, 14 bp, Homo sapiens
ggcagccacccaag

SEQ ID NO: 3190868 - DNA, 16 bp, Homo sapiens
ggcagccacccaagcc

SEQ ID NO: 3190869 - DNA, 11 bp, Homo sapiens
ggcagccagac

SEQ ID NO: 3190870 - DNA, 13 bp, Homo sapiens
ggcagccagacca

SEQ ID NO: 3190871 - DNA, 12 bp, Homo sapiens
ggcagccagcag

SEQ ID NO: 3190872 - DNA, 13 bp, Homo sapiens
ggcagccatgcct

SEQ ID NO: 3190873 - DNA, 14 bp, Homo sapiens
ggcagccatgcctc

SEQ ID NO: 3190874 - DNA, 15 bp, Homo sapiens
ggcagccatgcctca

SEQ ID NO: 3190875 - DNA, 19 bp, Homo sapiens
ggcagccatgcctcatgcc

SEQ ID NO: 3190876 - DNA, 19 bp, Homo sapiens
ggcagccccagagagagga

SEQ ID NO: 3190877 - DNA, 21 bp, Homo sapiens
ggcagccccattctgcctgcc

SEQ ID NO: 3190878 - DNA, 21 bp, Homo sapiens
ggcagccgctaggagagactg

SEQ ID NO: 3190879 - DNA, 18 bp, Homo sapiens
ggcagccgtgccttcagc

SEQ ID NO: 3190880 - DNA, 21 bp, Homo sapiens
ggcagccgtgccttcagctct

SEQ ID NO: 3190881 - DNA, 22 bp, Homo sapiens
ggcagccgtgccttcagctcta

SEQ ID NO: 3190882 - DNA, 22 bp, Homo sapiens
ggcagcctatgggggctctcgg

SEQ ID NO: 3190883 - DNA, 15 bp, Homo sapiens
ggcagcctccagagc

SEQ ID NO: 3190884 - DNA, 22 bp, Homo sapiens
ggcagcctccagagccagcctg

SEQ ID NO: 3190885 - DNA, 18 bp, Homo sapiens
ggcagcctttccagcctc

SEQ ID NO: 3190886 - DNA, 21 bp, Homo sapiens
ggaggcagagtttgccttcct

SEQ ID NO: 3190887 - DNA, 15 bp, Homo sapiens
ggaggccaaccagcc

SEQ ID NO: 3190888 - DNA, 14 bp, Homo sapiens
ggaggccaataaaa

SEQ ID NO: 3190889 - DNA, 19 bp, Homo sapiens
ggaggccacctctccaagg

SEQ ID NO: 3190890 - DNA, 16 bp, Homo sapiens
ggaggcccaggctggg

SEQ ID NO: 3190891 - DNA, 17 bp, Homo sapiens
ggaggccccagctctga

SEQ ID NO: 3190892 - DNA, 17 bp, Homo sapiens
ggaggcctctggccctc

SEQ ID NO: 3190893 - DNA, 14 bp, Homo sapiens
ggaggcctgatgct

SEQ ID NO: 3190894 - DNA, 19 bp, Homo sapiens
ggaggcctgatgctgcccc

SEQ ID NO: 3190895 - DNA, 21 bp, Homo sapiens
ggaggcgcaggcgaccgggcc

SEQ ID NO: 3190896 - DNA, 23 bp, Homo sapiens
ggaggcgcccttggcttctgtga

SEQ ID NO: 3190897 - DNA, 14 bp, Homo sapiens
ggaggcggcccggc

SEQ ID NO: 3190898 - DNA, 17 bp, Homo sapiens
ggaggcggcccggccag

SEQ ID NO: 3190899 - DNA, 18 bp, Homo sapiens
ggaggcggcccggccagc

SEQ ID NO: 3190900 - DNA, 16 bp, Homo sapiens
ggaggctccaggactc

SEQ ID NO: 3190901 - DNA, 19 bp, Homo sapiens
ggaggctccaggactccac

SEQ ID NO: 3190902 - DNA, 22 bp, Homo sapiens
ggaggctcctgcctgagcttcc

SEQ ID NO: 3190903 - DNA, 10 bp, Homo sapiens
ggaggctgcg

SEQ ID NO: 3190904 - DNA, 13 bp, Homo sapiens
ggaggctgggccc

SEQ ID NO: 3190905 - DNA, 14 bp, Homo sapiens
ggaggctgggcccc

SEQ ID NO: 3190906 - DNA, 15 bp, Homo sapiens
ggagggaagtgtgag

SEQ ID NO: 3190907 - DNA, 16 bp, Homo sapiens
ggagggaagtgtgagc

SEQ ID NO: 3190908 - DNA, 14 bp, Homo sapiens
ggagggagcaagcc

SEQ ID NO: 3190909 - DNA, 16 bp, Homo sapiens
ggagggagcaagccct

SEQ ID NO: 3190910 - DNA, 19 bp, Homo sapiens
ggagggagcaagccctact

SEQ ID NO: 3190911 - DNA, 15 bp, Homo sapiens
ggagggaggccaggc

SEQ ID NO: 3190912 - DNA, 13 bp, Homo sapiens
ggagggaggcgct

SEQ ID NO: 3190913 - DNA, 20 bp, Homo sapiens
ggagggatgaagggcgagtg

SEQ ID NO: 3190914 - DNA, 21 bp, Homo sapiens
ggagggatgctgcctgagtca

SEQ ID NO: 3190915 - DNA, 22 bp, Homo sapiens
ggagggattctggttccagggt

SEQ ID NO: 3190916 - DNA, 14 bp, Homo sapiens
ggagggcacagccc

SEQ ID NO: 3190917 - DNA, 12 bp, Homo sapiens
ggagggcagagc

SEQ ID NO: 3190918 - DNA, 13 bp, Homo sapiens
ggagggcagagcc

SEQ ID NO: 3190919 - DNA, 15 bp, Homo sapiens
ggagggcagagccat

SEQ ID NO: 3190920 - DNA, 18 bp, Homo sapiens
ggagggcagagccatggg

SEQ ID NO: 3190921 - DNA, 22 bp, Homo sapiens
ggagggcagagccatgggcctg

SEQ ID NO: 3190922 - DNA, 17 bp, Homo sapiens
ggagggcggcacaggtc

SEQ ID NO: 3190923 - DNA, 13 bp, Homo sapiens
ggaggggaggcag

SEQ ID NO: 3190924 - DNA, 14 bp, Homo sapiens
ggaggggcaggctg

SEQ ID NO: 3190925 - DNA, 22 bp, Homo sapiens
ggaggggcgcccacctccccac

SEQ ID NO: 3190926 - DNA, 15 bp, Homo sapiens
ggagggggagggggt

SEQ ID NO: 3190927 - DNA, 21 bp, Homo sapiens
ggagggggctatttctctccc

SEQ ID NO: 3190928 - DNA, 16 bp, Homo sapiens
ggagggggttacaaac

SEQ ID NO: 3190929 - DNA, 16 bp, Homo sapiens
ggaggggttgccacag

SEQ ID NO: 3190930 - DNA, 18 bp, Homo sapiens
ggaggggttgccacaggc

SEQ ID NO: 3190931 - DNA, 21 bp, Homo sapiens
ggaggggttgccacaggcctc

SEQ ID NO: 3190932 - DNA, 16 bp, Homo sapiens
ggagggtacagctggg

SEQ ID NO: 3190933 - DNA, 13 bp, Homo sapiens
ggaggtagagagg

SEQ ID NO: 3190934 - DNA, 21 bp, Homo sapiens
ggaggtcactggaaaggggag

SEQ ID NO: 3190935 - DNA, 15 bp, Homo sapiens
ggaggtcaggccctg

SEQ ID NO: 3190936 - DNA, 19 bp, Homo sapiens
ggaggtcctttggacagct

SEQ ID NO: 3190937 - DNA, 16 bp, Homo sapiens
ggaggtctccaggggc

SEQ ID NO: 3190938 - DNA, 15 bp, Homo sapiens
ggaggtgagagtggg

SEQ ID NO: 3190939 - DNA, 17 bp, Homo sapiens
ggaggtgagagtgggag

SEQ ID NO: 3190940 - DNA, 13 bp, Homo sapiens
ggaggtgcctgga

SEQ ID NO: 3190941 - DNA, 20 bp, Homo sapiens
ggaggtggaggttgcagtga

SEQ ID NO: 3190942 - DNA, 17 bp, Homo sapiens
ggaggtggcagccctgt

SEQ ID NO: 3190943 - DNA, 16 bp, Homo sapiens
ggaggtgggagcagga

SEQ ID NO: 3190944 - DNA, 19 bp, Homo sapiens
ggaggtgggagcaggagat

SEQ ID NO: 3190945 - DNA, 18 bp, Homo sapiens
ggaggtgggcatgccacc

SEQ ID NO: 3190946 - DNA, 20 bp, Homo sapiens
ggaggtgggtgtgggtggaa

SEQ ID NO: 3190947 - DNA, 22 bp, Homo sapiens
ggaggtgggtgtgggtggaagg

SEQ ID NO: 3190948 - DNA, 15 bp, Homo sapiens
ggaggtgtgaatgca

SEQ ID NO: 3190949 - DNA, 16 bp, Homo sapiens
ggaggtgtgaatgcac

SEQ ID NO: 3190950 - DNA, 19 bp, Homo sapiens
ggaggtgtgaatgcacgtt

SEQ ID NO: 3190951 - DNA, 18 bp, Homo sapiens
ggaggtgtggagccgagg

SEQ ID NO: 3190952 - DNA, 14 bp, Homo sapiens
ggaggtgttcactg

SEQ ID NO: 3190953 - DNA, 20 bp, Homo sapiens
ggaggtgttcccaggctgcc

SEQ ID NO: 3190954 - DNA, 12 bp, Homo sapiens
ggaggttctaag

SEQ ID NO: 3190955 - DNA, 14 bp, Homo sapiens
ggaggttgcaggga

SEQ ID NO: 3190956 - DNA, 15 bp, Homo sapiens
ggaggttgggtgggc

SEQ ID NO: 3190957 - DNA, 16 bp, Homo sapiens
ggaggttggtgactga

SEQ ID NO: 3190958 - DNA, 14 bp, Homo sapiens
ggaggtttgtcggg

SEQ ID NO: 3190959 - DNA, 15 bp, Homo sapiens
ggagtaagttcttca

SEQ ID NO: 3190960 - DNA, 16 bp, Homo sapiens
ggagtattttaagtct

SEQ ID NO: 3190961 - DNA, 16 bp, Homo sapiens
ggagtcagagccctgg

SEQ ID NO: 3190962 - DNA, 19 bp, Homo sapiens
ggagtcagagccctggctg

SEQ ID NO: 3190963 - DNA, 21 bp, Homo sapiens
ggagtcagagccctggctggg

SEQ ID NO: 3190964 - DNA, 15 bp, Homo sapiens
ggagtcagccaggag

SEQ ID NO: 3190965 - DNA, 21 bp, Homo sapiens
ggagtcagtaggtccaagggc

SEQ ID NO: 3190966 - DNA, 15 bp, Homo sapiens
ggagtcagtgtctgg

SEQ ID NO: 3190967 - DNA, 15 bp, Homo sapiens
ggagtcccctcacct

SEQ ID NO: 3190968 - DNA, 22 bp, Homo sapiens
ggagtcgtggggtgtgctggga

SEQ ID NO: 3190969 - DNA, 16 bp, Homo sapiens
ggagtctctgccaccc

SEQ ID NO: 3190970 - DNA, 20 bp, Homo sapiens
ggagtctctgccacccactc

SEQ ID NO: 3190971 - DNA, 16 bp, Homo sapiens
ggagtctgtgctcttt

SEQ ID NO: 3190972 - DNA, 19 bp, Homo sapiens
ggagtgaagaggggcagcc

SEQ ID NO: 3190973 - DNA, 22 bp, Homo sapiens
ggagtgaagaggggcagccctt

SEQ ID NO: 3190974 - DNA, 16 bp, Homo sapiens
ggagtgacagaggcag

SEQ ID NO: 3190975 - DNA, 14 bp, Homo sapiens
ggagtgagctggtt

SEQ ID NO: 3190976 - DNA, 21 bp, Homo sapiens
ggagtgaggcttccaggctct

SEQ ID NO: 3190977 - DNA, 15 bp, Homo sapiens
ggagtgcagggagga

SEQ ID NO: 3190978 - DNA, 21 bp, Homo sapiens
ggagtgcgctcttggtccctg

SEQ ID NO: 3190979 - DNA, 23 bp, Homo sapiens
ggagtgcgctcttggtccctggt

SEQ ID NO: 3190980 - DNA, 22 bp, Homo sapiens
ggagtgctggctcacagtacag

SEQ ID NO: 3190981 - DNA, 18 bp, Homo sapiens
ggagtggaaggtctattg

SEQ ID NO: 3190982 - DNA, 15 bp, Homo sapiens
ggagtgggcacctca

SEQ ID NO: 3190983 - DNA, 17 bp, Homo sapiens
ggagtgggcacctcaga

SEQ ID NO: 3190984 - DNA, 19 bp, Homo sapiens
ggagtgggtgacaagagcc

SEQ ID NO: 3190985 - DNA, 15 bp, Homo sapiens
ggagtggtgcagaca

SEQ ID NO: 3190986 - DNA, 20 bp, Homo sapiens
ggagtggtttaggctatttg

SEQ ID NO: 3190987 - DNA, 20 bp, Homo sapiens
ggagtgtcctcttccctctc

SEQ ID NO: 3190988 - DNA, 24 bp, Homo sapiens
ggagtgtcctcttccctctctgca

SEQ ID NO: 3190989 - DNA, 14 bp, Homo sapiens
ggagtgtcctgccc

SEQ ID NO: 3190990 - DNA, 15 bp, Homo sapiens
ggagtgtcctgccca

SEQ ID NO: 3190991 - DNA, 19 bp, Homo sapiens
ggagtgtgagccacctaag

SEQ ID NO: 3190992 - DNA, 19 bp, Homo sapiens
ggagtgtgtattgttccca

SEQ ID NO: 3190993 - DNA, 19 bp, Homo sapiens
ggagtgtttctaataaact

SEQ ID NO: 3190994 - DNA, 20 bp, Homo sapiens
ggagtgtttgtgtctgactc

SEQ ID NO: 3190995 - DNA, 21 bp, Homo sapiens
ggagtgtttgtgtctgactca

SEQ ID NO: 3190996 - DNA, 21 bp, Homo sapiens
ggagttcaagaccagcctggg

SEQ ID NO: 3190997 - DNA, 19 bp, Homo sapiens
ggagttctagaaccacttc

SEQ ID NO: 3190998 - DNA, 14 bp, Homo sapiens
ggagttgagtacag

SEQ ID NO: 3190999 - DNA, 22 bp, Homo sapiens
ggagtttctgacgaaggtccta

SEQ ID NO: 3191000 - DNA, 18 bp, Homo sapiens
ggagtttctttcctgcct

SEQ ID NO: 3191001 - DNA, 17 bp, Homo sapiens
ggagtttgagacaagcc

SEQ ID NO: 3191002 - DNA, 20 bp, Homo sapiens
ggagtttgagacaagccctg

SEQ ID NO: 3191003 - DNA, 21 bp, Homo sapiens
ggagtttgagacaagccctgg

SEQ ID NO: 3191004 - DNA, 13 bp, Homo sapiens
ggagtttgaggct

SEQ ID NO: 3191005 - DNA, 16 bp, Homo sapiens
ggagtttttttataca

SEQ ID NO: 3191006 - DNA, 14 bp, Homo sapiens
ggataaaatgaggt

SEQ ID NO: 3191007 - DNA, 15 bp, Homo sapiens
ggataaaatgaggtt

SEQ ID NO: 3191008 - DNA, 20 bp, Homo sapiens
ggataaggagactgaggctt

SEQ ID NO: 3191009 - DNA, 16 bp, Homo sapiens
ggataatatatttgca

SEQ ID NO: 3191010 - DNA, 14 bp, Homo sapiens
ggataatgaaataa

SEQ ID NO: 3191011 - DNA, 14 bp, Homo sapiens
ggataatgtcatta

SEQ ID NO: 3191012 - DNA, 16 bp, Homo sapiens
ggatactgcagggcca

SEQ ID NO: 3191013 - DNA, 21 bp, Homo sapiens
ggatactgcagggccaggact

SEQ ID NO: 3191014 - DNA, 18 bp, Homo sapiens
ggatactggcacagaggt

SEQ ID NO: 3191015 - DNA, 23 bp, Homo sapiens
gctttttttgcctaccatttcac

SEQ ID NO: 3191016 - DNA, 15 bp, Homo sapiens
gctttttttttctct

SEQ ID NO: 3191017 - DNA, 24 bp, Homo sapiens
gctttttttttctctttctctcct

SEQ ID NO: 3191018 - DNA, 20 bp, Homo sapiens
ggaaaaaaaaaaaagaaaag

SEQ ID NO: 3191019 - DNA, 15 bp, Homo sapiens
ggaaaaaaactggga

SEQ ID NO: 3191020 - DNA, 20 bp, Homo sapiens
ggaaaaaaagactgatgaag

SEQ ID NO: 3191021 - DNA, 11 bp, Homo sapiens
ggaaaaaagca

SEQ ID NO: 3191022 - DNA, 13 bp, Homo sapiens
ggaaaaaagcaca

SEQ ID NO: 3191023 - DNA, 14 bp, Homo sapiens
ggaaaaaagcacat

SEQ ID NO: 3191024 - DNA, 18 bp, Homo sapiens
ggaaaaaagcacatacat

SEQ ID NO: 3191025 - DNA, 17 bp, Homo sapiens
ggaaaaagcacaagaag

SEQ ID NO: 3191026 - DNA, 20 bp, Homo sapiens
ggaaaaataatcaagatttt

SEQ ID NO: 3191027 - DNA, 12 bp, Homo sapiens
ggaaaacatttg

SEQ ID NO: 3191028 - DNA, 13 bp, Homo sapiens
ggaaaacatttgc

SEQ ID NO: 3191029 - DNA, 21 bp, Homo sapiens
ggaaaaccaagccgtggcttc

SEQ ID NO: 3191030 - DNA, 12 bp, Homo sapiens
ggaaaaccagac

SEQ ID NO: 3191031 - DNA, 16 bp, Homo sapiens
ggaaaacctgaagact

SEQ ID NO: 3191032 - DNA, 22 bp, Homo sapiens
ggaaaagcaagaaacagtttct

SEQ ID NO: 3191033 - DNA, 23 bp, Homo sapiens
ggaaaagcgtctttaagagactc

SEQ ID NO: 3191034 - DNA, 14 bp, Homo sapiens
ggaaaagggagcta

SEQ ID NO: 3191035 - DNA, 19 bp, Homo sapiens
ggaaaatacctaattgtgg

SEQ ID NO: 3191036 - DNA, 17 bp, Homo sapiens
ggaaaatatttcctgac

SEQ ID NO: 3191037 - DNA, 22 bp, Homo sapiens
ggaaaatgagtatttggtccaa

SEQ ID NO: 3191038 - DNA, 14 bp, Homo sapiens
ggaaaattcatttt

SEQ ID NO: 3191039 - DNA, 15 bp, Homo sapiens
ggaaaattcattttt

SEQ ID NO: 3191040 - DNA, 12 bp, Homo sapiens
ggaaacaatata

SEQ ID NO: 3191041 - DNA, 12 bp, Homo sapiens
ggaaacagcatg

SEQ ID NO: 3191042 - DNA, 13 bp, Homo sapiens
ggaaacagcatga

SEQ ID NO: 3191043 - DNA, 20 bp, Homo sapiens
ggaaacagctaatgggacac

SEQ ID NO: 3191044 - DNA, 22 bp, Homo sapiens
ggaaacgccccgggcaaagggt

SEQ ID NO: 3191045 - DNA, 23 bp, Homo sapiens
ggaaacgccccgggcaaagggtc

SEQ ID NO: 3191046 - DNA, 23 bp, Homo sapiens
ggaaacgctacctctctgtccct

SEQ ID NO: 3191047 - DNA, 21 bp, Homo sapiens
ggaaactagacaagtaaaatt

SEQ ID NO: 3191048 - DNA, 16 bp, Homo sapiens
ggaaagacgtttttgt

SEQ ID NO: 3191049 - DNA, 19 bp, Homo sapiens
ggaaagaggtgaaaatgaa

SEQ ID NO: 3191050 - DNA, 22 bp, Homo sapiens
ggaaagatggataaactgagcc

SEQ ID NO: 3191051 - DNA, 19 bp, Homo sapiens
ggaaagatgttaagcattt

SEQ ID NO: 3191052 - DNA, 20 bp, Homo sapiens
ggaaagatgttaagcattta

SEQ ID NO: 3191053 - DNA, 20 bp, Homo sapiens
ggaaagatttgtgaactgga

SEQ ID NO: 3191054 - DNA, 18 bp, Homo sapiens
ggaaagccacctctccct

SEQ ID NO: 3191055 - DNA, 23 bp, Homo sapiens
ggaaagccacctctccctcaaca

SEQ ID NO: 3191056 - DNA, 13 bp, Homo sapiens
ggaaagcccagac

SEQ ID NO: 3191057 - DNA, 17 bp, Homo sapiens
ggaaagcccagacttta

SEQ ID NO: 3191058 - DNA, 16 bp, Homo sapiens
ggaaagccctccccct

SEQ ID NO: 3191059 - DNA, 23 bp, Homo sapiens
ggaaagctcagctactgattttt

SEQ ID NO: 3191060 - DNA, 20 bp, Homo sapiens
ggaaagctgatgatgtctct

SEQ ID NO: 3191061 - DNA, 15 bp, Homo sapiens
ggaaaggacccaccc

SEQ ID NO: 3191062 - DNA, 19 bp, Homo sapiens
ggaaaggacccacccatct

SEQ ID NO: 3191063 - DNA, 16 bp, Homo sapiens
ggaaaggatattttct

SEQ ID NO: 3191064 - DNA, 19 bp, Homo sapiens
ggaaaggattttaccaaag

SEQ ID NO: 3191065 - DNA, 20 bp, Homo sapiens
ggaaaggctcagtctcagga

SEQ ID NO: 3191066 - DNA, 23 bp, Homo sapiens
ggaaaggctcagtctcaggagca

SEQ ID NO: 3191067 - DNA, 15 bp, Homo sapiens
ggaaaggctctgaaa

SEQ ID NO: 3191068 - DNA, 20 bp, Homo sapiens
ggaaaggctctgaaagccag

SEQ ID NO: 3191069 - DNA, 18 bp, Homo sapiens
ggaaaggggagagcctgc

SEQ ID NO: 3191070 - DNA, 19 bp, Homo sapiens
ggaaaggggagagcctgct

SEQ ID NO: 3191071 - DNA, 21 bp, Homo sapiens
ggaaaggggagagcctgctgg

SEQ ID NO: 3191072 - DNA, 20 bp, Homo sapiens
ggaaaggggtcggctgacca

SEQ ID NO: 3191073 - DNA, 19 bp, Homo sapiens
ggaaaggttttgtattttt

SEQ ID NO: 3191074 - DNA, 19 bp, Homo sapiens
ggaaagtacactctgctgt

SEQ ID NO: 3191075 - DNA, 18 bp, Homo sapiens
ggaaagtcagaatcagaa

SEQ ID NO: 3191076 - DNA, 13 bp, Homo sapiens
ggaaagtgaattt

SEQ ID NO: 3191077 - DNA, 22 bp, Homo sapiens
ggaaagtgaatttgaatgaaaa

SEQ ID NO: 3191078 - DNA, 14 bp, Homo sapiens
ggaaataaaaaagt

SEQ ID NO: 3191079 - DNA, 19 bp, Homo sapiens
ggaaataaaaaagtctcta

SEQ ID NO: 3191080 - DNA, 18 bp, Homo sapiens
ggaaataaaacctttcaa

SEQ ID NO: 3191081 - DNA, 19 bp, Homo sapiens
ggaaataaaacctttcaaa

SEQ ID NO: 3191082 - DNA, 17 bp, Homo sapiens
ggaaatccgagcggcta

SEQ ID NO: 3191083 - DNA, 15 bp, Homo sapiens
ggaaatgaagcaggg

SEQ ID NO: 3191084 - DNA, 22 bp, Homo sapiens
ggaaatgctattgttgtgggct

SEQ ID NO: 3191085 - DNA, 23 bp, Homo sapiens
ggaaattgagattagagggaggt

SEQ ID NO: 3191086 - DNA, 18 bp, Homo sapiens
ggaacaagtaatgtatta

SEQ ID NO: 3191087 - DNA, 22 bp, Homo sapiens
ggaacacctgatcttacagaaa

SEQ ID NO: 3191088 - DNA, 23 bp, Homo sapiens
ggaacactggtgggcagctgagg

SEQ ID NO: 3191089 - DNA, 16 bp, Homo sapiens
ggaacagaatgtttta

SEQ ID NO: 3191090 - DNA, 19 bp, Homo sapiens
ggaacagactggaagcaca

SEQ ID NO: 3191091 - DNA, 20 bp, Homo sapiens
ggaacagactggaagcacag

SEQ ID NO: 3191092 - DNA, 17 bp, Homo sapiens
ggaacagcactggggag

SEQ ID NO: 3191093 - DNA, 21 bp, Homo sapiens
ggaacagcactggggagtctt

SEQ ID NO: 3191094 - DNA, 14 bp, Homo sapiens
ggaacagtggctgg

SEQ ID NO: 3191095 - DNA, 18 bp, Homo sapiens
ggaacagtgtttcccata

SEQ ID NO: 3191096 - DNA, 18 bp, Homo sapiens
ggaacatttctgtaaata

SEQ ID NO: 3191097 - DNA, 12 bp, Homo sapiens
ggaacatttctt

SEQ ID NO: 3191098 - DNA, 21 bp, Homo sapiens
ggaacatttgatatttttcca

SEQ ID NO: 3191099 - DNA, 18 bp, Homo sapiens
ggaaccacagggccagag

SEQ ID NO: 3191100 - DNA, 21 bp, Homo sapiens
ggaaccagcatctcagcgcca

SEQ ID NO: 3191101 - DNA, 16 bp, Homo sapiens
ggaaccagggaggaga

SEQ ID NO: 3191102 - DNA, 16 bp, Homo sapiens
ggaaccccgcagcccg

SEQ ID NO: 3191103 - DNA, 17 bp, Homo sapiens
ggaaccccgcagcccgt

SEQ ID NO: 3191104 - DNA, 20 bp, Homo sapiens
ggaaccgctcacctagagcc

SEQ ID NO: 3191105 - DNA, 21 bp, Homo sapiens
ggaaccgctcacctagagcca

SEQ ID NO: 3191106 - DNA, 23 bp, Homo sapiens
ggaacctagtactctctgctcta

SEQ ID NO: 3191107 - DNA, 13 bp, Homo sapiens
ggaacctcccaga

SEQ ID NO: 3191108 - DNA, 15 bp, Homo sapiens
ggaacctcccagagg

SEQ ID NO: 3191109 - DNA, 23 bp, Homo sapiens
ggaacctcccagaggtccagccc

SEQ ID NO: 3191110 - DNA, 23 bp, Homo sapiens
ggaacctctgtctcatcctcctg

SEQ ID NO: 3191111 - DNA, 11 bp, Homo sapiens
ggaacctgcca

SEQ ID NO: 3191112 - DNA, 20 bp, Homo sapiens
ggaaccttccttcctgcttg

SEQ ID NO: 3191113 - DNA, 19 bp, Homo sapiens
ggaacgagcactggccaga

SEQ ID NO: 3191114 - DNA, 14 bp, Homo sapiens
ggaactaataaata

SEQ ID NO: 3191115 - DNA, 23 bp, Homo sapiens
ggaactaggctcttatgtgtgcc

SEQ ID NO: 3191116 - DNA, 19 bp, Homo sapiens
ggaactatacccgggacca

SEQ ID NO: 3191117 - DNA, 21 bp, Homo sapiens
ggaactcctaaacctttgccc

SEQ ID NO: 3191118 - DNA, 22 bp, Homo sapiens
ggaactcctaaacctttgcccc

SEQ ID NO: 3191119 - DNA, 12 bp, Homo sapiens
ggaactcctgcc

SEQ ID NO: 3191120 - DNA, 15 bp, Homo sapiens
ggaactcctgccaca

SEQ ID NO: 3191121 - DNA, 13 bp, Homo sapiens
ggaactccttggc

SEQ ID NO: 3191122 - DNA, 17 bp, Homo sapiens
ggaactccttggcctag

SEQ ID NO: 3191123 - DNA, 18 bp, Homo sapiens
ggaactctatctgggcct

SEQ ID NO: 3191124 - DNA, 21 bp, Homo sapiens
ggaactctatctgggcctggg

SEQ ID NO: 3191125 - DNA, 23 bp, Homo sapiens
ggaactctatctgggcctgggct

SEQ ID NO: 3191126 - DNA, 20 bp, Homo sapiens
ggaactgaccccctcccctg

SEQ ID NO: 3191127 - DNA, 17 bp, Homo sapiens
ggaactgtagggccagg

SEQ ID NO: 3191128 - DNA, 17 bp, Homo sapiens
ggaactgtccagagagc

SEQ ID NO: 3191129 - DNA, 14 bp, Homo sapiens
ggaacttcagagat

SEQ ID NO: 3191130 - DNA, 14 bp, Homo sapiens
ggaagaaagcaaca

SEQ ID NO: 3191131 - DNA, 14 bp, Homo sapiens
ggaagaaggcagtg

SEQ ID NO: 3191132 - DNA, 14 bp, Homo sapiens
ggaagaagggagaa

SEQ ID NO: 3191133 - DNA, 20 bp, Homo sapiens
ggaagaagtggtactagtgt

SEQ ID NO: 3191134 - DNA, 11 bp, Homo sapiens
ggaagaatgaa

SEQ ID NO: 3191135 - DNA, 16 bp, Homo sapiens
ggaagaatgaaagctg

SEQ ID NO: 3191136 - DNA, 19 bp, Homo sapiens
ggaagacacttcagatctg

SEQ ID NO: 3191137 - DNA, 21 bp, Homo sapiens
ggaagaccagctttgcagtga

SEQ ID NO: 3191138 - DNA, 15 bp, Homo sapiens
ggaagacgcagagca

SEQ ID NO: 3191139 - DNA, 15 bp, Homo sapiens
ggaagacgcctgagc

SEQ ID NO: 3191140 - DNA, 20 bp, Homo sapiens
ggaagagaagagggcccagc

SEQ ID NO: 3191141 - DNA, 16 bp, Homo sapiens
ggaagagacagcccag

SEQ ID NO: 3191142 - DNA, 19 bp, Homo sapiens
ggaagagcagaacggagcc

SEQ ID NO: 3191143 - DNA, 15 bp, Homo sapiens
gcttggttggctggc

SEQ ID NO: 3191144 - DNA, 13 bp, Homo sapiens
gcttgtaaatacc

SEQ ID NO: 3191145 - DNA, 18 bp, Homo sapiens
gcttgtaaatagctcagg

SEQ ID NO: 3191146 - DNA, 19 bp, Homo sapiens
gcttgtaaatagctcaggt

SEQ ID NO: 3191147 - DNA, 14 bp, Homo sapiens
gcttgtactgggac

SEQ ID NO: 3191148 - DNA, 18 bp, Homo sapiens
gcttgtagaactcactct

SEQ ID NO: 3191149 - DNA, 22 bp, Homo sapiens
gcttgtagaactcactctgggc

SEQ ID NO: 3191150 - DNA, 14 bp, Homo sapiens
gcttgtaggagctg

SEQ ID NO: 3191151 - DNA, 20 bp, Homo sapiens
gcttgtctatactccttccc

SEQ ID NO: 3191152 - DNA, 20 bp, Homo sapiens
gcttgtgaaaaaataaagaa

SEQ ID NO: 3191153 - DNA, 21 bp, Homo sapiens
gcttgtgatttccatttctga

SEQ ID NO: 3191154 - DNA, 14 bp, Homo sapiens
gcttgtgggctggt

SEQ ID NO: 3191155 - DNA, 17 bp, Homo sapiens
gcttgtgggctggtgcc

SEQ ID NO: 3191156 - DNA, 16 bp, Homo sapiens
gcttgtgtgtttcact

SEQ ID NO: 3191157 - DNA, 20 bp, Homo sapiens
gcttgtgtgtttcactttta

SEQ ID NO: 3191158 - DNA, 14 bp, Homo sapiens
gcttgttaaatttt

SEQ ID NO: 3191159 - DNA, 19 bp, Homo sapiens
gcttgttagagagaaagag

SEQ ID NO: 3191160 - DNA, 22 bp, Homo sapiens
gcttgttgaaaatatttctcta

SEQ ID NO: 3191161 - DNA, 18 bp, Homo sapiens
gcttgttgggattcctga

SEQ ID NO: 3191162 - DNA, 16 bp, Homo sapiens
gcttgtttacctttct

SEQ ID NO: 3191163 - DNA, 13 bp, Homo sapiens
gctttaaacaaat

SEQ ID NO: 3191164 - DNA, 21 bp, Homo sapiens
gctttaaactcagggacagag

SEQ ID NO: 3191165 - DNA, 18 bp, Homo sapiens
gctttaaagggcctgcct

SEQ ID NO: 3191166 - DNA, 12 bp, Homo sapiens
gctttaattgta

SEQ ID NO: 3191167 - DNA, 13 bp, Homo sapiens
gctttaattgtat

SEQ ID NO: 3191168 - DNA, 20 bp, Homo sapiens
gctttacatgctgtgctctt

SEQ ID NO: 3191169 - DNA, 16 bp, Homo sapiens
gctttacctttttgta

SEQ ID NO: 3191170 - DNA, 23 bp, Homo sapiens
gctttacctttttgtatgtgaac

SEQ ID NO: 3191171 - DNA, 16 bp, Homo sapiens
gctttatcttttcata

SEQ ID NO: 3191172 - DNA, 21 bp, Homo sapiens
gctttatgataatagattctc

SEQ ID NO: 3191173 - DNA, 23 bp, Homo sapiens
gctttattgttcacacaaagcct

SEQ ID NO: 3191174 - DNA, 19 bp, Homo sapiens
gctttattttttaagtatt

SEQ ID NO: 3191175 - DNA, 23 bp, Homo sapiens
gctttcaaaggagctcgaaggat

SEQ ID NO: 3191176 - DNA, 20 bp, Homo sapiens
gctttcaagacccctgtctt

SEQ ID NO: 3191177 - DNA, 14 bp, Homo sapiens
gctttcactaggaa

SEQ ID NO: 3191178 - DNA, 17 bp, Homo sapiens
gctttcagagccagtga

SEQ ID NO: 3191179 - DNA, 20 bp, Homo sapiens
gctttcccagtcccattcct

SEQ ID NO: 3191180 - DNA, 13 bp, Homo sapiens
gctttcccccagg

SEQ ID NO: 3191181 - DNA, 16 bp, Homo sapiens
gctttcccctgtgggg

SEQ ID NO: 3191182 - DNA, 13 bp, Homo sapiens
gctttccctgtgc

SEQ ID NO: 3191183 - DNA, 15 bp, Homo sapiens
gctttccctgtgcca

SEQ ID NO: 3191184 - DNA, 20 bp, Homo sapiens
gctttccctgtgccactttg

SEQ ID NO: 3191185 - DNA, 11 bp, Homo sapiens
gctttcctgaa

SEQ ID NO: 3191186 - DNA, 11 bp, Homo sapiens
gctttcctgcc

SEQ ID NO: 3191187 - DNA, 15 bp, Homo sapiens
gctttcctggtccct

SEQ ID NO: 3191188 - DNA, 13 bp, Homo sapiens
gctttctacccag

SEQ ID NO: 3191189 - DNA, 12 bp, Homo sapiens
gctttctagaag

SEQ ID NO: 3191190 - DNA, 21 bp, Homo sapiens
gctttctccggggtctgtgct

SEQ ID NO: 3191191 - DNA, 14 bp, Homo sapiens
gctttctggggcct

SEQ ID NO: 3191192 - DNA, 15 bp, Homo sapiens
gctttcttgctccct

SEQ ID NO: 3191193 - DNA, 14 bp, Homo sapiens
gctttcttgctggt

SEQ ID NO: 3191194 - DNA, 19 bp, Homo sapiens
gctttgaaagaagcaagac

SEQ ID NO: 3191195 - DNA, 20 bp, Homo sapiens
gctttgaaagaagcaagaca

SEQ ID NO: 3191196 - DNA, 14 bp, Homo sapiens
gctttgagaagcct

SEQ ID NO: 3191197 - DNA, 16 bp, Homo sapiens
gctttgagaagccttc

SEQ ID NO: 3191198 - DNA, 15 bp, Homo sapiens
gctttgagtccccca

SEQ ID NO: 3191199 - DNA, 14 bp, Homo sapiens
gctttgatccctga

SEQ ID NO: 3191200 - DNA, 15 bp, Homo sapiens
gctttgatccctgac

SEQ ID NO: 3191201 - DNA, 15 bp, Homo sapiens
gctttgattcatagt

SEQ ID NO: 3191202 - DNA, 21 bp, Homo sapiens
gctttgatttagattgagtaa

SEQ ID NO: 3191203 - DNA, 15 bp, Homo sapiens
gctttgcaggctctg

SEQ ID NO: 3191204 - DNA, 16 bp, Homo sapiens
gctttgcaggctctgg

SEQ ID NO: 3191205 - DNA, 12 bp, Homo sapiens
gctttgcagtga

SEQ ID NO: 3191206 - DNA, 18 bp, Homo sapiens
gctttgccaaaataccag

SEQ ID NO: 3191207 - DNA, 21 bp, Homo sapiens
gctttgccaaaataccagagc

SEQ ID NO: 3191208 - DNA, 20 bp, Homo sapiens
gctttgcccaacaccagccc

SEQ ID NO: 3191209 - DNA, 22 bp, Homo sapiens
gctttgcccaacaccagcccct

SEQ ID NO: 3191210 - DNA, 17 bp, Homo sapiens
gctttgctccgctccca

SEQ ID NO: 3191211 - DNA, 18 bp, Homo sapiens
gctttgctccgctcccac

SEQ ID NO: 3191212 - DNA, 23 bp, Homo sapiens
gctttgctccgctcccaccgccc

SEQ ID NO: 3191213 - DNA, 17 bp, Homo sapiens
gctttggaaaaatgggt

SEQ ID NO: 3191214 - DNA, 20 bp, Homo sapiens
gctttggaaaaatgggtctt

SEQ ID NO: 3191215 - DNA, 16 bp, Homo sapiens
gctttggctgaggggc

SEQ ID NO: 3191216 - DNA, 21 bp, Homo sapiens
gctttgggaaagcccagactt

SEQ ID NO: 3191217 - DNA, 14 bp, Homo sapiens
gctttgggaggcca

SEQ ID NO: 3191218 - DNA, 18 bp, Homo sapiens
gctttgggaggccaaggc

SEQ ID NO: 3191219 - DNA, 15 bp, Homo sapiens
gctttgggctgccct

SEQ ID NO: 3191220 - DNA, 16 bp, Homo sapiens
gctttgggctgccctg

SEQ ID NO: 3191221 - DNA, 18 bp, Homo sapiens
gctttgggctgccctggt

SEQ ID NO: 3191222 - DNA, 19 bp, Homo sapiens
gctttggggacagttggca

SEQ ID NO: 3191223 - DNA, 22 bp, Homo sapiens
gctttgtaatattctccccacc

SEQ ID NO: 3191224 - DNA, 23 bp, Homo sapiens
gctttgtaatattctccccaccc

SEQ ID NO: 3191225 - DNA, 20 bp, Homo sapiens
gctttgtaggtgagatgcaa

SEQ ID NO: 3191226 - DNA, 20 bp, Homo sapiens
gctttgtgcttggggctatt

SEQ ID NO: 3191227 - DNA, 20 bp, Homo sapiens
gctttgtttggatgtaattt

SEQ ID NO: 3191228 - DNA, 15 bp, Homo sapiens
gctttgttttatata

SEQ ID NO: 3191229 - DNA, 15 bp, Homo sapiens
gcttttaagaaacac

SEQ ID NO: 3191230 - DNA, 19 bp, Homo sapiens
gcttttaccattagcataa

SEQ ID NO: 3191231 - DNA, 18 bp, Homo sapiens
gcttttacgtagtaaaag

SEQ ID NO: 3191232 - DNA, 12 bp, Homo sapiens
gcttttagaaaa

SEQ ID NO: 3191233 - DNA, 13 bp, Homo sapiens
gcttttagaaaag

SEQ ID NO: 3191234 - DNA, 19 bp, Homo sapiens
gcttttagaaggtaatttg

SEQ ID NO: 3191235 - DNA, 21 bp, Homo sapiens
gcttttaggagaattcacaga

SEQ ID NO: 3191236 - DNA, 20 bp, Homo sapiens
gcttttagttcatatataca

SEQ ID NO: 3191237 - DNA, 16 bp, Homo sapiens
gcttttatagaggcta

SEQ ID NO: 3191238 - DNA, 14 bp, Homo sapiens
gcttttatggatga

SEQ ID NO: 3191239 - DNA, 16 bp, Homo sapiens
gcttttattttaatat

SEQ ID NO: 3191240 - DNA, 15 bp, Homo sapiens
gcttttattttgaaa

SEQ ID NO: 3191241 - DNA, 22 bp, Homo sapiens
gcttttattttgaaaagcttct

SEQ ID NO: 3191242 - DNA, 14 bp, Homo sapiens
gcttttcactgcct

SEQ ID NO: 3191243 - DNA, 16 bp, Homo sapiens
gcttttcatggaagtg

SEQ ID NO: 3191244 - DNA, 15 bp, Homo sapiens
gcttttccaggatcc

SEQ ID NO: 3191245 - DNA, 15 bp, Homo sapiens
gcttttcctcccttg

SEQ ID NO: 3191246 - DNA, 13 bp, Homo sapiens
gcttttctcctct

SEQ ID NO: 3191247 - DNA, 18 bp, Homo sapiens
gcttttctggggcccagg

SEQ ID NO: 3191248 - DNA, 20 bp, Homo sapiens
gcttttctggggcccaggaa

SEQ ID NO: 3191249 - DNA, 18 bp, Homo sapiens
gcttttctgtattttatt

SEQ ID NO: 3191250 - DNA, 18 bp, Homo sapiens
gcttttgaaaactgctga

SEQ ID NO: 3191251 - DNA, 16 bp, Homo sapiens
gcttttgagcctcaga

SEQ ID NO: 3191252 - DNA, 21 bp, Homo sapiens
gcttttgcagacgggcaagaa

SEQ ID NO: 3191253 - DNA, 18 bp, Homo sapiens
gcttttgcataatgcaat

SEQ ID NO: 3191254 - DNA, 12 bp, Homo sapiens
gcttttgtgtgc

SEQ ID NO: 3191255 - DNA, 15 bp, Homo sapiens
gcttttgttgtgact

SEQ ID NO: 3191256 - DNA, 13 bp, Homo sapiens
gcttttgtttttt

SEQ ID NO: 3191257 - DNA, 17 bp, Homo sapiens
gctttttaaaacattag

SEQ ID NO: 3191258 - DNA, 13 bp, Homo sapiens
gctttttaattaa

SEQ ID NO: 3191259 - DNA, 13 bp, Homo sapiens
gctttttaattgt

SEQ ID NO: 3191260 - DNA, 21 bp, Homo sapiens
gctttttaattgttgtttctt

SEQ ID NO: 3191261 - DNA, 12 bp, Homo sapiens
gctttttataaa

SEQ ID NO: 3191262 - DNA, 20 bp, Homo sapiens
gctttttattccctgcccaa

SEQ ID NO: 3191263 - DNA, 17 bp, Homo sapiens
gctttttatttctgcat

SEQ ID NO: 3191264 - DNA, 15 bp, Homo sapiens
gctttttcacagtca

SEQ ID NO: 3191265 - DNA, 17 bp, Homo sapiens
gctttttgaaatgaaat

SEQ ID NO: 3191266 - DNA, 18 bp, Homo sapiens
gctttttgaaatgaaatt

SEQ ID NO: 3191267 - DNA, 20 bp, Homo sapiens
gctttttgaggtggcacttt

SEQ ID NO: 3191268 - DNA, 12 bp, Homo sapiens
gctttttggaat

SEQ ID NO: 3191269 - DNA, 13 bp, Homo sapiens
gctttttggaatc

SEQ ID NO: 3191270 - DNA, 17 bp, Homo sapiens
gcttttttccaaaacaa

SEQ ID NO: 3191271 - DNA, 18 bp, Homo sapiens
gcttttttgattttgctg

SEQ ID NO: 3191272 - DNA, 15 bp, Homo sapiens
gctttttttcttgct

SEQ ID NO: 3191273 - DNA, 23 bp, Homo sapiens
gcttccacccgtctctctgccca

SEQ ID NO: 3191274 - DNA, 19 bp, Homo sapiens
gcttccagaaaaccccagc

SEQ ID NO: 3191275 - DNA, 17 bp, Homo sapiens
gcttccagcttcaggca

SEQ ID NO: 3191276 - DNA, 18 bp, Homo sapiens
gcttccagcttcaggcac

SEQ ID NO: 3191277 - DNA, 19 bp, Homo sapiens
gcttccagcttcaggcacc

SEQ ID NO: 3191278 - DNA, 15 bp, Homo sapiens
gcttccatgattcta

SEQ ID NO: 3191279 - DNA, 18 bp, Homo sapiens
gcttccatgattctattt

SEQ ID NO: 3191280 - DNA, 19 bp, Homo sapiens
gcttccatgattctattta

SEQ ID NO: 3191281 - DNA, 17 bp, Homo sapiens
gcttccattaacaaatg

SEQ ID NO: 3191282 - DNA, 12 bp, Homo sapiens
gcttccattcca

SEQ ID NO: 3191283 - DNA, 14 bp, Homo sapiens
gcttcccacctccc

SEQ ID NO: 3191284 - DNA, 15 bp, Homo sapiens
gcttcccacctccct

SEQ ID NO: 3191285 - DNA, 12 bp, Homo sapiens
gcttcccatcct

SEQ ID NO: 3191286 - DNA, 22 bp, Homo sapiens
gcttcccatcctaccctcgggc

SEQ ID NO: 3191287 - DNA, 15 bp, Homo sapiens
gcttcccccatagcc

SEQ ID NO: 3191288 - DNA, 16 bp, Homo sapiens
gcttcccccatagcca

SEQ ID NO: 3191289 - DNA, 16 bp, Homo sapiens
gcttccccttcctaag

SEQ ID NO: 3191290 - DNA, 17 bp, Homo sapiens
gcttcccgctcagccct

SEQ ID NO: 3191291 - DNA, 18 bp, Homo sapiens
gcttcccgctcagccctc

SEQ ID NO: 3191292 - DNA, 13 bp, Homo sapiens
gcttccctcctgc

SEQ ID NO: 3191293 - DNA, 16 bp, Homo sapiens
gcttccctcctgcccg

SEQ ID NO: 3191294 - DNA, 18 bp, Homo sapiens
gcttccctgacttgcttt

SEQ ID NO: 3191295 - DNA, 18 bp, Homo sapiens
gcttccgccactcagcca

SEQ ID NO: 3191296 - DNA, 17 bp, Homo sapiens
gcttccggtagggaggc

SEQ ID NO: 3191297 - DNA, 20 bp, Homo sapiens
gcttccggtagggaggcagc

SEQ ID NO: 3191298 - DNA, 17 bp, Homo sapiens
gcttccgtactatggct

SEQ ID NO: 3191299 - DNA, 18 bp, Homo sapiens
gcttcctataacttcttc

SEQ ID NO: 3191300 - DNA, 21 bp, Homo sapiens
gcttcctataacttcttcctg

SEQ ID NO: 3191301 - DNA, 22 bp, Homo sapiens
gcttcctccgtccacccaggct

SEQ ID NO: 3191302 - DNA, 13 bp, Homo sapiens
gcttcctcctgga

SEQ ID NO: 3191303 - DNA, 23 bp, Homo sapiens
gcttcctctagaagccaagggaa

SEQ ID NO: 3191304 - DNA, 12 bp, Homo sapiens
gcttcctgaaat

SEQ ID NO: 3191305 - DNA, 20 bp, Homo sapiens
gcttcctgaaataaacactg

SEQ ID NO: 3191306 - DNA, 22 bp, Homo sapiens
gcttcctgaaataaacactggt

SEQ ID NO: 3191307 - DNA, 20 bp, Homo sapiens
gcttcctgcgtcctcctcac

SEQ ID NO: 3191308 - DNA, 16 bp, Homo sapiens
gcttcctgggtcctgt

SEQ ID NO: 3191309 - DNA, 22 bp, Homo sapiens
gcttccttagaacttctacaga

SEQ ID NO: 3191310 - DNA, 22 bp, Homo sapiens
gcttccttggcatcacagggca

SEQ ID NO: 3191311 - DNA, 23 bp, Homo sapiens
gcttcctttcctgtgtgtactct

SEQ ID NO: 3191312 - DNA, 14 bp, Homo sapiens
gcttcgacttttct

SEQ ID NO: 3191313 - DNA, 19 bp, Homo sapiens
gcttctaaatggtgctgca

SEQ ID NO: 3191314 - DNA, 21 bp, Homo sapiens
gcttctaaatggtgctgcaga

SEQ ID NO: 3191315 - DNA, 12 bp, Homo sapiens
gcttctaataaa

SEQ ID NO: 3191316 - DNA, 19 bp, Homo sapiens
gcttctataattttgcctt

SEQ ID NO: 3191317 - DNA, 14 bp, Homo sapiens
gcttctatcccagg

SEQ ID NO: 3191318 - DNA, 21 bp, Homo sapiens
gcttctcaccgtgcagagctg

SEQ ID NO: 3191319 - DNA, 14 bp, Homo sapiens
gcttctcatcccca

SEQ ID NO: 3191320 - DNA, 16 bp, Homo sapiens
gcttctcatcttgtga

SEQ ID NO: 3191321 - DNA, 18 bp, Homo sapiens
gcttctcatcttgtgaaa

SEQ ID NO: 3191322 - DNA, 17 bp, Homo sapiens
gcttctccagcctggac

SEQ ID NO: 3191323 - DNA, 16 bp, Homo sapiens
gcttctccagtggtga

SEQ ID NO: 3191324 - DNA, 13 bp, Homo sapiens
gcttctccccaga

SEQ ID NO: 3191325 - DNA, 14 bp, Homo sapiens
gcttctccgccagc

SEQ ID NO: 3191326 - DNA, 18 bp, Homo sapiens
gcttctccgccagcctcc

SEQ ID NO: 3191327 - DNA, 20 bp, Homo sapiens
gcttctcctgcgccccgccc

SEQ ID NO: 3191328 - DNA, 23 bp, Homo sapiens
gcttctcctgttttatatattat

SEQ ID NO: 3191329 - DNA, 17 bp, Homo sapiens
gcttctctgacttctgc

SEQ ID NO: 3191330 - DNA, 22 bp, Homo sapiens
gcttctctgacttctgcctgga

SEQ ID NO: 3191331 - DNA, 23 bp, Homo sapiens
gcttctctgcagtaaaacacatt

SEQ ID NO: 3191332 - DNA, 13 bp, Homo sapiens
gcttctgcaccct

SEQ ID NO: 3191333 - DNA, 14 bp, Homo sapiens
gcttctgcaccctc

SEQ ID NO: 3191334 - DNA, 21 bp, Homo sapiens
gcttctgcaccctccaccctg

SEQ ID NO: 3191335 - DNA, 13 bp, Homo sapiens
gcttctgcctgca

SEQ ID NO: 3191336 - DNA, 16 bp, Homo sapiens
gcttctgcttttctgc

SEQ ID NO: 3191337 - DNA, 19 bp, Homo sapiens
gcttctgcttttctgccct

SEQ ID NO: 3191338 - DNA, 17 bp, Homo sapiens
gcttctggaaactacca

SEQ ID NO: 3191339 - DNA, 20 bp, Homo sapiens
gcttctggaatttgttcaag

SEQ ID NO: 3191340 - DNA, 14 bp, Homo sapiens
gcttctggagccct

SEQ ID NO: 3191341 - DNA, 13 bp, Homo sapiens
gcttctgtagctt

SEQ ID NO: 3191342 - DNA, 19 bp, Homo sapiens
gcttctgtgatgagctgat

SEQ ID NO: 3191343 - DNA, 15 bp, Homo sapiens
gcttcttaaagagtt

SEQ ID NO: 3191344 - DNA, 18 bp, Homo sapiens
gcttcttactattaagca

SEQ ID NO: 3191345 - DNA, 18 bp, Homo sapiens
gcttcttcacaggcactc

SEQ ID NO: 3191346 - DNA, 15 bp, Homo sapiens
gcttcttcctaggtc

SEQ ID NO: 3191347 - DNA, 21 bp, Homo sapiens
gcttcttcctaggtccaagcc

SEQ ID NO: 3191348 - DNA, 15 bp, Homo sapiens
gcttcttgcactcct

SEQ ID NO: 3191349 - DNA, 16 bp, Homo sapiens
gcttcttgcactcctt

SEQ ID NO: 3191350 - DNA, 17 bp, Homo sapiens
gcttcttgcctctgtgc

SEQ ID NO: 3191351 - DNA, 17 bp, Homo sapiens
gcttcttgtgttttact

SEQ ID NO: 3191352 - DNA, 15 bp, Homo sapiens
gcttcttttgaactg

SEQ ID NO: 3191353 - DNA, 17 bp, Homo sapiens
gcttcttttgaactgtt

SEQ ID NO: 3191354 - DNA, 19 bp, Homo sapiens
gcttgaaaagctagtgtac

SEQ ID NO: 3191355 - DNA, 19 bp, Homo sapiens
gcttgaaattactgtgtaa

SEQ ID NO: 3191356 - DNA, 17 bp, Homo sapiens
gcttgaacacagtattt

SEQ ID NO: 3191357 - DNA, 23 bp, Homo sapiens
gcttgaacctgggaggcagaggt

SEQ ID NO: 3191358 - DNA, 19 bp, Homo sapiens
gcttgaactaggctgagca

SEQ ID NO: 3191359 - DNA, 22 bp, Homo sapiens
gcttgaagatcgttagtatcta

SEQ ID NO: 3191360 - DNA, 12 bp, Homo sapiens
gcttgaagccaa

SEQ ID NO: 3191361 - DNA, 14 bp, Homo sapiens
gcttgaagccaaag

SEQ ID NO: 3191362 - DNA, 18 bp, Homo sapiens
gcttgaagccaaagaaaa

SEQ ID NO: 3191363 - DNA, 11 bp, Homo sapiens
gcttgaagctg

SEQ ID NO: 3191364 - DNA, 18 bp, Homo sapiens
gcttgaagtaactgtgga

SEQ ID NO: 3191365 - DNA, 16 bp, Homo sapiens
gcttgacacagtcagc

SEQ ID NO: 3191366 - DNA, 13 bp, Homo sapiens
gcttgacatgtgc

SEQ ID NO: 3191367 - DNA, 14 bp, Homo sapiens
gcttgacctgaggc

SEQ ID NO: 3191368 - DNA, 17 bp, Homo sapiens
gcttgactcccaagttt

SEQ ID NO: 3191369 - DNA, 21 bp, Homo sapiens
gcttgactggatggaaggaga

SEQ ID NO: 3191370 - DNA, 22 bp, Homo sapiens
gcttgagccgggcccctgggct

SEQ ID NO: 3191371 - DNA, 20 bp, Homo sapiens
gcttgagggttgggctggtg

SEQ ID NO: 3191372 - DNA, 22 bp, Homo sapiens
gcttgagggttgggctggtgtc

SEQ ID NO: 3191373 - DNA, 13 bp, Homo sapiens
gcttgatgaagca

SEQ ID NO: 3191374 - DNA, 21 bp, Homo sapiens
gcttgccaaagtacagaattt

SEQ ID NO: 3191375 - DNA, 22 bp, Homo sapiens
gcttgccaaagtacagaatttg

SEQ ID NO: 3191376 - DNA, 22 bp, Homo sapiens
gcttgcccagtacatttaaatt

SEQ ID NO: 3191377 - DNA, 23 bp, Homo sapiens
gcttgcccagtacatttaaattt

SEQ ID NO: 3191378 - DNA, 14 bp, Homo sapiens
gcttgccccggccc

SEQ ID NO: 3191379 - DNA, 16 bp, Homo sapiens
gcttgcgtatgtctgt

SEQ ID NO: 3191380 - DNA, 13 bp, Homo sapiens
gcttgctccaggg

SEQ ID NO: 3191381 - DNA, 19 bp, Homo sapiens
gcttggaaagcatcacctc

SEQ ID NO: 3191382 - DNA, 18 bp, Homo sapiens
gcttggaaattccttgcc

SEQ ID NO: 3191383 - DNA, 21 bp, Homo sapiens
gcttggaaattccttgcccca

SEQ ID NO: 3191384 - DNA, 15 bp, Homo sapiens
gcttggaagccaggt

SEQ ID NO: 3191385 - DNA, 13 bp, Homo sapiens
gcttggcagctga

SEQ ID NO: 3191386 - DNA, 19 bp, Homo sapiens
gcttggcgtggagcaggcg

SEQ ID NO: 3191387 - DNA, 15 bp, Homo sapiens
gcttggctccatgct

SEQ ID NO: 3191388 - DNA, 12 bp, Homo sapiens
gcttgggaaaaa

SEQ ID NO: 3191389 - DNA, 23 bp, Homo sapiens
gcttgggaaaaaaacttggcact

SEQ ID NO: 3191390 - DNA, 21 bp, Homo sapiens
gcttgggagagcccctggggc

SEQ ID NO: 3191391 - DNA, 14 bp, Homo sapiens
gcttgggatttgct

SEQ ID NO: 3191392 - DNA, 15 bp, Homo sapiens
gcttgggatttgctg

SEQ ID NO: 3191393 - DNA, 16 bp, Homo sapiens
gcttgggctgacccag

SEQ ID NO: 3191394 - DNA, 17 bp, Homo sapiens
gcttgggctgacccagc

SEQ ID NO: 3191395 - DNA, 21 bp, Homo sapiens
gcttgggctgacccagcatct

SEQ ID NO: 3191396 - DNA, 20 bp, Homo sapiens
gcttggggccaccaaagctg

SEQ ID NO: 3191397 - DNA, 16 bp, Homo sapiens
gcttggggcttcctaa

SEQ ID NO: 3191398 - DNA, 24 bp, Homo sapiens
gcttgggggatgactagaggcagg

SEQ ID NO: 3191399 - DNA, 20 bp, Homo sapiens
gcttgggtggtgggtgctgg

SEQ ID NO: 3191400 - DNA, 20 bp, Homo sapiens
gcttggtggggctcgtggcc

SEQ ID NO: 3191401 - DNA, 21 bp, Homo sapiens
gcttggtggggctcgtggcct

SEQ ID NO: 3191402 - DNA, 20 bp, Homo sapiens
tcgaggcaccggcgctgcag

SEQ ID NO: 3191403 - DNA, 21 bp, Homo sapiens
tcgaggcaccggcgctgcagg

SEQ ID NO: 3191404 - DNA, 14 bp, Homo sapiens
tcgaggcctgcaaa

SEQ ID NO: 3191405 - DNA, 23 bp, Homo sapiens
tcgaggcctgcaaaccttcctgg

SEQ ID NO: 3191406 - DNA, 14 bp, Homo sapiens
tcgaggggctctca

SEQ ID NO: 3191407 - DNA, 18 bp, Homo sapiens
tcgaggggctctcagctc

SEQ ID NO: 3191408 - DNA, 21 bp, Homo sapiens
tcgatacccaggaccaagcca

SEQ ID NO: 3191409 - DNA, 19 bp, Homo sapiens
tcgatactgcgactttctg

SEQ ID NO: 3191410 - DNA, 20 bp, Homo sapiens
tcgatactgcgactttctgc

SEQ ID NO: 3191411 - DNA, 13 bp, Homo sapiens
tcgatatgtatat

SEQ ID NO: 3191412 - DNA, 21 bp, Homo sapiens
tcgatatgtatatcattctac

SEQ ID NO: 3191413 - DNA, 19 bp, Homo sapiens
tcgatcctggattcactca

SEQ ID NO: 3191414 - DNA, 19 bp, Homo sapiens
tcgatgaagcccaataaac

SEQ ID NO: 3191415 - DNA, 22 bp, Homo sapiens
tcgatgttttattatttctatt

SEQ ID NO: 3191416 - DNA, 15 bp, Homo sapiens
tcgatttctacctca

SEQ ID NO: 3191417 - DNA, 23 bp, Homo sapiens
tcgcaatagttttttacttctct

SEQ ID NO: 3191418 - DNA, 17 bp, Homo sapiens
tcgcaccattctgactc

SEQ ID NO: 3191419 - DNA, 15 bp, Homo sapiens
tcgcacccccctgtt

SEQ ID NO: 3191420 - DNA, 22 bp, Homo sapiens
tcgcacccccctgttctaaggg

SEQ ID NO: 3191421 - DNA, 12 bp, Homo sapiens
tcgcacctacca

SEQ ID NO: 3191422 - DNA, 19 bp, Homo sapiens
tcgcaggagtctctgccac

SEQ ID NO: 3191423 - DNA, 18 bp, Homo sapiens
tcgcaggatccgctgcca

SEQ ID NO: 3191424 - DNA, 19 bp, Homo sapiens
tcgcaggatccgctgccac

SEQ ID NO: 3191425 - DNA, 20 bp, Homo sapiens
tcgcatggtcacacactgat

SEQ ID NO: 3191426 - DNA, 19 bp, Homo sapiens
tcgccaaggactgactgag

SEQ ID NO: 3191427 - DNA, 18 bp, Homo sapiens
tcgccacctttcaccctc

SEQ ID NO: 3191428 - DNA, 13 bp, Homo sapiens
tcgcccagcagga

SEQ ID NO: 3191429 - DNA, 18 bp, Homo sapiens
tcgccccacctccacctg

SEQ ID NO: 3191430 - DNA, 15 bp, Homo sapiens
tcgccccagatcacc

SEQ ID NO: 3191431 - DNA, 20 bp, Homo sapiens
tcgccccagatcaccagccc

SEQ ID NO: 3191432 - DNA, 22 bp, Homo sapiens
tcgccccagatcaccagcccgg

SEQ ID NO: 3191433 - DNA, 16 bp, Homo sapiens
tcgccctcctttctgt

SEQ ID NO: 3191434 - DNA, 18 bp, Homo sapiens
tcgccctcctttctgtgc

SEQ ID NO: 3191435 - DNA, 19 bp, Homo sapiens
tcgccggccttgttttatt

SEQ ID NO: 3191436 - DNA, 22 bp, Homo sapiens
tcgccgtgttactgttgcactg

SEQ ID NO: 3191437 - DNA, 18 bp, Homo sapiens
tcgcctaccaatctctgc

SEQ ID NO: 3191438 - DNA, 21 bp, Homo sapiens
tcgcctgacaaccactggtct

SEQ ID NO: 3191439 - DNA, 18 bp, Homo sapiens
tcgcctgagcccaggagg

SEQ ID NO: 3191440 - DNA, 19 bp, Homo sapiens
tcgcctgtggagctcagcc

SEQ ID NO: 3191441 - DNA, 21 bp, Homo sapiens
tcgcctgtggagctcagcccc

SEQ ID NO: 3191442 - DNA, 13 bp, Homo sapiens
tcctcttgtccta

SEQ ID NO: 3191443 - DNA, 20 bp, Homo sapiens
tcctcttgtctgatttctta

SEQ ID NO: 3191444 - DNA, 21 bp, Homo sapiens
tcctcttttatcttggactga

SEQ ID NO: 3191445 - DNA, 21 bp, Homo sapiens
tcctcttttgtgctgcttctc

SEQ ID NO: 3191446 - DNA, 18 bp, Homo sapiens
tcctgaaagaaacagtta

SEQ ID NO: 3191447 - DNA, 16 bp, Homo sapiens
tcctgaaagggcactt

SEQ ID NO: 3191448 - DNA, 12 bp, Homo sapiens
tcctgaaataaa

SEQ ID NO: 3191449 - DNA, 18 bp, Homo sapiens
tcctgaaataaacactgg

SEQ ID NO: 3191450 - DNA, 16 bp, Homo sapiens
tcctgaaccgcacagc

SEQ ID NO: 3191451 - DNA, 23 bp, Homo sapiens
tcctgaaccgcacagctcaggag

SEQ ID NO: 3191452 - DNA, 19 bp, Homo sapiens
tcctgaactcttctgcaaa

SEQ ID NO: 3191453 - DNA, 19 bp, Homo sapiens
tcctgaactttctccctca

SEQ ID NO: 3191454 - DNA, 13 bp, Homo sapiens
tcctgaagaatta

SEQ ID NO: 3191455 - DNA, 14 bp, Homo sapiens
tcctgaatctgtgc

SEQ ID NO: 3191456 - DNA, 15 bp, Homo sapiens
tcctgaattctattt

SEQ ID NO: 3191457 - DNA, 15 bp, Homo sapiens
tcctgacagaaggtg

SEQ ID NO: 3191458 - DNA, 16 bp, Homo sapiens
tcctgacagaaggtgc

SEQ ID NO: 3191459 - DNA, 17 bp, Homo sapiens
tcctgacagaaggtgcc

SEQ ID NO: 3191460 - DNA, 13 bp, Homo sapiens
tcctgaccaccct

SEQ ID NO: 3191461 - DNA, 15 bp, Homo sapiens
tcctgacccagtccc

SEQ ID NO: 3191462 - DNA, 20 bp, Homo sapiens
tcctgacgaaactggccccg

SEQ ID NO: 3191463 - DNA, 13 bp, Homo sapiens
tcctgacgccctg

SEQ ID NO: 3191464 - DNA, 23 bp, Homo sapiens
tcctgacgccctgcgttggagcc

SEQ ID NO: 3191465 - DNA, 20 bp, Homo sapiens
tcctgacgtctgaagcttga

SEQ ID NO: 3191466 - DNA, 19 bp, Homo sapiens
tcctgactcaacatgttac

SEQ ID NO: 3191467 - DNA, 22 bp, Homo sapiens
tcctgactcctacctgccctgg

SEQ ID NO: 3191468 - DNA, 20 bp, Homo sapiens
tcctgactgaaagtaggggg

SEQ ID NO: 3191469 - DNA, 22 bp, Homo sapiens
tcctgactgtaacatattctgt

SEQ ID NO: 3191470 - DNA, 13 bp, Homo sapiens
tcctgacttctaa

SEQ ID NO: 3191471 - DNA, 18 bp, Homo sapiens
tcctgagaaggcgaggag

SEQ ID NO: 3191472 - DNA, 13 bp, Homo sapiens
tcctgagccccgc

SEQ ID NO: 3191473 - DNA, 16 bp, Homo sapiens
tcctgagcctgtgggt

SEQ ID NO: 3191474 - DNA, 19 bp, Homo sapiens
tcctgagcctgtgggtccc

SEQ ID NO: 3191475 - DNA, 15 bp, Homo sapiens
tcctgaggctccact

SEQ ID NO: 3191476 - DNA, 17 bp, Homo sapiens
tcctgaggctccacttg

SEQ ID NO: 3191477 - DNA, 19 bp, Homo sapiens
tcctgaggctccacttggt

SEQ ID NO: 3191478 - DNA, 15 bp, Homo sapiens
tcctgaggggcatct

SEQ ID NO: 3191479 - DNA, 16 bp, Homo sapiens
tcctgaggggcatctg

SEQ ID NO: 3191480 - DNA, 19 bp, Homo sapiens
tcctgaggggcatctgccc

SEQ ID NO: 3191481 - DNA, 22 bp, Homo sapiens
tcctgaggggcatctgcccctc

SEQ ID NO: 3191482 - DNA, 17 bp, Homo sapiens
tcctgagtggccaggga

SEQ ID NO: 3191483 - DNA, 18 bp, Homo sapiens
tcctgataaagcacagct

SEQ ID NO: 3191484 - DNA, 13 bp, Homo sapiens
tcctgatggccaa

SEQ ID NO: 3191485 - DNA, 15 bp, Homo sapiens
tcctgatggccaaga

SEQ ID NO: 3191486 - DNA, 18 bp, Homo sapiens
tcctgatggtcagctccc

SEQ ID NO: 3191487 - DNA, 20 bp, Homo sapiens
tcctgatggtcagctccctt

SEQ ID NO: 3191488 - DNA, 15 bp, Homo sapiens
tcctgattaaaacag

SEQ ID NO: 3191489 - DNA, 17 bp, Homo sapiens
tcctgattgtttacagt

SEQ ID NO: 3191490 - DNA, 16 bp, Homo sapiens
tcctgcaattttctaa

SEQ ID NO: 3191491 - DNA, 21 bp, Homo sapiens
tcctgcacttacttgcttatt

SEQ ID NO: 3191492 - DNA, 11 bp, Homo sapiens
tcctgcagaca

SEQ ID NO: 3191493 - DNA, 21 bp, Homo sapiens
tcctgcagacacctggactga

SEQ ID NO: 3191494 - DNA, 17 bp, Homo sapiens
tcctgcagaccacgccc

SEQ ID NO: 3191495 - DNA, 19 bp, Homo sapiens
tcctgcagcaaacactcca

SEQ ID NO: 3191496 - DNA, 22 bp, Homo sapiens
tcctgcagcaaacactccaccc

SEQ ID NO: 3191497 - DNA, 22 bp, Homo sapiens
tcctgcagcatggtccctgcct

SEQ ID NO: 3191498 - DNA, 17 bp, Homo sapiens
tcctgcagccccagaag

SEQ ID NO: 3191499 - DNA, 20 bp, Homo sapiens
tcctgcagccccagaagaaa

SEQ ID NO: 3191500 - DNA, 22 bp, Homo sapiens
tcctgcaggcaggaacaaacag

SEQ ID NO: 3191501 - DNA, 15 bp, Homo sapiens
tcctgccacaacaga

SEQ ID NO: 3191502 - DNA, 22 bp, Homo sapiens
tcctgccacaacagaataaagc

SEQ ID NO: 3191503 - DNA, 13 bp, Homo sapiens
tcctgccaccagc

SEQ ID NO: 3191504 - DNA, 18 bp, Homo sapiens
tcctgccaccagcatcca

SEQ ID NO: 3191505 - DNA, 21 bp, Homo sapiens
tcctgccagccccacacagct

SEQ ID NO: 3191506 - DNA, 12 bp, Homo sapiens
tcctgccagctg

SEQ ID NO: 3191507 - DNA, 16 bp, Homo sapiens
tcctgccagctgcctt

SEQ ID NO: 3191508 - DNA, 13 bp, Homo sapiens
tcctgcccagtcc

SEQ ID NO: 3191509 - DNA, 21 bp, Homo sapiens
tcctgcccagtcccccaaccc

SEQ ID NO: 3191510 - DNA, 13 bp, Homo sapiens
tcctgcccatgtg

SEQ ID NO: 3191511 - DNA, 23 bp, Homo sapiens
tcctgccctacagaggtctctgc

SEQ ID NO: 3191512 - DNA, 18 bp, Homo sapiens
tcctgccctgtccctgtc

SEQ ID NO: 3191513 - DNA, 18 bp, Homo sapiens
tcctgccctgttgtgtat

SEQ ID NO: 3191514 - DNA, 22 bp, Homo sapiens
tcctgccgctcctctctagaac

SEQ ID NO: 3191515 - DNA, 16 bp, Homo sapiens
tcctgccggtgggacc

SEQ ID NO: 3191516 - DNA, 16 bp, Homo sapiens
tcctgcctcagcctcc

SEQ ID NO: 3191517 - DNA, 19 bp, Homo sapiens
tcctgcctcagcctcccaa

SEQ ID NO: 3191518 - DNA, 17 bp, Homo sapiens
tcctgcctcagcctccg

SEQ ID NO: 3191519 - DNA, 13 bp, Homo sapiens
tcctgcctccgct

SEQ ID NO: 3191520 - DNA, 14 bp, Homo sapiens
tcctgcctccgctg

SEQ ID NO: 3191521 - DNA, 18 bp, Homo sapiens
tcctgcctccgctggctt

SEQ ID NO: 3191522 - DNA, 13 bp, Homo sapiens
tcctgcctggcca

SEQ ID NO: 3191523 - DNA, 16 bp, Homo sapiens
tcctgcctggccaggc

SEQ ID NO: 3191524 - DNA, 19 bp, Homo sapiens
tcctgcctgggtgggacag

SEQ ID NO: 3191525 - DNA, 22 bp, Homo sapiens
tcctgcctgggtgggacagcct

SEQ ID NO: 3191526 - DNA, 17 bp, Homo sapiens
tcctgcctttaagccaa

SEQ ID NO: 3191527 - DNA, 19 bp, Homo sapiens
tcctgcctttaagccaaag

SEQ ID NO: 3191528 - DNA, 21 bp, Homo sapiens
tcctgcgccccgcccacaccc

SEQ ID NO: 3191529 - DNA, 14 bp, Homo sapiens
tcctgcgggtgggg

SEQ ID NO: 3191530 - DNA, 14 bp, Homo sapiens
tcctgcgggtttta

SEQ ID NO: 3191531 - DNA, 16 bp, Homo sapiens
tcctgcgtcctcctca

SEQ ID NO: 3191532 - DNA, 13 bp, Homo sapiens
tcctgctacagga

SEQ ID NO: 3191533 - DNA, 22 bp, Homo sapiens
tcctgctcaactctacccctgc

SEQ ID NO: 3191534 - DNA, 14 bp, Homo sapiens
tcctgctccagaat

SEQ ID NO: 3191535 - DNA, 21 bp, Homo sapiens
tcctgctccatgactggctgt

SEQ ID NO: 3191536 - DNA, 13 bp, Homo sapiens
tcctgctcctccc

SEQ ID NO: 3191537 - DNA, 14 bp, Homo sapiens
tcctgctcctccct

SEQ ID NO: 3191538 - DNA, 13 bp, Homo sapiens
tcctgctcctttt

SEQ ID NO: 3191539 - DNA, 12 bp, Homo sapiens
tcctgctgctgt

SEQ ID NO: 3191540 - DNA, 13 bp, Homo sapiens
tcctgctgctgta

SEQ ID NO: 3191541 - DNA, 22 bp, Homo sapiens
tcctgctgctgtaactgctgag

SEQ ID NO: 3191542 - DNA, 13 bp, Homo sapiens
tcctgctggggcc

SEQ ID NO: 3191543 - DNA, 14 bp, Homo sapiens
tcctgctggtacct

SEQ ID NO: 3191544 - DNA, 13 bp, Homo sapiens
tcctgcttttagg

SEQ ID NO: 3191545 - DNA, 15 bp, Homo sapiens
tcctggaaacagcat

SEQ ID NO: 3191546 - DNA, 16 bp, Homo sapiens
tcctggaaacagcatg

SEQ ID NO: 3191547 - DNA, 22 bp, Homo sapiens
tcctggaaaggctcagtctcag

SEQ ID NO: 3191548 - DNA, 20 bp, Homo sapiens
tcctggaaccttgctgtcct

SEQ ID NO: 3191549 - DNA, 21 bp, Homo sapiens
tcctggaaccttgctgtcctg

SEQ ID NO: 3191550 - DNA, 13 bp, Homo sapiens
tcctggaagcagg

SEQ ID NO: 3191551 - DNA, 22 bp, Homo sapiens
tcctggaagcgcgagggcctca

SEQ ID NO: 3191552 - DNA, 17 bp, Homo sapiens
tcctggacactcagacc

SEQ ID NO: 3191553 - DNA, 14 bp, Homo sapiens
tcctggacctgagt

SEQ ID NO: 3191554 - DNA, 16 bp, Homo sapiens
tcctggactcctgcca

SEQ ID NO: 3191555 - DNA, 16 bp, Homo sapiens
tcctggagaagcctcg

SEQ ID NO: 3191556 - DNA, 18 bp, Homo sapiens
tcctggagcagaccaccc

SEQ ID NO: 3191557 - DNA, 11 bp, Homo sapiens
tcctggagggg

SEQ ID NO: 3191558 - DNA, 14 bp, Homo sapiens
tcctggagtgatat

SEQ ID NO: 3191559 - DNA, 23 bp, Homo sapiens
tcctggatttatagtatgtgact

SEQ ID NO: 3191560 - DNA, 23 bp, Homo sapiens
tcctggcaatagtgtgttctgat

SEQ ID NO: 3191561 - DNA, 11 bp, Homo sapiens
tcctggcagcc

SEQ ID NO: 3191562 - DNA, 13 bp, Homo sapiens
tcctggcagccca

SEQ ID NO: 3191563 - DNA, 15 bp, Homo sapiens
tcctggcagcccaga

SEQ ID NO: 3191564 - DNA, 17 bp, Homo sapiens
tcctggcagtttaaaaa

SEQ ID NO: 3191565 - DNA, 14 bp, Homo sapiens
tcctggcccctcaa

SEQ ID NO: 3191566 - DNA, 14 bp, Homo sapiens
tcctggcctatccg

SEQ ID NO: 3191567 - DNA, 18 bp, Homo sapiens
tcctggcctcactggctg

SEQ ID NO: 3191568 - DNA, 20 bp, Homo sapiens
tcctggcctcactggctggg

SEQ ID NO: 3191569 - DNA, 22 bp, Homo sapiens
tcctggcctcactggctggggc

SEQ ID NO: 3191570 - DNA, 19 bp, Homo sapiens
tcctggctaagcctctgct

SEQ ID NO: 3191571 - DNA, 17 bp, Homo sapiens
tcctggctacatcccag

SEQ ID NO: 3191572 - DNA, 20 bp, Homo sapiens
tcctggctacatcccagcct

SEQ ID NO: 3191573 - DNA, 21 bp, Homo sapiens
tcctggctacatcccagcctg

SEQ ID NO: 3191574 - DNA, 14 bp, Homo sapiens
tcctggctgccagg

SEQ ID NO: 3191575 - DNA, 17 bp, Homo sapiens
tcctgggagaacctcag

SEQ ID NO: 3191576 - DNA, 23 bp, Homo sapiens
tcctgggagaacctcaggcttcc

SEQ ID NO: 3191577 - DNA, 20 bp, Homo sapiens
tcctgggaggacaggcaggc

SEQ ID NO: 3191578 - DNA, 14 bp, Homo sapiens
tcctgggagtgagc

SEQ ID NO: 3191579 - DNA, 13 bp, Homo sapiens
tcctggggcagca

SEQ ID NO: 3191580 - DNA, 17 bp, Homo sapiens
tcctggggcagcactcc

SEQ ID NO: 3191581 - DNA, 15 bp, Homo sapiens
tcctggggccccgct

SEQ ID NO: 3191582 - DNA, 23 bp, Homo sapiens
tcctggggtataaaactttcctc

SEQ ID NO: 3191583 - DNA, 14 bp, Homo sapiens
tcctgggtaatgag

SEQ ID NO: 3191584 - DNA, 16 bp, Homo sapiens
tcctgggtttcctgca

SEQ ID NO: 3191585 - DNA, 19 bp, Homo sapiens
tcctgggtttcctgcaggc

SEQ ID NO: 3191586 - DNA, 17 bp, Homo sapiens
tcctggtacccagccat

SEQ ID NO: 3191587 - DNA, 14 bp, Homo sapiens
tcctggtccctctg

SEQ ID NO: 3191588 - DNA, 18 bp, Homo sapiens
tcctggtccctctgaggc

SEQ ID NO: 3191589 - DNA, 20 bp, Homo sapiens
tcctggtccctctgaggcag

SEQ ID NO: 3191590 - DNA, 14 bp, Homo sapiens
tcctggtctgtgaa

SEQ ID NO: 3191591 - DNA, 21 bp, Homo sapiens
tcctggtgccaatttcaagtt

SEQ ID NO: 3191592 - DNA, 14 bp, Homo sapiens
tcctggtgcccctc

SEQ ID NO: 3191593 - DNA, 23 bp, Homo sapiens
tcctggttcccgtttctccacct

SEQ ID NO: 3191594 - DNA, 19 bp, Homo sapiens
tccctgttttctgagcccg

SEQ ID NO: 3191595 - DNA, 23 bp, Homo sapiens
tccacggtgcgtggctgtggcac

SEQ ID NO: 3191596 - DNA, 17 bp, Homo sapiens
tccactaaaaatattgt

SEQ ID NO: 3191597 - DNA, 16 bp, Homo sapiens
tccactacacctggct

SEQ ID NO: 3191598 - DNA, 21 bp, Homo sapiens
tccactccatgtttgcaatgc

SEQ ID NO: 3191599 - DNA, 19 bp, Homo sapiens
tccactcccccacctgaca

SEQ ID NO: 3191600 - DNA, 12 bp, Homo sapiens
tccactcctcca

SEQ ID NO: 3191601 - DNA, 23 bp, Homo sapiens
tccactctaccctcccaccccct

SEQ ID NO: 3191602 - DNA, 23 bp, Homo sapiens
tccactctccttcgtgtctctcc

SEQ ID NO: 3191603 - DNA, 12 bp, Homo sapiens
tccactctgctt

SEQ ID NO: 3191604 - DNA, 17 bp, Homo sapiens
tccactgcaaataaagc

SEQ ID NO: 3191605 - DNA, 20 bp, Homo sapiens
tccactgcaaataaagcctt

SEQ ID NO: 3191606 - DNA, 17 bp, Homo sapiens
tccactgccctggcagc

SEQ ID NO: 3191607 - DNA, 19 bp, Homo sapiens
tccactgccctggcagcag

SEQ ID NO: 3191608 - DNA, 20 bp, Homo sapiens
tccactgccctggcagcagc

SEQ ID NO: 3191609 - DNA, 19 bp, Homo sapiens
tccactgcctctgccttag

SEQ ID NO: 3191610 - DNA, 22 bp, Homo sapiens
tccactgccttcgatacaccgg

SEQ ID NO: 3191611 - DNA, 15 bp, Homo sapiens
tcatttagtgctaaa

SEQ ID NO: 3191612 - DNA, 12 bp, Homo sapiens
tcatttatctat

SEQ ID NO: 3191613 - DNA, 22 bp, Homo sapiens
tcatttattgtttatgtaaatg

SEQ ID NO: 3191614 - DNA, 20 bp, Homo sapiens
tcatttattttaaaaaatga

SEQ ID NO: 3191615 - DNA, 16 bp, Homo sapiens
tcatttattttaagca

SEQ ID NO: 3191616 - DNA, 14 bp, Homo sapiens
tcatttcacacagt

SEQ ID NO: 3191617 - DNA, 14 bp, Homo sapiens
tcatttcacattaa

SEQ ID NO: 3191618 - DNA, 18 bp, Homo sapiens
tcatttccccataactca

SEQ ID NO: 3191619 - DNA, 15 bp, Homo sapiens
tcatttctaaaagaa

SEQ ID NO: 3191620 - DNA, 17 bp, Homo sapiens
tcatttctcactgtgta

SEQ ID NO: 3191621 - DNA, 24 bp, Homo sapiens
tcatttctcactgtgtacataatg

SEQ ID NO: 3191622 - DNA, 20 bp, Homo sapiens
tcatttcttcctcagctggt

SEQ ID NO: 3191623 - DNA, 16 bp, Homo sapiens
tcatttgaacaactag

SEQ ID NO: 3191624 - DNA, 18 bp, Homo sapiens
tcatttgactgtctcact

SEQ ID NO: 3191625 - DNA, 18 bp, Homo sapiens
tcatttgcttttgtcact

SEQ ID NO: 3191626 - DNA, 13 bp, Homo sapiens
tcatttgcttttt

SEQ ID NO: 3191627 - DNA, 13 bp, Homo sapiens
tcatttggtgctg

SEQ ID NO: 3191628 - DNA, 13 bp, Homo sapiens
tcatttgtacaag

SEQ ID NO: 3191629 - DNA, 18 bp, Homo sapiens
tcatttgtacaaggtaat

SEQ ID NO: 3191630 - DNA, 23 bp, Homo sapiens
tcatttgtacaaggtaattgttt

SEQ ID NO: 3191631 - DNA, 16 bp, Homo sapiens
tcatttgtatgtcaaa

SEQ ID NO: 3191632 - DNA, 15 bp, Homo sapiens
tcatttgtgtcaatg

SEQ ID NO: 3191633 - DNA, 12 bp, Homo sapiens
tcatttgttgtg

SEQ ID NO: 3191634 - DNA, 12 bp, Homo sapiens
tcatttgtttac

SEQ ID NO: 3191635 - DNA, 18 bp, Homo sapiens
tcatttgtttacatttga

SEQ ID NO: 3191636 - DNA, 17 bp, Homo sapiens
tcatttgttttgctttt

SEQ ID NO: 3191637 - DNA, 15 bp, Homo sapiens
tcatttgtttttctc

SEQ ID NO: 3191638 - DNA, 17 bp, Homo sapiens
tcatttgttttttcaat

SEQ ID NO: 3191639 - DNA, 17 bp, Homo sapiens
tcattttaaaaacttta

SEQ ID NO: 3191640 - DNA, 13 bp, Homo sapiens
tcattttacagtg

SEQ ID NO: 3191641 - DNA, 15 bp, Homo sapiens
tcattttagtgactg

SEQ ID NO: 3191642 - DNA, 22 bp, Homo sapiens
tcattttatgaatatcattgat

SEQ ID NO: 3191643 - DNA, 16 bp, Homo sapiens
tcattttcatcactgg

SEQ ID NO: 3191644 - DNA, 15 bp, Homo sapiens
tcattttctataaca

SEQ ID NO: 3191645 - DNA, 17 bp, Homo sapiens
tcattttctgacatgca

SEQ ID NO: 3191646 - DNA, 21 bp, Homo sapiens
tcattttgaattatgtgcact

SEQ ID NO: 3191647 - DNA, 12 bp, Homo sapiens
tcattttgaggg

SEQ ID NO: 3191648 - DNA, 23 bp, Homo sapiens
tcattttggtttatttttgtaat

SEQ ID NO: 3191649 - DNA, 15 bp, Homo sapiens
tcatttttaacagca

SEQ ID NO: 3191650 - DNA, 14 bp, Homo sapiens
tcatttttatagca

SEQ ID NO: 3191651 - DNA, 21 bp, Homo sapiens
tcatttttatagcaacaacaa

SEQ ID NO: 3191652 - DNA, 14 bp, Homo sapiens
tcatttttcaaaaa

SEQ ID NO: 3191653 - DNA, 12 bp, Homo sapiens
tcatttttgtac

SEQ ID NO: 3191654 - DNA, 17 bp, Homo sapiens
tcatttttttaatttat

SEQ ID NO: 3191655 - DNA, 18 bp, Homo sapiens
tccaaaaaaaaaaaaaat

SEQ ID NO: 3191656 - DNA, 21 bp, Homo sapiens
tccaaaaaaaaaaaaaataca

SEQ ID NO: 3191657 - DNA, 13 bp, Homo sapiens
tccaaaaaaagga

SEQ ID NO: 3191658 - DNA, 22 bp, Homo sapiens
tccaaaaagattttcagaaaat

SEQ ID NO: 3191659 - DNA, 18 bp, Homo sapiens
tccaaaacaaacatgcag

SEQ ID NO: 3191660 - DNA, 23 bp, Homo sapiens
tccaaaacaaacatgcagtactt

SEQ ID NO: 3191661 - DNA, 16 bp, Homo sapiens
tccaaaagattgctga

SEQ ID NO: 3191662 - DNA, 16 bp, Homo sapiens
tccaaaagctttttat

SEQ ID NO: 3191663 - DNA, 18 bp, Homo sapiens
tccaaaatattttttgca

SEQ ID NO: 3191664 - DNA, 22 bp, Homo sapiens
tccaaacaaaagcacttacttt

SEQ ID NO: 3191665 - DNA, 16 bp, Homo sapiens
tccaaaccaaataaaa

SEQ ID NO: 3191666 - DNA, 17 bp, Homo sapiens
tccaaaccaaattttaa

SEQ ID NO: 3191667 - DNA, 20 bp, Homo sapiens
tccaaactgttctgagaagg

SEQ ID NO: 3191668 - DNA, 15 bp, Homo sapiens
tccaaagaacttgat

SEQ ID NO: 3191669 - DNA, 21 bp, Homo sapiens
tccaaagaacttgatttgcat

SEQ ID NO: 3191670 - DNA, 22 bp, Homo sapiens
tccaaagaacttgatttgcatg

SEQ ID NO: 3191671 - DNA, 15 bp, Homo sapiens
tccaaagactgtact

SEQ ID NO: 3191672 - DNA, 22 bp, Homo sapiens
tccaaagactgtactggccagt

SEQ ID NO: 3191673 - DNA, 17 bp, Homo sapiens
tccaaagagccttcaga

SEQ ID NO: 3191674 - DNA, 16 bp, Homo sapiens
tccaaagaggctgccc

SEQ ID NO: 3191675 - DNA, 20 bp, Homo sapiens
tccaaagagtagaattgcat

SEQ ID NO: 3191676 - DNA, 12 bp, Homo sapiens
tccaaagccagt

SEQ ID NO: 3191677 - DNA, 15 bp, Homo sapiens
tccaaagccagtgaa

SEQ ID NO: 3191678 - DNA, 23 bp, Homo sapiens
tccaaaggaataacctttctgga

SEQ ID NO: 3191679 - DNA, 13 bp, Homo sapiens
tccaaaggaggct

SEQ ID NO: 3191680 - DNA, 16 bp, Homo sapiens
tccaaaggggctgctg

SEQ ID NO: 3191681 - DNA, 14 bp, Homo sapiens
tccaaagtctctaa

SEQ ID NO: 3191682 - DNA, 17 bp, Homo sapiens
tccaaagtctctaattc

SEQ ID NO: 3191683 - DNA, 14 bp, Homo sapiens
tccaaagtgtaagt

SEQ ID NO: 3191684 - DNA, 18 bp, Homo sapiens
tccaaataaaaattagat

SEQ ID NO: 3191685 - DNA, 18 bp, Homo sapiens
tccaaatcttgaatttct

SEQ ID NO: 3191686 - DNA, 22 bp, Homo sapiens
tccaaatgtgatcaactgttca

SEQ ID NO: 3191687 - DNA, 19 bp, Homo sapiens
tccaaatgtgtataatttt

SEQ ID NO: 3191688 - DNA, 21 bp, Homo sapiens
tccaaatgtgtataattttaa

SEQ ID NO: 3191689 - DNA, 15 bp, Homo sapiens
tccaaattatttctt

SEQ ID NO: 3191690 - DNA, 14 bp, Homo sapiens
tccaaattgtgctt

SEQ ID NO: 3191691 - DNA, 23 bp, Homo sapiens
tccaaattgtgcttctccccaga

SEQ ID NO: 3191692 - DNA, 22 bp, Homo sapiens
tccaaatttggctcacttgcct

SEQ ID NO: 3191693 - DNA, 12 bp, Homo sapiens
tccaacaataaa

SEQ ID NO: 3191694 - DNA, 23 bp, Homo sapiens
tccaacacaaggctccaagacct

SEQ ID NO: 3191695 - DNA, 17 bp, Homo sapiens
tccaacaccacagacac

SEQ ID NO: 3191696 - DNA, 19 bp, Homo sapiens
tccaacaccacagacacac

SEQ ID NO: 3191697 - DNA, 22 bp, Homo sapiens
tccaacaccacagacacacaca

SEQ ID NO: 3191698 - DNA, 16 bp, Homo sapiens
tccaacactttgagca

SEQ ID NO: 3191699 - DNA, 20 bp, Homo sapiens
tccaacagaactaaatgttc

SEQ ID NO: 3191700 - DNA, 18 bp, Homo sapiens
tccaacatttctcactga

SEQ ID NO: 3191701 - DNA, 12 bp, Homo sapiens
tccaaccaggca

SEQ ID NO: 3191702 - DNA, 17 bp, Homo sapiens
tccaaccattttcatta

SEQ ID NO: 3191703 - DNA, 14 bp, Homo sapiens
tccaacgcccctgt

SEQ ID NO: 3191704 - DNA, 15 bp, Homo sapiens
tccaacgcccctgtg

SEQ ID NO: 3191705 - DNA, 22 bp, Homo sapiens
tccaactaatgccttactcttc

SEQ ID NO: 3191706 - DNA, 21 bp, Homo sapiens
tccaactactaatagaataaa

SEQ ID NO: 3191707 - DNA, 13 bp, Homo sapiens
tccaactcaggtt

SEQ ID NO: 3191708 - DNA, 14 bp, Homo sapiens
tccaactccagcaa

SEQ ID NO: 3191709 - DNA, 13 bp, Homo sapiens
tccaactccagga

SEQ ID NO: 3191710 - DNA, 20 bp, Homo sapiens
tccaactgtatatattccca

SEQ ID NO: 3191711 - DNA, 18 bp, Homo sapiens
tccaactgtgttcattag

SEQ ID NO: 3191712 - DNA, 20 bp, Homo sapiens
tccaacttatgtttttaaat

SEQ ID NO: 3191713 - DNA, 14 bp, Homo sapiens
tccaagaatccaca

SEQ ID NO: 3191714 - DNA, 16 bp, Homo sapiens
tccaagactctagagt

SEQ ID NO: 3191715 - DNA, 20 bp, Homo sapiens
tccaagactctagagtccaa

SEQ ID NO: 3191716 - DNA, 14 bp, Homo sapiens
tccaagggtttcga

SEQ ID NO: 3191717 - DNA, 19 bp, Homo sapiens
tccaagggtttcgactggt

SEQ ID NO: 3191718 - DNA, 21 bp, Homo sapiens
tccaagggtttcgactggtcc

SEQ ID NO: 3191719 - DNA, 13 bp, Homo sapiens
tccaaggtttaaa

SEQ ID NO: 3191720 - DNA, 14 bp, Homo sapiens
tccaagtaccaatg

SEQ ID NO: 3191721 - DNA, 17 bp, Homo sapiens
tccaagtaccaatgctg

SEQ ID NO: 3191722 - DNA, 15 bp, Homo sapiens
tccaagtctgtacct

SEQ ID NO: 3191723 - DNA, 19 bp, Homo sapiens
tccaagtctgtacctcaaa

SEQ ID NO: 3191724 - DNA, 21 bp, Homo sapiens
tccaataaaaacattttgaag

SEQ ID NO: 3191725 - DNA, 20 bp, Homo sapiens
tccaataaagtgccttctgg

SEQ ID NO: 3191726 - DNA, 21 bp, Homo sapiens
tccaataaagtgccttctggg

SEQ ID NO: 3191727 - DNA, 15 bp, Homo sapiens
tccaataatcagaaa

SEQ ID NO: 3191728 - DNA, 15 bp, Homo sapiens
tccaatcctcactgg

SEQ ID NO: 3191729 - DNA, 15 bp, Homo sapiens
tccaatctcaaggaa

SEQ ID NO: 3191730 - DNA, 13 bp, Homo sapiens
tccaatctctggt

SEQ ID NO: 3191731 - DNA, 14 bp, Homo sapiens
tccaatctggtaat

SEQ ID NO: 3191732 - DNA, 11 bp, Homo sapiens
tccaatgtgtt

SEQ ID NO: 3191733 - DNA, 19 bp, Homo sapiens
tccaattagtttccttttt

SEQ ID NO: 3191734 - DNA, 16 bp, Homo sapiens
tccaattgatgtatat

SEQ ID NO: 3191735 - DNA, 16 bp, Homo sapiens
tccaattgttgacagt

SEQ ID NO: 3191736 - DNA, 12 bp, Homo sapiens
tccaatttaagg

SEQ ID NO: 3191737 - DNA, 22 bp, Homo sapiens
tccaattttctggaatacatga

SEQ ID NO: 3191738 - DNA, 17 bp, Homo sapiens
tccacaagttaaataaa

SEQ ID NO: 3191739 - DNA, 18 bp, Homo sapiens
tccacaagttaaataaat

SEQ ID NO: 3191740 - DNA, 21 bp, Homo sapiens
tccacaatagtcagaaaacaa

SEQ ID NO: 3191741 - DNA, 23 bp, Homo sapiens
tccacacaaagattttctaagga

SEQ ID NO: 3191742 - DNA, 15 bp, Homo sapiens
tccacacaagggaag

SEQ ID NO: 3191743 - DNA, 14 bp, Homo sapiens
tccacacacagagg

SEQ ID NO: 3191744 - DNA, 19 bp, Homo sapiens
tccacacacagaggaagag

SEQ ID NO: 3191745 - DNA, 22 bp, Homo sapiens
tccacacacagaggaagagcag

SEQ ID NO: 3191746 - DNA, 23 bp, Homo sapiens
tccacacacagaggaagagcagg

SEQ ID NO: 3191747 - DNA, 18 bp, Homo sapiens
tccacaccactgttgcct

SEQ ID NO: 3191748 - DNA, 16 bp, Homo sapiens
tccacacccaatgctg

SEQ ID NO: 3191749 - DNA, 14 bp, Homo sapiens
tccacacctccacc

SEQ ID NO: 3191750 - DNA, 15 bp, Homo sapiens
tccacacctccaccg

SEQ ID NO: 3191751 - DNA, 15 bp, Homo sapiens
tccacactagaaaga

SEQ ID NO: 3191752 - DNA, 16 bp, Homo sapiens
tccacactagaaagaa

SEQ ID NO: 3191753 - DNA, 19 bp, Homo sapiens
tccacagagtgagccagtg

SEQ ID NO: 3191754 - DNA, 15 bp, Homo sapiens
tccacagatatcttt

SEQ ID NO: 3191755 - DNA, 18 bp, Homo sapiens
tccacagatatctttttc

SEQ ID NO: 3191756 - DNA, 21 bp, Homo sapiens
tccacagatatctttttcatt

SEQ ID NO: 3191757 - DNA, 17 bp, Homo sapiens
tccacagattgtttcta

SEQ ID NO: 3191758 - DNA, 17 bp, Homo sapiens
tccacagccgcagcctc

SEQ ID NO: 3191759 - DNA, 15 bp, Homo sapiens
tccacagcctgcaag

SEQ ID NO: 3191760 - DNA, 18 bp, Homo sapiens
tccacagcgagggcagct

SEQ ID NO: 3191761 - DNA, 21 bp, Homo sapiens
tccacagcgagggcagctgct

SEQ ID NO: 3191762 - DNA, 15 bp, Homo sapiens
tccacaggggcaggc

SEQ ID NO: 3191763 - DNA, 17 bp, Homo sapiens
tccacaggggcaggcct

SEQ ID NO: 3191764 - DNA, 19 bp, Homo sapiens
tccacaggggcaggcctgg

SEQ ID NO: 3191765 - DNA, 22 bp, Homo sapiens
tccacaggggcaggcctgggac

SEQ ID NO: 3191766 - DNA, 23 bp, Homo sapiens
tccacaggggcaggcctgggacc

SEQ ID NO: 3191767 - DNA, 14 bp, Homo sapiens
tccacagtgctgct

SEQ ID NO: 3191768 - DNA, 22 bp, Homo sapiens
tccacagtgctgcttctcttgg

SEQ ID NO: 3191769 - DNA, 14 bp, Homo sapiens
tccacagttatctt

SEQ ID NO: 3191770 - DNA, 13 bp, Homo sapiens
tccacagttcagt

SEQ ID NO: 3191771 - DNA, 16 bp, Homo sapiens
tccacagttcagtggc

SEQ ID NO: 3191772 - DNA, 21 bp, Homo sapiens
tccacagttgccaccacctct

SEQ ID NO: 3191773 - DNA, 14 bp, Homo sapiens
tccacatcagatgc

SEQ ID NO: 3191774 - DNA, 14 bp, Homo sapiens
tccacatcccagca

SEQ ID NO: 3191775 - DNA, 17 bp, Homo sapiens
tccacatcccagcagcc

SEQ ID NO: 3191776 - DNA, 13 bp, Homo sapiens
tccacatctgcct

SEQ ID NO: 3191777 - DNA, 18 bp, Homo sapiens
tccacatctgccttaaaa

SEQ ID NO: 3191778 - DNA, 14 bp, Homo sapiens
tccacatgctctga

SEQ ID NO: 3191779 - DNA, 14 bp, Homo sapiens
tccacatgttactg

SEQ ID NO: 3191780 - DNA, 14 bp, Homo sapiens
tccacatttctaaa

SEQ ID NO: 3191781 - DNA, 16 bp, Homo sapiens
tccacatttttgcaca

SEQ ID NO: 3191782 - DNA, 17 bp, Homo sapiens
tccaccacatctgccag

SEQ ID NO: 3191783 - DNA, 18 bp, Homo sapiens
tccaccacatctgccaga

SEQ ID NO: 3191784 - DNA, 14 bp, Homo sapiens
tccaccaccactgg

SEQ ID NO: 3191785 - DNA, 22 bp, Homo sapiens
tccaccaccactggccaccagg

SEQ ID NO: 3191786 - DNA, 17 bp, Homo sapiens
tccaccacctccctcac

SEQ ID NO: 3191787 - DNA, 22 bp, Homo sapiens
tccaccacctccctcaccaaca

SEQ ID NO: 3191788 - DNA, 14 bp, Homo sapiens
tccaccagcagcat

SEQ ID NO: 3191789 - DNA, 12 bp, Homo sapiens
tccacccacctc

SEQ ID NO: 3191790 - DNA, 13 bp, Homo sapiens
tccacccacctca

SEQ ID NO: 3191791 - DNA, 18 bp, Homo sapiens
tccacccacctcagcctc

SEQ ID NO: 3191792 - DNA, 16 bp, Homo sapiens
tccacccagcccctgg

SEQ ID NO: 3191793 - DNA, 17 bp, Homo sapiens
tccacccaggagccccg

SEQ ID NO: 3191794 - DNA, 20 bp, Homo sapiens
tccacccaggagccccgagg

SEQ ID NO: 3191795 - DNA, 17 bp, Homo sapiens
tccacccaggctgcact

SEQ ID NO: 3191796 - DNA, 18 bp, Homo sapiens
tccacccaggctgcactg

SEQ ID NO: 3191797 - DNA, 22 bp, Homo sapiens
tccacccaggctgcactgcagt

SEQ ID NO: 3191798 - DNA, 13 bp, Homo sapiens
tccacccagtgct

SEQ ID NO: 3191799 - DNA, 14 bp, Homo sapiens
tccacccagtgctg

SEQ ID NO: 3191800 - DNA, 21 bp, Homo sapiens
tccacccagtgctgccatgcc

SEQ ID NO: 3191801 - DNA, 19 bp, Homo sapiens
tccacccgggggagcccag

SEQ ID NO: 3191802 - DNA, 13 bp, Homo sapiens
tccaccctgctct

SEQ ID NO: 3191803 - DNA, 17 bp, Homo sapiens
tccaccctgtcccccag

SEQ ID NO: 3191804 - DNA, 21 bp, Homo sapiens
tccaccctgtcccccagctct

SEQ ID NO: 3191805 - DNA, 22 bp, Homo sapiens
tccaccctgtcccccagctctg

SEQ ID NO: 3191806 - DNA, 20 bp, Homo sapiens
tccacccttggcctgtctca

SEQ ID NO: 3191807 - DNA, 17 bp, Homo sapiens
tccaccggcccctggca

SEQ ID NO: 3191808 - DNA, 13 bp, Homo sapiens
tccacctcctaga

SEQ ID NO: 3191809 - DNA, 20 bp, Homo sapiens
tccacctcctagaggtgggc

SEQ ID NO: 3191810 - DNA, 19 bp, Homo sapiens
tccacctcggagcatggtg

SEQ ID NO: 3191811 - DNA, 18 bp, Homo sapiens
tccacctgagaccctggg

SEQ ID NO: 3191812 - DNA, 23 bp, Homo sapiens
tccacctggtactccctctcagg

SEQ ID NO: 3191813 - DNA, 13 bp, Homo sapiens
tccacctgtctca

SEQ ID NO: 3191814 - DNA, 13 bp, Homo sapiens
tccacctgtgaga

SEQ ID NO: 3191815 - DNA, 12 bp, Homo sapiens
tccacctgtggg

SEQ ID NO: 3191816 - DNA, 15 bp, Homo sapiens
tccaccttcccactt

SEQ ID NO: 3191817 - DNA, 19 bp, Homo sapiens
tccaccttggctctgccag

SEQ ID NO: 3191818 - DNA, 17 bp, Homo sapiens
tccacgatcctgccacc

SEQ ID NO: 3191819 - DNA, 20 bp, Homo sapiens
tccacgcctcctggccagac

SEQ ID NO: 3191820 - DNA, 21 bp, Homo sapiens
tccacgcgcttcgacttttct

SEQ ID NO: 3191821 - DNA, 13 bp, Homo sapiens
tccacggtgcgtg

SEQ ID NO: 3191822 - DNA, 21 bp, Homo sapiens
tccacggtgcgtggctgtggc

SEQ ID NO: 3191823 - DNA, 20 bp, Homo sapiens
tcataaagggttgaaaatgt

SEQ ID NO: 3191824 - DNA, 21 bp, Homo sapiens
tcataaagggttgaaaatgtg

SEQ ID NO: 3191825 - DNA, 17 bp, Homo sapiens
tcataacagtgccattg

SEQ ID NO: 3191826 - DNA, 20 bp, Homo sapiens
tcataacagtgccattgtct

SEQ ID NO: 3191827 - DNA, 14 bp, Homo sapiens
tcataacctagcct

SEQ ID NO: 3191828 - DNA, 15 bp, Homo sapiens
tcataagtaaaccta

SEQ ID NO: 3191829 - DNA, 20 bp, Homo sapiens
tcataagtaaacctagtaaa

SEQ ID NO: 3191830 - DNA, 20 bp, Homo sapiens
tcataataggtagtttggat

SEQ ID NO: 3191831 - DNA, 18 bp, Homo sapiens
tcataatgaattataaca

SEQ ID NO: 3191832 - DNA, 20 bp, Homo sapiens
tcataatggtgaatgttcaa

SEQ ID NO: 3191833 - DNA, 12 bp, Homo sapiens
tcataattacat

SEQ ID NO: 3191834 - DNA, 22 bp, Homo sapiens
tcataattgttgtggtttaaat

SEQ ID NO: 3191835 - DNA, 19 bp, Homo sapiens
tcataatttgtttccagca

SEQ ID NO: 3191836 - DNA, 20 bp, Homo sapiens
tcatacctaagtactgtaat

SEQ ID NO: 3191837 - DNA, 14 bp, Homo sapiens
tcatacctctgacc

SEQ ID NO: 3191838 - DNA, 21 bp, Homo sapiens
tcatactactgaaacagattt

SEQ ID NO: 3191839 - DNA, 21 bp, Homo sapiens
tcatactgaaattattttctc

SEQ ID NO: 3191840 - DNA, 17 bp, Homo sapiens
tcatactgatttttaag

SEQ ID NO: 3191841 - DNA, 22 bp, Homo sapiens
tcatagaaatgtaacttttgta

SEQ ID NO: 3191842 - DNA, 14 bp, Homo sapiens
tcatagcattaact

SEQ ID NO: 3191843 - DNA, 21 bp, Homo sapiens
tcatagcattaactaatctat

SEQ ID NO: 3191844 - DNA, 15 bp, Homo sapiens
tcatagggaaaggtt

SEQ ID NO: 3191845 - DNA, 21 bp, Homo sapiens
tcatagggtctcttcaggttc

SEQ ID NO: 3191846 - DNA, 21 bp, Homo sapiens
tcataggttaaaaaaaaaagt

SEQ ID NO: 3191847 - DNA, 16 bp, Homo sapiens
tcataggttgccaata

SEQ ID NO: 3191848 - DNA, 20 bp, Homo sapiens
tcataggttgccaataatac

SEQ ID NO: 3191849 - DNA, 14 bp, Homo sapiens
tcatagtagttttt

SEQ ID NO: 3191850 - DNA, 16 bp, Homo sapiens
tcatagtagtttttac

SEQ ID NO: 3191851 - DNA, 22 bp, Homo sapiens
tcatagtagtttttacagctgt

SEQ ID NO: 3191852 - DNA, 15 bp, Homo sapiens
tcatatactgccatg

SEQ ID NO: 3191853 - DNA, 21 bp, Homo sapiens
tcatatagcattgataatctt

SEQ ID NO: 3191854 - DNA, 21 bp, Homo sapiens
tcatatcatcacattgagctg

SEQ ID NO: 3191855 - DNA, 13 bp, Homo sapiens
tcatatgccaccc

SEQ ID NO: 3191856 - DNA, 20 bp, Homo sapiens
tcatatgccaccccatgtgc

SEQ ID NO: 3191857 - DNA, 15 bp, Homo sapiens
tcatatgctctgctt

SEQ ID NO: 3191858 - DNA, 18 bp, Homo sapiens
tcatatggcccagtgtca

SEQ ID NO: 3191859 - DNA, 19 bp, Homo sapiens
tcatatgttgctcagtctc

SEQ ID NO: 3191860 - DNA, 20 bp, Homo sapiens
tcatatgttgctcagtctcc

SEQ ID NO: 3191861 - DNA, 19 bp, Homo sapiens
tcatattaaaattacagat

SEQ ID NO: 3191862 - DNA, 13 bp, Homo sapiens
tcatattaagaca

SEQ ID NO: 3191863 - DNA, 16 bp, Homo sapiens
tcatattaagacagtg

SEQ ID NO: 3191864 - DNA, 14 bp, Homo sapiens
tcatattgatgaaa

SEQ ID NO: 3191865 - DNA, 21 bp, Homo sapiens
tcatattgtgattctgccttt

SEQ ID NO: 3191866 - DNA, 15 bp, Homo sapiens
tcatattgtgccaat

SEQ ID NO: 3191867 - DNA, 22 bp, Homo sapiens
tcatattgtgccaatatgtatt

SEQ ID NO: 3191868 - DNA, 20 bp, Homo sapiens
tcatatttacttcttataca

SEQ ID NO: 3191869 - DNA, 14 bp, Homo sapiens
tcatatttatactt

SEQ ID NO: 3191870 - DNA, 13 bp, Homo sapiens
tcatatttctacc

SEQ ID NO: 3191871 - DNA, 12 bp, Homo sapiens
tcatattttgat

SEQ ID NO: 3191872 - DNA, 16 bp, Homo sapiens
tcatattttgattatt

SEQ ID NO: 3191873 - DNA, 15 bp, Homo sapiens
tcatattttgtatat

SEQ ID NO: 3191874 - DNA, 13 bp, Homo sapiens
tcatcaaaaagaa

SEQ ID NO: 3191875 - DNA, 14 bp, Homo sapiens
tcatcaaaaagaaa

SEQ ID NO: 3191876 - DNA, 21 bp, Homo sapiens
tcatcaaaaagaaaaatcaaa

SEQ ID NO: 3191877 - DNA, 24 bp, Homo sapiens
tcatcaaaaagaaaaatcaaagta

SEQ ID NO: 3191878 - DNA, 17 bp, Homo sapiens
tcatcaaagaacaaaca

SEQ ID NO: 3191879 - DNA, 21 bp, Homo sapiens
tcatcaagcaggaattatgtc

SEQ ID NO: 3191880 - DNA, 15 bp, Homo sapiens
tcatcaattcccatt

SEQ ID NO: 3191881 - DNA, 12 bp, Homo sapiens
tcatcagcattt

SEQ ID NO: 3191882 - DNA, 17 bp, Homo sapiens
tcatcagccagcaagag

SEQ ID NO: 3191883 - DNA, 14 bp, Homo sapiens
tcatcaggatgaac

SEQ ID NO: 3191884 - DNA, 13 bp, Homo sapiens
tcatcatcagggc

SEQ ID NO: 3191885 - DNA, 14 bp, Homo sapiens
tcatcatcagggcc

SEQ ID NO: 3191886 - DNA, 14 bp, Homo sapiens
tcatcatcctaagc

SEQ ID NO: 3191887 - DNA, 20 bp, Homo sapiens
tcatcatggaggtcatacat

SEQ ID NO: 3191888 - DNA, 22 bp, Homo sapiens
tcatcattgtttctgcatgaat

SEQ ID NO: 3191889 - DNA, 20 bp, Homo sapiens
tcatccaaaatattttttgc

SEQ ID NO: 3191890 - DNA, 22 bp, Homo sapiens
tcatccaaaatattttttgcaa

SEQ ID NO: 3191891 - DNA, 19 bp, Homo sapiens
tcatccaatcctcactggg

SEQ ID NO: 3191892 - DNA, 14 bp, Homo sapiens
tcatccactgtgcc

SEQ ID NO: 3191893 - DNA, 18 bp, Homo sapiens
tcatcccacgcactccat

SEQ ID NO: 3191894 - DNA, 13 bp, Homo sapiens
tcatcccagcccc

SEQ ID NO: 3191895 - DNA, 14 bp, Homo sapiens
tcatcccagcccca

SEQ ID NO: 3191896 - DNA, 22 bp, Homo sapiens
tcatcccattaatcatttcccc

SEQ ID NO: 3191897 - DNA, 21 bp, Homo sapiens
tcatccccaggggtcccagcc

SEQ ID NO: 3191898 - DNA, 21 bp, Homo sapiens
tcatccctatgggattcagtg

SEQ ID NO: 3191899 - DNA, 14 bp, Homo sapiens
tcatccctttctcc

SEQ ID NO: 3191900 - DNA, 15 bp, Homo sapiens
tcatcctattgttga

SEQ ID NO: 3191901 - DNA, 18 bp, Homo sapiens
tcatcctcaaagaaagtg

SEQ ID NO: 3191902 - DNA, 23 bp, Homo sapiens
tcatcctcaaagaaagtgtattg

SEQ ID NO: 3191903 - DNA, 13 bp, Homo sapiens
tcatcctccagta

SEQ ID NO: 3191904 - DNA, 21 bp, Homo sapiens
tcatcctggaggggtgttgta

SEQ ID NO: 3191905 - DNA, 22 bp, Homo sapiens
tcatcctggaggggtgttgtat

SEQ ID NO: 3191906 - DNA, 15 bp, Homo sapiens
tcatcctgtgctcgg

SEQ ID NO: 3191907 - DNA, 12 bp, Homo sapiens
tcatcctgtttt

SEQ ID NO: 3191908 - DNA, 17 bp, Homo sapiens
tcatccttggtctttgt

SEQ ID NO: 3191909 - DNA, 21 bp, Homo sapiens
tcatccttggtctttgtatct

SEQ ID NO: 3191910 - DNA, 16 bp, Homo sapiens
tcatcctttgttctga

SEQ ID NO: 3191911 - DNA, 22 bp, Homo sapiens
tcatcgaaaattcatttcacat

SEQ ID NO: 3191912 - DNA, 14 bp, Homo sapiens
tcatcgaatctact

SEQ ID NO: 3191913 - DNA, 21 bp, Homo sapiens
tcatcgaatctactaattcca

SEQ ID NO: 3191914 - DNA, 14 bp, Homo sapiens
tcatcgccagaggt

SEQ ID NO: 3191915 - DNA, 22 bp, Homo sapiens
tcatctaaccattaagtcatgt

SEQ ID NO: 3191916 - DNA, 13 bp, Homo sapiens
tcatctataaaga

SEQ ID NO: 3191917 - DNA, 16 bp, Homo sapiens
tcatctccatcagctg

SEQ ID NO: 3191918 - DNA, 17 bp, Homo sapiens
tcatctccatcagctgt

SEQ ID NO: 3191919 - DNA, 14 bp, Homo sapiens
tcatctctctgggg

SEQ ID NO: 3191920 - DNA, 15 bp, Homo sapiens
tcatctctctggggc

SEQ ID NO: 3191921 - DNA, 20 bp, Homo sapiens
tcatctctctggggccctgg

SEQ ID NO: 3191922 - DNA, 12 bp, Homo sapiens
tcatctcttcag

SEQ ID NO: 3191923 - DNA, 19 bp, Homo sapiens
tcatctcttcaggttctca

SEQ ID NO: 3191924 - DNA, 18 bp, Homo sapiens
tcatctgcagttcttttt

SEQ ID NO: 3191925 - DNA, 15 bp, Homo sapiens
tcatctggggtgggg

SEQ ID NO: 3191926 - DNA, 22 bp, Homo sapiens
tcatctggggttggcaacagga

SEQ ID NO: 3191927 - DNA, 23 bp, Homo sapiens
tcatctggttgaactctggtggc

SEQ ID NO: 3191928 - DNA, 19 bp, Homo sapiens
tcatctgtcattatattct

SEQ ID NO: 3191929 - DNA, 14 bp, Homo sapiens
tcatctgtccatgg

SEQ ID NO: 3191930 - DNA, 22 bp, Homo sapiens
tcatctgtccatggcctttcta

SEQ ID NO: 3191931 - DNA, 16 bp, Homo sapiens
tcatctgtggagctgc

SEQ ID NO: 3191932 - DNA, 19 bp, Homo sapiens
tcatctgtgtgaaaatggg

SEQ ID NO: 3191933 - DNA, 17 bp, Homo sapiens
tcatctgtttttctttt

SEQ ID NO: 3191934 - DNA, 17 bp, Homo sapiens
tcatcttgctaccagta

SEQ ID NO: 3191935 - DNA, 15 bp, Homo sapiens
tcatcttgtgaaatg

SEQ ID NO: 3191936 - DNA, 14 bp, Homo sapiens
tcatgaaaatacca

SEQ ID NO: 3191937 - DNA, 23 bp, Homo sapiens
tcatgaacatgttcctgaattct

SEQ ID NO: 3191938 - DNA, 14 bp, Homo sapiens
tcatgaatatgatg

SEQ ID NO: 3191939 - DNA, 20 bp, Homo sapiens
tcatgaattcttatgcttat

SEQ ID NO: 3191940 - DNA, 18 bp, Homo sapiens
tcatgacggcttttgtca

SEQ ID NO: 3191941 - DNA, 14 bp, Homo sapiens
tcatgagcccacca

SEQ ID NO: 3191942 - DNA, 16 bp, Homo sapiens
tcatgatccaactaat

SEQ ID NO: 3191943 - DNA, 23 bp, Homo sapiens
tcatgattagaaattacctgtgg

SEQ ID NO: 3191944 - DNA, 16 bp, Homo sapiens
tcatgattagcaagtt

SEQ ID NO: 3191945 - DNA, 11 bp, Homo sapiens
tcatgattttt

SEQ ID NO: 3191946 - DNA, 13 bp, Homo sapiens
tcatgcaatgaca

SEQ ID NO: 3191947 - DNA, 14 bp, Homo sapiens
tcatgcataaatat

SEQ ID NO: 3191948 - DNA, 18 bp, Homo sapiens
tcatgcatagtcccagct

SEQ ID NO: 3191949 - DNA, 15 bp, Homo sapiens
tcatgcatttcaagc

SEQ ID NO: 3191950 - DNA, 21 bp, Homo sapiens
tcatgccagctacttcctcct

SEQ ID NO: 3191951 - DNA, 15 bp, Homo sapiens
tcatgcccaccccct

SEQ ID NO: 3191952 - DNA, 19 bp, Homo sapiens
tcatgcccaccccctgccc

SEQ ID NO: 3191953 - DNA, 21 bp, Homo sapiens
tcatgcccaccccctgccctg

SEQ ID NO: 3191954 - DNA, 21 bp, Homo sapiens
tcatgccccctttcagatgtc

SEQ ID NO: 3191955 - DNA, 17 bp, Homo sapiens
tcatgcccggtcccacc

SEQ ID NO: 3191956 - DNA, 15 bp, Homo sapiens
tcatgcccttctgat

SEQ ID NO: 3191957 - DNA, 17 bp, Homo sapiens
tcatgccttgataaata

SEQ ID NO: 3191958 - DNA, 18 bp, Homo sapiens
tcatgccttgataaatat

SEQ ID NO: 3191959 - DNA, 16 bp, Homo sapiens
tcatgctctcatatat

SEQ ID NO: 3191960 - DNA, 18 bp, Homo sapiens
tcatgctgaatccacctc

SEQ ID NO: 3191961 - DNA, 19 bp, Homo sapiens
tcatgctgaatccacctcg

SEQ ID NO: 3191962 - DNA, 22 bp, Homo sapiens
tcatgctgaatccacctcggag

SEQ ID NO: 3191963 - DNA, 17 bp, Homo sapiens
tcatgctggagggaggc

SEQ ID NO: 3191964 - DNA, 20 bp, Homo sapiens
tcatgctgggatttccaact

SEQ ID NO: 3191965 - DNA, 19 bp, Homo sapiens
tcatgctgttgctgctact

SEQ ID NO: 3191966 - DNA, 19 bp, Homo sapiens
tcatgctttaaagtgtaat

SEQ ID NO: 3191967 - DNA, 20 bp, Homo sapiens
tcatgctttaaagtgtaata

SEQ ID NO: 3191968 - DNA, 23 bp, Homo sapiens
tcatggaatatttataggccagg

SEQ ID NO: 3191969 - DNA, 19 bp, Homo sapiens
tcatggcccccaggggcag

SEQ ID NO: 3191970 - DNA, 21 bp, Homo sapiens
tcatggcccccaggggcagga

SEQ ID NO: 3191971 - DNA, 18 bp, Homo sapiens
tcatggcccctctgacct

SEQ ID NO: 3191972 - DNA, 20 bp, Homo sapiens
tcatggcctattatattaaa

SEQ ID NO: 3191973 - DNA, 19 bp, Homo sapiens
tcatggctaatttaacacc

SEQ ID NO: 3191974 - DNA, 23 bp, Homo sapiens
tcatgggagggggcttgaagcca

SEQ ID NO: 3191975 - DNA, 18 bp, Homo sapiens
tcatgggcaccaacctgc

SEQ ID NO: 3191976 - DNA, 20 bp, Homo sapiens
tcatgggtcccttgaaggaa

SEQ ID NO: 3191977 - DNA, 17 bp, Homo sapiens
tcatgggttatgtgtat

SEQ ID NO: 3191978 - DNA, 18 bp, Homo sapiens
tcatggtcctttctggaa

SEQ ID NO: 3191979 - DNA, 19 bp, Homo sapiens
tcatggtgaaaatgtactg

SEQ ID NO: 3191980 - DNA, 19 bp, Homo sapiens
tcatggtgatcagtgcaat

SEQ ID NO: 3191981 - DNA, 19 bp, Homo sapiens
tcatggtgattccagcaag

SEQ ID NO: 3191982 - DNA, 17 bp, Homo sapiens
tcatggtgcatataaat

SEQ ID NO: 3191983 - DNA, 13 bp, Homo sapiens
tcatggtgtaata

SEQ ID NO: 3191984 - DNA, 14 bp, Homo sapiens
tcatggtgtaataa

SEQ ID NO: 3191985 - DNA, 17 bp, Homo sapiens
tcatggtgtaataagac

SEQ ID NO: 3191986 - DNA, 18 bp, Homo sapiens
tcatggtgtaataagaca

SEQ ID NO: 3191987 - DNA, 21 bp, Homo sapiens
tcatggtgtaataagacataa

SEQ ID NO: 3191988 - DNA, 15 bp, Homo sapiens
tcatgtaacattggt

SEQ ID NO: 3191989 - DNA, 13 bp, Homo sapiens
tcatgtacttttt

SEQ ID NO: 3191990 - DNA, 16 bp, Homo sapiens
tcatgtagagaaaagc

SEQ ID NO: 3191991 - DNA, 17 bp, Homo sapiens
tcatgtagagaaaagca

SEQ ID NO: 3191992 - DNA, 15 bp, Homo sapiens
tcatgtatgatgagc

SEQ ID NO: 3191993 - DNA, 16 bp, Homo sapiens
tcatgtcaacttctgg

SEQ ID NO: 3191994 - DNA, 17 bp, Homo sapiens
tcatgtcaacttctggc

SEQ ID NO: 3191995 - DNA, 21 bp, Homo sapiens
tcatgtccaaacgtcctcttt

SEQ ID NO: 3191996 - DNA, 19 bp, Homo sapiens
tcatgtccatcccttttcc

SEQ ID NO: 3191997 - DNA, 23 bp, Homo sapiens
tcatgtccatcccttttcctgtc

SEQ ID NO: 3191998 - DNA, 14 bp, Homo sapiens
tcatgtgcctctgc

SEQ ID NO: 3191999 - DNA, 21 bp, Homo sapiens
tcatgtggaatggattataga

SEQ ID NO: 3192000 - DNA, 16 bp, Homo sapiens
tcatgtggctggaaga

SEQ ID NO: 3192001 - DNA, 21 bp, Homo sapiens
tcatgtggctggaagatcctg

SEQ ID NO: 3192002 - DNA, 14 bp, Homo sapiens
tcatgtgtgaacac

SEQ ID NO: 3192003 - DNA, 23 bp, Homo sapiens
tcatgttagttaccttatagtta

SEQ ID NO: 3192004 - DNA, 20 bp, Homo sapiens
tcatgttatatttaatgcat

SEQ ID NO: 3192005 - DNA, 20 bp, Homo sapiens
tcatgttatgatttgtaaca

SEQ ID NO: 3192006 - DNA, 16 bp, Homo sapiens
tcatgttcactgtgag

SEQ ID NO: 3192007 - DNA, 13 bp, Homo sapiens
tcatgttggccaa

SEQ ID NO: 3192008 - DNA, 13 bp, Homo sapiens
tcatgttgttaaa

SEQ ID NO: 3192009 - DNA, 22 bp, Homo sapiens
tcatgtttatgaaaataaatag

SEQ ID NO: 3192010 - DNA, 14 bp, Homo sapiens
tcatgtttgcttca

SEQ ID NO: 3192011 - DNA, 11 bp, Homo sapiens
tcatgtttggt

SEQ ID NO: 3192012 - DNA, 23 bp, Homo sapiens
tcatgttttgagacataaatgtt

SEQ ID NO: 3192013 - DNA, 14 bp, Homo sapiens
tcattaaacttgaa

SEQ ID NO: 3192014 - DNA, 16 bp, Homo sapiens
tcattaaacttgaagc

SEQ ID NO: 3192015 - DNA, 15 bp, Homo sapiens
tcattaacacattgt

SEQ ID NO: 3192016 - DNA, 14 bp, Homo sapiens
tcattaatgtgttg

SEQ ID NO: 3192017 - DNA, 13 bp, Homo sapiens
tcattaattctat

SEQ ID NO: 3192018 - DNA, 14 bp, Homo sapiens
tcattactgcaaat

SEQ ID NO: 3192019 - DNA, 14 bp, Homo sapiens
tcattactgggcct

SEQ ID NO: 3192020 - DNA, 16 bp, Homo sapiens
tcattacttttgaagt

SEQ ID NO: 3192021 - DNA, 10 bp, Homo sapiens
tcattagaac

SEQ ID NO: 3192022 - DNA, 23 bp, Homo sapiens
tcattataaacgtgatgatcagc

SEQ ID NO: 3192023 - DNA, 16 bp, Homo sapiens
tcattataatctcaaa

SEQ ID NO: 3192024 - DNA, 15 bp, Homo sapiens
tcattatattctaat

SEQ ID NO: 3192025 - DNA, 14 bp, Homo sapiens
tcattatctgagtt

SEQ ID NO: 3192026 - DNA, 17 bp, Homo sapiens
tcattatctgagttgca

SEQ ID NO: 3192027 - DNA, 13 bp, Homo sapiens
tcattatgttcat

SEQ ID NO: 3192028 - DNA, 17 bp, Homo sapiens
tcattatgttcatgtaa

SEQ ID NO: 3192029 - DNA, 20 bp, Homo sapiens
tcattatgttcatgtaagaa

SEQ ID NO: 3192030 - DNA, 18 bp, Homo sapiens
tcattattggaattaacc

SEQ ID NO: 3192031 - DNA, 23 bp, Homo sapiens
tcattattttgtggttctatttt

SEQ ID NO: 3192032 - DNA, 14 bp, Homo sapiens
tcattcaaactgca

SEQ ID NO: 3192033 - DNA, 18 bp, Homo sapiens
tcattcaaactgcacttt

SEQ ID NO: 3192034 - DNA, 23 bp, Homo sapiens
tcattcaactctccaatgttcta

SEQ ID NO: 3192035 - DNA, 14 bp, Homo sapiens
tcattcaagctatt

SEQ ID NO: 3192036 - DNA, 16 bp, Homo sapiens
tcattcaagctattta

SEQ ID NO: 3192037 - DNA, 22 bp, Homo sapiens
tcattcaccaaatgatgccact

SEQ ID NO: 3192038 - DNA, 19 bp, Homo sapiens
tcattcagcagcaaatttt

SEQ ID NO: 3192039 - DNA, 21 bp, Homo sapiens
tcattcagcagcaaattttca

SEQ ID NO: 3192040 - DNA, 15 bp, Homo sapiens
tcattcccagagtca

SEQ ID NO: 3192041 - DNA, 17 bp, Homo sapiens
tcattcccccttcctag

SEQ ID NO: 3192042 - DNA, 20 bp, Homo sapiens
tcattcccccttcctagtga

SEQ ID NO: 3192043 - DNA, 17 bp, Homo sapiens
tcattccctctcatctc

SEQ ID NO: 3192044 - DNA, 14 bp, Homo sapiens
tcattcctgaaaga

SEQ ID NO: 3192045 - DNA, 21 bp, Homo sapiens
tcattcctgaaagaaacagtt

SEQ ID NO: 3192046 - DNA, 15 bp, Homo sapiens
tcattccttcactca

SEQ ID NO: 3192047 - DNA, 17 bp, Homo sapiens
tcattccttcagatttg

SEQ ID NO: 3192048 - DNA, 17 bp, Homo sapiens
tcattcgtggcatgttt

SEQ ID NO: 3192049 - DNA, 16 bp, Homo sapiens
tcattctacagaataa

SEQ ID NO: 3192050 - DNA, 17 bp, Homo sapiens
tcattctacagaataat

SEQ ID NO: 3192051 - DNA, 14 bp, Homo sapiens
tcattctgaattaa

SEQ ID NO: 3192052 - DNA, 18 bp, Homo sapiens
tcattcttgaaagctgtg

SEQ ID NO: 3192053 - DNA, 12 bp, Homo sapiens
tcattgaaatgt

SEQ ID NO: 3192054 - DNA, 14 bp, Homo sapiens
tcattgaaatgtca

SEQ ID NO: 3192055 - DNA, 19 bp, Homo sapiens
tcattgaactttaagaagc

SEQ ID NO: 3192056 - DNA, 21 bp, Homo sapiens
tcattgaagtatattcttatt

SEQ ID NO: 3192057 - DNA, 15 bp, Homo sapiens
tcattgacctctcag

SEQ ID NO: 3192058 - DNA, 18 bp, Homo sapiens
tcattgacctctcagggc

SEQ ID NO: 3192059 - DNA, 24 bp, Homo sapiens
tcattgacttttataaagcatgtt

SEQ ID NO: 3192060 - DNA, 14 bp, Homo sapiens
tcattgagagtttt

SEQ ID NO: 3192061 - DNA, 19 bp, Homo sapiens
tcattgagagttttgtctt

SEQ ID NO: 3192062 - DNA, 19 bp, Homo sapiens
tcattgatggatgtcttct

SEQ ID NO: 3192063 - DNA, 18 bp, Homo sapiens
tcattgattgtcagctac

SEQ ID NO: 3192064 - DNA, 12 bp, Homo sapiens
tcattgatttta

SEQ ID NO: 3192065 - DNA, 19 bp, Homo sapiens
tcattgcagcagataactt

SEQ ID NO: 3192066 - DNA, 20 bp, Homo sapiens
tcattgcagcagataacttt

SEQ ID NO: 3192067 - DNA, 22 bp, Homo sapiens
tcattgcagcagataacttttt

SEQ ID NO: 3192068 - DNA, 15 bp, Homo sapiens
tcattgccagtgtct

SEQ ID NO: 3192069 - DNA, 21 bp, Homo sapiens
tcattgccagtgtctttcttt

SEQ ID NO: 3192070 - DNA, 14 bp, Homo sapiens
tcattgcccccacc

SEQ ID NO: 3192071 - DNA, 19 bp, Homo sapiens
tcattgcccccacctctgg

SEQ ID NO: 3192072 - DNA, 13 bp, Homo sapiens
tcattgctgctgc

SEQ ID NO: 3192073 - DNA, 13 bp, Homo sapiens
tcattgcttacaa

SEQ ID NO: 3192074 - DNA, 14 bp, Homo sapiens
tcattgcttctgac

SEQ ID NO: 3192075 - DNA, 17 bp, Homo sapiens
tcattggatttttgtta

SEQ ID NO: 3192076 - DNA, 22 bp, Homo sapiens
tcattggcctggcaaaataaaa

SEQ ID NO: 3192077 - DNA, 14 bp, Homo sapiens
tcattggctcctgg

SEQ ID NO: 3192078 - DNA, 19 bp, Homo sapiens
tcattgtaaacaaactctt

SEQ ID NO: 3192079 - DNA, 12 bp, Homo sapiens
tcattgtagaaa

SEQ ID NO: 3192080 - DNA, 14 bp, Homo sapiens
tcattgtatgatgt

SEQ ID NO: 3192081 - DNA, 14 bp, Homo sapiens
tcagtactgacttt

SEQ ID NO: 3192082 - DNA, 16 bp, Homo sapiens
tcagtataatttttta

SEQ ID NO: 3192083 - DNA, 15 bp, Homo sapiens
tcagtatatttggtt

SEQ ID NO: 3192084 - DNA, 22 bp, Homo sapiens
tcagtatatttggtttctagat

SEQ ID NO: 3192085 - DNA, 14 bp, Homo sapiens
tcagtatcatctcc

SEQ ID NO: 3192086 - DNA, 20 bp, Homo sapiens
tcagtattagatgcacttaa

SEQ ID NO: 3192087 - DNA, 16 bp, Homo sapiens
tcagtatttcaactgc

SEQ ID NO: 3192088 - DNA, 19 bp, Homo sapiens
tcagtatttcaactgctgt

SEQ ID NO: 3192089 - DNA, 22 bp, Homo sapiens
tcagtatttcaactgctgtaaa

SEQ ID NO: 3192090 - DNA, 15 bp, Homo sapiens
tcagtatttcagtgt

SEQ ID NO: 3192091 - DNA, 19 bp, Homo sapiens
tcagtattttggagaaatt

SEQ ID NO: 3192092 - DNA, 20 bp, Homo sapiens
tcagtattttggagaaatta

SEQ ID NO: 3192093 - DNA, 16 bp, Homo sapiens
tcagtcaaaactttaa

SEQ ID NO: 3192094 - DNA, 15 bp, Homo sapiens
tcagtcagaaaactt

SEQ ID NO: 3192095 - DNA, 17 bp, Homo sapiens
tcagtcagaaaacttta

SEQ ID NO: 3192096 - DNA, 20 bp, Homo sapiens
tcagtcagaaaactttaaaa

SEQ ID NO: 3192097 - DNA, 22 bp, Homo sapiens
tcagtcagttcccggagcacag

SEQ ID NO: 3192098 - DNA, 15 bp, Homo sapiens
tcagtcatgcataaa

SEQ ID NO: 3192099 - DNA, 16 bp, Homo sapiens
tcagtcatgcataaat

SEQ ID NO: 3192100 - DNA, 13 bp, Homo sapiens
tcagtcccctccc

SEQ ID NO: 3192101 - DNA, 14 bp, Homo sapiens
tcagtcccctccca

SEQ ID NO: 3192102 - DNA, 17 bp, Homo sapiens
tcagtccctatgtattt

SEQ ID NO: 3192103 - DNA, 18 bp, Homo sapiens
tcagtcctcctctccttt

SEQ ID NO: 3192104 - DNA, 16 bp, Homo sapiens
tcagtcctgctccaga

SEQ ID NO: 3192105 - DNA, 15 bp, Homo sapiens
tcagtctatccacag

SEQ ID NO: 3192106 - DNA, 17 bp, Homo sapiens
tcagtctgattcccaag

SEQ ID NO: 3192107 - DNA, 15 bp, Homo sapiens
tcagtgacccatgag

SEQ ID NO: 3192108 - DNA, 12 bp, Homo sapiens
tcagtgactgaa

SEQ ID NO: 3192109 - DNA, 19 bp, Homo sapiens
tcagtgactgaaaccattt

SEQ ID NO: 3192110 - DNA, 16 bp, Homo sapiens
tcagtgatctatgttt

SEQ ID NO: 3192111 - DNA, 14 bp, Homo sapiens
tcagtgcatttgtg

SEQ ID NO: 3192112 - DNA, 15 bp, Homo sapiens
tcagtgctgtggcct

SEQ ID NO: 3192113 - DNA, 12 bp, Homo sapiens
tcagtgcttctt

SEQ ID NO: 3192114 - DNA, 17 bp, Homo sapiens
tcagtgcttgggctcca

SEQ ID NO: 3192115 - DNA, 19 bp, Homo sapiens
tcagtgcttgggctccacg

SEQ ID NO: 3192116 - DNA, 20 bp, Homo sapiens
tcagtggaaaccctgagagt

SEQ ID NO: 3192117 - DNA, 13 bp, Homo sapiens
tcagtggcagcat

SEQ ID NO: 3192118 - DNA, 15 bp, Homo sapiens
tcagtggcagcatcc

SEQ ID NO: 3192119 - DNA, 13 bp, Homo sapiens
tcagtggcagctg

SEQ ID NO: 3192120 - DNA, 19 bp, Homo sapiens
tcagtgggcaggataaact

SEQ ID NO: 3192121 - DNA, 14 bp, Homo sapiens
tcagtgtaaagtgt

SEQ ID NO: 3192122 - DNA, 15 bp, Homo sapiens
tcagtgtagttaatt

SEQ ID NO: 3192123 - DNA, 21 bp, Homo sapiens
tcagtgtatggaaataaatgt

SEQ ID NO: 3192124 - DNA, 19 bp, Homo sapiens
tcagtgtcctcttgctcaa

SEQ ID NO: 3192125 - DNA, 15 bp, Homo sapiens
tcagtgtctcacact

SEQ ID NO: 3192126 - DNA, 11 bp, Homo sapiens
tcagtgtctgg

SEQ ID NO: 3192127 - DNA, 17 bp, Homo sapiens
tcagtgtggagaggggt

SEQ ID NO: 3192128 - DNA, 23 bp, Homo sapiens
tcagtgttaaaaaatttttgaaa

SEQ ID NO: 3192129 - DNA, 23 bp, Homo sapiens
tcagtgttactgcctataatctt

SEQ ID NO: 3192130 - DNA, 15 bp, Homo sapiens
tcagtgtttcacgta

SEQ ID NO: 3192131 - DNA, 15 bp, Homo sapiens
tcagtgttttaaatt

SEQ ID NO: 3192132 - DNA, 17 bp, Homo sapiens
tcagtgttttaaattct

SEQ ID NO: 3192133 - DNA, 18 bp, Homo sapiens
tcagtgttttaaattctg

SEQ ID NO: 3192134 - DNA, 20 bp, Homo sapiens
tcagtgttttggactccatc

SEQ ID NO: 3192135 - DNA, 13 bp, Homo sapiens
tcagtgtttttga

SEQ ID NO: 3192136 - DNA, 23 bp, Homo sapiens
tcagtgtttttgaaacccacagt

SEQ ID NO: 3192137 - DNA, 20 bp, Homo sapiens
tcagttatacagttataaaa

SEQ ID NO: 3192138 - DNA, 15 bp, Homo sapiens
tcagttcccagctcc

SEQ ID NO: 3192139 - DNA, 17 bp, Homo sapiens
tcagttcccagctcccc

SEQ ID NO: 3192140 - DNA, 23 bp, Homo sapiens
tcagttcccagctccccccgccc

SEQ ID NO: 3192141 - DNA, 20 bp, Homo sapiens
tcagttcccggagcacagcc

SEQ ID NO: 3192142 - DNA, 23 bp, Homo sapiens
tcagttcccggagcacagccctg

SEQ ID NO: 3192143 - DNA, 18 bp, Homo sapiens
tcagttcccttggcctca

SEQ ID NO: 3192144 - DNA, 16 bp, Homo sapiens
tcagttcctttgtgtg

SEQ ID NO: 3192145 - DNA, 15 bp, Homo sapiens
tcagttctgtgtaca

SEQ ID NO: 3192146 - DNA, 13 bp, Homo sapiens
tcagttgcttgtc

SEQ ID NO: 3192147 - DNA, 19 bp, Homo sapiens
tcagttggaatcattgcta

SEQ ID NO: 3192148 - DNA, 15 bp, Homo sapiens
tcagttgtgactaac

SEQ ID NO: 3192149 - DNA, 12 bp, Homo sapiens
tcagttgtgttt

SEQ ID NO: 3192150 - DNA, 22 bp, Homo sapiens
tcagtttaatgtctcctttgct

SEQ ID NO: 3192151 - DNA, 19 bp, Homo sapiens
tcagtttcataaaaggaga

SEQ ID NO: 3192152 - DNA, 16 bp, Homo sapiens
tcagtttcatgaaatg

SEQ ID NO: 3192153 - DNA, 20 bp, Homo sapiens
tcagtttgaaaatattttgt

SEQ ID NO: 3192154 - DNA, 21 bp, Homo sapiens
tcagtttgaaaatattttgtt

SEQ ID NO: 3192155 - DNA, 22 bp, Homo sapiens
tcagtttgatacagtattgaaa

SEQ ID NO: 3192156 - DNA, 14 bp, Homo sapiens
tcagtttgtataga

SEQ ID NO: 3192157 - DNA, 18 bp, Homo sapiens
tcagtttgtcctgtagag

SEQ ID NO: 3192158 - DNA, 19 bp, Homo sapiens
tcagtttgttggaaagtaa

SEQ ID NO: 3192159 - DNA, 16 bp, Homo sapiens
tcagttttatcatttt

SEQ ID NO: 3192160 - DNA, 19 bp, Homo sapiens
tcagttttatcattttcaa

SEQ ID NO: 3192161 - DNA, 17 bp, Homo sapiens
tcagtttttcatttgtt

SEQ ID NO: 3192162 - DNA, 20 bp, Homo sapiens
tcagtttttcatttgttttg

SEQ ID NO: 3192163 - DNA, 23 bp, Homo sapiens
tcagtttttcatttgttttgctt

SEQ ID NO: 3192164 - DNA, 12 bp, Homo sapiens
tcagtttttgta

SEQ ID NO: 3192165 - DNA, 18 bp, Homo sapiens
tcagttttttgttttaca

SEQ ID NO: 3192166 - DNA, 21 bp, Homo sapiens
tcataaaataaagtatatata

SEQ ID NO: 3192167 - DNA, 21 bp, Homo sapiens
tcataaacaacttaatgttct

SEQ ID NO: 3192168 - DNA, 20 bp, Homo sapiens
tcaagacgaggggcagggaa

SEQ ID NO: 3192169 - DNA, 21 bp, Homo sapiens
tcaagatactgctactgtaat

SEQ ID NO: 3192170 - DNA, 15 bp, Homo sapiens
tcaagatattaaaat

SEQ ID NO: 3192171 - DNA, 18 bp, Homo sapiens
tcaagattttgaatgctt

SEQ ID NO: 3192172 - DNA, 19 bp, Homo sapiens
tcaagattttgaatgcttc

SEQ ID NO: 3192173 - DNA, 21 bp, Homo sapiens
tcaagcacatgtaataaattc

SEQ ID NO: 3192174 - DNA, 23 bp, Homo sapiens
tcaagcactaaaaagttgaacca

SEQ ID NO: 3192175 - DNA, 22 bp, Homo sapiens
tcaagcagcgaccgccccctcc

SEQ ID NO: 3192176 - DNA, 17 bp, Homo sapiens
tcaagcagtcgtgcctg

SEQ ID NO: 3192177 - DNA, 19 bp, Homo sapiens
tcaagcagtcgtgcctgtg

SEQ ID NO: 3192178 - DNA, 22 bp, Homo sapiens
tcaagcagtcgtgcctgtgtcc

SEQ ID NO: 3192179 - DNA, 23 bp, Homo sapiens
tcaagcagtcgtgcctgtgtcca

SEQ ID NO: 3192180 - DNA, 21 bp, Homo sapiens
tcaagccaatcccctccttgg

SEQ ID NO: 3192181 - DNA, 21 bp, Homo sapiens
tcaagccagcaacacagagca

SEQ ID NO: 3192182 - DNA, 21 bp, Homo sapiens
tcaagccccagcagccctcaa

SEQ ID NO: 3192183 - DNA, 14 bp, Homo sapiens
tcaagcctgtggga

SEQ ID NO: 3192184 - DNA, 15 bp, Homo sapiens
tcaagctagccagag

SEQ ID NO: 3192185 - DNA, 22 bp, Homo sapiens
tcaagctattctcatgcctcag

SEQ ID NO: 3192186 - DNA, 12 bp, Homo sapiens
tcaagctgtccc

SEQ ID NO: 3192187 - DNA, 13 bp, Homo sapiens
tcaagctgtcccc

SEQ ID NO: 3192188 - DNA, 20 bp, Homo sapiens
tcaagctgtcccctctgtca

SEQ ID NO: 3192189 - DNA, 20 bp, Homo sapiens
tcaaggaaaaatgctgcttc

SEQ ID NO: 3192190 - DNA, 19 bp, Homo sapiens
tcaaggaaagggggtccca

SEQ ID NO: 3192191 - DNA, 20 bp, Homo sapiens
tcaaggaaagggggtcccag

SEQ ID NO: 3192192 - DNA, 23 bp, Homo sapiens
tcaaggaatttcttaacttcttg

SEQ ID NO: 3192193 - DNA, 18 bp, Homo sapiens
tcaaggacttgaaagcat

SEQ ID NO: 3192194 - DNA, 14 bp, Homo sapiens
tcaaggcactctag

SEQ ID NO: 3192195 - DNA, 20 bp, Homo sapiens
tcaaggcactctagattcca

SEQ ID NO: 3192196 - DNA, 13 bp, Homo sapiens
tcaaggccttcca

SEQ ID NO: 3192197 - DNA, 20 bp, Homo sapiens
tcaagggaaaaccccgtctc

SEQ ID NO: 3192198 - DNA, 13 bp, Homo sapiens
tcaagggaagaaa

SEQ ID NO: 3192199 - DNA, 21 bp, Homo sapiens
tcaaggtcacttaaagggtct

SEQ ID NO: 3192200 - DNA, 14 bp, Homo sapiens
tcaaggtccattat

SEQ ID NO: 3192201 - DNA, 20 bp, Homo sapiens
tcaaggtggccaaattattt

SEQ ID NO: 3192202 - DNA, 14 bp, Homo sapiens
tcaaggttctaacc

SEQ ID NO: 3192203 - DNA, 21 bp, Homo sapiens
tcaaggttttaggttctaaag

SEQ ID NO: 3192204 - DNA, 18 bp, Homo sapiens
tcaagtaagaagacatga

SEQ ID NO: 3192205 - DNA, 21 bp, Homo sapiens
tcaagtaatacgttttgacat

SEQ ID NO: 3192206 - DNA, 18 bp, Homo sapiens
tcaagtagctgggactac

SEQ ID NO: 3192207 - DNA, 22 bp, Homo sapiens
tcaagtatttattattgaagat

SEQ ID NO: 3192208 - DNA, 21 bp, Homo sapiens
tcaagtcatggcaggtacagt

SEQ ID NO: 3192209 - DNA, 22 bp, Homo sapiens
tcaagtccttacctcttccgga

SEQ ID NO: 3192210 - DNA, 16 bp, Homo sapiens
tcaagtctctgctggc

SEQ ID NO: 3192211 - DNA, 17 bp, Homo sapiens
tcaagtgattctcctgc

SEQ ID NO: 3192212 - DNA, 21 bp, Homo sapiens
tcaagtgattctcctgcctca

SEQ ID NO: 3192213 - DNA, 12 bp, Homo sapiens
tcaagtgcctta

SEQ ID NO: 3192214 - DNA, 23 bp, Homo sapiens
tcaagtgccttttgctgcgcacc

SEQ ID NO: 3192215 - DNA, 19 bp, Homo sapiens
tcaagttaacaaggaatgc

SEQ ID NO: 3192216 - DNA, 21 bp, Homo sapiens
tcaagttattcaaatttgtac

SEQ ID NO: 3192217 - DNA, 13 bp, Homo sapiens
tcaagttattgta

SEQ ID NO: 3192218 - DNA, 16 bp, Homo sapiens
tcaagttctaagattc

SEQ ID NO: 3192219 - DNA, 17 bp, Homo sapiens
tcaagttctaagattct

SEQ ID NO: 3192220 - DNA, 18 bp, Homo sapiens
tcaagttctaagattcta

SEQ ID NO: 3192221 - DNA, 17 bp, Homo sapiens
tcaagttgtgtctgaaa

SEQ ID NO: 3192222 - DNA, 14 bp, Homo sapiens
tcaagtttaaaagc

SEQ ID NO: 3192223 - DNA, 17 bp, Homo sapiens
tcaagtttaaaagccat

SEQ ID NO: 3192224 - DNA, 12 bp, Homo sapiens
tcaagtttacac

SEQ ID NO: 3192225 - DNA, 16 bp, Homo sapiens
tcaataaaatgtgatt

SEQ ID NO: 3192226 - DNA, 22 bp, Homo sapiens
tcaataaaatgtgatttttctg

SEQ ID NO: 3192227 - DNA, 16 bp, Homo sapiens
tcaataaacaacagct

SEQ ID NO: 3192228 - DNA, 14 bp, Homo sapiens
tcaataaacagctt

SEQ ID NO: 3192229 - DNA, 12 bp, Homo sapiens
tcaataaactta

SEQ ID NO: 3192230 - DNA, 20 bp, Homo sapiens
tcaataaacttagaggaaaa

SEQ ID NO: 3192231 - DNA, 16 bp, Homo sapiens
tcaataaagaaaactt

SEQ ID NO: 3192232 - DNA, 12 bp, Homo sapiens
tcaataaagcat

SEQ ID NO: 3192233 - DNA, 14 bp, Homo sapiens
tcaatacactagtt

SEQ ID NO: 3192234 - DNA, 21 bp, Homo sapiens
tcaatactgtatgccttctgt

SEQ ID NO: 3192235 - DNA, 21 bp, Homo sapiens
tcaatagatttaggagcagaa

SEQ ID NO: 3192236 - DNA, 13 bp, Homo sapiens
tcaatagttgaat

SEQ ID NO: 3192237 - DNA, 14 bp, Homo sapiens
tcaatattaaatac

SEQ ID NO: 3192238 - DNA, 16 bp, Homo sapiens
tcaatattaaatacag

SEQ ID NO: 3192239 - DNA, 14 bp, Homo sapiens
tcaatattcctgaa

SEQ ID NO: 3192240 - DNA, 22 bp, Homo sapiens
tcaatattcctgaatgaaatat

SEQ ID NO: 3192241 - DNA, 13 bp, Homo sapiens
tcaatatttttct

SEQ ID NO: 3192242 - DNA, 21 bp, Homo sapiens
tcaatcaaataagtatttata

SEQ ID NO: 3192243 - DNA, 14 bp, Homo sapiens
tcaatcaactttac

SEQ ID NO: 3192244 - DNA, 18 bp, Homo sapiens
tcaatcactgcactgcat

SEQ ID NO: 3192245 - DNA, 15 bp, Homo sapiens
tcaatcatctgtgtg

SEQ ID NO: 3192246 - DNA, 19 bp, Homo sapiens
tcaatcatctgtgtgaaaa

SEQ ID NO: 3192247 - DNA, 13 bp, Homo sapiens
tcaatcatttctc

SEQ ID NO: 3192248 - DNA, 15 bp, Homo sapiens
tcaatcatttctcac

SEQ ID NO: 3192249 - DNA, 22 bp, Homo sapiens
tcaatcctaatttctcctccct

SEQ ID NO: 3192250 - DNA, 18 bp, Homo sapiens
tcaatcctggtaaccaaa

SEQ ID NO: 3192251 - DNA, 13 bp, Homo sapiens
tcaatctgtaaac

SEQ ID NO: 3192252 - DNA, 17 bp, Homo sapiens
tcaatctgtaaactgtg

SEQ ID NO: 3192253 - DNA, 14 bp, Homo sapiens
tcaatgattcttcc

SEQ ID NO: 3192254 - DNA, 21 bp, Homo sapiens
tcaatgcattgtcttgtggag

SEQ ID NO: 3192255 - DNA, 18 bp, Homo sapiens
tcaatgcgttttgttgta

SEQ ID NO: 3192256 - DNA, 22 bp, Homo sapiens
tcaatgcgttttgttgtagatg

SEQ ID NO: 3192257 - DNA, 23 bp, Homo sapiens
tcaatggcctaaaactggcctga

SEQ ID NO: 3192258 - DNA, 12 bp, Homo sapiens
tcaatggctttt

SEQ ID NO: 3192259 - DNA, 14 bp, Homo sapiens
tcaatgtaaaaata

SEQ ID NO: 3192260 - DNA, 14 bp, Homo sapiens
tcaatgtgtataaa

SEQ ID NO: 3192261 - DNA, 16 bp, Homo sapiens
tcaatgtgtctttcta

SEQ ID NO: 3192262 - DNA, 18 bp, Homo sapiens
tcaatgttcattgtaatg

SEQ ID NO: 3192263 - DNA, 12 bp, Homo sapiens
tcaatgttccat

SEQ ID NO: 3192264 - DNA, 11 bp, Homo sapiens
tcaatgtttga

SEQ ID NO: 3192265 - DNA, 16 bp, Homo sapiens
tcaattaaatgtaggt

SEQ ID NO: 3192266 - DNA, 20 bp, Homo sapiens
tcaattactggtccaaaaga

SEQ ID NO: 3192267 - DNA, 19 bp, Homo sapiens
tcaattagaatagtgttct

SEQ ID NO: 3192268 - DNA, 14 bp, Homo sapiens
tcaattatagtttc

SEQ ID NO: 3192269 - DNA, 15 bp, Homo sapiens
tcaattatagtttct

SEQ ID NO: 3192270 - DNA, 16 bp, Homo sapiens
tcaattatagtttctg

SEQ ID NO: 3192271 - DNA, 12 bp, Homo sapiens
tcaattctcaaa

SEQ ID NO: 3192272 - DNA, 12 bp, Homo sapiens
tcaattgacaaa

SEQ ID NO: 3192273 - DNA, 18 bp, Homo sapiens
tcaattggcagtgacttt

SEQ ID NO: 3192274 - DNA, 22 bp, Homo sapiens
tcaattggcagtgactttgtat

SEQ ID NO: 3192275 - DNA, 23 bp, Homo sapiens
tcaattggcagtgactttgtata

SEQ ID NO: 3192276 - DNA, 15 bp, Homo sapiens
tcaattgttaatgtg

SEQ ID NO: 3192277 - DNA, 17 bp, Homo sapiens
tcaatttaaaaagcaaa

SEQ ID NO: 3192278 - DNA, 14 bp, Homo sapiens
tcaatttaagtgtt

SEQ ID NO: 3192279 - DNA, 21 bp, Homo sapiens
tcaatttaagtgttggaaaaa

SEQ ID NO: 3192280 - DNA, 15 bp, Homo sapiens
tcaatttcattatca

SEQ ID NO: 3192281 - DNA, 16 bp, Homo sapiens
tcaattttatccctca

SEQ ID NO: 3192282 - DNA, 21 bp, Homo sapiens
tcaattttcattaaacttgaa

SEQ ID NO: 3192283 - DNA, 13 bp, Homo sapiens
tcaattttgactt

SEQ ID NO: 3192284 - DNA, 17 bp, Homo sapiens
tcaatttttgtctcaga

SEQ ID NO: 3192285 - DNA, 16 bp, Homo sapiens
tcacaaaaatttgaac

SEQ ID NO: 3192286 - DNA, 21 bp, Homo sapiens
tcacaaactacctctggacag

SEQ ID NO: 3192287 - DNA, 17 bp, Homo sapiens
tcacaaacttttatact

SEQ ID NO: 3192288 - DNA, 18 bp, Homo sapiens
tcacaaagagttctggaa

SEQ ID NO: 3192289 - DNA, 19 bp, Homo sapiens
tcacaaccaccgttacaag

SEQ ID NO: 3192290 - DNA, 13 bp, Homo sapiens
tcacaagcctcct

SEQ ID NO: 3192291 - DNA, 14 bp, Homo sapiens
tcacaagcctcctg

SEQ ID NO: 3192292 - DNA, 15 bp, Homo sapiens
tcacaagcctcctgt

SEQ ID NO: 3192293 - DNA, 23 bp, Homo sapiens
tcacaagcctcctgtacctcagt

SEQ ID NO: 3192294 - DNA, 16 bp, Homo sapiens
tcacaagcgctcccag

SEQ ID NO: 3192295 - DNA, 19 bp, Homo sapiens
tcacaagcgctcccagcct

SEQ ID NO: 3192296 - DNA, 20 bp, Homo sapiens
tcacaagcgctcccagcctg

SEQ ID NO: 3192297 - DNA, 15 bp, Homo sapiens
tcaaaccctagcctt

SEQ ID NO: 3192298 - DNA, 17 bp, Homo sapiens
tcaaaccctagccttgc

SEQ ID NO: 3192299 - DNA, 18 bp, Homo sapiens
tcaaaccctagccttgct

SEQ ID NO: 3192300 - DNA, 17 bp, Homo sapiens
tcaaacctcctcttctg

SEQ ID NO: 3192301 - DNA, 19 bp, Homo sapiens
tcaaactgaggaatttcac

SEQ ID NO: 3192302 - DNA, 16 bp, Homo sapiens
tcaaactggggcctcc

SEQ ID NO: 3192303 - DNA, 19 bp, Homo sapiens
tcaaactggggcctccaga

SEQ ID NO: 3192304 - DNA, 23 bp, Homo sapiens
tcaaactggggcctccagaactc

SEQ ID NO: 3192305 - DNA, 21 bp, Homo sapiens
tcaaactgtgggattctgatt

SEQ ID NO: 3192306 - DNA, 12 bp, Homo sapiens
tcaaacttggat

SEQ ID NO: 3192307 - DNA, 14 bp, Homo sapiens
tcaaactttcactt

SEQ ID NO: 3192308 - DNA, 13 bp, Homo sapiens
tcaaacttttatt

SEQ ID NO: 3192309 - DNA, 15 bp, Homo sapiens
tcaaagaaagtgtat

SEQ ID NO: 3192310 - DNA, 12 bp, Homo sapiens
tcaaagaaatgc

SEQ ID NO: 3192311 - DNA, 16 bp, Homo sapiens
tcaaagaaggatggca

SEQ ID NO: 3192312 - DNA, 12 bp, Homo sapiens
tcaaagaattac

SEQ ID NO: 3192313 - DNA, 15 bp, Homo sapiens
tcaaagaattacagt

SEQ ID NO: 3192314 - DNA, 22 bp, Homo sapiens
tcaaagactgtatttagatctc

SEQ ID NO: 3192315 - DNA, 18 bp, Homo sapiens
tcaaagcaagggctccag

SEQ ID NO: 3192316 - DNA, 20 bp, Homo sapiens
tcaaagcatggacatttaga

SEQ ID NO: 3192317 - DNA, 12 bp, Homo sapiens
tcaaagcctggc

SEQ ID NO: 3192318 - DNA, 22 bp, Homo sapiens
tcaaagctaaaatatataatat

SEQ ID NO: 3192319 - DNA, 14 bp, Homo sapiens
tcaaagcttgaaga

SEQ ID NO: 3192320 - DNA, 18 bp, Homo sapiens
tcaaaggcatctcccttc

SEQ ID NO: 3192321 - DNA, 19 bp, Homo sapiens
tcaaagtaaaggcctcctc

SEQ ID NO: 3192322 - DNA, 20 bp, Homo sapiens
tcaaagtaaaggcctcctcc

SEQ ID NO: 3192323 - DNA, 21 bp, Homo sapiens
tcaaagtaaaggcctcctccc

SEQ ID NO: 3192324 - DNA, 20 bp, Homo sapiens
tcaaagtagaaactactaat

SEQ ID NO: 3192325 - DNA, 19 bp, Homo sapiens
tcaaagtataatctttcta

SEQ ID NO: 3192326 - DNA, 20 bp, Homo sapiens
tcaaagtataatctttctat

SEQ ID NO: 3192327 - DNA, 20 bp, Homo sapiens
tcaaagtgtaaacaccatag

SEQ ID NO: 3192328 - DNA, 14 bp, Homo sapiens
tcaaagtgtatatt

SEQ ID NO: 3192329 - DNA, 17 bp, Homo sapiens
tcaaagttaaaagtaaa

SEQ ID NO: 3192330 - DNA, 18 bp, Homo sapiens
tcaaagttaattcaccta

SEQ ID NO: 3192331 - DNA, 22 bp, Homo sapiens
tcaaagttaattcacctatgtt

SEQ ID NO: 3192332 - DNA, 22 bp, Homo sapiens
tcaaagtttcctaatcagaaat

SEQ ID NO: 3192333 - DNA, 11 bp, Homo sapiens
tcaaagtttta

SEQ ID NO: 3192334 - DNA, 18 bp, Homo sapiens
tcaaagttttgaaaagct

SEQ ID NO: 3192335 - DNA, 11 bp, Homo sapiens
tcaaataaact

SEQ ID NO: 3192336 - DNA, 13 bp, Homo sapiens
tcaaatacaaagt

SEQ ID NO: 3192337 - DNA, 16 bp, Homo sapiens
tcaaatacaaagtaaa

SEQ ID NO: 3192338 - DNA, 20 bp, Homo sapiens
tcaaatacaaagtaaataca

SEQ ID NO: 3192339 - DNA, 17 bp, Homo sapiens
tcaaatacacatttgct

SEQ ID NO: 3192340 - DNA, 15 bp, Homo sapiens
tcaaatagttgcata

SEQ ID NO: 3192341 - DNA, 15 bp, Homo sapiens
tcaaatatagaaagt

SEQ ID NO: 3192342 - DNA, 16 bp, Homo sapiens
tcaaatattaccaaaa

SEQ ID NO: 3192343 - DNA, 16 bp, Homo sapiens
tcaaatccttccaaaa

SEQ ID NO: 3192344 - DNA, 19 bp, Homo sapiens
tcaaatccttccaaaaatt

SEQ ID NO: 3192345 - DNA, 13 bp, Homo sapiens
tcaaatctattca

SEQ ID NO: 3192346 - DNA, 18 bp, Homo sapiens
tcaaatctcccacaagta

SEQ ID NO: 3192347 - DNA, 12 bp, Homo sapiens
tcaaatctgtat

SEQ ID NO: 3192348 - DNA, 21 bp, Homo sapiens
tcaaatctgtatatgttgtaa

SEQ ID NO: 3192349 - DNA, 14 bp, Homo sapiens
tcaaatgaaatgta

SEQ ID NO: 3192350 - DNA, 15 bp, Homo sapiens
tcaaatgaaatgtat

SEQ ID NO: 3192351 - DNA, 20 bp, Homo sapiens
tcaaatgaaatgtatgcatt

SEQ ID NO: 3192352 - DNA, 23 bp, Homo sapiens
tcaaatgaaatgtatgcattcac

SEQ ID NO: 3192353 - DNA, 14 bp, Homo sapiens
tcaaatgatttcat

SEQ ID NO: 3192354 - DNA, 20 bp, Homo sapiens
tcaaatgatttcatattgat

SEQ ID NO: 3192355 - DNA, 22 bp, Homo sapiens
tcaaatgttctaagtttctaag

SEQ ID NO: 3192356 - DNA, 22 bp, Homo sapiens
tcaaattaataatcttattagg

SEQ ID NO: 3192357 - DNA, 14 bp, Homo sapiens
tcaaattctcttct

SEQ ID NO: 3192358 - DNA, 20 bp, Homo sapiens
tcaaattctcttctttttct

SEQ ID NO: 3192359 - DNA, 14 bp, Homo sapiens
tcaaattcttctga

SEQ ID NO: 3192360 - DNA, 14 bp, Homo sapiens
tcaaattgcttaaa

SEQ ID NO: 3192361 - DNA, 16 bp, Homo sapiens
tcaaatttattttaat

SEQ ID NO: 3192362 - DNA, 23 bp, Homo sapiens
tcaaatttattttaatgtaaaga

SEQ ID NO: 3192363 - DNA, 23 bp, Homo sapiens
tcaaatttgtacaggactgtaaa

SEQ ID NO: 3192364 - DNA, 15 bp, Homo sapiens
tcaacaaagcacagt

SEQ ID NO: 3192365 - DNA, 20 bp, Homo sapiens
tcaacaagaatattgtatgt

SEQ ID NO: 3192366 - DNA, 16 bp, Homo sapiens
tcaacaagggagagac

SEQ ID NO: 3192367 - DNA, 20 bp, Homo sapiens
tcaacaagggagagacctca

SEQ ID NO: 3192368 - DNA, 15 bp, Homo sapiens
tcaacaataaaacat

SEQ ID NO: 3192369 - DNA, 17 bp, Homo sapiens
tcaacaataaaattttt

SEQ ID NO: 3192370 - DNA, 18 bp, Homo sapiens
tcaacaataaaatttttt

SEQ ID NO: 3192371 - DNA, 15 bp, Homo sapiens
tcaacacccctgtgt

SEQ ID NO: 3192372 - DNA, 15 bp, Homo sapiens
tcaacagaagcattt

SEQ ID NO: 3192373 - DNA, 18 bp, Homo sapiens
tcaacagaagcatttgta

SEQ ID NO: 3192374 - DNA, 16 bp, Homo sapiens
tcaacagagactgaat

SEQ ID NO: 3192375 - DNA, 14 bp, Homo sapiens
tcaacagccaagtg

SEQ ID NO: 3192376 - DNA, 18 bp, Homo sapiens
tcaacagctatgctggta

SEQ ID NO: 3192377 - DNA, 12 bp, Homo sapiens
tcaacaggccca

SEQ ID NO: 3192378 - DNA, 13 bp, Homo sapiens
tcaacaggcccag

SEQ ID NO: 3192379 - DNA, 23 bp, Homo sapiens
tcaacaggggcgtgaggtcccag

SEQ ID NO: 3192380 - DNA, 14 bp, Homo sapiens
tcaacagtgttttc

SEQ ID NO: 3192381 - DNA, 23 bp, Homo sapiens
tcaacataacccacttgtcactg

SEQ ID NO: 3192382 - DNA, 23 bp, Homo sapiens
tcaacatcaatgttcattgtaat

SEQ ID NO: 3192383 - DNA, 15 bp, Homo sapiens
tcaacatcctgccag

SEQ ID NO: 3192384 - DNA, 16 bp, Homo sapiens
tcaacatcctgccagc

SEQ ID NO: 3192385 - DNA, 18 bp, Homo sapiens
tcaacatcctgccagccc

SEQ ID NO: 3192386 - DNA, 20 bp, Homo sapiens
tcaacatgttactgaccagc

SEQ ID NO: 3192387 - DNA, 19 bp, Homo sapiens
tcaacatgttattcaatgt

SEQ ID NO: 3192388 - DNA, 14 bp, Homo sapiens
tcaacattactgtt

SEQ ID NO: 3192389 - DNA, 15 bp, Homo sapiens
tcaaccactaaagta

SEQ ID NO: 3192390 - DNA, 16 bp, Homo sapiens
tcaaccatcgctttat

SEQ ID NO: 3192391 - DNA, 18 bp, Homo sapiens
tcaaccattccccatggg

SEQ ID NO: 3192392 - DNA, 22 bp, Homo sapiens
tcaaccccaccatatgaattgt

SEQ ID NO: 3192393 - DNA, 16 bp, Homo sapiens
tcaacccctcccctcc

SEQ ID NO: 3192394 - DNA, 23 bp, Homo sapiens
tcaacccctcccctccatccctg

SEQ ID NO: 3192395 - DNA, 19 bp, Homo sapiens
tcaaccccttcgctcctgt

SEQ ID NO: 3192396 - DNA, 20 bp, Homo sapiens
tcaaccccttcgctcctgtg

SEQ ID NO: 3192397 - DNA, 17 bp, Homo sapiens
tcaaccggaaggaggcc

SEQ ID NO: 3192398 - DNA, 13 bp, Homo sapiens
tcaacctcctggg

SEQ ID NO: 3192399 - DNA, 14 bp, Homo sapiens
tcaacctcctgggc

SEQ ID NO: 3192400 - DNA, 18 bp, Homo sapiens
tcaacctcttctggctca

SEQ ID NO: 3192401 - DNA, 17 bp, Homo sapiens
tcaacctggtggcacca

SEQ ID NO: 3192402 - DNA, 21 bp, Homo sapiens
tcaacctggtggcaccagatg

SEQ ID NO: 3192403 - DNA, 15 bp, Homo sapiens
tcaaccttaagacct

SEQ ID NO: 3192404 - DNA, 14 bp, Homo sapiens
tcaactattctgtt

SEQ ID NO: 3192405 - DNA, 16 bp, Homo sapiens
tcaactcacctaatgt

SEQ ID NO: 3192406 - DNA, 20 bp, Homo sapiens
tcaactctccaatgttctat

SEQ ID NO: 3192407 - DNA, 18 bp, Homo sapiens
tcaactgaccagcctcca

SEQ ID NO: 3192408 - DNA, 12 bp, Homo sapiens
tcaactgctttg

SEQ ID NO: 3192409 - DNA, 16 bp, Homo sapiens
tcaactggttgtatat

SEQ ID NO: 3192410 - DNA, 16 bp, Homo sapiens
tcaactgtattgggcc

SEQ ID NO: 3192411 - DNA, 12 bp, Homo sapiens
tcaacttaacat

SEQ ID NO: 3192412 - DNA, 19 bp, Homo sapiens
tcaacttgcatccaactcc

SEQ ID NO: 3192413 - DNA, 14 bp, Homo sapiens
tcaactttactgta

SEQ ID NO: 3192414 - DNA, 21 bp, Homo sapiens
tcaactttagtatttttacta

SEQ ID NO: 3192415 - DNA, 19 bp, Homo sapiens
tcaactttgtaaaaatctt

SEQ ID NO: 3192416 - DNA, 19 bp, Homo sapiens
tcaagaaaatctttgttga

SEQ ID NO: 3192417 - DNA, 23 bp, Homo sapiens
tcaagaaaatctttgttgaagtt

SEQ ID NO: 3192418 - DNA, 12 bp, Homo sapiens
tcaagaaactga

SEQ ID NO: 3192419 - DNA, 20 bp, Homo sapiens
tcaagaaactgaggaatttt

SEQ ID NO: 3192420 - DNA, 21 bp, Homo sapiens
tcaagaataatcacgctttcc

SEQ ID NO: 3192421 - DNA, 20 bp, Homo sapiens
tcaagaattagaagtctttc

SEQ ID NO: 3192422 - DNA, 14 bp, Homo sapiens
tcaagacatagcat

SEQ ID NO: 3192423 - DNA, 16 bp, Homo sapiens
tcaagaccttctcccc

SEQ ID NO: 3192424 - DNA, 17 bp, Homo sapiens
tcaagacgaggggcagg

SEQ ID NO: 3192425 - DNA, 18 bp, Homo sapiens
tcaagacgaggggcaggg

SEQ ID NO: 3192426 - DNA, 15 bp, Homo sapiens
tattctcaaagttaa

SEQ ID NO: 3192427 - DNA, 15 bp, Homo sapiens
tattctcagagcatg

SEQ ID NO: 3192428 - DNA, 18 bp, Homo sapiens
tattctcagagcatgtgt

SEQ ID NO: 3192429 - DNA, 16 bp, Homo sapiens
tattctcatgcctcag

SEQ ID NO: 3192430 - DNA, 15 bp, Homo sapiens
tattctctatttgaa

SEQ ID NO: 3192431 - DNA, 16 bp, Homo sapiens
tattctgacttcctct

SEQ ID NO: 3192432 - DNA, 11 bp, Homo sapiens
tattctgagcc

SEQ ID NO: 3192433 - DNA, 15 bp, Homo sapiens
tattctgagccttga

SEQ ID NO: 3192434 - DNA, 21 bp, Homo sapiens
tattctgtgttgcattattca

SEQ ID NO: 3192435 - DNA, 15 bp, Homo sapiens
tattctgttggaagc

SEQ ID NO: 3192436 - DNA, 11 bp, Homo sapiens
tattctgtttt

SEQ ID NO: 3192437 - DNA, 23 bp, Homo sapiens
tattcttaacagatctttactct

SEQ ID NO: 3192438 - DNA, 22 bp, Homo sapiens
tattcttattggaaatgtactt

SEQ ID NO: 3192439 - DNA, 15 bp, Homo sapiens
tattcttatttaatg

SEQ ID NO: 3192440 - DNA, 14 bp, Homo sapiens
tattctttactatt

SEQ ID NO: 3192441 - DNA, 14 bp, Homo sapiens
tattctttgaaaac

SEQ ID NO: 3192442 - DNA, 18 bp, Homo sapiens
tattcttttataataatg

SEQ ID NO: 3192443 - DNA, 17 bp, Homo sapiens
tattgaaaaattatcag

SEQ ID NO: 3192444 - DNA, 16 bp, Homo sapiens
tattgaaaacttcaaa

SEQ ID NO: 3192445 - DNA, 22 bp, Homo sapiens
tattgaagaaacagataccata

SEQ ID NO: 3192446 - DNA, 14 bp, Homo sapiens
tattgaagaggata

SEQ ID NO: 3192447 - DNA, 19 bp, Homo sapiens
tattgaagaggatattctt

SEQ ID NO: 3192448 - DNA, 14 bp, Homo sapiens
tattgaatattgtg

SEQ ID NO: 3192449 - DNA, 23 bp, Homo sapiens
tattgacacagaaaatgttgaga

SEQ ID NO: 3192450 - DNA, 22 bp, Homo sapiens
tattgactaacaggccaaagag

SEQ ID NO: 3192451 - DNA, 17 bp, Homo sapiens
tattgacttgtatattt

SEQ ID NO: 3192452 - DNA, 18 bp, Homo sapiens
tattgagaattttaaatt

SEQ ID NO: 3192453 - DNA, 18 bp, Homo sapiens
tattgagatttcttaaat

SEQ ID NO: 3192454 - DNA, 19 bp, Homo sapiens
tattgagatttcttaaata

SEQ ID NO: 3192455 - DNA, 21 bp, Homo sapiens
tattgagggatagattgtatc

SEQ ID NO: 3192456 - DNA, 21 bp, Homo sapiens
tattgagttccagttgaagtt

SEQ ID NO: 3192457 - DNA, 21 bp, Homo sapiens
tattgagtttgtaggtaaaat

SEQ ID NO: 3192458 - DNA, 14 bp, Homo sapiens
tattgatagtactc

SEQ ID NO: 3192459 - DNA, 13 bp, Homo sapiens
tattgatatatat

SEQ ID NO: 3192460 - DNA, 13 bp, Homo sapiens
tattgatgaaaag

SEQ ID NO: 3192461 - DNA, 17 bp, Homo sapiens
tattgatgaaaagattt

SEQ ID NO: 3192462 - DNA, 16 bp, Homo sapiens
tattgatgaaatcatt

SEQ ID NO: 3192463 - DNA, 21 bp, Homo sapiens
tattgatgataacacttaaaa

SEQ ID NO: 3192464 - DNA, 13 bp, Homo sapiens
tattgatgtcagt

SEQ ID NO: 3192465 - DNA, 15 bp, Homo sapiens
tattgattgggaaaa

SEQ ID NO: 3192466 - DNA, 20 bp, Homo sapiens
tattgcaaaatagcatttgt

SEQ ID NO: 3192467 - DNA, 16 bp, Homo sapiens
tattgcaataaagtat

SEQ ID NO: 3192468 - DNA, 13 bp, Homo sapiens
tattgcacattgt

SEQ ID NO: 3192469 - DNA, 18 bp, Homo sapiens
tattgcaggagacatttt

SEQ ID NO: 3192470 - DNA, 21 bp, Homo sapiens
tattgccttttaatttttaat

SEQ ID NO: 3192471 - DNA, 19 bp, Homo sapiens
tattgctgagagaaatatg

SEQ ID NO: 3192472 - DNA, 18 bp, Homo sapiens
tattgcttagtaaaattt

SEQ ID NO: 3192473 - DNA, 19 bp, Homo sapiens
tattgcttagtaaaattta

SEQ ID NO: 3192474 - DNA, 21 bp, Homo sapiens
tattgcttattgcttagtaaa

SEQ ID NO: 3192475 - DNA, 22 bp, Homo sapiens
tattgcttattttattatgagc

SEQ ID NO: 3192476 - DNA, 22 bp, Homo sapiens
tattggaaatttgttataatga

SEQ ID NO: 3192477 - DNA, 17 bp, Homo sapiens
tattggatatttgatat

SEQ ID NO: 3192478 - DNA, 23 bp, Homo sapiens
tattgggatgtgagccccagggg

SEQ ID NO: 3192479 - DNA, 17 bp, Homo sapiens
tattggggtctgacccc

SEQ ID NO: 3192480 - DNA, 21 bp, Homo sapiens
tattggggttgagagggaaaa

SEQ ID NO: 3192481 - DNA, 14 bp, Homo sapiens
tattgggttcatta

SEQ ID NO: 3192482 - DNA, 20 bp, Homo sapiens
tattgggttcattattggaa

SEQ ID NO: 3192483 - DNA, 15 bp, Homo sapiens
tattggtgcgttttt

SEQ ID NO: 3192484 - DNA, 15 bp, Homo sapiens
tattgtaaacatgtg

SEQ ID NO: 3192485 - DNA, 16 bp, Homo sapiens
tattgtaagttgtaca

SEQ ID NO: 3192486 - DNA, 22 bp, Homo sapiens
tattgtaagttgtacaaatgta

SEQ ID NO: 3192487 - DNA, 18 bp, Homo sapiens
tattgtaatgagtgaatt

SEQ ID NO: 3192488 - DNA, 17 bp, Homo sapiens
tattgtacagactgttt

SEQ ID NO: 3192489 - DNA, 13 bp, Homo sapiens
tattgtaccattt

SEQ ID NO: 3192490 - DNA, 13 bp, Homo sapiens
tattgtacctctc

SEQ ID NO: 3192491 - DNA, 13 bp, Homo sapiens
tattgtataaaaa

SEQ ID NO: 3192492 - DNA, 17 bp, Homo sapiens
tattgtattatttggag

SEQ ID NO: 3192493 - DNA, 15 bp, Homo sapiens
tattgtatttatgtg

SEQ ID NO: 3192494 - DNA, 15 bp, Homo sapiens
tattgtatttattcc

SEQ ID NO: 3192495 - DNA, 12 bp, Homo sapiens
tattgtattttg

SEQ ID NO: 3192496 - DNA, 16 bp, Homo sapiens
tattgtattttgatga

SEQ ID NO: 3192497 - DNA, 14 bp, Homo sapiens
tattgtcagccatc

SEQ ID NO: 3192498 - DNA, 22 bp, Homo sapiens
tattgtcagtatctgtatctct

SEQ ID NO: 3192499 - DNA, 11 bp, Homo sapiens
tattgtcccac

SEQ ID NO: 3192500 - DNA, 17 bp, Homo sapiens
tattgtccttcagagct

SEQ ID NO: 3192501 - DNA, 14 bp, Homo sapiens
tattgtctgtctac

SEQ ID NO: 3192502 - DNA, 15 bp, Homo sapiens
tattgtctgtctaca

SEQ ID NO: 3192503 - DNA, 23 bp, Homo sapiens
tattgtggtattgaatattgtgt

SEQ ID NO: 3192504 - DNA, 14 bp, Homo sapiens
tattgtgttgtgaa

SEQ ID NO: 3192505 - DNA, 22 bp, Homo sapiens
tattgttacgtagcctaaggct

SEQ ID NO: 3192506 - DNA, 15 bp, Homo sapiens
tattgttactctggt

SEQ ID NO: 3192507 - DNA, 16 bp, Homo sapiens
tattgttcaaacaata

SEQ ID NO: 3192508 - DNA, 20 bp, Homo sapiens
tattgttcaaacaatatcat

SEQ ID NO: 3192509 - DNA, 19 bp, Homo sapiens
tattgttccaagacattgt

SEQ ID NO: 3192510 - DNA, 20 bp, Homo sapiens
tattgttccaagacattgtc

SEQ ID NO: 3192511 - DNA, 21 bp, Homo sapiens
tattttttatttctaagtatt

SEQ ID NO: 3192512 - DNA, 15 bp, Homo sapiens
tattttttccctcct

SEQ ID NO: 3192513 - DNA, 21 bp, Homo sapiens
tattttttcttttgtaattgt

SEQ ID NO: 3192514 - DNA, 19 bp, Homo sapiens
tattttttgaactttgtag

SEQ ID NO: 3192515 - DNA, 19 bp, Homo sapiens
tatttttttaaaatcacta

SEQ ID NO: 3192516 - DNA, 19 bp, Homo sapiens
tatttttttaactgaaaat

SEQ ID NO: 3192517 - DNA, 22 bp, Homo sapiens
tatttttttaactgaaaatgta

SEQ ID NO: 3192518 - DNA, 17 bp, Homo sapiens
tattttttttaagtatt

SEQ ID NO: 3192519 - DNA, 19 bp, Homo sapiens
tcaaaaaaaaaaaaatgca

SEQ ID NO: 3192520 - DNA, 14 bp, Homo sapiens
tcaaaaaaacacta

SEQ ID NO: 3192521 - DNA, 11 bp, Homo sapiens
tcaaaaagaaa

SEQ ID NO: 3192522 - DNA, 16 bp, Homo sapiens
tcaaaaagcagagtgg

SEQ ID NO: 3192523 - DNA, 14 bp, Homo sapiens
tcaaaaagtgttta

SEQ ID NO: 3192524 - DNA, 20 bp, Homo sapiens
tcaaaaataaaaaatctgaa

SEQ ID NO: 3192525 - DNA, 22 bp, Homo sapiens
tcaaaaataaaaaatctgaaga

SEQ ID NO: 3192526 - DNA, 14 bp, Homo sapiens
tcaaaaatacaaaa

SEQ ID NO: 3192527 - DNA, 15 bp, Homo sapiens
tcaaaaatacaaaat

SEQ ID NO: 3192528 - DNA, 14 bp, Homo sapiens
tcaaaaatataact

SEQ ID NO: 3192529 - DNA, 15 bp, Homo sapiens
tcaaaaatataactt

SEQ ID NO: 3192530 - DNA, 16 bp, Homo sapiens
tcaaaaatataactta

SEQ ID NO: 3192531 - DNA, 21 bp, Homo sapiens
tcaaaaatatgtgtttttaag

SEQ ID NO: 3192532 - DNA, 13 bp, Homo sapiens
tcaaaacactgtg

SEQ ID NO: 3192533 - DNA, 21 bp, Homo sapiens
tcaaaacagaagcagcttctt

SEQ ID NO: 3192534 - DNA, 12 bp, Homo sapiens
tcaaaacattcc

SEQ ID NO: 3192535 - DNA, 13 bp, Homo sapiens
tcaaaacattcca

SEQ ID NO: 3192536 - DNA, 14 bp, Homo sapiens
tcaaaaccatctct

SEQ ID NO: 3192537 - DNA, 19 bp, Homo sapiens
tcaaaaccatctctcttcc

SEQ ID NO: 3192538 - DNA, 19 bp, Homo sapiens
tcaaaacctgcagttaaca

SEQ ID NO: 3192539 - DNA, 16 bp, Homo sapiens
tcaaaacctgtgccag

SEQ ID NO: 3192540 - DNA, 17 bp, Homo sapiens
tcaaaacttggtatttt

SEQ ID NO: 3192541 - DNA, 17 bp, Homo sapiens
tcaaaagacaaacatgc

SEQ ID NO: 3192542 - DNA, 21 bp, Homo sapiens
tcaaaagacatgttgtaaatt

SEQ ID NO: 3192543 - DNA, 20 bp, Homo sapiens
tcaaaagagaaaaacaaaac

SEQ ID NO: 3192544 - DNA, 14 bp, Homo sapiens
tcaaaaggaacaaa

SEQ ID NO: 3192545 - DNA, 21 bp, Homo sapiens
tcaaaaggaatgaacttgtta

SEQ ID NO: 3192546 - DNA, 23 bp, Homo sapiens
tcaaaaggaatgaacttgttact

SEQ ID NO: 3192547 - DNA, 20 bp, Homo sapiens
tcaaaaggtattatacatgt

SEQ ID NO: 3192548 - DNA, 15 bp, Homo sapiens
tcaaaagtctatttt

SEQ ID NO: 3192549 - DNA, 17 bp, Homo sapiens
tcaaaagttccaagagt

SEQ ID NO: 3192550 - DNA, 21 bp, Homo sapiens
tcaaaagttccaagagtctaa

SEQ ID NO: 3192551 - DNA, 20 bp, Homo sapiens
tcaaaagttggactaaatgc

SEQ ID NO: 3192552 - DNA, 20 bp, Homo sapiens
tcaaaataaaaagcctcagt

SEQ ID NO: 3192553 - DNA, 18 bp, Homo sapiens
tcaaaataggatttctta

SEQ ID NO: 3192554 - DNA, 16 bp, Homo sapiens
tcaaaatatttgtaca

SEQ ID NO: 3192555 - DNA, 18 bp, Homo sapiens
tcaaaatccttccaaaga

SEQ ID NO: 3192556 - DNA, 19 bp, Homo sapiens
tcaaaattaatatgattat

SEQ ID NO: 3192557 - DNA, 17 bp, Homo sapiens
tcaaaattctagctgta

SEQ ID NO: 3192558 - DNA, 19 bp, Homo sapiens
tcaaaattctagctgtatg

SEQ ID NO: 3192559 - DNA, 21 bp, Homo sapiens
tcaaacacaatggagtgtgta

SEQ ID NO: 3192560 - DNA, 20 bp, Homo sapiens
tcaaacagtaggttggcagt

SEQ ID NO: 3192561 - DNA, 14 bp, Homo sapiens
tatggaatacagtg

SEQ ID NO: 3192562 - DNA, 17 bp, Homo sapiens
tatggaatacagtgtta

SEQ ID NO: 3192563 - DNA, 16 bp, Homo sapiens
tatggaatatcatctg

SEQ ID NO: 3192564 - DNA, 21 bp, Homo sapiens
tatggaatatcatctgtcatt

SEQ ID NO: 3192565 - DNA, 13 bp, Homo sapiens
tatggaatcaatt

SEQ ID NO: 3192566 - DNA, 15 bp, Homo sapiens
tatggaatcaattca

SEQ ID NO: 3192567 - DNA, 18 bp, Homo sapiens
tatggaattgatttgcat

SEQ ID NO: 3192568 - DNA, 19 bp, Homo sapiens
tatggaattgatttgcatt

SEQ ID NO: 3192569 - DNA, 16 bp, Homo sapiens
tatggacaacttattt

SEQ ID NO: 3192570 - DNA, 13 bp, Homo sapiens
tatggagcctggc

SEQ ID NO: 3192571 - DNA, 15 bp, Homo sapiens
tatggaggatggaga

SEQ ID NO: 3192572 - DNA, 16 bp, Homo sapiens
tatggatgattaaatt

SEQ ID NO: 3192573 - DNA, 20 bp, Homo sapiens
tatggatgattcagaaattg

SEQ ID NO: 3192574 - DNA, 21 bp, Homo sapiens
tatggattttctattgttact

SEQ ID NO: 3192575 - DNA, 12 bp, Homo sapiens
tatggcacttct

SEQ ID NO: 3192576 - DNA, 13 bp, Homo sapiens
tatggcagaagac

SEQ ID NO: 3192577 - DNA, 14 bp, Homo sapiens
tatggcagaagaca

SEQ ID NO: 3192578 - DNA, 16 bp, Homo sapiens
tatggcagaagacacc

SEQ ID NO: 3192579 - DNA, 23 bp, Homo sapiens
tatggcagaagacaccagagcag

SEQ ID NO: 3192580 - DNA, 14 bp, Homo sapiens
tatggcccagcctt

SEQ ID NO: 3192581 - DNA, 15 bp, Homo sapiens
tatggcctcgcctcc

SEQ ID NO: 3192582 - DNA, 22 bp, Homo sapiens
tatggcgttttgtctgtgttgc

SEQ ID NO: 3192583 - DNA, 21 bp, Homo sapiens
tatggctagacaggaaccctt

SEQ ID NO: 3192584 - DNA, 13 bp, Homo sapiens
tatggctgcccag

SEQ ID NO: 3192585 - DNA, 17 bp, Homo sapiens
tatggcttgtgaactgc

SEQ ID NO: 3192586 - DNA, 16 bp, Homo sapiens
tatgggactcaatgca

SEQ ID NO: 3192587 - DNA, 23 bp, Homo sapiens
tatgggactcaatgcactgacat

SEQ ID NO: 3192588 - DNA, 16 bp, Homo sapiens
tatgggagccccaggg

SEQ ID NO: 3192589 - DNA, 23 bp, Homo sapiens
tatgggcttttggggagccagaa

SEQ ID NO: 3192590 - DNA, 23 bp, Homo sapiens
tatggtatgctggccagcaccct

SEQ ID NO: 3192591 - DNA, 22 bp, Homo sapiens
tatggtatgtagccagctgtgc

SEQ ID NO: 3192592 - DNA, 17 bp, Homo sapiens
tatggttactaaaaagt

SEQ ID NO: 3192593 - DNA, 17 bp, Homo sapiens
tatgtaaaactcgcttt

SEQ ID NO: 3192594 - DNA, 20 bp, Homo sapiens
tatgtaaagtatgtaaacag

SEQ ID NO: 3192595 - DNA, 21 bp, Homo sapiens
tatgtaagaattcagaagacc

SEQ ID NO: 3192596 - DNA, 20 bp, Homo sapiens
tatgtaatatattgtacaaa

SEQ ID NO: 3192597 - DNA, 14 bp, Homo sapiens
tatgtacatatata

SEQ ID NO: 3192598 - DNA, 19 bp, Homo sapiens
tatgtacgtttgtatgtgt

SEQ ID NO: 3192599 - DNA, 22 bp, Homo sapiens
tatgtacgtttgtatgtgtgta

SEQ ID NO: 3192600 - DNA, 23 bp, Homo sapiens
tatgtacttagctgtactataag

SEQ ID NO: 3192601 - DNA, 21 bp, Homo sapiens
tatgtacttgatactgaatgc

SEQ ID NO: 3192602 - DNA, 23 bp, Homo sapiens
tatgtacttgatactgaatgcat

SEQ ID NO: 3192603 - DNA, 13 bp, Homo sapiens
tatgtagaaacat

SEQ ID NO: 3192604 - DNA, 14 bp, Homo sapiens
tatgtagaaacatt

SEQ ID NO: 3192605 - DNA, 17 bp, Homo sapiens
tatgtagaaacatttag

SEQ ID NO: 3192606 - DNA, 18 bp, Homo sapiens
tatgtagaattgctgtct

SEQ ID NO: 3192607 - DNA, 22 bp, Homo sapiens
tatgtagactatatacatgtgt

SEQ ID NO: 3192608 - DNA, 17 bp, Homo sapiens
tatgtagatatttggct

SEQ ID NO: 3192609 - DNA, 17 bp, Homo sapiens
tatgtagatgtgcattt

SEQ ID NO: 3192610 - DNA, 18 bp, Homo sapiens
tatgtagtattaaaagtt

SEQ ID NO: 3192611 - DNA, 23 bp, Homo sapiens
tatgtatatttttttaatttaac

SEQ ID NO: 3192612 - DNA, 12 bp, Homo sapiens
tatgtatgaagg

SEQ ID NO: 3192613 - DNA, 13 bp, Homo sapiens
tatgtatgtttac

SEQ ID NO: 3192614 - DNA, 13 bp, Homo sapiens
tatgtattattta

SEQ ID NO: 3192615 - DNA, 20 bp, Homo sapiens
tatgtattgtaaacatgtgt

SEQ ID NO: 3192616 - DNA, 16 bp, Homo sapiens
tatgtcaagaggctga

SEQ ID NO: 3192617 - DNA, 22 bp, Homo sapiens
tatgtccaccacttcaggggat

SEQ ID NO: 3192618 - DNA, 13 bp, Homo sapiens
tatgtcctaagga

SEQ ID NO: 3192619 - DNA, 21 bp, Homo sapiens
tatgtccttgggttgctggtt

SEQ ID NO: 3192620 - DNA, 16 bp, Homo sapiens
tatgtctagaaagtaa

SEQ ID NO: 3192621 - DNA, 13 bp, Homo sapiens
tatgtctatttaa

SEQ ID NO: 3192622 - DNA, 21 bp, Homo sapiens
tatgtctgtttttgtatcttt

SEQ ID NO: 3192623 - DNA, 22 bp, Homo sapiens
tatgtgaaagtgtaaaatagaa

SEQ ID NO: 3192624 - DNA, 19 bp, Homo sapiens
tatgtgaacaaatcaaatt

SEQ ID NO: 3192625 - DNA, 20 bp, Homo sapiens
tatgtgaacaaatcaaattg

SEQ ID NO: 3192626 - DNA, 17 bp, Homo sapiens
tatgtgaagaatttaga

SEQ ID NO: 3192627 - DNA, 12 bp, Homo sapiens
tatgtgaatgat

SEQ ID NO: 3192628 - DNA, 19 bp, Homo sapiens
tatgtgctatacacacaca

SEQ ID NO: 3192629 - DNA, 19 bp, Homo sapiens
tatgtgggttgcctggtga

SEQ ID NO: 3192630 - DNA, 18 bp, Homo sapiens
tatgtggttttagatttt

SEQ ID NO: 3192631 - DNA, 19 bp, Homo sapiens
tatgtggttttagattttc

SEQ ID NO: 3192632 - DNA, 14 bp, Homo sapiens
tatgtgtaaataca

SEQ ID NO: 3192633 - DNA, 21 bp, Homo sapiens
tatgtgtatatatacatacac

SEQ ID NO: 3192634 - DNA, 17 bp, Homo sapiens
tatgtgtatatttgtag

SEQ ID NO: 3192635 - DNA, 17 bp, Homo sapiens
tatgtgtgaaacaatgt

SEQ ID NO: 3192636 - DNA, 21 bp, Homo sapiens
tatgtgtgaggagctgctggc

SEQ ID NO: 3192637 - DNA, 20 bp, Homo sapiens
tatgtgtgcatgtgtgtata

SEQ ID NO: 3192638 - DNA, 21 bp, Homo sapiens
tatgtgtgcatgtgtgtataa

SEQ ID NO: 3192639 - DNA, 16 bp, Homo sapiens
tatgtgttacttcaag

SEQ ID NO: 3192640 - DNA, 17 bp, Homo sapiens
tatgtgtttttctcata

SEQ ID NO: 3192641 - DNA, 14 bp, Homo sapiens
tatgttaaagagaa

SEQ ID NO: 3192642 - DNA, 13 bp, Homo sapiens
tatgttaaagttt

SEQ ID NO: 3192643 - DNA, 16 bp, Homo sapiens
tatgttaaatactgtg

SEQ ID NO: 3192644 - DNA, 18 bp, Homo sapiens
tatgttaaatactgtgca

SEQ ID NO: 3192645 - DNA, 20 bp, Homo sapiens
tatgttaacctcagtgtcat

SEQ ID NO: 3192646 - DNA, 22 bp, Homo sapiens
tatgttaacctcagtgtcattt

SEQ ID NO: 3192647 - DNA, 19 bp, Homo sapiens
tatgttacatctgttttaa

SEQ ID NO: 3192648 - DNA, 15 bp, Homo sapiens
tatgttactattttc

SEQ ID NO: 3192649 - DNA, 16 bp, Homo sapiens
tatgttatacaaggca

SEQ ID NO: 3192650 - DNA, 23 bp, Homo sapiens
tatgttatacaaggcaagcattt

SEQ ID NO: 3192651 - DNA, 15 bp, Homo sapiens
tatgttatgaacatg

SEQ ID NO: 3192652 - DNA, 16 bp, Homo sapiens
tatgttattttgtgta

SEQ ID NO: 3192653 - DNA, 12 bp, Homo sapiens
tatgttcatgta

SEQ ID NO: 3192654 - DNA, 22 bp, Homo sapiens
tatgttcttagtggatgttctg

SEQ ID NO: 3192655 - DNA, 16 bp, Homo sapiens
tatgttgaaaaaattt

SEQ ID NO: 3192656 - DNA, 12 bp, Homo sapiens
tatgttgaatac

SEQ ID NO: 3192657 - DNA, 15 bp, Homo sapiens
tattaactacattta

SEQ ID NO: 3192658 - DNA, 17 bp, Homo sapiens
tattaactttaatgttt

SEQ ID NO: 3192659 - DNA, 18 bp, Homo sapiens
tattaactttaatgtttt

SEQ ID NO: 3192660 - DNA, 21 bp, Homo sapiens
tattaagacaatagcacttaa

SEQ ID NO: 3192661 - DNA, 13 bp, Homo sapiens
tattaagacagtg

SEQ ID NO: 3192662 - DNA, 13 bp, Homo sapiens
tattaagcacttt

SEQ ID NO: 3192663 - DNA, 13 bp, Homo sapiens
tattaagcttttt

SEQ ID NO: 3192664 - DNA, 16 bp, Homo sapiens
tattaagctttttgga

SEQ ID NO: 3192665 - DNA, 21 bp, Homo sapiens
tattaagtctgggatgtagaa

SEQ ID NO: 3192666 - DNA, 22 bp, Homo sapiens
tattaagttcgaacatgtttca

SEQ ID NO: 3192667 - DNA, 13 bp, Homo sapiens
tattaataaaaag

SEQ ID NO: 3192668 - DNA, 21 bp, Homo sapiens
tattaataaaactttatgtac

SEQ ID NO: 3192669 - DNA, 14 bp, Homo sapiens
tattaataaagcat

SEQ ID NO: 3192670 - DNA, 19 bp, Homo sapiens
tattaataaagcattcttt

SEQ ID NO: 3192671 - DNA, 15 bp, Homo sapiens
tattaatactggtat

SEQ ID NO: 3192672 - DNA, 14 bp, Homo sapiens
tattaatcagaata

SEQ ID NO: 3192673 - DNA, 17 bp, Homo sapiens
tattaatcttagtgtat

SEQ ID NO: 3192674 - DNA, 18 bp, Homo sapiens
tattaatcttagtgtatg

SEQ ID NO: 3192675 - DNA, 17 bp, Homo sapiens
tattaatgttttcaaaa

SEQ ID NO: 3192676 - DNA, 18 bp, Homo sapiens
tattaatgttttcaaaag

SEQ ID NO: 3192677 - DNA, 13 bp, Homo sapiens
tattaattcttca

SEQ ID NO: 3192678 - DNA, 21 bp, Homo sapiens
tattaattgttttgcactttt

SEQ ID NO: 3192679 - DNA, 12 bp, Homo sapiens
tattaatttgaa

SEQ ID NO: 3192680 - DNA, 21 bp, Homo sapiens
tattacaataccgttaagata

SEQ ID NO: 3192681 - DNA, 13 bp, Homo sapiens
tattacaattttt

SEQ ID NO: 3192682 - DNA, 13 bp, Homo sapiens
tattacactgtat

SEQ ID NO: 3192683 - DNA, 19 bp, Homo sapiens
tattacactgtatttgtat

SEQ ID NO: 3192684 - DNA, 16 bp, Homo sapiens
tattacatctaatgct

SEQ ID NO: 3192685 - DNA, 19 bp, Homo sapiens
tattaccaaaaaagtattt

SEQ ID NO: 3192686 - DNA, 13 bp, Homo sapiens
tattaccagcaag

SEQ ID NO: 3192687 - DNA, 22 bp, Homo sapiens
tattaccccctccttcagacac

SEQ ID NO: 3192688 - DNA, 15 bp, Homo sapiens
tattaccccttttcg

SEQ ID NO: 3192689 - DNA, 14 bp, Homo sapiens
tattacctcaaatt

SEQ ID NO: 3192690 - DNA, 13 bp, Homo sapiens
tattacctctgat

SEQ ID NO: 3192691 - DNA, 17 bp, Homo sapiens
tattactcctatttttg

SEQ ID NO: 3192692 - DNA, 23 bp, Homo sapiens
tattactgtctggttttaacaat

SEQ ID NO: 3192693 - DNA, 14 bp, Homo sapiens
tattactgtctttt

SEQ ID NO: 3192694 - DNA, 17 bp, Homo sapiens
tattactgttgcattta

SEQ ID NO: 3192695 - DNA, 19 bp, Homo sapiens
tattactgttgcatttact

SEQ ID NO: 3192696 - DNA, 16 bp, Homo sapiens
tattactgtttgttct

SEQ ID NO: 3192697 - DNA, 18 bp, Homo sapiens
tattacttaggttatttt

SEQ ID NO: 3192698 - DNA, 22 bp, Homo sapiens
tattacttaggttattttgctt

SEQ ID NO: 3192699 - DNA, 23 bp, Homo sapiens
tattacttatttttgacagtgtt

SEQ ID NO: 3192700 - DNA, 12 bp, Homo sapiens
tattacttctgt

SEQ ID NO: 3192701 - DNA, 14 bp, Homo sapiens
tattactttctctg

SEQ ID NO: 3192702 - DNA, 18 bp, Homo sapiens
tattactttctctgtagt

SEQ ID NO: 3192703 - DNA, 16 bp, Homo sapiens
tattagacttctaaat

SEQ ID NO: 3192704 - DNA, 22 bp, Homo sapiens
tattagatcaaatagttgcata

SEQ ID NO: 3192705 - DNA, 15 bp, Homo sapiens
tattagatgcactta

SEQ ID NO: 3192706 - DNA, 14 bp, Homo sapiens
tattagatgtggtt

SEQ ID NO: 3192707 - DNA, 12 bp, Homo sapiens
tattagccaact

SEQ ID NO: 3192708 - DNA, 18 bp, Homo sapiens
tattagccaggatcatgg

SEQ ID NO: 3192709 - DNA, 19 bp, Homo sapiens
tattagccaggatcatggt

SEQ ID NO: 3192710 - DNA, 23 bp, Homo sapiens
tattagccaggatcatggtgtaa

SEQ ID NO: 3192711 - DNA, 21 bp, Homo sapiens
tattagggagaaaattcaatt

SEQ ID NO: 3192712 - DNA, 21 bp, Homo sapiens
tattagtgaagatggtttcaa

SEQ ID NO: 3192713 - DNA, 16 bp, Homo sapiens
tattagttacaaagtt

SEQ ID NO: 3192714 - DNA, 23 bp, Homo sapiens
tattagttccctgtctcttgaaa

SEQ ID NO: 3192715 - DNA, 21 bp, Homo sapiens
tattataaattctactaagtt

SEQ ID NO: 3192716 - DNA, 23 bp, Homo sapiens
tattataaattctactaagttat

SEQ ID NO: 3192717 - DNA, 19 bp, Homo sapiens
tattataacaagtgtgtct

SEQ ID NO: 3192718 - DNA, 20 bp, Homo sapiens
tattataacaagtgtgtctt

SEQ ID NO: 3192719 - DNA, 18 bp, Homo sapiens
tattataagtcttacata

SEQ ID NO: 3192720 - DNA, 14 bp, Homo sapiens
tattatacatgtga

SEQ ID NO: 3192721 - DNA, 18 bp, Homo sapiens
tattatactaagaaaaga

SEQ ID NO: 3192722 - DNA, 13 bp, Homo sapiens
tattatatacata

SEQ ID NO: 3192723 - DNA, 15 bp, Homo sapiens
tattatcaacaatag

SEQ ID NO: 3192724 - DNA, 13 bp, Homo sapiens
tattatcactgtc

SEQ ID NO: 3192725 - DNA, 21 bp, Homo sapiens
tattatcttgttcaggaaaag

SEQ ID NO: 3192726 - DNA, 16 bp, Homo sapiens
tattatgagctttctt

SEQ ID NO: 3192727 - DNA, 16 bp, Homo sapiens
tattatggcttgtgaa

SEQ ID NO: 3192728 - DNA, 17 bp, Homo sapiens
tattatggcttgtgaac

SEQ ID NO: 3192729 - DNA, 17 bp, Homo sapiens
tattatgtctcttctga

SEQ ID NO: 3192730 - DNA, 12 bp, Homo sapiens
tattatgtgttt

SEQ ID NO: 3192731 - DNA, 14 bp, Homo sapiens
tattatgttgttca

SEQ ID NO: 3192732 - DNA, 20 bp, Homo sapiens
tattatgtttattacaattt

SEQ ID NO: 3192733 - DNA, 23 bp, Homo sapiens
tattattctgttttgcacagtta

SEQ ID NO: 3192734 - DNA, 14 bp, Homo sapiens
tattattgaaattg

SEQ ID NO: 3192735 - DNA, 15 bp, Homo sapiens
tattattgaaattgt

SEQ ID NO: 3192736 - DNA, 16 bp, Homo sapiens
tattattgtaagttgt

SEQ ID NO: 3192737 - DNA, 19 bp, Homo sapiens
tattattgtaagttgtaca

SEQ ID NO: 3192738 - DNA, 22 bp, Homo sapiens
tattattgtggtaggcctttta

SEQ ID NO: 3192739 - DNA, 22 bp, Homo sapiens
tattatttaccgttgcttgaaa

SEQ ID NO: 3192740 - DNA, 15 bp, Homo sapiens
tattatttataattc

SEQ ID NO: 3192741 - DNA, 14 bp, Homo sapiens
tattatttggagtt

SEQ ID NO: 3192742 - DNA, 17 bp, Homo sapiens
tattatttggagttagg

SEQ ID NO: 3192743 - DNA, 14 bp, Homo sapiens
tattatttggcagt

SEQ ID NO: 3192744 - DNA, 14 bp, Homo sapiens
tattatttgtgttt

SEQ ID NO: 3192745 - DNA, 19 bp, Homo sapiens
tattcaacaatttcaataa

SEQ ID NO: 3192746 - DNA, 16 bp, Homo sapiens
tattcaatcaaaattt

SEQ ID NO: 3192747 - DNA, 15 bp, Homo sapiens
tattcaattcctctg

SEQ ID NO: 3192748 - DNA, 17 bp, Homo sapiens
tattcagagaatatcaa

SEQ ID NO: 3192749 - DNA, 19 bp, Homo sapiens
tattcagcttcatttgtgt

SEQ ID NO: 3192750 - DNA, 16 bp, Homo sapiens
tattcaggaagataaa

SEQ ID NO: 3192751 - DNA, 19 bp, Homo sapiens
tattcaggaagataaaaat

SEQ ID NO: 3192752 - DNA, 20 bp, Homo sapiens
tattcaggagttggaatgtt

SEQ ID NO: 3192753 - DNA, 15 bp, Homo sapiens
tattcagggtaaata

SEQ ID NO: 3192754 - DNA, 20 bp, Homo sapiens
tattcagtaataactctacc

SEQ ID NO: 3192755 - DNA, 18 bp, Homo sapiens
tattcagtgctgtggcct

SEQ ID NO: 3192756 - DNA, 23 bp, Homo sapiens
tattcataaagagaaaatgatga

SEQ ID NO: 3192757 - DNA, 23 bp, Homo sapiens
tattcatgctctcatatatattt

SEQ ID NO: 3192758 - DNA, 20 bp, Homo sapiens
tattcattctgtgatcattt

SEQ ID NO: 3192759 - DNA, 22 bp, Homo sapiens
tattcattctgtgatcatttat

SEQ ID NO: 3192760 - DNA, 17 bp, Homo sapiens
tattccagaatgctgta

SEQ ID NO: 3192761 - DNA, 21 bp, Homo sapiens
tattccagaatgctgtacatc

SEQ ID NO: 3192762 - DNA, 23 bp, Homo sapiens
tattccagaatgctgtacatcta

SEQ ID NO: 3192763 - DNA, 22 bp, Homo sapiens
tattccagatctttcagaaata

SEQ ID NO: 3192764 - DNA, 17 bp, Homo sapiens
tattccatcaataaatg

SEQ ID NO: 3192765 - DNA, 17 bp, Homo sapiens
tattccatgaatgtatc

SEQ ID NO: 3192766 - DNA, 23 bp, Homo sapiens
tattccatgaatgtatcaggaaa

SEQ ID NO: 3192767 - DNA, 14 bp, Homo sapiens
tattccatttgtat

SEQ ID NO: 3192768 - DNA, 20 bp, Homo sapiens
tattcccaagcccatgagtc

SEQ ID NO: 3192769 - DNA, 23 bp, Homo sapiens
tattcccaagctctagtgggaag

SEQ ID NO: 3192770 - DNA, 16 bp, Homo sapiens
tattccctcatccttt

SEQ ID NO: 3192771 - DNA, 13 bp, Homo sapiens
tattccctgccca

SEQ ID NO: 3192772 - DNA, 21 bp, Homo sapiens
tattcccttgtattttgttaa

SEQ ID NO: 3192773 - DNA, 22 bp, Homo sapiens
tattcctacttgcagtacatca

SEQ ID NO: 3192774 - DNA, 17 bp, Homo sapiens
tattcctgtatgttgtc

SEQ ID NO: 3192775 - DNA, 16 bp, Homo sapiens
tattccttctggcctt

SEQ ID NO: 3192776 - DNA, 21 bp, Homo sapiens
tattccttctggcctttcctc

SEQ ID NO: 3192777 - DNA, 16 bp, Homo sapiens
tattccttgatcattt

SEQ ID NO: 3192778 - DNA, 15 bp, Homo sapiens
tattctaaaaccatt

SEQ ID NO: 3192779 - DNA, 11 bp, Homo sapiens
tattctaagac

SEQ ID NO: 3192780 - DNA, 21 bp, Homo sapiens
tattctagcctgcattgagct

SEQ ID NO: 3192781 - DNA, 20 bp, Homo sapiens
tattctagggtttcttaaat

SEQ ID NO: 3192782 - DNA, 20 bp, Homo sapiens
tattctatacacaccctgcc

SEQ ID NO: 3192783 - DNA, 14 bp, Homo sapiens
tattctatatgaat

SEQ ID NO: 3192784 - DNA, 19 bp, Homo sapiens
tattctatatgaatttaaa

SEQ ID NO: 3192785 - DNA, 22 bp, Homo sapiens
tattctattgtattatttggag

SEQ ID NO: 3192786 - DNA, 20 bp, Homo sapiens
tatctttccatgggagccag

SEQ ID NO: 3192787 - DNA, 19 bp, Homo sapiens
tatctttcgcacagcagtt

SEQ ID NO: 3192788 - DNA, 23 bp, Homo sapiens
tatcttttctattgtttattctt

SEQ ID NO: 3192789 - DNA, 16 bp, Homo sapiens
tatcttttctttcaaa

SEQ ID NO: 3192790 - DNA, 18 bp, Homo sapiens
tatctttttaaaaactct

SEQ ID NO: 3192791 - DNA, 21 bp, Homo sapiens
tatctttttaaaaactcttca

SEQ ID NO: 3192792 - DNA, 22 bp, Homo sapiens
tatctttttaaaaactcttcag

SEQ ID NO: 3192793 - DNA, 15 bp, Homo sapiens
tatgaaaaaatatga

SEQ ID NO: 3192794 - DNA, 19 bp, Homo sapiens
tatgaaaatgagcatcaga

SEQ ID NO: 3192795 - DNA, 20 bp, Homo sapiens
tatgaaaatgagttgtgaaa

SEQ ID NO: 3192796 - DNA, 19 bp, Homo sapiens
tatgaaagaatatatttat

SEQ ID NO: 3192797 - DNA, 20 bp, Homo sapiens
tatgaaagatggctgtgcct

SEQ ID NO: 3192798 - DNA, 22 bp, Homo sapiens
tatgaaagatggctgtgcctct

SEQ ID NO: 3192799 - DNA, 19 bp, Homo sapiens
tatgaaataaagaaattgc

SEQ ID NO: 3192800 - DNA, 14 bp, Homo sapiens
tatgaacatattgt

SEQ ID NO: 3192801 - DNA, 14 bp, Homo sapiens
tatgaacatgcagt

SEQ ID NO: 3192802 - DNA, 20 bp, Homo sapiens
tatgaaccctttgtttcttg

SEQ ID NO: 3192803 - DNA, 15 bp, Homo sapiens
tatgaacctattttc

SEQ ID NO: 3192804 - DNA, 17 bp, Homo sapiens
tatgaacctattttcat

SEQ ID NO: 3192805 - DNA, 22 bp, Homo sapiens
tatgaacctattttcatttgta

SEQ ID NO: 3192806 - DNA, 23 bp, Homo sapiens
tatgaacctattttcatttgtac

SEQ ID NO: 3192807 - DNA, 17 bp, Homo sapiens
tatgaagaactgaggag

SEQ ID NO: 3192808 - DNA, 15 bp, Homo sapiens
tatgaagcagattta

SEQ ID NO: 3192809 - DNA, 21 bp, Homo sapiens
tatgaagctacctcaaacttc

SEQ ID NO: 3192810 - DNA, 13 bp, Homo sapiens
tatgaagtgcgtg

SEQ ID NO: 3192811 - DNA, 20 bp, Homo sapiens
tatgaagttgctgtttattt

SEQ ID NO: 3192812 - DNA, 18 bp, Homo sapiens
tatgaagttggcacattt

SEQ ID NO: 3192813 - DNA, 18 bp, Homo sapiens
tatgaataaagacaccta

SEQ ID NO: 3192814 - DNA, 12 bp, Homo sapiens
tatgaataaagt

SEQ ID NO: 3192815 - DNA, 12 bp, Homo sapiens
tatgaatacagg

SEQ ID NO: 3192816 - DNA, 15 bp, Homo sapiens
tatgaatatcattga

SEQ ID NO: 3192817 - DNA, 15 bp, Homo sapiens
tatgaatattactct

SEQ ID NO: 3192818 - DNA, 23 bp, Homo sapiens
tatgaatcagtgggcaggataaa

SEQ ID NO: 3192819 - DNA, 20 bp, Homo sapiens
tatgaatgtactgcatgtta

SEQ ID NO: 3192820 - DNA, 23 bp, Homo sapiens
tatgaatgtactgcatgttacca

SEQ ID NO: 3192821 - DNA, 13 bp, Homo sapiens
tatgaattcaaga

SEQ ID NO: 3192822 - DNA, 18 bp, Homo sapiens
tatgaattcaagaaagga

SEQ ID NO: 3192823 - DNA, 15 bp, Homo sapiens
tatgaattgtacaga

SEQ ID NO: 3192824 - DNA, 17 bp, Homo sapiens
tatgaatttaaatataa

SEQ ID NO: 3192825 - DNA, 19 bp, Homo sapiens
tatgaatttaaatataatt

SEQ ID NO: 3192826 - DNA, 20 bp, Homo sapiens
tatgaatttaaatataattc

SEQ ID NO: 3192827 - DNA, 20 bp, Homo sapiens
tatgacacaaaggtggaata

SEQ ID NO: 3192828 - DNA, 15 bp, Homo sapiens
tatgacagatatatt

SEQ ID NO: 3192829 - DNA, 21 bp, Homo sapiens
tatgacagatatatttaagcc

SEQ ID NO: 3192830 - DNA, 20 bp, Homo sapiens
tatgacatcacttgtacaaa

SEQ ID NO: 3192831 - DNA, 24 bp, Homo sapiens
tatgacatcacttgtacaaaataa

SEQ ID NO: 3192832 - DNA, 21 bp, Homo sapiens
tatgacatgaaaagttattta

SEQ ID NO: 3192833 - DNA, 16 bp, Homo sapiens
tatgacgctgatacat

SEQ ID NO: 3192834 - DNA, 18 bp, Homo sapiens
tatgacgctgatacataa

SEQ ID NO: 3192835 - DNA, 22 bp, Homo sapiens
tatgacgctgatacataactaa

SEQ ID NO: 3192836 - DNA, 19 bp, Homo sapiens
tatgacggaagaacataga

SEQ ID NO: 3192837 - DNA, 20 bp, Homo sapiens
tatgacggaagaacatagaa

SEQ ID NO: 3192838 - DNA, 14 bp, Homo sapiens
tatgactaaagaga

SEQ ID NO: 3192839 - DNA, 20 bp, Homo sapiens
tatgactaaagagagaatgt

SEQ ID NO: 3192840 - DNA, 14 bp, Homo sapiens
tatgacttaaaatt

SEQ ID NO: 3192841 - DNA, 23 bp, Homo sapiens
tatgacttaaaattggaaatgtc

SEQ ID NO: 3192842 - DNA, 13 bp, Homo sapiens
tatgactttttat

SEQ ID NO: 3192843 - DNA, 22 bp, Homo sapiens
tatgactttttataaaatggct

SEQ ID NO: 3192844 - DNA, 21 bp, Homo sapiens
tatgagatctaatgtgaaaat

SEQ ID NO: 3192845 - DNA, 17 bp, Homo sapiens
tatgagatggttaaaaa

SEQ ID NO: 3192846 - DNA, 23 bp, Homo sapiens
tatgaggacttgtgtctctgtgc

SEQ ID NO: 3192847 - DNA, 15 bp, Homo sapiens
tatgaggagacattc

SEQ ID NO: 3192848 - DNA, 22 bp, Homo sapiens
tatgaggcaacctgattgtaaa

SEQ ID NO: 3192849 - DNA, 18 bp, Homo sapiens
tatgagggtgtttcctct

SEQ ID NO: 3192850 - DNA, 14 bp, Homo sapiens
tatgaggtgaaatg

SEQ ID NO: 3192851 - DNA, 18 bp, Homo sapiens
tatgagtaactattatta

SEQ ID NO: 3192852 - DNA, 17 bp, Homo sapiens
tatgagtcaatgtgcag

SEQ ID NO: 3192853 - DNA, 16 bp, Homo sapiens
tatgagttggacttca

SEQ ID NO: 3192854 - DNA, 21 bp, Homo sapiens
tatgatagatgacaaattggg

SEQ ID NO: 3192855 - DNA, 13 bp, Homo sapiens
tatgatatccctg

SEQ ID NO: 3192856 - DNA, 21 bp, Homo sapiens
tatgatattccccatttcctg

SEQ ID NO: 3192857 - DNA, 22 bp, Homo sapiens
tatgatattccccatttcctgt

SEQ ID NO: 3192858 - DNA, 16 bp, Homo sapiens
tatgatattgtttaaa

SEQ ID NO: 3192859 - DNA, 14 bp, Homo sapiens
tatgatcacggctc

SEQ ID NO: 3192860 - DNA, 14 bp, Homo sapiens
tatgatcagtgttg

SEQ ID NO: 3192861 - DNA, 15 bp, Homo sapiens
tatgatctatttgta

SEQ ID NO: 3192862 - DNA, 17 bp, Homo sapiens
tatgatctatttgtaga

SEQ ID NO: 3192863 - DNA, 16 bp, Homo sapiens
tatgatgcatacagtt

SEQ ID NO: 3192864 - DNA, 19 bp, Homo sapiens
tatgatgctaatcttgtcc

SEQ ID NO: 3192865 - DNA, 16 bp, Homo sapiens
tatgatgttttccctt

SEQ ID NO: 3192866 - DNA, 22 bp, Homo sapiens
tatgattactggcctttttcat

SEQ ID NO: 3192867 - DNA, 20 bp, Homo sapiens
tatgatttataaacagacaa

SEQ ID NO: 3192868 - DNA, 14 bp, Homo sapiens
tatgatttatagtt

SEQ ID NO: 3192869 - DNA, 20 bp, Homo sapiens
tatgatttgttttgaatttt

SEQ ID NO: 3192870 - DNA, 16 bp, Homo sapiens
tatgattttatttgac

SEQ ID NO: 3192871 - DNA, 16 bp, Homo sapiens
tatgattttttaaaag

SEQ ID NO: 3192872 - DNA, 17 bp, Homo sapiens
tatgattttttaaaaga

SEQ ID NO: 3192873 - DNA, 18 bp, Homo sapiens
tatgattttttaaaagaa

SEQ ID NO: 3192874 - DNA, 20 bp, Homo sapiens
tatgattttttaaaagaaat

SEQ ID NO: 3192875 - DNA, 20 bp, Homo sapiens
tatgcaaatgcctccaagcc

SEQ ID NO: 3192876 - DNA, 15 bp, Homo sapiens
tatgcaagcagcttt

SEQ ID NO: 3192877 - DNA, 15 bp, Homo sapiens
tatgcaagtctgtga

SEQ ID NO: 3192878 - DNA, 12 bp, Homo sapiens
tatgcacagagc

SEQ ID NO: 3192879 - DNA, 15 bp, Homo sapiens
tatgcacagagccca

SEQ ID NO: 3192880 - DNA, 14 bp, Homo sapiens
tatgcaccttgtgt

SEQ ID NO: 3192881 - DNA, 19 bp, Homo sapiens
tatgcaccttgtgtctgta

SEQ ID NO: 3192882 - DNA, 16 bp, Homo sapiens
tatgcactaaatatga

SEQ ID NO: 3192883 - DNA, 14 bp, Homo sapiens
tatgcattatatca

SEQ ID NO: 3192884 - DNA, 17 bp, Homo sapiens
tagatggaaaaatgtga

SEQ ID NO: 3192885 - DNA, 18 bp, Homo sapiens
tagatgggggaactgtga

SEQ ID NO: 3192886 - DNA, 14 bp, Homo sapiens
tagatggttacact

SEQ ID NO: 3192887 - DNA, 18 bp, Homo sapiens
tagatggttacactgtta

SEQ ID NO: 3192888 - DNA, 14 bp, Homo sapiens
tagatgtggtcctt

SEQ ID NO: 3192889 - DNA, 20 bp, Homo sapiens
tagatgttttggtagattaa

SEQ ID NO: 3192890 - DNA, 22 bp, Homo sapiens
tagattaaatatagattagaaa

SEQ ID NO: 3192891 - DNA, 16 bp, Homo sapiens
tagattagaaaaattc

SEQ ID NO: 3192892 - DNA, 15 bp, Homo sapiens
tagattatatcaaag

SEQ ID NO: 3192893 - DNA, 17 bp, Homo sapiens
tagattatatcaaagta

SEQ ID NO: 3192894 - DNA, 13 bp, Homo sapiens
tagattcaaaggt

SEQ ID NO: 3192895 - DNA, 16 bp, Homo sapiens
tagattcaaaggttct

SEQ ID NO: 3192896 - DNA, 17 bp, Homo sapiens
tagattcaaaggttcta

SEQ ID NO: 3192897 - DNA, 20 bp, Homo sapiens
tagcctaaagggcagggccc

SEQ ID NO: 3192898 - DNA, 16 bp, Homo sapiens
tagcctaggtgacaga

SEQ ID NO: 3192899 - DNA, 17 bp, Homo sapiens
tagcctatatttacagt

SEQ ID NO: 3192900 - DNA, 13 bp, Homo sapiens
tagcctgaaggat

SEQ ID NO: 3192901 - DNA, 17 bp, Homo sapiens
tagcctgggccacaggg

SEQ ID NO: 3192902 - DNA, 20 bp, Homo sapiens
tagcctgtgcctctgggact

SEQ ID NO: 3192903 - DNA, 19 bp, Homo sapiens
taggccccagaggccctgg

SEQ ID NO: 3192904 - DNA, 18 bp, Homo sapiens
taggcccttgtcctgcca

SEQ ID NO: 3192905 - DNA, 19 bp, Homo sapiens
taggcccttgtcctgccag

SEQ ID NO: 3192906 - DNA, 12 bp, Homo sapiens
tagtcctgtgaa

SEQ ID NO: 3192907 - DNA, 17 bp, Homo sapiens
tagtcctttctgccttg

SEQ ID NO: 3192908 - DNA, 17 bp, Homo sapiens
tagtctaagactatata

SEQ ID NO: 3192909 - DNA, 11 bp, Homo sapiens
tagtctcagtt

SEQ ID NO: 3192910 - DNA, 18 bp, Homo sapiens
tagtctcctttgcactga

SEQ ID NO: 3192911 - DNA, 12 bp, Homo sapiens
tagtctgctcac

SEQ ID NO: 3192912 - DNA, 12 bp, Homo sapiens
tagtcttctcat

SEQ ID NO: 3192913 - DNA, 18 bp, Homo sapiens
tagtctttgccagtcatt

SEQ ID NO: 3192914 - DNA, 14 bp, Homo sapiens
tagtcttttgcttt

SEQ ID NO: 3192915 - DNA, 16 bp, Homo sapiens
tagtcttttgcttttg

SEQ ID NO: 3192916 - DNA, 22 bp, Homo sapiens
tagtgaccatcttcataatttg

SEQ ID NO: 3192917 - DNA, 16 bp, Homo sapiens
tagtgacttgtgtccc

SEQ ID NO: 3192918 - DNA, 15 bp, Homo sapiens
tagtgagacccctgt

SEQ ID NO: 3192919 - DNA, 20 bp, Homo sapiens
tagtgagccactcagtctct

SEQ ID NO: 3192920 - DNA, 16 bp, Homo sapiens
tagtgatcatttaaaa

SEQ ID NO: 3192921 - DNA, 19 bp, Homo sapiens
tagtgatgatggttcacgt

SEQ ID NO: 3192922 - DNA, 14 bp, Homo sapiens
tagtgatggttccc

SEQ ID NO: 3192923 - DNA, 18 bp, Homo sapiens
tagtgatggttcccctgt

SEQ ID NO: 3192924 - DNA, 14 bp, Homo sapiens
tagtgattctgatt

SEQ ID NO: 3192925 - DNA, 15 bp, Homo sapiens
tagtgcagctgattt

SEQ ID NO: 3192926 - DNA, 22 bp, Homo sapiens
tagtgcagctgattttaacaat

SEQ ID NO: 3192927 - DNA, 21 bp, Homo sapiens
tagtgccagaattttaggaac

SEQ ID NO: 3192928 - DNA, 15 bp, Homo sapiens
tagtgccctgccccc

SEQ ID NO: 3192929 - DNA, 18 bp, Homo sapiens
tagtgccctgccccctgg

SEQ ID NO: 3192930 - DNA, 20 bp, Homo sapiens
tagtgccctgccccctggct

SEQ ID NO: 3192931 - DNA, 21 bp, Homo sapiens
tagtgccctgccccctggctg

SEQ ID NO: 3192932 - DNA, 18 bp, Homo sapiens
tagtgcctaaaattgtat

SEQ ID NO: 3192933 - DNA, 22 bp, Homo sapiens
tagtgcctgagagtatttaggc

SEQ ID NO: 3192934 - DNA, 17 bp, Homo sapiens
tagtgcggacaagtttt

SEQ ID NO: 3192935 - DNA, 12 bp, Homo sapiens
tagtgctgggat

SEQ ID NO: 3192936 - DNA, 19 bp, Homo sapiens
tagtggaaatcgcttatat

SEQ ID NO: 3192937 - DNA, 17 bp, Homo sapiens
tagtggaagagcagcct

SEQ ID NO: 3192938 - DNA, 18 bp, Homo sapiens
tagtggaagagcagcctg

SEQ ID NO: 3192939 - DNA, 21 bp, Homo sapiens
tagtggatgactgttgatgaa

SEQ ID NO: 3192940 - DNA, 17 bp, Homo sapiens
tagtggattactgccat

SEQ ID NO: 3192941 - DNA, 21 bp, Homo sapiens
tagtggcaagacagtggttct

SEQ ID NO: 3192942 - DNA, 20 bp, Homo sapiens
tagtggcttaaaacaacact

SEQ ID NO: 3192943 - DNA, 14 bp, Homo sapiens
tagtggcttcaaaa

SEQ ID NO: 3192944 - DNA, 14 bp, Homo sapiens
tagtgggccagggc

SEQ ID NO: 3192945 - DNA, 14 bp, Homo sapiens
tagtggggcctggg

SEQ ID NO: 3192946 - DNA, 13 bp, Homo sapiens
tagtggtatgtct

SEQ ID NO: 3192947 - DNA, 19 bp, Homo sapiens
tagtgtgagtggcagccat

SEQ ID NO: 3192948 - DNA, 20 bp, Homo sapiens
tagtgtgagtggcagccatg

SEQ ID NO: 3192949 - DNA, 22 bp, Homo sapiens
tagtgtgagtggcagccatgcc

SEQ ID NO: 3192950 - DNA, 19 bp, Homo sapiens
tagtgtggtatttgctgtc

SEQ ID NO: 3192951 - DNA, 16 bp, Homo sapiens
tagtgtggtgtgtttg

SEQ ID NO: 3192952 - DNA, 19 bp, Homo sapiens
tagttaagacatgatttcc

SEQ ID NO: 3192953 - DNA, 23 bp, Homo sapiens
tagttaagacatgatttccttga

SEQ ID NO: 3192954 - DNA, 16 bp, Homo sapiens
tagttaaggagcctaa

SEQ ID NO: 3192955 - DNA, 23 bp, Homo sapiens
tagttaatattgtgaagaaaaat

SEQ ID NO: 3192956 - DNA, 12 bp, Homo sapiens
tagttaatttat

SEQ ID NO: 3192957 - DNA, 17 bp, Homo sapiens
tagttaccttatagtta

SEQ ID NO: 3192958 - DNA, 23 bp, Homo sapiens
tagttaccttatagttactgtgt

SEQ ID NO: 3192959 - DNA, 13 bp, Homo sapiens
tagttactcaagc

SEQ ID NO: 3192960 - DNA, 18 bp, Homo sapiens
tagttactgtgtaattag

SEQ ID NO: 3192961 - DNA, 20 bp, Homo sapiens
tagttagccatctaatgctt

SEQ ID NO: 3192962 - DNA, 18 bp, Homo sapiens
tagttaggaaataaaacc

SEQ ID NO: 3192963 - DNA, 23 bp, Homo sapiens
tagttaggaaataaaacctttca

SEQ ID NO: 3192964 - DNA, 16 bp, Homo sapiens
tagttatagtttcaga

SEQ ID NO: 3192965 - DNA, 13 bp, Homo sapiens
tagttcaatacag

SEQ ID NO: 3192966 - DNA, 19 bp, Homo sapiens
tagttcaatatttgttact

SEQ ID NO: 3192967 - DNA, 11 bp, Homo sapiens
tagttcaatgc

SEQ ID NO: 3192968 - DNA, 15 bp, Homo sapiens
tagttcagacacttt

SEQ ID NO: 3192969 - DNA, 19 bp, Homo sapiens
tagttcagtagaattacca

SEQ ID NO: 3192970 - DNA, 18 bp, Homo sapiens
tagttcatccaatcctca

SEQ ID NO: 3192971 - DNA, 16 bp, Homo sapiens
tagttccctctgctca

SEQ ID NO: 3192972 - DNA, 20 bp, Homo sapiens
tagttccctctgctcagcca

SEQ ID NO: 3192973 - DNA, 15 bp, Homo sapiens
tagttccctttgcca

SEQ ID NO: 3192974 - DNA, 12 bp, Homo sapiens
tagttcctgcta

SEQ ID NO: 3192975 - DNA, 22 bp, Homo sapiens
tagttctatcaggaaaacaaat

SEQ ID NO: 3192976 - DNA, 17 bp, Homo sapiens
tagttctctagggtctg

SEQ ID NO: 3192977 - DNA, 16 bp, Homo sapiens
tagttctgaggtccct

SEQ ID NO: 3192978 - DNA, 22 bp, Homo sapiens
tagttctgtttggtgtgtccca

SEQ ID NO: 3192979 - DNA, 20 bp, Homo sapiens
tagttctttcctccccctgc

SEQ ID NO: 3192980 - DNA, 14 bp, Homo sapiens
tagttgactcacag

SEQ ID NO: 3192981 - DNA, 21 bp, Homo sapiens
tagttgagagagtagttttga

SEQ ID NO: 3192982 - DNA, 12 bp, Homo sapiens
tagttgagcccc

SEQ ID NO: 3192983 - DNA, 17 bp, Homo sapiens
tagttgagccccaagtc

SEQ ID NO: 3192984 - DNA, 22 bp, Homo sapiens
tagttgatgcatgttactaaat

SEQ ID NO: 3192985 - DNA, 14 bp, Homo sapiens
tagttgcaattgaa

SEQ ID NO: 3192986 - DNA, 20 bp, Homo sapiens
tagttgcatagcagtatatg

SEQ ID NO: 3192987 - DNA, 16 bp, Homo sapiens
tagttggtgctgatgg

SEQ ID NO: 3192988 - DNA, 15 bp, Homo sapiens
tagttggtgttcaaa

SEQ ID NO: 3192989 - DNA, 17 bp, Homo sapiens
tagttgtgggtgggaga

SEQ ID NO: 3192990 - DNA, 15 bp, Homo sapiens
tagttgtgtttcaac

SEQ ID NO: 3192991 - DNA, 17 bp, Homo sapiens
tagtttacctctttaaa

SEQ ID NO: 3192992 - DNA, 18 bp, Homo sapiens
tagtttattggaagtgtt

SEQ ID NO: 3192993 - DNA, 23 bp, Homo sapiens
tagtttcaaaggccacatacctc

SEQ ID NO: 3192994 - DNA, 14 bp, Homo sapiens
tagtttcagtaaat

SEQ ID NO: 3192995 - DNA, 17 bp, Homo sapiens
tagtttctagaggcctc

SEQ ID NO: 3192996 - DNA, 13 bp, Homo sapiens
tagtttctgaggc

SEQ ID NO: 3192997 - DNA, 20 bp, Homo sapiens
tagtttgacctcacagtgac

SEQ ID NO: 3192998 - DNA, 21 bp, Homo sapiens
tagtttgacctcacagtgacc

SEQ ID NO: 3192999 - DNA, 18 bp, Homo sapiens
tagtttgattattatgtt

SEQ ID NO: 3193000 - DNA, 12 bp, Homo sapiens
tagtttggatat

SEQ ID NO: 3193001 - DNA, 22 bp, Homo sapiens
tagtttggatatttttgtactt

SEQ ID NO: 3193002 - DNA, 19 bp, Homo sapiens
tagtttgtaccatttatga

SEQ ID NO: 3193003 - DNA, 17 bp, Homo sapiens
tagtttgtataacttct

SEQ ID NO: 3193004 - DNA, 15 bp, Homo sapiens
tagtttgtctatttt

SEQ ID NO: 3193005 - DNA, 22 bp, Homo sapiens
tagttttacttttaaactgtgt

SEQ ID NO: 3193006 - DNA, 17 bp, Homo sapiens
tagttttagttgcagaa

SEQ ID NO: 3193007 - DNA, 14 bp, Homo sapiens
tagttttagttttc

SEQ ID NO: 3193008 - DNA, 15 bp, Homo sapiens
tagttttcagccttg

SEQ ID NO: 3193009 - DNA, 23 bp, Homo sapiens
tagttttttttttttttatgtga

SEQ ID NO: 3193010 - DNA, 22 bp, Homo sapiens
tataaaaaatcatgccagtatt

SEQ ID NO: 3193011 - DNA, 17 bp, Homo sapiens
tataaaaaatggttcag

SEQ ID NO: 3193012 - DNA, 17 bp, Homo sapiens
tataaaaaatgtaacat

SEQ ID NO: 3193013 - DNA, 17 bp, Homo sapiens
tataaaaacatgagtta

SEQ ID NO: 3193014 - DNA, 19 bp, Homo sapiens
tataaaaagaaaagataaa

SEQ ID NO: 3193015 - DNA, 14 bp, Homo sapiens
tataaaaagccact

SEQ ID NO: 3193016 - DNA, 18 bp, Homo sapiens
tataaaaagcttccatga

SEQ ID NO: 3193017 - DNA, 16 bp, Homo sapiens
tataaaaatatatata

SEQ ID NO: 3193018 - DNA, 14 bp, Homo sapiens
tataaaaatggctt

SEQ ID NO: 3193019 - DNA, 15 bp, Homo sapiens
tataaaagatatata

SEQ ID NO: 3193020 - DNA, 19 bp, Homo sapiens
tataaaaggcaaatgtgta

SEQ ID NO: 3193021 - DNA, 9 bp, Homo sapiens
tataaaata

SEQ ID NO: 3193022 - DNA, 19 bp, Homo sapiens
tataaaatagacaaataga

SEQ ID NO: 3193023 - DNA, 21 bp, Homo sapiens
tataaaatgcagtaacattct

SEQ ID NO: 3193024 - DNA, 22 bp, Homo sapiens
tataaaatgcagtaacattcta

SEQ ID NO: 3193025 - DNA, 17 bp, Homo sapiens
tataaaatgggaagact

SEQ ID NO: 3193026 - DNA, 15 bp, Homo sapiens
tataaaatgtattca

SEQ ID NO: 3193027 - DNA, 12 bp, Homo sapiens
tataaaatgtgc

SEQ ID NO: 3193028 - DNA, 21 bp, Homo sapiens
tataaaatgtgcagatgcaat

SEQ ID NO: 3193029 - DNA, 18 bp, Homo sapiens
tataaaattaaatgcctt

SEQ ID NO: 3193030 - DNA, 12 bp, Homo sapiens
tataaaattatg

SEQ ID NO: 3193031 - DNA, 18 bp, Homo sapiens
tataaacacattgaatgc

SEQ ID NO: 3193032 - DNA, 21 bp, Homo sapiens
tataaacagaaatggaaagca

SEQ ID NO: 3193033 - DNA, 20 bp, Homo sapiens
tataaacagacaatatgtga

SEQ ID NO: 3193034 - DNA, 14 bp, Homo sapiens
tataaacatcacac

SEQ ID NO: 3193035 - DNA, 22 bp, Homo sapiens
tacttgggaggctgaggcagga

SEQ ID NO: 3193036 - DNA, 20 bp, Homo sapiens
tacttggtttgtgttcttct

SEQ ID NO: 3193037 - DNA, 15 bp, Homo sapiens
tacttgtaaattgat

SEQ ID NO: 3193038 - DNA, 17 bp, Homo sapiens
tacttgtgactgaaggg

SEQ ID NO: 3193039 - DNA, 15 bp, Homo sapiens
tacttgtgtttgctt

SEQ ID NO: 3193040 - DNA, 13 bp, Homo sapiens
tactttaaaaagg

SEQ ID NO: 3193041 - DNA, 22 bp, Homo sapiens
tactttaagcactacataaact

SEQ ID NO: 3193042 - DNA, 21 bp, Homo sapiens
tactttatatctgtaatgata

SEQ ID NO: 3193043 - DNA, 18 bp, Homo sapiens
tactttatcactttttga

SEQ ID NO: 3193044 - DNA, 21 bp, Homo sapiens
tactttatcatgaatgctttt

SEQ ID NO: 3193045 - DNA, 19 bp, Homo sapiens
tactttattaatatgagtt

SEQ ID NO: 3193046 - DNA, 10 bp, Homo sapiens
tactttcaaa

SEQ ID NO: 3193047 - DNA, 17 bp, Homo sapiens
tactttcgtacattggc

SEQ ID NO: 3193048 - DNA, 13 bp, Homo sapiens
tactttctctgta

SEQ ID NO: 3193049 - DNA, 15 bp, Homo sapiens
tactttctctgtagt

SEQ ID NO: 3193050 - DNA, 15 bp, Homo sapiens
tactttctctttttc

SEQ ID NO: 3193051 - DNA, 18 bp, Homo sapiens
tactttgcaatccaaata

SEQ ID NO: 3193052 - DNA, 16 bp, Homo sapiens
tactttggcaatttcc

SEQ ID NO: 3193053 - DNA, 23 bp, Homo sapiens
tactttggcaatttcctggccct

SEQ ID NO: 3193054 - DNA, 15 bp, Homo sapiens
tactttggcatcttt

SEQ ID NO: 3193055 - DNA, 20 bp, Homo sapiens
tactttggggctaatttaac

SEQ ID NO: 3193056 - DNA, 12 bp, Homo sapiens
tactttgtaatt

SEQ ID NO: 3193057 - DNA, 13 bp, Homo sapiens
tactttgtaattt

SEQ ID NO: 3193058 - DNA, 16 bp, Homo sapiens
tactttgtacttgtgt

SEQ ID NO: 3193059 - DNA, 21 bp, Homo sapiens
tactttgtacttgtgtttgct

SEQ ID NO: 3193060 - DNA, 22 bp, Homo sapiens
tactttgtggaccaattattga

SEQ ID NO: 3193061 - DNA, 13 bp, Homo sapiens
tactttgtttatt

SEQ ID NO: 3193062 - DNA, 15 bp, Homo sapiens
tacttttaaaaatgt

SEQ ID NO: 3193063 - DNA, 23 bp, Homo sapiens
tacttttcccctgttaaacagta

SEQ ID NO: 3193064 - DNA, 21 bp, Homo sapiens
tacttttcctgggtttcctgc

SEQ ID NO: 3193065 - DNA, 20 bp, Homo sapiens
tacttttgcttttttattta

SEQ ID NO: 3193066 - DNA, 19 bp, Homo sapiens
tacttttgttctgtatttt

SEQ ID NO: 3193067 - DNA, 20 bp, Homo sapiens
tactttttaaaaggtatttt

SEQ ID NO: 3193068 - DNA, 19 bp, Homo sapiens
tactttttagtaatttctt

SEQ ID NO: 3193069 - DNA, 13 bp, Homo sapiens
tactttttgttat

SEQ ID NO: 3193070 - DNA, 18 bp, Homo sapiens
tacttttttaaatatttt

SEQ ID NO: 3193071 - DNA, 21 bp, Homo sapiens
tacttttttaaatattttcta

SEQ ID NO: 3193072 - DNA, 23 bp, Homo sapiens
tacttttttaaatattttctatt

SEQ ID NO: 3193073 - DNA, 13 bp, Homo sapiens
tacttttttatag

SEQ ID NO: 3193074 - DNA, 20 bp, Homo sapiens
tactttttttggaagttatt

SEQ ID NO: 3193075 - DNA, 15 bp, Homo sapiens
tagaaaaataaaaat

SEQ ID NO: 3193076 - DNA, 18 bp, Homo sapiens
tagaaaaatctcattccc

SEQ ID NO: 3193077 - DNA, 20 bp, Homo sapiens
tagaaaaattcagcaaacca

SEQ ID NO: 3193078 - DNA, 15 bp, Homo sapiens
tagaaaacaatgcaa

SEQ ID NO: 3193079 - DNA, 20 bp, Homo sapiens
tagaaaacaatgcaaaacct

SEQ ID NO: 3193080 - DNA, 21 bp, Homo sapiens
tagaaaactgaaaatctaata

SEQ ID NO: 3193081 - DNA, 21 bp, Homo sapiens
tagaaaagcagtcccattcat

SEQ ID NO: 3193082 - DNA, 11 bp, Homo sapiens
tagaaaaggcg

SEQ ID NO: 3193083 - DNA, 23 bp, Homo sapiens
tagaaaagttgcagatgtattga

SEQ ID NO: 3193084 - DNA, 21 bp, Homo sapiens
tagaaaatagagcttttaaaa

SEQ ID NO: 3193085 - DNA, 17 bp, Homo sapiens
tagaaaatgacttattt

SEQ ID NO: 3193086 - DNA, 20 bp, Homo sapiens
tagaaaatgacttatttctg

SEQ ID NO: 3193087 - DNA, 22 bp, Homo sapiens
tagaaaatgacttatttctgct

SEQ ID NO: 3193088 - DNA, 13 bp, Homo sapiens
tagaaaatttgct

SEQ ID NO: 3193089 - DNA, 16 bp, Homo sapiens
tagaaacatgacactg

SEQ ID NO: 3193090 - DNA, 19 bp, Homo sapiens
tagaaacatgacactgacc

SEQ ID NO: 3193091 - DNA, 23 bp, Homo sapiens
tagaaacatggttttgaaatgct

SEQ ID NO: 3193092 - DNA, 15 bp, Homo sapiens
tagaaacattgtaaa

SEQ ID NO: 3193093 - DNA, 19 bp, Homo sapiens
tagaaactcaccatgtaaa

SEQ ID NO: 3193094 - DNA, 21 bp, Homo sapiens
tagaaagaagcccaatattat

SEQ ID NO: 3193095 - DNA, 14 bp, Homo sapiens
tagaaagcaggggc

SEQ ID NO: 3193096 - DNA, 15 bp, Homo sapiens
tagaaagcaggggct

SEQ ID NO: 3193097 - DNA, 20 bp, Homo sapiens
tagaaataaaggatgtgatt

SEQ ID NO: 3193098 - DNA, 16 bp, Homo sapiens
tagaaataaatagcta

SEQ ID NO: 3193099 - DNA, 11 bp, Homo sapiens
tagaaataagt

SEQ ID NO: 3193100 - DNA, 22 bp, Homo sapiens
tagaaataagtggttatttctc

SEQ ID NO: 3193101 - DNA, 15 bp, Homo sapiens
tagaaatataattga

SEQ ID NO: 3193102 - DNA, 23 bp, Homo sapiens
tagaaatatctgaaaatgtatgt

SEQ ID NO: 3193103 - DNA, 13 bp, Homo sapiens
tagaaatcacaac

SEQ ID NO: 3193104 - DNA, 17 bp, Homo sapiens
tagaaatctaaaagaat

SEQ ID NO: 3193105 - DNA, 21 bp, Homo sapiens
tagaaatctatcttaaaacct

SEQ ID NO: 3193106 - DNA, 19 bp, Homo sapiens
tagaaatgatgatgtggaa

SEQ ID NO: 3193107 - DNA, 16 bp, Homo sapiens
tagaaatggaaatttt

SEQ ID NO: 3193108 - DNA, 17 bp, Homo sapiens
tagaaatggaaattttg

SEQ ID NO: 3193109 - DNA, 21 bp, Homo sapiens
tagaaatggaaattttgctat

SEQ ID NO: 3193110 - DNA, 16 bp, Homo sapiens
tagaaatgtaaactgc

SEQ ID NO: 3193111 - DNA, 18 bp, Homo sapiens
tagaaattataattttag

SEQ ID NO: 3193112 - DNA, 22 bp, Homo sapiens
tagaaattttacaataggtgct

SEQ ID NO: 3193113 - DNA, 13 bp, Homo sapiens
tagaaattttcaa

SEQ ID NO: 3193114 - DNA, 16 bp, Homo sapiens
tagaacactaattcat

SEQ ID NO: 3193115 - DNA, 12 bp, Homo sapiens
tagaacactatt

SEQ ID NO: 3193116 - DNA, 14 bp, Homo sapiens
tagaacactatttt

SEQ ID NO: 3193117 - DNA, 18 bp, Homo sapiens
tagaacactattttcaga

SEQ ID NO: 3193118 - DNA, 17 bp, Homo sapiens
tagaacagataatcagt

SEQ ID NO: 3193119 - DNA, 18 bp, Homo sapiens
tagaaccaccaaaattat

SEQ ID NO: 3193120 - DNA, 12 bp, Homo sapiens
tagaaccacttc

SEQ ID NO: 3193121 - DNA, 22 bp, Homo sapiens
tagaacctgggctgtgctgctt

SEQ ID NO: 3193122 - DNA, 15 bp, Homo sapiens
tagaaccttctagaa

SEQ ID NO: 3193123 - DNA, 23 bp, Homo sapiens
tagaaccttctagaacctgggct

SEQ ID NO: 3193124 - DNA, 17 bp, Homo sapiens
tagaactcactctgggc

SEQ ID NO: 3193125 - DNA, 14 bp, Homo sapiens
tagaactcagcagt

SEQ ID NO: 3193126 - DNA, 19 bp, Homo sapiens
tagaactcagttttaacta

SEQ ID NO: 3193127 - DNA, 16 bp, Homo sapiens
tagaacttgaccccct

SEQ ID NO: 3193128 - DNA, 21 bp, Homo sapiens
tagaacttttttaaataaact

SEQ ID NO: 3193129 - DNA, 12 bp, Homo sapiens
tagaagaaaagc

SEQ ID NO: 3193130 - DNA, 16 bp, Homo sapiens
tagaagaaaagcccat

SEQ ID NO: 3193131 - DNA, 16 bp, Homo sapiens
tagaagaaagatgttt

SEQ ID NO: 3193132 - DNA, 22 bp, Homo sapiens
tagaagaacatccaaggagaaa

SEQ ID NO: 3193133 - DNA, 12 bp, Homo sapiens
tagaagagagcc

SEQ ID NO: 3193134 - DNA, 19 bp, Homo sapiens
tagaagagggttttaggta

SEQ ID NO: 3193135 - DNA, 16 bp, Homo sapiens
tagaagataacatttt

SEQ ID NO: 3193136 - DNA, 20 bp, Homo sapiens
tagaagcattccttctttga

SEQ ID NO: 3193137 - DNA, 21 bp, Homo sapiens
tagaagcatttgatattatct

SEQ ID NO: 3193138 - DNA, 16 bp, Homo sapiens
tagaagccaagggaaa

SEQ ID NO: 3193139 - DNA, 19 bp, Homo sapiens
tagaagccaagggaaaggg

SEQ ID NO: 3193140 - DNA, 19 bp, Homo sapiens
tagaaggaatttgtacttc

SEQ ID NO: 3193141 - DNA, 18 bp, Homo sapiens
tagaagtcttagatgtat

SEQ ID NO: 3193142 - DNA, 19 bp, Homo sapiens
tagaagtcttagatgtata

SEQ ID NO: 3193143 - DNA, 16 bp, Homo sapiens
tagaagtctttcagtg

SEQ ID NO: 3193144 - DNA, 16 bp, Homo sapiens
tagaagtgcatttctg

SEQ ID NO: 3193145 - DNA, 17 bp, Homo sapiens
tagaagtgcatttctga

SEQ ID NO: 3193146 - DNA, 18 bp, Homo sapiens
tagaagtgcatttctgaa

SEQ ID NO: 3193147 - DNA, 13 bp, Homo sapiens
tagaagtttttgt

SEQ ID NO: 3193148 - DNA, 14 bp, Homo sapiens
tagaagtttttgta

SEQ ID NO: 3193149 - DNA, 19 bp, Homo sapiens
tagaataaaagctataaag

SEQ ID NO: 3193150 - DNA, 14 bp, Homo sapiens
tagaataaggagga

SEQ ID NO: 3193151 - DNA, 18 bp, Homo sapiens
tagaatactttttaaaag

SEQ ID NO: 3193152 - DNA, 19 bp, Homo sapiens
tagaatataggtctcttct

SEQ ID NO: 3193153 - DNA, 22 bp, Homo sapiens
tagaatataggtctcttctccc

SEQ ID NO: 3193154 - DNA, 14 bp, Homo sapiens
tagaatccaaactt

SEQ ID NO: 3193155 - DNA, 15 bp, Homo sapiens
tagaatccaaacttg

SEQ ID NO: 3193156 - DNA, 16 bp, Homo sapiens
tagaatgattaatcaa

SEQ ID NO: 3193157 - DNA, 21 bp, Homo sapiens
tagaatgatttcatgctatct

SEQ ID NO: 3193158 - DNA, 21 bp, Homo sapiens
tagaatgttactttggaatga

SEQ ID NO: 3193159 - DNA, 14 bp, Homo sapiens
tagaattaaaaaag

SEQ ID NO: 3193160 - DNA, 21 bp, Homo sapiens
tagaattaaaaaagcatactt

SEQ ID NO: 3193161 - DNA, 15 bp, Homo sapiens
tagaattatctaatt

SEQ ID NO: 3193162 - DNA, 12 bp, Homo sapiens
tagaattattta

SEQ ID NO: 3193163 - DNA, 15 bp, Homo sapiens
tagaattatttaaac

SEQ ID NO: 3193164 - DNA, 16 bp, Homo sapiens
tagaattatttaaaca

SEQ ID NO: 3193165 - DNA, 19 bp, Homo sapiens
tagaattcagaaaattgtt

SEQ ID NO: 3193166 - DNA, 15 bp, Homo sapiens
tagaattgcattgac

SEQ ID NO: 3193167 - DNA, 22 bp, Homo sapiens
tagaattgctgtctatgattgt

SEQ ID NO: 3193168 - DNA, 21 bp, Homo sapiens
tagaattgtagactgatgttt

SEQ ID NO: 3193169 - DNA, 15 bp, Homo sapiens
tagaatttattcaat

SEQ ID NO: 3193170 - DNA, 20 bp, Homo sapiens
tagaatttattcaattcctc

SEQ ID NO: 3193171 - DNA, 23 bp, Homo sapiens
tagaatttgtattttgcttaaaa

SEQ ID NO: 3193172 - DNA, 16 bp, Homo sapiens
tagaattttaagtgct

SEQ ID NO: 3193173 - DNA, 13 bp, Homo sapiens
tagacaaaaagta

SEQ ID NO: 3193174 - DNA, 19 bp, Homo sapiens
tagacaaatagaaaatggt

SEQ ID NO: 3193175 - DNA, 20 bp, Homo sapiens
tagacaaatagaaaatggtc

SEQ ID NO: 3193176 - DNA, 20 bp, Homo sapiens
tagacaacctgaaatttatt

SEQ ID NO: 3193177 - DNA, 20 bp, Homo sapiens
tagacaatcattgttttgaa

SEQ ID NO: 3193178 - DNA, 23 bp, Homo sapiens
tagacaatcattgttttgaatat

SEQ ID NO: 3193179 - DNA, 21 bp, Homo sapiens
tagacaccaaagttctaataa

SEQ ID NO: 3193180 - DNA, 15 bp, Homo sapiens
tagacactttggaag

SEQ ID NO: 3193181 - DNA, 17 bp, Homo sapiens
tagacagttagagactc

SEQ ID NO: 3193182 - DNA, 13 bp, Homo sapiens
tagacataacaaa

SEQ ID NO: 3193183 - DNA, 20 bp, Homo sapiens
tagacatcaatcctggtaac

SEQ ID NO: 3193184 - DNA, 22 bp, Homo sapiens
tagacatggaggttctaaggcc

SEQ ID NO: 3193185 - DNA, 13 bp, Homo sapiens
tagacattctgtc

SEQ ID NO: 3193186 - DNA, 20 bp, Homo sapiens
tagaccctgggtgggctctg

SEQ ID NO: 3193187 - DNA, 21 bp, Homo sapiens
tagacgccttccaggtcagga

SEQ ID NO: 3193188 - DNA, 14 bp, Homo sapiens
tagactagagaaac

SEQ ID NO: 3193189 - DNA, 15 bp, Homo sapiens
tagactataaatgtt

SEQ ID NO: 3193190 - DNA, 22 bp, Homo sapiens
tagactatatacatgtgtgtat

SEQ ID NO: 3193191 - DNA, 18 bp, Homo sapiens
tagactcatcttactgta

SEQ ID NO: 3193192 - DNA, 19 bp, Homo sapiens
tagactctgtaacatcact

SEQ ID NO: 3193193 - DNA, 12 bp, Homo sapiens
tagactcttcac

SEQ ID NO: 3193194 - DNA, 21 bp, Homo sapiens
tagactcttttccttcccttt

SEQ ID NO: 3193195 - DNA, 17 bp, Homo sapiens
tagactggagtgaggct

SEQ ID NO: 3193196 - DNA, 21 bp, Homo sapiens
tagactggagtgaggcttcca

SEQ ID NO: 3193197 - DNA, 22 bp, Homo sapiens
tagactggagtgaggcttccag

SEQ ID NO: 3193198 - DNA, 23 bp, Homo sapiens
tagactggagtgaggcttccagg

SEQ ID NO: 3193199 - DNA, 17 bp, Homo sapiens
tagactgtgattcagaa

SEQ ID NO: 3193200 - DNA, 18 bp, Homo sapiens
tagactgtgattcagaaa

SEQ ID NO: 3193201 - DNA, 13 bp, Homo sapiens
tagacttattctt

SEQ ID NO: 3193202 - DNA, 23 bp, Homo sapiens
tagacttattcttttataataat

SEQ ID NO: 3193203 - DNA, 15 bp, Homo sapiens
tagacttcccaacag

SEQ ID NO: 3193204 - DNA, 17 bp, Homo sapiens
tagacttctggttgtat

SEQ ID NO: 3193205 - DNA, 21 bp, Homo sapiens
tagacttgaaagttttccagt

SEQ ID NO: 3193206 - DNA, 17 bp, Homo sapiens
tagactttagaaataaa

SEQ ID NO: 3193207 - DNA, 20 bp, Homo sapiens
tagagaaaataaatttaact

SEQ ID NO: 3193208 - DNA, 16 bp, Homo sapiens
tagagaactgtggccg

SEQ ID NO: 3193209 - DNA, 14 bp, Homo sapiens
tagagaatgcacag

SEQ ID NO: 3193210 - DNA, 13 bp, Homo sapiens
tagagaggcccgc

SEQ ID NO: 3193211 - DNA, 22 bp, Homo sapiens
tagagatctcagccctaaacct

SEQ ID NO: 3193212 - DNA, 17 bp, Homo sapiens
tagagatctggttttgc

SEQ ID NO: 3193213 - DNA, 19 bp, Homo sapiens
tagagatctggttttgcta

SEQ ID NO: 3193214 - DNA, 20 bp, Homo sapiens
tagagatctggttttgctat

SEQ ID NO: 3193215 - DNA, 17 bp, Homo sapiens
tagagatgactgagtcc

SEQ ID NO: 3193216 - DNA, 19 bp, Homo sapiens
tagagatgtttttaaaagt

SEQ ID NO: 3193217 - DNA, 21 bp, Homo sapiens
tagagcaaaattgatgtgttt

SEQ ID NO: 3193218 - DNA, 14 bp, Homo sapiens
tagagcagcccaaa

SEQ ID NO: 3193219 - DNA, 16 bp, Homo sapiens
tagagcagctttggga

SEQ ID NO: 3193220 - DNA, 19 bp, Homo sapiens
tagagcattgaattggaga

SEQ ID NO: 3193221 - DNA, 13 bp, Homo sapiens
tagagcccctcct

SEQ ID NO: 3193222 - DNA, 12 bp, Homo sapiens
tagagccctggc

SEQ ID NO: 3193223 - DNA, 22 bp, Homo sapiens
tagagccttctgatgtctctaa

SEQ ID NO: 3193224 - DNA, 16 bp, Homo sapiens
tagagcgcggctggct

SEQ ID NO: 3193225 - DNA, 19 bp, Homo sapiens
tagagcgcggctggctctg

SEQ ID NO: 3193226 - DNA, 15 bp, Homo sapiens
tagagctccagttct

SEQ ID NO: 3193227 - DNA, 16 bp, Homo sapiens
tagagctgggtggcct

SEQ ID NO: 3193228 - DNA, 15 bp, Homo sapiens
tagagcttctggcac

SEQ ID NO: 3193229 - DNA, 17 bp, Homo sapiens
tagaggaaaaaaatgac

SEQ ID NO: 3193230 - DNA, 13 bp, Homo sapiens
tagaggaagaaat

SEQ ID NO: 3193231 - DNA, 22 bp, Homo sapiens
tagaggaagaaatgtcagatgc

SEQ ID NO: 3193232 - DNA, 20 bp, Homo sapiens
tagaggccagccccacccag

SEQ ID NO: 3193233 - DNA, 14 bp, Homo sapiens
tagaggctccccag

SEQ ID NO: 3193234 - DNA, 23 bp, Homo sapiens
tagaggcttctccgccagcctcc

SEQ ID NO: 3193235 - DNA, 17 bp, Homo sapiens
tagagggttcctgtaga

SEQ ID NO: 3193236 - DNA, 23 bp, Homo sapiens
tagaggtaccagcaatatgtaaa

SEQ ID NO: 3193237 - DNA, 15 bp, Homo sapiens
tagaggtcctcatgg

SEQ ID NO: 3193238 - DNA, 18 bp, Homo sapiens
tagaggtcctctggagcc

SEQ ID NO: 3193239 - DNA, 14 bp, Homo sapiens
tagaggtgggcagc

SEQ ID NO: 3193240 - DNA, 16 bp, Homo sapiens
tagaggtgggcagctg

SEQ ID NO: 3193241 - DNA, 19 bp, Homo sapiens
tagagtagaagatttgatg

SEQ ID NO: 3193242 - DNA, 21 bp, Homo sapiens
tagagtagaagatttgatgct

SEQ ID NO: 3193243 - DNA, 21 bp, Homo sapiens
tagagtcaactacacaaagca

SEQ ID NO: 3193244 - DNA, 13 bp, Homo sapiens
tagagtcagcctt

SEQ ID NO: 3193245 - DNA, 14 bp, Homo sapiens
tagagtcagccttc

SEQ ID NO: 3193246 - DNA, 13 bp, Homo sapiens
tagagtcatgtga

SEQ ID NO: 3193247 - DNA, 16 bp, Homo sapiens
tagagtccaaggttta

SEQ ID NO: 3193248 - DNA, 17 bp, Homo sapiens
tagagtctgaacagctg

SEQ ID NO: 3193249 - DNA, 14 bp, Homo sapiens
tagagtgtagctgt

SEQ ID NO: 3193250 - DNA, 15 bp, Homo sapiens
tagagttaagaagct

SEQ ID NO: 3193251 - DNA, 18 bp, Homo sapiens
tagagtttttatgccttt

SEQ ID NO: 3193252 - DNA, 23 bp, Homo sapiens
tagagttttttttttctttcaca

SEQ ID NO: 3193253 - DNA, 19 bp, Homo sapiens
tagataaatatttgacttg

SEQ ID NO: 3193254 - DNA, 19 bp, Homo sapiens
tagataacgcttaaaggaa

SEQ ID NO: 3193255 - DNA, 13 bp, Homo sapiens
tagataatttgaa

SEQ ID NO: 3193256 - DNA, 14 bp, Homo sapiens
tagataatttgaaa

SEQ ID NO: 3193257 - DNA, 17 bp, Homo sapiens
tagatactactttctct

SEQ ID NO: 3193258 - DNA, 11 bp, Homo sapiens
tagatagaaat

SEQ ID NO: 3193259 - DNA, 16 bp, Homo sapiens
tagataggtaaatacc

SEQ ID NO: 3193260 - DNA, 13 bp, Homo sapiens
tagatataatgaa

SEQ ID NO: 3193261 - DNA, 14 bp, Homo sapiens
tagatataatgaac

SEQ ID NO: 3193262 - DNA, 23 bp, Homo sapiens
tagatatcgacttgtttttgcac

SEQ ID NO: 3193263 - DNA, 22 bp, Homo sapiens
tagatatgtattcttttctcag

SEQ ID NO: 3193264 - DNA, 15 bp, Homo sapiens
tagatattactttat

SEQ ID NO: 3193265 - DNA, 22 bp, Homo sapiens
tagatattactttatcactttt

SEQ ID NO: 3193266 - DNA, 15 bp, Homo sapiens
tagatattgctacta

SEQ ID NO: 3193267 - DNA, 17 bp, Homo sapiens
tagatattgctactata

SEQ ID NO: 3193268 - DNA, 18 bp, Homo sapiens
tagatattgctactataa

SEQ ID NO: 3193269 - DNA, 19 bp, Homo sapiens
tagatatttggcttaaata

SEQ ID NO: 3193270 - DNA, 16 bp, Homo sapiens
tagatcacgagatcaa

SEQ ID NO: 3193271 - DNA, 14 bp, Homo sapiens
tagatcagatgctc

SEQ ID NO: 3193272 - DNA, 23 bp, Homo sapiens
tagatcagatgctccaagattct

SEQ ID NO: 3193273 - DNA, 13 bp, Homo sapiens
tagatcagtattt

SEQ ID NO: 3193274 - DNA, 16 bp, Homo sapiens
tagatcagtatttcac

SEQ ID NO: 3193275 - DNA, 18 bp, Homo sapiens
tagatccacacacagagg

SEQ ID NO: 3193276 - DNA, 21 bp, Homo sapiens
tagatccagatccagactgta

SEQ ID NO: 3193277 - DNA, 18 bp, Homo sapiens
tagatccatttccattgc

SEQ ID NO: 3193278 - DNA, 21 bp, Homo sapiens
tagatccatttccattgctta

SEQ ID NO: 3193279 - DNA, 17 bp, Homo sapiens
tagatcctaagatgtgt

SEQ ID NO: 3193280 - DNA, 15 bp, Homo sapiens
tagatcgcttgagcc

SEQ ID NO: 3193281 - DNA, 13 bp, Homo sapiens
tagatctccagcg

SEQ ID NO: 3193282 - DNA, 14 bp, Homo sapiens
tagatcttatattg

SEQ ID NO: 3193283 - DNA, 14 bp, Homo sapiens
tagatcttctgaaa

SEQ ID NO: 3193284 - DNA, 23 bp, Homo sapiens
tagatgagcccagccctgttctg

SEQ ID NO: 3193285 - DNA, 23 bp, Homo sapiens
tagatgattaaataagattctaa

SEQ ID NO: 3193286 - DNA, 22 bp, Homo sapiens
tagatgattttttgaaagttaa

SEQ ID NO: 3193287 - DNA, 19 bp, Homo sapiens
tagatgcaagatatttata

SEQ ID NO: 3193288 - DNA, 16 bp, Homo sapiens
tagatgcacttatgca

SEQ ID NO: 3193289 - DNA, 23 bp, Homo sapiens
tagatgctgactgtactcctccc

SEQ ID NO: 3193290 - DNA, 17 bp, Homo sapiens
tagatgctggcatctct

SEQ ID NO: 3193291 - DNA, 13 bp, Homo sapiens
tagatggaaaaat

SEQ ID NO: 3193292 - DNA, 15 bp, Homo sapiens
tagatggaaaaatgt

SEQ ID NO: 3193293 - DNA, 12 bp, Homo sapiens
ttgcggccccag

SEQ ID NO: 3193294 - DNA, 23 bp, Homo sapiens
ttgcggcgtcagtctttttctgt

SEQ ID NO: 3193295 - DNA, 16 bp, Homo sapiens
ttgcgtatgtctgtta

SEQ ID NO: 3193296 - DNA, 14 bp, Homo sapiens
ttgctaaaaaaagt

SEQ ID NO: 3193297 - DNA, 20 bp, Homo sapiens
ttgctaaaaaaagtgcatga

SEQ ID NO: 3193298 - DNA, 13 bp, Homo sapiens
ttgctaaactgat

SEQ ID NO: 3193299 - DNA, 12 bp, Homo sapiens
ttgctaaagcac

SEQ ID NO: 3193300 - DNA, 21 bp, Homo sapiens
ttgctaaagcactttgcactt

SEQ ID NO: 3193301 - DNA, 15 bp, Homo sapiens
ttgctaagaagccta

SEQ ID NO: 3193302 - DNA, 18 bp, Homo sapiens
ttgctaatcaaagccagg

SEQ ID NO: 3193303 - DNA, 22 bp, Homo sapiens
ttgctaatcaaagccagggtct

SEQ ID NO: 3193304 - DNA, 14 bp, Homo sapiens
ttgctaatcagtgt

SEQ ID NO: 3193305 - DNA, 15 bp, Homo sapiens
ttgctaatcagtgtc

SEQ ID NO: 3193306 - DNA, 15 bp, Homo sapiens
ttgctaccagtattt

SEQ ID NO: 3193307 - DNA, 18 bp, Homo sapiens
ttgctactataatcaaat

SEQ ID NO: 3193308 - DNA, 22 bp, Homo sapiens
ttgctatcaacaataaaatttt

SEQ ID NO: 3193309 - DNA, 17 bp, Homo sapiens
ttgctatgtaagggtct

SEQ ID NO: 3193310 - DNA, 21 bp, Homo sapiens
ttgctatgtgccttatgttga

SEQ ID NO: 3193311 - DNA, 18 bp, Homo sapiens
ttgctatgttactatttt

SEQ ID NO: 3193312 - DNA, 21 bp, Homo sapiens
ttgctatgttactattttcta

SEQ ID NO: 3193313 - DNA, 14 bp, Homo sapiens
ttgctattagagca

SEQ ID NO: 3193314 - DNA, 19 bp, Homo sapiens
ttgctcaaatctattcaga

SEQ ID NO: 3193315 - DNA, 22 bp, Homo sapiens
ttgctcaagttcattgatgacc

SEQ ID NO: 3193316 - DNA, 11 bp, Homo sapiens
ttgctccaggg

SEQ ID NO: 3193317 - DNA, 14 bp, Homo sapiens
ttgctccagggtct

SEQ ID NO: 3193318 - DNA, 15 bp, Homo sapiens
ttgctccgctcccac

SEQ ID NO: 3193319 - DNA, 19 bp, Homo sapiens
ttgctccgctcccaccgcc

SEQ ID NO: 3193320 - DNA, 13 bp, Homo sapiens
ttgctctccctct

SEQ ID NO: 3193321 - DNA, 23 bp, Homo sapiens
ttgctctgtgtatatctcttgga

SEQ ID NO: 3193322 - DNA, 13 bp, Homo sapiens
ttgctcttggaaa

SEQ ID NO: 3193323 - DNA, 19 bp, Homo sapiens
ttgctcttgtcccacgtgt

SEQ ID NO: 3193324 - DNA, 16 bp, Homo sapiens
ttgctcttttaagcag

SEQ ID NO: 3193325 - DNA, 19 bp, Homo sapiens
ttgctgaaattttatatgc

SEQ ID NO: 3193326 - DNA, 21 bp, Homo sapiens
ttgctgaagggcattctttcc

SEQ ID NO: 3193327 - DNA, 14 bp, Homo sapiens
ttgctgactttaaa

SEQ ID NO: 3193328 - DNA, 22 bp, Homo sapiens
ttgctgagcctctgctccccag

SEQ ID NO: 3193329 - DNA, 22 bp, Homo sapiens
ttgctgatggcttgacatgtgc

SEQ ID NO: 3193330 - DNA, 20 bp, Homo sapiens
ttgctgcaagcacagccctt

SEQ ID NO: 3193331 - DNA, 20 bp, Homo sapiens
ttgctgctaccgccctgggc

SEQ ID NO: 3193332 - DNA, 16 bp, Homo sapiens
ttgctgctagaacttt

SEQ ID NO: 3193333 - DNA, 17 bp, Homo sapiens
ttgctgctagaactttt

SEQ ID NO: 3193334 - DNA, 18 bp, Homo sapiens
ttgctgctagaacttttt

SEQ ID NO: 3193335 - DNA, 15 bp, Homo sapiens
ttgctgctgctacca

SEQ ID NO: 3193336 - DNA, 16 bp, Homo sapiens
ttgctgctgctaccag

SEQ ID NO: 3193337 - DNA, 15 bp, Homo sapiens
ttgctgcttggattt

SEQ ID NO: 3193338 - DNA, 19 bp, Homo sapiens
ttgctggaagaaactaaaa

SEQ ID NO: 3193339 - DNA, 13 bp, Homo sapiens
ttgctggccccag

SEQ ID NO: 3193340 - DNA, 23 bp, Homo sapiens
ttgctggccccagccctgctggg

SEQ ID NO: 3193341 - DNA, 19 bp, Homo sapiens
ttgctggctctgagaatca

SEQ ID NO: 3193342 - DNA, 23 bp, Homo sapiens
ttgctggtagagacccccaggcc

SEQ ID NO: 3193343 - DNA, 14 bp, Homo sapiens
ttgctggttgctgt

SEQ ID NO: 3193344 - DNA, 13 bp, Homo sapiens
ttgctggttggat

SEQ ID NO: 3193345 - DNA, 22 bp, Homo sapiens
ttgctggtttgaaagattatga

SEQ ID NO: 3193346 - DNA, 21 bp, Homo sapiens
ttgctgtaccacatctgctct

SEQ ID NO: 3193347 - DNA, 16 bp, Homo sapiens
ttgctgtataagttat

SEQ ID NO: 3193348 - DNA, 11 bp, Homo sapiens
ttgctgtatat

SEQ ID NO: 3193349 - DNA, 18 bp, Homo sapiens
ttgctgtatgctgatcat

SEQ ID NO: 3193350 - DNA, 21 bp, Homo sapiens
ttgctgtatgctgatcatcgc

SEQ ID NO: 3193351 - DNA, 16 bp, Homo sapiens
ttgctgtcctgatctg

SEQ ID NO: 3193352 - DNA, 15 bp, Homo sapiens
ttgctgtctctgctc

SEQ ID NO: 3193353 - DNA, 14 bp, Homo sapiens
ttgctgtgaggctg

SEQ ID NO: 3193354 - DNA, 20 bp, Homo sapiens
ttgctgtgaggctgtcctgt

SEQ ID NO: 3193355 - DNA, 14 bp, Homo sapiens
ttgctgtttagagt

SEQ ID NO: 3193356 - DNA, 21 bp, Homo sapiens
ttgctgtttagagtaaataaa

SEQ ID NO: 3193357 - DNA, 13 bp, Homo sapiens
ttgctgttttgat

SEQ ID NO: 3193358 - DNA, 13 bp, Homo sapiens
ttgcttacatttt

SEQ ID NO: 3193359 - DNA, 22 bp, Homo sapiens
ttgcttagtcacttatttcata

SEQ ID NO: 3193360 - DNA, 15 bp, Homo sapiens
ttgcttattgttcca

SEQ ID NO: 3193361 - DNA, 20 bp, Homo sapiens
ttgcttattgttccaagaca

SEQ ID NO: 3193362 - DNA, 22 bp, Homo sapiens
ttgcttattgttccaagacatt

SEQ ID NO: 3193363 - DNA, 20 bp, Homo sapiens
ttgcttgaaattactgtgta

SEQ ID NO: 3193364 - DNA, 15 bp, Homo sapiens
ttgcttgaacacagt

SEQ ID NO: 3193365 - DNA, 18 bp, Homo sapiens
ttgcttgaacacagtatt

SEQ ID NO: 3193366 - DNA, 16 bp, Homo sapiens
tttttcaatatttatt

SEQ ID NO: 3193367 - DNA, 21 bp, Homo sapiens
tttttcaatcaactttactgt

SEQ ID NO: 3193368 - DNA, 11 bp, Homo sapiens
tttttcaatgt

SEQ ID NO: 3193369 - DNA, 13 bp, Homo sapiens
tttttcacatttt

SEQ ID NO: 3193370 - DNA, 11 bp, Homo sapiens
tttttcactgt

SEQ ID NO: 3193371 - DNA, 11 bp, Homo sapiens
tttttcagttg

SEQ ID NO: 3193372 - DNA, 11 bp, Homo sapiens
tttttcatttc

SEQ ID NO: 3193373 - DNA, 12 bp, Homo sapiens
tttttcatttgt

SEQ ID NO: 3193374 - DNA, 21 bp, Homo sapiens
tttttccaactactaatagaa

SEQ ID NO: 3193375 - DNA, 23 bp, Homo sapiens
tttttccaactactaatagaata

SEQ ID NO: 3193376 - DNA, 11 bp, Homo sapiens
tttttccatca

SEQ ID NO: 3193377 - DNA, 21 bp, Homo sapiens
tttttccatcataattctaat

SEQ ID NO: 3193378 - DNA, 23 bp, Homo sapiens
ttttcccatcatcctttgttctg

SEQ ID NO: 3193379 - DNA, 19 bp, Homo sapiens
ttttccccccactctcccc

SEQ ID NO: 3193380 - DNA, 21 bp, Homo sapiens
ttttcccccttgaggattgtg

SEQ ID NO: 3193381 - DNA, 23 bp, Homo sapiens
ttttcccccttgaggattgtgga

SEQ ID NO: 3193382 - DNA, 16 bp, Homo sapiens
ttttcccctgtcctga

SEQ ID NO: 3193383 - DNA, 13 bp, Homo sapiens
ttttcccttaaat

SEQ ID NO: 3193384 - DNA, 22 bp, Homo sapiens
ttttcccttaaatacagataat

SEQ ID NO: 3193385 - DNA, 17 bp, Homo sapiens
ttttcctaaagagagta

SEQ ID NO: 3193386 - DNA, 17 bp, Homo sapiens
ttttcctaagcacaaat

SEQ ID NO: 3193387 - DNA, 14 bp, Homo sapiens
ttttcctcaagcaa

SEQ ID NO: 3193388 - DNA, 16 bp, Homo sapiens
ttttcctcaagcaata

SEQ ID NO: 3193389 - DNA, 18 bp, Homo sapiens
ttttcctcaagcaataat

SEQ ID NO: 3193390 - DNA, 17 bp, Homo sapiens
ttttcctcatgtaacat

SEQ ID NO: 3193391 - DNA, 21 bp, Homo sapiens
ttttcctctgagcccagctgc

SEQ ID NO: 3193392 - DNA, 16 bp, Homo sapiens
ttttcctctgttcaca

SEQ ID NO: 3193393 - DNA, 15 bp, Homo sapiens
ttttcctggatttat

SEQ ID NO: 3193394 - DNA, 16 bp, Homo sapiens
ttttccttcattcata

SEQ ID NO: 3193395 - DNA, 19 bp, Homo sapiens
ttttccttcccttttctgt

SEQ ID NO: 3193396 - DNA, 12 bp, Homo sapiens
ttttcctttaaa

SEQ ID NO: 3193397 - DNA, 12 bp, Homo sapiens
ttttcctttaga

SEQ ID NO: 3193398 - DNA, 12 bp, Homo sapiens
ttttcctttgta

SEQ ID NO: 3193399 - DNA, 13 bp, Homo sapiens
ttttcctttgtgc

SEQ ID NO: 3193400 - DNA, 23 bp, Homo sapiens
ttttcgaacattctttgcctggt

SEQ ID NO: 3193401 - DNA, 21 bp, Homo sapiens
ttttcggaggccccactgatg

SEQ ID NO: 3193402 - DNA, 19 bp, Homo sapiens
ttttcggccccatgtatct

SEQ ID NO: 3193403 - DNA, 19 bp, Homo sapiens
ttttcgtatgaaaatgagt

SEQ ID NO: 3193404 - DNA, 22 bp, Homo sapiens
ttttctaaaacattcccctccc

SEQ ID NO: 3193405 - DNA, 17 bp, Homo sapiens
ttttctaagaaaagcat

SEQ ID NO: 3193406 - DNA, 13 bp, Homo sapiens
ttttctacagtta

SEQ ID NO: 3193407 - DNA, 16 bp, Homo sapiens
ttttctaccatttctg

SEQ ID NO: 3193408 - DNA, 14 bp, Homo sapiens
ttttctagactttc

SEQ ID NO: 3193409 - DNA, 15 bp, Homo sapiens
ttttctagtttcagt

SEQ ID NO: 3193410 - DNA, 12 bp, Homo sapiens
ttttctataaat

SEQ ID NO: 3193411 - DNA, 14 bp, Homo sapiens
ttttctataaatca

SEQ ID NO: 3193412 - DNA, 19 bp, Homo sapiens
ttttctattccttctggcc

SEQ ID NO: 3193413 - DNA, 12 bp, Homo sapiens
ttttctattttg

SEQ ID NO: 3193414 - DNA, 18 bp, Homo sapiens
ttttctcagaacagctga

SEQ ID NO: 3193415 - DNA, 15 bp, Homo sapiens
ttttctccaccaact

SEQ ID NO: 3193416 - DNA, 13 bp, Homo sapiens
ttttctcctccca

SEQ ID NO: 3193417 - DNA, 14 bp, Homo sapiens
ttttctcctcccag

SEQ ID NO: 3193418 - DNA, 21 bp, Homo sapiens
ttttctctggtaatattgact

SEQ ID NO: 3193419 - DNA, 15 bp, Homo sapiens
ttttctctttctctc

SEQ ID NO: 3193420 - DNA, 9 bp, Homo sapiens
ttttctgaa

SEQ ID NO: 3193421 - DNA, 16 bp, Homo sapiens
ttttctgacatgcatt

SEQ ID NO: 3193422 - DNA, 18 bp, Homo sapiens
ttttctgacatgcattgt

SEQ ID NO: 3193423 - DNA, 22 bp, Homo sapiens
ttttctgagcccgggctgcctg

SEQ ID NO: 3193424 - DNA, 15 bp, Homo sapiens
ttttctgagcgatta

SEQ ID NO: 3193425 - DNA, 21 bp, Homo sapiens
ttttctgcatcatctgtagat

SEQ ID NO: 3193426 - DNA, 13 bp, Homo sapiens
ttttctgccctgg

SEQ ID NO: 3193427 - DNA, 17 bp, Homo sapiens
ttttctggaatacatga

SEQ ID NO: 3193428 - DNA, 12 bp, Homo sapiens
ttttctggacca

SEQ ID NO: 3193429 - DNA, 16 bp, Homo sapiens
ttttctggtagataga

SEQ ID NO: 3193430 - DNA, 14 bp, Homo sapiens
ttttctgtaccagt

SEQ ID NO: 3193431 - DNA, 14 bp, Homo sapiens
ttttctgtagtcat

SEQ ID NO: 3193432 - DNA, 12 bp, Homo sapiens
ttttctgtattt

SEQ ID NO: 3193433 - DNA, 15 bp, Homo sapiens
ttttctgttgtaact

SEQ ID NO: 3193434 - DNA, 16 bp, Homo sapiens
ttttcttcatgcaatg

SEQ ID NO: 3193435 - DNA, 18 bp, Homo sapiens
ttttcttcttccctccct

SEQ ID NO: 3193436 - DNA, 16 bp, Homo sapiens
ttttcttgatcttaaa

SEQ ID NO: 3193437 - DNA, 21 bp, Homo sapiens
ttttcttgccaatgaggtctg

SEQ ID NO: 3193438 - DNA, 14 bp, Homo sapiens
ttttcttgtatgat

SEQ ID NO: 3193439 - DNA, 12 bp, Homo sapiens
ttttctttgttt

SEQ ID NO: 3193440 - DNA, 15 bp, Homo sapiens
ttttcttttgttact

SEQ ID NO: 3193441 - DNA, 18 bp, Homo sapiens
ttttcttttgttactgtt

SEQ ID NO: 3193442 - DNA, 20 bp, Homo sapiens
ttttcttttgttactgttct

SEQ ID NO: 3193443 - DNA, 23 bp, Homo sapiens
ttttcttttttaaattaatatct

SEQ ID NO: 3193444 - DNA, 17 bp, Homo sapiens
ttttgaaaagcttctta

SEQ ID NO: 3193445 - DNA, 19 bp, Homo sapiens
ttttgaaacacaataccta

SEQ ID NO: 3193446 - DNA, 14 bp, Homo sapiens
ttttgaaacagcag

SEQ ID NO: 3193447 - DNA, 16 bp, Homo sapiens
ttttgaaacccacagt

SEQ ID NO: 3193448 - DNA, 12 bp, Homo sapiens
ttttgaaagaat

SEQ ID NO: 3193449 - DNA, 17 bp, Homo sapiens
ttttgaaatgaaattta

SEQ ID NO: 3193450 - DNA, 22 bp, Homo sapiens
ttttgaaatgaaatttaaacat

SEQ ID NO: 3193451 - DNA, 16 bp, Homo sapiens
ttttgaaatttactgt

SEQ ID NO: 3193452 - DNA, 18 bp, Homo sapiens
ttttgaagaatatttaag

SEQ ID NO: 3193453 - DNA, 21 bp, Homo sapiens
ttttgaagcagtcttgctctg

SEQ ID NO: 3193454 - DNA, 21 bp, Homo sapiens
ttttgaataccattaaaactg

SEQ ID NO: 3193455 - DNA, 18 bp, Homo sapiens
ttttgaatgcttcctgac

SEQ ID NO: 3193456 - DNA, 14 bp, Homo sapiens
ttttgaatgtcaca

SEQ ID NO: 3193457 - DNA, 13 bp, Homo sapiens
ttttgaatgttat

SEQ ID NO: 3193458 - DNA, 23 bp, Homo sapiens
ttttgacagtgttgaaaatgttc

SEQ ID NO: 3193459 - DNA, 24 bp, Homo sapiens
ttttgacagtgttgaaaatgttca

SEQ ID NO: 3193460 - DNA, 20 bp, Homo sapiens
ttttgactaaagctatgtta

SEQ ID NO: 3193461 - DNA, 15 bp, Homo sapiens
ttttgacttaatgtg

SEQ ID NO: 3193462 - DNA, 17 bp, Homo sapiens
ttttgaggggttcttct

SEQ ID NO: 3193463 - DNA, 23 bp, Homo sapiens
ttttgaggtaaagatatggagaa

SEQ ID NO: 3193464 - DNA, 21 bp, Homo sapiens
ttttgagtacggctatagcct

SEQ ID NO: 3193465 - DNA, 18 bp, Homo sapiens
ttttgagtagatattact

SEQ ID NO: 3193466 - DNA, 14 bp, Homo sapiens
ttttgagttctaca

SEQ ID NO: 3193467 - DNA, 18 bp, Homo sapiens
ttttgataataaattgaa

SEQ ID NO: 3193468 - DNA, 20 bp, Homo sapiens
ttttgataataatattgttt

SEQ ID NO: 3193469 - DNA, 17 bp, Homo sapiens
ttttgatatacattgtg

SEQ ID NO: 3193470 - DNA, 22 bp, Homo sapiens
ttttgatcatccctttctccca

SEQ ID NO: 3193471 - DNA, 12 bp, Homo sapiens
ttttgattatgt

SEQ ID NO: 3193472 - DNA, 18 bp, Homo sapiens
ttttgattattgtattta

SEQ ID NO: 3193473 - DNA, 23 bp, Homo sapiens
ttttgattccaatccaattatca

SEQ ID NO: 3193474 - DNA, 18 bp, Homo sapiens
ttttgattgttatgtaaa

SEQ ID NO: 3193475 - DNA, 13 bp, Homo sapiens
ttttgcaaaattt

SEQ ID NO: 3193476 - DNA, 18 bp, Homo sapiens
ttttgcaaatataaacat

SEQ ID NO: 3193477 - DNA, 17 bp, Homo sapiens
ttttgcaataacttcta

SEQ ID NO: 3193478 - DNA, 19 bp, Homo sapiens
ttttgcaataacttctata

SEQ ID NO: 3193479 - DNA, 13 bp, Homo sapiens
ttttgcacccctc

SEQ ID NO: 3193480 - DNA, 21 bp, Homo sapiens
ttttgcagcccagacaaatgt

SEQ ID NO: 3193481 - DNA, 17 bp, Homo sapiens
ttttgcataagattaaa

SEQ ID NO: 3193482 - DNA, 15 bp, Homo sapiens
ttttgcataatgcaa

SEQ ID NO: 3193483 - DNA, 18 bp, Homo sapiens
ttttgcatgtcgcacaat

SEQ ID NO: 3193484 - DNA, 20 bp, Homo sapiens
ttttgccacagcttttgcaa

SEQ ID NO: 3193485 - DNA, 16 bp, Homo sapiens
ttttgccagactctag

SEQ ID NO: 3193486 - DNA, 20 bp, Homo sapiens
ttttgccatacatcagttat

SEQ ID NO: 3193487 - DNA, 23 bp, Homo sapiens
ttttgccggctggtgaattcaaa

SEQ ID NO: 3193488 - DNA, 15 bp, Homo sapiens
ttttgcctcttttct

SEQ ID NO: 3193489 - DNA, 12 bp, Homo sapiens
ttttgcctggct

SEQ ID NO: 3193490 - DNA, 21 bp, Homo sapiens
ttttgctattagactgtagga

SEQ ID NO: 3193491 - DNA, 11 bp, Homo sapiens
ttttgctctat

SEQ ID NO: 3193492 - DNA, 15 bp, Homo sapiens
ttttgctgagttgtt

SEQ ID NO: 3193493 - DNA, 15 bp, Homo sapiens
ttttgcttaaaattt

SEQ ID NO: 3193494 - DNA, 18 bp, Homo sapiens
ttttgcttaaaattttac

SEQ ID NO: 3193495 - DNA, 15 bp, Homo sapiens
ttttgcttgcaatgt

SEQ ID NO: 3193496 - DNA, 16 bp, Homo sapiens
ttttgcttgcaatgta

SEQ ID NO: 3193497 - DNA, 21 bp, Homo sapiens
ttttgcttttggcaaaactct

SEQ ID NO: 3193498 - DNA, 12 bp, Homo sapiens
ttttgcttttgt

SEQ ID NO: 3193499 - DNA, 13 bp, Homo sapiens
ttttgcttttgtt

SEQ ID NO: 3193500 - DNA, 23 bp, Homo sapiens
ttttggaaactgctaaattctat

SEQ ID NO: 3193501 - DNA, 14 bp, Homo sapiens
ttttggaaagtcag

SEQ ID NO: 3193502 - DNA, 21 bp, Homo sapiens
ttttggaactaaagcaaattt

SEQ ID NO: 3193503 - DNA, 20 bp, Homo sapiens
ttttggaagattttcagtct

SEQ ID NO: 3193504 - DNA, 17 bp, Homo sapiens
ttttggactccatctct

SEQ ID NO: 3193505 - DNA, 13 bp, Homo sapiens
ttttggaggtgct

SEQ ID NO: 3193506 - DNA, 18 bp, Homo sapiens
ttttggatatattattgt

SEQ ID NO: 3193507 - DNA, 17 bp, Homo sapiens
ttttggatcttgaatgt

SEQ ID NO: 3193508 - DNA, 20 bp, Homo sapiens
ttgtaaaacagctaaatttg

SEQ ID NO: 3193509 - DNA, 15 bp, Homo sapiens
ttgtaaacaaactct

SEQ ID NO: 3193510 - DNA, 16 bp, Homo sapiens
ttgtaaacaaactctt

SEQ ID NO: 3193511 - DNA, 13 bp, Homo sapiens
ttgtaaaccattg

SEQ ID NO: 3193512 - DNA, 18 bp, Homo sapiens
ttgtaaacgtttcagtaa

SEQ ID NO: 3193513 - DNA, 15 bp, Homo sapiens
ttgtaaactgtatca

SEQ ID NO: 3193514 - DNA, 22 bp, Homo sapiens
ttgtaaactgtatcaaatctgt

SEQ ID NO: 3193515 - DNA, 21 bp, Homo sapiens
ttgtaaagactggttttctgc

SEQ ID NO: 3193516 - DNA, 13 bp, Homo sapiens
ttgtaaataagag

SEQ ID NO: 3193517 - DNA, 21 bp, Homo sapiens
ttgtaaataagagatttggag

SEQ ID NO: 3193518 - DNA, 14 bp, Homo sapiens
ttgtaaatacacat

SEQ ID NO: 3193519 - DNA, 18 bp, Homo sapiens
ttgtaaataggattttta

SEQ ID NO: 3193520 - DNA, 19 bp, Homo sapiens
ttgtaaatatttatgtaaa

SEQ ID NO: 3193521 - DNA, 13 bp, Homo sapiens
ttgtaaatgcctc

SEQ ID NO: 3193522 - DNA, 22 bp, Homo sapiens
ttgtaaatgtttcttttccctt

SEQ ID NO: 3193523 - DNA, 14 bp, Homo sapiens
ttgtaacctcagct

SEQ ID NO: 3193524 - DNA, 15 bp, Homo sapiens
ttgtaacctcagctc

SEQ ID NO: 3193525 - DNA, 12 bp, Homo sapiens
ttgtaacctgct

SEQ ID NO: 3193526 - DNA, 9 bp, Homo sapiens
ttgtaacta

SEQ ID NO: 3193527 - DNA, 12 bp, Homo sapiens
ttgtaactacaa

SEQ ID NO: 3193528 - DNA, 17 bp, Homo sapiens
ttgtaacttatgtagat

SEQ ID NO: 3193529 - DNA, 22 bp, Homo sapiens
ttgtaagacaaaggttttcctc

SEQ ID NO: 3193530 - DNA, 17 bp, Homo sapiens
ttgtaagagtgtagaag

SEQ ID NO: 3193531 - DNA, 17 bp, Homo sapiens
ttgtaagatgctgggtt

SEQ ID NO: 3193532 - DNA, 18 bp, Homo sapiens
ttgtaagctcctcactgg

SEQ ID NO: 3193533 - DNA, 17 bp, Homo sapiens
ttgtaagttgtacaaat

SEQ ID NO: 3193534 - DNA, 18 bp, Homo sapiens
ttgtaagttgtacaaatg

SEQ ID NO: 3193535 - DNA, 16 bp, Homo sapiens
ttgtaagtttcaggtg

SEQ ID NO: 3193536 - DNA, 18 bp, Homo sapiens
ttgtaagtttcaggtgac

SEQ ID NO: 3193537 - DNA, 18 bp, Homo sapiens
ttgtaatcactcccattt

SEQ ID NO: 3193538 - DNA, 17 bp, Homo sapiens
ttgtaatctgaataaag

SEQ ID NO: 3193539 - DNA, 21 bp, Homo sapiens
ttgtaatgctgcacttcctgt

SEQ ID NO: 3193540 - DNA, 17 bp, Homo sapiens
ttgtaatgtgtgaaaaa

SEQ ID NO: 3193541 - DNA, 18 bp, Homo sapiens
ttgtaattgcttacattt

SEQ ID NO: 3193542 - DNA, 23 bp, Homo sapiens
ttgtaattgtgtaaaaaatggaa

SEQ ID NO: 3193543 - DNA, 16 bp, Homo sapiens
ttgtaatttaatgaaa

SEQ ID NO: 3193544 - DNA, 16 bp, Homo sapiens
ttgtaattttaaaagt

SEQ ID NO: 3193545 - DNA, 19 bp, Homo sapiens
ttgtaattttaaaagtcta

SEQ ID NO: 3193546 - DNA, 22 bp, Homo sapiens
ttgtacaaaaaaaaagttttat

SEQ ID NO: 3193547 - DNA, 12 bp, Homo sapiens
ttgtacaaaata

SEQ ID NO: 3193548 - DNA, 14 bp, Homo sapiens
ttgtacaaaataaa

SEQ ID NO: 3193549 - DNA, 21 bp, Homo sapiens
ttgtacaaatgtaagcaaagg

SEQ ID NO: 3193550 - DNA, 20 bp, Homo sapiens
ttgtacaaatgtattttgaa

SEQ ID NO: 3193551 - DNA, 20 bp, Homo sapiens
ttgtacaagagtccctttga

SEQ ID NO: 3193552 - DNA, 18 bp, Homo sapiens
ttgtacaaggtaattgtt

SEQ ID NO: 3193553 - DNA, 21 bp, Homo sapiens
ttgtacaaggtaattgttttt

SEQ ID NO: 3193554 - DNA, 21 bp, Homo sapiens
ttgtacagactgttttactgt

SEQ ID NO: 3193555 - DNA, 21 bp, Homo sapiens
ttgtacaggactgtaaagatt

SEQ ID NO: 3193556 - DNA, 17 bp, Homo sapiens
ttgtacagtttgctgta

SEQ ID NO: 3193557 - DNA, 13 bp, Homo sapiens
ttgtacatattgt

SEQ ID NO: 3193558 - DNA, 15 bp, Homo sapiens
ttgtacatatttgtg

SEQ ID NO: 3193559 - DNA, 23 bp, Homo sapiens
ttgtacatctggcttattttaat

SEQ ID NO: 3193560 - DNA, 21 bp, Homo sapiens
ttgtacatgtgtagcctgtgc

SEQ ID NO: 3193561 - DNA, 18 bp, Homo sapiens
ttgtaccaaaattttaaa

SEQ ID NO: 3193562 - DNA, 20 bp, Homo sapiens
ttgtaccccccaacccctga

SEQ ID NO: 3193563 - DNA, 11 bp, Homo sapiens
ttgtacctctc

SEQ ID NO: 3193564 - DNA, 21 bp, Homo sapiens
ttgtacctgtaggactctcat

SEQ ID NO: 3193565 - DNA, 21 bp, Homo sapiens
ttgtacgtaaagcttaaattg

SEQ ID NO: 3193566 - DNA, 12 bp, Homo sapiens
ttgtactgggac

SEQ ID NO: 3193567 - DNA, 12 bp, Homo sapiens
ttgtactgtaaa

SEQ ID NO: 3193568 - DNA, 14 bp, Homo sapiens
ttgtactgtaaaga

SEQ ID NO: 3193569 - DNA, 23 bp, Homo sapiens
ttgtacttaaatggtaataagca

SEQ ID NO: 3193570 - DNA, 22 bp, Homo sapiens
ttgtacttagccagttcaaagt

SEQ ID NO: 3193571 - DNA, 23 bp, Homo sapiens
ttgtacttagccagttcaaagtg

SEQ ID NO: 3193572 - DNA, 14 bp, Homo sapiens
ttgtacttctgtgt

SEQ ID NO: 3193573 - DNA, 15 bp, Homo sapiens
ttgtacttctgtgtt

SEQ ID NO: 3193574 - DNA, 13 bp, Homo sapiens
ttgtacttgattt

SEQ ID NO: 3193575 - DNA, 19 bp, Homo sapiens
ttgtactttatcatgaatg

SEQ ID NO: 3193576 - DNA, 18 bp, Homo sapiens
ttgtactttgtggagaga

SEQ ID NO: 3193577 - DNA, 12 bp, Homo sapiens
ttgtagaaacac

SEQ ID NO: 3193578 - DNA, 20 bp, Homo sapiens
ttgtagaactcactctgggc

SEQ ID NO: 3193579 - DNA, 13 bp, Homo sapiens
ttgtagaaggagc

SEQ ID NO: 3193580 - DNA, 13 bp, Homo sapiens
ttgtagaattgtt

SEQ ID NO: 3193581 - DNA, 14 bp, Homo sapiens
ttgtagaattgtta

SEQ ID NO: 3193582 - DNA, 14 bp, Homo sapiens
ttgtagagccaggg

SEQ ID NO: 3193583 - DNA, 18 bp, Homo sapiens
ttgtagatgctaacgtgt

SEQ ID NO: 3193584 - DNA, 14 bp, Homo sapiens
ttgtagcactgagg

SEQ ID NO: 3193585 - DNA, 22 bp, Homo sapiens
ttgtagcagattgtttcctctt

SEQ ID NO: 3193586 - DNA, 23 bp, Homo sapiens
ttgtagcatataggtgatgtttg

SEQ ID NO: 3193587 - DNA, 20 bp, Homo sapiens
ttgtagtagtctcattactt

SEQ ID NO: 3193588 - DNA, 19 bp, Homo sapiens
ttgtagtgccactgttgtt

SEQ ID NO: 3193589 - DNA, 19 bp, Homo sapiens
ttgtagttacctactgagt

SEQ ID NO: 3193590 - DNA, 17 bp, Homo sapiens
ttgtagttactcaagca

SEQ ID NO: 3193591 - DNA, 13 bp, Homo sapiens
ttgtataaaaaca

SEQ ID NO: 3193592 - DNA, 14 bp, Homo sapiens
ttgtataaaataga

SEQ ID NO: 3193593 - DNA, 19 bp, Homo sapiens
ttgtataaaatccaaaatg

SEQ ID NO: 3193594 - DNA, 23 bp, Homo sapiens
ttgtataaactgtcaaattttca

SEQ ID NO: 3193595 - DNA, 13 bp, Homo sapiens
ttgtataaatgta

SEQ ID NO: 3193596 - DNA, 18 bp, Homo sapiens
ttgtataacttaaaataa

SEQ ID NO: 3193597 - DNA, 14 bp, Homo sapiens
ttgtataacttctt

SEQ ID NO: 3193598 - DNA, 19 bp, Homo sapiens
ttgtataagtcaagcacat

SEQ ID NO: 3193599 - DNA, 12 bp, Homo sapiens
ttgtataattgg

SEQ ID NO: 3193600 - DNA, 15 bp, Homo sapiens
ttgtatagtgtaaaa

SEQ ID NO: 3193601 - DNA, 19 bp, Homo sapiens
ttgtatatacagttatttt

SEQ ID NO: 3193602 - DNA, 11 bp, Homo sapiens
ttgtatatatc

SEQ ID NO: 3193603 - DNA, 13 bp, Homo sapiens
ttgtatatatctg

SEQ ID NO: 3193604 - DNA, 21 bp, Homo sapiens
ttgtatattatggaagatttt

SEQ ID NO: 3193605 - DNA, 19 bp, Homo sapiens
ttgtatattgtgtttgtgt

SEQ ID NO: 3193606 - DNA, 14 bp, Homo sapiens
ttgtatatttgtac

SEQ ID NO: 3193607 - DNA, 15 bp, Homo sapiens
ttgtatcagaggcct

SEQ ID NO: 3193608 - DNA, 20 bp, Homo sapiens
ttgtatctctgaagcatgtt

SEQ ID NO: 3193609 - DNA, 12 bp, Homo sapiens
ttgtatctctta

SEQ ID NO: 3193610 - DNA, 17 bp, Homo sapiens
ttgtatcttcctttctt

SEQ ID NO: 3193611 - DNA, 16 bp, Homo sapiens
ttgtatgagatggtta

SEQ ID NO: 3193612 - DNA, 13 bp, Homo sapiens
ttgtatgatgtgt

SEQ ID NO: 3193613 - DNA, 16 bp, Homo sapiens
ttgtatgatgtgttgt

SEQ ID NO: 3193614 - DNA, 20 bp, Homo sapiens
ttgtatgatgtgttgtgata

SEQ ID NO: 3193615 - DNA, 13 bp, Homo sapiens
ttgtatgattcca

SEQ ID NO: 3193616 - DNA, 21 bp, Homo sapiens
ttgtatgattccaatctctgt

SEQ ID NO: 3193617 - DNA, 20 bp, Homo sapiens
ttgtatggggaggcaagtgt

SEQ ID NO: 3193618 - DNA, 17 bp, Homo sapiens
ttgtatgttatgaacat

SEQ ID NO: 3193619 - DNA, 16 bp, Homo sapiens
ttgtattaaagacaga

SEQ ID NO: 3193620 - DNA, 15 bp, Homo sapiens
ttgtattaataaagc

SEQ ID NO: 3193621 - DNA, 24 bp, Homo sapiens
ttgtattactttctctgtagttcc

SEQ ID NO: 3193622 - DNA, 19 bp, Homo sapiens
ttgtattgtggtattgaat

SEQ ID NO: 3193623 - DNA, 22 bp, Homo sapiens
ttgtatttattaatttgaaacc

SEQ ID NO: 3193624 - DNA, 17 bp, Homo sapiens
ttgtattttcatgaaaa

SEQ ID NO: 3193625 - DNA, 16 bp, Homo sapiens
ttgtattttgttaaag

SEQ ID NO: 3193626 - DNA, 18 bp, Homo sapiens
ttgtattttgttaaagct

SEQ ID NO: 3193627 - DNA, 20 bp, Homo sapiens
ttgtattttttatttacatt

SEQ ID NO: 3193628 - DNA, 20 bp, Homo sapiens
ttgtcaagtctctgctggcc

SEQ ID NO: 3193629 - DNA, 17 bp, Homo sapiens
ttgtcaataaggagcat

SEQ ID NO: 3193630 - DNA, 14 bp, Homo sapiens
ttgtcacaataaat

SEQ ID NO: 3193631 - DNA, 17 bp, Homo sapiens
ttgtcacacactttggc

SEQ ID NO: 3193632 - DNA, 17 bp, Homo sapiens
ttgtcacagaaatcaga

SEQ ID NO: 3193633 - DNA, 22 bp, Homo sapiens
ttgtcacattatttattaaaaa

SEQ ID NO: 3193634 - DNA, 15 bp, Homo sapiens
ttgtgtatatttgta

SEQ ID NO: 3193635 - DNA, 11 bp, Homo sapiens
ttgtgtatgtt

SEQ ID NO: 3193636 - DNA, 20 bp, Homo sapiens
ttgtgtatttacgctttgat

SEQ ID NO: 3193637 - DNA, 23 bp, Homo sapiens
ttgtgtatttacgctttgattca

SEQ ID NO: 3193638 - DNA, 19 bp, Homo sapiens
ttgtgtcaaccactaaagt

SEQ ID NO: 3193639 - DNA, 22 bp, Homo sapiens
ttgtgtctgtgccctccaaaga

SEQ ID NO: 3193640 - DNA, 23 bp, Homo sapiens
ttgtgtgaaaaaagaaaatggct

SEQ ID NO: 3193641 - DNA, 18 bp, Homo sapiens
ttgtgtgaccaactgtgt

SEQ ID NO: 3193642 - DNA, 19 bp, Homo sapiens
ttgtgtgaccaactgtgtt

SEQ ID NO: 3193643 - DNA, 16 bp, Homo sapiens
ttgtgtgtatttgtat

SEQ ID NO: 3193644 - DNA, 18 bp, Homo sapiens
ttgtgtgtatttgtatta

SEQ ID NO: 3193645 - DNA, 13 bp, Homo sapiens
ttgtgtgttgtct

SEQ ID NO: 3193646 - DNA, 17 bp, Homo sapiens
ttgtgtgttgtctcttg

SEQ ID NO: 3193647 - DNA, 13 bp, Homo sapiens
ttgtgtgtttcac

SEQ ID NO: 3193648 - DNA, 22 bp, Homo sapiens
ttgtgttctgtttgttaaaact

SEQ ID NO: 3193649 - DNA, 13 bp, Homo sapiens
ttgtgttgtacaa

SEQ ID NO: 3193650 - DNA, 13 bp, Homo sapiens
ttgtgttgtcctt

SEQ ID NO: 3193651 - DNA, 11 bp, Homo sapiens
ttgtgttttct

SEQ ID NO: 3193652 - DNA, 21 bp, Homo sapiens
ttgtgttttcttgtaaatgtt

SEQ ID NO: 3193653 - DNA, 17 bp, Homo sapiens
ttgtgtttttaatttat

SEQ ID NO: 3193654 - DNA, 15 bp, Homo sapiens
ttgttaaaaatgtca

SEQ ID NO: 3193655 - DNA, 20 bp, Homo sapiens
ttgttaaaattatgaatctg

SEQ ID NO: 3193656 - DNA, 22 bp, Homo sapiens
ttgttaaagctggaacatttga

SEQ ID NO: 3193657 - DNA, 18 bp, Homo sapiens
ttgttaactcttgtctat

SEQ ID NO: 3193658 - DNA, 20 bp, Homo sapiens
ttgttaatgctctatgtttg

SEQ ID NO: 3193659 - DNA, 9 bp, Homo sapiens
ttgttactg

SEQ ID NO: 3193660 - DNA, 11 bp, Homo sapiens
ttgttactgtt

SEQ ID NO: 3193661 - DNA, 13 bp, Homo sapiens
ttgttactgttct

SEQ ID NO: 3193662 - DNA, 15 bp, Homo sapiens
ttgttactgttcttg

SEQ ID NO: 3193663 - DNA, 16 bp, Homo sapiens
ttgttactgttcttgc

SEQ ID NO: 3193664 - DNA, 13 bp, Homo sapiens
ttgttacttgcag

SEQ ID NO: 3193665 - DNA, 22 bp, Homo sapiens
ttgttagaaaacaaaattttat

SEQ ID NO: 3193666 - DNA, 16 bp, Homo sapiens
ttgttagtttagtgtg

SEQ ID NO: 3193667 - DNA, 16 bp, Homo sapiens
ttgttatacttcaaaa

SEQ ID NO: 3193668 - DNA, 16 bp, Homo sapiens
ttgttatcagtcaata

SEQ ID NO: 3193669 - DNA, 15 bp, Homo sapiens
ttgttattccatcaa

SEQ ID NO: 3193670 - DNA, 11 bp, Homo sapiens
ttgttattgtg

SEQ ID NO: 3193671 - DNA, 14 bp, Homo sapiens
ttgttatttataac

SEQ ID NO: 3193672 - DNA, 19 bp, Homo sapiens
ttgttcaataataaatatt

SEQ ID NO: 3193673 - DNA, 15 bp, Homo sapiens
ttgttcaatgttcca

SEQ ID NO: 3193674 - DNA, 17 bp, Homo sapiens
ttgttcaatgttccatt

SEQ ID NO: 3193675 - DNA, 15 bp, Homo sapiens
ttgttcaattagaat

SEQ ID NO: 3193676 - DNA, 17 bp, Homo sapiens
ttgttcacacaaagcct

SEQ ID NO: 3193677 - DNA, 19 bp, Homo sapiens
ttgttcacacaaagcctgt

SEQ ID NO: 3193678 - DNA, 23 bp, Homo sapiens
ttgttcaggaaaaggttgaataa

SEQ ID NO: 3193679 - DNA, 13 bp, Homo sapiens
ttgttcatgtttg

SEQ ID NO: 3193680 - DNA, 19 bp, Homo sapiens
ttgttcatgtttggtgcat

SEQ ID NO: 3193681 - DNA, 11 bp, Homo sapiens
ttgttcattta

SEQ ID NO: 3193682 - DNA, 18 bp, Homo sapiens
ttgttccctatgaaagat

SEQ ID NO: 3193683 - DNA, 14 bp, Homo sapiens
ttgttccctctccc

SEQ ID NO: 3193684 - DNA, 17 bp, Homo sapiens
ttgttctatttttcaat

SEQ ID NO: 3193685 - DNA, 18 bp, Homo sapiens
ttgttctatttttcaatc

SEQ ID NO: 3193686 - DNA, 22 bp, Homo sapiens
ttgttctccgggtgtggcctca

SEQ ID NO: 3193687 - DNA, 23 bp, Homo sapiens
ttgttctccgggtgtggcctcag

SEQ ID NO: 3193688 - DNA, 12 bp, Homo sapiens
ttgttctgagca

SEQ ID NO: 3193689 - DNA, 16 bp, Homo sapiens
ttgttctgtcccttcc

SEQ ID NO: 3193690 - DNA, 15 bp, Homo sapiens
ttgttcttttataga

SEQ ID NO: 3193691 - DNA, 16 bp, Homo sapiens
ttgttgaacatacttc

SEQ ID NO: 3193692 - DNA, 16 bp, Homo sapiens
ttgttgacaaaatttt

SEQ ID NO: 3193693 - DNA, 21 bp, Homo sapiens
ttgttgacagttctgaagaat

SEQ ID NO: 3193694 - DNA, 14 bp, Homo sapiens
ttgttgacttattt

SEQ ID NO: 3193695 - DNA, 17 bp, Homo sapiens
ttgttgacttattttct

SEQ ID NO: 3193696 - DNA, 21 bp, Homo sapiens
ttgttgataaattccactgga

SEQ ID NO: 3193697 - DNA, 20 bp, Homo sapiens
ttgttgatacctctgctggg

SEQ ID NO: 3193698 - DNA, 20 bp, Homo sapiens
ttgttgccatgtgcaccttg

SEQ ID NO: 3193699 - DNA, 13 bp, Homo sapiens
ttgttggaatgaa

SEQ ID NO: 3193700 - DNA, 20 bp, Homo sapiens
ttgttggagtgtttctaata

SEQ ID NO: 3193701 - DNA, 16 bp, Homo sapiens
ttgttggcatagctct

SEQ ID NO: 3193702 - DNA, 19 bp, Homo sapiens
ttgttgggattcctgaccc

SEQ ID NO: 3193703 - DNA, 13 bp, Homo sapiens
ttgttggtaacta

SEQ ID NO: 3193704 - DNA, 14 bp, Homo sapiens
ttgttggtcagagg

SEQ ID NO: 3193705 - DNA, 21 bp, Homo sapiens
ttgttggtcgcagctacataa

SEQ ID NO: 3193706 - DNA, 15 bp, Homo sapiens
ttgttgtaaaaagaa

SEQ ID NO: 3193707 - DNA, 15 bp, Homo sapiens
ttgttgtaacctgct

SEQ ID NO: 3193708 - DNA, 12 bp, Homo sapiens
ttgttgtactta

SEQ ID NO: 3193709 - DNA, 23 bp, Homo sapiens
ttgttgtttgccatactttgtct

SEQ ID NO: 3193710 - DNA, 15 bp, Homo sapiens
ttgtttaaaatgtaa

SEQ ID NO: 3193711 - DNA, 15 bp, Homo sapiens
ttgtttaaatataaa

SEQ ID NO: 3193712 - DNA, 13 bp, Homo sapiens
ttggaggagagag

SEQ ID NO: 3193713 - DNA, 23 bp, Homo sapiens
ttggagggtgggagagcccagcc

SEQ ID NO: 3193714 - DNA, 23 bp, Homo sapiens
ttggaggtgcttaagcagaagca

SEQ ID NO: 3193715 - DNA, 23 bp, Homo sapiens
ttggagtcccctcacctcctcta

SEQ ID NO: 3193716 - DNA, 17 bp, Homo sapiens
ttggataaatcatttca

SEQ ID NO: 3193717 - DNA, 19 bp, Homo sapiens
ttggataaatcatttcagt

SEQ ID NO: 3193718 - DNA, 21 bp, Homo sapiens
ttggataagtttctattctgt

SEQ ID NO: 3193719 - DNA, 23 bp, Homo sapiens
ttggataatattcattggttaac

SEQ ID NO: 3193720 - DNA, 20 bp, Homo sapiens
ttggatatttgatatttggt

SEQ ID NO: 3193721 - DNA, 19 bp, Homo sapiens
ttggatattttttacttta

SEQ ID NO: 3193722 - DNA, 17 bp, Homo sapiens
ttggatcttgaatgtgg

SEQ ID NO: 3193723 - DNA, 20 bp, Homo sapiens
ttggatgggagtgagacaga

SEQ ID NO: 3193724 - DNA, 17 bp, Homo sapiens
ttggattatttaataac

SEQ ID NO: 3193725 - DNA, 21 bp, Homo sapiens
ttggattatttaataacatta

SEQ ID NO: 3193726 - DNA, 20 bp, Homo sapiens
ttggattcctcacagccttg

SEQ ID NO: 3193727 - DNA, 23 bp, Homo sapiens
ttggattctcttagctactgtat

SEQ ID NO: 3193728 - DNA, 19 bp, Homo sapiens
ttggatttaaaagcctgct

SEQ ID NO: 3193729 - DNA, 16 bp, Homo sapiens
ttggatttagtttcag

SEQ ID NO: 3193730 - DNA, 12 bp, Homo sapiens
ttggatttccta

SEQ ID NO: 3193731 - DNA, 14 bp, Homo sapiens
ttggatttcctaat

SEQ ID NO: 3193732 - DNA, 14 bp, Homo sapiens
ttggatttgacatt

SEQ ID NO: 3193733 - DNA, 15 bp, Homo sapiens
ttggcaaaagccttg

SEQ ID NO: 3193734 - DNA, 20 bp, Homo sapiens
ttggcaaaagccttgtgtat

SEQ ID NO: 3193735 - DNA, 17 bp, Homo sapiens
ttggcaagaacttgttt

SEQ ID NO: 3193736 - DNA, 21 bp, Homo sapiens
ttggcaagaacttgtttacaa

SEQ ID NO: 3193737 - DNA, 23 bp, Homo sapiens
ttggcaagaacttgtttacaaca

SEQ ID NO: 3193738 - DNA, 20 bp, Homo sapiens
ttggcaagatgaaataattt

SEQ ID NO: 3193739 - DNA, 13 bp, Homo sapiens
ttggcaaggaaag

SEQ ID NO: 3193740 - DNA, 20 bp, Homo sapiens
ttggcaatagtttgcataga

SEQ ID NO: 3193741 - DNA, 23 bp, Homo sapiens
ttggcacagaaacacaatatttt

SEQ ID NO: 3193742 - DNA, 14 bp, Homo sapiens
ttggcacagaacag

SEQ ID NO: 3193743 - DNA, 12 bp, Homo sapiens
ttggcaccaaag

SEQ ID NO: 3193744 - DNA, 23 bp, Homo sapiens
ttggcaccaaagatgcagccgcc

SEQ ID NO: 3193745 - DNA, 14 bp, Homo sapiens
ttggcacttgtatt

SEQ ID NO: 3193746 - DNA, 16 bp, Homo sapiens
ttggcacttgtattta

SEQ ID NO: 3193747 - DNA, 19 bp, Homo sapiens
ttggcacttgtatttaatt

SEQ ID NO: 3193748 - DNA, 13 bp, Homo sapiens
ttggcagagaagg

SEQ ID NO: 3193749 - DNA, 18 bp, Homo sapiens
ttggcagagaaggcctct

SEQ ID NO: 3193750 - DNA, 23 bp, Homo sapiens
ttggcagtgagtgagcctggctc

SEQ ID NO: 3193751 - DNA, 20 bp, Homo sapiens
ttggcataatagtcaatttc

SEQ ID NO: 3193752 - DNA, 16 bp, Homo sapiens
ttggcatagctctggg

SEQ ID NO: 3193753 - DNA, 20 bp, Homo sapiens
ttggcatgggcgcaggccca

SEQ ID NO: 3193754 - DNA, 21 bp, Homo sapiens
ttggcatgggcgcaggcccag

SEQ ID NO: 3193755 - DNA, 22 bp, Homo sapiens
ttggcatgggcgcaggcccagt

SEQ ID NO: 3193756 - DNA, 13 bp, Homo sapiens
ttggcatttctat

SEQ ID NO: 3193757 - DNA, 16 bp, Homo sapiens
ttggccaaacatcaga

SEQ ID NO: 3193758 - DNA, 20 bp, Homo sapiens
ttggccaaacatcagacctg

SEQ ID NO: 3193759 - DNA, 15 bp, Homo sapiens
ttggccaaagtgtta

SEQ ID NO: 3193760 - DNA, 22 bp, Homo sapiens
ttggccacaacctgaaagacaa

SEQ ID NO: 3193761 - DNA, 22 bp, Homo sapiens
ttggccacctgtagccatctgc

SEQ ID NO: 3193762 - DNA, 14 bp, Homo sapiens
ttggccactccgag

SEQ ID NO: 3193763 - DNA, 22 bp, Homo sapiens
ttggccactccgagaggtgggc

SEQ ID NO: 3193764 - DNA, 19 bp, Homo sapiens
ttggcccaagtcattgttt

SEQ ID NO: 3193765 - DNA, 11 bp, Homo sapiens
ttggcccagcg

SEQ ID NO: 3193766 - DNA, 23 bp, Homo sapiens
ttggcctagcccaccctgctgcc

SEQ ID NO: 3193767 - DNA, 12 bp, Homo sapiens
ttggcctcagaa

SEQ ID NO: 3193768 - DNA, 19 bp, Homo sapiens
ttggcctcagggccaggaa

SEQ ID NO: 3193769 - DNA, 23 bp, Homo sapiens
ttggcctgtctcatccccagggg

SEQ ID NO: 3193770 - DNA, 23 bp, Homo sapiens
ttggcctgtctttggattgttaa

SEQ ID NO: 3193771 - DNA, 21 bp, Homo sapiens
ttggccttggcttttctagcc

SEQ ID NO: 3193772 - DNA, 19 bp, Homo sapiens
ttggcgtagcagagttaaa

SEQ ID NO: 3193773 - DNA, 21 bp, Homo sapiens
ttggctatttgaaatactaaa

SEQ ID NO: 3193774 - DNA, 17 bp, Homo sapiens
ttggctcaataaagatt

SEQ ID NO: 3193775 - DNA, 14 bp, Homo sapiens
ttggctcagacatg

SEQ ID NO: 3193776 - DNA, 20 bp, Homo sapiens
ttggctcctgagaaaggtga

SEQ ID NO: 3193777 - DNA, 17 bp, Homo sapiens
ttggctcgaatctctgt

SEQ ID NO: 3193778 - DNA, 13 bp, Homo sapiens
ttggctctactcc

SEQ ID NO: 3193779 - DNA, 13 bp, Homo sapiens
ttggctctggaga

SEQ ID NO: 3193780 - DNA, 19 bp, Homo sapiens
ttggctctggagacagccc

SEQ ID NO: 3193781 - DNA, 22 bp, Homo sapiens
ttggctgaaattctcctggagg

SEQ ID NO: 3193782 - DNA, 17 bp, Homo sapiens
ttggctggatcagggaa

SEQ ID NO: 3193783 - DNA, 21 bp, Homo sapiens
ttggctggatgaaattttcta

SEQ ID NO: 3193784 - DNA, 23 bp, Homo sapiens
ttggctggatgaaattttctaga

SEQ ID NO: 3193785 - DNA, 20 bp, Homo sapiens
ttggctgggctacaatttgt

SEQ ID NO: 3193786 - DNA, 22 bp, Homo sapiens
ttggctgggggcctcagtgcca

SEQ ID NO: 3193787 - DNA, 16 bp, Homo sapiens
ttggcttaatcatttt

SEQ ID NO: 3193788 - DNA, 16 bp, Homo sapiens
ttggcttacctgacct

SEQ ID NO: 3193789 - DNA, 16 bp, Homo sapiens
ttggcttcctccgtcc

SEQ ID NO: 3193790 - DNA, 21 bp, Homo sapiens
ttggcttgtagaattgttata

SEQ ID NO: 3193791 - DNA, 16 bp, Homo sapiens
ttggctttcctgtttc

SEQ ID NO: 3193792 - DNA, 14 bp, Homo sapiens
ttggctttgtgctt

SEQ ID NO: 3193793 - DNA, 15 bp, Homo sapiens
ttggctttgtgcttg

SEQ ID NO: 3193794 - DNA, 15 bp, Homo sapiens
ttgggaaaacatttg

SEQ ID NO: 3193795 - DNA, 13 bp, Homo sapiens
ttgggaaagccca

SEQ ID NO: 3193796 - DNA, 22 bp, Homo sapiens
ttgggaaattaaatccaataaa

SEQ ID NO: 3193797 - DNA, 13 bp, Homo sapiens
ttgggacagccag

SEQ ID NO: 3193798 - DNA, 16 bp, Homo sapiens
ttgggacagccagagc

SEQ ID NO: 3193799 - DNA, 16 bp, Homo sapiens
ttgggagagcccctgg

SEQ ID NO: 3193800 - DNA, 21 bp, Homo sapiens
ttgggagcaaaataaggaaga

SEQ ID NO: 3193801 - DNA, 16 bp, Homo sapiens
ttgggaggaggaaaag

SEQ ID NO: 3193802 - DNA, 15 bp, Homo sapiens
ttgggaggccaaggc

SEQ ID NO: 3193803 - DNA, 16 bp, Homo sapiens
ttgggaggccaaggca

SEQ ID NO: 3193804 - DNA, 16 bp, Homo sapiens
ttgggatactgcaggg

SEQ ID NO: 3193805 - DNA, 17 bp, Homo sapiens
ttgggatgtcttatttt

SEQ ID NO: 3193806 - DNA, 20 bp, Homo sapiens
ttgggatgtgagccccaggg

SEQ ID NO: 3193807 - DNA, 16 bp, Homo sapiens
ttgggattcctgaccc

SEQ ID NO: 3193808 - DNA, 21 bp, Homo sapiens
ttgggattcctgacccaggcc

SEQ ID NO: 3193809 - DNA, 12 bp, Homo sapiens
ttgggcagagct

SEQ ID NO: 3193810 - DNA, 22 bp, Homo sapiens
ttgggcagagctggctctgagc

SEQ ID NO: 3193811 - DNA, 15 bp, Homo sapiens
ttgggctactggcag

SEQ ID NO: 3193812 - DNA, 19 bp, Homo sapiens
ttgggctactggcagctcc

SEQ ID NO: 3193813 - DNA, 24 bp, Homo sapiens
ttgggctactggcagctcctctcc

SEQ ID NO: 3193814 - DNA, 23 bp, Homo sapiens
ttgggctgacacctaccatgctg

SEQ ID NO: 3193815 - DNA, 19 bp, Homo sapiens
ttgggctttgcaggctctg

SEQ ID NO: 3193816 - DNA, 16 bp, Homo sapiens
ttggggaaaaaagcac

SEQ ID NO: 3193817 - DNA, 22 bp, Homo sapiens
ttggggaaaaaagcacatacat

SEQ ID NO: 3193818 - DNA, 23 bp, Homo sapiens
ttggggagcaggaggccaataaa

SEQ ID NO: 3193819 - DNA, 12 bp, Homo sapiens
ttggggaggcaa

SEQ ID NO: 3193820 - DNA, 13 bp, Homo sapiens
ttggggaggggcg

SEQ ID NO: 3193821 - DNA, 15 bp, Homo sapiens
ttggggaggtgttca

SEQ ID NO: 3193822 - DNA, 15 bp, Homo sapiens
ttggggcaaaaatcc

SEQ ID NO: 3193823 - DNA, 19 bp, Homo sapiens
ttggggcaagactgcaaac

SEQ ID NO: 3193824 - DNA, 13 bp, Homo sapiens
ttggggcctggct

SEQ ID NO: 3193825 - DNA, 11 bp, Homo sapiens
ttgggggaggc

SEQ ID NO: 3193826 - DNA, 18 bp, Homo sapiens
ttgggggcactcagccac

SEQ ID NO: 3193827 - DNA, 19 bp, Homo sapiens
ttgggggcactcagccacg

SEQ ID NO: 3193828 - DNA, 20 bp, Homo sapiens
ttggggggccgggcaggtcc

SEQ ID NO: 3193829 - DNA, 13 bp, Homo sapiens
ttgggggggtggc

SEQ ID NO: 3193830 - DNA, 17 bp, Homo sapiens
ttgggggttcaggcccg

SEQ ID NO: 3193831 - DNA, 19 bp, Homo sapiens
ttggggtactcttgatgtg

SEQ ID NO: 3193832 - DNA, 22 bp, Homo sapiens
ttggggtctcttttgtaaatta

SEQ ID NO: 3193833 - DNA, 16 bp, Homo sapiens
ttgggtagatgggtgg

SEQ ID NO: 3193834 - DNA, 17 bp, Homo sapiens
ttgggtagatgggtggg

SEQ ID NO: 3193835 - DNA, 12 bp, Homo sapiens
ttgggtcattga

SEQ ID NO: 3193836 - DNA, 15 bp, Homo sapiens
ttgggtgaatcttga

SEQ ID NO: 3193837 - DNA, 16 bp, Homo sapiens
ttgggtggatgcctgg

SEQ ID NO: 3193838 - DNA, 16 bp, Homo sapiens
ttgggttaagtatgag

SEQ ID NO: 3193839 - DNA, 20 bp, Homo sapiens
ttgggttccaaccaggcagt

SEQ ID NO: 3193840 - DNA, 14 bp, Homo sapiens
ttcagggtaaatag

SEQ ID NO: 3193841 - DNA, 23 bp, Homo sapiens
ttcagggtaaataggaatcattc

SEQ ID NO: 3193842 - DNA, 21 bp, Homo sapiens
ttcagggttttctgagggaaa

SEQ ID NO: 3193843 - DNA, 20 bp, Homo sapiens
ttcaggtaggcccttgtcct

SEQ ID NO: 3193844 - DNA, 16 bp, Homo sapiens
ttcaggtatgttgcct

SEQ ID NO: 3193845 - DNA, 15 bp, Homo sapiens
ttcaggtgaaaatgt

SEQ ID NO: 3193846 - DNA, 14 bp, Homo sapiens
ttcaggtgacatgt

SEQ ID NO: 3193847 - DNA, 21 bp, Homo sapiens
ttcaggtgacatgtgaaacct

SEQ ID NO: 3193848 - DNA, 20 bp, Homo sapiens
ttcaggttatcgaaataaca

SEQ ID NO: 3193849 - DNA, 22 bp, Homo sapiens
ttcaggttatcgaaataacaat

SEQ ID NO: 3193850 - DNA, 16 bp, Homo sapiens
ttcagtaataaaacat

SEQ ID NO: 3193851 - DNA, 22 bp, Homo sapiens
ttcagtaccctctcagctccag

SEQ ID NO: 3193852 - DNA, 22 bp, Homo sapiens
ttcagtactcaaattcaatgat

SEQ ID NO: 3193853 - DNA, 19 bp, Homo sapiens
ttgaggggccctggccagg

SEQ ID NO: 3193854 - DNA, 15 bp, Homo sapiens
ttgaggggcctggag

SEQ ID NO: 3193855 - DNA, 22 bp, Homo sapiens
ttgaggggctggccttcctgcc

SEQ ID NO: 3193856 - DNA, 16 bp, Homo sapiens
ttgaggggttcttctg

SEQ ID NO: 3193857 - DNA, 16 bp, Homo sapiens
ttgagggttgggctgg

SEQ ID NO: 3193858 - DNA, 23 bp, Homo sapiens
ttgaggtagaccaggatttctaa

SEQ ID NO: 3193859 - DNA, 13 bp, Homo sapiens
ttgagtaaaaagg

SEQ ID NO: 3193860 - DNA, 16 bp, Homo sapiens
ttgagtaatggtgtag

SEQ ID NO: 3193861 - DNA, 21 bp, Homo sapiens
ttgagtaatggtgtagaacac

SEQ ID NO: 3193862 - DNA, 19 bp, Homo sapiens
ttgagtacagtgaggaggg

SEQ ID NO: 3193863 - DNA, 23 bp, Homo sapiens
ttgagtactagaatttgtatttt

SEQ ID NO: 3193864 - DNA, 16 bp, Homo sapiens
ttgagtagatattact

SEQ ID NO: 3193865 - DNA, 17 bp, Homo sapiens
ttgagtagatattactt

SEQ ID NO: 3193866 - DNA, 21 bp, Homo sapiens
ttgagtagatattactttatc

SEQ ID NO: 3193867 - DNA, 14 bp, Homo sapiens
ttgagtattgttta

SEQ ID NO: 3193868 - DNA, 18 bp, Homo sapiens
ttgagtcattgacttcat

SEQ ID NO: 3193869 - DNA, 13 bp, Homo sapiens
ttgagtccctgct

SEQ ID NO: 3193870 - DNA, 23 bp, Homo sapiens
ttgagtggggttatctctgtgtt

SEQ ID NO: 3193871 - DNA, 18 bp, Homo sapiens
ttgagttaacctttaaga

SEQ ID NO: 3193872 - DNA, 13 bp, Homo sapiens
ttgagttacatta

SEQ ID NO: 3193873 - DNA, 20 bp, Homo sapiens
ttgagttacattaaaataaa

SEQ ID NO: 3193874 - DNA, 18 bp, Homo sapiens
ttgagttctgtagagcct

SEQ ID NO: 3193875 - DNA, 20 bp, Homo sapiens
ttgagttggttacttcatat

SEQ ID NO: 3193876 - DNA, 11 bp, Homo sapiens
ttgagtttgtc

SEQ ID NO: 3193877 - DNA, 15 bp, Homo sapiens
ttgataagcacatta

SEQ ID NO: 3193878 - DNA, 17 bp, Homo sapiens
ttgataataaattgaaa

SEQ ID NO: 3193879 - DNA, 22 bp, Homo sapiens
ttgataatattagtgattctga

SEQ ID NO: 3193880 - DNA, 15 bp, Homo sapiens
ttgataatcttcagg

SEQ ID NO: 3193881 - DNA, 22 bp, Homo sapiens
ttgataatcttcaggtgaacac

SEQ ID NO: 3193882 - DNA, 13 bp, Homo sapiens
ttgataatgttaa

SEQ ID NO: 3193883 - DNA, 14 bp, Homo sapiens
ttgataatgttaaa

SEQ ID NO: 3193884 - DNA, 13 bp, Homo sapiens
ttgatacccccct

SEQ ID NO: 3193885 - DNA, 13 bp, Homo sapiens
ttgatacccctgg

SEQ ID NO: 3193886 - DNA, 20 bp, Homo sapiens
ttgatacccctggggaacat

SEQ ID NO: 3193887 - DNA, 22 bp, Homo sapiens
ttgatactgaatgcataaataa

SEQ ID NO: 3193888 - DNA, 16 bp, Homo sapiens
ttgatacttatatttt

SEQ ID NO: 3193889 - DNA, 20 bp, Homo sapiens
ttgatacttatattttcgta

SEQ ID NO: 3193890 - DNA, 13 bp, Homo sapiens
ttgatagaaccat

SEQ ID NO: 3193891 - DNA, 17 bp, Homo sapiens
ttgataggaactgtctc

SEQ ID NO: 3193892 - DNA, 14 bp, Homo sapiens
ttgatatacattgt

SEQ ID NO: 3193893 - DNA, 16 bp, Homo sapiens
ttgatatacattgtgt

SEQ ID NO: 3193894 - DNA, 13 bp, Homo sapiens
ttgatatatatta

SEQ ID NO: 3193895 - DNA, 18 bp, Homo sapiens
ttgatatgagtatacaat

SEQ ID NO: 3193896 - DNA, 16 bp, Homo sapiens
ttgatatgcttataca

SEQ ID NO: 3193897 - DNA, 23 bp, Homo sapiens
ttgatatttgcattgaggaaata

SEQ ID NO: 3193898 - DNA, 22 bp, Homo sapiens
ttgatattttcaacgcagccct

SEQ ID NO: 3193899 - DNA, 14 bp, Homo sapiens
ttgatcaaatatag

SEQ ID NO: 3193900 - DNA, 14 bp, Homo sapiens
ttgatcatttcttg

SEQ ID NO: 3193901 - DNA, 17 bp, Homo sapiens
ttgatcatttcttgtga

SEQ ID NO: 3193902 - DNA, 18 bp, Homo sapiens
ttgatcattttcccccca

SEQ ID NO: 3193903 - DNA, 19 bp, Homo sapiens
ttgatcattttccccccac

SEQ ID NO: 3193904 - DNA, 22 bp, Homo sapiens
ttgatcattttccccccactct

SEQ ID NO: 3193905 - DNA, 22 bp, Homo sapiens
ttgatcccagaaagtatatact

SEQ ID NO: 3193906 - DNA, 14 bp, Homo sapiens
ttgatcttaaagat

SEQ ID NO: 3193907 - DNA, 18 bp, Homo sapiens
ttgatcttacaagatatt

SEQ ID NO: 3193908 - DNA, 15 bp, Homo sapiens
ttgatctttttatca

SEQ ID NO: 3193909 - DNA, 20 bp, Homo sapiens
ttgatgaaaagatttaagca

SEQ ID NO: 3193910 - DNA, 15 bp, Homo sapiens
ttgatgaaagctgat

SEQ ID NO: 3193911 - DNA, 16 bp, Homo sapiens
ttgatgaaagctgatt

SEQ ID NO: 3193912 - DNA, 16 bp, Homo sapiens
ttgatgctatttatgc

SEQ ID NO: 3193913 - DNA, 16 bp, Homo sapiens
ttgatggagtgtgagc

SEQ ID NO: 3193914 - DNA, 21 bp, Homo sapiens
ttgatggagtgtgagccacct

SEQ ID NO: 3193915 - DNA, 22 bp, Homo sapiens
ttgatggtggactaagcaattt

SEQ ID NO: 3193916 - DNA, 19 bp, Homo sapiens
ttgatgtacagtctgtcat

SEQ ID NO: 3193917 - DNA, 14 bp, Homo sapiens
ttgatgtatatgtt

SEQ ID NO: 3193918 - DNA, 12 bp, Homo sapiens
ttgatgtatctg

SEQ ID NO: 3193919 - DNA, 20 bp, Homo sapiens
ttgatgtatctgagttgcca

SEQ ID NO: 3193920 - DNA, 13 bp, Homo sapiens
ttgatgtatgtgt

SEQ ID NO: 3193921 - DNA, 23 bp, Homo sapiens
ttgatgtatgtgtgaaacaatgt

SEQ ID NO: 3193922 - DNA, 15 bp, Homo sapiens
ttgatgttacagatt

SEQ ID NO: 3193923 - DNA, 16 bp, Homo sapiens
ttgatgtttgtggcct

SEQ ID NO: 3193924 - DNA, 20 bp, Homo sapiens
ttgatgtttgtggcctcaga

SEQ ID NO: 3193925 - DNA, 14 bp, Homo sapiens
ttgattaacaaata

SEQ ID NO: 3193926 - DNA, 20 bp, Homo sapiens
ttgattaagattttacaaaa

SEQ ID NO: 3193927 - DNA, 16 bp, Homo sapiens
ttgattattagccagg

SEQ ID NO: 3193928 - DNA, 20 bp, Homo sapiens
ttgattattctgattccact

SEQ ID NO: 3193929 - DNA, 17 bp, Homo sapiens
ttgattcagcaaaaatc

SEQ ID NO: 3193930 - DNA, 20 bp, Homo sapiens
ttgattctgcagtaaatctt

SEQ ID NO: 3193931 - DNA, 19 bp, Homo sapiens
ttgattgggaaaacatttg

SEQ ID NO: 3193932 - DNA, 17 bp, Homo sapiens
ttgatttaaacacacag

SEQ ID NO: 3193933 - DNA, 20 bp, Homo sapiens
ttgatttcaaagttttgttg

SEQ ID NO: 3193934 - DNA, 13 bp, Homo sapiens
ttgatttgcatgg

SEQ ID NO: 3193935 - DNA, 16 bp, Homo sapiens
ttgatttgcatggatt

SEQ ID NO: 3193936 - DNA, 17 bp, Homo sapiens
ttgatttgcattgaaca

SEQ ID NO: 3193937 - DNA, 15 bp, Homo sapiens
ttcttcaaatacaaa

SEQ ID NO: 3193938 - DNA, 17 bp, Homo sapiens
ttcttcacctgttatgt

SEQ ID NO: 3193939 - DNA, 21 bp, Homo sapiens
ttcttcacctgttatgtatga

SEQ ID NO: 3193940 - DNA, 22 bp, Homo sapiens
ttcttcacctgttatgtatgaa

SEQ ID NO: 3193941 - DNA, 17 bp, Homo sapiens
ttcttcagaagacactg

SEQ ID NO: 3193942 - DNA, 18 bp, Homo sapiens
ttcttcataacaatttta

SEQ ID NO: 3193943 - DNA, 21 bp, Homo sapiens
ttcttcataacaattttagga

SEQ ID NO: 3193944 - DNA, 21 bp, Homo sapiens
ttcttcattcaatacaagtgt

SEQ ID NO: 3193945 - DNA, 22 bp, Homo sapiens
ttcttcattctatcaagcccag

SEQ ID NO: 3193946 - DNA, 17 bp, Homo sapiens
ttcttccaaaaagattt

SEQ ID NO: 3193947 - DNA, 14 bp, Homo sapiens
ttcttccatcccag

SEQ ID NO: 3193948 - DNA, 20 bp, Homo sapiens
ttcttccccaggtccttcct

SEQ ID NO: 3193949 - DNA, 20 bp, Homo sapiens
ttcttcccccacttcccctc

SEQ ID NO: 3193950 - DNA, 18 bp, Homo sapiens
ttcttcctaccaagtcaa

SEQ ID NO: 3193951 - DNA, 14 bp, Homo sapiens
ttcttcctcagctg

SEQ ID NO: 3193952 - DNA, 13 bp, Homo sapiens
ttcttcctgccag

SEQ ID NO: 3193953 - DNA, 12 bp, Homo sapiens
ttcttcctgctg

SEQ ID NO: 3193954 - DNA, 18 bp, Homo sapiens
ttcttcctgttaatgtat

SEQ ID NO: 3193955 - DNA, 13 bp, Homo sapiens
ttcttcctttcta

SEQ ID NO: 3193956 - DNA, 23 bp, Homo sapiens
ttcttcgctgctctagctggcag

SEQ ID NO: 3193957 - DNA, 19 bp, Homo sapiens
ttcttcgtccttttggttt

SEQ ID NO: 3193958 - DNA, 20 bp, Homo sapiens
ttcttctagaagataacatt

SEQ ID NO: 3193959 - DNA, 22 bp, Homo sapiens
ttcttctagaagataacatttt

SEQ ID NO: 3193960 - DNA, 11 bp, Homo sapiens
ttcttctagag

SEQ ID NO: 3193961 - DNA, 18 bp, Homo sapiens
ttcttctaggttctaaaa

SEQ ID NO: 3193962 - DNA, 21 bp, Homo sapiens
ttcttctaggttctaaaaatt

SEQ ID NO: 3193963 - DNA, 15 bp, Homo sapiens
ttcttctcttctctg

SEQ ID NO: 3193964 - DNA, 14 bp, Homo sapiens
ttcttctctttagt

SEQ ID NO: 3193965 - DNA, 20 bp, Homo sapiens
ttcttctgaactcaaactga

SEQ ID NO: 3193966 - DNA, 12 bp, Homo sapiens
ttcttctgccct

SEQ ID NO: 3193967 - DNA, 13 bp, Homo sapiens
ttcttctgccctt

SEQ ID NO: 3193968 - DNA, 20 bp, Homo sapiens
ttcttctgcttcagcctccc

SEQ ID NO: 3193969 - DNA, 13 bp, Homo sapiens
ttcttcttccctc

SEQ ID NO: 3193970 - DNA, 13 bp, Homo sapiens
ttgaaggaagagg

SEQ ID NO: 3193971 - DNA, 15 bp, Homo sapiens
ttgaaggaagaggga

SEQ ID NO: 3193972 - DNA, 20 bp, Homo sapiens
ttgaaggaagccaaatttat

SEQ ID NO: 3193973 - DNA, 11 bp, Homo sapiens
ttgaaggctta

SEQ ID NO: 3193974 - DNA, 12 bp, Homo sapiens
ttgaaggcttaa

SEQ ID NO: 3193975 - DNA, 19 bp, Homo sapiens
ttgaagggagaagacactg

SEQ ID NO: 3193976 - DNA, 15 bp, Homo sapiens
ttgaagggcccagga

SEQ ID NO: 3193977 - DNA, 13 bp, Homo sapiens
ttgaagggtcctg

SEQ ID NO: 3193978 - DNA, 16 bp, Homo sapiens
ttgaagtaatgaattt

SEQ ID NO: 3193979 - DNA, 16 bp, Homo sapiens
ttgaagtagctctttt

SEQ ID NO: 3193980 - DNA, 19 bp, Homo sapiens
ttgaagtttcaagttttaa

SEQ ID NO: 3193981 - DNA, 12 bp, Homo sapiens
ttgaagtttgaa

SEQ ID NO: 3193982 - DNA, 17 bp, Homo sapiens
ttgaataaagtattcta

SEQ ID NO: 3193983 - DNA, 21 bp, Homo sapiens
ttgaataaagtattctagtgt

SEQ ID NO: 3193984 - DNA, 12 bp, Homo sapiens
ttgaataaataa

SEQ ID NO: 3193985 - DNA, 16 bp, Homo sapiens
ttgaataccattaaaa

SEQ ID NO: 3193986 - DNA, 17 bp, Homo sapiens
ttgaatataaaaaatca

SEQ ID NO: 3193987 - DNA, 22 bp, Homo sapiens
ttgaatataagaaaatgcttga

SEQ ID NO: 3193988 - DNA, 14 bp, Homo sapiens
ttgaatcctttgcc

SEQ ID NO: 3193989 - DNA, 17 bp, Homo sapiens
ttgaatctataaaagaa

SEQ ID NO: 3193990 - DNA, 15 bp, Homo sapiens
ttgaatctttccaat

SEQ ID NO: 3193991 - DNA, 18 bp, Homo sapiens
ttgaatgaaaaatttaag

SEQ ID NO: 3193992 - DNA, 20 bp, Homo sapiens
ttgaatgacaacagaagctt

SEQ ID NO: 3193993 - DNA, 15 bp, Homo sapiens
ttgaatgctttttga

SEQ ID NO: 3193994 - DNA, 23 bp, Homo sapiens
ttgaatgctttttgaatgttatt

SEQ ID NO: 3193995 - DNA, 17 bp, Homo sapiens
ttgaatggcttttctta

SEQ ID NO: 3193996 - DNA, 18 bp, Homo sapiens
ttgaatgtcacaaattga

SEQ ID NO: 3193997 - DNA, 19 bp, Homo sapiens
ttgaatgtcacaaattgat

SEQ ID NO: 3193998 - DNA, 17 bp, Homo sapiens
ttgaatgtcttttgaat

SEQ ID NO: 3193999 - DNA, 22 bp, Homo sapiens
ttgaatgtggcttgagaaatat

SEQ ID NO: 3194000 - DNA, 13 bp, Homo sapiens
ttgaatgtgtcag

SEQ ID NO: 3194001 - DNA, 22 bp, Homo sapiens
ttgaatgttaaagggatatttt

SEQ ID NO: 3194002 - DNA, 17 bp, Homo sapiens
ttgaatgttaagcagat

SEQ ID NO: 3194003 - DNA, 17 bp, Homo sapiens
ttgaattaaattaggaa

SEQ ID NO: 3194004 - DNA, 13 bp, Homo sapiens
ttgaattcagtaa

SEQ ID NO: 3194005 - DNA, 15 bp, Homo sapiens
ttgaattctggaaac

SEQ ID NO: 3194006 - DNA, 14 bp, Homo sapiens
ttgacaaatctgtg

SEQ ID NO: 3194007 - DNA, 20 bp, Homo sapiens
ttgacaaatctgtgtatatt

SEQ ID NO: 3194008 - DNA, 21 bp, Homo sapiens
ttgacaagttgcgacggagag

SEQ ID NO: 3194009 - DNA, 15 bp, Homo sapiens
ttgacacaattggaa

SEQ ID NO: 3194010 - DNA, 16 bp, Homo sapiens
ttgacacaattggaat

SEQ ID NO: 3194011 - DNA, 20 bp, Homo sapiens
ttgacacatccgccttttgt

SEQ ID NO: 3194012 - DNA, 19 bp, Homo sapiens
ttgacaccattctcctgcc

SEQ ID NO: 3194013 - DNA, 16 bp, Homo sapiens
ttgacactgctctaac

SEQ ID NO: 3194014 - DNA, 23 bp, Homo sapiens
ttgacactgctctaacagccctc

SEQ ID NO: 3194015 - DNA, 16 bp, Homo sapiens
ttgacagcaaaatgtt

SEQ ID NO: 3194016 - DNA, 23 bp, Homo sapiens
ttgacagcaaaatgttgaagaaa

SEQ ID NO: 3194017 - DNA, 19 bp, Homo sapiens
ttgacagggcacaccgggc

SEQ ID NO: 3194018 - DNA, 14 bp, Homo sapiens
ttgacagtgttttt

SEQ ID NO: 3194019 - DNA, 17 bp, Homo sapiens
ttgacagttctgaagaa

SEQ ID NO: 3194020 - DNA, 18 bp, Homo sapiens
ttgacagttctgaagaat

SEQ ID NO: 3194021 - DNA, 18 bp, Homo sapiens
ttgacatcagttcctttg

SEQ ID NO: 3194022 - DNA, 16 bp, Homo sapiens
ttgacatccaaatcta

SEQ ID NO: 3194023 - DNA, 14 bp, Homo sapiens
ttgacatgtggaaa

SEQ ID NO: 3194024 - DNA, 14 bp, Homo sapiens
ttgacattgcgttt

SEQ ID NO: 3194025 - DNA, 13 bp, Homo sapiens
ttgacatttaatt

SEQ ID NO: 3194026 - DNA, 16 bp, Homo sapiens
ttgaccaagaactgca

SEQ ID NO: 3194027 - DNA, 19 bp, Homo sapiens
ttgaccactgtctttttct

SEQ ID NO: 3194028 - DNA, 21 bp, Homo sapiens
ttgaccactgtctttttctta

SEQ ID NO: 3194029 - DNA, 15 bp, Homo sapiens
ttgacctcaggtgat

SEQ ID NO: 3194030 - DNA, 16 bp, Homo sapiens
ttgacctctataaact

SEQ ID NO: 3194031 - DNA, 13 bp, Homo sapiens
ttgacctgaggct

SEQ ID NO: 3194032 - DNA, 23 bp, Homo sapiens
ttgaccttctccctcactcctgc

SEQ ID NO: 3194033 - DNA, 16 bp, Homo sapiens
ttgacgaagtctcttt

SEQ ID NO: 3194034 - DNA, 21 bp, Homo sapiens
ttgacggggcagtcagatttt

SEQ ID NO: 3194035 - DNA, 23 bp, Homo sapiens
ttgacggttttttattattgtgg

SEQ ID NO: 3194036 - DNA, 20 bp, Homo sapiens
ttgactaactcaaatacaca

SEQ ID NO: 3194037 - DNA, 15 bp, Homo sapiens
ttgactaattttaca

SEQ ID NO: 3194038 - DNA, 21 bp, Homo sapiens
ttgactagggattcaggctgc

SEQ ID NO: 3194039 - DNA, 17 bp, Homo sapiens
ttgactcagaggctggg

SEQ ID NO: 3194040 - DNA, 19 bp, Homo sapiens
ttgactcccaagtttccat

SEQ ID NO: 3194041 - DNA, 13 bp, Homo sapiens
ttgactctaatat

SEQ ID NO: 3194042 - DNA, 21 bp, Homo sapiens
ttgactcttgcgtgtcaattt

SEQ ID NO: 3194043 - DNA, 20 bp, Homo sapiens
ttgactgaaaaaaaaaaaga

SEQ ID NO: 3194044 - DNA, 22 bp, Homo sapiens
ttgactgccgcatcatgggagt

SEQ ID NO: 3194045 - DNA, 15 bp, Homo sapiens
ttgactgtgctagct

SEQ ID NO: 3194046 - DNA, 18 bp, Homo sapiens
ttgactgtgctagctaaa

SEQ ID NO: 3194047 - DNA, 18 bp, Homo sapiens
ttgacttcagctgcctga

SEQ ID NO: 3194048 - DNA, 16 bp, Homo sapiens
ttgacttcttgcttca

SEQ ID NO: 3194049 - DNA, 21 bp, Homo sapiens
ttgacttgtttgtgcatcctg

SEQ ID NO: 3194050 - DNA, 17 bp, Homo sapiens
ttgactttatctcctgc

SEQ ID NO: 3194051 - DNA, 20 bp, Homo sapiens
ttgacttttataaagcatgt

SEQ ID NO: 3194052 - DNA, 21 bp, Homo sapiens
ttgacttttataaagcatgtt

SEQ ID NO: 3194053 - DNA, 17 bp, Homo sapiens
ttgactttttgcattta

SEQ ID NO: 3194054 - DNA, 10 bp, Homo sapiens
ttgagaaacc

SEQ ID NO: 3194055 - DNA, 23 bp, Homo sapiens
ttgagaaaccttattgtacctct

SEQ ID NO: 3194056 - DNA, 21 bp, Homo sapiens
ttgagaaatatggacacttaa

SEQ ID NO: 3194057 - DNA, 16 bp, Homo sapiens
ttgagaaatgaataat

SEQ ID NO: 3194058 - DNA, 15 bp, Homo sapiens
ttgagaactttccat

SEQ ID NO: 3194059 - DNA, 22 bp, Homo sapiens
ttgagaagacctcacctagaaa

SEQ ID NO: 3194060 - DNA, 19 bp, Homo sapiens
ttgagaagccttcagctcc

SEQ ID NO: 3194061 - DNA, 14 bp, Homo sapiens
ttgagaaggagaga

SEQ ID NO: 3194062 - DNA, 23 bp, Homo sapiens
ttgagaatcccaaatttgattga

SEQ ID NO: 3194063 - DNA, 16 bp, Homo sapiens
ttgagaatggaaacca

SEQ ID NO: 3194064 - DNA, 16 bp, Homo sapiens
ttgagacaagccctgg

SEQ ID NO: 3194065 - DNA, 19 bp, Homo sapiens
ttgagacaagccctggcaa

SEQ ID NO: 3194066 - DNA, 11 bp, Homo sapiens
ttgagacagag

SEQ ID NO: 3194067 - DNA, 19 bp, Homo sapiens
ttgagacagtttcttagct

SEQ ID NO: 3194068 - DNA, 19 bp, Homo sapiens
ttgagacataaatgttcac

SEQ ID NO: 3194069 - DNA, 21 bp, Homo sapiens
ttgagacgcaccatgtgggca

SEQ ID NO: 3194070 - DNA, 23 bp, Homo sapiens
ttgagactatttaaacttataaa

SEQ ID NO: 3194071 - DNA, 16 bp, Homo sapiens
ttgagactttttggtg

SEQ ID NO: 3194072 - DNA, 23 bp, Homo sapiens
ttgagactttttggtggatgtaa

SEQ ID NO: 3194073 - DNA, 19 bp, Homo sapiens
ttgagatgtgttcctcctg

SEQ ID NO: 3194074 - DNA, 17 bp, Homo sapiens
ttgagattagagggagg

SEQ ID NO: 3194075 - DNA, 12 bp, Homo sapiens
ttgagcagggct

SEQ ID NO: 3194076 - DNA, 16 bp, Homo sapiens
ttgagcatttttaagg

SEQ ID NO: 3194077 - DNA, 17 bp, Homo sapiens
ttgagccaggcctgggt

SEQ ID NO: 3194078 - DNA, 17 bp, Homo sapiens
ttgagccagtaatcttt

SEQ ID NO: 3194079 - DNA, 18 bp, Homo sapiens
ttgagccagtaatcttta

SEQ ID NO: 3194080 - DNA, 23 bp, Homo sapiens
ttgagccccaagtcctgaagagg

SEQ ID NO: 3194081 - DNA, 13 bp, Homo sapiens
ttgagcctccccc

SEQ ID NO: 3194082 - DNA, 16 bp, Homo sapiens
ttgagctgatataaat

SEQ ID NO: 3194083 - DNA, 13 bp, Homo sapiens
ttgagctgccttc

SEQ ID NO: 3194084 - DNA, 14 bp, Homo sapiens
ttgagctgccttcc

SEQ ID NO: 3194085 - DNA, 15 bp, Homo sapiens
ttgagctgccttccc

SEQ ID NO: 3194086 - DNA, 12 bp, Homo sapiens
ttgagctggcct

SEQ ID NO: 3194087 - DNA, 18 bp, Homo sapiens
ttgagctgttttccctga

SEQ ID NO: 3194088 - DNA, 16 bp, Homo sapiens
ttgaggaaatattaat

SEQ ID NO: 3194089 - DNA, 18 bp, Homo sapiens
ttgaggagcatgttttgt

SEQ ID NO: 3194090 - DNA, 23 bp, Homo sapiens
ttgaggagcatgttttgtataca

SEQ ID NO: 3194091 - DNA, 12 bp, Homo sapiens
ttgaggagcccc

SEQ ID NO: 3194092 - DNA, 22 bp, Homo sapiens
ttgaggatatattttcactttg

SEQ ID NO: 3194093 - DNA, 14 bp, Homo sapiens
ttgaggccaggagt

SEQ ID NO: 3194094 - DNA, 14 bp, Homo sapiens
ttgagggcccagag

SEQ ID NO: 3194095 - DNA, 15 bp, Homo sapiens
ttgagggcccagagc

SEQ ID NO: 3194096 - DNA, 19 bp, Homo sapiens
ttgagggcccagagcagga

SEQ ID NO: 3194097 - DNA, 21 bp, Homo sapiens
ttgagggcccagagcaggaag

SEQ ID NO: 3194098 - DNA, 16 bp, Homo sapiens
ttgaggggattaatat

SEQ ID NO: 3194099 - DNA, 18 bp, Homo sapiens
tgtacttctgtgttcatt

SEQ ID NO: 3194100 - DNA, 19 bp, Homo sapiens
tgtacttctgtgttcattt

SEQ ID NO: 3194101 - DNA, 20 bp, Homo sapiens
tgtacttcttattgcaaggc

SEQ ID NO: 3194102 - DNA, 15 bp, Homo sapiens
tgtacttgatactga

SEQ ID NO: 3194103 - DNA, 15 bp, Homo sapiens
tgtacttgatttgat

SEQ ID NO: 3194104 - DNA, 18 bp, Homo sapiens
tgtacttgatttgatgtg

SEQ ID NO: 3194105 - DNA, 19 bp, Homo sapiens
tgtactttatcatgaatgc

SEQ ID NO: 3194106 - DNA, 21 bp, Homo sapiens
tgtactttatcatgaatgctt

SEQ ID NO: 3194107 - DNA, 12 bp, Homo sapiens
tgtactttgaat

SEQ ID NO: 3194108 - DNA, 14 bp, Homo sapiens
tgtactttgccatt

SEQ ID NO: 3194109 - DNA, 22 bp, Homo sapiens
tgtactttgccatttttctata

SEQ ID NO: 3194110 - DNA, 13 bp, Homo sapiens
tgtacttttcatt

SEQ ID NO: 3194111 - DNA, 20 bp, Homo sapiens
tggtttgggaatatccatgt

SEQ ID NO: 3194112 - DNA, 16 bp, Homo sapiens
tggttttacttacaaa

SEQ ID NO: 3194113 - DNA, 21 bp, Homo sapiens
tggttttacttacaaaaatgg

SEQ ID NO: 3194114 - DNA, 13 bp, Homo sapiens
tggttttagattt

SEQ ID NO: 3194115 - DNA, 16 bp, Homo sapiens
tgtgctagaatacttt

SEQ ID NO: 3194116 - DNA, 14 bp, Homo sapiens
tgtgctccgtgcct

SEQ ID NO: 3194117 - DNA, 20 bp, Homo sapiens
tgtgctccgtgcctccacca

SEQ ID NO: 3194118 - DNA, 15 bp, Homo sapiens
tgtgctctggacagg

SEQ ID NO: 3194119 - DNA, 18 bp, Homo sapiens
tgtgctctggacaggcat

SEQ ID NO: 3194120 - DNA, 16 bp, Homo sapiens
tgtgctctggaggctg

SEQ ID NO: 3194121 - DNA, 20 bp, Homo sapiens
tgtgctctttttttaaaagg

SEQ ID NO: 3194122 - DNA, 12 bp, Homo sapiens
tgtgctgctttt

SEQ ID NO: 3194123 - DNA, 20 bp, Homo sapiens
tgtgctggatggagcccagg

SEQ ID NO: 3194124 - DNA, 10 bp, Homo sapiens
tgtgctggga

SEQ ID NO: 3194125 - DNA, 24 bp, Homo sapiens
tgtgctgggggaatgagcccagag

SEQ ID NO: 3194126 - DNA, 15 bp, Homo sapiens
tgtgctgtgcctgct

SEQ ID NO: 3194127 - DNA, 21 bp, Homo sapiens
tgtgctgtggagagaagctga

SEQ ID NO: 3194128 - DNA, 14 bp, Homo sapiens
tgtgctgtgggcag

SEQ ID NO: 3194129 - DNA, 15 bp, Homo sapiens
tgtgctgtgggcagc

SEQ ID NO: 3194130 - DNA, 19 bp, Homo sapiens
tgtgctgtgggcagcaccc

SEQ ID NO: 3194131 - DNA, 21 bp, Homo sapiens
tgtgctgtgggcagcaccctc

SEQ ID NO: 3194132 - DNA, 22 bp, Homo sapiens
tgtgctgtgggcagcaccctcc

SEQ ID NO: 3194133 - DNA, 15 bp, Homo sapiens
tgtgctgtgtgtgac

SEQ ID NO: 3194134 - DNA, 22 bp, Homo sapiens
tgtgcttcacagtagagccagc

SEQ ID NO: 3194135 - DNA, 18 bp, Homo sapiens
tgtgcttctccccagaat

SEQ ID NO: 3194136 - DNA, 23 bp, Homo sapiens
tgtgcttgtttacagcactactc

SEQ ID NO: 3194137 - DNA, 13 bp, Homo sapiens
tgtggaaaacaga

SEQ ID NO: 3194138 - DNA, 19 bp, Homo sapiens
tgtggaaaaccaggaaaag

SEQ ID NO: 3194139 - DNA, 16 bp, Homo sapiens
tgtggaaagcactttt

SEQ ID NO: 3194140 - DNA, 12 bp, Homo sapiens
tgtggaaagcct

SEQ ID NO: 3194141 - DNA, 20 bp, Homo sapiens
tgtggaaagcctctgctgcc

SEQ ID NO: 3194142 - DNA, 19 bp, Homo sapiens
tgtggaagaaaatggttta

SEQ ID NO: 3194143 - DNA, 22 bp, Homo sapiens
tgtggaagaaaatggtttattt

SEQ ID NO: 3194144 - DNA, 14 bp, Homo sapiens
tgtggaagcaaaaa

SEQ ID NO: 3194145 - DNA, 13 bp, Homo sapiens
tgtggaatgagtg

SEQ ID NO: 3194146 - DNA, 21 bp, Homo sapiens
tgtggaatggattatagagta

SEQ ID NO: 3194147 - DNA, 13 bp, Homo sapiens
tgtggacacagct

SEQ ID NO: 3194148 - DNA, 14 bp, Homo sapiens
tgtggactaaatat

SEQ ID NO: 3194149 - DNA, 14 bp, Homo sapiens
tgtggactgtgatg

SEQ ID NO: 3194150 - DNA, 16 bp, Homo sapiens
tgtggagagaagctga

SEQ ID NO: 3194151 - DNA, 21 bp, Homo sapiens
tgtggagaggggtgcacccac

SEQ ID NO: 3194152 - DNA, 18 bp, Homo sapiens
tgtggagcaaaaggcagc

SEQ ID NO: 3194153 - DNA, 19 bp, Homo sapiens
tgtggagcaaaaggcagct

SEQ ID NO: 3194154 - DNA, 20 bp, Homo sapiens
tgtggagcaaaaggcagctc

SEQ ID NO: 3194155 - DNA, 21 bp, Homo sapiens
tgtggagcaaaaggcagctca

SEQ ID NO: 3194156 - DNA, 15 bp, Homo sapiens
tgtggagctgccaca

SEQ ID NO: 3194157 - DNA, 14 bp, Homo sapiens
tgtggaggaaggat

SEQ ID NO: 3194158 - DNA, 19 bp, Homo sapiens
tgtggagggagtgttcaaa

SEQ ID NO: 3194159 - DNA, 14 bp, Homo sapiens
tgtggatcttgcca

SEQ ID NO: 3194160 - DNA, 19 bp, Homo sapiens
tgtggatcttgccacattt

SEQ ID NO: 3194161 - DNA, 15 bp, Homo sapiens
tgtggatgtcttcct

SEQ ID NO: 3194162 - DNA, 17 bp, Homo sapiens
tgtggattctgaggccc

SEQ ID NO: 3194163 - DNA, 22 bp, Homo sapiens
tgtggattctgaggccctgccc

SEQ ID NO: 3194164 - DNA, 21 bp, Homo sapiens
tgtggattttctactgtaaga

SEQ ID NO: 3194165 - DNA, 15 bp, Homo sapiens
tgtggcaaagtgctg

SEQ ID NO: 3194166 - DNA, 14 bp, Homo sapiens
tgtggcagagagag

SEQ ID NO: 3194167 - DNA, 15 bp, Homo sapiens
tgtggcagagagaga

SEQ ID NO: 3194168 - DNA, 22 bp, Homo sapiens
tgtggcagagagagagaaagag

SEQ ID NO: 3194169 - DNA, 23 bp, Homo sapiens
tgtggcagagagagagaaagaga

SEQ ID NO: 3194170 - DNA, 15 bp, Homo sapiens
tgtggcagagttaca

SEQ ID NO: 3194171 - DNA, 20 bp, Homo sapiens
tgtggcagagttacagttct

SEQ ID NO: 3194172 - DNA, 21 bp, Homo sapiens
tgtggcagagttacagttctg

SEQ ID NO: 3194173 - DNA, 14 bp, Homo sapiens
tgtggcaggcagcg

SEQ ID NO: 3194174 - DNA, 18 bp, Homo sapiens
tgtggcagtaaagagaaa

SEQ ID NO: 3194175 - DNA, 21 bp, Homo sapiens
tgtggcagtaaagagaaactt

SEQ ID NO: 3194176 - DNA, 15 bp, Homo sapiens
tgtggcagtggtttt

SEQ ID NO: 3194177 - DNA, 16 bp, Homo sapiens
tgtggccacagccccc

SEQ ID NO: 3194178 - DNA, 16 bp, Homo sapiens
tgtggccacttatttc

SEQ ID NO: 3194179 - DNA, 22 bp, Homo sapiens
tgtggcccctgaacaagaattg

SEQ ID NO: 3194180 - DNA, 12 bp, Homo sapiens
tgtggccctgga

SEQ ID NO: 3194181 - DNA, 12 bp, Homo sapiens
tgtggccctggc

SEQ ID NO: 3194182 - DNA, 18 bp, Homo sapiens
tgtggccctggctctgct

SEQ ID NO: 3194183 - DNA, 19 bp, Homo sapiens
tgtggccgtctcctccctc

SEQ ID NO: 3194184 - DNA, 16 bp, Homo sapiens
tgtggcctcaccctga

SEQ ID NO: 3194185 - DNA, 11 bp, Homo sapiens
tgtggcctcag

SEQ ID NO: 3194186 - DNA, 18 bp, Homo sapiens
tgtggcctcagccctcag

SEQ ID NO: 3194187 - DNA, 17 bp, Homo sapiens
tgtggcctgcacagtga

SEQ ID NO: 3194188 - DNA, 15 bp, Homo sapiens
tgtggcctgtggcct

SEQ ID NO: 3194189 - DNA, 17 bp, Homo sapiens
tgtggcctgtggcctgt

SEQ ID NO: 3194190 - DNA, 19 bp, Homo sapiens
tgtggcgccgtctccaggg

SEQ ID NO: 3194191 - DNA, 19 bp, Homo sapiens
tgtggctcttatttctgaa

SEQ ID NO: 3194192 - DNA, 21 bp, Homo sapiens
tgtggctcttatttctgaatt

SEQ ID NO: 3194193 - DNA, 13 bp, Homo sapiens
tgtggctgaaaat

SEQ ID NO: 3194194 - DNA, 15 bp, Homo sapiens
tgtgggaagaccaaa

SEQ ID NO: 3194195 - DNA, 13 bp, Homo sapiens
tgtgggactgtac

SEQ ID NO: 3194196 - DNA, 13 bp, Homo sapiens
tgtgggagcagcg

SEQ ID NO: 3194197 - DNA, 13 bp, Homo sapiens
tgtgggagtagaa

SEQ ID NO: 3194198 - DNA, 15 bp, Homo sapiens
tgtgggatgtcctct

SEQ ID NO: 3194199 - DNA, 22 bp, Homo sapiens
tgtgggatgttcagcactgtcc

SEQ ID NO: 3194200 - DNA, 18 bp, Homo sapiens
tgtgtaatagaaaactga

SEQ ID NO: 3194201 - DNA, 17 bp, Homo sapiens
tgtgtacaagttgttat

SEQ ID NO: 3194202 - DNA, 12 bp, Homo sapiens
tgtgtacagtga

SEQ ID NO: 3194203 - DNA, 13 bp, Homo sapiens
tgtgtacagtgaa

SEQ ID NO: 3194204 - DNA, 18 bp, Homo sapiens
tgtgtacataactctgta

SEQ ID NO: 3194205 - DNA, 17 bp, Homo sapiens
tgtgtacataactgaaa

SEQ ID NO: 3194206 - DNA, 14 bp, Homo sapiens
tgtgtactctgtcc

SEQ ID NO: 3194207 - DNA, 16 bp, Homo sapiens
tgtgtagacaaatatt

SEQ ID NO: 3194208 - DNA, 21 bp, Homo sapiens
tgtgtagacaaatatttggag

SEQ ID NO: 3194209 - DNA, 13 bp, Homo sapiens
tgtgtagcctatg

SEQ ID NO: 3194210 - DNA, 23 bp, Homo sapiens
tgtgtagcctgtgcatgtatgtc

SEQ ID NO: 3194211 - DNA, 13 bp, Homo sapiens
tgtgtagcctttt

SEQ ID NO: 3194212 - DNA, 16 bp, Homo sapiens
tgtgtagggcgggagg

SEQ ID NO: 3194213 - DNA, 15 bp, Homo sapiens
tgtgtaggttatctt

SEQ ID NO: 3194214 - DNA, 22 bp, Homo sapiens
tgtgtagttgtctctcttcaga

SEQ ID NO: 3194215 - DNA, 16 bp, Homo sapiens
tgtgtataaattgtct

SEQ ID NO: 3194216 - DNA, 16 bp, Homo sapiens
tgtgtataactggatt

SEQ ID NO: 3194217 - DNA, 17 bp, Homo sapiens
tgtgtataagtgcacac

SEQ ID NO: 3194218 - DNA, 16 bp, Homo sapiens
tgtgtataattttaaa

SEQ ID NO: 3194219 - DNA, 16 bp, Homo sapiens
tgtgtatacagccctg

SEQ ID NO: 3194220 - DNA, 15 bp, Homo sapiens
tgtgtatatagtttt

SEQ ID NO: 3194221 - DNA, 13 bp, Homo sapiens
tgtgtatatatac

SEQ ID NO: 3194222 - DNA, 14 bp, Homo sapiens
tgtgtatatataca

SEQ ID NO: 3194223 - DNA, 13 bp, Homo sapiens
tgtgtatatctct

SEQ ID NO: 3194224 - DNA, 18 bp, Homo sapiens
tgtgtatattatttggca

SEQ ID NO: 3194225 - DNA, 21 bp, Homo sapiens
tgtgtatccgactctaagctg

SEQ ID NO: 3194226 - DNA, 23 bp, Homo sapiens
tgtgtatccgactctaagctgtg

SEQ ID NO: 3194227 - DNA, 11 bp, Homo sapiens
tgtgtatgtac

SEQ ID NO: 3194228 - DNA, 14 bp, Homo sapiens
tgtgtatgtactta

SEQ ID NO: 3194229 - DNA, 22 bp, Homo sapiens
tgtgtatgtacttagctgtact

SEQ ID NO: 3194230 - DNA, 16 bp, Homo sapiens
tgtgtatgtgtattta

SEQ ID NO: 3194231 - DNA, 19 bp, Homo sapiens
tgtgtatttaattgtaaac

SEQ ID NO: 3194232 - DNA, 21 bp, Homo sapiens
tgtgtatttaattgtaaactg

SEQ ID NO: 3194233 - DNA, 16 bp, Homo sapiens
tgtgtatttcttatac

SEQ ID NO: 3194234 - DNA, 23 bp, Homo sapiens
tgtgtcacaatgagattgaattt

SEQ ID NO: 3194235 - DNA, 12 bp, Homo sapiens
tgtgtcagaaac

SEQ ID NO: 3194236 - DNA, 15 bp, Homo sapiens
tgtgtcagaaacatg

SEQ ID NO: 3194237 - DNA, 21 bp, Homo sapiens
tgtgtcagaaacatgaaatgc

SEQ ID NO: 3194238 - DNA, 17 bp, Homo sapiens
tgtgtcagaaaccctgg

SEQ ID NO: 3194239 - DNA, 17 bp, Homo sapiens
tgtgtcaggtggggcag

SEQ ID NO: 3194240 - DNA, 13 bp, Homo sapiens
tgtgtcatttcaa

SEQ ID NO: 3194241 - DNA, 14 bp, Homo sapiens
tgtgtcatttcaaa

SEQ ID NO: 3194242 - DNA, 13 bp, Homo sapiens
tgtgtccagcagc

SEQ ID NO: 3194243 - DNA, 20 bp, Homo sapiens
tgtgtccatgcgctcagggc

SEQ ID NO: 3194244 - DNA, 19 bp, Homo sapiens
tgtgtcccatgacccaccc

SEQ ID NO: 3194245 - DNA, 22 bp, Homo sapiens
tgtgtcccatgacccacccctg

SEQ ID NO: 3194246 - DNA, 13 bp, Homo sapiens
tgtgtcccctcac

SEQ ID NO: 3194247 - DNA, 17 bp, Homo sapiens
tgtgtcccctcactctg

SEQ ID NO: 3194248 - DNA, 22 bp, Homo sapiens
tgtgtcccctcactctgtcagc

SEQ ID NO: 3194249 - DNA, 14 bp, Homo sapiens
tgtgtccctggaca

SEQ ID NO: 3194250 - DNA, 15 bp, Homo sapiens
tgtgtccctggacac

SEQ ID NO: 3194251 - DNA, 19 bp, Homo sapiens
tgtgtccctggacacagct

SEQ ID NO: 3194252 - DNA, 14 bp, Homo sapiens
tgtgtcctggttcc

SEQ ID NO: 3194253 - DNA, 18 bp, Homo sapiens
tgtgtctaagattctaga

SEQ ID NO: 3194254 - DNA, 20 bp, Homo sapiens
tgtgtctaagattctagatc

SEQ ID NO: 3194255 - DNA, 14 bp, Homo sapiens
tgtgtctgctcagt

SEQ ID NO: 3194256 - DNA, 13 bp, Homo sapiens
tgtgtctgctctc

SEQ ID NO: 3194257 - DNA, 13 bp, Homo sapiens
tgtgtctggtaac

SEQ ID NO: 3194258 - DNA, 24 bp, Homo sapiens
tgtgtctgtatttcatgtggctgt

SEQ ID NO: 3194259 - DNA, 22 bp, Homo sapiens
tgtgtctgtgccctccaaagag

SEQ ID NO: 3194260 - DNA, 20 bp, Homo sapiens
tgtgtctttatagatgtaca

SEQ ID NO: 3194261 - DNA, 14 bp, Homo sapiens
tgtgtgaaacaatg

SEQ ID NO: 3194262 - DNA, 15 bp, Homo sapiens
tgtgtgaaacaatgt

SEQ ID NO: 3194263 - DNA, 23 bp, Homo sapiens
tgtgtgaaacaatgttgtccaac

SEQ ID NO: 3194264 - DNA, 14 bp, Homo sapiens
tgtgtgaaattgca

SEQ ID NO: 3194265 - DNA, 16 bp, Homo sapiens
tgtgtgaatgaacact

SEQ ID NO: 3194266 - DNA, 17 bp, Homo sapiens
tgtgtgaatgaacactc

SEQ ID NO: 3194267 - DNA, 12 bp, Homo sapiens
tgtgtgaatgtg

SEQ ID NO: 3194268 - DNA, 17 bp, Homo sapiens
tgtgtgaattctgcaac

SEQ ID NO: 3194269 - DNA, 14 bp, Homo sapiens
tgtgtgagcagtgg

SEQ ID NO: 3194270 - DNA, 18 bp, Homo sapiens
tgtgtgagtttgctggtt

SEQ ID NO: 3194271 - DNA, 14 bp, Homo sapiens
tgtgtgattgaagg

SEQ ID NO: 3194272 - DNA, 15 bp, Homo sapiens
tgtgtgatttcctaa

SEQ ID NO: 3194273 - DNA, 23 bp, Homo sapiens
tgtgtgatttcctaaacataatt

SEQ ID NO: 3194274 - DNA, 19 bp, Homo sapiens
tgtgtgcacgtacacacac

SEQ ID NO: 3194275 - DNA, 18 bp, Homo sapiens
tgtgtgcagagtccattt

SEQ ID NO: 3194276 - DNA, 13 bp, Homo sapiens
tgtgtgcctgtgg

SEQ ID NO: 3194277 - DNA, 15 bp, Homo sapiens
tgtgtgcctgtggca

SEQ ID NO: 3194278 - DNA, 22 bp, Homo sapiens
tgtgtgctcatgtatgtgcgaa

SEQ ID NO: 3194279 - DNA, 12 bp, Homo sapiens
tgtgtgctttcc

SEQ ID NO: 3194280 - DNA, 17 bp, Homo sapiens
tgtgtggactcaagtcc

SEQ ID NO: 3194281 - DNA, 14 bp, Homo sapiens
tgtgtggattcttt

SEQ ID NO: 3194282 - DNA, 21 bp, Homo sapiens
tgttatgaaataaagaaattg

SEQ ID NO: 3194283 - DNA, 15 bp, Homo sapiens
tgttatgaacatgca

SEQ ID NO: 3194284 - DNA, 14 bp, Homo sapiens
tgttatgacagtga

SEQ ID NO: 3194285 - DNA, 15 bp, Homo sapiens
tgttatgctgtgaca

SEQ ID NO: 3194286 - DNA, 13 bp, Homo sapiens
tgttatgtaaaac

SEQ ID NO: 3194287 - DNA, 13 bp, Homo sapiens
tgttatgtactgt

SEQ ID NO: 3194288 - DNA, 12 bp, Homo sapiens
tgttatgtatga

SEQ ID NO: 3194289 - DNA, 19 bp, Homo sapiens
tgttattccatcaataaat

SEQ ID NO: 3194290 - DNA, 13 bp, Homo sapiens
tgttattgtgaat

SEQ ID NO: 3194291 - DNA, 19 bp, Homo sapiens
tgttattgtgaatgattca

SEQ ID NO: 3194292 - DNA, 13 bp, Homo sapiens
tgttattgtggaa

SEQ ID NO: 3194293 - DNA, 16 bp, Homo sapiens
tgttattgttgaacat

SEQ ID NO: 3194294 - DNA, 16 bp, Homo sapiens
tgttattgttttgtta

SEQ ID NO: 3194295 - DNA, 22 bp, Homo sapiens
tgttattgttttgttaattaca

SEQ ID NO: 3194296 - DNA, 18 bp, Homo sapiens
tgttatttaacagctgaa

SEQ ID NO: 3194297 - DNA, 17 bp, Homo sapiens
tgttatttattctttat

SEQ ID NO: 3194298 - DNA, 18 bp, Homo sapiens
tgttattttcagtatttt

SEQ ID NO: 3194299 - DNA, 19 bp, Homo sapiens
tgttattttctttgaaatt

SEQ ID NO: 3194300 - DNA, 22 bp, Homo sapiens
tgttatttttatatcagcctga

SEQ ID NO: 3194301 - DNA, 18 bp, Homo sapiens
tgttatttttcaaggaag

SEQ ID NO: 3194302 - DNA, 18 bp, Homo sapiens
tgttattttttaattatt

SEQ ID NO: 3194303 - DNA, 20 bp, Homo sapiens
tgttcaaagccacattattt

SEQ ID NO: 3194304 - DNA, 16 bp, Homo sapiens
tgttcaaatgcatttt

SEQ ID NO: 3194305 - DNA, 21 bp, Homo sapiens
tgttcaatctgtgtaagaaaa

SEQ ID NO: 3194306 - DNA, 23 bp, Homo sapiens
tgttcaatctgtgtaagaaaaca

SEQ ID NO: 3194307 - DNA, 16 bp, Homo sapiens
tgttcaatgttccatt

SEQ ID NO: 3194308 - DNA, 18 bp, Homo sapiens
tgttcacacaaagcctgt

SEQ ID NO: 3194309 - DNA, 17 bp, Homo sapiens
tgttcacagaaaaagca

SEQ ID NO: 3194310 - DNA, 15 bp, Homo sapiens
tgttcagatgtgcat

SEQ ID NO: 3194311 - DNA, 16 bp, Homo sapiens
tgttcagctccagctc

SEQ ID NO: 3194312 - DNA, 16 bp, Homo sapiens
tgttcaggtctctaga

SEQ ID NO: 3194313 - DNA, 13 bp, Homo sapiens
tgttcagtaataa

SEQ ID NO: 3194314 - DNA, 12 bp, Homo sapiens
tgttcatacatt

SEQ ID NO: 3194315 - DNA, 19 bp, Homo sapiens
tgttcatcatcctaagcta

SEQ ID NO: 3194316 - DNA, 23 bp, Homo sapiens
tgttcatcctcattgcctcctgt

SEQ ID NO: 3194317 - DNA, 20 bp, Homo sapiens
tgttcatgctgaatccacct

SEQ ID NO: 3194318 - DNA, 21 bp, Homo sapiens
tgttcatgctgaatccacctc

SEQ ID NO: 3194319 - DNA, 22 bp, Homo sapiens
tgttcatgctgaatccacctcg

SEQ ID NO: 3194320 - DNA, 14 bp, Homo sapiens
tgttcatgtgcctc

SEQ ID NO: 3194321 - DNA, 12 bp, Homo sapiens
tgttcatgtttg

SEQ ID NO: 3194322 - DNA, 20 bp, Homo sapiens
tgttcattataatctcaaag

SEQ ID NO: 3194323 - DNA, 20 bp, Homo sapiens
tgttcattcaagctatttaa

SEQ ID NO: 3194324 - DNA, 13 bp, Homo sapiens
tgttcattgtaat

SEQ ID NO: 3194325 - DNA, 18 bp, Homo sapiens
tgttcattgtaatgttac

SEQ ID NO: 3194326 - DNA, 19 bp, Homo sapiens
tgttcattgtaatgttact

SEQ ID NO: 3194327 - DNA, 20 bp, Homo sapiens
tgttcattgtaatgttactg

SEQ ID NO: 3194328 - DNA, 22 bp, Homo sapiens
tgttcattgtaatgttactgat

SEQ ID NO: 3194329 - DNA, 21 bp, Homo sapiens
tgttcatttagataatttgaa

SEQ ID NO: 3194330 - DNA, 20 bp, Homo sapiens
tgttcatttggtgttcctgg

SEQ ID NO: 3194331 - DNA, 21 bp, Homo sapiens
tgttcatttggtgttcctgga

SEQ ID NO: 3194332 - DNA, 22 bp, Homo sapiens
tgttcatttggtgttcctggaa

SEQ ID NO: 3194333 - DNA, 13 bp, Homo sapiens
tgttccaaagcca

SEQ ID NO: 3194334 - DNA, 17 bp, Homo sapiens
tgttccaaagccagtga

SEQ ID NO: 3194335 - DNA, 15 bp, Homo sapiens
tgttgaaaaaattta

SEQ ID NO: 3194336 - DNA, 18 bp, Homo sapiens
tgttgaagaatacagtta

SEQ ID NO: 3194337 - DNA, 13 bp, Homo sapiens
tgttgaagtcacc

SEQ ID NO: 3194338 - DNA, 22 bp, Homo sapiens
tgttgacaaaattttctcattt

SEQ ID NO: 3194339 - DNA, 18 bp, Homo sapiens
tgttgacattaagaatgt

SEQ ID NO: 3194340 - DNA, 16 bp, Homo sapiens
tgttgacgaagtctct

SEQ ID NO: 3194341 - DNA, 21 bp, Homo sapiens
tgttgacttattttctctgtg

SEQ ID NO: 3194342 - DNA, 22 bp, Homo sapiens
tgttgacttattttctctgtgt

SEQ ID NO: 3194343 - DNA, 22 bp, Homo sapiens
tgttgagaagcgtttttaacct

SEQ ID NO: 3194344 - DNA, 19 bp, Homo sapiens
tgttgaggtggtctgaatg

SEQ ID NO: 3194345 - DNA, 13 bp, Homo sapiens
tgttgagtgttca

SEQ ID NO: 3194346 - DNA, 14 bp, Homo sapiens
tgttgagtgttcat

SEQ ID NO: 3194347 - DNA, 19 bp, Homo sapiens
tgttgataaattccactgg

SEQ ID NO: 3194348 - DNA, 21 bp, Homo sapiens
tgttgatacctctgctgggat

SEQ ID NO: 3194349 - DNA, 16 bp, Homo sapiens
tgttgattattagcca

SEQ ID NO: 3194350 - DNA, 14 bp, Homo sapiens
tgttgattttctgt

SEQ ID NO: 3194351 - DNA, 21 bp, Homo sapiens
tgttgcaatgtgaaaaatctg

SEQ ID NO: 3194352 - DNA, 21 bp, Homo sapiens
tgttgcacagcagcaattgtt

SEQ ID NO: 3194353 - DNA, 16 bp, Homo sapiens
tgttgcattattcatt

SEQ ID NO: 3194354 - DNA, 19 bp, Homo sapiens
tgttgccaaatatgtcctg

SEQ ID NO: 3194355 - DNA, 19 bp, Homo sapiens
tgttgccaactaagccctc

SEQ ID NO: 3194356 - DNA, 20 bp, Homo sapiens
tgttgccaactaagccctcg

SEQ ID NO: 3194357 - DNA, 20 bp, Homo sapiens
tgttgccaagctccaagccc

SEQ ID NO: 3194358 - DNA, 14 bp, Homo sapiens
tgttgccaagctgg

SEQ ID NO: 3194359 - DNA, 19 bp, Homo sapiens
tgttgccatgtgcaccttg

SEQ ID NO: 3194360 - DNA, 15 bp, Homo sapiens
tgttgccctttctgt

SEQ ID NO: 3194361 - DNA, 18 bp, Homo sapiens
tgttgcctaattggaaag

SEQ ID NO: 3194362 - DNA, 16 bp, Homo sapiens
tgttgccttcatcttc

SEQ ID NO: 3194363 - DNA, 18 bp, Homo sapiens
tgttgcctttatggtttc

SEQ ID NO: 3194364 - DNA, 14 bp, Homo sapiens
tgttgcgttccttt

SEQ ID NO: 3194365 - DNA, 23 bp, Homo sapiens
tgttgctaaaaaaagtgcatgat

SEQ ID NO: 3194366 - DNA, 23 bp, Homo sapiens
tgttgctcaaatctattcagaca

SEQ ID NO: 3194367 - DNA, 23 bp, Homo sapiens
tgttgctcagcaaggggctctgc

SEQ ID NO: 3194368 - DNA, 14 bp, Homo sapiens
tgttgctcagtctc

SEQ ID NO: 3194369 - DNA, 17 bp, Homo sapiens
tgttgctctaggaagac

SEQ ID NO: 3194370 - DNA, 13 bp, Homo sapiens
tgttgctcttgga

SEQ ID NO: 3194371 - DNA, 18 bp, Homo sapiens
tgttgctgctactgtctt

SEQ ID NO: 3194372 - DNA, 15 bp, Homo sapiens
tgttgctgtttagag

SEQ ID NO: 3194373 - DNA, 18 bp, Homo sapiens
tgttgcttagatgagggt

SEQ ID NO: 3194374 - DNA, 23 bp, Homo sapiens
tgttgcttagatgagggtgactg

SEQ ID NO: 3194375 - DNA, 20 bp, Homo sapiens
tgttgcttagtcacttattt

SEQ ID NO: 3194376 - DNA, 13 bp, Homo sapiens
tgttggaaaaaat

SEQ ID NO: 3194377 - DNA, 13 bp, Homo sapiens
tgttggaaaagaa

SEQ ID NO: 3194378 - DNA, 21 bp, Homo sapiens
tgttggacacctttaggttct

SEQ ID NO: 3194379 - DNA, 11 bp, Homo sapiens
tgttggatctt

SEQ ID NO: 3194380 - DNA, 21 bp, Homo sapiens
tgttggatcttcaatggcttt

SEQ ID NO: 3194381 - DNA, 13 bp, Homo sapiens
tgttggcacagaa

SEQ ID NO: 3194382 - DNA, 13 bp, Homo sapiens
tgttggcagctct

SEQ ID NO: 3194383 - DNA, 12 bp, Homo sapiens
tgttggcaggct

SEQ ID NO: 3194384 - DNA, 21 bp, Homo sapiens
tgttggcagtgagtgagcctg

SEQ ID NO: 3194385 - DNA, 17 bp, Homo sapiens
tgttggcatagctctgg

SEQ ID NO: 3194386 - DNA, 16 bp, Homo sapiens
tgttggccaggctggt

SEQ ID NO: 3194387 - DNA, 22 bp, Homo sapiens
tgttggctacacagacccctcc

SEQ ID NO: 3194388 - DNA, 15 bp, Homo sapiens
tgttggctatttgaa

SEQ ID NO: 3194389 - DNA, 16 bp, Homo sapiens
tgttggctatttgaaa

SEQ ID NO: 3194390 - DNA, 17 bp, Homo sapiens
tgttggctatttgaaat

SEQ ID NO: 3194391 - DNA, 19 bp, Homo sapiens
tgttggctgggggcctcag

SEQ ID NO: 3194392 - DNA, 17 bp, Homo sapiens
tgtttacatttgatgca

SEQ ID NO: 3194393 - DNA, 12 bp, Homo sapiens
tgtttactgaaa

SEQ ID NO: 3194394 - DNA, 22 bp, Homo sapiens
tgtttagagtaaataaactgtt

SEQ ID NO: 3194395 - DNA, 13 bp, Homo sapiens
tgtttagcagaac

SEQ ID NO: 3194396 - DNA, 17 bp, Homo sapiens
tgtttaggggtgaagga

SEQ ID NO: 3194397 - DNA, 13 bp, Homo sapiens
tgtttagtggaaa

SEQ ID NO: 3194398 - DNA, 14 bp, Homo sapiens
tgtttagttgcaga

SEQ ID NO: 3194399 - DNA, 17 bp, Homo sapiens
tgtttataatctgaaga

SEQ ID NO: 3194400 - DNA, 18 bp, Homo sapiens
tgtttataatctgaagat

SEQ ID NO: 3194401 - DNA, 19 bp, Homo sapiens
tgtttatatggcgttttgt

SEQ ID NO: 3194402 - DNA, 20 bp, Homo sapiens
tgtttatatggcgttttgtc

SEQ ID NO: 3194403 - DNA, 15 bp, Homo sapiens
tgtttatcagataca

SEQ ID NO: 3194404 - DNA, 16 bp, Homo sapiens
tgtttatcagatacat

SEQ ID NO: 3194405 - DNA, 17 bp, Homo sapiens
tgtttatcagatacatc

SEQ ID NO: 3194406 - DNA, 19 bp, Homo sapiens
tgtttatcagatacatcac

SEQ ID NO: 3194407 - DNA, 23 bp, Homo sapiens
tgtttatcagatacatcactgct

SEQ ID NO: 3194408 - DNA, 12 bp, Homo sapiens
tgtttatgaaaa

SEQ ID NO: 3194409 - DNA, 13 bp, Homo sapiens
tgtttatgaaaat

SEQ ID NO: 3194410 - DNA, 19 bp, Homo sapiens
tgtttatgatatttcttgc

SEQ ID NO: 3194411 - DNA, 22 bp, Homo sapiens
tgtttatgatatttcttgcttt

SEQ ID NO: 3194412 - DNA, 17 bp, Homo sapiens
tgtttatggccacattt

SEQ ID NO: 3194413 - DNA, 23 bp, Homo sapiens
tgtttatggcctcagctgcctca

SEQ ID NO: 3194414 - DNA, 16 bp, Homo sapiens
tgtttattaaatgctt

SEQ ID NO: 3194415 - DNA, 19 bp, Homo sapiens
tgtttattaacaaattatg

SEQ ID NO: 3194416 - DNA, 15 bp, Homo sapiens
tgtttattaatctta

SEQ ID NO: 3194417 - DNA, 14 bp, Homo sapiens
tgtttattacaatt

SEQ ID NO: 3194418 - DNA, 18 bp, Homo sapiens
tgtttattacaattttta

SEQ ID NO: 3194419 - DNA, 18 bp, Homo sapiens
tgtttattctaatatcca

SEQ ID NO: 3194420 - DNA, 17 bp, Homo sapiens
tgtttattcttctagag

SEQ ID NO: 3194421 - DNA, 23 bp, Homo sapiens
tgtttatttataagcagatttaa

SEQ ID NO: 3194422 - DNA, 22 bp, Homo sapiens
tgtttatttttatatagcttga

SEQ ID NO: 3194423 - DNA, 16 bp, Homo sapiens
tgtttatttttcatat

SEQ ID NO: 3194424 - DNA, 18 bp, Homo sapiens
tgtttatttttcatattg

SEQ ID NO: 3194425 - DNA, 19 bp, Homo sapiens
tgtttatttttcttgtctt

SEQ ID NO: 3194426 - DNA, 21 bp, Homo sapiens
tgtttcaagtggggctcgcca

SEQ ID NO: 3194427 - DNA, 16 bp, Homo sapiens
tgtttcaatcactgtc

SEQ ID NO: 3194428 - DNA, 15 bp, Homo sapiens
tgtttcaatctctga

SEQ ID NO: 3194429 - DNA, 23 bp, Homo sapiens
tgtttcacaccggaaggttttta

SEQ ID NO: 3194430 - DNA, 18 bp, Homo sapiens
tgtttccaacctggagta

SEQ ID NO: 3194431 - DNA, 18 bp, Homo sapiens
tgtttccagcagaagaca

SEQ ID NO: 3194432 - DNA, 16 bp, Homo sapiens
tgtttccatcatttct

SEQ ID NO: 3194433 - DNA, 22 bp, Homo sapiens
tgtttcccataattttcttcat

SEQ ID NO: 3194434 - DNA, 20 bp, Homo sapiens
tgtttccctacttgataata

SEQ ID NO: 3194435 - DNA, 20 bp, Homo sapiens
tgtttccctttcactggcat

SEQ ID NO: 3194436 - DNA, 13 bp, Homo sapiens
tgtttcctctaaa

SEQ ID NO: 3194437 - DNA, 15 bp, Homo sapiens
tgtttcctcttccaa

SEQ ID NO: 3194438 - DNA, 21 bp, Homo sapiens
tgtttccttgttggtcagagg

SEQ ID NO: 3194439 - DNA, 23 bp, Homo sapiens
tgtttccttgtttatcagataca

SEQ ID NO: 3194440 - DNA, 15 bp, Homo sapiens
tgtttcgtggggagg

SEQ ID NO: 3194441 - DNA, 14 bp, Homo sapiens
tgtttctagaacag

SEQ ID NO: 3194442 - DNA, 23 bp, Homo sapiens
tgtttctagttgaggagtttcct

SEQ ID NO: 3194443 - DNA, 17 bp, Homo sapiens
tgtttctccccctgggc

SEQ ID NO: 3194444 - DNA, 17 bp, Homo sapiens
tgtttctccttctgaaa

SEQ ID NO: 3194445 - DNA, 15 bp, Homo sapiens
tgtttctctgctgtt

SEQ ID NO: 3194446 - DNA, 21 bp, Homo sapiens
tgtttctgaaaattccagaaa

SEQ ID NO: 3194447 - DNA, 17 bp, Homo sapiens
tgtttctgacccactga

SEQ ID NO: 3194448 - DNA, 17 bp, Homo sapiens
tgtttctgagaaaagaa

SEQ ID NO: 3194449 - DNA, 17 bp, Homo sapiens
tgtttctggatttcata

SEQ ID NO: 3194450 - DNA, 14 bp, Homo sapiens
tgtttctgttatta

SEQ ID NO: 3194451 - DNA, 15 bp, Homo sapiens
tgtttctgttccaaa

SEQ ID NO: 3194452 - DNA, 21 bp, Homo sapiens
tgtttcttcctgttaatgtat

SEQ ID NO: 3194453 - DNA, 20 bp, Homo sapiens
tgttttcatggtgaaaatgt

SEQ ID NO: 3194454 - DNA, 18 bp, Homo sapiens
tgttttcattatgttcat

SEQ ID NO: 3194455 - DNA, 17 bp, Homo sapiens
tgttttcattccccctt

SEQ ID NO: 3194456 - DNA, 12 bp, Homo sapiens
tgttttccctga

SEQ ID NO: 3194457 - DNA, 16 bp, Homo sapiens
tgttttccctgacctc

SEQ ID NO: 3194458 - DNA, 16 bp, Homo sapiens
tgttttctgactaatt

SEQ ID NO: 3194459 - DNA, 17 bp, Homo sapiens
tgttttctgactaatta

SEQ ID NO: 3194460 - DNA, 21 bp, Homo sapiens
tgttttcttgtaaatgtttct

SEQ ID NO: 3194461 - DNA, 21 bp, Homo sapiens
tgttttctttaaagatgtaat

SEQ ID NO: 3194462 - DNA, 20 bp, Homo sapiens
tgttttctttctttaaatgt

SEQ ID NO: 3194463 - DNA, 15 bp, Homo sapiens
tgttttgaatattac

SEQ ID NO: 3194464 - DNA, 21 bp, Homo sapiens
tgttttgaatattactcctat

SEQ ID NO: 3194465 - DNA, 18 bp, Homo sapiens
tgttttgcacagccaaat

SEQ ID NO: 3194466 - DNA, 12 bp, Homo sapiens
tgttttgcactt

SEQ ID NO: 3194467 - DNA, 20 bp, Homo sapiens
tgttttgccaaagactgtaa

SEQ ID NO: 3194468 - DNA, 15 bp, Homo sapiens
tgttttgcttttgtt

SEQ ID NO: 3194469 - DNA, 19 bp, Homo sapiens
tgttttggactccatctct

SEQ ID NO: 3194470 - DNA, 14 bp, Homo sapiens
tgttttgggtgaat

SEQ ID NO: 3194471 - DNA, 17 bp, Homo sapiens
tgttttgtacaattact

SEQ ID NO: 3194472 - DNA, 14 bp, Homo sapiens
tgttttgtatacaa

SEQ ID NO: 3194473 - DNA, 16 bp, Homo sapiens
tgttttgtatacaaat

SEQ ID NO: 3194474 - DNA, 17 bp, Homo sapiens
tgttttgtatacaaata

SEQ ID NO: 3194475 - DNA, 13 bp, Homo sapiens
tgttttgtgcatt

SEQ ID NO: 3194476 - DNA, 15 bp, Homo sapiens
tgttttgtgttgtgt

SEQ ID NO: 3194477 - DNA, 17 bp, Homo sapiens
tgttttgttctttaaag

SEQ ID NO: 3194478 - DNA, 13 bp, Homo sapiens
tgttttgtttgtc

SEQ ID NO: 3194479 - DNA, 14 bp, Homo sapiens
tgttttgtttgtct

SEQ ID NO: 3194480 - DNA, 16 bp, Homo sapiens
tgttttgtttgtctct

SEQ ID NO: 3194481 - DNA, 17 bp, Homo sapiens
tgtttttaagctgtttc

SEQ ID NO: 3194482 - DNA, 18 bp, Homo sapiens
tgtttttaggctgttcct

SEQ ID NO: 3194483 - DNA, 18 bp, Homo sapiens
tgtttttattaatttata

SEQ ID NO: 3194484 - DNA, 12 bp, Homo sapiens
tgtttttctcca

SEQ ID NO: 3194485 - DNA, 20 bp, Homo sapiens
tgtttttgaaacccacagtt

SEQ ID NO: 3194486 - DNA, 14 bp, Homo sapiens
tgtttttgggatgt

SEQ ID NO: 3194487 - DNA, 17 bp, Homo sapiens
tgtttttgggatgtctt

SEQ ID NO: 3194488 - DNA, 22 bp, Homo sapiens
tgtttttgtatttattaatttg

SEQ ID NO: 3194489 - DNA, 15 bp, Homo sapiens
tgttttttaaagcaa

SEQ ID NO: 3194490 - DNA, 17 bp, Homo sapiens
tgttttttatgaagtgc

SEQ ID NO: 3194491 - DNA, 13 bp, Homo sapiens
tgttttttccttt

SEQ ID NO: 3194492 - DNA, 16 bp, Homo sapiens
tgttttttgaaaacat

SEQ ID NO: 3194493 - DNA, 15 bp, Homo sapiens
tgttttttgtaacta

SEQ ID NO: 3194494 - DNA, 21 bp, Homo sapiens
tgttttttgtaactacaaagc

SEQ ID NO: 3194495 - DNA, 23 bp, Homo sapiens
tgttttttgttcaatgttccatt

SEQ ID NO: 3194496 - DNA, 22 bp, Homo sapiens
tgtttttttcctcatgtaacat

SEQ ID NO: 3194497 - DNA, 13 bp, Homo sapiens
ttaaaaaaaaaga

SEQ ID NO: 3194498 - DNA, 15 bp, Homo sapiens
ttaaaaaaacaaata

SEQ ID NO: 3194499 - DNA, 21 bp, Homo sapiens
ttaaaaaaattggttggagaa

SEQ ID NO: 3194500 - DNA, 20 bp, Homo sapiens
ttaaaaaacttcatgtaatt

SEQ ID NO: 3194501 - DNA, 21 bp, Homo sapiens
ttaaaaaatatttattaaata

SEQ ID NO: 3194502 - DNA, 14 bp, Homo sapiens
ttaaaaaatatttt

SEQ ID NO: 3194503 - DNA, 13 bp, Homo sapiens
ttaaaaaatctgt

SEQ ID NO: 3194504 - DNA, 12 bp, Homo sapiens
ttaaaaaatgaa

SEQ ID NO: 3194505 - DNA, 23 bp, Homo sapiens
ttaaaaaattatggaatatcatc

SEQ ID NO: 3194506 - DNA, 17 bp, Homo sapiens
ttaaaaaatttttgaaa

SEQ ID NO: 3194507 - DNA, 18 bp, Homo sapiens
ttaaaaactcttcagtgc

SEQ ID NO: 3194508 - DNA, 14 bp, Homo sapiens
ttaaaaagaaatct

SEQ ID NO: 3194509 - DNA, 12 bp, Homo sapiens
ttaaaaaggaaa

SEQ ID NO: 3194510 - DNA, 12 bp, Homo sapiens
ttaaaaaggcca

SEQ ID NO: 3194511 - DNA, 14 bp, Homo sapiens
ttaaaaaggccaaa

SEQ ID NO: 3194512 - DNA, 23 bp, Homo sapiens
ttaaaaagggcagggcatctcct

SEQ ID NO: 3194513 - DNA, 16 bp, Homo sapiens
ttaaaaagtactcttt

SEQ ID NO: 3194514 - DNA, 23 bp, Homo sapiens
ttaaaaagtccataccttatata

SEQ ID NO: 3194515 - DNA, 17 bp, Homo sapiens
ttaaaaagttgttcaac

SEQ ID NO: 3194516 - DNA, 20 bp, Homo sapiens
ttaaaaatatggaacttcta

SEQ ID NO: 3194517 - DNA, 22 bp, Homo sapiens
ttaaaaatatggaacttctaat

SEQ ID NO: 3194518 - DNA, 13 bp, Homo sapiens
ttaaaaatatttc

SEQ ID NO: 3194519 - DNA, 15 bp, Homo sapiens
ttaagtttcaaactt

SEQ ID NO: 3194520 - DNA, 22 bp, Homo sapiens
ttaagtttcaaacttactattt

SEQ ID NO: 3194521 - DNA, 15 bp, Homo sapiens
ttaagtttcaggata

SEQ ID NO: 3194522 - DNA, 15 bp, Homo sapiens
ttaataaaaatgaca

SEQ ID NO: 3194523 - DNA, 17 bp, Homo sapiens
ttaataaaaatgacaga

SEQ ID NO: 3194524 - DNA, 19 bp, Homo sapiens
ttaataaaaatgacagact

SEQ ID NO: 3194525 - DNA, 21 bp, Homo sapiens
ttaataaaactgcacagtgct

SEQ ID NO: 3194526 - DNA, 16 bp, Homo sapiens
ttaataaaataattct

SEQ ID NO: 3194527 - DNA, 14 bp, Homo sapiens
ttaataaagatgag

SEQ ID NO: 3194528 - DNA, 11 bp, Homo sapiens
ttaataaagca

SEQ ID NO: 3194529 - DNA, 13 bp, Homo sapiens
ttaataaagcatt

SEQ ID NO: 3194530 - DNA, 15 bp, Homo sapiens
ttaataaattgctta

SEQ ID NO: 3194531 - DNA, 20 bp, Homo sapiens
ttaataacaatatatagaat

SEQ ID NO: 3194532 - DNA, 23 bp, Homo sapiens
ttaataacaatatatagaattgt

SEQ ID NO: 3194533 - DNA, 12 bp, Homo sapiens
ttaataacaatt

SEQ ID NO: 3194534 - DNA, 13 bp, Homo sapiens
ttaataacattac

SEQ ID NO: 3194535 - DNA, 15 bp, Homo sapiens
ttaataacattacct

SEQ ID NO: 3194536 - DNA, 16 bp, Homo sapiens
ttaataacattacctt

SEQ ID NO: 3194537 - DNA, 17 bp, Homo sapiens
ttaataacattacctta

SEQ ID NO: 3194538 - DNA, 21 bp, Homo sapiens
ttaataacattaccttactgt

SEQ ID NO: 3194539 - DNA, 24 bp, Homo sapiens
ttaataatcagcaagaatttgatc

SEQ ID NO: 3194540 - DNA, 14 bp, Homo sapiens
ttaataatgtattg

SEQ ID NO: 3194541 - DNA, 22 bp, Homo sapiens
ttaataatgtattgtaatcttt

SEQ ID NO: 3194542 - DNA, 16 bp, Homo sapiens
ttaatacacagtactt

SEQ ID NO: 3194543 - DNA, 20 bp, Homo sapiens
ttaatacacagtactttatt

SEQ ID NO: 3194544 - DNA, 15 bp, Homo sapiens
ttaatactaaaatat

SEQ ID NO: 3194545 - DNA, 21 bp, Homo sapiens
ttaatactcaaatgagtaaca

SEQ ID NO: 3194546 - DNA, 20 bp, Homo sapiens
ttaatagaaataaattccta

SEQ ID NO: 3194547 - DNA, 16 bp, Homo sapiens
ttaatagcagcctttc

SEQ ID NO: 3194548 - DNA, 13 bp, Homo sapiens
ttaatagccctcc

SEQ ID NO: 3194549 - DNA, 20 bp, Homo sapiens
ttaatagcttttattgtata

SEQ ID NO: 3194550 - DNA, 16 bp, Homo sapiens
ttaatagtttgtctat

SEQ ID NO: 3194551 - DNA, 19 bp, Homo sapiens
ttaatagtttgtctatttt

SEQ ID NO: 3194552 - DNA, 15 bp, Homo sapiens
ttaatatatgtatta

SEQ ID NO: 3194553 - DNA, 16 bp, Homo sapiens
ttaatatattaaaatt

SEQ ID NO: 3194554 - DNA, 17 bp, Homo sapiens
ttaatatattgaataaa

SEQ ID NO: 3194555 - DNA, 15 bp, Homo sapiens
ttaatatgaaaactt

SEQ ID NO: 3194556 - DNA, 13 bp, Homo sapiens
ttaatattattat

SEQ ID NO: 3194557 - DNA, 10 bp, Homo sapiens
ttaatcaaag

SEQ ID NO: 3194558 - DNA, 18 bp, Homo sapiens
ttaatcaaaggcatatct

SEQ ID NO: 3194559 - DNA, 19 bp, Homo sapiens
ttaatcaaaggcatatctt

SEQ ID NO: 3194560 - DNA, 17 bp, Homo sapiens
ttaatcaagttgaattg

SEQ ID NO: 3194561 - DNA, 22 bp, Homo sapiens
ttaatcaatcatgccctgcctt

SEQ ID NO: 3194562 - DNA, 20 bp, Homo sapiens
ttaatcaccttctttgtaat

SEQ ID NO: 3194563 - DNA, 17 bp, Homo sapiens
ttaatcactattgttcc

SEQ ID NO: 3194564 - DNA, 19 bp, Homo sapiens
ttaatcagaatatcagaat

SEQ ID NO: 3194565 - DNA, 20 bp, Homo sapiens
ttaatcaggtcctcagagaa

SEQ ID NO: 3194566 - DNA, 18 bp, Homo sapiens
ttaatcatctataaagaa

SEQ ID NO: 3194567 - DNA, 15 bp, Homo sapiens
ttaatcattttcatt

SEQ ID NO: 3194568 - DNA, 12 bp, Homo sapiens
ttaatccaatgg

SEQ ID NO: 3194569 - DNA, 19 bp, Homo sapiens
ttaatccagttataagaag

SEQ ID NO: 3194570 - DNA, 21 bp, Homo sapiens
ttaatccctatgtttgtctca

SEQ ID NO: 3194571 - DNA, 18 bp, Homo sapiens
ttaatcctgtaccaaatc

SEQ ID NO: 3194572 - DNA, 21 bp, Homo sapiens
ttaatcctgtaccaaatctga

SEQ ID NO: 3194573 - DNA, 23 bp, Homo sapiens
ttaatcctttgttttctgactaa

SEQ ID NO: 3194574 - DNA, 14 bp, Homo sapiens
ttaatctctgttat

SEQ ID NO: 3194575 - DNA, 20 bp, Homo sapiens
ttaatctctgttatgtactg

SEQ ID NO: 3194576 - DNA, 21 bp, Homo sapiens
ttaatctctgttatgtactgt

SEQ ID NO: 3194577 - DNA, 18 bp, Homo sapiens
ttaatctgaaattctaaa

SEQ ID NO: 3194578 - DNA, 23 bp, Homo sapiens
ttaatctgaaattctaaagagca

SEQ ID NO: 3194579 - DNA, 20 bp, Homo sapiens
ttaatctgggcagacattat

SEQ ID NO: 3194580 - DNA, 13 bp, Homo sapiens
ttaatctgtgtgt

SEQ ID NO: 3194581 - DNA, 21 bp, Homo sapiens
ttaatcttagtgtatgattac

SEQ ID NO: 3194582 - DNA, 22 bp, Homo sapiens
ttaatcttcagttttatcttta

SEQ ID NO: 3194583 - DNA, 20 bp, Homo sapiens
ttaatcttttcttatttttg

SEQ ID NO: 3194584 - DNA, 14 bp, Homo sapiens
ttaatgaaaatgtc

SEQ ID NO: 3194585 - DNA, 15 bp, Homo sapiens
ttaatgaaaatgtca

SEQ ID NO: 3194586 - DNA, 19 bp, Homo sapiens
ttaatgaaagactgtacaa

SEQ ID NO: 3194587 - DNA, 16 bp, Homo sapiens
ttaatgacaacactta

SEQ ID NO: 3194588 - DNA, 19 bp, Homo sapiens
ttaatgacaacacttaata

SEQ ID NO: 3194589 - DNA, 14 bp, Homo sapiens
ttaatgacaatatt

SEQ ID NO: 3194590 - DNA, 16 bp, Homo sapiens
ttaatgagccatcact

SEQ ID NO: 3194591 - DNA, 22 bp, Homo sapiens
ttaatgcagttgcttactaaag

SEQ ID NO: 3194592 - DNA, 18 bp, Homo sapiens
ttaatgcatctagattat

SEQ ID NO: 3194593 - DNA, 22 bp, Homo sapiens
ttaatgcattaaacctgtctcc

SEQ ID NO: 3194594 - DNA, 23 bp, Homo sapiens
ttaatgcattaaacctgtctcca

SEQ ID NO: 3194595 - DNA, 18 bp, Homo sapiens
ttaattttaaagtgcaaa

SEQ ID NO: 3194596 - DNA, 22 bp, Homo sapiens
ttaattttaccaagagtaactt

SEQ ID NO: 3194597 - DNA, 13 bp, Homo sapiens
ttaattttcctgg

SEQ ID NO: 3194598 - DNA, 19 bp, Homo sapiens
ttaattttgaagtgctgtt

SEQ ID NO: 3194599 - DNA, 17 bp, Homo sapiens
ttaattttgatatacat

SEQ ID NO: 3194600 - DNA, 14 bp, Homo sapiens
ttaattttgtgcat

SEQ ID NO: 3194601 - DNA, 16 bp, Homo sapiens
ttaattttgtgcattc

SEQ ID NO: 3194602 - DNA, 22 bp, Homo sapiens
ttaattttgtgcattctttggt

SEQ ID NO: 3194603 - DNA, 16 bp, Homo sapiens
ttaattttgtgttgct

SEQ ID NO: 3194604 - DNA, 19 bp, Homo sapiens
ttaatttttttgagacaga

SEQ ID NO: 3194605 - DNA, 16 bp, Homo sapiens
ttaattttttttaatg

SEQ ID NO: 3194606 - DNA, 17 bp, Homo sapiens
ttaattttttttaatgt

SEQ ID NO: 3194607 - DNA, 18 bp, Homo sapiens
ttaattttttttaatgta

SEQ ID NO: 3194608 - DNA, 17 bp, Homo sapiens
ttacaaaactacatgag

SEQ ID NO: 3194609 - DNA, 20 bp, Homo sapiens
ttacaaaagaaataccttga

SEQ ID NO: 3194610 - DNA, 13 bp, Homo sapiens
ttacaaactacag

SEQ ID NO: 3194611 - DNA, 12 bp, Homo sapiens
ttacaaactgca

SEQ ID NO: 3194612 - DNA, 15 bp, Homo sapiens
ttacaaactgcaata

SEQ ID NO: 3194613 - DNA, 21 bp, Homo sapiens
ttacaaactgcaatagagact

SEQ ID NO: 3194614 - DNA, 14 bp, Homo sapiens
ttacaaagcagtta

SEQ ID NO: 3194615 - DNA, 16 bp, Homo sapiens
ttacaaagcagttact

SEQ ID NO: 3194616 - DNA, 14 bp, Homo sapiens
ttacaaagttatat

SEQ ID NO: 3194617 - DNA, 22 bp, Homo sapiens
ttacaaataaaattggcaccat

SEQ ID NO: 3194618 - DNA, 22 bp, Homo sapiens
ttacaaatcagaagtcatcttg

SEQ ID NO: 3194619 - DNA, 15 bp, Homo sapiens
ttacaacattcaact

SEQ ID NO: 3194620 - DNA, 20 bp, Homo sapiens
ttacaacgaatttacagtct

SEQ ID NO: 3194621 - DNA, 20 bp, Homo sapiens
ttacaagaagtttattctca

SEQ ID NO: 3194622 - DNA, 21 bp, Homo sapiens
ttacaagatccatttgccttt

SEQ ID NO: 3194623 - DNA, 17 bp, Homo sapiens
ttacaataggagtggtg

SEQ ID NO: 3194624 - DNA, 20 bp, Homo sapiens
ttacaataggtgcttattct

SEQ ID NO: 3194625 - DNA, 14 bp, Homo sapiens
ttacaatcaaatct

SEQ ID NO: 3194626 - DNA, 12 bp, Homo sapiens
ttacaattacat

SEQ ID NO: 3194627 - DNA, 15 bp, Homo sapiens
ttacaattacatctc

SEQ ID NO: 3194628 - DNA, 13 bp, Homo sapiens
ttacaattttatc

SEQ ID NO: 3194629 - DNA, 15 bp, Homo sapiens
ttacaattttttatc

SEQ ID NO: 3194630 - DNA, 18 bp, Homo sapiens
ttacacaaatgtgatttt

SEQ ID NO: 3194631 - DNA, 15 bp, Homo sapiens
ttacacaattaattc

SEQ ID NO: 3194632 - DNA, 18 bp, Homo sapiens
ttacacatctcagaccct

SEQ ID NO: 3194633 - DNA, 16 bp, Homo sapiens
ttacacattagatttt

SEQ ID NO: 3194634 - DNA, 16 bp, Homo sapiens
ttacacatttgtacag

SEQ ID NO: 3194635 - DNA, 14 bp, Homo sapiens
ttacaccacacttt

SEQ ID NO: 3194636 - DNA, 18 bp, Homo sapiens
ttacaccgactagccagg

SEQ ID NO: 3194637 - DNA, 15 bp, Homo sapiens
ttacactctttgtaa

SEQ ID NO: 3194638 - DNA, 18 bp, Homo sapiens
ttacactgcctgtatact

SEQ ID NO: 3194639 - DNA, 19 bp, Homo sapiens
ttacactgcctgtatactt

SEQ ID NO: 3194640 - DNA, 21 bp, Homo sapiens
ttacactgcctgtatacttta

SEQ ID NO: 3194641 - DNA, 21 bp, Homo sapiens
ttacacttggagcccgtgcag

SEQ ID NO: 3194642 - DNA, 20 bp, Homo sapiens
ttacactttatgcacaaaat

SEQ ID NO: 3194643 - DNA, 15 bp, Homo sapiens
ttacagaaaaatctt

SEQ ID NO: 3194644 - DNA, 22 bp, Homo sapiens
ttacagagaggagaaacacatc

SEQ ID NO: 3194645 - DNA, 15 bp, Homo sapiens
ttacagatgtgaaaa

SEQ ID NO: 3194646 - DNA, 20 bp, Homo sapiens
ttacagcaagtagataaata

SEQ ID NO: 3194647 - DNA, 19 bp, Homo sapiens
ttacagcattgtctttgct

SEQ ID NO: 3194648 - DNA, 20 bp, Homo sapiens
ttacagcattgtctttgctg

SEQ ID NO: 3194649 - DNA, 15 bp, Homo sapiens
ttacagctttacaca

SEQ ID NO: 3194650 - DNA, 21 bp, Homo sapiens
ttacaggaaaaaaaattctgt

SEQ ID NO: 3194651 - DNA, 17 bp, Homo sapiens
ttacaggaatgaagaac

SEQ ID NO: 3194652 - DNA, 20 bp, Homo sapiens
ttacaggaatgaagaactgt

SEQ ID NO: 3194653 - DNA, 17 bp, Homo sapiens
ttacaggcaccgagaat

SEQ ID NO: 3194654 - DNA, 20 bp, Homo sapiens
ttacaggcatgagccactgc

SEQ ID NO: 3194655 - DNA, 11 bp, Homo sapiens
ttacaggccct

SEQ ID NO: 3194656 - DNA, 18 bp, Homo sapiens
ttacagggagcctcctgc

SEQ ID NO: 3194657 - DNA, 15 bp, Homo sapiens
ttacagggtgactca

SEQ ID NO: 3194658 - DNA, 14 bp, Homo sapiens
ttacaggtgtgaac

SEQ ID NO: 3194659 - DNA, 19 bp, Homo sapiens
ttacagtaactaattttgt

SEQ ID NO: 3194660 - DNA, 21 bp, Homo sapiens
ttacagtacacatccccagaa

SEQ ID NO: 3194661 - DNA, 17 bp, Homo sapiens
ttacagtcaattttaca

SEQ ID NO: 3194662 - DNA, 20 bp, Homo sapiens
ttacagtgaaaatgtaagct

SEQ ID NO: 3194663 - DNA, 18 bp, Homo sapiens
ttacagtgcagacaggcc

SEQ ID NO: 3194664 - DNA, 18 bp, Homo sapiens
ttacagttaaagaagcaa

SEQ ID NO: 3194665 - DNA, 19 bp, Homo sapiens
ttacagttagggttttgca

SEQ ID NO: 3194666 - DNA, 22 bp, Homo sapiens
ttacagttagggttttgcaata

SEQ ID NO: 3194667 - DNA, 14 bp, Homo sapiens
ttacagttctgtgg

SEQ ID NO: 3194668 - DNA, 22 bp, Homo sapiens
ttacagttctgtggtttcatgt

SEQ ID NO: 3194669 - DNA, 16 bp, Homo sapiens
ttacataagaaatgta

SEQ ID NO: 3194670 - DNA, 23 bp, Homo sapiens
ttacataatcagtatatttggtt

SEQ ID NO: 3194671 - DNA, 21 bp, Homo sapiens
ttacataatttagttgtttct

SEQ ID NO: 3194672 - DNA, 22 bp, Homo sapiens
ttacataatttagttgtttcta

SEQ ID NO: 3194673 - DNA, 13 bp, Homo sapiens
ttacatacagatt

SEQ ID NO: 3194674 - DNA, 15 bp, Homo sapiens
ttacatacttttgca

SEQ ID NO: 3194675 - DNA, 22 bp, Homo sapiens
ttacttttaaatgcaatctctt

SEQ ID NO: 3194676 - DNA, 18 bp, Homo sapiens
ttacttttttatagctta

SEQ ID NO: 3194677 - DNA, 23 bp, Homo sapiens
ttagaaaagggagtttaaaaatg

SEQ ID NO: 3194678 - DNA, 22 bp, Homo sapiens
ttagaaaatgacttatttctgc

SEQ ID NO: 3194679 - DNA, 13 bp, Homo sapiens
ttagaaaatgtgt

SEQ ID NO: 3194680 - DNA, 15 bp, Homo sapiens
ttagaaacacataaa

SEQ ID NO: 3194681 - DNA, 17 bp, Homo sapiens
ttagaaacatggttttg

SEQ ID NO: 3194682 - DNA, 20 bp, Homo sapiens
ttagaaacctcattggccag

SEQ ID NO: 3194683 - DNA, 16 bp, Homo sapiens
ttagaaactgatttct

SEQ ID NO: 3194684 - DNA, 22 bp, Homo sapiens
ttagaaagaagcccaatattat

SEQ ID NO: 3194685 - DNA, 17 bp, Homo sapiens
ttagaaagcaacttatc

SEQ ID NO: 3194686 - DNA, 11 bp, Homo sapiens
ttagaaatata

SEQ ID NO: 3194687 - DNA, 17 bp, Homo sapiens
ttagaaatgtaaactgc

SEQ ID NO: 3194688 - DNA, 20 bp, Homo sapiens
ttagaaatgtaaactgccat

SEQ ID NO: 3194689 - DNA, 17 bp, Homo sapiens
ttagaaattgcatttcc

SEQ ID NO: 3194690 - DNA, 14 bp, Homo sapiens
ttagaaatttaaca

SEQ ID NO: 3194691 - DNA, 13 bp, Homo sapiens
ttagaacactatt

SEQ ID NO: 3194692 - DNA, 20 bp, Homo sapiens
ttagaacactattttcagaa

SEQ ID NO: 3194693 - DNA, 13 bp, Homo sapiens
ttagaacatttaa

SEQ ID NO: 3194694 - DNA, 20 bp, Homo sapiens
ttagaaccagccgtatttta

SEQ ID NO: 3194695 - DNA, 12 bp, Homo sapiens
ttagaagagagc

SEQ ID NO: 3194696 - DNA, 23 bp, Homo sapiens
ttagaagcctgcataatgtttct

SEQ ID NO: 3194697 - DNA, 20 bp, Homo sapiens
ttagaaggcttaagaactgc

SEQ ID NO: 3194698 - DNA, 16 bp, Homo sapiens
ttagaagtcacacagt

SEQ ID NO: 3194699 - DNA, 18 bp, Homo sapiens
ttagaatccaaacttgga

SEQ ID NO: 3194700 - DNA, 22 bp, Homo sapiens
ttagaatccaaacttggatttt

SEQ ID NO: 3194701 - DNA, 12 bp, Homo sapiens
ttagaattattt

SEQ ID NO: 3194702 - DNA, 13 bp, Homo sapiens
ttagaattattta

SEQ ID NO: 3194703 - DNA, 15 bp, Homo sapiens
ttagaattatttaaa

SEQ ID NO: 3194704 - DNA, 11 bp, Homo sapiens
ttagacagagt

SEQ ID NO: 3194705 - DNA, 13 bp, Homo sapiens
ttagacagagtct

SEQ ID NO: 3194706 - DNA, 12 bp, Homo sapiens
ttagaccaagga

SEQ ID NO: 3194707 - DNA, 19 bp, Homo sapiens
ttagaccagaggtctagat

SEQ ID NO: 3194708 - DNA, 13 bp, Homo sapiens
ttagaccctgggt

SEQ ID NO: 3194709 - DNA, 22 bp, Homo sapiens
ttagaccgctctcttttctgta

SEQ ID NO: 3194710 - DNA, 15 bp, Homo sapiens
ttagactcaaagaat

SEQ ID NO: 3194711 - DNA, 23 bp, Homo sapiens
ttagactgtaggaagagtagcat

SEQ ID NO: 3194712 - DNA, 18 bp, Homo sapiens
ttagactgtgattcagaa

SEQ ID NO: 3194713 - DNA, 21 bp, Homo sapiens
ttagacttcgactcaggatcc

SEQ ID NO: 3194714 - DNA, 16 bp, Homo sapiens
ttagacttctaaataa

SEQ ID NO: 3194715 - DNA, 18 bp, Homo sapiens
ttagactttagaaataaa

SEQ ID NO: 3194716 - DNA, 10 bp, Homo sapiens
ttatattctt

SEQ ID NO: 3194717 - DNA, 13 bp, Homo sapiens
ttatattgcaatg

SEQ ID NO: 3194718 - DNA, 18 bp, Homo sapiens
ttatatttaaaaattgtt

SEQ ID NO: 3194719 - DNA, 22 bp, Homo sapiens
ttatatttagttatagtttcag

SEQ ID NO: 3194720 - DNA, 19 bp, Homo sapiens
ttatatttatatttcaggt

SEQ ID NO: 3194721 - DNA, 18 bp, Homo sapiens
ttatatttcacaggctgt

SEQ ID NO: 3194722 - DNA, 20 bp, Homo sapiens
ttatatttcacaggctgtaa

SEQ ID NO: 3194723 - DNA, 11 bp, Homo sapiens
ttatatttcca

SEQ ID NO: 3194724 - DNA, 20 bp, Homo sapiens
ttatatttccctaaaataca

SEQ ID NO: 3194725 - DNA, 15 bp, Homo sapiens
ttatatttgtaggag

SEQ ID NO: 3194726 - DNA, 14 bp, Homo sapiens
ttatatttgtgtat

SEQ ID NO: 3194727 - DNA, 20 bp, Homo sapiens
ttatattttcgtatgaaaat

SEQ ID NO: 3194728 - DNA, 20 bp, Homo sapiens
ttatattttgctgtttatga

SEQ ID NO: 3194729 - DNA, 19 bp, Homo sapiens
ttatatttttgtacatatt

SEQ ID NO: 3194730 - DNA, 21 bp, Homo sapiens
ttatcaaaaaaagactcagcc

SEQ ID NO: 3194731 - DNA, 15 bp, Homo sapiens
ttatcaaaactttct

SEQ ID NO: 3194732 - DNA, 18 bp, Homo sapiens
ttatcaaaccctagcctt

SEQ ID NO: 3194733 - DNA, 21 bp, Homo sapiens
ttatcaaaccctagccttgct

SEQ ID NO: 3194734 - DNA, 15 bp, Homo sapiens
ttatcaaagcataga

SEQ ID NO: 3194735 - DNA, 22 bp, Homo sapiens
ttatcaagtttgggtctgtgct

SEQ ID NO: 3194736 - DNA, 15 bp, Homo sapiens
ttatcaatatctaat

SEQ ID NO: 3194737 - DNA, 16 bp, Homo sapiens
ttatcaatatctaata

SEQ ID NO: 3194738 - DNA, 23 bp, Homo sapiens
ttatcaatgtgtctttctaagaa

SEQ ID NO: 3194739 - DNA, 19 bp, Homo sapiens
ttatcaattacaacagtga

SEQ ID NO: 3194740 - DNA, 18 bp, Homo sapiens
ttatcacattatttgcat

SEQ ID NO: 3194741 - DNA, 14 bp, Homo sapiens
ttatcagatacatc

SEQ ID NO: 3194742 - DNA, 23 bp, Homo sapiens
ttatcagtcataactaaataaag

SEQ ID NO: 3194743 - DNA, 13 bp, Homo sapiens
ttatcagtttcca

SEQ ID NO: 3194744 - DNA, 17 bp, Homo sapiens
ttatcatatccttgccc

SEQ ID NO: 3194745 - DNA, 18 bp, Homo sapiens
ttatcatgaattttaaag

SEQ ID NO: 3194746 - DNA, 15 bp, Homo sapiens
ttatccaaaatgtgt

SEQ ID NO: 3194747 - DNA, 22 bp, Homo sapiens
ttatccaaaatgtgtatttctt

SEQ ID NO: 3194748 - DNA, 20 bp, Homo sapiens
ttattaaatacaaaacttcc

SEQ ID NO: 3194749 - DNA, 15 bp, Homo sapiens
ttattaaatgcttca

SEQ ID NO: 3194750 - DNA, 17 bp, Homo sapiens
ttattaaattgtaaaac

SEQ ID NO: 3194751 - DNA, 16 bp, Homo sapiens
ttattaactacattta

SEQ ID NO: 3194752 - DNA, 22 bp, Homo sapiens
ttattaagtctgggatgtagaa

SEQ ID NO: 3194753 - DNA, 15 bp, Homo sapiens
ttattaataaaacaa

SEQ ID NO: 3194754 - DNA, 13 bp, Homo sapiens
ttattaatataat

SEQ ID NO: 3194755 - DNA, 11 bp, Homo sapiens
ttattaatatt

SEQ ID NO: 3194756 - DNA, 18 bp, Homo sapiens
ttattaatatttaacatt

SEQ ID NO: 3194757 - DNA, 13 bp, Homo sapiens
ttattaatcacta

SEQ ID NO: 3194758 - DNA, 17 bp, Homo sapiens
ttattaatcttagtgta

SEQ ID NO: 3194759 - DNA, 12 bp, Homo sapiens
ttattaatgttt

SEQ ID NO: 3194760 - DNA, 14 bp, Homo sapiens
ttattaatttgaaa

SEQ ID NO: 3194761 - DNA, 21 bp, Homo sapiens
ttattacaatttgtattactt

SEQ ID NO: 3194762 - DNA, 18 bp, Homo sapiens
ttattacatgtaatttga

SEQ ID NO: 3194763 - DNA, 19 bp, Homo sapiens
ttattacatttaaatcctt

SEQ ID NO: 3194764 - DNA, 20 bp, Homo sapiens
ttattaccccctccttcaga

SEQ ID NO: 3194765 - DNA, 12 bp, Homo sapiens
ttattacctctg

SEQ ID NO: 3194766 - DNA, 16 bp, Homo sapiens
ttattagccagtgaaa

SEQ ID NO: 3194767 - DNA, 13 bp, Homo sapiens
ttattataaaaat

SEQ ID NO: 3194768 - DNA, 16 bp, Homo sapiens
ttattatctaaagtgt

SEQ ID NO: 3194769 - DNA, 22 bp, Homo sapiens
ttattatctaaagtgtgttgtt

SEQ ID NO: 3194770 - DNA, 17 bp, Homo sapiens
ttattatggcttgtgaa

SEQ ID NO: 3194771 - DNA, 18 bp, Homo sapiens
ttattatggcttgtgaac

SEQ ID NO: 3194772 - DNA, 21 bp, Homo sapiens
ttattatgtttattacaattt

SEQ ID NO: 3194773 - DNA, 15 bp, Homo sapiens
ttattattgctgaag

SEQ ID NO: 3194774 - DNA, 22 bp, Homo sapiens
ttattatttgtgttttaattta

SEQ ID NO: 3194775 - DNA, 22 bp, Homo sapiens
ttcaaaacattccaagaaaggt

SEQ ID NO: 3194776 - DNA, 16 bp, Homo sapiens
ttcaaaagaagagttt

SEQ ID NO: 3194777 - DNA, 16 bp, Homo sapiens
ttcaaaagagtagaaa

SEQ ID NO: 3194778 - DNA, 21 bp, Homo sapiens
ttcaaaagccataacttgaaa

SEQ ID NO: 3194779 - DNA, 12 bp, Homo sapiens
ttcaaaagttcc

SEQ ID NO: 3194780 - DNA, 15 bp, Homo sapiens
ttcaaaagttccaag

SEQ ID NO: 3194781 - DNA, 16 bp, Homo sapiens
ttcaaaagttccaaga

SEQ ID NO: 3194782 - DNA, 20 bp, Homo sapiens
ttcaaaatgctttttattat

SEQ ID NO: 3194783 - DNA, 23 bp, Homo sapiens
ttcaaaatgttatcttctcaagt

SEQ ID NO: 3194784 - DNA, 17 bp, Homo sapiens
ttcaaaattaaatctgt

SEQ ID NO: 3194785 - DNA, 16 bp, Homo sapiens
ttcaaacacaatggag

SEQ ID NO: 3194786 - DNA, 16 bp, Homo sapiens
ttcaaactgcactttt

SEQ ID NO: 3194787 - DNA, 13 bp, Homo sapiens
ttcaaactgtgaa

SEQ ID NO: 3194788 - DNA, 21 bp, Homo sapiens
ttcaaagagatgggccttttc

SEQ ID NO: 3194789 - DNA, 23 bp, Homo sapiens
ttcaaagagatgggccttttctt

SEQ ID NO: 3194790 - DNA, 12 bp, Homo sapiens
ttcaaagatgct

SEQ ID NO: 3194791 - DNA, 13 bp, Homo sapiens
ttcaaagatgctg

SEQ ID NO: 3194792 - DNA, 13 bp, Homo sapiens
ttcaaagccacat

SEQ ID NO: 3194793 - DNA, 16 bp, Homo sapiens
ttcaaagctaaaatat

SEQ ID NO: 3194794 - DNA, 16 bp, Homo sapiens
ttcaaaggttctaggt

SEQ ID NO: 3194795 - DNA, 21 bp, Homo sapiens
ttcaaaggttctaggtttcaa

SEQ ID NO: 3194796 - DNA, 22 bp, Homo sapiens
ttcaaagtaaaggcctcctccc

SEQ ID NO: 3194797 - DNA, 13 bp, Homo sapiens
ttcaaagtgtata

SEQ ID NO: 3194798 - DNA, 23 bp, Homo sapiens
tgggcccaggaccagctggggcg

SEQ ID NO: 3194799 - DNA, 21 bp, Homo sapiens
tgggccccatgctctgcccca

SEQ ID NO: 3194800 - DNA, 17 bp, Homo sapiens
tgggccccgccttcctg

SEQ ID NO: 3194801 - DNA, 14 bp, Homo sapiens
tgggcccctcaaca

SEQ ID NO: 3194802 - DNA, 20 bp, Homo sapiens
tgggcccctcaacagccaag

SEQ ID NO: 3194803 - DNA, 16 bp, Homo sapiens
tgggcccctcagagcc

SEQ ID NO: 3194804 - DNA, 18 bp, Homo sapiens
tgggcccctccacgcctc

SEQ ID NO: 3194805 - DNA, 22 bp, Homo sapiens
tgggcccctccacgcctcctgg

SEQ ID NO: 3194806 - DNA, 17 bp, Homo sapiens
tgggcccctcttattcc

SEQ ID NO: 3194807 - DNA, 13 bp, Homo sapiens
tgggccctctctt

SEQ ID NO: 3194808 - DNA, 23 bp, Homo sapiens
tgggccctctttccctgcgagac

SEQ ID NO: 3194809 - DNA, 11 bp, Homo sapiens
tgggccctgga

SEQ ID NO: 3194810 - DNA, 17 bp, Homo sapiens
tgggccctgggctggaa

SEQ ID NO: 3194811 - DNA, 19 bp, Homo sapiens
tgggccgaatcccccaggg

SEQ ID NO: 3194812 - DNA, 14 bp, Homo sapiens
tgggccgctgccac

SEQ ID NO: 3194813 - DNA, 16 bp, Homo sapiens
tgggcctcaaggactt

SEQ ID NO: 3194814 - DNA, 16 bp, Homo sapiens
tgggcctcaggctctg

SEQ ID NO: 3194815 - DNA, 22 bp, Homo sapiens
tgggcctcccttgggctggaag

SEQ ID NO: 3194816 - DNA, 20 bp, Homo sapiens
tgggcctgcccaatgctttg

SEQ ID NO: 3194817 - DNA, 18 bp, Homo sapiens
tgggcctgcttttccagg

SEQ ID NO: 3194818 - DNA, 22 bp, Homo sapiens
tgggcctgcttttccaggatcc

SEQ ID NO: 3194819 - DNA, 23 bp, Homo sapiens
tgggcctgcttttccaggatcct

SEQ ID NO: 3194820 - DNA, 13 bp, Homo sapiens
tgggcctggcctg

SEQ ID NO: 3194821 - DNA, 14 bp, Homo sapiens
tgggcctggcctga

SEQ ID NO: 3194822 - DNA, 15 bp, Homo sapiens
tgggcctggcctgag

SEQ ID NO: 3194823 - DNA, 16 bp, Homo sapiens
tgggcctggcctgagc

SEQ ID NO: 3194824 - DNA, 17 bp, Homo sapiens
tgggcctggcctgagct

SEQ ID NO: 3194825 - DNA, 20 bp, Homo sapiens
tgggcctggcctgagctggg

SEQ ID NO: 3194826 - DNA, 12 bp, Homo sapiens
tgggcctgggcc

SEQ ID NO: 3194827 - DNA, 17 bp, Homo sapiens
tgggcctgggcctgctt

SEQ ID NO: 3194828 - DNA, 18 bp, Homo sapiens
tgggcctgggctagggga

SEQ ID NO: 3194829 - DNA, 13 bp, Homo sapiens
tgggcctgtcccc

SEQ ID NO: 3194830 - DNA, 14 bp, Homo sapiens
tgggcctgtccccc

SEQ ID NO: 3194831 - DNA, 16 bp, Homo sapiens
tgggcctgtcgtgcca

SEQ ID NO: 3194832 - DNA, 21 bp, Homo sapiens
tgggcctgtcgtgccagtcct

SEQ ID NO: 3194833 - DNA, 17 bp, Homo sapiens
tgggcctgtgcagcagc

SEQ ID NO: 3194834 - DNA, 18 bp, Homo sapiens
tgggcctgtgcagcagcc

SEQ ID NO: 3194835 - DNA, 19 bp, Homo sapiens
tgggcctgtgcagcagccc

SEQ ID NO: 3194836 - DNA, 18 bp, Homo sapiens
tgggccttagtgggccag

SEQ ID NO: 3194837 - DNA, 14 bp, Homo sapiens
tgggccttgctgct

SEQ ID NO: 3194838 - DNA, 14 bp, Homo sapiens
tgggccttgctttg

SEQ ID NO: 3194839 - DNA, 18 bp, Homo sapiens
tgggccttgctttgggct

SEQ ID NO: 3194840 - DNA, 13 bp, Homo sapiens
tgggcgcaggccc

SEQ ID NO: 3194841 - DNA, 16 bp, Homo sapiens
tgggcgcaggcccagt

SEQ ID NO: 3194842 - DNA, 17 bp, Homo sapiens
tgggcgcaggcccagtg

SEQ ID NO: 3194843 - DNA, 17 bp, Homo sapiens
tgggcgttgggagccta

SEQ ID NO: 3194844 - DNA, 22 bp, Homo sapiens
tgggctaagtgatcctcccacc

SEQ ID NO: 3194845 - DNA, 22 bp, Homo sapiens
tgggctaccctaaagggagaag

SEQ ID NO: 3194846 - DNA, 15 bp, Homo sapiens
tgggctactggcagc

SEQ ID NO: 3194847 - DNA, 18 bp, Homo sapiens
tgggctcaaccagaaaag

SEQ ID NO: 3194848 - DNA, 13 bp, Homo sapiens
tgggctcagggct

SEQ ID NO: 3194849 - DNA, 15 bp, Homo sapiens
tgggctcagggctgg

SEQ ID NO: 3194850 - DNA, 20 bp, Homo sapiens
tgggctcagggctggagtgc

SEQ ID NO: 3194851 - DNA, 19 bp, Homo sapiens
tgggctccacgggcagggg

SEQ ID NO: 3194852 - DNA, 19 bp, Homo sapiens
tgggctccctttgctgctg

SEQ ID NO: 3194853 - DNA, 13 bp, Homo sapiens
tgggctcctggct

SEQ ID NO: 3194854 - DNA, 14 bp, Homo sapiens
tgggctcctggctg

SEQ ID NO: 3194855 - DNA, 20 bp, Homo sapiens
tgggctcctggctgccaggc

SEQ ID NO: 3194856 - DNA, 23 bp, Homo sapiens
tgggctctgccccagctctggct

SEQ ID NO: 3194857 - DNA, 18 bp, Homo sapiens
tgggctgacccagcatct

SEQ ID NO: 3194858 - DNA, 15 bp, Homo sapiens
tgggctgatgctggg

SEQ ID NO: 3194859 - DNA, 18 bp, Homo sapiens
tgggctgatttacatgta

SEQ ID NO: 3194860 - DNA, 17 bp, Homo sapiens
tgggctgcgggaggccc

SEQ ID NO: 3194861 - DNA, 21 bp, Homo sapiens
tgggctgcgggaggccctggc

SEQ ID NO: 3194862 - DNA, 15 bp, Homo sapiens
tgggctgctcctcat

SEQ ID NO: 3194863 - DNA, 16 bp, Homo sapiens
tgggctgctcctcatg

SEQ ID NO: 3194864 - DNA, 16 bp, Homo sapiens
tgggctggactggagg

SEQ ID NO: 3194865 - DNA, 19 bp, Homo sapiens
tgggctggcagtcctggaa

SEQ ID NO: 3194866 - DNA, 14 bp, Homo sapiens
tgggctgggccctc

SEQ ID NO: 3194867 - DNA, 20 bp, Homo sapiens
tgggctgggccctctcttct

SEQ ID NO: 3194868 - DNA, 16 bp, Homo sapiens
tgggctgggccctctt

SEQ ID NO: 3194869 - DNA, 12 bp, Homo sapiens
tgggctggggct

SEQ ID NO: 3194870 - DNA, 21 bp, Homo sapiens
tgggctggtatctcagaaagt

SEQ ID NO: 3194871 - DNA, 19 bp, Homo sapiens
tgggctgtctgtcaccagc

SEQ ID NO: 3194872 - DNA, 12 bp, Homo sapiens
tgggctgtgctg

SEQ ID NO: 3194873 - DNA, 13 bp, Homo sapiens
tgggctgtgctgc

SEQ ID NO: 3194874 - DNA, 14 bp, Homo sapiens
tgggctgtgctgct

SEQ ID NO: 3194875 - DNA, 17 bp, Homo sapiens
tgggctgttggcactca

SEQ ID NO: 3194876 - DNA, 19 bp, Homo sapiens
tgggctgttggcactcaca

SEQ ID NO: 3194877 - DNA, 23 bp, Homo sapiens
tgggctgttggcactcacagacc

SEQ ID NO: 3194878 - DNA, 18 bp, Homo sapiens
tgggcttcactgtataaa

SEQ ID NO: 3194879 - DNA, 13 bp, Homo sapiens
tgggcttcatctg

SEQ ID NO: 3194880 - DNA, 22 bp, Homo sapiens
tgggcttgaccaggcttggcct

SEQ ID NO: 3194881 - DNA, 14 bp, Homo sapiens
tgggcttggcctgc

SEQ ID NO: 3194882 - DNA, 18 bp, Homo sapiens
tgggctttctccggggtc

SEQ ID NO: 3194883 - DNA, 18 bp, Homo sapiens
tgggctttgcaggctctg

SEQ ID NO: 3194884 - DNA, 13 bp, Homo sapiens
tggggaaaaaagc

SEQ ID NO: 3194885 - DNA, 15 bp, Homo sapiens
tggggaaaaaagcac

SEQ ID NO: 3194886 - DNA, 20 bp, Homo sapiens
tggggaaaaaagcacataca

SEQ ID NO: 3194887 - DNA, 21 bp, Homo sapiens
tggggaaaaaagcacatacat

SEQ ID NO: 3194888 - DNA, 11 bp, Homo sapiens
tggggaaaggg

SEQ ID NO: 3194889 - DNA, 21 bp, Homo sapiens
tggggaaaggggtcggctgac

SEQ ID NO: 3194890 - DNA, 15 bp, Homo sapiens
tggggaaggagccag

SEQ ID NO: 3194891 - DNA, 16 bp, Homo sapiens
tggggaatgctcccag

SEQ ID NO: 3194892 - DNA, 17 bp, Homo sapiens
tggggaatgctcccagc

SEQ ID NO: 3194893 - DNA, 16 bp, Homo sapiens
tggggaatttcctcta

SEQ ID NO: 3194894 - DNA, 16 bp, Homo sapiens
tggggacagagggtgt

SEQ ID NO: 3194895 - DNA, 15 bp, Homo sapiens
tggggacagttggca

SEQ ID NO: 3194896 - DNA, 14 bp, Homo sapiens
tggggacccaggct

SEQ ID NO: 3194897 - DNA, 22 bp, Homo sapiens
tggggacccaggctccgccctt

SEQ ID NO: 3194898 - DNA, 19 bp, Homo sapiens
tggggaccccaacctcaga

SEQ ID NO: 3194899 - DNA, 20 bp, Homo sapiens
tggggaccccactccctgct

SEQ ID NO: 3194900 - DNA, 23 bp, Homo sapiens
tggggactgctacctctgagaag

SEQ ID NO: 3194901 - DNA, 16 bp, Homo sapiens
tggggacttgtgtctg

SEQ ID NO: 3194902 - DNA, 15 bp, Homo sapiens
tggggagaggaactc

SEQ ID NO: 3194903 - DNA, 12 bp, Homo sapiens
tggggagatcca

SEQ ID NO: 3194904 - DNA, 17 bp, Homo sapiens
tggggagcagagacact

SEQ ID NO: 3194905 - DNA, 16 bp, Homo sapiens
tggggagcaggaggcc

SEQ ID NO: 3194906 - DNA, 23 bp, Homo sapiens
tggggagcaggaggccaataaaa

SEQ ID NO: 3194907 - DNA, 22 bp, Homo sapiens
tggggagcagttttcccctggc

SEQ ID NO: 3194908 - DNA, 18 bp, Homo sapiens
tggggagcccgtctcagt

SEQ ID NO: 3194909 - DNA, 13 bp, Homo sapiens
tggggaggacctg

SEQ ID NO: 3194910 - DNA, 17 bp, Homo sapiens
tggggagggccgtaccc

SEQ ID NO: 3194911 - DNA, 15 bp, Homo sapiens
tggggaggggcgctg

SEQ ID NO: 3194912 - DNA, 22 bp, Homo sapiens
tggggaggggcgctggcccagc

SEQ ID NO: 3194913 - DNA, 19 bp, Homo sapiens
tggggaggggcggcaggag

SEQ ID NO: 3194914 - DNA, 14 bp, Homo sapiens
tggggagggggaag

SEQ ID NO: 3194915 - DNA, 16 bp, Homo sapiens
tggggaggtgttcact

SEQ ID NO: 3194916 - DNA, 23 bp, Homo sapiens
tggggaggtgttcactgaagacg

SEQ ID NO: 3194917 - DNA, 13 bp, Homo sapiens
tggggatagagga

SEQ ID NO: 3194918 - DNA, 15 bp, Homo sapiens
tggggatagaggaaa

SEQ ID NO: 3194919 - DNA, 17 bp, Homo sapiens
tggggatcaattttcat

SEQ ID NO: 3194920 - DNA, 21 bp, Homo sapiens
tggggatccccgcctggccag

SEQ ID NO: 3194921 - DNA, 23 bp, Homo sapiens
tggggatccccgcctggccagga

SEQ ID NO: 3194922 - DNA, 15 bp, Homo sapiens
tggggatgagaaagg

SEQ ID NO: 3194923 - DNA, 13 bp, Homo sapiens
tggggatgagaca

SEQ ID NO: 3194924 - DNA, 14 bp, Homo sapiens
tggggatgtgggag

SEQ ID NO: 3194925 - DNA, 16 bp, Homo sapiens
tggggattggtgggtc

SEQ ID NO: 3194926 - DNA, 16 bp, Homo sapiens
tggggcagaggggcag

SEQ ID NO: 3194927 - DNA, 17 bp, Homo sapiens
tggggcagaggggcagc

SEQ ID NO: 3194928 - DNA, 13 bp, Homo sapiens
tggggcagcactc

SEQ ID NO: 3194929 - DNA, 13 bp, Homo sapiens
tggggcagcttga

SEQ ID NO: 3194930 - DNA, 16 bp, Homo sapiens
tggggcagcttgaggg

SEQ ID NO: 3194931 - DNA, 18 bp, Homo sapiens
tggggcaggctgggccat

SEQ ID NO: 3194932 - DNA, 20 bp, Homo sapiens
tggggcaggctgggccatgt

SEQ ID NO: 3194933 - DNA, 21 bp, Homo sapiens
tggggcatggttccttccctg

SEQ ID NO: 3194934 - DNA, 17 bp, Homo sapiens
tggggcatgtgtgcctg

SEQ ID NO: 3194935 - DNA, 18 bp, Homo sapiens
tggggcatgtgtgcctgt

SEQ ID NO: 3194936 - DNA, 21 bp, Homo sapiens
tggggccaccaaagctgccca

SEQ ID NO: 3194937 - DNA, 11 bp, Homo sapiens
tggggccactt

SEQ ID NO: 3194938 - DNA, 19 bp, Homo sapiens
tggggccactttcagagcc

SEQ ID NO: 3194939 - DNA, 23 bp, Homo sapiens
tggggccataaacggttcctggt

SEQ ID NO: 3194940 - DNA, 11 bp, Homo sapiens
tggggcccagg

SEQ ID NO: 3194941 - DNA, 19 bp, Homo sapiens
tggggcccaggaagcccac

SEQ ID NO: 3194942 - DNA, 21 bp, Homo sapiens
tggggcccaggaagcccacac

SEQ ID NO: 3194943 - DNA, 22 bp, Homo sapiens
tggggcccaggaagcccacact

SEQ ID NO: 3194944 - DNA, 15 bp, Homo sapiens
tggggccctgcccct

SEQ ID NO: 3194945 - DNA, 19 bp, Homo sapiens
tggggccctgggcctcagt

SEQ ID NO: 3194946 - DNA, 20 bp, Homo sapiens
tggggccgccacggcctggc

SEQ ID NO: 3194947 - DNA, 13 bp, Homo sapiens
tggggcctcagac

SEQ ID NO: 3194948 - DNA, 11 bp, Homo sapiens
tggggcctccc

SEQ ID NO: 3194949 - DNA, 14 bp, Homo sapiens
tggggcctccctcc

SEQ ID NO: 3194950 - DNA, 20 bp, Homo sapiens
tggggcctccctccttgggt

SEQ ID NO: 3194951 - DNA, 11 bp, Homo sapiens
tggggcctgag

SEQ ID NO: 3194952 - DNA, 12 bp, Homo sapiens
tggggcctgaga

SEQ ID NO: 3194953 - DNA, 22 bp, Homo sapiens
tggggcctggcccacgccctcc

SEQ ID NO: 3194954 - DNA, 14 bp, Homo sapiens
tggggcctggcttg

SEQ ID NO: 3194955 - DNA, 16 bp, Homo sapiens
tggggcctggcttgct

SEQ ID NO: 3194956 - DNA, 20 bp, Homo sapiens
tggggcctggcttgctccag

SEQ ID NO: 3194957 - DNA, 22 bp, Homo sapiens
tggggcctggcttgctccaggg

SEQ ID NO: 3194958 - DNA, 12 bp, Homo sapiens
tggggcctgtgg

SEQ ID NO: 3194959 - DNA, 14 bp, Homo sapiens
tggggcctgtggaa

SEQ ID NO: 3194960 - DNA, 21 bp, Homo sapiens
tggggcctgtggaatgagtgt

SEQ ID NO: 3194961 - DNA, 22 bp, Homo sapiens
tggggcctgtggaatgagtgtg

SEQ ID NO: 3194962 - DNA, 19 bp, Homo sapiens
tggggctcacggggcctcc

SEQ ID NO: 3194963 - DNA, 20 bp, Homo sapiens
tggggctcacttttcatcct

SEQ ID NO: 3194964 - DNA, 21 bp, Homo sapiens
tggggctcctttctccagcca

SEQ ID NO: 3194965 - DNA, 23 bp, Homo sapiens
tggggctcctttctccagccagc

SEQ ID NO: 3194966 - DNA, 12 bp, Homo sapiens
tggggctgctcc

SEQ ID NO: 3194967 - DNA, 13 bp, Homo sapiens
tggggctgggccc

SEQ ID NO: 3194968 - DNA, 11 bp, Homo sapiens
tggggctgggg

SEQ ID NO: 3194969 - DNA, 18 bp, Homo sapiens
tggggcttggcgtggagc

SEQ ID NO: 3194970 - DNA, 14 bp, Homo sapiens
tgggggactgggag

SEQ ID NO: 3194971 - DNA, 21 bp, Homo sapiens
tgggggactgggagtcagagc

SEQ ID NO: 3194972 - DNA, 11 bp, Homo sapiens
tgggggagaga

SEQ ID NO: 3194973 - DNA, 17 bp, Homo sapiens
tgggggagagcaggctg

SEQ ID NO: 3194974 - DNA, 21 bp, Homo sapiens
tgggggaggggggggtggggt

SEQ ID NO: 3194975 - DNA, 17 bp, Homo sapiens
tgggggagttttcctct

SEQ ID NO: 3194976 - DNA, 18 bp, Homo sapiens
tgggggatgggccagggt

SEQ ID NO: 3194977 - DNA, 21 bp, Homo sapiens
tgggggatgggccagggttta

SEQ ID NO: 3194978 - DNA, 23 bp, Homo sapiens
tgggggcaccgggctccatgcct

SEQ ID NO: 3194979 - DNA, 22 bp, Homo sapiens
tgggggcaggagggccctacct

SEQ ID NO: 3194980 - DNA, 19 bp, Homo sapiens
tgggggcagtgactggcag

SEQ ID NO: 3194981 - DNA, 20 bp, Homo sapiens
tgggggcagtgactggcagg

SEQ ID NO: 3194982 - DNA, 19 bp, Homo sapiens
tgggggccaaacctgggac

SEQ ID NO: 3194983 - DNA, 20 bp, Homo sapiens
tggggggacagagactcaga

SEQ ID NO: 3194984 - DNA, 23 bp, Homo sapiens
tggggggacagagactcagatga

SEQ ID NO: 3194985 - DNA, 14 bp, Homo sapiens
tggggggctgatgg

SEQ ID NO: 3194986 - DNA, 15 bp, Homo sapiens
tgggggtagcagctg

SEQ ID NO: 3194987 - DNA, 19 bp, Homo sapiens
tgggggtggaggcttcctg

SEQ ID NO: 3194988 - DNA, 14 bp, Homo sapiens
tgggggtggccatc

SEQ ID NO: 3194989 - DNA, 19 bp, Homo sapiens
tgggggtggccatccctgg

SEQ ID NO: 3194990 - DNA, 23 bp, Homo sapiens
tgggggtggccatccctgggccc

SEQ ID NO: 3194991 - DNA, 23 bp, Homo sapiens
tgggggtggggaggcccaaatga

SEQ ID NO: 3194992 - DNA, 16 bp, Homo sapiens
tgggggttcaggcccg

SEQ ID NO: 3194993 - DNA, 19 bp, Homo sapiens
tgggggttctttcttcctc

SEQ ID NO: 3194994 - DNA, 22 bp, Homo sapiens
tggggtaagccagagcctgggg

SEQ ID NO: 3194995 - DNA, 20 bp, Homo sapiens
tggggtacaggtttggggag

SEQ ID NO: 3194996 - DNA, 22 bp, Homo sapiens
tggggtcaagaaacagccagca

SEQ ID NO: 3194997 - DNA, 22 bp, Homo sapiens
tggggtcaggaacagtggctgg

SEQ ID NO: 3194998 - DNA, 12 bp, Homo sapiens
tggggtgaatac

SEQ ID NO: 3194999 - DNA, 17 bp, Homo sapiens
tggggtgaggaccactc

SEQ ID NO: 3195000 - DNA, 14 bp, Homo sapiens
tggggtgctgccct

SEQ ID NO: 3195001 - DNA, 14 bp, Homo sapiens
tggggtggcctcaa

SEQ ID NO: 3195002 - DNA, 13 bp, Homo sapiens
tggggtgggccca

SEQ ID NO: 3195003 - DNA, 14 bp, Homo sapiens
tggggtggggtggg

SEQ ID NO: 3195004 - DNA, 13 bp, Homo sapiens
tggggtgtgctgg

SEQ ID NO: 3195005 - DNA, 18 bp, Homo sapiens
tggggtgtggggtggggt

SEQ ID NO: 3195006 - DNA, 16 bp, Homo sapiens
tggggtgtttgggagg

SEQ ID NO: 3195007 - DNA, 18 bp, Homo sapiens
tggggttatctctgtgtt

SEQ ID NO: 3195008 - DNA, 23 bp, Homo sapiens
tggggtttgggcccctcagagcc

SEQ ID NO: 3195009 - DNA, 12 bp, Homo sapiens
tggggttttgta

SEQ ID NO: 3195010 - DNA, 15 bp, Homo sapiens
tgggtaaaatacttt

SEQ ID NO: 3195011 - DNA, 23 bp, Homo sapiens
tgggtaaaatacttttactctgc

SEQ ID NO: 3195012 - DNA, 15 bp, Homo sapiens
tgggtaaatgcaaag

SEQ ID NO: 3195013 - DNA, 18 bp, Homo sapiens
tgggtaagtcccccaggg

SEQ ID NO: 3195014 - DNA, 18 bp, Homo sapiens
tgggtacttgtggacaca

SEQ ID NO: 3195015 - DNA, 20 bp, Homo sapiens
tgggtacttgtggacacagc

SEQ ID NO: 3195016 - DNA, 14 bp, Homo sapiens
tgggtatcaagaca

SEQ ID NO: 3195017 - DNA, 20 bp, Homo sapiens
tgggtatcaagacatagcat

SEQ ID NO: 3195018 - DNA, 20 bp, Homo sapiens
tgggtatcctgcccagtgtt

SEQ ID NO: 3195019 - DNA, 15 bp, Homo sapiens
tgggtatgttcctaa

SEQ ID NO: 3195020 - DNA, 18 bp, Homo sapiens
tgggtccaaataaaaact

SEQ ID NO: 3195021 - DNA, 16 bp, Homo sapiens
tgggtccaagagacat

SEQ ID NO: 3195022 - DNA, 19 bp, Homo sapiens
tgggtccaggaaggcagct

SEQ ID NO: 3195023 - DNA, 17 bp, Homo sapiens
tgggtcccccacgtgac

SEQ ID NO: 3195024 - DNA, 18 bp, Homo sapiens
tgggtcccgcactctgcc

SEQ ID NO: 3195025 - DNA, 21 bp, Homo sapiens
tgggtccgataatatctttgt

SEQ ID NO: 3195026 - DNA, 22 bp, Homo sapiens
tgggtctaggacacagttcctg

SEQ ID NO: 3195027 - DNA, 20 bp, Homo sapiens
tgggtctcgctttgttgccc

SEQ ID NO: 3195028 - DNA, 24 bp, Homo sapiens
tgggtctgggatatggctgcccag

SEQ ID NO: 3195029 - DNA, 22 bp, Homo sapiens
tgggtctgttttcctttctcac

SEQ ID NO: 3195030 - DNA, 13 bp, Homo sapiens
tgggtcttttata

SEQ ID NO: 3195031 - DNA, 19 bp, Homo sapiens
tgggtgaaggcctggctgg

SEQ ID NO: 3195032 - DNA, 22 bp, Homo sapiens
tgggtgaaggcctggctggaag

SEQ ID NO: 3195033 - DNA, 17 bp, Homo sapiens
tgggtgacagagcaaga

SEQ ID NO: 3195034 - DNA, 12 bp, Homo sapiens
tgggtgacattt

SEQ ID NO: 3195035 - DNA, 13 bp, Homo sapiens
tgggtgagagaga

SEQ ID NO: 3195036 - DNA, 14 bp, Homo sapiens
tgggtgagagagac

SEQ ID NO: 3195037 - DNA, 15 bp, Homo sapiens
tgggtgagagaggaa

SEQ ID NO: 3195038 - DNA, 13 bp, Homo sapiens
tgggtgctcagaa

SEQ ID NO: 3195039 - DNA, 16 bp, Homo sapiens
tgggtgctgccctgtg

SEQ ID NO: 3195040 - DNA, 15 bp, Homo sapiens
tgggtgctggaggat

SEQ ID NO: 3195041 - DNA, 14 bp, Homo sapiens
tgggtgctggctgc

SEQ ID NO: 3195042 - DNA, 17 bp, Homo sapiens
tgggtggaagggctggg

SEQ ID NO: 3195043 - DNA, 14 bp, Homo sapiens
tgggtggcacctcc

SEQ ID NO: 3195044 - DNA, 12 bp, Homo sapiens
tgggtgggacag

SEQ ID NO: 3195045 - DNA, 17 bp, Homo sapiens
tgggtgggacagcctct

SEQ ID NO: 3195046 - DNA, 14 bp, Homo sapiens
tgggtggggacagt

SEQ ID NO: 3195047 - DNA, 22 bp, Homo sapiens
tgggtgggggctcctggtggcc

SEQ ID NO: 3195048 - DNA, 15 bp, Homo sapiens
tgggtggggtgagga

SEQ ID NO: 3195049 - DNA, 14 bp, Homo sapiens
tgggtgggtggtgg

SEQ ID NO: 3195050 - DNA, 15 bp, Homo sapiens
tgggtgggtggtggg

SEQ ID NO: 3195051 - DNA, 16 bp, Homo sapiens
tgggtgggtggtgggg

SEQ ID NO: 3195052 - DNA, 14 bp, Homo sapiens
tgggtgtagccagg

SEQ ID NO: 3195053 - DNA, 21 bp, Homo sapiens
tgggtgtcaagagggtctgag

SEQ ID NO: 3195054 - DNA, 15 bp, Homo sapiens
tgggtgttcctggca

SEQ ID NO: 3195055 - DNA, 20 bp, Homo sapiens
tgggtgttcctggcagttta

SEQ ID NO: 3195056 - DNA, 22 bp, Homo sapiens
tgggttaggcattaatgtttct

SEQ ID NO: 3195057 - DNA, 14 bp, Homo sapiens
tggttttcaaaata

SEQ ID NO: 3195058 - DNA, 19 bp, Homo sapiens
tggttttgtaagatgctgg

SEQ ID NO: 3195059 - DNA, 14 bp, Homo sapiens
tggttttgttttgc

SEQ ID NO: 3195060 - DNA, 24 bp, Homo sapiens
tggtttttgcaagatttaacacta

SEQ ID NO: 3195061 - DNA, 18 bp, Homo sapiens
tgtaaaaaaaaatgcctt

SEQ ID NO: 3195062 - DNA, 19 bp, Homo sapiens
tgtaaaaaaaaatgccttt

SEQ ID NO: 3195063 - DNA, 12 bp, Homo sapiens
tgtaaaaaaagc

SEQ ID NO: 3195064 - DNA, 14 bp, Homo sapiens
tgtaaaaaaagcaa

SEQ ID NO: 3195065 - DNA, 16 bp, Homo sapiens
tgtaaaaaaagcaaaa

SEQ ID NO: 3195066 - DNA, 20 bp, Homo sapiens
tgtaaaaaaagcaaaaatga

SEQ ID NO: 3195067 - DNA, 16 bp, Homo sapiens
tgtaaaaaacaaaaac

SEQ ID NO: 3195068 - DNA, 21 bp, Homo sapiens
tgtaaaaaatggaaaaaaaca

SEQ ID NO: 3195069 - DNA, 14 bp, Homo sapiens
tgtaaaaacactga

SEQ ID NO: 3195070 - DNA, 19 bp, Homo sapiens
tgtaaaaacagcattgctt

SEQ ID NO: 3195071 - DNA, 20 bp, Homo sapiens
tgtaaaaacagcattgcttt

SEQ ID NO: 3195072 - DNA, 13 bp, Homo sapiens
tgtaaaaagaaaa

SEQ ID NO: 3195073 - DNA, 18 bp, Homo sapiens
tgtaaaaatacactaatg

SEQ ID NO: 3195074 - DNA, 12 bp, Homo sapiens
tgtaaaacaggt

SEQ ID NO: 3195075 - DNA, 16 bp, Homo sapiens
tgtaaaacctgtcaat

SEQ ID NO: 3195076 - DNA, 12 bp, Homo sapiens
tgtaaaacgctg

SEQ ID NO: 3195077 - DNA, 16 bp, Homo sapiens
tgtaaaacgctgtcaa

SEQ ID NO: 3195078 - DNA, 18 bp, Homo sapiens
tgtaaaactcgcttttat

SEQ ID NO: 3195079 - DNA, 21 bp, Homo sapiens
tgtaaaagaaaggttgcgttt

SEQ ID NO: 3195080 - DNA, 19 bp, Homo sapiens
tgtaaaagaacagtaaaca

SEQ ID NO: 3195081 - DNA, 12 bp, Homo sapiens
tgtaaaagacat

SEQ ID NO: 3195082 - DNA, 22 bp, Homo sapiens
tgtaaaagtactctgaaaagca

SEQ ID NO: 3195083 - DNA, 17 bp, Homo sapiens
tgtaaaatagcttgtat

SEQ ID NO: 3195084 - DNA, 21 bp, Homo sapiens
tgtaaaatagcttgtatagtg

SEQ ID NO: 3195085 - DNA, 17 bp, Homo sapiens
tgtaaaattataaactt

SEQ ID NO: 3195086 - DNA, 21 bp, Homo sapiens
tgtaaacaaaatttagttttt

SEQ ID NO: 3195087 - DNA, 19 bp, Homo sapiens
tgtaaacaatgtaaagtaa

SEQ ID NO: 3195088 - DNA, 14 bp, Homo sapiens
tgtaaacatgtgtt

SEQ ID NO: 3195089 - DNA, 22 bp, Homo sapiens
tgtaaacatgtgttttaattcc

SEQ ID NO: 3195090 - DNA, 22 bp, Homo sapiens
tgtaaactcaaaacttaacata

SEQ ID NO: 3195091 - DNA, 20 bp, Homo sapiens
tgtaaactggaattaaaagg

SEQ ID NO: 3195092 - DNA, 22 bp, Homo sapiens
tgtaaactgtactagtctgtgt

SEQ ID NO: 3195093 - DNA, 20 bp, Homo sapiens
tgtaaactgtatcaaatctg

SEQ ID NO: 3195094 - DNA, 18 bp, Homo sapiens
tgtaaactttgtcatggt

SEQ ID NO: 3195095 - DNA, 21 bp, Homo sapiens
tgtaaagagacctacctcagg

SEQ ID NO: 3195096 - DNA, 18 bp, Homo sapiens
tgtaaagatatttttatc

SEQ ID NO: 3195097 - DNA, 22 bp, Homo sapiens
tgtaaagatttgttgacagcaa

SEQ ID NO: 3195098 - DNA, 15 bp, Homo sapiens
tgtaaagctggccct

SEQ ID NO: 3195099 - DNA, 12 bp, Homo sapiens
tgtaaagtgtgg

SEQ ID NO: 3195100 - DNA, 21 bp, Homo sapiens
tgtaaataaccccattctttg

SEQ ID NO: 3195101 - DNA, 20 bp, Homo sapiens
tgtaaataattttaaataac

SEQ ID NO: 3195102 - DNA, 22 bp, Homo sapiens
tgtaaataattttaaataacct

SEQ ID NO: 3195103 - DNA, 13 bp, Homo sapiens
tgtaaatacataa

SEQ ID NO: 3195104 - DNA, 14 bp, Homo sapiens
tgtaaataccagga

SEQ ID NO: 3195105 - DNA, 19 bp, Homo sapiens
tgtaaataccaggattttt

SEQ ID NO: 3195106 - DNA, 15 bp, Homo sapiens
tgtaaataccattga

SEQ ID NO: 3195107 - DNA, 16 bp, Homo sapiens
tgtaaatagctcaggt

SEQ ID NO: 3195108 - DNA, 17 bp, Homo sapiens
tgtaaataggattttta

SEQ ID NO: 3195109 - DNA, 18 bp, Homo sapiens
tgtaaataggatttttag

SEQ ID NO: 3195110 - DNA, 18 bp, Homo sapiens
tgtaaatatttactcttt

SEQ ID NO: 3195111 - DNA, 18 bp, Homo sapiens
tgtaaatatttatttatg

SEQ ID NO: 3195112 - DNA, 16 bp, Homo sapiens
tgtaaatctgccacaa

SEQ ID NO: 3195113 - DNA, 11 bp, Homo sapiens
tgtaaatgcct

SEQ ID NO: 3195114 - DNA, 22 bp, Homo sapiens
tgtaaatgctgtcaactatgat

SEQ ID NO: 3195115 - DNA, 16 bp, Homo sapiens
tgtaaatggtgtacat

SEQ ID NO: 3195116 - DNA, 17 bp, Homo sapiens
tgtaaatggtgtacata

SEQ ID NO: 3195117 - DNA, 14 bp, Homo sapiens
tgtaaatgtttctt

SEQ ID NO: 3195118 - DNA, 22 bp, Homo sapiens
tgtaaatgtttgttaaaaataa

SEQ ID NO: 3195119 - DNA, 15 bp, Homo sapiens
tgtaaattaatactt

SEQ ID NO: 3195120 - DNA, 15 bp, Homo sapiens
tgtaaatttataaat

SEQ ID NO: 3195121 - DNA, 20 bp, Homo sapiens
tgtaacacagctgagagact

SEQ ID NO: 3195122 - DNA, 21 bp, Homo sapiens
tgtaacacagctgagagactt

SEQ ID NO: 3195123 - DNA, 11 bp, Homo sapiens
tgtaacactgt

SEQ ID NO: 3195124 - DNA, 18 bp, Homo sapiens
tgtaacactgtgtacacc

SEQ ID NO: 3195125 - DNA, 19 bp, Homo sapiens
tgtaacactgtgtacacct

SEQ ID NO: 3195126 - DNA, 22 bp, Homo sapiens
tgtaacactgtgtacacctcaa

SEQ ID NO: 3195127 - DNA, 18 bp, Homo sapiens
tgtaacagccaggagtgt

SEQ ID NO: 3195128 - DNA, 15 bp, Homo sapiens
tgtaacatcataatt

SEQ ID NO: 3195129 - DNA, 16 bp, Homo sapiens
tgtaacatcataatta

SEQ ID NO: 3195130 - DNA, 19 bp, Homo sapiens
tgtaacatcataattacat

SEQ ID NO: 3195131 - DNA, 20 bp, Homo sapiens
tgtaacatcataattacatt

SEQ ID NO: 3195132 - DNA, 21 bp, Homo sapiens
tgtaacatcataattacattc

SEQ ID NO: 3195133 - DNA, 16 bp, Homo sapiens
tgtaacattggtgaag

SEQ ID NO: 3195134 - DNA, 14 bp, Homo sapiens
tgtaacctcagctc

SEQ ID NO: 3195135 - DNA, 16 bp, Homo sapiens
tgtaacctcagctctg

SEQ ID NO: 3195136 - DNA, 23 bp, Homo sapiens
tgtaacctgttgctgtgtttaat

SEQ ID NO: 3195137 - DNA, 16 bp, Homo sapiens
tgtaacgtggcactgg

SEQ ID NO: 3195138 - DNA, 22 bp, Homo sapiens
tgtaacgttttctttcacacac

SEQ ID NO: 3195139 - DNA, 16 bp, Homo sapiens
tgtaactacaaagctt

SEQ ID NO: 3195140 - DNA, 19 bp, Homo sapiens
tgtaactacaaagctttgc

SEQ ID NO: 3195141 - DNA, 22 bp, Homo sapiens
tgtaactacaaagctttgctac

SEQ ID NO: 3195142 - DNA, 16 bp, Homo sapiens
tgtaactactttataa

SEQ ID NO: 3195143 - DNA, 18 bp, Homo sapiens
tgtaactactttataact

SEQ ID NO: 3195144 - DNA, 16 bp, Homo sapiens
tgtaactattaacctt

SEQ ID NO: 3195145 - DNA, 17 bp, Homo sapiens
tgtaactattaaccttt

SEQ ID NO: 3195146 - DNA, 14 bp, Homo sapiens
tgtaactcaccgtg

SEQ ID NO: 3195147 - DNA, 19 bp, Homo sapiens
tgtaactccagatagagaa

SEQ ID NO: 3195148 - DNA, 16 bp, Homo sapiens
tgtaactgctgagcca

SEQ ID NO: 3195149 - DNA, 17 bp, Homo sapiens
tgtaactgctgagccac

SEQ ID NO: 3195150 - DNA, 19 bp, Homo sapiens
tgtaactgctgagccactc

SEQ ID NO: 3195151 - DNA, 15 bp, Homo sapiens
tgtaacttatgtaga

SEQ ID NO: 3195152 - DNA, 16 bp, Homo sapiens
tgtaacttatgtagat

SEQ ID NO: 3195153 - DNA, 20 bp, Homo sapiens
tgtaacttttgtaagacaaa

SEQ ID NO: 3195154 - DNA, 15 bp, Homo sapiens
tgtaagaaaatttga

SEQ ID NO: 3195155 - DNA, 14 bp, Homo sapiens
tgtaagacatttgt

SEQ ID NO: 3195156 - DNA, 16 bp, Homo sapiens
tgtaagacatttgtat

SEQ ID NO: 3195157 - DNA, 18 bp, Homo sapiens
tgtaagacccttattgct

SEQ ID NO: 3195158 - DNA, 17 bp, Homo sapiens
tgtaagagaatgttgaa

SEQ ID NO: 3195159 - DNA, 15 bp, Homo sapiens
tgtaagagtgtagaa

SEQ ID NO: 3195160 - DNA, 16 bp, Homo sapiens
tgtaagatccaccccc

SEQ ID NO: 3195161 - DNA, 15 bp, Homo sapiens
tgtaagatgctgggt

SEQ ID NO: 3195162 - DNA, 17 bp, Homo sapiens
tgtaagatgctgggttg

SEQ ID NO: 3195163 - DNA, 11 bp, Homo sapiens
tgtaagatgtt

SEQ ID NO: 3195164 - DNA, 23 bp, Homo sapiens
tgtaagattatagattctaaaga

SEQ ID NO: 3195165 - DNA, 22 bp, Homo sapiens
tgtaagcaaaggctctgaaata

SEQ ID NO: 3195166 - DNA, 22 bp, Homo sapiens
tgtaagcatactttgtaaatag

SEQ ID NO: 3195167 - DNA, 13 bp, Homo sapiens
tgtaagccaaaga

SEQ ID NO: 3195168 - DNA, 21 bp, Homo sapiens
tgtaagccaaagaaatgaaca

SEQ ID NO: 3195169 - DNA, 19 bp, Homo sapiens
tgtaaggatccggaaagaa

SEQ ID NO: 3195170 - DNA, 18 bp, Homo sapiens
tgtaaggctctagatcat

SEQ ID NO: 3195171 - DNA, 12 bp, Homo sapiens
tgtaaggtatat

SEQ ID NO: 3195172 - DNA, 23 bp, Homo sapiens
tgtaagtcatctacttaataaat

SEQ ID NO: 3195173 - DNA, 18 bp, Homo sapiens
tgtaagtgagagagacaa

SEQ ID NO: 3195174 - DNA, 16 bp, Homo sapiens
tgtaagttatttcttg

SEQ ID NO: 3195175 - DNA, 19 bp, Homo sapiens
tgtaagttgtacaaatgta

SEQ ID NO: 3195176 - DNA, 20 bp, Homo sapiens
tgtaagttgtacaaatgtat

SEQ ID NO: 3195177 - DNA, 19 bp, Homo sapiens
tgtaagtttcaggtgacat

SEQ ID NO: 3195178 - DNA, 21 bp, Homo sapiens
tgtaagtttcaggtgacatgt

SEQ ID NO: 3195179 - DNA, 12 bp, Homo sapiens
tgtaagtttgtg

SEQ ID NO: 3195180 - DNA, 21 bp, Homo sapiens
tgtaataaaacttatgctagt

SEQ ID NO: 3195181 - DNA, 17 bp, Homo sapiens
tgtaataaagtgttttc

SEQ ID NO: 3195182 - DNA, 18 bp, Homo sapiens
tgtaataaagtgttttca

SEQ ID NO: 3195183 - DNA, 20 bp, Homo sapiens
tgtaataaagtgttttcaga

SEQ ID NO: 3195184 - DNA, 16 bp, Homo sapiens
tgtaataaattcaaaa

SEQ ID NO: 3195185 - DNA, 18 bp, Homo sapiens
tgtaatacagacaaactt

SEQ ID NO: 3195186 - DNA, 22 bp, Homo sapiens
tggaaactgctaaattctatgt

SEQ ID NO: 3195187 - DNA, 20 bp, Homo sapiens
tggaaagactgattgtttta

SEQ ID NO: 3195188 - DNA, 13 bp, Homo sapiens
tggaaagagacca

SEQ ID NO: 3195189 - DNA, 19 bp, Homo sapiens
tggaaagaggtgaaaatga

SEQ ID NO: 3195190 - DNA, 19 bp, Homo sapiens
tggaaagcagagttttcat

SEQ ID NO: 3195191 - DNA, 19 bp, Homo sapiens
tggaaagcatcacctcagg

SEQ ID NO: 3195192 - DNA, 20 bp, Homo sapiens
tggaaagcatcacctcaggc

SEQ ID NO: 3195193 - DNA, 20 bp, Homo sapiens
tggaaagcgattcactgtat

SEQ ID NO: 3195194 - DNA, 13 bp, Homo sapiens
tggaaaggctcag

SEQ ID NO: 3195195 - DNA, 17 bp, Homo sapiens
tggaaaggggggagctg

SEQ ID NO: 3195196 - DNA, 18 bp, Homo sapiens
tggaaaggggggagctgg

SEQ ID NO: 3195197 - DNA, 19 bp, Homo sapiens
tggaaaggggggagctggg

SEQ ID NO: 3195198 - DNA, 19 bp, Homo sapiens
tggaaaggtgtgagactgg

SEQ ID NO: 3195199 - DNA, 15 bp, Homo sapiens
tggaaagtaactgtg

SEQ ID NO: 3195200 - DNA, 13 bp, Homo sapiens
tggaaagtcagaa

SEQ ID NO: 3195201 - DNA, 14 bp, Homo sapiens
tggaaagtgaattt

SEQ ID NO: 3195202 - DNA, 12 bp, Homo sapiens
tggaaataaagt

SEQ ID NO: 3195203 - DNA, 15 bp, Homo sapiens
tggaaataaatgtat

SEQ ID NO: 3195204 - DNA, 14 bp, Homo sapiens
tggaaatacacagt

SEQ ID NO: 3195205 - DNA, 21 bp, Homo sapiens
tggaaatattttgataataaa

SEQ ID NO: 3195206 - DNA, 17 bp, Homo sapiens
tggaaatcctgccctgg

SEQ ID NO: 3195207 - DNA, 15 bp, Homo sapiens
tggaaatcgcttata

SEQ ID NO: 3195208 - DNA, 17 bp, Homo sapiens
tggaaatggatgcaaag

SEQ ID NO: 3195209 - DNA, 19 bp, Homo sapiens
tggaaatggatgcaaagta

SEQ ID NO: 3195210 - DNA, 14 bp, Homo sapiens
tggaaattcctgta

SEQ ID NO: 3195211 - DNA, 19 bp, Homo sapiens
tggaaattcctgtactgtg

SEQ ID NO: 3195212 - DNA, 22 bp, Homo sapiens
tggaaattcctgtactgtgtct

SEQ ID NO: 3195213 - DNA, 23 bp, Homo sapiens
tggaaattccttgccccacagtt

SEQ ID NO: 3195214 - DNA, 16 bp, Homo sapiens
tggaaattgacgaggg

SEQ ID NO: 3195215 - DNA, 17 bp, Homo sapiens
tggaaattggaagagca

SEQ ID NO: 3195216 - DNA, 21 bp, Homo sapiens
tggaacagaatgttttactgt

SEQ ID NO: 3195217 - DNA, 13 bp, Homo sapiens
tggaacagcggga

SEQ ID NO: 3195218 - DNA, 23 bp, Homo sapiens
tggaacatcctttgcagggcagc

SEQ ID NO: 3195219 - DNA, 20 bp, Homo sapiens
tggaacattggaatgttctc

SEQ ID NO: 3195220 - DNA, 17 bp, Homo sapiens
tggaacatttctttctt

SEQ ID NO: 3195221 - DNA, 18 bp, Homo sapiens
tggaacatttgatatttt

SEQ ID NO: 3195222 - DNA, 22 bp, Homo sapiens
tggaacatttgatatttttcca

SEQ ID NO: 3195223 - DNA, 18 bp, Homo sapiens
tggaaccagggaggagag

SEQ ID NO: 3195224 - DNA, 16 bp, Homo sapiens
tggaacctctgtctca

SEQ ID NO: 3195225 - DNA, 15 bp, Homo sapiens
tggaaccttgctgtc

SEQ ID NO: 3195226 - DNA, 16 bp, Homo sapiens
tggaaccttgctgtcc

SEQ ID NO: 3195227 - DNA, 13 bp, Homo sapiens
tggaactctgctt

SEQ ID NO: 3195228 - DNA, 16 bp, Homo sapiens
tggaacttttattaga

SEQ ID NO: 3195229 - DNA, 14 bp, Homo sapiens
tggaagaaagtaag

SEQ ID NO: 3195230 - DNA, 14 bp, Homo sapiens
tggaagacacttca

SEQ ID NO: 3195231 - DNA, 20 bp, Homo sapiens
tggaagacacttcagatctg

SEQ ID NO: 3195232 - DNA, 12 bp, Homo sapiens
tggaagagaatc

SEQ ID NO: 3195233 - DNA, 14 bp, Homo sapiens
tggaagagcagcct

SEQ ID NO: 3195234 - DNA, 17 bp, Homo sapiens
tggaagagcagcctgat

SEQ ID NO: 3195235 - DNA, 19 bp, Homo sapiens
tggaagagccgagcacctg

SEQ ID NO: 3195236 - DNA, 13 bp, Homo sapiens
tggaagagggtga

SEQ ID NO: 3195237 - DNA, 18 bp, Homo sapiens
tggaagagggtgaaaggc

SEQ ID NO: 3195238 - DNA, 19 bp, Homo sapiens
tggaagatagttttctcct

SEQ ID NO: 3195239 - DNA, 13 bp, Homo sapiens
tggaagatcctgc

SEQ ID NO: 3195240 - DNA, 21 bp, Homo sapiens
tggaagatcctgcgggtgggg

SEQ ID NO: 3195241 - DNA, 22 bp, Homo sapiens
tggaagatttaccttttctgtt

SEQ ID NO: 3195242 - DNA, 16 bp, Homo sapiens
tggaagattttaaatt

SEQ ID NO: 3195243 - DNA, 17 bp, Homo sapiens
tggaagattttcagtct

SEQ ID NO: 3195244 - DNA, 16 bp, Homo sapiens
tggaagcaaagtgctg

SEQ ID NO: 3195245 - DNA, 12 bp, Homo sapiens
tggaagccaggt

SEQ ID NO: 3195246 - DNA, 22 bp, Homo sapiens
tggaagccccaacgggaaagga

SEQ ID NO: 3195247 - DNA, 16 bp, Homo sapiens
tggaagcccctgggcc

SEQ ID NO: 3195248 - DNA, 20 bp, Homo sapiens
tggaagcccctgggcccagt

SEQ ID NO: 3195249 - DNA, 18 bp, Homo sapiens
tggaagctaatttgcatt

SEQ ID NO: 3195250 - DNA, 19 bp, Homo sapiens
tggaagctgtttggaaaag

SEQ ID NO: 3195251 - DNA, 20 bp, Homo sapiens
tggaagcttgttttccagtc

SEQ ID NO: 3195252 - DNA, 19 bp, Homo sapiens
tggaaggaccacattttat

SEQ ID NO: 3195253 - DNA, 16 bp, Homo sapiens
tggaaggactgtggct

SEQ ID NO: 3195254 - DNA, 15 bp, Homo sapiens
tggcttataaacaca

SEQ ID NO: 3195255 - DNA, 16 bp, Homo sapiens
tggcttataggtgttg

SEQ ID NO: 3195256 - DNA, 19 bp, Homo sapiens
tggcttattttaatgtgat

SEQ ID NO: 3195257 - DNA, 21 bp, Homo sapiens
tggcttattttaatgtgatga

SEQ ID NO: 3195258 - DNA, 17 bp, Homo sapiens
tggcttcaagttgtaaa

SEQ ID NO: 3195259 - DNA, 23 bp, Homo sapiens
tggcttccagaaaaccccagcat

SEQ ID NO: 3195260 - DNA, 14 bp, Homo sapiens
tggcttccagcttc

SEQ ID NO: 3195261 - DNA, 22 bp, Homo sapiens
tggcttccagcttcaggcacca

SEQ ID NO: 3195262 - DNA, 17 bp, Homo sapiens
tggcttcccgctcagcc

SEQ ID NO: 3195263 - DNA, 21 bp, Homo sapiens
tggcttcccgctcagccctcc

SEQ ID NO: 3195264 - DNA, 22 bp, Homo sapiens
tggcttcctccgtccacccagg

SEQ ID NO: 3195265 - DNA, 18 bp, Homo sapiens
tggcttcggacaaaatat

SEQ ID NO: 3195266 - DNA, 14 bp, Homo sapiens
tggcttctgtgatg

SEQ ID NO: 3195267 - DNA, 17 bp, Homo sapiens
tggcttctgtgatgagc

SEQ ID NO: 3195268 - DNA, 22 bp, Homo sapiens
tggcttctgtgatgagctgatc

SEQ ID NO: 3195269 - DNA, 15 bp, Homo sapiens
tggcttgagaaatat

SEQ ID NO: 3195270 - DNA, 14 bp, Homo sapiens
tggcttggccttgg

SEQ ID NO: 3195271 - DNA, 17 bp, Homo sapiens
tggcttgggcagggtct

SEQ ID NO: 3195272 - DNA, 22 bp, Homo sapiens
tggcttggggtcaagaaacagc

SEQ ID NO: 3195273 - DNA, 14 bp, Homo sapiens
tggcttgtagaatt

SEQ ID NO: 3195274 - DNA, 17 bp, Homo sapiens
tggcttgtagaattgtt

SEQ ID NO: 3195275 - DNA, 13 bp, Homo sapiens
tggcttgtctata

SEQ ID NO: 3195276 - DNA, 20 bp, Homo sapiens
tggcttgtgtgtttcacttt

SEQ ID NO: 3195277 - DNA, 23 bp, Homo sapiens
tggctttaagccttcaaaactat

SEQ ID NO: 3195278 - DNA, 19 bp, Homo sapiens
tggctttccttgtggcaga

SEQ ID NO: 3195279 - DNA, 17 bp, Homo sapiens
tggctttggcagtgttt

SEQ ID NO: 3195280 - DNA, 15 bp, Homo sapiens
tggcttttactttat

SEQ ID NO: 3195281 - DNA, 18 bp, Homo sapiens
tggcttttcactgctggc

SEQ ID NO: 3195282 - DNA, 19 bp, Homo sapiens
tggcttttcactgctggct

SEQ ID NO: 3195283 - DNA, 22 bp, Homo sapiens
tggcttttcactgctggctgcc

SEQ ID NO: 3195284 - DNA, 17 bp, Homo sapiens
tggctttttcctctgag

SEQ ID NO: 3195285 - DNA, 20 bp, Homo sapiens
tgggaaaaaaacttggcact

SEQ ID NO: 3195286 - DNA, 21 bp, Homo sapiens
tgggaaaaaagttttgatgaa

SEQ ID NO: 3195287 - DNA, 19 bp, Homo sapiens
tgggaaaatatttcctgac

SEQ ID NO: 3195288 - DNA, 21 bp, Homo sapiens
tgggaaagaaggcaaagtccc

SEQ ID NO: 3195289 - DNA, 15 bp, Homo sapiens
tgggaaagccacctc

SEQ ID NO: 3195290 - DNA, 20 bp, Homo sapiens
tgggaaagccacctctccct

SEQ ID NO: 3195291 - DNA, 21 bp, Homo sapiens
tgggaaagccacctctccctc

SEQ ID NO: 3195292 - DNA, 22 bp, Homo sapiens
tgggaaagccacctctccctca

SEQ ID NO: 3195293 - DNA, 16 bp, Homo sapiens
tgggaaagcccagact

SEQ ID NO: 3195294 - DNA, 22 bp, Homo sapiens
tgggaaattaaatccaataaaa

SEQ ID NO: 3195295 - DNA, 18 bp, Homo sapiens
tgggaacacgtgtgcaca

SEQ ID NO: 3195296 - DNA, 13 bp, Homo sapiens
tgggaaccactcc

SEQ ID NO: 3195297 - DNA, 23 bp, Homo sapiens
tgggaaccagcatctcagcgcca

SEQ ID NO: 3195298 - DNA, 20 bp, Homo sapiens
tgggaaccccttcatcctct

SEQ ID NO: 3195299 - DNA, 19 bp, Homo sapiens
tgggaacctcccagaggtc

SEQ ID NO: 3195300 - DNA, 21 bp, Homo sapiens
tgggaacctcccagaggtcca

SEQ ID NO: 3195301 - DNA, 24 bp, Homo sapiens
tgggaacgcagatgatccatgagt

SEQ ID NO: 3195302 - DNA, 16 bp, Homo sapiens
tgggaactctgacaag

SEQ ID NO: 3195303 - DNA, 22 bp, Homo sapiens
tgggaactctgacaagggctga

SEQ ID NO: 3195304 - DNA, 23 bp, Homo sapiens
tgggaagaaagaatgcaagagtg

SEQ ID NO: 3195305 - DNA, 21 bp, Homo sapiens
tgggaagaccaaaggaaggaa

SEQ ID NO: 3195306 - DNA, 19 bp, Homo sapiens
tgggaagacgcctgagctc

SEQ ID NO: 3195307 - DNA, 17 bp, Homo sapiens
tgggaagataggctctg

SEQ ID NO: 3195308 - DNA, 18 bp, Homo sapiens
tgggaagatgaggttctg

SEQ ID NO: 3195309 - DNA, 19 bp, Homo sapiens
tgggaagatgaggttctga

SEQ ID NO: 3195310 - DNA, 20 bp, Homo sapiens
tgggaagctgagggcaaatc

SEQ ID NO: 3195311 - DNA, 22 bp, Homo sapiens
tgggaagctgtactcagagcag

SEQ ID NO: 3195312 - DNA, 24 bp, Homo sapiens
tgggaagctgtactcagagcagag

SEQ ID NO: 3195313 - DNA, 14 bp, Homo sapiens
tgggaagcttgagc

SEQ ID NO: 3195314 - DNA, 16 bp, Homo sapiens
tgggaagcttgagcct

SEQ ID NO: 3195315 - DNA, 13 bp, Homo sapiens
tgggaaggacttg

SEQ ID NO: 3195316 - DNA, 22 bp, Homo sapiens
tgggaaggacttggcgcgccct

SEQ ID NO: 3195317 - DNA, 16 bp, Homo sapiens
tgggaaggccggcagc

SEQ ID NO: 3195318 - DNA, 17 bp, Homo sapiens
tgggaaggccggcagcg

SEQ ID NO: 3195319 - DNA, 18 bp, Homo sapiens
tgggaaggcttgggattt

SEQ ID NO: 3195320 - DNA, 20 bp, Homo sapiens
tgggaagggtcatagaaagg

SEQ ID NO: 3195321 - DNA, 23 bp, Homo sapiens
tgggaagttgcattcctttgtct

SEQ ID NO: 3195322 - DNA, 15 bp, Homo sapiens
tgggaataattgctt

SEQ ID NO: 3195323 - DNA, 17 bp, Homo sapiens
tgggaatgaggtgggag

SEQ ID NO: 3195324 - DNA, 14 bp, Homo sapiens
tgggaatgggagag

SEQ ID NO: 3195325 - DNA, 20 bp, Homo sapiens
tgggaatgttacattgtttg

SEQ ID NO: 3195326 - DNA, 14 bp, Homo sapiens
tgggacaccaggga

SEQ ID NO: 3195327 - DNA, 11 bp, Homo sapiens
tgggacagagg

SEQ ID NO: 3195328 - DNA, 21 bp, Homo sapiens
tgggacagccagagctgggtg

SEQ ID NO: 3195329 - DNA, 23 bp, Homo sapiens
tgggacagccagagctgggtggg

SEQ ID NO: 3195330 - DNA, 14 bp, Homo sapiens
tgggacagcctctt

SEQ ID NO: 3195331 - DNA, 16 bp, Homo sapiens
tgggacagggcatggc

SEQ ID NO: 3195332 - DNA, 23 bp, Homo sapiens
tgggaccaaccctggggaaggag

SEQ ID NO: 3195333 - DNA, 17 bp, Homo sapiens
tgggaccagagccagat

SEQ ID NO: 3195334 - DNA, 18 bp, Homo sapiens
tgggaccagggatggggg

SEQ ID NO: 3195335 - DNA, 20 bp, Homo sapiens
tgggacccaaaacacaggaa

SEQ ID NO: 3195336 - DNA, 13 bp, Homo sapiens
tgggaccctccag

SEQ ID NO: 3195337 - DNA, 19 bp, Homo sapiens
tgggacctgccaggcaggg

SEQ ID NO: 3195338 - DNA, 23 bp, Homo sapiens
tgggacctgccaggcaggggtgg

SEQ ID NO: 3195339 - DNA, 14 bp, Homo sapiens
tgggactacaggca

SEQ ID NO: 3195340 - DNA, 18 bp, Homo sapiens
tgcttcagagtttgtgtg

SEQ ID NO: 3195341 - DNA, 13 bp, Homo sapiens
tgcttcagcctcc

SEQ ID NO: 3195342 - DNA, 14 bp, Homo sapiens
tgcttcagcctgag

SEQ ID NO: 3195343 - DNA, 22 bp, Homo sapiens
tgcttcagcctgaggctgagac

SEQ ID NO: 3195344 - DNA, 17 bp, Homo sapiens
tgcttcatcattccctc

SEQ ID NO: 3195345 - DNA, 15 bp, Homo sapiens
tgcttccaattttct

SEQ ID NO: 3195346 - DNA, 21 bp, Homo sapiens
tgcttccaggtaaaaacagat

SEQ ID NO: 3195347 - DNA, 21 bp, Homo sapiens
tgcttcccacctccctgccca

SEQ ID NO: 3195348 - DNA, 15 bp, Homo sapiens
tgcttcccatcctac

SEQ ID NO: 3195349 - DNA, 18 bp, Homo sapiens
tgcttcccatcctaccct

SEQ ID NO: 3195350 - DNA, 23 bp, Homo sapiens
tgcttcccatcctaccctcgggc

SEQ ID NO: 3195351 - DNA, 17 bp, Homo sapiens
tgcttccccttcctaag

SEQ ID NO: 3195352 - DNA, 14 bp, Homo sapiens
tgcttcctcctgga

SEQ ID NO: 3195353 - DNA, 17 bp, Homo sapiens
tgcttcctgaaataaac

SEQ ID NO: 3195354 - DNA, 22 bp, Homo sapiens
tgcttctcaccgtgcagagctg

SEQ ID NO: 3195355 - DNA, 17 bp, Homo sapiens
tgcttctcatcttgtga

SEQ ID NO: 3195356 - DNA, 13 bp, Homo sapiens
tgcttctccagcc

SEQ ID NO: 3195357 - DNA, 14 bp, Homo sapiens
tgcttctccccaga

SEQ ID NO: 3195358 - DNA, 16 bp, Homo sapiens
tgcttctccccagaat

SEQ ID NO: 3195359 - DNA, 18 bp, Homo sapiens
tgcttctcctcccagcgt

SEQ ID NO: 3195360 - DNA, 23 bp, Homo sapiens
tgcttctcctcccagcgtgtgta

SEQ ID NO: 3195361 - DNA, 12 bp, Homo sapiens
tgcttctgtagc

SEQ ID NO: 3195362 - DNA, 14 bp, Homo sapiens
tgcttctgtagctt

SEQ ID NO: 3195363 - DNA, 15 bp, Homo sapiens
tgcttcttactgata

SEQ ID NO: 3195364 - DNA, 14 bp, Homo sapiens
tgcttcttgtgttt

SEQ ID NO: 3195365 - DNA, 16 bp, Homo sapiens
tgcttgaaattactgt

SEQ ID NO: 3195366 - DNA, 23 bp, Homo sapiens
tgcttgaaattactgtgtaaata

SEQ ID NO: 3195367 - DNA, 17 bp, Homo sapiens
tgcttgaacacagtatt

SEQ ID NO: 3195368 - DNA, 20 bp, Homo sapiens
tgcttgaacacagtattttc

SEQ ID NO: 3195369 - DNA, 12 bp, Homo sapiens
tgcttgaatgct

SEQ ID NO: 3195370 - DNA, 21 bp, Homo sapiens
tgcttgataggaattcatctt

SEQ ID NO: 3195371 - DNA, 12 bp, Homo sapiens
tgcttgattttt

SEQ ID NO: 3195372 - DNA, 15 bp, Homo sapiens
tgcttgccaaagtac

SEQ ID NO: 3195373 - DNA, 20 bp, Homo sapiens
tgcttgccgagcctaatgaa

SEQ ID NO: 3195374 - DNA, 21 bp, Homo sapiens
tgcttgcggcaaaaggaaagc

SEQ ID NO: 3195375 - DNA, 15 bp, Homo sapiens
tgcttgctttgaagt

SEQ ID NO: 3195376 - DNA, 17 bp, Homo sapiens
tgcttggaaattccttg

SEQ ID NO: 3195377 - DNA, 22 bp, Homo sapiens
tgcttggaaattccttgcccca

SEQ ID NO: 3195378 - DNA, 23 bp, Homo sapiens
tgcttggaaattccttgccccac

SEQ ID NO: 3195379 - DNA, 22 bp, Homo sapiens
tgcttggcagttgcagtgctgc

SEQ ID NO: 3195380 - DNA, 14 bp, Homo sapiens
tgcttggcccggcc

SEQ ID NO: 3195381 - DNA, 13 bp, Homo sapiens
tgcttgggctcca

SEQ ID NO: 3195382 - DNA, 14 bp, Homo sapiens
tgcttgggctccac

SEQ ID NO: 3195383 - DNA, 21 bp, Homo sapiens
tgcttgggctgacccagcatc

SEQ ID NO: 3195384 - DNA, 15 bp, Homo sapiens
tgcttggtggggctc

SEQ ID NO: 3195385 - DNA, 22 bp, Homo sapiens
tgcttggtggggctcgtggcct

SEQ ID NO: 3195386 - DNA, 20 bp, Homo sapiens
tgcttgtaacaagaaaacat

SEQ ID NO: 3195387 - DNA, 15 bp, Homo sapiens
tgcttgtcttctggt

SEQ ID NO: 3195388 - DNA, 19 bp, Homo sapiens
tgcttgttagagagaaaga

SEQ ID NO: 3195389 - DNA, 16 bp, Homo sapiens
tgcttgttccctctcc

SEQ ID NO: 3195390 - DNA, 19 bp, Homo sapiens
tgcttgttccctctccctg

SEQ ID NO: 3195391 - DNA, 20 bp, Homo sapiens
tgcttgttgaaaatatttct

SEQ ID NO: 3195392 - DNA, 14 bp, Homo sapiens
tgcttgtttacagc

SEQ ID NO: 3195393 - DNA, 13 bp, Homo sapiens
tgcttgtttatga

SEQ ID NO: 3195394 - DNA, 20 bp, Homo sapiens
tgctttaaagggcctgcctg

SEQ ID NO: 3195395 - DNA, 21 bp, Homo sapiens
tgctttaaagggcctgcctgg

SEQ ID NO: 3195396 - DNA, 15 bp, Homo sapiens
tgctttaaagtgtaa

SEQ ID NO: 3195397 - DNA, 20 bp, Homo sapiens
tgctttaattaattaagtat

SEQ ID NO: 3195398 - DNA, 13 bp, Homo sapiens
tgctttagcttga

SEQ ID NO: 3195399 - DNA, 22 bp, Homo sapiens
tgctttagcttgaaaaggtgac

SEQ ID NO: 3195400 - DNA, 17 bp, Homo sapiens
tgctttattaatgtttt

SEQ ID NO: 3195401 - DNA, 21 bp, Homo sapiens
tgctttattaatgttttcaaa

SEQ ID NO: 3195402 - DNA, 23 bp, Homo sapiens
tgctttattaatgttttcaaaag

SEQ ID NO: 3195403 - DNA, 19 bp, Homo sapiens
tgctttcaattacaaagca

SEQ ID NO: 3195404 - DNA, 18 bp, Homo sapiens
tgctttccagcctgggca

SEQ ID NO: 3195405 - DNA, 14 bp, Homo sapiens
tgctttcccctgtg

SEQ ID NO: 3195406 - DNA, 20 bp, Homo sapiens
tgctttcccctgtggggatc

SEQ ID NO: 3195407 - DNA, 14 bp, Homo sapiens
tgctttcctgggcc

SEQ ID NO: 3195408 - DNA, 15 bp, Homo sapiens
tgctttcctgggcct

SEQ ID NO: 3195409 - DNA, 21 bp, Homo sapiens
tgctttcggagctcctgtcca

SEQ ID NO: 3195410 - DNA, 16 bp, Homo sapiens
tggacatgagataatg

SEQ ID NO: 3195411 - DNA, 22 bp, Homo sapiens
tggaccaattattgatatatat

SEQ ID NO: 3195412 - DNA, 15 bp, Homo sapiens
tggaccactgggcaa

SEQ ID NO: 3195413 - DNA, 15 bp, Homo sapiens
tggaccccagctggg

SEQ ID NO: 3195414 - DNA, 16 bp, Homo sapiens
tggaccccagctggga

SEQ ID NO: 3195415 - DNA, 13 bp, Homo sapiens
tggacccccagct

SEQ ID NO: 3195416 - DNA, 16 bp, Homo sapiens
tggaccctgcttcacc

SEQ ID NO: 3195417 - DNA, 16 bp, Homo sapiens
tggaccgggtgggcct

SEQ ID NO: 3195418 - DNA, 17 bp, Homo sapiens
tggaccgggtgggcctg

SEQ ID NO: 3195419 - DNA, 23 bp, Homo sapiens
tggaccgggtgggcctggcctga

SEQ ID NO: 3195420 - DNA, 15 bp, Homo sapiens
tggaccgtggacagg

SEQ ID NO: 3195421 - DNA, 18 bp, Homo sapiens
tggacctaaatggcctca

SEQ ID NO: 3195422 - DNA, 22 bp, Homo sapiens
tggacctaatccaagcatccct

SEQ ID NO: 3195423 - DNA, 22 bp, Homo sapiens
tggacctatgtcctaaggacac

SEQ ID NO: 3195424 - DNA, 19 bp, Homo sapiens
tggacctctcagcagaaac

SEQ ID NO: 3195425 - DNA, 13 bp, Homo sapiens
tggacggcaggct

SEQ ID NO: 3195426 - DNA, 15 bp, Homo sapiens
tggacggcaggctca

SEQ ID NO: 3195427 - DNA, 20 bp, Homo sapiens
tggacggcaggctcactgcc

SEQ ID NO: 3195428 - DNA, 23 bp, Homo sapiens
tggacggcaggctcactgccagg

SEQ ID NO: 3195429 - DNA, 16 bp, Homo sapiens
tggactaaatgcctag

SEQ ID NO: 3195430 - DNA, 21 bp, Homo sapiens
tggactaaccccaacgcacag

SEQ ID NO: 3195431 - DNA, 24 bp, Homo sapiens
tggactacccacgttctcacaccc

SEQ ID NO: 3195432 - DNA, 15 bp, Homo sapiens
tggactatctgtctg

SEQ ID NO: 3195433 - DNA, 15 bp, Homo sapiens
tggactcagcccacc

SEQ ID NO: 3195434 - DNA, 22 bp, Homo sapiens
tggactcagcccacctgcaccc

SEQ ID NO: 3195435 - DNA, 19 bp, Homo sapiens
tggactcctgccaccagca

SEQ ID NO: 3195436 - DNA, 21 bp, Homo sapiens
tggactctaaagaccaaactt

SEQ ID NO: 3195437 - DNA, 13 bp, Homo sapiens
tggactctcaggg

SEQ ID NO: 3195438 - DNA, 13 bp, Homo sapiens
tggactctgcaca

SEQ ID NO: 3195439 - DNA, 14 bp, Homo sapiens
tggactctgcatcc

SEQ ID NO: 3195440 - DNA, 15 bp, Homo sapiens
tggactgaagcctgc

SEQ ID NO: 3195441 - DNA, 13 bp, Homo sapiens
tggactgacattt

SEQ ID NO: 3195442 - DNA, 14 bp, Homo sapiens
tggactgcagaagc

SEQ ID NO: 3195443 - DNA, 15 bp, Homo sapiens
tggactgcgctggac

SEQ ID NO: 3195444 - DNA, 14 bp, Homo sapiens
tggactggaagggg

SEQ ID NO: 3195445 - DNA, 23 bp, Homo sapiens
tggactggaggcccctggagcca

SEQ ID NO: 3195446 - DNA, 21 bp, Homo sapiens
tggactggcgttcacctccct

SEQ ID NO: 3195447 - DNA, 22 bp, Homo sapiens
tggactggcgttcacctccctg

SEQ ID NO: 3195448 - DNA, 20 bp, Homo sapiens
tggactggctagagtcctca

SEQ ID NO: 3195449 - DNA, 13 bp, Homo sapiens
tggactgggaggt

SEQ ID NO: 3195450 - DNA, 21 bp, Homo sapiens
tggactgggttgcgtcctgac

SEQ ID NO: 3195451 - DNA, 17 bp, Homo sapiens
tggactggtggcccctg

SEQ ID NO: 3195452 - DNA, 15 bp, Homo sapiens
tggactgtcatagaa

SEQ ID NO: 3195453 - DNA, 21 bp, Homo sapiens
tggactgtcatagaaattaca

SEQ ID NO: 3195454 - DNA, 21 bp, Homo sapiens
tggactgtgatgccacacaga

SEQ ID NO: 3195455 - DNA, 18 bp, Homo sapiens
tggactgttcacggcaga

SEQ ID NO: 3195456 - DNA, 14 bp, Homo sapiens
tggacttcctgggg

SEQ ID NO: 3195457 - DNA, 15 bp, Homo sapiens
tggacttcctggggc

SEQ ID NO: 3195458 - DNA, 18 bp, Homo sapiens
tggacttctacctgccct

SEQ ID NO: 3195459 - DNA, 14 bp, Homo sapiens
tggacttgcctctg

SEQ ID NO: 3195460 - DNA, 21 bp, Homo sapiens
tggacttgtatatttgtacaa

SEQ ID NO: 3195461 - DNA, 16 bp, Homo sapiens
tggactttcaaaatta

SEQ ID NO: 3195462 - DNA, 23 bp, Homo sapiens
tggactttcaaaattaaatctgt

SEQ ID NO: 3195463 - DNA, 18 bp, Homo sapiens
tggactttcctgcaactc

SEQ ID NO: 3195464 - DNA, 23 bp, Homo sapiens
tggactttggtactgctgtcttc

SEQ ID NO: 3195465 - DNA, 15 bp, Homo sapiens
tggagaaaaaaattg

SEQ ID NO: 3195466 - DNA, 17 bp, Homo sapiens
tggagaaagaagtggag

SEQ ID NO: 3195467 - DNA, 14 bp, Homo sapiens
tggagaaagagctg

SEQ ID NO: 3195468 - DNA, 20 bp, Homo sapiens
tggagaaagagctgcctgga

SEQ ID NO: 3195469 - DNA, 11 bp, Homo sapiens
tggagaaatta

SEQ ID NO: 3195470 - DNA, 19 bp, Homo sapiens
tggagaaattatttaataa

SEQ ID NO: 3195471 - DNA, 21 bp, Homo sapiens
tggagaaattatttaataaaa

SEQ ID NO: 3195472 - DNA, 23 bp, Homo sapiens
tggagaacagtggttgcctgggg

SEQ ID NO: 3195473 - DNA, 17 bp, Homo sapiens
tggagaagaccctcccc

SEQ ID NO: 3195474 - DNA, 12 bp, Homo sapiens
tggagaagagag

SEQ ID NO: 3195475 - DNA, 22 bp, Homo sapiens
tggagaattgctgaagggcatt

SEQ ID NO: 3195476 - DNA, 23 bp, Homo sapiens
tggcagagaaggcctcttgtgct

SEQ ID NO: 3195477 - DNA, 13 bp, Homo sapiens
tggcagagagaga

SEQ ID NO: 3195478 - DNA, 12 bp, Homo sapiens
tggcagagttac

SEQ ID NO: 3195479 - DNA, 17 bp, Homo sapiens
tggcagagtttgtgtgt

SEQ ID NO: 3195480 - DNA, 13 bp, Homo sapiens
tggcagattttac

SEQ ID NO: 3195481 - DNA, 15 bp, Homo sapiens
tggcagattttacaa

SEQ ID NO: 3195482 - DNA, 19 bp, Homo sapiens
tggcagcagcaggtgtggc

SEQ ID NO: 3195483 - DNA, 12 bp, Homo sapiens
tggcagccatgc

SEQ ID NO: 3195484 - DNA, 14 bp, Homo sapiens
tggcagccatgcct

SEQ ID NO: 3195485 - DNA, 11 bp, Homo sapiens
tggcagcccag

SEQ ID NO: 3195486 - DNA, 16 bp, Homo sapiens
tggcagccgtgccttc

SEQ ID NO: 3195487 - DNA, 17 bp, Homo sapiens
tggcagccgtgccttca

SEQ ID NO: 3195488 - DNA, 18 bp, Homo sapiens
tggcagccgtgccttcag

SEQ ID NO: 3195489 - DNA, 21 bp, Homo sapiens
tggcagccgtgccttcagctc

SEQ ID NO: 3195490 - DNA, 13 bp, Homo sapiens
tggcagccttggc

SEQ ID NO: 3195491 - DNA, 17 bp, Homo sapiens
tggcagccttggcaaac

SEQ ID NO: 3195492 - DNA, 15 bp, Homo sapiens
tggcagctagactgg

SEQ ID NO: 3195493 - DNA, 16 bp, Homo sapiens
tggcagctagactgga

SEQ ID NO: 3195494 - DNA, 20 bp, Homo sapiens
tggcagctagactggagtga

SEQ ID NO: 3195495 - DNA, 16 bp, Homo sapiens
tggcagctcctctcct

SEQ ID NO: 3195496 - DNA, 18 bp, Homo sapiens
tggcagctcctctccttg

SEQ ID NO: 3195497 - DNA, 22 bp, Homo sapiens
tggcagctgcggtccacccagg

SEQ ID NO: 3195498 - DNA, 22 bp, Homo sapiens
tggcaggcacacagcagccccc

SEQ ID NO: 3195499 - DNA, 23 bp, Homo sapiens
tggcaggcacacagcagcccccc

SEQ ID NO: 3195500 - DNA, 13 bp, Homo sapiens
tggcaggccagtg

SEQ ID NO: 3195501 - DNA, 18 bp, Homo sapiens
tggcaggcggggggggcg

SEQ ID NO: 3195502 - DNA, 20 bp, Homo sapiens
tggcagggaggtcaggccct

SEQ ID NO: 3195503 - DNA, 21 bp, Homo sapiens
tggcagggaggtcaggccctg

SEQ ID NO: 3195504 - DNA, 22 bp, Homo sapiens
tggcagggaggtcaggccctgg

SEQ ID NO: 3195505 - DNA, 12 bp, Homo sapiens
tggcagggctca

SEQ ID NO: 3195506 - DNA, 17 bp, Homo sapiens
tggcagggctcaggatt

SEQ ID NO: 3195507 - DNA, 21 bp, Homo sapiens
tggcagggctggccccagggc

SEQ ID NO: 3195508 - DNA, 17 bp, Homo sapiens
tggcaggggaagccttg

SEQ ID NO: 3195509 - DNA, 18 bp, Homo sapiens
tggcaggggacaggagtc

SEQ ID NO: 3195510 - DNA, 24 bp, Homo sapiens
tggcaggggagacaggagcctagc

SEQ ID NO: 3195511 - DNA, 14 bp, Homo sapiens
tggcaggggagcag

SEQ ID NO: 3195512 - DNA, 15 bp, Homo sapiens
tggcaggggagcagg

SEQ ID NO: 3195513 - DNA, 18 bp, Homo sapiens
tggcaggtgcagatgggc

SEQ ID NO: 3195514 - DNA, 23 bp, Homo sapiens
tggcaggtgtcatatgactgatt

SEQ ID NO: 3195515 - DNA, 22 bp, Homo sapiens
tggcagtaaagagaaactttgt

SEQ ID NO: 3195516 - DNA, 18 bp, Homo sapiens
tggcagtgagtgagcctg

SEQ ID NO: 3195517 - DNA, 19 bp, Homo sapiens
tggcagtgagtgagcctgg

SEQ ID NO: 3195518 - DNA, 21 bp, Homo sapiens
tggcagtgagtgagcctggct

SEQ ID NO: 3195519 - DNA, 16 bp, Homo sapiens
tggcagtttggtattt

SEQ ID NO: 3195520 - DNA, 16 bp, Homo sapiens
tggcatagccccggcc

SEQ ID NO: 3195521 - DNA, 14 bp, Homo sapiens
tggcatagctctgg

SEQ ID NO: 3195522 - DNA, 23 bp, Homo sapiens
tggcatcaagaggtgggagggcc

SEQ ID NO: 3195523 - DNA, 20 bp, Homo sapiens
tggcatcacagggcagagcc

SEQ ID NO: 3195524 - DNA, 14 bp, Homo sapiens
tggcatcatggtgg

SEQ ID NO: 3195525 - DNA, 21 bp, Homo sapiens
tggcatcgcaccattctgact

SEQ ID NO: 3195526 - DNA, 16 bp, Homo sapiens
tggcatcgtagaagag

SEQ ID NO: 3195527 - DNA, 21 bp, Homo sapiens
tggcatctgaatgaaaataac

SEQ ID NO: 3195528 - DNA, 18 bp, Homo sapiens
tggcatctgacacaaaaa

SEQ ID NO: 3195529 - DNA, 21 bp, Homo sapiens
tggcatctttgccttgggctg

SEQ ID NO: 3195530 - DNA, 14 bp, Homo sapiens
tggcatgaggaggt

SEQ ID NO: 3195531 - DNA, 16 bp, Homo sapiens
tggcatgcttaaattt

SEQ ID NO: 3195532 - DNA, 17 bp, Homo sapiens
tggcatgcttaaatttt

SEQ ID NO: 3195533 - DNA, 18 bp, Homo sapiens
tggcatgcttaaatttta

SEQ ID NO: 3195534 - DNA, 16 bp, Homo sapiens
tggcatggatttctgt

SEQ ID NO: 3195535 - DNA, 17 bp, Homo sapiens
tggcatgggcgcaggcc

SEQ ID NO: 3195536 - DNA, 22 bp, Homo sapiens
tggcatgtgctgtgaccattta

SEQ ID NO: 3195537 - DNA, 13 bp, Homo sapiens
tggcatgtggaga

SEQ ID NO: 3195538 - DNA, 16 bp, Homo sapiens
tggcatgtggagacac

SEQ ID NO: 3195539 - DNA, 14 bp, Homo sapiens
tggcatgtggcctg

SEQ ID NO: 3195540 - DNA, 16 bp, Homo sapiens
tggcatgtggcctgtg

SEQ ID NO: 3195541 - DNA, 18 bp, Homo sapiens
tggcattgcactgcttat

SEQ ID NO: 3195542 - DNA, 20 bp, Homo sapiens
tggccaaattatttgtgtaa

SEQ ID NO: 3195543 - DNA, 22 bp, Homo sapiens
tggccaacatcgtgaaaccctg

SEQ ID NO: 3195544 - DNA, 14 bp, Homo sapiens
tggccaatgtgcat

SEQ ID NO: 3195545 - DNA, 22 bp, Homo sapiens
tggccacagcccatccatagta

SEQ ID NO: 3195546 - DNA, 16 bp, Homo sapiens
tggccacagccccctt

SEQ ID NO: 3195547 - DNA, 12 bp, Homo sapiens
tggccaccaggc

SEQ ID NO: 3195548 - DNA, 17 bp, Homo sapiens
tggccaccaggctggcg

SEQ ID NO: 3195549 - DNA, 19 bp, Homo sapiens
tggccaccaggctggcgca

SEQ ID NO: 3195550 - DNA, 22 bp, Homo sapiens
tggccaccaggctggcgcagcc

SEQ ID NO: 3195551 - DNA, 14 bp, Homo sapiens
tggccacccctccc

SEQ ID NO: 3195552 - DNA, 22 bp, Homo sapiens
tggccacccgttctgctggcct

SEQ ID NO: 3195553 - DNA, 21 bp, Homo sapiens
tggccacctgaggtgggccca

SEQ ID NO: 3195554 - DNA, 22 bp, Homo sapiens
tggccacctgaggtgggcccag

SEQ ID NO: 3195555 - DNA, 22 bp, Homo sapiens
tggccacctgtagccatctgca

SEQ ID NO: 3195556 - DNA, 20 bp, Homo sapiens
tggccactccagacccctgg

SEQ ID NO: 3195557 - DNA, 20 bp, Homo sapiens
tggccactccgagaggtggg

SEQ ID NO: 3195558 - DNA, 23 bp, Homo sapiens
tggccactccgagaggtgggcca

SEQ ID NO: 3195559 - DNA, 18 bp, Homo sapiens
tggccactgcacagagct

SEQ ID NO: 3195560 - DNA, 16 bp, Homo sapiens
tggccacttatttcac

SEQ ID NO: 3195561 - DNA, 16 bp, Homo sapiens
tggccactttaagaga

SEQ ID NO: 3195562 - DNA, 13 bp, Homo sapiens
tggccagagagcc

SEQ ID NO: 3195563 - DNA, 20 bp, Homo sapiens
tggccagagagggcccagct

SEQ ID NO: 3195564 - DNA, 22 bp, Homo sapiens
tggccagagagggcccagctgt

SEQ ID NO: 3195565 - DNA, 20 bp, Homo sapiens
tggccagagctggaaggcag

SEQ ID NO: 3195566 - DNA, 18 bp, Homo sapiens
tggccagagctgggaggc

SEQ ID NO: 3195567 - DNA, 19 bp, Homo sapiens
tggccagatgcaccagccc

SEQ ID NO: 3195568 - DNA, 15 bp, Homo sapiens
tggccagcccggctg

SEQ ID NO: 3195569 - DNA, 17 bp, Homo sapiens
tggccagcccggctggt

SEQ ID NO: 3195570 - DNA, 19 bp, Homo sapiens
tggccagcccggctggttt

SEQ ID NO: 3195571 - DNA, 18 bp, Homo sapiens
tggccagcctggggcctg

SEQ ID NO: 3195572 - DNA, 14 bp, Homo sapiens
tggccaggagcagg

SEQ ID NO: 3195573 - DNA, 22 bp, Homo sapiens
tggccaggagcaggcacgggtg

SEQ ID NO: 3195574 - DNA, 18 bp, Homo sapiens
tggccaggcactgccttc

SEQ ID NO: 3195575 - DNA, 19 bp, Homo sapiens
tggccaggcagatctgtgc

SEQ ID NO: 3195576 - DNA, 17 bp, Homo sapiens
tggccaggctggtctca

SEQ ID NO: 3195577 - DNA, 16 bp, Homo sapiens
tggccagggcagggcc

SEQ ID NO: 3195578 - DNA, 17 bp, Homo sapiens
tggccagggcagggcca

SEQ ID NO: 3195579 - DNA, 20 bp, Homo sapiens
tggccagggccacgctccag

SEQ ID NO: 3195580 - DNA, 17 bp, Homo sapiens
tggccaggtggccactc

SEQ ID NO: 3195581 - DNA, 15 bp, Homo sapiens
tggccagtccaggct

SEQ ID NO: 3195582 - DNA, 17 bp, Homo sapiens
tggccagtccaggctgc

SEQ ID NO: 3195583 - DNA, 23 bp, Homo sapiens
tggccagtgtgacaaggattgct

SEQ ID NO: 3195584 - DNA, 16 bp, Homo sapiens
tggccagtgtgatccc

SEQ ID NO: 3195585 - DNA, 16 bp, Homo sapiens
tggccagttgcccaga

SEQ ID NO: 3195586 - DNA, 14 bp, Homo sapiens
tggccatccctggg

SEQ ID NO: 3195587 - DNA, 21 bp, Homo sapiens
tggccatccctgggcccctcc

SEQ ID NO: 3195588 - DNA, 22 bp, Homo sapiens
tggccatccctgggcccctcca

SEQ ID NO: 3195589 - DNA, 14 bp, Homo sapiens
tggccatccctgtg

SEQ ID NO: 3195590 - DNA, 16 bp, Homo sapiens
tggccatccctgtgag

SEQ ID NO: 3195591 - DNA, 22 bp, Homo sapiens
tggccatggtacccccttctgg

SEQ ID NO: 3195592 - DNA, 22 bp, Homo sapiens
tggccattctttttttcttggc

SEQ ID NO: 3195593 - DNA, 19 bp, Homo sapiens
tggcccaaaacgtcttatt

SEQ ID NO: 3195594 - DNA, 22 bp, Homo sapiens
tggcccagccaaaccctgtctg

SEQ ID NO: 3195595 - DNA, 15 bp, Homo sapiens
tggcccagccggcct

SEQ ID NO: 3195596 - DNA, 22 bp, Homo sapiens
tggcccagccggcctctctggc

SEQ ID NO: 3195597 - DNA, 22 bp, Homo sapiens
tggcccaggaattagagaagct

SEQ ID NO: 3195598 - DNA, 22 bp, Homo sapiens
tggcccatagaaacatgacact

SEQ ID NO: 3195599 - DNA, 15 bp, Homo sapiens
tggcccatctcagcc

SEQ ID NO: 3195600 - DNA, 16 bp, Homo sapiens
tggcccatctcagcct

SEQ ID NO: 3195601 - DNA, 12 bp, Homo sapiens
tgcataaatatg

SEQ ID NO: 3195602 - DNA, 23 bp, Homo sapiens
tgcataagattaaaggaaggaaa

SEQ ID NO: 3195603 - DNA, 14 bp, Homo sapiens
tgcataagttaact

SEQ ID NO: 3195604 - DNA, 17 bp, Homo sapiens
tgcataagttaacttcc

SEQ ID NO: 3195605 - DNA, 19 bp, Homo sapiens
tgcataataagctaaagag

SEQ ID NO: 3195606 - DNA, 17 bp, Homo sapiens
tgcataatgcaatcaaa

SEQ ID NO: 3195607 - DNA, 13 bp, Homo sapiens
tgcataatgcttt

SEQ ID NO: 3195608 - DNA, 20 bp, Homo sapiens
tgcataatgctttggaaaaa

SEQ ID NO: 3195609 - DNA, 21 bp, Homo sapiens
tgcatacagttttctagcaat

SEQ ID NO: 3195610 - DNA, 13 bp, Homo sapiens
tgcatactgaaaa

SEQ ID NO: 3195611 - DNA, 17 bp, Homo sapiens
tgcatactgagccaagt

SEQ ID NO: 3195612 - DNA, 22 bp, Homo sapiens
tgcatactttgtattttgatta

SEQ ID NO: 3195613 - DNA, 19 bp, Homo sapiens
tgcatactttttaaatgta

SEQ ID NO: 3195614 - DNA, 17 bp, Homo sapiens
tgcatagaactgggtaa

SEQ ID NO: 3195615 - DNA, 14 bp, Homo sapiens
tgcatagagccctg

SEQ ID NO: 3195616 - DNA, 17 bp, Homo sapiens
tgcatagagccctggcc

SEQ ID NO: 3195617 - DNA, 19 bp, Homo sapiens
tgcatagagccctggccag

SEQ ID NO: 3195618 - DNA, 22 bp, Homo sapiens
tgcatagagccctggccagccc

SEQ ID NO: 3195619 - DNA, 17 bp, Homo sapiens
tgcatagctctccttcc

SEQ ID NO: 3195620 - DNA, 21 bp, Homo sapiens
tgcatagtaccaatcatttta

SEQ ID NO: 3195621 - DNA, 14 bp, Homo sapiens
tgcatagtgctggg

SEQ ID NO: 3195622 - DNA, 18 bp, Homo sapiens
tgcatagttgtagacaaa

SEQ ID NO: 3195623 - DNA, 19 bp, Homo sapiens
tgcatataaatatatttaa

SEQ ID NO: 3195624 - DNA, 15 bp, Homo sapiens
tgcatatgaaatcct

SEQ ID NO: 3195625 - DNA, 15 bp, Homo sapiens
tgcatatgttgaata

SEQ ID NO: 3195626 - DNA, 19 bp, Homo sapiens
tgcatatgttgaatacttt

SEQ ID NO: 3195627 - DNA, 16 bp, Homo sapiens
tgcatattcctttcta

SEQ ID NO: 3195628 - DNA, 22 bp, Homo sapiens
tgcatattcctttctatcattt

SEQ ID NO: 3195629 - DNA, 15 bp, Homo sapiens
tgcatatttatccaa

SEQ ID NO: 3195630 - DNA, 16 bp, Homo sapiens
tgcatcacctctgtaa

SEQ ID NO: 3195631 - DNA, 14 bp, Homo sapiens
tgcatcactgggtg

SEQ ID NO: 3195632 - DNA, 13 bp, Homo sapiens
tgcatcaggtcct

SEQ ID NO: 3195633 - DNA, 20 bp, Homo sapiens
tgcatcagtattaatactaa

SEQ ID NO: 3195634 - DNA, 16 bp, Homo sapiens
tgcatcatccttgcag

SEQ ID NO: 3195635 - DNA, 17 bp, Homo sapiens
tgcatcatctgtagata

SEQ ID NO: 3195636 - DNA, 19 bp, Homo sapiens
tgcatcattactgttccag

SEQ ID NO: 3195637 - DNA, 16 bp, Homo sapiens
tgcatccaactccagg

SEQ ID NO: 3195638 - DNA, 15 bp, Homo sapiens
tgcatccattgttgt

SEQ ID NO: 3195639 - DNA, 20 bp, Homo sapiens
tgcatccattgttgtgtctg

SEQ ID NO: 3195640 - DNA, 13 bp, Homo sapiens
tgcatccctgaga

SEQ ID NO: 3195641 - DNA, 12 bp, Homo sapiens
tgcatcctgtga

SEQ ID NO: 3195642 - DNA, 18 bp, Homo sapiens
tgcatccttcctataact

SEQ ID NO: 3195643 - DNA, 14 bp, Homo sapiens
tgcatcgggaaaga

SEQ ID NO: 3195644 - DNA, 19 bp, Homo sapiens
tgcatcgggaaagaagaaa

SEQ ID NO: 3195645 - DNA, 13 bp, Homo sapiens
tgcatctcagccc

SEQ ID NO: 3195646 - DNA, 20 bp, Homo sapiens
tgcatgaaaaatcatgggcc

SEQ ID NO: 3195647 - DNA, 21 bp, Homo sapiens
tgcatgaaattgtatctcagt

SEQ ID NO: 3195648 - DNA, 19 bp, Homo sapiens
tgcatgaaattttgcctgc

SEQ ID NO: 3195649 - DNA, 16 bp, Homo sapiens
tgcatgaagagaagca

SEQ ID NO: 3195650 - DNA, 23 bp, Homo sapiens
tgcatgaagagaagcaattttgg

SEQ ID NO: 3195651 - DNA, 14 bp, Homo sapiens
tgcatgatggtgag

SEQ ID NO: 3195652 - DNA, 18 bp, Homo sapiens
tgcatgattttgtaaccc

SEQ ID NO: 3195653 - DNA, 15 bp, Homo sapiens
tgcatgcctgtaatc

SEQ ID NO: 3195654 - DNA, 21 bp, Homo sapiens
tgcatgctattcacaattatt

SEQ ID NO: 3195655 - DNA, 15 bp, Homo sapiens
tgcatggacctaaca

SEQ ID NO: 3195656 - DNA, 21 bp, Homo sapiens
tgcatggacctaacattcgat

SEQ ID NO: 3195657 - DNA, 16 bp, Homo sapiens
tgcatggattcagcat

SEQ ID NO: 3195658 - DNA, 16 bp, Homo sapiens
tgcatggctccagaaa

SEQ ID NO: 3195659 - DNA, 19 bp, Homo sapiens
tgcatggctccagaaatgt

SEQ ID NO: 3195660 - DNA, 17 bp, Homo sapiens
tgcatggggaaagagat

SEQ ID NO: 3195661 - DNA, 18 bp, Homo sapiens
tgcatgtagaggcttgtt

SEQ ID NO: 3195662 - DNA, 21 bp, Homo sapiens
tgcatgtagaggcttgtttac

SEQ ID NO: 3195663 - DNA, 15 bp, Homo sapiens
tgcatgtcgcacaat

SEQ ID NO: 3195664 - DNA, 16 bp, Homo sapiens
tgcatgtcgcacaatg

SEQ ID NO: 3195665 - DNA, 18 bp, Homo sapiens
tgcatgtcgcacaatgtt

SEQ ID NO: 3195666 - DNA, 11 bp, Homo sapiens
tgcatgtgtgt

SEQ ID NO: 3195667 - DNA, 14 bp, Homo sapiens
tgcatgtgtgtata

SEQ ID NO: 3195668 - DNA, 19 bp, Homo sapiens
tgcatgtgtgtataagtgc

SEQ ID NO: 3195669 - DNA, 19 bp, Homo sapiens
tgcatgttacataagataa

SEQ ID NO: 3195670 - DNA, 17 bp, Homo sapiens
tgcattaaactgtgaat

SEQ ID NO: 3195671 - DNA, 14 bp, Homo sapiens
tgcattaaattcac

SEQ ID NO: 3195672 - DNA, 19 bp, Homo sapiens
tgcattaaattcacaaact

SEQ ID NO: 3195673 - DNA, 15 bp, Homo sapiens
tgcattacagagagg

SEQ ID NO: 3195674 - DNA, 22 bp, Homo sapiens
tgcattacagagaggagaaaca

SEQ ID NO: 3195675 - DNA, 22 bp, Homo sapiens
tgcattagaaatagacagtata

SEQ ID NO: 3195676 - DNA, 14 bp, Homo sapiens
tgcattagcacaga

SEQ ID NO: 3195677 - DNA, 18 bp, Homo sapiens
tgcattagcacagatttt

SEQ ID NO: 3195678 - DNA, 23 bp, Homo sapiens
tgcattagcacagattttaattg

SEQ ID NO: 3195679 - DNA, 19 bp, Homo sapiens
tgcattagggatgcctcct

SEQ ID NO: 3195680 - DNA, 15 bp, Homo sapiens
tgcattattaaattg

SEQ ID NO: 3195681 - DNA, 23 bp, Homo sapiens
tgcattattcatttagtgagtta

SEQ ID NO: 3195682 - DNA, 23 bp, Homo sapiens
tgcattcacaggggttggctggg

SEQ ID NO: 3195683 - DNA, 11 bp, Homo sapiens
tgcattcattt

SEQ ID NO: 3195684 - DNA, 15 bp, Homo sapiens
tgcattcctttgtct

SEQ ID NO: 3195685 - DNA, 13 bp, Homo sapiens
tgcattctactag

SEQ ID NO: 3195686 - DNA, 16 bp, Homo sapiens
tgcattctttggtaat

SEQ ID NO: 3195687 - DNA, 13 bp, Homo sapiens
tgcattgaacaca

SEQ ID NO: 3195688 - DNA, 14 bp, Homo sapiens
tgcattgaacacaa

SEQ ID NO: 3195689 - DNA, 18 bp, Homo sapiens
tgcattgaacacaaactg

SEQ ID NO: 3195690 - DNA, 19 bp, Homo sapiens
tgcattgaacacaaactgt

SEQ ID NO: 3195691 - DNA, 21 bp, Homo sapiens
tgcattgaacacaaactgtaa

SEQ ID NO: 3195692 - DNA, 20 bp, Homo sapiens
tgcattgaggaaatattaat

SEQ ID NO: 3195693 - DNA, 15 bp, Homo sapiens
tgcattgctggtaga

SEQ ID NO: 3195694 - DNA, 16 bp, Homo sapiens
tgcattgctggtagag

SEQ ID NO: 3195695 - DNA, 14 bp, Homo sapiens
tgccaagacaaatc

SEQ ID NO: 3195696 - DNA, 16 bp, Homo sapiens
tgccaagacaaatcaa

SEQ ID NO: 3195697 - DNA, 22 bp, Homo sapiens
tgccaagagtcaacaggtcact

SEQ ID NO: 3195698 - DNA, 13 bp, Homo sapiens
tgccaagccagat

SEQ ID NO: 3195699 - DNA, 15 bp, Homo sapiens
tgccaagctccaagc

SEQ ID NO: 3195700 - DNA, 23 bp, Homo sapiens
tgccaagctccaagccccatctt

SEQ ID NO: 3195701 - DNA, 15 bp, Homo sapiens
tgccaaggagcccct

SEQ ID NO: 3195702 - DNA, 21 bp, Homo sapiens
tgccaaggccagagtggcctg

SEQ ID NO: 3195703 - DNA, 15 bp, Homo sapiens
tgccaagtctcagaa

SEQ ID NO: 3195704 - DNA, 23 bp, Homo sapiens
tgccaagtggggatggggcctcc

SEQ ID NO: 3195705 - DNA, 20 bp, Homo sapiens
tgccaagttgctgtcactgt

SEQ ID NO: 3195706 - DNA, 11 bp, Homo sapiens
tgccaataaag

SEQ ID NO: 3195707 - DNA, 21 bp, Homo sapiens
tgccaatactagtcaccccaa

SEQ ID NO: 3195708 - DNA, 19 bp, Homo sapiens
tgccaatatgtattgtaaa

SEQ ID NO: 3195709 - DNA, 21 bp, Homo sapiens
tgccaatattaaatctgctgg

SEQ ID NO: 3195710 - DNA, 15 bp, Homo sapiens
tgccaattgctaccg

SEQ ID NO: 3195711 - DNA, 18 bp, Homo sapiens
tgccaattgctaccgaga

SEQ ID NO: 3195712 - DNA, 16 bp, Homo sapiens
tgccacaacagaataa

SEQ ID NO: 3195713 - DNA, 20 bp, Homo sapiens
tgccacaacagaataaagca

SEQ ID NO: 3195714 - DNA, 21 bp, Homo sapiens
tgccacaacagaataaagcag

SEQ ID NO: 3195715 - DNA, 22 bp, Homo sapiens
tgccacaacagaataaagcagc

SEQ ID NO: 3195716 - DNA, 16 bp, Homo sapiens
tgccacacctggcctt

SEQ ID NO: 3195717 - DNA, 22 bp, Homo sapiens
tgccacacttcaggctcttctc

SEQ ID NO: 3195718 - DNA, 11 bp, Homo sapiens
tgccacaggcc

SEQ ID NO: 3195719 - DNA, 12 bp, Homo sapiens
tgccacaggcct

SEQ ID NO: 3195720 - DNA, 13 bp, Homo sapiens
tgccacaggcctc

SEQ ID NO: 3195721 - DNA, 14 bp, Homo sapiens
tgccacaggcctcc

SEQ ID NO: 3195722 - DNA, 16 bp, Homo sapiens
tgccacatacaggtgc

SEQ ID NO: 3195723 - DNA, 18 bp, Homo sapiens
tgccacatacaggtgctc

SEQ ID NO: 3195724 - DNA, 22 bp, Homo sapiens
tgccacatcaaacctttgagta

SEQ ID NO: 3195725 - DNA, 15 bp, Homo sapiens
tgccacatggagccc

SEQ ID NO: 3195726 - DNA, 15 bp, Homo sapiens
tgccacatttctgat

SEQ ID NO: 3195727 - DNA, 23 bp, Homo sapiens
tgccacatttctgatcagaggtg

SEQ ID NO: 3195728 - DNA, 18 bp, Homo sapiens
tgccaccaacactgctca

SEQ ID NO: 3195729 - DNA, 15 bp, Homo sapiens
tgccaccaccctgcc

SEQ ID NO: 3195730 - DNA, 18 bp, Homo sapiens
tgccaccacctctgtggc

SEQ ID NO: 3195731 - DNA, 19 bp, Homo sapiens
tgccaccacctctgtggca

SEQ ID NO: 3195732 - DNA, 15 bp, Homo sapiens
tgccaccacgtctgc

SEQ ID NO: 3195733 - DNA, 18 bp, Homo sapiens
tgccaccacgtctgccag

SEQ ID NO: 3195734 - DNA, 21 bp, Homo sapiens
tgccaccacgtctgccaggcc

SEQ ID NO: 3195735 - DNA, 21 bp, Homo sapiens
tgccaccagagaccgtcctca

SEQ ID NO: 3195736 - DNA, 22 bp, Homo sapiens
tgccaccaggagaaccactaca

SEQ ID NO: 3195737 - DNA, 13 bp, Homo sapiens
tgccaccaggcca

SEQ ID NO: 3195738 - DNA, 17 bp, Homo sapiens
tgccaccaggccacctc

SEQ ID NO: 3195739 - DNA, 18 bp, Homo sapiens
tgccaccatggccagcca

SEQ ID NO: 3195740 - DNA, 12 bp, Homo sapiens
tgccacccactc

SEQ ID NO: 3195741 - DNA, 16 bp, Homo sapiens
tgccaccccatgtgcc

SEQ ID NO: 3195742 - DNA, 17 bp, Homo sapiens
tgccaccccatgtgcct

SEQ ID NO: 3195743 - DNA, 15 bp, Homo sapiens
tgccacctcccccca

SEQ ID NO: 3195744 - DNA, 18 bp, Homo sapiens
tgccacgtggtcactgtg

SEQ ID NO: 3195745 - DNA, 20 bp, Homo sapiens
tgccacgtggtcactgtgca

SEQ ID NO: 3195746 - DNA, 19 bp, Homo sapiens
tgccactcactaggccccc

SEQ ID NO: 3195747 - DNA, 17 bp, Homo sapiens
tgccactcattcctgta

SEQ ID NO: 3195748 - DNA, 17 bp, Homo sapiens
tgccactccctgagctt

SEQ ID NO: 3195749 - DNA, 16 bp, Homo sapiens
tgccactcctccctcc

SEQ ID NO: 3195750 - DNA, 17 bp, Homo sapiens
tgccactcctccctccg

SEQ ID NO: 3195751 - DNA, 14 bp, Homo sapiens
tgccactgccaggc

SEQ ID NO: 3195752 - DNA, 20 bp, Homo sapiens
tgccactgccaggcacctgg

SEQ ID NO: 3195753 - DNA, 17 bp, Homo sapiens
tgccactgcccgagctg

SEQ ID NO: 3195754 - DNA, 20 bp, Homo sapiens
tgccactgcccgagctggtg

SEQ ID NO: 3195755 - DNA, 19 bp, Homo sapiens
tgccactgcctcttcctcc

SEQ ID NO: 3195756 - DNA, 21 bp, Homo sapiens
tgccactgccttcgcttcttg

SEQ ID NO: 3195757 - DNA, 12 bp, Homo sapiens
tgccactgttgt

SEQ ID NO: 3195758 - DNA, 20 bp, Homo sapiens
tgccacttaatgtatgttac

SEQ ID NO: 3195759 - DNA, 21 bp, Homo sapiens
tgccactttacccacctagaa

SEQ ID NO: 3195760 - DNA, 22 bp, Homo sapiens
tgccactttacccacctagaac

SEQ ID NO: 3195761 - DNA, 20 bp, Homo sapiens
tgccactttgactcagaggc

SEQ ID NO: 3195762 - DNA, 21 bp, Homo sapiens
tgccactttgactcagaggct

SEQ ID NO: 3195763 - DNA, 19 bp, Homo sapiens
tgccactttgcacattttg

SEQ ID NO: 3195764 - DNA, 20 bp, Homo sapiens
tgccactttgcacattttga

SEQ ID NO: 3195765 - DNA, 24 bp, Homo sapiens
tgccagaaacagtgggagccctga

SEQ ID NO: 3195766 - DNA, 19 bp, Homo sapiens
tgccagaggtgggcaggtg

SEQ ID NO: 3195767 - DNA, 22 bp, Homo sapiens
tgccagcaatgacatctcaggg

SEQ ID NO: 3195768 - DNA, 18 bp, Homo sapiens
tgccagcacaggggcccc

SEQ ID NO: 3195769 - DNA, 20 bp, Homo sapiens
tgccagcacaggggccccag

SEQ ID NO: 3195770 - DNA, 17 bp, Homo sapiens
tgccagcagcagcaggt

SEQ ID NO: 3195771 - DNA, 18 bp, Homo sapiens
tgccagcagcagcaggtg

SEQ ID NO: 3195772 - DNA, 21 bp, Homo sapiens
tgccagcaggggggctgtgcc

SEQ ID NO: 3195773 - DNA, 15 bp, Homo sapiens
tgccagcattccaga

SEQ ID NO: 3195774 - DNA, 20 bp, Homo sapiens
tgccagcattccagacttca

SEQ ID NO: 3195775 - DNA, 11 bp, Homo sapiens
tgccagccaca

SEQ ID NO: 3195776 - DNA, 19 bp, Homo sapiens
tgccagccccctaaaagca

SEQ ID NO: 3195777 - DNA, 12 bp, Homo sapiens
tgccagcccctg

SEQ ID NO: 3195778 - DNA, 19 bp, Homo sapiens
tgccagcccctgcctgggt

SEQ ID NO: 3195779 - DNA, 11 bp, Homo sapiens
tgccagccctt

SEQ ID NO: 3195780 - DNA, 12 bp, Homo sapiens
tgccagcccttc

SEQ ID NO: 3195781 - DNA, 13 bp, Homo sapiens
tgccagcccttca

SEQ ID NO: 3195782 - DNA, 21 bp, Homo sapiens
tgccagccgtgatgctcaggc

SEQ ID NO: 3195783 - DNA, 16 bp, Homo sapiens
tgccagcctggcttct

SEQ ID NO: 3195784 - DNA, 17 bp, Homo sapiens
tgccagcctggcttctg

SEQ ID NO: 3195785 - DNA, 18 bp, Homo sapiens
tgccagcctggcttctgg

SEQ ID NO: 3195786 - DNA, 21 bp, Homo sapiens
tgccccccaaggttctggttc

SEQ ID NO: 3195787 - DNA, 17 bp, Homo sapiens
tgccccccgaggctgct

SEQ ID NO: 3195788 - DNA, 18 bp, Homo sapiens
tgccccccgaggctgcta

SEQ ID NO: 3195789 - DNA, 19 bp, Homo sapiens
tgccccccgaggctgctag

SEQ ID NO: 3195790 - DNA, 13 bp, Homo sapiens
tgcccccgcctgc

SEQ ID NO: 3195791 - DNA, 21 bp, Homo sapiens
tgcccccgctcccgctcccag

SEQ ID NO: 3195792 - DNA, 14 bp, Homo sapiens
tgccccctcctctc

SEQ ID NO: 3195793 - DNA, 20 bp, Homo sapiens
tgccccctcctctcccatcc

SEQ ID NO: 3195794 - DNA, 21 bp, Homo sapiens
tgccccctcctctcccatccc

SEQ ID NO: 3195795 - DNA, 12 bp, Homo sapiens
tgccccctggtg

SEQ ID NO: 3195796 - DNA, 13 bp, Homo sapiens
tgccccctggtgg

SEQ ID NO: 3195797 - DNA, 21 bp, Homo sapiens
tgccccctggtggacagtcct

SEQ ID NO: 3195798 - DNA, 16 bp, Homo sapiens
tgccccctttcagatg

SEQ ID NO: 3195799 - DNA, 21 bp, Homo sapiens
tgccccctttcagatgtcttc

SEQ ID NO: 3195800 - DNA, 15 bp, Homo sapiens
tgccccgcctccccg

SEQ ID NO: 3195801 - DNA, 17 bp, Homo sapiens
tgccccgctttgcggac

SEQ ID NO: 3195802 - DNA, 14 bp, Homo sapiens
tgccccggaggaag

SEQ ID NO: 3195803 - DNA, 18 bp, Homo sapiens
tgccccggaggaagcttg

SEQ ID NO: 3195804 - DNA, 17 bp, Homo sapiens
tgccccggccacctctg

SEQ ID NO: 3195805 - DNA, 23 bp, Homo sapiens
tgccccggccacctctgcggacc

SEQ ID NO: 3195806 - DNA, 18 bp, Homo sapiens
tgccccgttccctgtcag

SEQ ID NO: 3195807 - DNA, 18 bp, Homo sapiens
tgcccctaggatgctgca

SEQ ID NO: 3195808 - DNA, 21 bp, Homo sapiens
tgcccctaggatgctgcagca

SEQ ID NO: 3195809 - DNA, 21 bp, Homo sapiens
tgcccctcccccaacccccac

SEQ ID NO: 3195810 - DNA, 22 bp, Homo sapiens
tgcccctcccccaacccccacc

SEQ ID NO: 3195811 - DNA, 20 bp, Homo sapiens
tgcccctcgccagcttctcc

SEQ ID NO: 3195812 - DNA, 22 bp, Homo sapiens
tgcccctcgccagcttctcctg

SEQ ID NO: 3195813 - DNA, 21 bp, Homo sapiens
tgcccctgatcactcccagca

SEQ ID NO: 3195814 - DNA, 23 bp, Homo sapiens
tgcccctgatcactcccagcact

SEQ ID NO: 3195815 - DNA, 22 bp, Homo sapiens
tgccccttaagggttgaaggca

SEQ ID NO: 3195816 - DNA, 20 bp, Homo sapiens
tgcccgagctggtgcattac

SEQ ID NO: 3195817 - DNA, 21 bp, Homo sapiens
tgcccgagtgcggcgtggaga

SEQ ID NO: 3195818 - DNA, 17 bp, Homo sapiens
tgcccgcacagcagcct

SEQ ID NO: 3195819 - DNA, 21 bp, Homo sapiens
tgcccgcgggagacagcttct

SEQ ID NO: 3195820 - DNA, 22 bp, Homo sapiens
tgcccgcgggagacagcttctc

SEQ ID NO: 3195821 - DNA, 13 bp, Homo sapiens
tgcccgctcccaa

SEQ ID NO: 3195822 - DNA, 14 bp, Homo sapiens
tgcccgctcccaac

SEQ ID NO: 3195823 - DNA, 20 bp, Homo sapiens
tgcccgctcccaacccccct

SEQ ID NO: 3195824 - DNA, 21 bp, Homo sapiens
tgcccgctcccaacccccctc

SEQ ID NO: 3195825 - DNA, 16 bp, Homo sapiens
tgcccggattctggga

SEQ ID NO: 3195826 - DNA, 17 bp, Homo sapiens
tgcccggattctgggag

SEQ ID NO: 3195827 - DNA, 17 bp, Homo sapiens
tgcccggcgccgggcac

SEQ ID NO: 3195828 - DNA, 15 bp, Homo sapiens
tgccctactcactct

SEQ ID NO: 3195829 - DNA, 16 bp, Homo sapiens
tgccctagcccagact

SEQ ID NO: 3195830 - DNA, 19 bp, Homo sapiens
tgccctagcccagactctg

SEQ ID NO: 3195831 - DNA, 21 bp, Homo sapiens
tgccctagcccagactctgag

SEQ ID NO: 3195832 - DNA, 23 bp, Homo sapiens
tgccctagcccagactctgagct

SEQ ID NO: 3195833 - DNA, 21 bp, Homo sapiens
tgccctcaagtaaaagaaaag

SEQ ID NO: 3195834 - DNA, 14 bp, Homo sapiens
tgccctcaccacca

SEQ ID NO: 3195835 - DNA, 15 bp, Homo sapiens
tgccctcaccaccac

SEQ ID NO: 3195836 - DNA, 19 bp, Homo sapiens
tgccctcatggcccctctg

SEQ ID NO: 3195837 - DNA, 23 bp, Homo sapiens
tgccctcatggcccctctgacct

SEQ ID NO: 3195838 - DNA, 19 bp, Homo sapiens
tgccctcattactgggcct

SEQ ID NO: 3195839 - DNA, 13 bp, Homo sapiens
tgccctccaaaga

SEQ ID NO: 3195840 - DNA, 12 bp, Homo sapiens
tgccctccagct

SEQ ID NO: 3195841 - DNA, 15 bp, Homo sapiens
tgccctccccagagc

SEQ ID NO: 3195842 - DNA, 16 bp, Homo sapiens
tgccctccccagagca

SEQ ID NO: 3195843 - DNA, 18 bp, Homo sapiens
tgccctccgcctgggatc

SEQ ID NO: 3195844 - DNA, 12 bp, Homo sapiens
tgccctcctgga

SEQ ID NO: 3195845 - DNA, 16 bp, Homo sapiens
tgccctcgtggccagc

SEQ ID NO: 3195846 - DNA, 18 bp, Homo sapiens
tgccctcgtggccagccc

SEQ ID NO: 3195847 - DNA, 21 bp, Homo sapiens
tgccctcgtggccagcccggc

SEQ ID NO: 3195848 - DNA, 13 bp, Homo sapiens
tgccctctgggtc

SEQ ID NO: 3195849 - DNA, 13 bp, Homo sapiens
tgccctgacctcc

SEQ ID NO: 3195850 - DNA, 14 bp, Homo sapiens
tgccctgacctccc

SEQ ID NO: 3195851 - DNA, 11 bp, Homo sapiens
tgccctgagaa

SEQ ID NO: 3195852 - DNA, 14 bp, Homo sapiens
tgccctgaggaagg

SEQ ID NO: 3195853 - DNA, 17 bp, Homo sapiens
tgccctgccccctggct

SEQ ID NO: 3195854 - DNA, 14 bp, Homo sapiens
tgccctgcctgccc

SEQ ID NO: 3195855 - DNA, 11 bp, Homo sapiens
tgccctgctgc

SEQ ID NO: 3195856 - DNA, 18 bp, Homo sapiens
tgccctggatccatcagg

SEQ ID NO: 3195857 - DNA, 16 bp, Homo sapiens
tgccctggcagcagca

SEQ ID NO: 3195858 - DNA, 11 bp, Homo sapiens
tgccctggctg

SEQ ID NO: 3195859 - DNA, 12 bp, Homo sapiens
tgccctggctgc

SEQ ID NO: 3195860 - DNA, 15 bp, Homo sapiens
tgccctggctgctgc

SEQ ID NO: 3195861 - DNA, 16 bp, Homo sapiens
tgccctggctgctgcc

SEQ ID NO: 3195862 - DNA, 14 bp, Homo sapiens
tgccctggtgctgc

SEQ ID NO: 3195863 - DNA, 21 bp, Homo sapiens
tgccctggtgctgccacactt

SEQ ID NO: 3195864 - DNA, 23 bp, Homo sapiens
tgccctggtggagaaagcactga

SEQ ID NO: 3195865 - DNA, 23 bp, Homo sapiens
tgccctgttcatgtgcctctgcg

SEQ ID NO: 3195866 - DNA, 20 bp, Homo sapiens
tgccctgttgtgtatagatg

SEQ ID NO: 3195867 - DNA, 15 bp, Homo sapiens
tgcccttaaatcata

SEQ ID NO: 3195868 - DNA, 13 bp, Homo sapiens
tgcccttccctgt

SEQ ID NO: 3195869 - DNA, 15 bp, Homo sapiens
tgcccttccctgtcc

SEQ ID NO: 3195870 - DNA, 16 bp, Homo sapiens
tgcccttccctgtccc

SEQ ID NO: 3195871 - DNA, 20 bp, Homo sapiens
tgctgtatgctgatcatcgc

SEQ ID NO: 3195872 - DNA, 22 bp, Homo sapiens
tgctgtatgctgatcatcgcca

SEQ ID NO: 3195873 - DNA, 14 bp, Homo sapiens
tgctgtcctaggcc

SEQ ID NO: 3195874 - DNA, 12 bp, Homo sapiens
tgctgtctcctt

SEQ ID NO: 3195875 - DNA, 14 bp, Homo sapiens
tgctgtctctgctc

SEQ ID NO: 3195876 - DNA, 14 bp, Homo sapiens
tgctgtcttaaact

SEQ ID NO: 3195877 - DNA, 21 bp, Homo sapiens
tgctgtcttaaactaaatgtg

SEQ ID NO: 3195878 - DNA, 21 bp, Homo sapiens
tgctgtcttccccaccgcagt

SEQ ID NO: 3195879 - DNA, 18 bp, Homo sapiens
tgctgtcttctggtctgt

SEQ ID NO: 3195880 - DNA, 22 bp, Homo sapiens
tgctgtgacaataagtttgaac

SEQ ID NO: 3195881 - DNA, 19 bp, Homo sapiens
tgctgtgaccatttataat

SEQ ID NO: 3195882 - DNA, 13 bp, Homo sapiens
tgctgtgaggctg

SEQ ID NO: 3195883 - DNA, 14 bp, Homo sapiens
tgctgtgaggctgt

SEQ ID NO: 3195884 - DNA, 18 bp, Homo sapiens
tgctgtgaggctgtcctg

SEQ ID NO: 3195885 - DNA, 23 bp, Homo sapiens
tgctgtgagtctttggttctaag

SEQ ID NO: 3195886 - DNA, 19 bp, Homo sapiens
tgctgtgccatgctgggcc

SEQ ID NO: 3195887 - DNA, 13 bp, Homo sapiens
tgctgtgcctgct

SEQ ID NO: 3195888 - DNA, 14 bp, Homo sapiens
tgctgtggcctggg

SEQ ID NO: 3195889 - DNA, 15 bp, Homo sapiens
tgctgtggcctgggc

SEQ ID NO: 3195890 - DNA, 14 bp, Homo sapiens
tgctgtgggagagc

SEQ ID NO: 3195891 - DNA, 13 bp, Homo sapiens
tgctgtgggcagc

SEQ ID NO: 3195892 - DNA, 11 bp, Homo sapiens
tgctgtgtgcc

SEQ ID NO: 3195893 - DNA, 14 bp, Homo sapiens
tgctgtgtggtttg

SEQ ID NO: 3195894 - DNA, 18 bp, Homo sapiens
tgctgtgttaaataaacc

SEQ ID NO: 3195895 - DNA, 23 bp, Homo sapiens
tgctgtttagagtaaataaactg

SEQ ID NO: 3195896 - DNA, 23 bp, Homo sapiens
tgctgtttattaatcttagtgta

SEQ ID NO: 3195897 - DNA, 23 bp, Homo sapiens
tgctgttttaaacattaatagca

SEQ ID NO: 3195898 - DNA, 18 bp, Homo sapiens
tgctgttttgatttgtac

SEQ ID NO: 3195899 - DNA, 16 bp, Homo sapiens
tgcttaaaaaagagtt

SEQ ID NO: 3195900 - DNA, 19 bp, Homo sapiens
tgcttaaaaatcattgatt

SEQ ID NO: 3195901 - DNA, 14 bp, Homo sapiens
tgcttaaaagacat

SEQ ID NO: 3195902 - DNA, 22 bp, Homo sapiens
tgcttaaaaggtataattaaac

SEQ ID NO: 3195903 - DNA, 15 bp, Homo sapiens
tgcttaaaattttac

SEQ ID NO: 3195904 - DNA, 21 bp, Homo sapiens
tgcttaaaccacttaaacgaa

SEQ ID NO: 3195905 - DNA, 20 bp, Homo sapiens
tgcttaaactaaataatgaa

SEQ ID NO: 3195906 - DNA, 13 bp, Homo sapiens
tgcttaaatttta

SEQ ID NO: 3195907 - DNA, 16 bp, Homo sapiens
tgcttaaattttaact

SEQ ID NO: 3195908 - DNA, 13 bp, Homo sapiens
tgcttaagttcca

SEQ ID NO: 3195909 - DNA, 15 bp, Homo sapiens
tgcttaagttccagc

SEQ ID NO: 3195910 - DNA, 16 bp, Homo sapiens
tgcttaatcttcaaag

SEQ ID NO: 3195911 - DNA, 14 bp, Homo sapiens
tgcttacaatcttt

SEQ ID NO: 3195912 - DNA, 15 bp, Homo sapiens
tgcttacaatcttta

SEQ ID NO: 3195913 - DNA, 20 bp, Homo sapiens
tgcttacacatctcagaccc

SEQ ID NO: 3195914 - DNA, 17 bp, Homo sapiens
tgcttacatttttacaa

SEQ ID NO: 3195915 - DNA, 18 bp, Homo sapiens
tgcttacatttttacaat

SEQ ID NO: 3195916 - DNA, 19 bp, Homo sapiens
tgcttacctactttcttca

SEQ ID NO: 3195917 - DNA, 14 bp, Homo sapiens
tgcttagaaaagaa

SEQ ID NO: 3195918 - DNA, 21 bp, Homo sapiens
tgcttagatgagggtgactgt

SEQ ID NO: 3195919 - DNA, 14 bp, Homo sapiens
tgcttagtaaaatt

SEQ ID NO: 3195920 - DNA, 16 bp, Homo sapiens
tgcttagtaaaattta

SEQ ID NO: 3195921 - DNA, 21 bp, Homo sapiens
tgcttagtcacttatttcata

SEQ ID NO: 3195922 - DNA, 13 bp, Homo sapiens
tgcttatacactt

SEQ ID NO: 3195923 - DNA, 18 bp, Homo sapiens
tgcttatgaatatttata

SEQ ID NO: 3195924 - DNA, 19 bp, Homo sapiens
tgcttatgaatatttataa

SEQ ID NO: 3195925 - DNA, 17 bp, Homo sapiens
tgcttattatgtaggta

SEQ ID NO: 3195926 - DNA, 20 bp, Homo sapiens
tgcttcaaattcaaggcctt

SEQ ID NO: 3195927 - DNA, 22 bp, Homo sapiens
tgcttcaataaatctttggaaa

SEQ ID NO: 3195928 - DNA, 19 bp, Homo sapiens
tcgcctttgtcttgtactt

SEQ ID NO: 3195929 - DNA, 18 bp, Homo sapiens
tcgcgagcacatgttcat

SEQ ID NO: 3195930 - DNA, 17 bp, Homo sapiens
tcgcgcccgcccctgca

SEQ ID NO: 3195931 - DNA, 15 bp, Homo sapiens
tcgcgctcagtaaac

SEQ ID NO: 3195932 - DNA, 19 bp, Homo sapiens
tcgcgggcagcgggccagg

SEQ ID NO: 3195933 - DNA, 20 bp, Homo sapiens
tcgcgggcagcgggccaggc

SEQ ID NO: 3195934 - DNA, 22 bp, Homo sapiens
tcgcgggcagcgggccaggccc

SEQ ID NO: 3195935 - DNA, 17 bp, Homo sapiens
tcgctaagctggctctg

SEQ ID NO: 3195936 - DNA, 13 bp, Homo sapiens
tcgctatgtgcac

SEQ ID NO: 3195937 - DNA, 18 bp, Homo sapiens
tcgctcctcaacccctcc

SEQ ID NO: 3195938 - DNA, 12 bp, Homo sapiens
tcgctcctgtgt

SEQ ID NO: 3195939 - DNA, 13 bp, Homo sapiens
tcgctcctgtgtc

SEQ ID NO: 3195940 - DNA, 14 bp, Homo sapiens
tcgctcctgtgtct

SEQ ID NO: 3195941 - DNA, 21 bp, Homo sapiens
tcgctctgctggcctggccgg

SEQ ID NO: 3195942 - DNA, 23 bp, Homo sapiens
tcgctctgctggcctggccggca

SEQ ID NO: 3195943 - DNA, 20 bp, Homo sapiens
tcgctgccatcaccgctggg

SEQ ID NO: 3195944 - DNA, 21 bp, Homo sapiens
tcgctgccatcaccgctgggt

SEQ ID NO: 3195945 - DNA, 18 bp, Homo sapiens
tcgctgtaccctttaaga

SEQ ID NO: 3195946 - DNA, 16 bp, Homo sapiens
tcgctgtcacaggcgg

SEQ ID NO: 3195947 - DNA, 15 bp, Homo sapiens
tcgctgtcactggct

SEQ ID NO: 3195948 - DNA, 22 bp, Homo sapiens
tcgctgtcactggctggctcct

SEQ ID NO: 3195949 - DNA, 21 bp, Homo sapiens
tcgctgttaccgcctgtctct

SEQ ID NO: 3195950 - DNA, 17 bp, Homo sapiens
tcgcttcccccatagcc

SEQ ID NO: 3195951 - DNA, 19 bp, Homo sapiens
tcgcttcccccatagccac

SEQ ID NO: 3195952 - DNA, 22 bp, Homo sapiens
tcgcttctgtgtatctctttca

SEQ ID NO: 3195953 - DNA, 22 bp, Homo sapiens
tcgcttcttagaacagtggaaa

SEQ ID NO: 3195954 - DNA, 15 bp, Homo sapiens
tcgcttcttgcctct

SEQ ID NO: 3195955 - DNA, 17 bp, Homo sapiens
tcgcttgagcccaggag

SEQ ID NO: 3195956 - DNA, 12 bp, Homo sapiens
tcgcttgtaaat

SEQ ID NO: 3195957 - DNA, 20 bp, Homo sapiens
tcggaaaagcgtctttaaga

SEQ ID NO: 3195958 - DNA, 19 bp, Homo sapiens
tcggaacccaagcttagaa

SEQ ID NO: 3195959 - DNA, 23 bp, Homo sapiens
tcggaccgcttgtggggacccag

SEQ ID NO: 3195960 - DNA, 20 bp, Homo sapiens
tcggactaaactatctgtat

SEQ ID NO: 3195961 - DNA, 15 bp, Homo sapiens
tcggagacagtgatc

SEQ ID NO: 3195962 - DNA, 22 bp, Homo sapiens
tcggagactatggcctcgcctc

SEQ ID NO: 3195963 - DNA, 16 bp, Homo sapiens
tcggagagcagcagca

SEQ ID NO: 3195964 - DNA, 21 bp, Homo sapiens
tcggagcatcccggaggaaat

SEQ ID NO: 3195965 - DNA, 23 bp, Homo sapiens
tcggagcatcccggaggaaatct

SEQ ID NO: 3195966 - DNA, 18 bp, Homo sapiens
tcggaggccccactgatg

SEQ ID NO: 3195967 - DNA, 21 bp, Homo sapiens
tcggagggatggagaaagaag

SEQ ID NO: 3195968 - DNA, 20 bp, Homo sapiens
tcggatctggggctctggga

SEQ ID NO: 3195969 - DNA, 16 bp, Homo sapiens
tcggatgacaccctgg

SEQ ID NO: 3195970 - DNA, 19 bp, Homo sapiens
tcggatgacaccctggcct

SEQ ID NO: 3195971 - DNA, 13 bp, Homo sapiens
tcggattttttcc

SEQ ID NO: 3195972 - DNA, 14 bp, Homo sapiens
tcggattttttcca

SEQ ID NO: 3195973 - DNA, 13 bp, Homo sapiens
tcggcaggaagga

SEQ ID NO: 3195974 - DNA, 22 bp, Homo sapiens
tcggccaagaatacttgaagaa

SEQ ID NO: 3195975 - DNA, 19 bp, Homo sapiens
tcggccaggcattggctca

SEQ ID NO: 3195976 - DNA, 16 bp, Homo sapiens
tcggcctccatcctga

SEQ ID NO: 3195977 - DNA, 18 bp, Homo sapiens
tcggcctccatcctgagg

SEQ ID NO: 3195978 - DNA, 12 bp, Homo sapiens
tcggcctcccaa

SEQ ID NO: 3195979 - DNA, 18 bp, Homo sapiens
tcggcctcccaaagtgct

SEQ ID NO: 3195980 - DNA, 19 bp, Homo sapiens
tcggctcactgaaacctct

SEQ ID NO: 3195981 - DNA, 13 bp, Homo sapiens
tcggctcaggctc

SEQ ID NO: 3195982 - DNA, 15 bp, Homo sapiens
tcggctgaccatgct

SEQ ID NO: 3195983 - DNA, 20 bp, Homo sapiens
tcggctggggactgctacct

SEQ ID NO: 3195984 - DNA, 16 bp, Homo sapiens
tcgggacacctgccct

SEQ ID NO: 3195985 - DNA, 20 bp, Homo sapiens
tcgggacacctgccctgccc

SEQ ID NO: 3195986 - DNA, 13 bp, Homo sapiens
tcgggagcaccca

SEQ ID NO: 3195987 - DNA, 14 bp, Homo sapiens
tcgggagcacccag

SEQ ID NO: 3195988 - DNA, 13 bp, Homo sapiens
tcgggagcagtgt

SEQ ID NO: 3195989 - DNA, 15 bp, Homo sapiens
tcgggagcagtgtct

SEQ ID NO: 3195990 - DNA, 23 bp, Homo sapiens
tcgggagcagtgtcttccataat

SEQ ID NO: 3195991 - DNA, 19 bp, Homo sapiens
tcgggaggctgaggcagga

SEQ ID NO: 3195992 - DNA, 21 bp, Homo sapiens
tcgggcccacctggccacctg

SEQ ID NO: 3195993 - DNA, 12 bp, Homo sapiens
tcgggctgtgcc

SEQ ID NO: 3195994 - DNA, 19 bp, Homo sapiens
tcggggagaggctgaggac

SEQ ID NO: 3195995 - DNA, 17 bp, Homo sapiens
tcggggcatgctggggc

SEQ ID NO: 3195996 - DNA, 20 bp, Homo sapiens
tcggggcccttggggcctgg

SEQ ID NO: 3195997 - DNA, 15 bp, Homo sapiens
tcggggctccaggct

SEQ ID NO: 3195998 - DNA, 13 bp, Homo sapiens
tcgggggctggcc

SEQ ID NO: 3195999 - DNA, 16 bp, Homo sapiens
tcgggggctggcctag

SEQ ID NO: 3196000 - DNA, 15 bp, Homo sapiens
tcgggggctgtggat

SEQ ID NO: 3196001 - DNA, 17 bp, Homo sapiens
tcggggggtcacaggcc

SEQ ID NO: 3196002 - DNA, 21 bp, Homo sapiens
tcggtaagttgaatggcctgc

SEQ ID NO: 3196003 - DNA, 15 bp, Homo sapiens
tcggtcttttgtatt

SEQ ID NO: 3196004 - DNA, 22 bp, Homo sapiens
tcggttctgcgccacttccttt

SEQ ID NO: 3196005 - DNA, 19 bp, Homo sapiens
tcgtacataataagtttca

SEQ ID NO: 3196006 - DNA, 12 bp, Homo sapiens
tcgtatgaaaat

SEQ ID NO: 3196007 - DNA, 20 bp, Homo sapiens
tcgtccacaggggcaggcct

SEQ ID NO: 3196008 - DNA, 14 bp, Homo sapiens
tcgtcctgtcccag

SEQ ID NO: 3196009 - DNA, 16 bp, Homo sapiens
tcgtcctgtcccagag

SEQ ID NO: 3196010 - DNA, 14 bp, Homo sapiens
tcgtccttcctctc

SEQ ID NO: 3196011 - DNA, 10 bp, Homo sapiens
tcgtctgtga

SEQ ID NO: 3196012 - DNA, 14 bp, Homo sapiens
tcgtctgtgaatgc

SEQ ID NO: 3196013 - DNA, 15 bp, Homo sapiens
tcgtctgtgaatgct

SEQ ID NO: 3196014 - DNA, 18 bp, Homo sapiens
tcgtctgtgaatgctaag

SEQ ID NO: 3196015 - DNA, 12 bp, Homo sapiens
tgcactccagcc

SEQ ID NO: 3196016 - DNA, 17 bp, Homo sapiens
tgcactccagcctgggg

SEQ ID NO: 3196017 - DNA, 18 bp, Homo sapiens
tgcactctaaaaggttca

SEQ ID NO: 3196018 - DNA, 18 bp, Homo sapiens
tgcactgacattgttggc

SEQ ID NO: 3196019 - DNA, 16 bp, Homo sapiens
tgcactgacccttcca

SEQ ID NO: 3196020 - DNA, 12 bp, Homo sapiens
tgcactgagggc

SEQ ID NO: 3196021 - DNA, 15 bp, Homo sapiens
tgcactgagggccac

SEQ ID NO: 3196022 - DNA, 17 bp, Homo sapiens
tgcactgagggccacac

SEQ ID NO: 3196023 - DNA, 14 bp, Homo sapiens
tgcactgatgttgt

SEQ ID NO: 3196024 - DNA, 21 bp, Homo sapiens
tgcactgatgttgtgttttta

SEQ ID NO: 3196025 - DNA, 23 bp, Homo sapiens
tgcactgccctgttcatgtgcct

SEQ ID NO: 3196026 - DNA, 13 bp, Homo sapiens
tgcactgctgttc

SEQ ID NO: 3196027 - DNA, 15 bp, Homo sapiens
tgcactgtcactttg

SEQ ID NO: 3196028 - DNA, 22 bp, Homo sapiens
tgcactgtcactttgctctggg

SEQ ID NO: 3196029 - DNA, 23 bp, Homo sapiens
tgcactgtcactttgctctgggt

SEQ ID NO: 3196030 - DNA, 15 bp, Homo sapiens
tgcacttaatggctg

SEQ ID NO: 3196031 - DNA, 23 bp, Homo sapiens
tgcacttattgaccattttttaa

SEQ ID NO: 3196032 - DNA, 14 bp, Homo sapiens
tgcacttggcctca

SEQ ID NO: 3196033 - DNA, 22 bp, Homo sapiens
tgcacttggcctcagctggctg

SEQ ID NO: 3196034 - DNA, 20 bp, Homo sapiens
tgcacttgtgattatttatt

SEQ ID NO: 3196035 - DNA, 16 bp, Homo sapiens
tgcagaaatgaaatag

SEQ ID NO: 3196036 - DNA, 18 bp, Homo sapiens
tgcagaaccacaaacaat

SEQ ID NO: 3196037 - DNA, 17 bp, Homo sapiens
tgcagaactcctccaaa

SEQ ID NO: 3196038 - DNA, 13 bp, Homo sapiens
tgcagaactgcca

SEQ ID NO: 3196039 - DNA, 14 bp, Homo sapiens
tgcagaactgccat

SEQ ID NO: 3196040 - DNA, 15 bp, Homo sapiens
tgcagaagagggtgt

SEQ ID NO: 3196041 - DNA, 20 bp, Homo sapiens
tgcagaagcatattttgctg

SEQ ID NO: 3196042 - DNA, 15 bp, Homo sapiens
tgcagaataatggaa

SEQ ID NO: 3196043 - DNA, 13 bp, Homo sapiens
tgcagaatctctg

SEQ ID NO: 3196044 - DNA, 18 bp, Homo sapiens
tgcagacaacaccttcct

SEQ ID NO: 3196045 - DNA, 17 bp, Homo sapiens
tgcagacacctggactg

SEQ ID NO: 3196046 - DNA, 21 bp, Homo sapiens
tgcagacacgccttcccctca

SEQ ID NO: 3196047 - DNA, 13 bp, Homo sapiens
tgcagacaggcaa

SEQ ID NO: 3196048 - DNA, 20 bp, Homo sapiens
tgcagacgggcaagaagctg

SEQ ID NO: 3196049 - DNA, 14 bp, Homo sapiens
tgcagactcctcag

SEQ ID NO: 3196050 - DNA, 16 bp, Homo sapiens
tgcagactctacagag

SEQ ID NO: 3196051 - DNA, 23 bp, Homo sapiens
tgcagagaagcatcctccacatc

SEQ ID NO: 3196052 - DNA, 17 bp, Homo sapiens
tgcagagaagctggact

SEQ ID NO: 3196053 - DNA, 15 bp, Homo sapiens
tgcagagagccattt

SEQ ID NO: 3196054 - DNA, 16 bp, Homo sapiens
tgcagagagccatttt

SEQ ID NO: 3196055 - DNA, 17 bp, Homo sapiens
tgcagagagccattttg

SEQ ID NO: 3196056 - DNA, 21 bp, Homo sapiens
tgcagagagccattttgtgaa

SEQ ID NO: 3196057 - DNA, 22 bp, Homo sapiens
tgcagagctgcacttggcctca

SEQ ID NO: 3196058 - DNA, 14 bp, Homo sapiens
tgcagaggccagag

SEQ ID NO: 3196059 - DNA, 14 bp, Homo sapiens
tgcagagtccattt

SEQ ID NO: 3196060 - DNA, 15 bp, Homo sapiens
tgcagatgcaattgt

SEQ ID NO: 3196061 - DNA, 17 bp, Homo sapiens
tgcagatgccaccctag

SEQ ID NO: 3196062 - DNA, 13 bp, Homo sapiens
tgcagatgtctta

SEQ ID NO: 3196063 - DNA, 14 bp, Homo sapiens
tgcagattcctggg

SEQ ID NO: 3196064 - DNA, 16 bp, Homo sapiens
tgcagattcctgggcc

SEQ ID NO: 3196065 - DNA, 18 bp, Homo sapiens
tgcagattcctgggcctg

SEQ ID NO: 3196066 - DNA, 21 bp, Homo sapiens
tgcagattcctgggcctgtcc

SEQ ID NO: 3196067 - DNA, 22 bp, Homo sapiens
tgcagattcctgggcctgtccc

SEQ ID NO: 3196068 - DNA, 14 bp, Homo sapiens
tgcagatttgatat

SEQ ID NO: 3196069 - DNA, 18 bp, Homo sapiens
tgcagcaaggccctgctg

SEQ ID NO: 3196070 - DNA, 20 bp, Homo sapiens
tgcagcaaggccctgctgcc

SEQ ID NO: 3196071 - DNA, 18 bp, Homo sapiens
tgcagcacctccaggcct

SEQ ID NO: 3196072 - DNA, 16 bp, Homo sapiens
tgcagcacggacaata

SEQ ID NO: 3196073 - DNA, 17 bp, Homo sapiens
tgcagcacggacaataa

SEQ ID NO: 3196074 - DNA, 20 bp, Homo sapiens
tgcagcagaaaggctctgaa

SEQ ID NO: 3196075 - DNA, 15 bp, Homo sapiens
tgcagcagaggacag

SEQ ID NO: 3196076 - DNA, 22 bp, Homo sapiens
tgcagcagaggacagtctggag

SEQ ID NO: 3196077 - DNA, 11 bp, Homo sapiens
tgcagcagccc

SEQ ID NO: 3196078 - DNA, 19 bp, Homo sapiens
tgcagcagcccagcttcct

SEQ ID NO: 3196079 - DNA, 13 bp, Homo sapiens
tgcagcaggagtg

SEQ ID NO: 3196080 - DNA, 13 bp, Homo sapiens
tgcagcatgacct

SEQ ID NO: 3196081 - DNA, 22 bp, Homo sapiens
tgcagcatgacctgtgaccagc

SEQ ID NO: 3196082 - DNA, 18 bp, Homo sapiens
tgcagcatggtccctgcc

SEQ ID NO: 3196083 - DNA, 14 bp, Homo sapiens
tgcagccacatggc

SEQ ID NO: 3196084 - DNA, 16 bp, Homo sapiens
tgcagccacatggccc

SEQ ID NO: 3196085 - DNA, 18 bp, Homo sapiens
tgcagccacatggcccca

SEQ ID NO: 3196086 - DNA, 11 bp, Homo sapiens
tgcagccagct

SEQ ID NO: 3196087 - DNA, 13 bp, Homo sapiens
tgcagcccaaaac

SEQ ID NO: 3196088 - DNA, 22 bp, Homo sapiens
tgcagcccaaaacccagggcaa

SEQ ID NO: 3196089 - DNA, 14 bp, Homo sapiens
tgcagcccatgccc

SEQ ID NO: 3196090 - DNA, 18 bp, Homo sapiens
tgcagcccatgcccacct

SEQ ID NO: 3196091 - DNA, 19 bp, Homo sapiens
tgcagcccatgcccacctg

SEQ ID NO: 3196092 - DNA, 17 bp, Homo sapiens
tgcagccccagaagaaa

SEQ ID NO: 3196093 - DNA, 21 bp, Homo sapiens
tgcagccccgcgcctccttcc

SEQ ID NO: 3196094 - DNA, 14 bp, Homo sapiens
tgcagcccttcctc

SEQ ID NO: 3196095 - DNA, 15 bp, Homo sapiens
tgcagcccttgggca

SEQ ID NO: 3196096 - DNA, 18 bp, Homo sapiens
tgcagcccttgggcagtt

SEQ ID NO: 3196097 - DNA, 19 bp, Homo sapiens
tgcagcccttgggcagttc

SEQ ID NO: 3196098 - DNA, 17 bp, Homo sapiens
tgcagccgccttccttg

SEQ ID NO: 3196099 - DNA, 22 bp, Homo sapiens
tgcagcctcaacctcctgggct

SEQ ID NO: 3196100 - DNA, 16 bp, Homo sapiens
tgcagcctcctcctga

SEQ ID NO: 3196101 - DNA, 19 bp, Homo sapiens
tgcagcctcctcctgacca

SEQ ID NO: 3196102 - DNA, 12 bp, Homo sapiens
tgcagcgcagct

SEQ ID NO: 3196103 - DNA, 20 bp, Homo sapiens
tgcagctatgcgcaatgtgg

SEQ ID NO: 3196104 - DNA, 14 bp, Homo sapiens
tgcagctgatttta

SEQ ID NO: 3196105 - DNA, 20 bp, Homo sapiens
tgcagctgattttaacaata

SEQ ID NO: 3196106 - DNA, 20 bp, Homo sapiens
tgcagctgggccccatgctc

SEQ ID NO: 3196107 - DNA, 22 bp, Homo sapiens
tgcagctgggccccatgctctg

SEQ ID NO: 3196108 - DNA, 20 bp, Homo sapiens
tgcagctgtggcagagttac

SEQ ID NO: 3196109 - DNA, 20 bp, Homo sapiens
tgcagcttccaaatctcata

SEQ ID NO: 3196110 - DNA, 23 bp, Homo sapiens
tgcagcttgggagagcccctggg

SEQ ID NO: 3196111 - DNA, 15 bp, Homo sapiens
tgcagctttgcaaac

SEQ ID NO: 3196112 - DNA, 22 bp, Homo sapiens
tgcaggaacgagcactggccag

SEQ ID NO: 3196113 - DNA, 14 bp, Homo sapiens
tgcaggacaggagg

SEQ ID NO: 3196114 - DNA, 23 bp, Homo sapiens
tgcaggacaggaggcggcccggc

SEQ ID NO: 3196115 - DNA, 15 bp, Homo sapiens
tgcaggacttgagaa

SEQ ID NO: 3196116 - DNA, 14 bp, Homo sapiens
tgcaggagaaaagt

SEQ ID NO: 3196117 - DNA, 18 bp, Homo sapiens
tgcaggatggtgtctctt

SEQ ID NO: 3196118 - DNA, 19 bp, Homo sapiens
tgcaggcaggaacaaacag

SEQ ID NO: 3196119 - DNA, 20 bp, Homo sapiens
tgcaggcaggaacaaacagg

SEQ ID NO: 3196120 - DNA, 21 bp, Homo sapiens
tgcaggccaagagcagaggca

SEQ ID NO: 3196121 - DNA, 22 bp, Homo sapiens
tgcaggccctttgaagcctcag

SEQ ID NO: 3196122 - DNA, 21 bp, Homo sapiens
tgcaggcctaggtgcagctcc

SEQ ID NO: 3196123 - DNA, 16 bp, Homo sapiens
tgcaggctctgggctc

SEQ ID NO: 3196124 - DNA, 21 bp, Homo sapiens
tgcaggctctgggctcagggc

SEQ ID NO: 3196125 - DNA, 16 bp, Homo sapiens
tgcaggcttaataaaa

SEQ ID NO: 3196126 - DNA, 13 bp, Homo sapiens
tgcagggaagagg

SEQ ID NO: 3196127 - DNA, 16 bp, Homo sapiens
tgcagggacagagcat

SEQ ID NO: 3196128 - DNA, 14 bp, Homo sapiens
tgcagggagccgag

SEQ ID NO: 3196129 - DNA, 20 bp, Homo sapiens
tgcagggagggcagttttct

SEQ ID NO: 3196130 - DNA, 15 bp, Homo sapiens
tgcagggaggggagg

SEQ ID NO: 3196131 - DNA, 17 bp, Homo sapiens
tgcagggctcccatggg

SEQ ID NO: 3196132 - DNA, 19 bp, Homo sapiens
tgcagggctcccatgggct

SEQ ID NO: 3196133 - DNA, 13 bp, Homo sapiens
tgcaggggcagga

SEQ ID NO: 3196134 - DNA, 19 bp, Homo sapiens
tgcaggggctctggagaga

SEQ ID NO: 3196135 - DNA, 22 bp, Homo sapiens
tgcagggggtgtgtctgctcag

SEQ ID NO: 3196136 - DNA, 18 bp, Homo sapiens
tgcaggggtcccccctca

SEQ ID NO: 3196137 - DNA, 15 bp, Homo sapiens
tgcagggtcctcttc

SEQ ID NO: 3196138 - DNA, 23 bp, Homo sapiens
tgcaggtacttcctcctgatggc

SEQ ID NO: 3196139 - DNA, 24 bp, Homo sapiens
tgcaggtacttcctcctgatggcc

SEQ ID NO: 3196140 - DNA, 20 bp, Homo sapiens
tgcaggtgggcactggagca

SEQ ID NO: 3196141 - DNA, 21 bp, Homo sapiens
tgcaggtgggcactggagcat

SEQ ID NO: 3196142 - DNA, 16 bp, Homo sapiens
tgcaggttggacccca

SEQ ID NO: 3196143 - DNA, 15 bp, Homo sapiens
tgcaggtttgttaca

SEQ ID NO: 3196144 - DNA, 14 bp, Homo sapiens
tgcagtaaatcttt

SEQ ID NO: 3196145 - DNA, 15 bp, Homo sapiens
tgcagtaaatctttt

SEQ ID NO: 3196146 - DNA, 21 bp, Homo sapiens
tgcagtaactgttttttaagt

SEQ ID NO: 3196147 - DNA, 13 bp, Homo sapiens
tgcagtacaggca

SEQ ID NO: 3196148 - DNA, 16 bp, Homo sapiens
tgcagtagagtcatct

SEQ ID NO: 3196149 - DNA, 19 bp, Homo sapiens
tgcagtatggccagacgtg

SEQ ID NO: 3196150 - DNA, 15 bp, Homo sapiens
tgcagtcactggagg

SEQ ID NO: 3196151 - DNA, 16 bp, Homo sapiens
tgcagtcctgaggaga

SEQ ID NO: 3196152 - DNA, 21 bp, Homo sapiens
tgcagtcttctgggctgcggg

SEQ ID NO: 3196153 - DNA, 22 bp, Homo sapiens
tgcagtgacgtgcacctgtact

SEQ ID NO: 3196154 - DNA, 13 bp, Homo sapiens
tgcagtgagctga

SEQ ID NO: 3196155 - DNA, 17 bp, Homo sapiens
tgcagtggctcacgcct

SEQ ID NO: 3196156 - DNA, 14 bp, Homo sapiens
tgcagtgtgaaaag

SEQ ID NO: 3196157 - DNA, 16 bp, Homo sapiens
tgcagtgttcgcttgg

SEQ ID NO: 3196158 - DNA, 21 bp, Homo sapiens
tgcagttacactaaaaggtga

SEQ ID NO: 3196159 - DNA, 16 bp, Homo sapiens
tgcagttacttgaata

SEQ ID NO: 3196160 - DNA, 19 bp, Homo sapiens
tgcagttggactctcaggg

SEQ ID NO: 3196161 - DNA, 19 bp, Homo sapiens
tgcagtttaagagcagaac

SEQ ID NO: 3196162 - DNA, 19 bp, Homo sapiens
tgcagtttgagacaggaga

SEQ ID NO: 3196163 - DNA, 14 bp, Homo sapiens
tgcagtttttcagg

SEQ ID NO: 3196164 - DNA, 15 bp, Homo sapiens
tgcagtttttcagga

SEQ ID NO: 3196165 - DNA, 18 bp, Homo sapiens
tgcagtttttcattttaa

SEQ ID NO: 3196166 - DNA, 13 bp, Homo sapiens
tgctggtacctgc

SEQ ID NO: 3196167 - DNA, 18 bp, Homo sapiens
tgctggtagagaccccca

SEQ ID NO: 3196168 - DNA, 19 bp, Homo sapiens
ttcatttccaactcaggtt

SEQ ID NO: 3196169 - DNA, 21 bp, Homo sapiens
ttcatttcttcctcagctggt

SEQ ID NO: 3196170 - DNA, 13 bp, Homo sapiens
ttcatttgtacaa

SEQ ID NO: 3196171 - DNA, 21 bp, Homo sapiens
ttcatttgtacaaggtaattg

SEQ ID NO: 3196172 - DNA, 22 bp, Homo sapiens
ttcatttgtacaaggtaattgt

SEQ ID NO: 3196173 - DNA, 12 bp, Homo sapiens
ttcatttgtatt

SEQ ID NO: 3196174 - DNA, 13 bp, Homo sapiens
ttcatttgtgtca

SEQ ID NO: 3196175 - DNA, 15 bp, Homo sapiens
ttcatttgttttgct

SEQ ID NO: 3196176 - DNA, 18 bp, Homo sapiens
ttcatttgttttgctttt

SEQ ID NO: 3196177 - DNA, 17 bp, Homo sapiens
ttctccccctgggctct

SEQ ID NO: 3196178 - DNA, 18 bp, Homo sapiens
ttctccccctgggctctg

SEQ ID NO: 3196179 - DNA, 19 bp, Homo sapiens
ttctccccgctaaggaaga

SEQ ID NO: 3196180 - DNA, 21 bp, Homo sapiens
ttctcccctccccgcctggcc

SEQ ID NO: 3196181 - DNA, 10 bp, Homo sapiens
ttctccctgt

SEQ ID NO: 3196182 - DNA, 19 bp, Homo sapiens
ttctccctttatgtatctc

SEQ ID NO: 3196183 - DNA, 18 bp, Homo sapiens
ttctccctttctctctcc

SEQ ID NO: 3196184 - DNA, 19 bp, Homo sapiens
ttctccctttctctctcct

SEQ ID NO: 3196185 - DNA, 16 bp, Homo sapiens
ttctccgccagcctcc

SEQ ID NO: 3196186 - DNA, 20 bp, Homo sapiens
ttctccgccagcctcctctg

SEQ ID NO: 3196187 - DNA, 21 bp, Homo sapiens
ttctccgccagcctcctctgg

SEQ ID NO: 3196188 - DNA, 18 bp, Homo sapiens
ttctccggggtctgtgct

SEQ ID NO: 3196189 - DNA, 19 bp, Homo sapiens
ttctccggggtctgtgctg

SEQ ID NO: 3196190 - DNA, 23 bp, Homo sapiens
ttctccggggtctgtgctgtgcc

SEQ ID NO: 3196191 - DNA, 17 bp, Homo sapiens
ttctccgggtgtggcct

SEQ ID NO: 3196192 - DNA, 16 bp, Homo sapiens
ttctccgttagctcct

SEQ ID NO: 3196193 - DNA, 20 bp, Homo sapiens
aacagcccaggcatctcctt

SEQ ID NO: 3196194 - DNA, 20 bp, Homo sapiens
aacagcgggagacctgtgct

SEQ ID NO: 3196195 - DNA, 16 bp, Homo sapiens
aacagctaatgggaca

SEQ ID NO: 3196196 - DNA, 18 bp, Homo sapiens
aacagctcaagtcttccc

SEQ ID NO: 3196197 - DNA, 15 bp, Homo sapiens
aacagctcagccagt

SEQ ID NO: 3196198 - DNA, 18 bp, Homo sapiens
aacagctcagccagtggg

SEQ ID NO: 3196199 - DNA, 21 bp, Homo sapiens
aacagctgaggtctcttgagg

SEQ ID NO: 3196200 - DNA, 16 bp, Homo sapiens
aacagctgcattagaa

SEQ ID NO: 3196201 - DNA, 14 bp, Homo sapiens
aacagctgttttta

SEQ ID NO: 3196202 - DNA, 15 bp, Homo sapiens
aacagcttcaggtta

SEQ ID NO: 3196203 - DNA, 20 bp, Homo sapiens
aacagcttcatgcctttgta

SEQ ID NO: 3196204 - DNA, 21 bp, Homo sapiens
aacagcttcatgcctttgtaa

SEQ ID NO: 3196205 - DNA, 22 bp, Homo sapiens
aacagcttcatgcctttgtaag

SEQ ID NO: 3196206 - DNA, 16 bp, Homo sapiens
aacaggaatgtctgga

SEQ ID NO: 3196207 - DNA, 19 bp, Homo sapiens
aacaggacagagttcacag

SEQ ID NO: 3196208 - DNA, 20 bp, Homo sapiens
aacaggaccacaaaaatgaa

SEQ ID NO: 3196209 - DNA, 19 bp, Homo sapiens
aacaggaggtgtgaatgca

SEQ ID NO: 3196210 - DNA, 16 bp, Homo sapiens
aacaggattgatcatt

SEQ ID NO: 3196211 - DNA, 23 bp, Homo sapiens
aacaggcccagcattgctggttc

SEQ ID NO: 3196212 - DNA, 21 bp, Homo sapiens
aacaggctcaatattcctgaa

SEQ ID NO: 3196213 - DNA, 23 bp, Homo sapiens
aacaggctgttctgcactgaaaa

SEQ ID NO: 3196214 - DNA, 16 bp, Homo sapiens
aacagggccacataga

SEQ ID NO: 3196215 - DNA, 16 bp, Homo sapiens
aacagtagttgtattc

SEQ ID NO: 3196216 - DNA, 19 bp, Homo sapiens
aacagtagttgtattcttc

SEQ ID NO: 3196217 - DNA, 17 bp, Homo sapiens
aacagtcaaaacagaga

SEQ ID NO: 3196218 - DNA, 13 bp, Homo sapiens
aacagtcatttaa

SEQ ID NO: 3196219 - DNA, 23 bp, Homo sapiens
aacagtccccgtggccatccctg

SEQ ID NO: 3196220 - DNA, 18 bp, Homo sapiens
aacagtcttactgcaggc

SEQ ID NO: 3196221 - DNA, 21 bp, Homo sapiens
aacagtgagcctgaattttgt

SEQ ID NO: 3196222 - DNA, 22 bp, Homo sapiens
aacagtgcatattcctttctat

SEQ ID NO: 3196223 - DNA, 20 bp, Homo sapiens
aacagtgccattgtctttat

SEQ ID NO: 3196224 - DNA, 15 bp, Homo sapiens
aacagtggaatataa

SEQ ID NO: 3196225 - DNA, 14 bp, Homo sapiens
aacagtggatcaca

SEQ ID NO: 3196226 - DNA, 13 bp, Homo sapiens
aacagtggctggg

SEQ ID NO: 3196227 - DNA, 19 bp, Homo sapiens
aacagtggctgggtgggcc

SEQ ID NO: 3196228 - DNA, 22 bp, Homo sapiens
aacagtgggagccctgaccttg

SEQ ID NO: 3196229 - DNA, 18 bp, Homo sapiens
aacagtgtttcccataat

SEQ ID NO: 3196230 - DNA, 21 bp, Homo sapiens
aacagtgtttcccataatttt

SEQ ID NO: 3196231 - DNA, 13 bp, Homo sapiens
aacagtgttttca

SEQ ID NO: 3196232 - DNA, 13 bp, Homo sapiens
aacagttatattt

SEQ ID NO: 3196233 - DNA, 15 bp, Homo sapiens
aacagttatattttt

SEQ ID NO: 3196234 - DNA, 16 bp, Homo sapiens
aacagttatatttttg

SEQ ID NO: 3196235 - DNA, 17 bp, Homo sapiens
aacagttggtaactttt

SEQ ID NO: 3196236 - DNA, 17 bp, Homo sapiens
aacagtttcttgcttgg

SEQ ID NO: 3196237 - DNA, 22 bp, Homo sapiens
aacagtttcttgcttggaagcc

SEQ ID NO: 3196238 - DNA, 11 bp, Homo sapiens
aacagttttcc

SEQ ID NO: 3196239 - DNA, 18 bp, Homo sapiens
aacagttttccatgaaaa

SEQ ID NO: 3196240 - DNA, 19 bp, Homo sapiens
aacagttttccatgaaaac

SEQ ID NO: 3196241 - DNA, 23 bp, Homo sapiens
aacataaaaagcagaattttaat

SEQ ID NO: 3196242 - DNA, 14 bp, Homo sapiens
aacataatctagtt

SEQ ID NO: 3196243 - DNA, 16 bp, Homo sapiens
aacataatctagttta

SEQ ID NO: 3196244 - DNA, 20 bp, Homo sapiens
aacataatcttctgccttct

SEQ ID NO: 3196245 - DNA, 19 bp, Homo sapiens
aacatacttcaaaaataat

SEQ ID NO: 3196246 - DNA, 23 bp, Homo sapiens
aacatagaaatggaaattttgct

SEQ ID NO: 3196247 - DNA, 20 bp, Homo sapiens
aacatagactagagaaaccg

SEQ ID NO: 3196248 - DNA, 17 bp, Homo sapiens
aacatagcccctgcccc

SEQ ID NO: 3196249 - DNA, 12 bp, Homo sapiens
aacatatgattt

SEQ ID NO: 3196250 - DNA, 14 bp, Homo sapiens
aacatatgatttca

SEQ ID NO: 3196251 - DNA, 21 bp, Homo sapiens
aacatatgatttcactagaaa

SEQ ID NO: 3196252 - DNA, 14 bp, Homo sapiens
aacatattgttgaa

SEQ ID NO: 3196253 - DNA, 16 bp, Homo sapiens
aacatatttcatttta

SEQ ID NO: 3196254 - DNA, 13 bp, Homo sapiens
aacatcaaataaa

SEQ ID NO: 3196255 - DNA, 15 bp, Homo sapiens
aacatcaaataaatt

SEQ ID NO: 3196256 - DNA, 16 bp, Homo sapiens
aacatcaaataaattt

SEQ ID NO: 3196257 - DNA, 17 bp, Homo sapiens
aacatcaaataaatttc

SEQ ID NO: 3196258 - DNA, 20 bp, Homo sapiens
aacatcaaataaatttctgg

SEQ ID NO: 3196259 - DNA, 13 bp, Homo sapiens
aacatcaatgttc

SEQ ID NO: 3196260 - DNA, 19 bp, Homo sapiens
aacatcagaactgaaataa

SEQ ID NO: 3196261 - DNA, 16 bp, Homo sapiens
aacatcataattacat

SEQ ID NO: 3196262 - DNA, 17 bp, Homo sapiens
aacatcataattacatt

SEQ ID NO: 3196263 - DNA, 21 bp, Homo sapiens
aacatcataattacattccta

SEQ ID NO: 3196264 - DNA, 19 bp, Homo sapiens
aacatccaaggagaaacag

SEQ ID NO: 3196265 - DNA, 15 bp, Homo sapiens
aacatccaatatttt

SEQ ID NO: 3196266 - DNA, 19 bp, Homo sapiens
aacatcctttgcagggcag

SEQ ID NO: 3196267 - DNA, 21 bp, Homo sapiens
aacatcctttgcagggcagcc

SEQ ID NO: 3196268 - DNA, 18 bp, Homo sapiens
aacatcgatatgtatatc

SEQ ID NO: 3196269 - DNA, 19 bp, Homo sapiens
aacatcgatatgtatatca

SEQ ID NO: 3196270 - DNA, 19 bp, Homo sapiens
aacatctttattgaaattc

SEQ ID NO: 3196271 - DNA, 15 bp, Homo sapiens
aacatctttgcgaaa

SEQ ID NO: 3196272 - DNA, 19 bp, Homo sapiens
aacatctttgcgaaaagat

SEQ ID NO: 3196273 - DNA, 14 bp, Homo sapiens
aacatgaagaatgc

SEQ ID NO: 3196274 - DNA, 13 bp, Homo sapiens
aacatgacactga

SEQ ID NO: 3196275 - DNA, 14 bp, Homo sapiens
aacatgacactgac

SEQ ID NO: 3196276 - DNA, 21 bp, Homo sapiens
aacatgaggggacattttggt

SEQ ID NO: 3196277 - DNA, 19 bp, Homo sapiens
aacatgcactgatgttgtg

SEQ ID NO: 3196278 - DNA, 16 bp, Homo sapiens
aacatgcagttcatta

SEQ ID NO: 3196279 - DNA, 14 bp, Homo sapiens
aacatgcatacttt

SEQ ID NO: 3196280 - DNA, 16 bp, Homo sapiens
aacatgcatactttat

SEQ ID NO: 3196281 - DNA, 17 bp, Homo sapiens
aacatgcatactttatt

SEQ ID NO: 3196282 - DNA, 13 bp, Homo sapiens
aacatgccccctg

SEQ ID NO: 3196283 - DNA, 15 bp, Homo sapiens
aacatggacttgtat

SEQ ID NO: 3196284 - DNA, 15 bp, Homo sapiens
aacatgggcattggg

SEQ ID NO: 3196285 - DNA, 21 bp, Homo sapiens
aacatgggcattgggttctaa

SEQ ID NO: 3196286 - DNA, 22 bp, Homo sapiens
aacatgggcattgggttctaaa

SEQ ID NO: 3196287 - DNA, 21 bp, Homo sapiens
aacatgtatttatgtaatgaa

SEQ ID NO: 3196288 - DNA, 19 bp, Homo sapiens
aacatgtgccttttctgaa

SEQ ID NO: 3196289 - DNA, 20 bp, Homo sapiens
aacatgttaatgacaatatt

SEQ ID NO: 3196290 - DNA, 16 bp, Homo sapiens
aacatgttactgacca

SEQ ID NO: 3196291 - DNA, 14 bp, Homo sapiens
aacatgtttctgtt

SEQ ID NO: 3196292 - DNA, 16 bp, Homo sapiens
aacattaaaaatggaa

SEQ ID NO: 3196293 - DNA, 21 bp, Homo sapiens
aacattaaaaatggaactgtg

SEQ ID NO: 3196294 - DNA, 23 bp, Homo sapiens
aacattaatgcctgctttttgga

SEQ ID NO: 3196295 - DNA, 17 bp, Homo sapiens
aacattaattttgtgca

SEQ ID NO: 3196296 - DNA, 16 bp, Homo sapiens
aacattatttattcag

SEQ ID NO: 3196297 - DNA, 16 bp, Homo sapiens
aacattcagctctgga

SEQ ID NO: 3196298 - DNA, 22 bp, Homo sapiens
aacattcagctctggagaacag

SEQ ID NO: 3196299 - DNA, 20 bp, Homo sapiens
aacattccaaggagttggaa

SEQ ID NO: 3196300 - DNA, 14 bp, Homo sapiens
aacattcccctccc

SEQ ID NO: 3196301 - DNA, 16 bp, Homo sapiens
aacattctgatttgga

SEQ ID NO: 3196302 - DNA, 19 bp, Homo sapiens
aacattgaagtaatgaatt

SEQ ID NO: 3196303 - DNA, 17 bp, Homo sapiens
aacattgaccaagaact

SEQ ID NO: 3196304 - DNA, 23 bp, Homo sapiens
aacattgaccaagaactgcatgg

SEQ ID NO: 3196305 - DNA, 16 bp, Homo sapiens
aacattggaatgttct

SEQ ID NO: 3196306 - DNA, 19 bp, Homo sapiens
aacattggagctgactgtt

SEQ ID NO: 3196307 - DNA, 20 bp, Homo sapiens
aacattgttgctccctgtga

SEQ ID NO: 3196308 - DNA, 15 bp, Homo sapiens
aacatttatatgtag

SEQ ID NO: 3196309 - DNA, 19 bp, Homo sapiens
aacatttccgaataaagta

SEQ ID NO: 3196310 - DNA, 16 bp, Homo sapiens
aacatttctgtaaata

SEQ ID NO: 3196311 - DNA, 18 bp, Homo sapiens
aacatttctgtaaatacc

SEQ ID NO: 3196312 - DNA, 19 bp, Homo sapiens
aacatttctgtaaatacca

SEQ ID NO: 3196313 - DNA, 12 bp, Homo sapiens
aacatttgatat

SEQ ID NO: 3196314 - DNA, 20 bp, Homo sapiens
aacatttgccttgcagaact

SEQ ID NO: 3196315 - DNA, 14 bp, Homo sapiens
aacatttgctgttt

SEQ ID NO: 3196316 - DNA, 15 bp, Homo sapiens
aacatttgctgtttt

SEQ ID NO: 3196317 - DNA, 20 bp, Homo sapiens
aacattttaaataaaagaaa

SEQ ID NO: 3196318 - DNA, 22 bp, Homo sapiens
aacattttatttttaaaatatt

SEQ ID NO: 3196319 - DNA, 18 bp, Homo sapiens
aacattttgttcttacac

SEQ ID NO: 3196320 - DNA, 20 bp, Homo sapiens
aacattttgttcttacacat

SEQ ID NO: 3196321 - DNA, 15 bp, Homo sapiens
aacatttttcaacaa

SEQ ID NO: 3196322 - DNA, 22 bp, Homo sapiens
aacatttttcaacaaatatctt

SEQ ID NO: 3196323 - DNA, 12 bp, Homo sapiens
aaccaaaacata

SEQ ID NO: 3196324 - DNA, 14 bp, Homo sapiens
aaccaaaacttcca

SEQ ID NO: 3196325 - DNA, 13 bp, Homo sapiens
aaccaaacaatta

SEQ ID NO: 3196326 - DNA, 18 bp, Homo sapiens
aaccaaacttgttcattt

SEQ ID NO: 3196327 - DNA, 16 bp, Homo sapiens
aaccaaagcctcttca

SEQ ID NO: 3196328 - DNA, 15 bp, Homo sapiens
aaccaaatatgttaa

SEQ ID NO: 3196329 - DNA, 16 bp, Homo sapiens
aaccaaatatgttaaa

SEQ ID NO: 3196330 - DNA, 15 bp, Homo sapiens
aaccaaatctggaag

SEQ ID NO: 3196331 - DNA, 14 bp, Homo sapiens
aaccaaatggttct

SEQ ID NO: 3196332 - DNA, 16 bp, Homo sapiens
aaccaaattgcactga

SEQ ID NO: 3196333 - DNA, 22 bp, Homo sapiens
aaccaacctttaaaattgtcac

SEQ ID NO: 3196334 - DNA, 13 bp, Homo sapiens
aaccaactctaat

SEQ ID NO: 3196335 - DNA, 14 bp, Homo sapiens
aaccaactctaata

SEQ ID NO: 3196336 - DNA, 19 bp, Homo sapiens
aaccaagcaggagacgaca

SEQ ID NO: 3196337 - DNA, 18 bp, Homo sapiens
aaccaagctgagtttcct

SEQ ID NO: 3196338 - DNA, 19 bp, Homo sapiens
aaccaagctgagtttccta

SEQ ID NO: 3196339 - DNA, 20 bp, Homo sapiens
aaccaagtcatgtgcatttc

SEQ ID NO: 3196340 - DNA, 21 bp, Homo sapiens
aaccaagtcggaacagcagat

SEQ ID NO: 3196341 - DNA, 21 bp, Homo sapiens
aaccaatcttaaacataataa

SEQ ID NO: 3196342 - DNA, 23 bp, Homo sapiens
aaccaatgattcataacaatgta

SEQ ID NO: 3196343 - DNA, 21 bp, Homo sapiens
aaccaatggtgatcctctatt

SEQ ID NO: 3196344 - DNA, 17 bp, Homo sapiens
aaccaatttcttccttc

SEQ ID NO: 3196345 - DNA, 11 bp, Homo sapiens
aaccacaaagg

SEQ ID NO: 3196346 - DNA, 19 bp, Homo sapiens
aaccacacttgaaaccttt

SEQ ID NO: 3196347 - DNA, 12 bp, Homo sapiens
aaccacagagaa

SEQ ID NO: 3196348 - DNA, 16 bp, Homo sapiens
aaccacagtcctcacc

SEQ ID NO: 3196349 - DNA, 18 bp, Homo sapiens
aaccacatcttgctctgc

SEQ ID NO: 3196350 - DNA, 20 bp, Homo sapiens
aaccacatcttgctctgctg

SEQ ID NO: 3196351 - DNA, 12 bp, Homo sapiens
aaccactagaaa

SEQ ID NO: 3196352 - DNA, 14 bp, Homo sapiens
aaccactgcaacgg

SEQ ID NO: 3196353 - DNA, 13 bp, Homo sapiens
aaccacttaaaaa

SEQ ID NO: 3196354 - DNA, 14 bp, Homo sapiens
aaccacttcattct

SEQ ID NO: 3196355 - DNA, 15 bp, Homo sapiens
aaccagaaaagcaat

SEQ ID NO: 3196356 - DNA, 15 bp, Homo sapiens
aaccagaataaaata

SEQ ID NO: 3196357 - DNA, 16 bp, Homo sapiens
aaccagacagcacagg

SEQ ID NO: 3196358 - DNA, 18 bp, Homo sapiens
aaccagcatctcagcgcc

SEQ ID NO: 3196359 - DNA, 14 bp, Homo sapiens
aaccagctaagaaa

SEQ ID NO: 3196360 - DNA, 21 bp, Homo sapiens
aaccagcttgttctgggctca

SEQ ID NO: 3196361 - DNA, 13 bp, Homo sapiens
aaccagggaggag

SEQ ID NO: 3196362 - DNA, 18 bp, Homo sapiens
aaccaggtccagatgtgc

SEQ ID NO: 3196363 - DNA, 14 bp, Homo sapiens
aaccagtgcagaaa

SEQ ID NO: 3196364 - DNA, 18 bp, Homo sapiens
aaccagtgcagaaatgaa

SEQ ID NO: 3196365 - DNA, 17 bp, Homo sapiens
aaccatcagaattcaga

SEQ ID NO: 3196366 - DNA, 17 bp, Homo sapiens
aaccatctggcctggcc

SEQ ID NO: 3196367 - DNA, 15 bp, Homo sapiens
aaccatgaagacagg

SEQ ID NO: 3196368 - DNA, 15 bp, Homo sapiens
aaccatgactgtgac

SEQ ID NO: 3196369 - DNA, 13 bp, Homo sapiens
aaccattaaagtc

SEQ ID NO: 3196370 - DNA, 14 bp, Homo sapiens
aaccattaaagtca

SEQ ID NO: 3196371 - DNA, 13 bp, Homo sapiens
aaccattatactt

SEQ ID NO: 3196372 - DNA, 19 bp, Homo sapiens
aaccattatactttatatc

SEQ ID NO: 3196373 - DNA, 23 bp, Homo sapiens
aaccattatactttatatctgta

SEQ ID NO: 3196374 - DNA, 17 bp, Homo sapiens
aaccattccatttccaa

SEQ ID NO: 3196375 - DNA, 23 bp, Homo sapiens
aaccattccatttccaagcactt

SEQ ID NO: 3196376 - DNA, 21 bp, Homo sapiens
aaccattgtaactattaacct

SEQ ID NO: 3196377 - DNA, 22 bp, Homo sapiens
aaccattttttgttctgtgtcc

SEQ ID NO: 3196378 - DNA, 14 bp, Homo sapiens
aacccaagctcctc

SEQ ID NO: 3196379 - DNA, 16 bp, Homo sapiens
aacccaagcttagaac

SEQ ID NO: 3196380 - DNA, 21 bp, Homo sapiens
aacccacagatgtctctgggg

SEQ ID NO: 3196381 - DNA, 15 bp, Homo sapiens
aacccacctctggcc

SEQ ID NO: 3196382 - DNA, 17 bp, Homo sapiens
aacccacctctggccct

SEQ ID NO: 3196383 - DNA, 20 bp, Homo sapiens
aacccacttgtcactgacac

SEQ ID NO: 3196384 - DNA, 13 bp, Homo sapiens
aacccagatttta

SEQ ID NO: 3196385 - DNA, 14 bp, Homo sapiens
aacccagattttat

SEQ ID NO: 3196386 - DNA, 10 bp, Homo sapiens
aacccagccg

SEQ ID NO: 3196387 - DNA, 19 bp, Homo sapiens
aacccagggctctgcccca

SEQ ID NO: 3196388 - DNA, 21 bp, Homo sapiens
aacccagggctctgccccagt

SEQ ID NO: 3196389 - DNA, 22 bp, Homo sapiens
aacccagggctctgccccagtc

SEQ ID NO: 3196390 - DNA, 15 bp, Homo sapiens
aaccccaacgcacag

SEQ ID NO: 3196391 - DNA, 11 bp, Homo sapiens
aaccccagccg

SEQ ID NO: 3196392 - DNA, 19 bp, Homo sapiens
aaccccagttctgctcctc

SEQ ID NO: 3196393 - DNA, 22 bp, Homo sapiens
aaccccagttctgctcctctcc

SEQ ID NO: 3196394 - DNA, 13 bp, Homo sapiens
aaccccatgggct

SEQ ID NO: 3196395 - DNA, 13 bp, Homo sapiens
aacccccagcctg

SEQ ID NO: 3196396 - DNA, 14 bp, Homo sapiens
aacccccagcctgc

SEQ ID NO: 3196397 - DNA, 13 bp, Homo sapiens
aacccccctcctg

SEQ ID NO: 3196398 - DNA, 17 bp, Homo sapiens
aacccccctcctgctcc

SEQ ID NO: 3196399 - DNA, 20 bp, Homo sapiens
aacccccgccacctcagggc

SEQ ID NO: 3196400 - DNA, 19 bp, Homo sapiens
aaccccctttgtgctgtgg

SEQ ID NO: 3196401 - DNA, 18 bp, Homo sapiens
aaccccgcggtgctctgg

SEQ ID NO: 3196402 - DNA, 15 bp, Homo sapiens
aaccccgggatgcaa

SEQ ID NO: 3196403 - DNA, 17 bp, Homo sapiens
aaccccgggatgcaagg

SEQ ID NO: 3196404 - DNA, 20 bp, Homo sapiens
aacccctcccctccatccct

SEQ ID NO: 3196405 - DNA, 12 bp, Homo sapiens
aacccctgtccc

SEQ ID NO: 3196406 - DNA, 23 bp, Homo sapiens
aacccctgtcccatgcaggccct

SEQ ID NO: 3196407 - DNA, 17 bp, Homo sapiens
aaccctacaaagagcct

SEQ ID NO: 3196408 - DNA, 20 bp, Homo sapiens
aaccctactttgcttccgcc

SEQ ID NO: 3196409 - DNA, 19 bp, Homo sapiens
aaccctagccttgcttgtt

SEQ ID NO: 3196410 - DNA, 20 bp, Homo sapiens
aaccctaggttcccggtccc

SEQ ID NO: 3196411 - DNA, 17 bp, Homo sapiens
aaccctaggttccctgt

SEQ ID NO: 3196412 - DNA, 16 bp, Homo sapiens
aaccctatctcctgac

SEQ ID NO: 3196413 - DNA, 17 bp, Homo sapiens
aaccctctcctgtctgc

SEQ ID NO: 3196414 - DNA, 19 bp, Homo sapiens
aaccctggcacttaagggg

SEQ ID NO: 3196415 - DNA, 16 bp, Homo sapiens
aaccctggggaaggag

SEQ ID NO: 3196416 - DNA, 19 bp, Homo sapiens
aaccctgtgctggtgtcct

SEQ ID NO: 3196417 - DNA, 22 bp, Homo sapiens
aaccctgttttatactgtactt

SEQ ID NO: 3196418 - DNA, 14 bp, Homo sapiens
aacccttattccat

SEQ ID NO: 3196419 - DNA, 17 bp, Homo sapiens
aaccgacaggccctggc

SEQ ID NO: 3196420 - DNA, 22 bp, Homo sapiens
aaccgagcaaagatcaaaataa

SEQ ID NO: 3196421 - DNA, 16 bp, Homo sapiens
aaccgcatgtgatctc

SEQ ID NO: 3196422 - DNA, 19 bp, Homo sapiens
aaccgccctgcagcatccc

SEQ ID NO: 3196423 - DNA, 12 bp, Homo sapiens
aaccgctcacct

SEQ ID NO: 3196424 - DNA, 16 bp, Homo sapiens
aaccgctcacctagag

SEQ ID NO: 3196425 - DNA, 13 bp, Homo sapiens
aaccgtcctcttt

SEQ ID NO: 3196426 - DNA, 15 bp, Homo sapiens
aaccgtcctcttttt

SEQ ID NO: 3196427 - DNA, 18 bp, Homo sapiens
aaccgtctgttatgctgt

SEQ ID NO: 3196428 - DNA, 23 bp, Homo sapiens
aaccgtgagcaggaaggcctggg

SEQ ID NO: 3196429 - DNA, 22 bp, Homo sapiens
aaccgttattataattgtatca

SEQ ID NO: 3196430 - DNA, 18 bp, Homo sapiens
aaccgttttgaagctact

SEQ ID NO: 3196431 - DNA, 21 bp, Homo sapiens
aacctaaaataattggttctt

SEQ ID NO: 3196432 - DNA, 22 bp, Homo sapiens
aacctaaatttggttctaggcc

SEQ ID NO: 3196433 - DNA, 18 bp, Homo sapiens
aacctaattaatatatta

SEQ ID NO: 3196434 - DNA, 13 bp, Homo sapiens
aacctaccagcca

SEQ ID NO: 3196435 - DNA, 23 bp, Homo sapiens
aacctacgagggaggaacacctg

SEQ ID NO: 3196436 - DNA, 17 bp, Homo sapiens
aacctactgttcctttc

SEQ ID NO: 3196437 - DNA, 14 bp, Homo sapiens
aacctagagaagat

SEQ ID NO: 3196438 - DNA, 20 bp, Homo sapiens
aacctagtactctctgctct

SEQ ID NO: 3196439 - DNA, 15 bp, Homo sapiens
aacctcagaggcagc

SEQ ID NO: 3196440 - DNA, 13 bp, Homo sapiens
aacctcagctctg

SEQ ID NO: 3196441 - DNA, 16 bp, Homo sapiens
aacctcagctctggga

SEQ ID NO: 3196442 - DNA, 18 bp, Homo sapiens
aacctcagggctcccagg

SEQ ID NO: 3196443 - DNA, 22 bp, Homo sapiens
aacctcaggtacggagaagaat

SEQ ID NO: 3196444 - DNA, 21 bp, Homo sapiens
aacctcattgacaagaactga

SEQ ID NO: 3196445 - DNA, 15 bp, Homo sapiens
aacctcattggccag

SEQ ID NO: 3196446 - DNA, 23 bp, Homo sapiens
aacctccctcttgttttgtttgt

SEQ ID NO: 3196447 - DNA, 20 bp, Homo sapiens
aacctccgccaatgcacggc

SEQ ID NO: 3196448 - DNA, 17 bp, Homo sapiens
aacctccgcctcttggg

SEQ ID NO: 3196449 - DNA, 19 bp, Homo sapiens
aacctcggcttgtgggctg

SEQ ID NO: 3196450 - DNA, 21 bp, Homo sapiens
aacctcggcttgtgggctggt

SEQ ID NO: 3196451 - DNA, 13 bp, Homo sapiens
aacctctcactcc

SEQ ID NO: 3196452 - DNA, 15 bp, Homo sapiens
aacctctctgatctt

SEQ ID NO: 3196453 - DNA, 10 bp, Homo sapiens
aacctctggc

SEQ ID NO: 3196454 - DNA, 11 bp, Homo sapiens
aacctctggcc

SEQ ID NO: 3196455 - DNA, 12 bp, Homo sapiens
aacctctggccc

SEQ ID NO: 3196456 - DNA, 13 bp, Homo sapiens
aacctctggccct

SEQ ID NO: 3196457 - DNA, 14 bp, Homo sapiens
aacctctggccctt

SEQ ID NO: 3196458 - DNA, 16 bp, Homo sapiens
aacctctggcccttgg

SEQ ID NO: 3196459 - DNA, 23 bp, Homo sapiens
aacctctggcccttggaataaag

SEQ ID NO: 3196460 - DNA, 16 bp, Homo sapiens
aacctctgtctcatcc

SEQ ID NO: 3196461 - DNA, 14 bp, Homo sapiens
aacctcttccccag

SEQ ID NO: 3196462 - DNA, 18 bp, Homo sapiens
aacctcttttctgcatca

SEQ ID NO: 3196463 - DNA, 21 bp, Homo sapiens
aacctgaaaaaaagtttacaa

SEQ ID NO: 3196464 - DNA, 15 bp, Homo sapiens
aacctgaaagacaaa

SEQ ID NO: 3196465 - DNA, 20 bp, Homo sapiens
aacctgaaatttattcacat

SEQ ID NO: 3196466 - DNA, 20 bp, Homo sapiens
aacctgacagatgtcagccg

SEQ ID NO: 3196467 - DNA, 19 bp, Homo sapiens
aacctgacccctgctcagt

SEQ ID NO: 3196468 - DNA, 11 bp, Homo sapiens
aacctgctctc

SEQ ID NO: 3196469 - DNA, 15 bp, Homo sapiens
aacctgctctcctct

SEQ ID NO: 3196470 - DNA, 20 bp, Homo sapiens
aacctgctctcctcttgcca

SEQ ID NO: 3196471 - DNA, 14 bp, Homo sapiens
aacctggagatatt

SEQ ID NO: 3196472 - DNA, 12 bp, Homo sapiens
aacctgggctgt

SEQ ID NO: 3196473 - DNA, 22 bp, Homo sapiens
aacctgggtccaaataaaaact

SEQ ID NO: 3196474 - DNA, 21 bp, Homo sapiens
aacctggtattttaagagaaa

SEQ ID NO: 3196475 - DNA, 14 bp, Homo sapiens
aacctggtgctgga

SEQ ID NO: 3196476 - DNA, 17 bp, Homo sapiens
aacctggtggcaccaga

SEQ ID NO: 3196477 - DNA, 15 bp, Homo sapiens
aacctgtacttcaag

SEQ ID NO: 3196478 - DNA, 18 bp, Homo sapiens
aacctgtagaatcaattt

SEQ ID NO: 3196479 - DNA, 22 bp, Homo sapiens
aacctgtagaatcaatttaagt

SEQ ID NO: 3196480 - DNA, 17 bp, Homo sapiens
aacctgtgccaggctga

SEQ ID NO: 3196481 - DNA, 24 bp, Homo sapiens
aacctgttacctactttgactttt

SEQ ID NO: 3196482 - DNA, 23 bp, Homo sapiens
aacctgttcttagagtgtagctg

SEQ ID NO: 3196483 - DNA, 23 bp, Homo sapiens
aacctgttgctgtgtttaatttg

SEQ ID NO: 3196484 - DNA, 22 bp, Homo sapiens
aacctgttttgttaatgctcta

SEQ ID NO: 3196485 - DNA, 13 bp, Homo sapiens
aaccttaagatac

SEQ ID NO: 3196486 - DNA, 13 bp, Homo sapiens
aaccttaatgaca

SEQ ID NO: 3196487 - DNA, 22 bp, Homo sapiens
aaccttccatacatttttttct

SEQ ID NO: 3196488 - DNA, 14 bp, Homo sapiens
aaccttccctccaa

SEQ ID NO: 3196489 - DNA, 15 bp, Homo sapiens
aaccttcgtcctttt

SEQ ID NO: 3196490 - DNA, 21 bp, Homo sapiens
aaccttctagaacctgggctg

SEQ ID NO: 3196491 - DNA, 20 bp, Homo sapiens
aaccttgaagtgactgttgt

SEQ ID NO: 3196492 - DNA, 13 bp, Homo sapiens
aaccttgctgtcc

SEQ ID NO: 3196493 - DNA, 15 bp, Homo sapiens
aaccttgtaaaaaaa

SEQ ID NO: 3196494 - DNA, 21 bp, Homo sapiens
aaccttgtaaaaaaagcaaaa

SEQ ID NO: 3196495 - DNA, 15 bp, Homo sapiens
aaccttgttctattt

SEQ ID NO: 3196496 - DNA, 16 bp, Homo sapiens
aaccttgttctatttt

SEQ ID NO: 3196497 - DNA, 23 bp, Homo sapiens
aacctttaaaattgtcacctctg

SEQ ID NO: 3196498 - DNA, 19 bp, Homo sapiens
aacctttagggcagcttgc

SEQ ID NO: 3196499 - DNA, 14 bp, Homo sapiens
aacctttcaaattt

SEQ ID NO: 3196500 - DNA, 20 bp, Homo sapiens
aacctttcacctttgtgtat

SEQ ID NO: 3196501 - DNA, 18 bp, Homo sapiens
aacctttccgctgtcgcc

SEQ ID NO: 3196502 - DNA, 22 bp, Homo sapiens
aacctttccgctgtcgccccag

SEQ ID NO: 3196503 - DNA, 19 bp, Homo sapiens
aacctttgctatgtaaggg

SEQ ID NO: 3196504 - DNA, 12 bp, Homo sapiens
aacctttttaaa

SEQ ID NO: 3196505 - DNA, 22 bp, Homo sapiens
aacctttttcttgatcttaaag

SEQ ID NO: 3196506 - DNA, 15 bp, Homo sapiens
aaccttttttaagat

SEQ ID NO: 3196507 - DNA, 18 bp, Homo sapiens
aaccttttttaagatttt

SEQ ID NO: 3196508 - DNA, 12 bp, Homo sapiens
aaccttttttgt

SEQ ID NO: 3196509 - DNA, 19 bp, Homo sapiens
aaccttttttgtcttattg

SEQ ID NO: 3196510 - DNA, 19 bp, Homo sapiens
aacctttttttttgaaaca

SEQ ID NO: 3196511 - DNA, 14 bp, Homo sapiens
aacgaagaaaaaaa

SEQ ID NO: 3196512 - DNA, 23 bp, Homo sapiens
aacgaaggggccccggggctggc

SEQ ID NO: 3196513 - DNA, 23 bp, Homo sapiens
aacgacaaagccaaactctgcca

SEQ ID NO: 3196514 - DNA, 14 bp, Homo sapiens
aacgacaatagctt

SEQ ID NO: 3196515 - DNA, 22 bp, Homo sapiens
aacgagttaatgatggcagagg

SEQ ID NO: 3196516 - DNA, 20 bp, Homo sapiens
aacgatgtgtctgtatttca

SEQ ID NO: 3196517 - DNA, 18 bp, Homo sapiens
aacgatttaccaattaat

SEQ ID NO: 3196518 - DNA, 12 bp, Homo sapiens
aacgcagccctg

SEQ ID NO: 3196519 - DNA, 16 bp, Homo sapiens
aacgcagccctgcttt

SEQ ID NO: 3196520 - DNA, 22 bp, Homo sapiens
aacgcaggagaatcactgcagc

SEQ ID NO: 3196521 - DNA, 13 bp, Homo sapiens
aacgcatggagtg

SEQ ID NO: 3196522 - DNA, 21 bp, Homo sapiens
aacgcatggagtgtgtattgt

SEQ ID NO: 3196523 - DNA, 22 bp, Homo sapiens
aacgcatggagtgtgtattgtt

SEQ ID NO: 3196524 - DNA, 17 bp, Homo sapiens
aacgccagtctcccagg

SEQ ID NO: 3196525 - DNA, 20 bp, Homo sapiens
aacgccagtctcccaggccc

SEQ ID NO: 3196526 - DNA, 18 bp, Homo sapiens
aacgccccgggcaaaggg

SEQ ID NO: 3196527 - DNA, 17 bp, Homo sapiens
aacgcccctgtggccaa

SEQ ID NO: 3196528 - DNA, 17 bp, Homo sapiens
aacgctaaagagccctt

SEQ ID NO: 3196529 - DNA, 21 bp, Homo sapiens
aacgctagaagcctaagaact

SEQ ID NO: 3196530 - DNA, 16 bp, Homo sapiens
aacgctgtcaaaagtt

SEQ ID NO: 3196531 - DNA, 22 bp, Homo sapiens
aacgcttgtagaactcactctg

SEQ ID NO: 3196532 - DNA, 17 bp, Homo sapiens
aacggaacgttggactt

SEQ ID NO: 3196533 - DNA, 19 bp, Homo sapiens
aacggaagctgacataatg

SEQ ID NO: 3196534 - DNA, 15 bp, Homo sapiens
aacggattccaaaga

SEQ ID NO: 3196535 - DNA, 19 bp, Homo sapiens
aacggccctgcagccagct

SEQ ID NO: 3196536 - DNA, 19 bp, Homo sapiens
aacgggaacatgccccctg

SEQ ID NO: 3196537 - DNA, 15 bp, Homo sapiens
aacggggtccttcaa

SEQ ID NO: 3196538 - DNA, 14 bp, Homo sapiens
aacggttcagtttc

SEQ ID NO: 3196539 - DNA, 14 bp, Homo sapiens
aacggttcctggtg

SEQ ID NO: 3196540 - DNA, 18 bp, Homo sapiens
aacgtaaaaataaaagca

SEQ ID NO: 3196541 - DNA, 22 bp, Homo sapiens
aacgtgagagaaagagagaagc

SEQ ID NO: 3196542 - DNA, 17 bp, Homo sapiens
aacgtgtatagtgccta

SEQ ID NO: 3196543 - DNA, 18 bp, Homo sapiens
aacgtgtcacacttgtga

SEQ ID NO: 3196544 - DNA, 23 bp, Homo sapiens
aacgtgtcagaatcctttacatt

SEQ ID NO: 3196545 - DNA, 20 bp, Homo sapiens
aacgtgtttaattaaatttc

SEQ ID NO: 3196546 - DNA, 17 bp, Homo sapiens
aacgttactcagggctc

SEQ ID NO: 3196547 - DNA, 13 bp, Homo sapiens
aacgttggacttt

SEQ ID NO: 3196548 - DNA, 13 bp, Homo sapiens
aacgttttattgt

SEQ ID NO: 3196549 - DNA, 15 bp, Homo sapiens
aacgttttgaactaa

SEQ ID NO: 3196550 - DNA, 20 bp, Homo sapiens
aacgttttgaactaataaaa

SEQ ID NO: 3196551 - DNA, 14 bp, Homo sapiens
aactaaataatgaa

SEQ ID NO: 3196552 - DNA, 16 bp, Homo sapiens
aactaaataatgaata

SEQ ID NO: 3196553 - DNA, 19 bp, Homo sapiens
aactaaatgagattatatg

SEQ ID NO: 3196554 - DNA, 16 bp, Homo sapiens
aactaaatttgatact

SEQ ID NO: 3196555 - DNA, 19 bp, Homo sapiens
aactaaatttgatacttat

SEQ ID NO: 3196556 - DNA, 20 bp, Homo sapiens
aactaaatttgatacttata

SEQ ID NO: 3196557 - DNA, 11 bp, Homo sapiens
aactaacatgt

SEQ ID NO: 3196558 - DNA, 23 bp, Homo sapiens
aactaagaaatatgcacaatagc

SEQ ID NO: 3196559 - DNA, 16 bp, Homo sapiens
aactaagattctttta

SEQ ID NO: 3196560 - DNA, 22 bp, Homo sapiens
aactaagattcttttaaattag

SEQ ID NO: 3196561 - DNA, 23 bp, Homo sapiens
aactaagcagtccctgagaccat

SEQ ID NO: 3196562 - DNA, 12 bp, Homo sapiens
aactaagcattg

SEQ ID NO: 3196563 - DNA, 15 bp, Homo sapiens
aactaaggatttttc

SEQ ID NO: 3196564 - DNA, 22 bp, Homo sapiens
aactaatatgggcattgtagtt

SEQ ID NO: 3196565 - DNA, 20 bp, Homo sapiens
aactaatctattgggttcat

SEQ ID NO: 3196566 - DNA, 21 bp, Homo sapiens
aactaatgataatcccaccac

SEQ ID NO: 3196567 - DNA, 21 bp, Homo sapiens
aactacaaagctttgctacaa

SEQ ID NO: 3196568 - DNA, 13 bp, Homo sapiens
aactacatgttct

SEQ ID NO: 3196569 - DNA, 15 bp, Homo sapiens
aactacctgagctaa

SEQ ID NO: 3196570 - DNA, 21 bp, Homo sapiens
aactactgaatgaagcagtat

SEQ ID NO: 3196571 - DNA, 23 bp, Homo sapiens
aactactgaatgaagcagtattt

SEQ ID NO: 3196572 - DNA, 13 bp, Homo sapiens
aactactgtactt

SEQ ID NO: 3196573 - DNA, 16 bp, Homo sapiens
aactactgtactttgc

SEQ ID NO: 3196574 - DNA, 14 bp, Homo sapiens
aactagaattagta

SEQ ID NO: 3196575 - DNA, 21 bp, Homo sapiens
aactagaattgttgcatccct

SEQ ID NO: 3196576 - DNA, 22 bp, Homo sapiens
aactagaatttattcaattcct

SEQ ID NO: 3196577 - DNA, 16 bp, Homo sapiens
aactagacattctgtc

SEQ ID NO: 3196578 - DNA, 18 bp, Homo sapiens
aactagccaaaccaggac

SEQ ID NO: 3196579 - DNA, 16 bp, Homo sapiens
aactagcccctggggt

SEQ ID NO: 3196580 - DNA, 13 bp, Homo sapiens
aactaggctctta

SEQ ID NO: 3196581 - DNA, 20 bp, Homo sapiens
aactaggtaatgttttgtat

SEQ ID NO: 3196582 - DNA, 16 bp, Homo sapiens
aactatacccgggacc

SEQ ID NO: 3196583 - DNA, 23 bp, Homo sapiens
aactatagcttgcagaactgtag

SEQ ID NO: 3196584 - DNA, 14 bp, Homo sapiens
aactatagtaactt

SEQ ID NO: 3196585 - DNA, 16 bp, Homo sapiens
aactatctgtatttat

SEQ ID NO: 3196586 - DNA, 11 bp, Homo sapiens
aactatcttgg

SEQ ID NO: 3196587 - DNA, 18 bp, Homo sapiens
aactatgacagatatatt

SEQ ID NO: 3196588 - DNA, 19 bp, Homo sapiens
aactatgacagatatattt

SEQ ID NO: 3196589 - DNA, 14 bp, Homo sapiens
aactatgataaatt

SEQ ID NO: 3196590 - DNA, 20 bp, Homo sapiens
aactatgtgtttttctcata

SEQ ID NO: 3196591 - DNA, 21 bp, Homo sapiens
aactattaaccttttttgtct

SEQ ID NO: 3196592 - DNA, 11 bp, Homo sapiens
aactattctgt

SEQ ID NO: 3196593 - DNA, 23 bp, Homo sapiens
aactatttatctgtgtttttgaa

SEQ ID NO: 3196594 - DNA, 16 bp, Homo sapiens
aactatttctacacag

SEQ ID NO: 3196595 - DNA, 14 bp, Homo sapiens
aactatttttgtaa

SEQ ID NO: 3196596 - DNA, 19 bp, Homo sapiens
aactcaaaacttaacatat

SEQ ID NO: 3196597 - DNA, 22 bp, Homo sapiens
aactcaaactgaggaatttcac

SEQ ID NO: 3196598 - DNA, 21 bp, Homo sapiens
aactcaaatgtgagtgttttt

SEQ ID NO: 3196599 - DNA, 13 bp, Homo sapiens
aactcaagacaat

SEQ ID NO: 3196600 - DNA, 22 bp, Homo sapiens
aactcaaggataccttcttatt

SEQ ID NO: 3196601 - DNA, 23 bp, Homo sapiens
aactcaaggataccttcttattt

SEQ ID NO: 3196602 - DNA, 23 bp, Homo sapiens
aactcaccctgggagccagtcct

SEQ ID NO: 3196603 - DNA, 21 bp, Homo sapiens
aactcacctaatgtttatgag

SEQ ID NO: 3196604 - DNA, 16 bp, Homo sapiens
aactcactctgggctg

SEQ ID NO: 3196605 - DNA, 14 bp, Homo sapiens
aactcactgctcaa

SEQ ID NO: 3196606 - DNA, 21 bp, Homo sapiens
aactcactgctcaagaagaca

SEQ ID NO: 3196607 - DNA, 22 bp, Homo sapiens
aactcactggaatgtacagtat

SEQ ID NO: 3196608 - DNA, 14 bp, Homo sapiens
aactcactttcctc

SEQ ID NO: 3196609 - DNA, 16 bp, Homo sapiens
aactcagaatataaca

SEQ ID NO: 3196610 - DNA, 18 bp, Homo sapiens
aactcagaattattttta

SEQ ID NO: 3196611 - DNA, 21 bp, Homo sapiens
aactcagaattatttttaaaa

SEQ ID NO: 3196612 - DNA, 14 bp, Homo sapiens
aactcagcagttga

SEQ ID NO: 3196613 - DNA, 15 bp, Homo sapiens
aactcatcataaaat

SEQ ID NO: 3196614 - DNA, 17 bp, Homo sapiens
aactcattctatcccca

SEQ ID NO: 3196615 - DNA, 22 bp, Homo sapiens
aactcattgcagcagataactt

SEQ ID NO: 3196616 - DNA, 17 bp, Homo sapiens
aactcatttttgccata

SEQ ID NO: 3196617 - DNA, 14 bp, Homo sapiens
aactccaaagtcca

SEQ ID NO: 3196618 - DNA, 22 bp, Homo sapiens
aactcccctgtttcaatcactg

SEQ ID NO: 3196619 - DNA, 19 bp, Homo sapiens
aactccccttcctcactgc

SEQ ID NO: 3196620 - DNA, 23 bp, Homo sapiens
aactccccttcctcactgcccaa

SEQ ID NO: 3196621 - DNA, 13 bp, Homo sapiens
aactccctttcaa

SEQ ID NO: 3196622 - DNA, 14 bp, Homo sapiens
aactccctttcaac

SEQ ID NO: 3196623 - DNA, 13 bp, Homo sapiens
aactcctaatttt

SEQ ID NO: 3196624 - DNA, 17 bp, Homo sapiens
aactcctaattttaaat

SEQ ID NO: 3196625 - DNA, 21 bp, Homo sapiens
aactcctcacacaccctgagg

SEQ ID NO: 3196626 - DNA, 17 bp, Homo sapiens
aactcctgattttgtag

SEQ ID NO: 3196627 - DNA, 15 bp, Homo sapiens
aactcctgccattct

SEQ ID NO: 3196628 - DNA, 12 bp, Homo sapiens
aactcctggcct

SEQ ID NO: 3196629 - DNA, 13 bp, Homo sapiens
aactcctggcctc

SEQ ID NO: 3196630 - DNA, 17 bp, Homo sapiens
aactcctggcctcaagt

SEQ ID NO: 3196631 - DNA, 19 bp, Homo sapiens
aactccttattttgtatta

SEQ ID NO: 3196632 - DNA, 16 bp, Homo sapiens
aactcgaatctgtgtg

SEQ ID NO: 3196633 - DNA, 15 bp, Homo sapiens
aactctaatattgct

SEQ ID NO: 3196634 - DNA, 22 bp, Homo sapiens
aactctaattcccattttgcaa

SEQ ID NO: 3196635 - DNA, 15 bp, Homo sapiens
aactctacccctgct

SEQ ID NO: 3196636 - DNA, 16 bp, Homo sapiens
aactctacccctgctc

SEQ ID NO: 3196637 - DNA, 15 bp, Homo sapiens
aactctcaaaagtct

SEQ ID NO: 3196638 - DNA, 20 bp, Homo sapiens
aactctcaaaagtctatttt

SEQ ID NO: 3196639 - DNA, 15 bp, Homo sapiens
aactctccagtgcct

SEQ ID NO: 3196640 - DNA, 20 bp, Homo sapiens
aactctctggaagcccctgg

SEQ ID NO: 3196641 - DNA, 17 bp, Homo sapiens
aactctgaactttggag

SEQ ID NO: 3196642 - DNA, 15 bp, Homo sapiens
aactctgacaagggc

SEQ ID NO: 3196643 - DNA, 19 bp, Homo sapiens
aactctgacaagggctgac

SEQ ID NO: 3196644 - DNA, 21 bp, Homo sapiens
aactctgacaagggctgacct

SEQ ID NO: 3196645 - DNA, 14 bp, Homo sapiens
aactctgagcccat

SEQ ID NO: 3196646 - DNA, 11 bp, Homo sapiens
aactctgcaaa

SEQ ID NO: 3196647 - DNA, 16 bp, Homo sapiens
aactctgcttgatttt

SEQ ID NO: 3196648 - DNA, 13 bp, Homo sapiens
aactctggtggca

SEQ ID NO: 3196649 - DNA, 18 bp, Homo sapiens
aactctgttcccccaccc

SEQ ID NO: 3196650 - DNA, 15 bp, Homo sapiens
aactctttgttattt

SEQ ID NO: 3196651 - DNA, 17 bp, Homo sapiens
aactcttttctattttg

SEQ ID NO: 3196652 - DNA, 20 bp, Homo sapiens
aactgaaaagactcagtgtt

SEQ ID NO: 3196653 - DNA, 17 bp, Homo sapiens
aactgaaagtgttttac

SEQ ID NO: 3196654 - DNA, 14 bp, Homo sapiens
aactgaaataaaaa

SEQ ID NO: 3196655 - DNA, 16 bp, Homo sapiens
aactgaaattacatat

SEQ ID NO: 3196656 - DNA, 22 bp, Homo sapiens
aactgaacaccattgaaggctt

SEQ ID NO: 3196657 - DNA, 14 bp, Homo sapiens
aactgaaccaaatt

SEQ ID NO: 3196658 - DNA, 14 bp, Homo sapiens
aactgaagagacag

SEQ ID NO: 3196659 - DNA, 21 bp, Homo sapiens
aactgaagcagcctctcccca

SEQ ID NO: 3196660 - DNA, 16 bp, Homo sapiens
aactgaagtttcacat

SEQ ID NO: 3196661 - DNA, 16 bp, Homo sapiens
aactgaatgtttacat

SEQ ID NO: 3196662 - DNA, 13 bp, Homo sapiens
aactgaatttgga

SEQ ID NO: 3196663 - DNA, 16 bp, Homo sapiens
aactgaattttgggac

SEQ ID NO: 3196664 - DNA, 12 bp, Homo sapiens
aactgacacagg

SEQ ID NO: 3196665 - DNA, 20 bp, Homo sapiens
aactgacatgattagcagaa

SEQ ID NO: 3196666 - DNA, 19 bp, Homo sapiens
aactgaccagcctccatgc

SEQ ID NO: 3196667 - DNA, 13 bp, Homo sapiens
aactgactttctc

SEQ ID NO: 3196668 - DNA, 10 bp, Homo sapiens
aactgagcct

SEQ ID NO: 3196669 - DNA, 12 bp, Homo sapiens
aactgaggaatt

SEQ ID NO: 3196670 - DNA, 19 bp, Homo sapiens
aactgaggcttagagatag

SEQ ID NO: 3196671 - DNA, 23 bp, Homo sapiens
aactgatggaccgggtgggcctg

SEQ ID NO: 3196672 - DNA, 18 bp, Homo sapiens
aactgatgttactagcct

SEQ ID NO: 3196673 - DNA, 13 bp, Homo sapiens
aactgattcataa

SEQ ID NO: 3196674 - DNA, 19 bp, Homo sapiens
aactgattcttatgattac

SEQ ID NO: 3196675 - DNA, 13 bp, Homo sapiens
aactgatttctat

SEQ ID NO: 3196676 - DNA, 15 bp, Homo sapiens
aactgatttctatgg

SEQ ID NO: 3196677 - DNA, 18 bp, Homo sapiens
aactgatttctatggctt

SEQ ID NO: 3196678 - DNA, 22 bp, Homo sapiens
aactgatttctatggctttcaa

SEQ ID NO: 3196679 - DNA, 21 bp, Homo sapiens
aactgcaaaaaaagcctccaa

SEQ ID NO: 3196680 - DNA, 14 bp, Homo sapiens
aactgcaaagaaag

SEQ ID NO: 3196681 - DNA, 17 bp, Homo sapiens
aactgcaaccttgttta

SEQ ID NO: 3196682 - DNA, 17 bp, Homo sapiens
aactgcaatagagactg

SEQ ID NO: 3196683 - DNA, 21 bp, Homo sapiens
aactgcacagtgctgttggtg

SEQ ID NO: 3196684 - DNA, 20 bp, Homo sapiens
aactgcaggccctggcctcc

SEQ ID NO: 3196685 - DNA, 16 bp, Homo sapiens
aactgcattagaaatt

SEQ ID NO: 3196686 - DNA, 19 bp, Homo sapiens
aactgctaatgcaaattaa

SEQ ID NO: 3196687 - DNA, 10 bp, Homo sapiens
aactgctgag

SEQ ID NO: 3196688 - DNA, 15 bp, Homo sapiens
aactgctgagccact

SEQ ID NO: 3196689 - DNA, 16 bp, Homo sapiens
aactgctgagccactc

SEQ ID NO: 3196690 - DNA, 20 bp, Homo sapiens
aactgctggacgtctttctt

SEQ ID NO: 3196691 - DNA, 15 bp, Homo sapiens
aactgctggagtctg

SEQ ID NO: 3196692 - DNA, 13 bp, Homo sapiens
aactgctttcaag

SEQ ID NO: 3196693 - DNA, 18 bp, Homo sapiens
aactgctttcaagtctga

SEQ ID NO: 3196694 - DNA, 18 bp, Homo sapiens
aactgctttctgttccaa

SEQ ID NO: 3196695 - DNA, 20 bp, Homo sapiens
aactgcttttttttttccag

SEQ ID NO: 3196696 - DNA, 22 bp, Homo sapiens
aactgcttttttttttccagca

SEQ ID NO: 3196697 - DNA, 14 bp, Homo sapiens
aactggaaggcctt

SEQ ID NO: 3196698 - DNA, 21 bp, Homo sapiens
aactggacacaataggtcttt

SEQ ID NO: 3196699 - DNA, 16 bp, Homo sapiens
aactggagtctggagt

SEQ ID NO: 3196700 - DNA, 16 bp, Homo sapiens
aactggattaaaacaa

SEQ ID NO: 3196701 - DNA, 22 bp, Homo sapiens
aactggcaggggagacaggagc

SEQ ID NO: 3196702 - DNA, 22 bp, Homo sapiens
aactggccctatttagatgata

SEQ ID NO: 3196703 - DNA, 17 bp, Homo sapiens
aactggccggtctgcaa

SEQ ID NO: 3196704 - DNA, 23 bp, Homo sapiens
aactgggtaaatgcaaagttctg

SEQ ID NO: 3196705 - DNA, 21 bp, Homo sapiens
aactgggtacttgtggacaca

SEQ ID NO: 3196706 - DNA, 16 bp, Homo sapiens
aactggttgtatattt

SEQ ID NO: 3196707 - DNA, 14 bp, Homo sapiens
aactgtaaataaaa

SEQ ID NO: 3196708 - DNA, 16 bp, Homo sapiens
aactgtaaataaaatg

SEQ ID NO: 3196709 - DNA, 18 bp, Homo sapiens
aactgtaaataaaatgtg

SEQ ID NO: 3196710 - DNA, 20 bp, Homo sapiens
aactgtaaataaaatgtgta

SEQ ID NO: 3196711 - DNA, 22 bp, Homo sapiens
aactgtaaataaaatgtgtaca

SEQ ID NO: 3196712 - DNA, 11 bp, Homo sapiens
aactgtaaatc

SEQ ID NO: 3196713 - DNA, 15 bp, Homo sapiens
aactgtagaaatgat

SEQ ID NO: 3196714 - DNA, 17 bp, Homo sapiens
aactgtagaaatgatga

SEQ ID NO: 3196715 - DNA, 19 bp, Homo sapiens
aactgtagaaatgatgatg

SEQ ID NO: 3196716 - DNA, 14 bp, Homo sapiens
aactgtatatattc

SEQ ID NO: 3196717 - DNA, 17 bp, Homo sapiens
aactgtatcaaatctgt

SEQ ID NO: 3196718 - DNA, 20 bp, Homo sapiens
aactgtatcaaatctgtata

SEQ ID NO: 3196719 - DNA, 14 bp, Homo sapiens
aactgtatgtcaga

SEQ ID NO: 3196720 - DNA, 15 bp, Homo sapiens
aactgtcaaattttc

SEQ ID NO: 3196721 - DNA, 19 bp, Homo sapiens
aactgtccgtaagcagtat

SEQ ID NO: 3196722 - DNA, 17 bp, Homo sapiens
aactgtctttgtcacca

SEQ ID NO: 3196723 - DNA, 15 bp, Homo sapiens
aactgtgaaatacca

SEQ ID NO: 3196724 - DNA, 21 bp, Homo sapiens
aactgtgaatacttgaactct

SEQ ID NO: 3196725 - DNA, 22 bp, Homo sapiens
aactgtggatacccttaccctt

SEQ ID NO: 3196726 - DNA, 14 bp, Homo sapiens
aactgtggatattg

SEQ ID NO: 3196727 - DNA, 20 bp, Homo sapiens
aactgtgggattctgatttg

SEQ ID NO: 3196728 - DNA, 15 bp, Homo sapiens
aactgtgtatgtaca

SEQ ID NO: 3196729 - DNA, 23 bp, Homo sapiens
aactgtgttgtattaacaaaagt

SEQ ID NO: 3196730 - DNA, 19 bp, Homo sapiens
aactgtgtttcaagttcaa

SEQ ID NO: 3196731 - DNA, 15 bp, Homo sapiens
aactgttagatgctg

SEQ ID NO: 3196732 - DNA, 14 bp, Homo sapiens
aactgttagcactg

SEQ ID NO: 3196733 - DNA, 18 bp, Homo sapiens
aactgttagcactgttga

SEQ ID NO: 3196734 - DNA, 21 bp, Homo sapiens
aactgttatcacttatatata

SEQ ID NO: 3196735 - DNA, 16 bp, Homo sapiens
aactgttcttttgcat

SEQ ID NO: 3196736 - DNA, 20 bp, Homo sapiens
aactgttgcctaattggaaa

SEQ ID NO: 3196737 - DNA, 11 bp, Homo sapiens
aactgtttata

SEQ ID NO: 3196738 - DNA, 13 bp, Homo sapiens
aactgtttatata

SEQ ID NO: 3196739 - DNA, 16 bp, Homo sapiens
aactgtttccctgctg

SEQ ID NO: 3196740 - DNA, 18 bp, Homo sapiens
aacttaaaaatgtaaata

SEQ ID NO: 3196741 - DNA, 11 bp, Homo sapiens
aacttaaaata

SEQ ID NO: 3196742 - DNA, 14 bp, Homo sapiens
aacttaaaatattt

SEQ ID NO: 3196743 - DNA, 16 bp, Homo sapiens
aacttaacattctgta

SEQ ID NO: 3196744 - DNA, 17 bp, Homo sapiens
aacttaacccagatttt

SEQ ID NO: 3196745 - DNA, 15 bp, Homo sapiens
aacttaagaaacact

SEQ ID NO: 3196746 - DNA, 21 bp, Homo sapiens
aacttacattgttcaattaga

SEQ ID NO: 3196747 - DNA, 22 bp, Homo sapiens
aacttacattgttcaattagaa

SEQ ID NO: 3196748 - DNA, 23 bp, Homo sapiens
aacttacctaagtgacatttgta

SEQ ID NO: 3196749 - DNA, 23 bp, Homo sapiens
aacttactattcattaaatgttt

SEQ ID NO: 3196750 - DNA, 16 bp, Homo sapiens
aacttagacccatgct

SEQ ID NO: 3196751 - DNA, 14 bp, Homo sapiens
aacttagaggaaaa

SEQ ID NO: 3196752 - DNA, 16 bp, Homo sapiens
aacttagaggaaaagg

SEQ ID NO: 3196753 - DNA, 20 bp, Homo sapiens
aacttagatcatcagtcacc

SEQ ID NO: 3196754 - DNA, 16 bp, Homo sapiens
aacttagcatgtgttg

SEQ ID NO: 3196755 - DNA, 19 bp, Homo sapiens
aacttagcatgtgttgaaa

SEQ ID NO: 3196756 - DNA, 13 bp, Homo sapiens
aacttagtatttt

SEQ ID NO: 3196757 - DNA, 21 bp, Homo sapiens
aacttatagttaatattttgt

SEQ ID NO: 3196758 - DNA, 15 bp, Homo sapiens
aacttatccatcttt

SEQ ID NO: 3196759 - DNA, 19 bp, Homo sapiens
aacttatgtagatatttgg

SEQ ID NO: 3196760 - DNA, 22 bp, Homo sapiens
aacttatgtagatatttggctt

SEQ ID NO: 3196761 - DNA, 15 bp, Homo sapiens
aacttattagaaacc

SEQ ID NO: 3196762 - DNA, 14 bp, Homo sapiens
aacttattctgtag

SEQ ID NO: 3196763 - DNA, 13 bp, Homo sapiens
aacttatttagag

SEQ ID NO: 3196764 - DNA, 19 bp, Homo sapiens
aacttattttaaatatgcc

SEQ ID NO: 3196765 - DNA, 17 bp, Homo sapiens
aacttattttatttcca

SEQ ID NO: 3196766 - DNA, 21 bp, Homo sapiens
aacttcaaaaactaaaatcat

SEQ ID NO: 3196767 - DNA, 19 bp, Homo sapiens
aacttcaaagctgaatatt

SEQ ID NO: 3196768 - DNA, 16 bp, Homo sapiens
aacttcacatttatgt

SEQ ID NO: 3196769 - DNA, 21 bp, Homo sapiens
aacttcagatgggaggaaaga

SEQ ID NO: 3196770 - DNA, 21 bp, Homo sapiens
aacttcaggataataaagtgt

SEQ ID NO: 3196771 - DNA, 22 bp, Homo sapiens
aacttcagttttatttttgcca

SEQ ID NO: 3196772 - DNA, 20 bp, Homo sapiens
aacttcatatatgaggactt

SEQ ID NO: 3196773 - DNA, 14 bp, Homo sapiens
aacttcatgtaatt

SEQ ID NO: 3196774 - DNA, 12 bp, Homo sapiens
aacttcatttga

SEQ ID NO: 3196775 - DNA, 13 bp, Homo sapiens
aacttccaaagaa

SEQ ID NO: 3196776 - DNA, 17 bp, Homo sapiens
aacttccaaagaaagtt

SEQ ID NO: 3196777 - DNA, 16 bp, Homo sapiens
aacttccaaggccctg

SEQ ID NO: 3196778 - DNA, 22 bp, Homo sapiens
aacttccaaggccctgcttttt

SEQ ID NO: 3196779 - DNA, 13 bp, Homo sapiens
aacttccaattta

SEQ ID NO: 3196780 - DNA, 19 bp, Homo sapiens
aacttccaggtgttactgt

SEQ ID NO: 3196781 - DNA, 23 bp, Homo sapiens
aacttcccacacgattagcttta

SEQ ID NO: 3196782 - DNA, 14 bp, Homo sapiens
aacttccgctgagg

SEQ ID NO: 3196783 - DNA, 16 bp, Homo sapiens
aacttctaatatattt

SEQ ID NO: 3196784 - DNA, 18 bp, Homo sapiens
aacttctatattttaata

SEQ ID NO: 3196785 - DNA, 14 bp, Homo sapiens
aacttctgaagact

SEQ ID NO: 3196786 - DNA, 20 bp, Homo sapiens
aacttctgcaacaagcatgc

SEQ ID NO: 3196787 - DNA, 16 bp, Homo sapiens
aacttcttatggaatt

SEQ ID NO: 3196788 - DNA, 24 bp, Homo sapiens
aacttcttatggaattgatttgca

SEQ ID NO: 3196789 - DNA, 20 bp, Homo sapiens
aacttcttgcttctttctag

SEQ ID NO: 3196790 - DNA, 22 bp, Homo sapiens
aacttcttgcttctttctagaa

SEQ ID NO: 3196791 - DNA, 13 bp, Homo sapiens
aacttcttgtcag

SEQ ID NO: 3196792 - DNA, 18 bp, Homo sapiens
aacttcttgtcagacata

SEQ ID NO: 3196793 - DNA, 21 bp, Homo sapiens
aacttcttgtcagacataaag

SEQ ID NO: 3196794 - DNA, 14 bp, Homo sapiens
aacttgaagcagtc

SEQ ID NO: 3196795 - DNA, 16 bp, Homo sapiens
aacttgaagctttgta

SEQ ID NO: 3196796 - DNA, 11 bp, Homo sapiens
aacttgatgca

SEQ ID NO: 3196797 - DNA, 21 bp, Homo sapiens
aacttgcatccaactccagga

SEQ ID NO: 3196798 - DNA, 15 bp, Homo sapiens
aacttgcatggagca

SEQ ID NO: 3196799 - DNA, 16 bp, Homo sapiens
aacttggcatttctat

SEQ ID NO: 3196800 - DNA, 21 bp, Homo sapiens
aacttggcatttctatacttt

SEQ ID NO: 3196801 - DNA, 23 bp, Homo sapiens
aacttggctcgaatctctgtgcc

SEQ ID NO: 3196802 - DNA, 15 bp, Homo sapiens
aacttggggaggcaa

SEQ ID NO: 3196803 - DNA, 17 bp, Homo sapiens
aacttggtcagagccac

SEQ ID NO: 3196804 - DNA, 18 bp, Homo sapiens
aacttgtaaatgctgtca

SEQ ID NO: 3196805 - DNA, 13 bp, Homo sapiens
aacttgtagctgt

SEQ ID NO: 3196806 - DNA, 17 bp, Homo sapiens
aacttgtagctgtaaaa

SEQ ID NO: 3196807 - DNA, 19 bp, Homo sapiens
aacttgtgtccctaatgtg

SEQ ID NO: 3196808 - DNA, 15 bp, Homo sapiens
aacttgttattgtga

SEQ ID NO: 3196809 - DNA, 19 bp, Homo sapiens
aacttgttattgtgaatga

SEQ ID NO: 3196810 - DNA, 15 bp, Homo sapiens
aacttgtttacaaca

SEQ ID NO: 3196811 - DNA, 13 bp, Homo sapiens
aactttaaacctg

SEQ ID NO: 3196812 - DNA, 21 bp, Homo sapiens
aactttaaacctgtagaatca

SEQ ID NO: 3196813 - DNA, 22 bp, Homo sapiens
aactttaaccacagtgaaagtt

SEQ ID NO: 3196814 - DNA, 18 bp, Homo sapiens
aactttaagcagctcttg

SEQ ID NO: 3196815 - DNA, 21 bp, Homo sapiens
aactttaattctctttcaaag

SEQ ID NO: 3196816 - DNA, 11 bp, Homo sapiens
aactttactgt

SEQ ID NO: 3196817 - DNA, 12 bp, Homo sapiens
aactttactgta

SEQ ID NO: 3196818 - DNA, 22 bp, Homo sapiens
aactttagagtagcatgagaga

SEQ ID NO: 3196819 - DNA, 22 bp, Homo sapiens
aactttatcagggaaactaaga

SEQ ID NO: 3196820 - DNA, 17 bp, Homo sapiens
aactttatgtactgctg

SEQ ID NO: 3196821 - DNA, 14 bp, Homo sapiens
aactttatgtgtaa

SEQ ID NO: 3196822 - DNA, 21 bp, Homo sapiens
aactttattaaatacaaaact

SEQ ID NO: 3196823 - DNA, 20 bp, Homo sapiens
aactttattacaatttgtat

SEQ ID NO: 3196824 - DNA, 20 bp, Homo sapiens
aactttattctttgttcttt

SEQ ID NO: 3196825 - DNA, 16 bp, Homo sapiens
aactttatttgtaaac

SEQ ID NO: 3196826 - DNA, 23 bp, Homo sapiens
aactttcaaaagggaagagtttt

SEQ ID NO: 3196827 - DNA, 12 bp, Homo sapiens
aactttcacttt

SEQ ID NO: 3196828 - DNA, 12 bp, Homo sapiens
aactttctccct

SEQ ID NO: 3196829 - DNA, 13 bp, Homo sapiens
aactttctccctc

SEQ ID NO: 3196830 - DNA, 14 bp, Homo sapiens
aactttctgctttg

SEQ ID NO: 3196831 - DNA, 15 bp, Homo sapiens
aactttgccaaaaaa

SEQ ID NO: 3196832 - DNA, 21 bp, Homo sapiens
aactttgccaaaaaaaaaaga

SEQ ID NO: 3196833 - DNA, 14 bp, Homo sapiens
aacttttaaagaaa

SEQ ID NO: 3196834 - DNA, 15 bp, Homo sapiens
aacttttcccctgtc

SEQ ID NO: 3196835 - DNA, 19 bp, Homo sapiens
aacttttgtgaattaggct

SEQ ID NO: 3196836 - DNA, 23 bp, Homo sapiens
aacttttgtggactgagcggccg

SEQ ID NO: 3196837 - DNA, 23 bp, Homo sapiens
aactttttatttctaaatgagac

SEQ ID NO: 3196838 - DNA, 15 bp, Homo sapiens
aactttttgttctgg

SEQ ID NO: 3196839 - DNA, 14 bp, Homo sapiens
aagagggcccagcc

SEQ ID NO: 3196840 - DNA, 16 bp, Homo sapiens
aagagggcccagccca

SEQ ID NO: 3196841 - DNA, 19 bp, Homo sapiens
aagagggcctgtgggagcc

SEQ ID NO: 3196842 - DNA, 14 bp, Homo sapiens
aagaggggaaaaca

SEQ ID NO: 3196843 - DNA, 19 bp, Homo sapiens
aagaggggaccagaagcca

SEQ ID NO: 3196844 - DNA, 13 bp, Homo sapiens
aagaggggcagcc

SEQ ID NO: 3196845 - DNA, 15 bp, Homo sapiens
aagaggggcagccct

SEQ ID NO: 3196846 - DNA, 16 bp, Homo sapiens
aagaggggcagccctt

SEQ ID NO: 3196847 - DNA, 14 bp, Homo sapiens
aagaggggtggaga

SEQ ID NO: 3196848 - DNA, 15 bp, Homo sapiens
aagaggggtggagac

SEQ ID NO: 3196849 - DNA, 22 bp, Homo sapiens
aagagggtctgaggaatccaga

SEQ ID NO: 3196850 - DNA, 22 bp, Homo sapiens
aagagggttttaggtagaaaaa

SEQ ID NO: 3196851 - DNA, 23 bp, Homo sapiens
aagagggttttaggtagaaaaac

SEQ ID NO: 3196852 - DNA, 17 bp, Homo sapiens
aagaggtctccccatcc

SEQ ID NO: 3196853 - DNA, 18 bp, Homo sapiens
aagaggtctccccatccc

SEQ ID NO: 3196854 - DNA, 13 bp, Homo sapiens
aagagtaacttta

SEQ ID NO: 3196855 - DNA, 23 bp, Homo sapiens
aagagtaactttactctgtgttt

SEQ ID NO: 3196856 - DNA, 19 bp, Homo sapiens
aagagtagaaagcttgaaa

SEQ ID NO: 3196857 - DNA, 18 bp, Homo sapiens
aagagtagcatttcattc

SEQ ID NO: 3196858 - DNA, 15 bp, Homo sapiens
aagagtatccttcct

SEQ ID NO: 3196859 - DNA, 17 bp, Homo sapiens
aagagtatccttccttc

SEQ ID NO: 3196860 - DNA, 13 bp, Homo sapiens
aagagtctaaaga

SEQ ID NO: 3196861 - DNA, 22 bp, Homo sapiens
aagagtgacttattttgtctta

SEQ ID NO: 3196862 - DNA, 23 bp, Homo sapiens
aagagtgatagtcttttgctttt

SEQ ID NO: 3196863 - DNA, 12 bp, Homo sapiens
aagagtgtgtgt

SEQ ID NO: 3196864 - DNA, 16 bp, Homo sapiens
aagagttcccttgaaa

SEQ ID NO: 3196865 - DNA, 23 bp, Homo sapiens
aagagttcttaaggattgtgata

SEQ ID NO: 3196866 - DNA, 21 bp, Homo sapiens
aagagtttcagtttgttggaa

SEQ ID NO: 3196867 - DNA, 18 bp, Homo sapiens
aagagtttgttctgttct

SEQ ID NO: 3196868 - DNA, 12 bp, Homo sapiens
aagataaatgtg

SEQ ID NO: 3196869 - DNA, 13 bp, Homo sapiens
aagataaatgtgc

SEQ ID NO: 3196870 - DNA, 17 bp, Homo sapiens
aagataacattttcaat

SEQ ID NO: 3196871 - DNA, 18 bp, Homo sapiens
aagataacccttattcca

SEQ ID NO: 3196872 - DNA, 16 bp, Homo sapiens
aagataacttactgta

SEQ ID NO: 3196873 - DNA, 23 bp, Homo sapiens
aagataatctcagtgctttcctc

SEQ ID NO: 3196874 - DNA, 20 bp, Homo sapiens
aagataatgttctttaatgt

SEQ ID NO: 3196875 - DNA, 21 bp, Homo sapiens
aagataattgctatttatttt

SEQ ID NO: 3196876 - DNA, 14 bp, Homo sapiens
aagataatttgcat

SEQ ID NO: 3196877 - DNA, 23 bp, Homo sapiens
aagatagatttggaataggaata

SEQ ID NO: 3196878 - DNA, 22 bp, Homo sapiens
aagatatatttcacttttgttc

SEQ ID NO: 3196879 - DNA, 20 bp, Homo sapiens
aagatatcagagctcttaat

SEQ ID NO: 3196880 - DNA, 20 bp, Homo sapiens
aagatatccatctttttctt

SEQ ID NO: 3196881 - DNA, 15 bp, Homo sapiens
aagatattgatcaaa

SEQ ID NO: 3196882 - DNA, 19 bp, Homo sapiens
aagatattgatcaaatata

SEQ ID NO: 3196883 - DNA, 22 bp, Homo sapiens
aagatattgatcaaatatagaa

SEQ ID NO: 3196884 - DNA, 13 bp, Homo sapiens
aagatatttatat

SEQ ID NO: 3196885 - DNA, 15 bp, Homo sapiens
aagatatttatatat

SEQ ID NO: 3196886 - DNA, 18 bp, Homo sapiens
aagatatttatatatatt

SEQ ID NO: 3196887 - DNA, 19 bp, Homo sapiens
aagatatttttatctttat

SEQ ID NO: 3196888 - DNA, 21 bp, Homo sapiens
aagatcaaaataaaaagtgac

SEQ ID NO: 3196889 - DNA, 22 bp, Homo sapiens
aagatcaaaataaaaagtgaca

SEQ ID NO: 3196890 - DNA, 19 bp, Homo sapiens
aagatcacgctccccgcct

SEQ ID NO: 3196891 - DNA, 23 bp, Homo sapiens
aagatcactttctcagttttcat

SEQ ID NO: 3196892 - DNA, 22 bp, Homo sapiens
aagatcagaacattcagctctg

SEQ ID NO: 3196893 - DNA, 17 bp, Homo sapiens
aagatccatttgccttt

SEQ ID NO: 3196894 - DNA, 23 bp, Homo sapiens
aagatccatttgcctttctggga

SEQ ID NO: 3196895 - DNA, 18 bp, Homo sapiens
aagatcccctctcctgcc

SEQ ID NO: 3196896 - DNA, 20 bp, Homo sapiens
aagatcctagtgaccaaatt

SEQ ID NO: 3196897 - DNA, 21 bp, Homo sapiens
aagatctgttttgaaggcaaa

SEQ ID NO: 3196898 - DNA, 13 bp, Homo sapiens
aagatctttcagg

SEQ ID NO: 3196899 - DNA, 18 bp, Homo sapiens
aagatgagatttgccagc

SEQ ID NO: 3196900 - DNA, 15 bp, Homo sapiens
aagatgatcagacct

SEQ ID NO: 3196901 - DNA, 14 bp, Homo sapiens
aagatgatcatttg

SEQ ID NO: 3196902 - DNA, 18 bp, Homo sapiens
aagatgatctactcagaa

SEQ ID NO: 3196903 - DNA, 18 bp, Homo sapiens
aagatgccaattattgtt

SEQ ID NO: 3196904 - DNA, 11 bp, Homo sapiens
aagatgctggg

SEQ ID NO: 3196905 - DNA, 12 bp, Homo sapiens
aagatgcttggt

SEQ ID NO: 3196906 - DNA, 20 bp, Homo sapiens
aagatggaatttatcaaacc

SEQ ID NO: 3196907 - DNA, 17 bp, Homo sapiens
aagatggagtttctaag

SEQ ID NO: 3196908 - DNA, 18 bp, Homo sapiens
aagatggagtttctaagg

SEQ ID NO: 3196909 - DNA, 20 bp, Homo sapiens
aagatggatgtaaagtgtgg

SEQ ID NO: 3196910 - DNA, 14 bp, Homo sapiens
aagatggattctca

SEQ ID NO: 3196911 - DNA, 16 bp, Homo sapiens
aagatggattctcaga

SEQ ID NO: 3196912 - DNA, 21 bp, Homo sapiens
aagatggattctcagatattt

SEQ ID NO: 3196913 - DNA, 21 bp, Homo sapiens
aagatgggaacgcagatgatc

SEQ ID NO: 3196914 - DNA, 17 bp, Homo sapiens
aagatgggggcaagaag

SEQ ID NO: 3196915 - DNA, 16 bp, Homo sapiens
aagatggtatatttgg

SEQ ID NO: 3196916 - DNA, 17 bp, Homo sapiens
aagatggttaaacattt

SEQ ID NO: 3196917 - DNA, 14 bp, Homo sapiens
aagatggtttcaat

SEQ ID NO: 3196918 - DNA, 17 bp, Homo sapiens
aagatggtttcaattca

SEQ ID NO: 3196919 - DNA, 20 bp, Homo sapiens
aagatgtcaaataaagcaaa

SEQ ID NO: 3196920 - DNA, 20 bp, Homo sapiens
aagatgtgatattctaagac

SEQ ID NO: 3196921 - DNA, 21 bp, Homo sapiens
aagatgtgatattctaagact

SEQ ID NO: 3196922 - DNA, 15 bp, Homo sapiens
aagatgtgttcttat

SEQ ID NO: 3196923 - DNA, 11 bp, Homo sapiens
aagatgttaag

SEQ ID NO: 3196924 - DNA, 15 bp, Homo sapiens
aagatgttgttttag

SEQ ID NO: 3196925 - DNA, 20 bp, Homo sapiens
aagattacaaatcagaagtc

SEQ ID NO: 3196926 - DNA, 19 bp, Homo sapiens
aagattaggagaaacacat

SEQ ID NO: 3196927 - DNA, 13 bp, Homo sapiens
aagattagtttca

SEQ ID NO: 3196928 - DNA, 20 bp, Homo sapiens
aagattatagattctaaaga

SEQ ID NO: 3196929 - DNA, 23 bp, Homo sapiens
aagattcacacctgactctgaaa

SEQ ID NO: 3196930 - DNA, 21 bp, Homo sapiens
aagattccggatcctaagcat

SEQ ID NO: 3196931 - DNA, 14 bp, Homo sapiens
aagattctaatgat

SEQ ID NO: 3196932 - DNA, 13 bp, Homo sapiens
aagattctagatc

SEQ ID NO: 3196933 - DNA, 17 bp, Homo sapiens
aagattctcctgtgcta

SEQ ID NO: 3196934 - DNA, 15 bp, Homo sapiens
aagattctctttaaa

SEQ ID NO: 3196935 - DNA, 15 bp, Homo sapiens
aagattctgaaacca

SEQ ID NO: 3196936 - DNA, 20 bp, Homo sapiens
aagattcttttaaattagaa

SEQ ID NO: 3196937 - DNA, 14 bp, Homo sapiens
aagattgagaagcc

SEQ ID NO: 3196938 - DNA, 15 bp, Homo sapiens
aagattgagaagcca

SEQ ID NO: 3196939 - DNA, 19 bp, Homo sapiens
aagattgtacttagccagt

SEQ ID NO: 3196940 - DNA, 14 bp, Homo sapiens
aagatttaacacta

SEQ ID NO: 3196941 - DNA, 12 bp, Homo sapiens
aagatttaagca

SEQ ID NO: 3196942 - DNA, 21 bp, Homo sapiens
aagatttagaaaaaagtttac

SEQ ID NO: 3196943 - DNA, 17 bp, Homo sapiens
aagatttccttgtgcaa

SEQ ID NO: 3196944 - DNA, 23 bp, Homo sapiens
aagatttgatgctggagaggtta

SEQ ID NO: 3196945 - DNA, 22 bp, Homo sapiens
aagatttgtgaactggaagaaa

SEQ ID NO: 3196946 - DNA, 22 bp, Homo sapiens
aagatttgtgtttttctttttc

SEQ ID NO: 3196947 - DNA, 21 bp, Homo sapiens
aagatttgttgacagcaaaat

SEQ ID NO: 3196948 - DNA, 23 bp, Homo sapiens
aagattttaaaagttttgttctt

SEQ ID NO: 3196949 - DNA, 22 bp, Homo sapiens
aagattttagggcttttatttt

SEQ ID NO: 3196950 - DNA, 13 bp, Homo sapiens
aagattttcagaa

SEQ ID NO: 3196951 - DNA, 15 bp, Homo sapiens
aagattttgaatgct

SEQ ID NO: 3196952 - DNA, 20 bp, Homo sapiens
aagattttgttttgttggac

SEQ ID NO: 3196953 - DNA, 14 bp, Homo sapiens
aagatttttctcaa

SEQ ID NO: 3196954 - DNA, 13 bp, Homo sapiens
aagcaaaaaatga

SEQ ID NO: 3196955 - DNA, 20 bp, Homo sapiens
aagcaaaaaatgaatgtcta

SEQ ID NO: 3196956 - DNA, 11 bp, Homo sapiens
aagcaaaagaa

SEQ ID NO: 3196957 - DNA, 14 bp, Homo sapiens
aagcaaaatattat

SEQ ID NO: 3196958 - DNA, 15 bp, Homo sapiens
aagcaaaatgtctct

SEQ ID NO: 3196959 - DNA, 11 bp, Homo sapiens
aagcaaaggtg

SEQ ID NO: 3196960 - DNA, 23 bp, Homo sapiens
aagcaaagtgctggattgtcctt

SEQ ID NO: 3196961 - DNA, 19 bp, Homo sapiens
aagcaaagtgctttgactt

SEQ ID NO: 3196962 - DNA, 15 bp, Homo sapiens
aagcaaatctacaga

SEQ ID NO: 3196963 - DNA, 19 bp, Homo sapiens
aagcaaatgttaaaagttt

SEQ ID NO: 3196964 - DNA, 23 bp, Homo sapiens
aactttttgttctggtccttttt

SEQ ID NO: 3196965 - DNA, 15 bp, Homo sapiens
aacttttttaaataa

SEQ ID NO: 3196966 - DNA, 18 bp, Homo sapiens
aacttttttaaataaact

SEQ ID NO: 3196967 - DNA, 22 bp, Homo sapiens
aacttttttaaataaacttttt

SEQ ID NO: 3196968 - DNA, 20 bp, Homo sapiens
aacttttttgagtcattgac

SEQ ID NO: 3196969 - DNA, 15 bp, Homo sapiens
aacttttttgtgtat

SEQ ID NO: 3196970 - DNA, 13 bp, Homo sapiens
aactttttttcaa

SEQ ID NO: 3196971 - DNA, 15 bp, Homo sapiens
aactttttttcaatg

SEQ ID NO: 3196972 - DNA, 16 bp, Homo sapiens
aactttttttcaatgt

SEQ ID NO: 3196973 - DNA, 18 bp, Homo sapiens
aagaaaaaaaaaaaagcc

SEQ ID NO: 3196974 - DNA, 15 bp, Homo sapiens
aagaaaaaaaaaaga

SEQ ID NO: 3196975 - DNA, 20 bp, Homo sapiens
aagaaaaaaaataacacaga

SEQ ID NO: 3196976 - DNA, 15 bp, Homo sapiens
aagaaaaaaatcttc

SEQ ID NO: 3196977 - DNA, 10 bp, Homo sapiens
aagaaaaaag

SEQ ID NO: 3196978 - DNA, 13 bp, Homo sapiens
aagaaaaagtaca

SEQ ID NO: 3196979 - DNA, 15 bp, Homo sapiens
aagaaaaagtacaat

SEQ ID NO: 3196980 - DNA, 12 bp, Homo sapiens
aagaaaaatcaa

SEQ ID NO: 3196981 - DNA, 12 bp, Homo sapiens
aagaaaacaaaa

SEQ ID NO: 3196982 - DNA, 14 bp, Homo sapiens
aagaaaacaacttc

SEQ ID NO: 3196983 - DNA, 11 bp, Homo sapiens
aagaaaagata

SEQ ID NO: 3196984 - DNA, 15 bp, Homo sapiens
aagaaaagataaaga

SEQ ID NO: 3196985 - DNA, 22 bp, Homo sapiens
aagaaaagattttaatcaagtt

SEQ ID NO: 3196986 - DNA, 24 bp, Homo sapiens
aagaaaagcattttcagtcttgta

SEQ ID NO: 3196987 - DNA, 20 bp, Homo sapiens
aagaaaagccgaaagggtta

SEQ ID NO: 3196988 - DNA, 20 bp, Homo sapiens
aagaaaagtgcatatttatc

SEQ ID NO: 3196989 - DNA, 16 bp, Homo sapiens
aagaaaatacaataaa

SEQ ID NO: 3196990 - DNA, 23 bp, Homo sapiens
aagaaaatcagatggagcatgaa

SEQ ID NO: 3196991 - DNA, 15 bp, Homo sapiens
aagaaaatctttata

SEQ ID NO: 3196992 - DNA, 12 bp, Homo sapiens
aagaaaatggtt

SEQ ID NO: 3196993 - DNA, 18 bp, Homo sapiens
aagaaacccttgctgctt

SEQ ID NO: 3196994 - DNA, 15 bp, Homo sapiens
aagaaactatttttg

SEQ ID NO: 3196995 - DNA, 16 bp, Homo sapiens
aagaaactgaggaatt

SEQ ID NO: 3196996 - DNA, 19 bp, Homo sapiens
aagaaactgaggaattttc

SEQ ID NO: 3196997 - DNA, 20 bp, Homo sapiens
aagaaactgaggaattttct

SEQ ID NO: 3196998 - DNA, 13 bp, Homo sapiens
aagaaacttgaag

SEQ ID NO: 3196999 - DNA, 16 bp, Homo sapiens
aagaaacttttgtaaa

SEQ ID NO: 3197000 - DNA, 14 bp, Homo sapiens
aagaaagatgtttg

SEQ ID NO: 3197001 - DNA, 17 bp, Homo sapiens
aagaaagctggtaaact

SEQ ID NO: 3197002 - DNA, 19 bp, Homo sapiens
aagaaagggaaaagggaga

SEQ ID NO: 3197003 - DNA, 23 bp, Homo sapiens
aagaaatccctgtttaatattta

SEQ ID NO: 3197004 - DNA, 16 bp, Homo sapiens
aagaaatcttgtctta

SEQ ID NO: 3197005 - DNA, 19 bp, Homo sapiens
aagaaatcttgtcttacca

SEQ ID NO: 3197006 - DNA, 15 bp, Homo sapiens
aagaaatctttccag

SEQ ID NO: 3197007 - DNA, 16 bp, Homo sapiens
aagaaattgcaataac

SEQ ID NO: 3197008 - DNA, 16 bp, Homo sapiens
aagaaattgtttcttt

SEQ ID NO: 3197009 - DNA, 21 bp, Homo sapiens
aagaacaaagagaaaaaatac

SEQ ID NO: 3197010 - DNA, 14 bp, Homo sapiens
aagaacaacggcaa

SEQ ID NO: 3197011 - DNA, 14 bp, Homo sapiens
aagaacaagtttag

SEQ ID NO: 3197012 - DNA, 19 bp, Homo sapiens
aagaacacagcatgtgcca

SEQ ID NO: 3197013 - DNA, 19 bp, Homo sapiens
aagaacaccctatattttg

SEQ ID NO: 3197014 - DNA, 16 bp, Homo sapiens
aagaacatagaactct

SEQ ID NO: 3197015 - DNA, 11 bp, Homo sapiens
aagaacatgtg

SEQ ID NO: 3197016 - DNA, 22 bp, Homo sapiens
aagaaccaaaagttttcctgag

SEQ ID NO: 3197017 - DNA, 15 bp, Homo sapiens
aagaaccatttgcaa

SEQ ID NO: 3197018 - DNA, 18 bp, Homo sapiens
aagaacgaacacaagaaa

SEQ ID NO: 3197019 - DNA, 23 bp, Homo sapiens
aagaacgaacacaagaaaaagat

SEQ ID NO: 3197020 - DNA, 23 bp, Homo sapiens
aagaacgcggtgtgtaacactgt

SEQ ID NO: 3197021 - DNA, 15 bp, Homo sapiens
aagaactccagagtc

SEQ ID NO: 3197022 - DNA, 13 bp, Homo sapiens
aagaactctctgg

SEQ ID NO: 3197023 - DNA, 22 bp, Homo sapiens
aagaactgcaggccctggcctc

SEQ ID NO: 3197024 - DNA, 23 bp, Homo sapiens
aagaactgcatggacctaacatt

SEQ ID NO: 3197025 - DNA, 18 bp, Homo sapiens
aagaactgttgcctaatt

SEQ ID NO: 3197026 - DNA, 23 bp, Homo sapiens
aagaactgttgcctaattggaaa

SEQ ID NO: 3197027 - DNA, 20 bp, Homo sapiens
aagaacttactgattatttt

SEQ ID NO: 3197028 - DNA, 17 bp, Homo sapiens
aagaacttgatttgcat

SEQ ID NO: 3197029 - DNA, 19 bp, Homo sapiens
aagaacttgtttacaacat

SEQ ID NO: 3197030 - DNA, 12 bp, Homo sapiens
aagaagaaaaag

SEQ ID NO: 3197031 - DNA, 15 bp, Homo sapiens
aagaagaacttgcat

SEQ ID NO: 3197032 - DNA, 13 bp, Homo sapiens
aagaagaagaagg

SEQ ID NO: 3197033 - DNA, 12 bp, Homo sapiens
aagaagaagaat

SEQ ID NO: 3197034 - DNA, 15 bp, Homo sapiens
aagaagaaggagagc

SEQ ID NO: 3197035 - DNA, 17 bp, Homo sapiens
aagaagacatggagact

SEQ ID NO: 3197036 - DNA, 12 bp, Homo sapiens
aagaagagatgc

SEQ ID NO: 3197037 - DNA, 22 bp, Homo sapiens
aagaagagcgagagatcaaaga

SEQ ID NO: 3197038 - DNA, 23 bp, Homo sapiens
aagaagagcgagagatcaaagat

SEQ ID NO: 3197039 - DNA, 17 bp, Homo sapiens
aagaagattcccacccc

SEQ ID NO: 3197040 - DNA, 16 bp, Homo sapiens
aagaagcaatctcctt

SEQ ID NO: 3197041 - DNA, 22 bp, Homo sapiens
aagaagccccttatttttagcc

SEQ ID NO: 3197042 - DNA, 18 bp, Homo sapiens
aagaagccctgcagagca

SEQ ID NO: 3197043 - DNA, 21 bp, Homo sapiens
aagaagctcgccccacctcca

SEQ ID NO: 3197044 - DNA, 19 bp, Homo sapiens
aagaagctgcttctgccca

SEQ ID NO: 3197045 - DNA, 20 bp, Homo sapiens
aagaagctgcttctgcccac

SEQ ID NO: 3197046 - DNA, 16 bp, Homo sapiens
aagaagctgttgtaca

SEQ ID NO: 3197047 - DNA, 17 bp, Homo sapiens
aagaagctgttgtacat

SEQ ID NO: 3197048 - DNA, 21 bp, Homo sapiens
aagaagcttctaataaattat

SEQ ID NO: 3197049 - DNA, 14 bp, Homo sapiens
aagaaggaaaaatt

SEQ ID NO: 3197050 - DNA, 13 bp, Homo sapiens
aagaaggaaagaa

SEQ ID NO: 3197051 - DNA, 17 bp, Homo sapiens
aagaaggaagctgtgtt

SEQ ID NO: 3197052 - DNA, 16 bp, Homo sapiens
aagaaggcaaaaatgt

SEQ ID NO: 3197053 - DNA, 18 bp, Homo sapiens
aagaagggggccctgcta

SEQ ID NO: 3197054 - DNA, 15 bp, Homo sapiens
aagaagtaggcatga

SEQ ID NO: 3197055 - DNA, 16 bp, Homo sapiens
aagaagtggtactagt

SEQ ID NO: 3197056 - DNA, 16 bp, Homo sapiens
aagaagtgtccgagaa

SEQ ID NO: 3197057 - DNA, 18 bp, Homo sapiens
aagaagtgtccgagaact

SEQ ID NO: 3197058 - DNA, 13 bp, Homo sapiens
aagaagttttaaa

SEQ ID NO: 3197059 - DNA, 12 bp, Homo sapiens
aagaataataaa

SEQ ID NO: 3197060 - DNA, 16 bp, Homo sapiens
aagaataatcacgctt

SEQ ID NO: 3197061 - DNA, 22 bp, Homo sapiens
aagaataatcacgctttcctga

SEQ ID NO: 3197062 - DNA, 23 bp, Homo sapiens
aagaataatcacgctttcctgaa

SEQ ID NO: 3197063 - DNA, 13 bp, Homo sapiens
aagaatacagtta

SEQ ID NO: 3197064 - DNA, 11 bp, Homo sapiens
aagaatagaac

SEQ ID NO: 3197065 - DNA, 17 bp, Homo sapiens
aagaatatctgtaatgg

SEQ ID NO: 3197066 - DNA, 17 bp, Homo sapiens
aagaatattcagagaat

SEQ ID NO: 3197067 - DNA, 13 bp, Homo sapiens
aagaatattgtat

SEQ ID NO: 3197068 - DNA, 16 bp, Homo sapiens
aagaatatttaagaaa

SEQ ID NO: 3197069 - DNA, 20 bp, Homo sapiens
aagaatatttaagaaaagca

SEQ ID NO: 3197070 - DNA, 21 bp, Homo sapiens
aagaatatttaagaaaagcac

SEQ ID NO: 3197071 - DNA, 23 bp, Homo sapiens
aagaatatttaagaaaagcactt

SEQ ID NO: 3197072 - DNA, 16 bp, Homo sapiens
aagaatcagagtagaa

SEQ ID NO: 3197073 - DNA, 18 bp, Homo sapiens
aagaatccacatttctaa

SEQ ID NO: 3197074 - DNA, 23 bp, Homo sapiens
aagaatctaaaccttacatgtgt

SEQ ID NO: 3197075 - DNA, 16 bp, Homo sapiens
aagaatgcaagagtgg

SEQ ID NO: 3197076 - DNA, 18 bp, Homo sapiens
aagaatgcacaagaatgg

SEQ ID NO: 3197077 - DNA, 19 bp, Homo sapiens
aagaatgcacaagaatgga

SEQ ID NO: 3197078 - DNA, 22 bp, Homo sapiens
aagaatgcacaagaatggatca

SEQ ID NO: 3197079 - DNA, 23 bp, Homo sapiens
aagaatgcagattcctgggcctg

SEQ ID NO: 3197080 - DNA, 15 bp, Homo sapiens
aagaatgcattcaaa

SEQ ID NO: 3197081 - DNA, 15 bp, Homo sapiens
aagaatgctggtttt

SEQ ID NO: 3197082 - DNA, 18 bp, Homo sapiens
aagaatgtcgattaaaat

SEQ ID NO: 3197083 - DNA, 17 bp, Homo sapiens
aagaatgttggtttact

SEQ ID NO: 3197084 - DNA, 19 bp, Homo sapiens
aagaattaagatacaaatt

SEQ ID NO: 3197085 - DNA, 11 bp, Homo sapiens
aagaattacag

SEQ ID NO: 3197086 - DNA, 19 bp, Homo sapiens
aagaattcaaactggggcc

SEQ ID NO: 3197087 - DNA, 19 bp, Homo sapiens
aagaattctgattgatttg

SEQ ID NO: 3197088 - DNA, 12 bp, Homo sapiens
aagaattcttat

SEQ ID NO: 3197089 - DNA, 18 bp, Homo sapiens
aagaattgaaaagttttt

SEQ ID NO: 3197090 - DNA, 19 bp, Homo sapiens
aagaattgaaaagtttttg

SEQ ID NO: 3197091 - DNA, 22 bp, Homo sapiens
aagaattgaccatctgctttta

SEQ ID NO: 3197092 - DNA, 16 bp, Homo sapiens
aagaattgagtaatgg

SEQ ID NO: 3197093 - DNA, 22 bp, Homo sapiens
aagaattgctaaatataaaaac

SEQ ID NO: 3197094 - DNA, 17 bp, Homo sapiens
aagcaaattgctttttt

SEQ ID NO: 3197095 - DNA, 19 bp, Homo sapiens
aagcaaatttgtggttgta

SEQ ID NO: 3197096 - DNA, 22 bp, Homo sapiens
aagcaacctgggtccaaataaa

SEQ ID NO: 3197097 - DNA, 15 bp, Homo sapiens
aagcaagagagatgt

SEQ ID NO: 3197098 - DNA, 22 bp, Homo sapiens
aagcaagaggcaagctgaaatt

SEQ ID NO: 3197099 - DNA, 12 bp, Homo sapiens
aagcaagctctc

SEQ ID NO: 3197100 - DNA, 17 bp, Homo sapiens
aagcaagggagaaaaga

SEQ ID NO: 3197101 - DNA, 17 bp, Homo sapiens
aagcaagggctccagca

SEQ ID NO: 3197102 - DNA, 15 bp, Homo sapiens
aagcaagggggtgat

SEQ ID NO: 3197103 - DNA, 13 bp, Homo sapiens
aagcaagtagctt

SEQ ID NO: 3197104 - DNA, 20 bp, Homo sapiens
aagcaataatggtcccatcc

SEQ ID NO: 3197105 - DNA, 13 bp, Homo sapiens
aagcaataattgt

SEQ ID NO: 3197106 - DNA, 23 bp, Homo sapiens
aagcaatgtgagtcccagagccc

SEQ ID NO: 3197107 - DNA, 17 bp, Homo sapiens
aagcaatgtgttttttc

SEQ ID NO: 3197108 - DNA, 16 bp, Homo sapiens
aagcaattgccctgta

SEQ ID NO: 3197109 - DNA, 17 bp, Homo sapiens
aagcaattgccctgtaa

SEQ ID NO: 3197110 - DNA, 17 bp, Homo sapiens
aagcacaagtacttttg

SEQ ID NO: 3197111 - DNA, 11 bp, Homo sapiens
aagcacagctg

SEQ ID NO: 3197112 - DNA, 13 bp, Homo sapiens
aagcacagtgtta

SEQ ID NO: 3197113 - DNA, 20 bp, Homo sapiens
aagcacagtgttaaatgaaa

SEQ ID NO: 3197114 - DNA, 14 bp, Homo sapiens
aagcacagtttgaa

SEQ ID NO: 3197115 - DNA, 18 bp, Homo sapiens
aagcacagtttgaacaaa

SEQ ID NO: 3197116 - DNA, 11 bp, Homo sapiens
aagcacataca

SEQ ID NO: 3197117 - DNA, 18 bp, Homo sapiens
aagcacatacattaaaac

SEQ ID NO: 3197118 - DNA, 16 bp, Homo sapiens
aagcacatctgcattt

SEQ ID NO: 3197119 - DNA, 17 bp, Homo sapiens
aagcacatgcttagctt

SEQ ID NO: 3197120 - DNA, 22 bp, Homo sapiens
aagcacatgcttagcttatctt

SEQ ID NO: 3197121 - DNA, 18 bp, Homo sapiens
aagcaccccagtcactag

SEQ ID NO: 3197122 - DNA, 12 bp, Homo sapiens
aagcacccttga

SEQ ID NO: 3197123 - DNA, 17 bp, Homo sapiens
aagcactacataaactg

SEQ ID NO: 3197124 - DNA, 13 bp, Homo sapiens
aagcactgaaaaa

SEQ ID NO: 3197125 - DNA, 16 bp, Homo sapiens
aagcactgacctgtca

SEQ ID NO: 3197126 - DNA, 21 bp, Homo sapiens
aagcactgacctgtcatgccc

SEQ ID NO: 3197127 - DNA, 19 bp, Homo sapiens
aagcacttggactcttgct

SEQ ID NO: 3197128 - DNA, 13 bp, Homo sapiens
aagcactttgatt

SEQ ID NO: 3197129 - DNA, 16 bp, Homo sapiens
aagcactttgcactta

SEQ ID NO: 3197130 - DNA, 14 bp, Homo sapiens
aagcacttttgtta

SEQ ID NO: 3197131 - DNA, 15 bp, Homo sapiens
aagcacttttgttat

SEQ ID NO: 3197132 - DNA, 21 bp, Homo sapiens
aagcacttttgttattccatc

SEQ ID NO: 3197133 - DNA, 11 bp, Homo sapiens
aagcacttttt

SEQ ID NO: 3197134 - DNA, 20 bp, Homo sapiens
aagcagaattttaatgtgaa

SEQ ID NO: 3197135 - DNA, 18 bp, Homo sapiens
aagcagagtgcacagctg

SEQ ID NO: 3197136 - DNA, 20 bp, Homo sapiens
aagcagatggaatgctgtgt

SEQ ID NO: 3197137 - DNA, 19 bp, Homo sapiens
aagcagatttctgcttcct

SEQ ID NO: 3197138 - DNA, 18 bp, Homo sapiens
aagcagcagctaggactg

SEQ ID NO: 3197139 - DNA, 16 bp, Homo sapiens
aagcagcatcttctgg

SEQ ID NO: 3197140 - DNA, 17 bp, Homo sapiens
aagcagcatggaaaaat

SEQ ID NO: 3197141 - DNA, 10 bp, Homo sapiens
aagcagccag

SEQ ID NO: 3197142 - DNA, 14 bp, Homo sapiens
aagcagcccttgct

SEQ ID NO: 3197143 - DNA, 22 bp, Homo sapiens
aagcagcccttgctttcggagc

SEQ ID NO: 3197144 - DNA, 18 bp, Homo sapiens
aagcagcctcattctgag

SEQ ID NO: 3197145 - DNA, 16 bp, Homo sapiens
aagcagcctctcccca

SEQ ID NO: 3197146 - DNA, 22 bp, Homo sapiens
aagcagcctctccccaggtcca

SEQ ID NO: 3197147 - DNA, 18 bp, Homo sapiens
aagcagcctgattgaaaa

SEQ ID NO: 3197148 - DNA, 16 bp, Homo sapiens
aagcaggacctggcat

SEQ ID NO: 3197149 - DNA, 23 bp, Homo sapiens
aagcaggactttgaggcaagtgt

SEQ ID NO: 3197150 - DNA, 16 bp, Homo sapiens
aagcaggcctttgcag

SEQ ID NO: 3197151 - DNA, 18 bp, Homo sapiens
aagcaggcgctgtgctat

SEQ ID NO: 3197152 - DNA, 20 bp, Homo sapiens
aagcaggggctacaagaggg

SEQ ID NO: 3197153 - DNA, 21 bp, Homo sapiens
aagcaggggctacaagaggga

SEQ ID NO: 3197154 - DNA, 20 bp, Homo sapiens
aagcaggtggatctatttca

SEQ ID NO: 3197155 - DNA, 22 bp, Homo sapiens
aagcaggtggatctatttcatg

SEQ ID NO: 3197156 - DNA, 18 bp, Homo sapiens
aagcaggtgtcctttccc

SEQ ID NO: 3197157 - DNA, 22 bp, Homo sapiens
aagcagtaaaaactgttctcta

SEQ ID NO: 3197158 - DNA, 13 bp, Homo sapiens
aagcagtattttg

SEQ ID NO: 3197159 - DNA, 17 bp, Homo sapiens
aagcagtcccattcata

SEQ ID NO: 3197160 - DNA, 17 bp, Homo sapiens
aagcagtcgtgcctgtg

SEQ ID NO: 3197161 - DNA, 19 bp, Homo sapiens
aagcagtcgtgcctgtgtc

SEQ ID NO: 3197162 - DNA, 14 bp, Homo sapiens
aagcagtgcctcga

SEQ ID NO: 3197163 - DNA, 20 bp, Homo sapiens
aagcagtgcctcgaggcacc

SEQ ID NO: 3197164 - DNA, 17 bp, Homo sapiens
aagcagtgccttccata

SEQ ID NO: 3197165 - DNA, 15 bp, Homo sapiens
aagcataaaaacatt

SEQ ID NO: 3197166 - DNA, 22 bp, Homo sapiens
aagcataaaaacattttaaaaa

SEQ ID NO: 3197167 - DNA, 22 bp, Homo sapiens
aagcataaatgcaaacacacaa

SEQ ID NO: 3197168 - DNA, 15 bp, Homo sapiens
aagcataatgaaaat

SEQ ID NO: 3197169 - DNA, 14 bp, Homo sapiens
aagcatactttgta

SEQ ID NO: 3197170 - DNA, 20 bp, Homo sapiens
aagcatagataatattgttt

SEQ ID NO: 3197171 - DNA, 17 bp, Homo sapiens
aagcatatgtgttactt

SEQ ID NO: 3197172 - DNA, 16 bp, Homo sapiens
aagcatattttgctgg

SEQ ID NO: 3197173 - DNA, 18 bp, Homo sapiens
aagcatcacctcaggcca

SEQ ID NO: 3197174 - DNA, 23 bp, Homo sapiens
aagcatcacctcaggccaggtgc

SEQ ID NO: 3197175 - DNA, 12 bp, Homo sapiens
aagcatccatgt

SEQ ID NO: 3197176 - DNA, 21 bp, Homo sapiens
aagcatccatgtgtggactca

SEQ ID NO: 3197177 - DNA, 14 bp, Homo sapiens
aagcatcctccaca

SEQ ID NO: 3197178 - DNA, 13 bp, Homo sapiens
aagcatctaagtt

SEQ ID NO: 3197179 - DNA, 13 bp, Homo sapiens
aagcatctggctc

SEQ ID NO: 3197180 - DNA, 13 bp, Homo sapiens
aagcatgaaaaag

SEQ ID NO: 3197181 - DNA, 17 bp, Homo sapiens
aagcatgatgggaaaat

SEQ ID NO: 3197182 - DNA, 18 bp, Homo sapiens
aagcatgatgggaaaata

SEQ ID NO: 3197183 - DNA, 21 bp, Homo sapiens
aagcatgatgggaaaatattt

SEQ ID NO: 3197184 - DNA, 17 bp, Homo sapiens
aagcatgctttgctgct

SEQ ID NO: 3197185 - DNA, 20 bp, Homo sapiens
aagcatgctttgctgctatg

SEQ ID NO: 3197186 - DNA, 19 bp, Homo sapiens
aagcatggacatttagaag

SEQ ID NO: 3197187 - DNA, 18 bp, Homo sapiens
aagcatgtgacacccaca

SEQ ID NO: 3197188 - DNA, 15 bp, Homo sapiens
aagcattaaaatgca

SEQ ID NO: 3197189 - DNA, 17 bp, Homo sapiens
aagcattcagagagcag

SEQ ID NO: 3197190 - DNA, 17 bp, Homo sapiens
aagcattccttctttga

SEQ ID NO: 3197191 - DNA, 18 bp, Homo sapiens
aagcattccttctttgat

SEQ ID NO: 3197192 - DNA, 18 bp, Homo sapiens
aagcattctccccagtgt

SEQ ID NO: 3197193 - DNA, 13 bp, Homo sapiens
aagcattgaaatt

SEQ ID NO: 3197194 - DNA, 22 bp, Homo sapiens
aagcattgggtgggtaaattca

SEQ ID NO: 3197195 - DNA, 21 bp, Homo sapiens
aagcattgtttgcttattgtt

SEQ ID NO: 3197196 - DNA, 16 bp, Homo sapiens
aagcatttactttgtg

SEQ ID NO: 3197197 - DNA, 15 bp, Homo sapiens
aagcatttatcattc

SEQ ID NO: 3197198 - DNA, 19 bp, Homo sapiens
aagcatttgatattatcta

SEQ ID NO: 3197199 - DNA, 21 bp, Homo sapiens
aagccaaaaaccttagctccc

SEQ ID NO: 3197200 - DNA, 16 bp, Homo sapiens
aagccaaactctgcca

SEQ ID NO: 3197201 - DNA, 13 bp, Homo sapiens
aagccaaagaaaa

SEQ ID NO: 3197202 - DNA, 15 bp, Homo sapiens
aagccaaagaaaaat

SEQ ID NO: 3197203 - DNA, 17 bp, Homo sapiens
aagccaaagaaacaagc

SEQ ID NO: 3197204 - DNA, 22 bp, Homo sapiens
aagccaaagaaacaagctgtgc

SEQ ID NO: 3197205 - DNA, 15 bp, Homo sapiens
aagccaaagaaatga

SEQ ID NO: 3197206 - DNA, 16 bp, Homo sapiens
aagccaaagacttagt

SEQ ID NO: 3197207 - DNA, 14 bp, Homo sapiens
aagccaaatgaaac

SEQ ID NO: 3197208 - DNA, 15 bp, Homo sapiens
aagccaaatgaaact

SEQ ID NO: 3197209 - DNA, 14 bp, Homo sapiens
aagccaaatttatc

SEQ ID NO: 3197210 - DNA, 16 bp, Homo sapiens
aagccaacaccctgtc

SEQ ID NO: 3197211 - DNA, 17 bp, Homo sapiens
aagccaacagtcaaaac

SEQ ID NO: 3197212 - DNA, 16 bp, Homo sapiens
aagccaacttgtaaat

SEQ ID NO: 3197213 - DNA, 15 bp, Homo sapiens
aatataacacatttt

SEQ ID NO: 3197214 - DNA, 12 bp, Homo sapiens
aatataacatgt

SEQ ID NO: 3197215 - DNA, 18 bp, Homo sapiens
aatataaggaaagcaata

SEQ ID NO: 3197216 - DNA, 21 bp, Homo sapiens
aatataaggaaagcaataaat

SEQ ID NO: 3197217 - DNA, 19 bp, Homo sapiens
aatataatggaagagaaat

SEQ ID NO: 3197218 - DNA, 13 bp, Homo sapiens
aatataattctgt

SEQ ID NO: 3197219 - DNA, 14 bp, Homo sapiens
aatatacaaaactt

SEQ ID NO: 3197220 - DNA, 19 bp, Homo sapiens
aatatacattcaaacttaa

SEQ ID NO: 3197221 - DNA, 19 bp, Homo sapiens
aatatactgattttgaaaa

SEQ ID NO: 3197222 - DNA, 19 bp, Homo sapiens
aatatagaaagttgatatt

SEQ ID NO: 3197223 - DNA, 15 bp, Homo sapiens
aatatagaagcattt

SEQ ID NO: 3197224 - DNA, 17 bp, Homo sapiens
aatatagattagaaaaa

SEQ ID NO: 3197225 - DNA, 18 bp, Homo sapiens
aatatagattagaaaaat

SEQ ID NO: 3197226 - DNA, 15 bp, Homo sapiens
aatatagcaaatgca

SEQ ID NO: 3197227 - DNA, 23 bp, Homo sapiens
aatatagcctgcctcagtggcag

SEQ ID NO: 3197228 - DNA, 12 bp, Homo sapiens
aatatataaaaa

SEQ ID NO: 3197229 - DNA, 16 bp, Homo sapiens
aatatataaaaatata

SEQ ID NO: 3197230 - DNA, 17 bp, Homo sapiens
aatatataaaaatatat

SEQ ID NO: 3197231 - DNA, 20 bp, Homo sapiens
aatatataaaaatatatata

SEQ ID NO: 3197232 - DNA, 15 bp, Homo sapiens
aatatataatatact

SEQ ID NO: 3197233 - DNA, 16 bp, Homo sapiens
aatatatataaagaat

SEQ ID NO: 3197234 - DNA, 22 bp, Homo sapiens
aatatatataaagaatatatat

SEQ ID NO: 3197235 - DNA, 13 bp, Homo sapiens
aatatatatacat

SEQ ID NO: 3197236 - DNA, 16 bp, Homo sapiens
aatatatatacatatg

SEQ ID NO: 3197237 - DNA, 14 bp, Homo sapiens
aatatatattttgt

SEQ ID NO: 3197238 - DNA, 12 bp, Homo sapiens
aatatatgtatt

SEQ ID NO: 3197239 - DNA, 18 bp, Homo sapiens
aatatatgtctgataatg

SEQ ID NO: 3197240 - DNA, 15 bp, Homo sapiens
aatatattaccagca

SEQ ID NO: 3197241 - DNA, 20 bp, Homo sapiens
aatatattaccagcaagaat

SEQ ID NO: 3197242 - DNA, 22 bp, Homo sapiens
aatatattaccagcaagaataa

SEQ ID NO: 3197243 - DNA, 18 bp, Homo sapiens
aatatattacttaactgt

SEQ ID NO: 3197244 - DNA, 16 bp, Homo sapiens
aatatattcaggagtt

SEQ ID NO: 3197245 - DNA, 13 bp, Homo sapiens
aatatattgttaa

SEQ ID NO: 3197246 - DNA, 13 bp, Homo sapiens
aatatatttaact

SEQ ID NO: 3197247 - DNA, 15 bp, Homo sapiens
aatatatttaagata

SEQ ID NO: 3197248 - DNA, 19 bp, Homo sapiens
aatatatttaagataatta

SEQ ID NO: 3197249 - DNA, 20 bp, Homo sapiens
aatatatttaagataattat

SEQ ID NO: 3197250 - DNA, 19 bp, Homo sapiens
aatatatttatttaaagca

SEQ ID NO: 3197251 - DNA, 14 bp, Homo sapiens
aatatatttgcaga

SEQ ID NO: 3197252 - DNA, 19 bp, Homo sapiens
aatatcagaatatgattca

SEQ ID NO: 3197253 - DNA, 13 bp, Homo sapiens
aatatcagacaag

SEQ ID NO: 3197254 - DNA, 16 bp, Homo sapiens
aatatcagacaagcac

SEQ ID NO: 3197255 - DNA, 18 bp, Homo sapiens
aatatcagacaagcacta

SEQ ID NO: 3197256 - DNA, 23 bp, Homo sapiens
aatatcaggagcttttttacaca

SEQ ID NO: 3197257 - DNA, 19 bp, Homo sapiens
aatatcatctgtcattata

SEQ ID NO: 3197258 - DNA, 13 bp, Homo sapiens
aatatcattgatt

SEQ ID NO: 3197259 - DNA, 23 bp, Homo sapiens
aatatcatttattttttacatta

SEQ ID NO: 3197260 - DNA, 19 bp, Homo sapiens
aatatccttgatgtacaga

SEQ ID NO: 3197261 - DNA, 22 bp, Homo sapiens
aatatccttgatgtacagattt

SEQ ID NO: 3197262 - DNA, 24 bp, Homo sapiens
aatatccttgatgtacagatttta

SEQ ID NO: 3197263 - DNA, 21 bp, Homo sapiens
aatatctatattctatacaca

SEQ ID NO: 3197264 - DNA, 16 bp, Homo sapiens
aatatctattaatata

SEQ ID NO: 3197265 - DNA, 16 bp, Homo sapiens
aatatctgaaaatgta

SEQ ID NO: 3197266 - DNA, 18 bp, Homo sapiens
aatatctgaaaatgtatg

SEQ ID NO: 3197267 - DNA, 16 bp, Homo sapiens
aatatcttcacattgt

SEQ ID NO: 3197268 - DNA, 15 bp, Homo sapiens
aatatcttggcctaa

SEQ ID NO: 3197269 - DNA, 19 bp, Homo sapiens
aatatctttaaatatatat

SEQ ID NO: 3197270 - DNA, 19 bp, Homo sapiens
aatatctttgtgataattt

SEQ ID NO: 3197271 - DNA, 16 bp, Homo sapiens
aataaatctttggaaa

SEQ ID NO: 3197272 - DNA, 16 bp, Homo sapiens
aataaatgccctcttc

SEQ ID NO: 3197273 - DNA, 20 bp, Homo sapiens
aataaatgcctttatatttc

SEQ ID NO: 3197274 - DNA, 14 bp, Homo sapiens
aataaattagttgt

SEQ ID NO: 3197275 - DNA, 16 bp, Homo sapiens
aataaattcaaaacct

SEQ ID NO: 3197276 - DNA, 14 bp, Homo sapiens
aataaattgaaatt

SEQ ID NO: 3197277 - DNA, 23 bp, Homo sapiens
aataaattgaataggtagtatca

SEQ ID NO: 3197278 - DNA, 13 bp, Homo sapiens
aataaattgctta

SEQ ID NO: 3197279 - DNA, 20 bp, Homo sapiens
aataaattggtgataagtgg

SEQ ID NO: 3197280 - DNA, 24 bp, Homo sapiens
aataaatttactcacagcacttgt

SEQ ID NO: 3197281 - DNA, 20 bp, Homo sapiens
aataaatttatatacttttt

SEQ ID NO: 3197282 - DNA, 13 bp, Homo sapiens
aataaatttctgg

SEQ ID NO: 3197283 - DNA, 18 bp, Homo sapiens
aataaatttggttctaat

SEQ ID NO: 3197284 - DNA, 17 bp, Homo sapiens
aataacaatatatagaa

SEQ ID NO: 3197285 - DNA, 15 bp, Homo sapiens
aataacagtgcatat

SEQ ID NO: 3197286 - DNA, 12 bp, Homo sapiens
aataacatgtaa

SEQ ID NO: 3197287 - DNA, 13 bp, Homo sapiens
aataacattacct

SEQ ID NO: 3197288 - DNA, 20 bp, Homo sapiens
aataacattaccttactgtg

SEQ ID NO: 3197289 - DNA, 22 bp, Homo sapiens
aataaccacttaaaaaatgtcc

SEQ ID NO: 3197290 - DNA, 12 bp, Homo sapiens
aataacccagtt

SEQ ID NO: 3197291 - DNA, 15 bp, Homo sapiens
aataacctctggccc

SEQ ID NO: 3197292 - DNA, 16 bp, Homo sapiens
aataacctctggccct

SEQ ID NO: 3197293 - DNA, 23 bp, Homo sapiens
aataacctctggcccttggaata

SEQ ID NO: 3197294 - DNA, 14 bp, Homo sapiens
aataacctttctgg

SEQ ID NO: 3197295 - DNA, 15 bp, Homo sapiens
aataactaaaatgta

SEQ ID NO: 3197296 - DNA, 17 bp, Homo sapiens
aataactactgtgttcc

SEQ ID NO: 3197297 - DNA, 21 bp, Homo sapiens
aataactccttcttgtagtag

SEQ ID NO: 3197298 - DNA, 15 bp, Homo sapiens
aataactgaaccaaa

SEQ ID NO: 3197299 - DNA, 16 bp, Homo sapiens
aataactgaaccaaat

SEQ ID NO: 3197300 - DNA, 23 bp, Homo sapiens
aataactgaaccaaattgcactg

SEQ ID NO: 3197301 - DNA, 14 bp, Homo sapiens
aataactgtgaagt

SEQ ID NO: 3197302 - DNA, 16 bp, Homo sapiens
aataactgtgaagttt

SEQ ID NO: 3197303 - DNA, 20 bp, Homo sapiens
aataactgtgaagtttacat

SEQ ID NO: 3197304 - DNA, 14 bp, Homo sapiens
aataacttcagtcc

SEQ ID NO: 3197305 - DNA, 15 bp, Homo sapiens
aataacttcagtcct

SEQ ID NO: 3197306 - DNA, 24 bp, Homo sapiens
aataacttcagtcctgctccagaa

SEQ ID NO: 3197307 - DNA, 21 bp, Homo sapiens
aataacttctatattttaata

SEQ ID NO: 3197308 - DNA, 12 bp, Homo sapiens
aataacttgaag

SEQ ID NO: 3197309 - DNA, 12 bp, Homo sapiens
aataagaaggta

SEQ ID NO: 3197310 - DNA, 18 bp, Homo sapiens
aataagaatagaaataaa

SEQ ID NO: 3197311 - DNA, 14 bp, Homo sapiens
aataagaatttagg

SEQ ID NO: 3197312 - DNA, 12 bp, Homo sapiens
aataagattcta

SEQ ID NO: 3197313 - DNA, 22 bp, Homo sapiens
aataagctctagttcttaacaa

SEQ ID NO: 3197314 - DNA, 12 bp, Homo sapiens
aataaggaggag

SEQ ID NO: 3197315 - DNA, 14 bp, Homo sapiens
aataaggaggagga

SEQ ID NO: 3197316 - DNA, 21 bp, Homo sapiens
aataaggcaggcattgaggaa

SEQ ID NO: 3197317 - DNA, 17 bp, Homo sapiens
aataaggccttaatatg

SEQ ID NO: 3197318 - DNA, 16 bp, Homo sapiens
aataagtatttataat

SEQ ID NO: 3197319 - DNA, 21 bp, Homo sapiens
aataagtcaaaaggaacaaaa

SEQ ID NO: 3197320 - DNA, 22 bp, Homo sapiens
aataagtcaaaaggaacaaaaa

SEQ ID NO: 3197321 - DNA, 12 bp, Homo sapiens
aataataaataa

SEQ ID NO: 3197322 - DNA, 14 bp, Homo sapiens
aataataatataat

SEQ ID NO: 3197323 - DNA, 14 bp, Homo sapiens
aataatacactaat

SEQ ID NO: 3197324 - DNA, 21 bp, Homo sapiens
aataatacctcaatgtttgag

SEQ ID NO: 3197325 - DNA, 15 bp, Homo sapiens
aataatagggaaaat

SEQ ID NO: 3197326 - DNA, 23 bp, Homo sapiens
aataataggtagggggctttcac

SEQ ID NO: 3197327 - DNA, 17 bp, Homo sapiens
aataatatgcattgtca

SEQ ID NO: 3197328 - DNA, 17 bp, Homo sapiens
aataatattgtttttct

SEQ ID NO: 3197329 - DNA, 15 bp, Homo sapiens
aataatatttcaagt

SEQ ID NO: 3197330 - DNA, 16 bp, Homo sapiens
aataatatttcaagtg

SEQ ID NO: 3197331 - DNA, 18 bp, Homo sapiens
aataatatttcaagtgcc

SEQ ID NO: 3197332 - DNA, 19 bp, Homo sapiens
aataatatttcaagtgcct

SEQ ID NO: 3197333 - DNA, 16 bp, Homo sapiens
aagccacgctgtcctc

SEQ ID NO: 3197334 - DNA, 22 bp, Homo sapiens
aagccacgctgtcctctcgagc

SEQ ID NO: 3197335 - DNA, 15 bp, Homo sapiens
aagccactagactct

SEQ ID NO: 3197336 - DNA, 15 bp, Homo sapiens
aagccagaggctggg

SEQ ID NO: 3197337 - DNA, 20 bp, Homo sapiens
aagccagccacagacccctg

SEQ ID NO: 3197338 - DNA, 21 bp, Homo sapiens
aagccagccacagacccctgg

SEQ ID NO: 3197339 - DNA, 11 bp, Homo sapiens
aagccagcctt

SEQ ID NO: 3197340 - DNA, 15 bp, Homo sapiens
aagccagctgccgac

SEQ ID NO: 3197341 - DNA, 15 bp, Homo sapiens
aagccagctttccct

SEQ ID NO: 3197342 - DNA, 23 bp, Homo sapiens
aagccagctttccctgcctctca

SEQ ID NO: 3197343 - DNA, 12 bp, Homo sapiens
aagccagggtct

SEQ ID NO: 3197344 - DNA, 21 bp, Homo sapiens
aagccagggtctctccctcag

SEQ ID NO: 3197345 - DNA, 14 bp, Homo sapiens
aagccaggtacagg

SEQ ID NO: 3197346 - DNA, 17 bp, Homo sapiens
aagccagtgaaatgtga

SEQ ID NO: 3197347 - DNA, 16 bp, Homo sapiens
aagccagttttcattt

SEQ ID NO: 3197348 - DNA, 19 bp, Homo sapiens
aagccatagcctccacgga

SEQ ID NO: 3197349 - DNA, 16 bp, Homo sapiens
aagccatagtgtcact

SEQ ID NO: 3197350 - DNA, 16 bp, Homo sapiens
aagccatcatgccttg

SEQ ID NO: 3197351 - DNA, 18 bp, Homo sapiens
aagccattaaatgaatat

SEQ ID NO: 3197352 - DNA, 20 bp, Homo sapiens
aagccattctaaggaaatta

SEQ ID NO: 3197353 - DNA, 16 bp, Homo sapiens
aagcccaacctcctga

SEQ ID NO: 3197354 - DNA, 17 bp, Homo sapiens
aagcccaaggtgctgat

SEQ ID NO: 3197355 - DNA, 16 bp, Homo sapiens
aagcccacactatgca

SEQ ID NO: 3197356 - DNA, 22 bp, Homo sapiens
aagcccagactttagtgccctg

SEQ ID NO: 3197357 - DNA, 21 bp, Homo sapiens
aagcccattttcaactgcttt

SEQ ID NO: 3197358 - DNA, 22 bp, Homo sapiens
aagcccattttcaactgctttg

SEQ ID NO: 3197359 - DNA, 14 bp, Homo sapiens
aagccccagggcct

SEQ ID NO: 3197360 - DNA, 15 bp, Homo sapiens
aagccccagggcctg

SEQ ID NO: 3197361 - DNA, 15 bp, Homo sapiens
aagccccatttcctc

SEQ ID NO: 3197362 - DNA, 15 bp, Homo sapiens
aagcccctcagccct

SEQ ID NO: 3197363 - DNA, 14 bp, Homo sapiens
aagcccctgggccc

SEQ ID NO: 3197364 - DNA, 15 bp, Homo sapiens
aagcccttccatgtc

SEQ ID NO: 3197365 - DNA, 19 bp, Homo sapiens
aagccgtctgactccagag

SEQ ID NO: 3197366 - DNA, 23 bp, Homo sapiens
aagcctaaaagtgggcttgattc

SEQ ID NO: 3197367 - DNA, 22 bp, Homo sapiens
aagcctaagggatcctgcctgc

SEQ ID NO: 3197368 - DNA, 23 bp, Homo sapiens
aagcctcaaggttttaggttcta

SEQ ID NO: 3197369 - DNA, 11 bp, Homo sapiens
aagcctcagtg

SEQ ID NO: 3197370 - DNA, 23 bp, Homo sapiens
aagcctccacagcgagggcagct

SEQ ID NO: 3197371 - DNA, 19 bp, Homo sapiens
aagcctccatttagttctt

SEQ ID NO: 3197372 - DNA, 20 bp, Homo sapiens
aagcctccatttagttcttt

SEQ ID NO: 3197373 - DNA, 22 bp, Homo sapiens
aagcctccatttagttctttgt

SEQ ID NO: 3197374 - DNA, 11 bp, Homo sapiens
aagcctctgct

SEQ ID NO: 3197375 - DNA, 11 bp, Homo sapiens
aagcctgagcc

SEQ ID NO: 3197376 - DNA, 13 bp, Homo sapiens
aagcctgagcctt

SEQ ID NO: 3197377 - DNA, 17 bp, Homo sapiens
aagcctgcaatttcata

SEQ ID NO: 3197378 - DNA, 21 bp, Homo sapiens
aagcctgcacaataaaaatgt

SEQ ID NO: 3197379 - DNA, 11 bp, Homo sapiens
aagcctgccct

SEQ ID NO: 3197380 - DNA, 20 bp, Homo sapiens
aagcctgcccttgtctgaga

SEQ ID NO: 3197381 - DNA, 21 bp, Homo sapiens
aagcctgcctaggaattccca

SEQ ID NO: 3197382 - DNA, 21 bp, Homo sapiens
aagcctgcgttggtccagagc

SEQ ID NO: 3197383 - DNA, 12 bp, Homo sapiens
aagcctgctggc

SEQ ID NO: 3197384 - DNA, 14 bp, Homo sapiens
aagcctgctggctg

SEQ ID NO: 3197385 - DNA, 16 bp, Homo sapiens
aagcctgggcttgagc

SEQ ID NO: 3197386 - DNA, 14 bp, Homo sapiens
aagccttaaaatgc

SEQ ID NO: 3197387 - DNA, 19 bp, Homo sapiens
aagccttaatttgcacagt

SEQ ID NO: 3197388 - DNA, 14 bp, Homo sapiens
aagccttagggaag

SEQ ID NO: 3197389 - DNA, 20 bp, Homo sapiens
aagccttataaaccaatctt

SEQ ID NO: 3197390 - DNA, 13 bp, Homo sapiens
aagccttcaaaac

SEQ ID NO: 3197391 - DNA, 15 bp, Homo sapiens
aagccttcagctcca

SEQ ID NO: 3197392 - DNA, 11 bp, Homo sapiens
aagccttccta

SEQ ID NO: 3197393 - DNA, 20 bp, Homo sapiens
aagccttgcactaggttgca

SEQ ID NO: 3197394 - DNA, 20 bp, Homo sapiens
aagcctttagtatcagtgtt

SEQ ID NO: 3197395 - DNA, 21 bp, Homo sapiens
aagcctttagtatcagtgttt

SEQ ID NO: 3197396 - DNA, 14 bp, Homo sapiens
aagccttttaaatc

SEQ ID NO: 3197397 - DNA, 15 bp, Homo sapiens
aagccttttaaatca

SEQ ID NO: 3197398 - DNA, 16 bp, Homo sapiens
aagcgatatacagatg

SEQ ID NO: 3197399 - DNA, 20 bp, Homo sapiens
aagcgatgaatttggagact

SEQ ID NO: 3197400 - DNA, 14 bp, Homo sapiens
aagcgattcttctg

SEQ ID NO: 3197401 - DNA, 21 bp, Homo sapiens
aagcgattcttctgcttcagc

SEQ ID NO: 3197402 - DNA, 22 bp, Homo sapiens
aagcgcatccaatctcaaggaa

SEQ ID NO: 3197403 - DNA, 23 bp, Homo sapiens
aagcgcatccaatctcaaggaat

SEQ ID NO: 3197404 - DNA, 20 bp, Homo sapiens
aagcggccctaagggagtgt

SEQ ID NO: 3197405 - DNA, 21 bp, Homo sapiens
aagcggccctaagggagtgtc

SEQ ID NO: 3197406 - DNA, 14 bp, Homo sapiens
aagcggggggaggg

SEQ ID NO: 3197407 - DNA, 23 bp, Homo sapiens
aagcgtctttaagagactcactg

SEQ ID NO: 3197408 - DNA, 15 bp, Homo sapiens
aagcgtgagccactg

SEQ ID NO: 3197409 - DNA, 22 bp, Homo sapiens
aagcgttcatatgctctgcttt

SEQ ID NO: 3197410 - DNA, 15 bp, Homo sapiens
aagcgtttttaacct

SEQ ID NO: 3197411 - DNA, 17 bp, Homo sapiens
aagcgtttttctttttc

SEQ ID NO: 3197412 - DNA, 21 bp, Homo sapiens
aagctaaatcctttactgtta

SEQ ID NO: 3197413 - DNA, 20 bp, Homo sapiens
aagctaatgtaggactgtat

SEQ ID NO: 3197414 - DNA, 22 bp, Homo sapiens
aagctaatttgcattaaattca

SEQ ID NO: 3197415 - DNA, 19 bp, Homo sapiens
aagctacctcaaacttcca

SEQ ID NO: 3197416 - DNA, 23 bp, Homo sapiens
aagctactgtgtgtgtgaatgaa

SEQ ID NO: 3197417 - DNA, 18 bp, Homo sapiens
aagctagccagagggtgg

SEQ ID NO: 3197418 - DNA, 17 bp, Homo sapiens
aagctaggcctggccag

SEQ ID NO: 3197419 - DNA, 18 bp, Homo sapiens
aagctaggcctggccaga

SEQ ID NO: 3197420 - DNA, 15 bp, Homo sapiens
aagctagggtggccc

SEQ ID NO: 3197421 - DNA, 19 bp, Homo sapiens
aagctagggtggcccttgc

SEQ ID NO: 3197422 - DNA, 18 bp, Homo sapiens
aagctagtggcttcaaaa

SEQ ID NO: 3197423 - DNA, 20 bp, Homo sapiens
aagctagtgtacctcctctc

SEQ ID NO: 3197424 - DNA, 19 bp, Homo sapiens
aagctataaagtatatatt

SEQ ID NO: 3197425 - DNA, 14 bp, Homo sapiens
aagctatcagcaat

SEQ ID NO: 3197426 - DNA, 14 bp, Homo sapiens
aagctatctaaagt

SEQ ID NO: 3197427 - DNA, 21 bp, Homo sapiens
aagctatgacacgagaatcag

SEQ ID NO: 3197428 - DNA, 22 bp, Homo sapiens
aagctattcagtaataactcta

SEQ ID NO: 3197429 - DNA, 18 bp, Homo sapiens
aagctcaaataaaaataa

SEQ ID NO: 3197430 - DNA, 18 bp, Homo sapiens
aagctcaaatgaaatgta

SEQ ID NO: 3197431 - DNA, 19 bp, Homo sapiens
aagctcaaatgaaatgtat

SEQ ID NO: 3197432 - DNA, 21 bp, Homo sapiens
aagctcatattttgtatatat

SEQ ID NO: 3197433 - DNA, 21 bp, Homo sapiens
aagctcatgcatttcaagcag

SEQ ID NO: 3197434 - DNA, 23 bp, Homo sapiens
aagctccacggtgcgtggctgtg

SEQ ID NO: 3197435 - DNA, 14 bp, Homo sapiens
aagctccatctcca

SEQ ID NO: 3197436 - DNA, 11 bp, Homo sapiens
aagctccctgc

SEQ ID NO: 3197437 - DNA, 14 bp, Homo sapiens
aagctccctggagc

SEQ ID NO: 3197438 - DNA, 16 bp, Homo sapiens
aagctccctggagccc

SEQ ID NO: 3197439 - DNA, 19 bp, Homo sapiens
aagctcctggtcttgagat

SEQ ID NO: 3197440 - DNA, 14 bp, Homo sapiens
aagctcctgtcctc

SEQ ID NO: 3197441 - DNA, 22 bp, Homo sapiens
aagctcctgtcctcccatcccc

SEQ ID NO: 3197442 - DNA, 17 bp, Homo sapiens
aagctcgccccacctcc

SEQ ID NO: 3197443 - DNA, 21 bp, Homo sapiens
aagtgtatttggaaataaagt

SEQ ID NO: 3197444 - DNA, 22 bp, Homo sapiens
aagtgtatttttcaataaagca

SEQ ID NO: 3197445 - DNA, 17 bp, Homo sapiens
aagtgtccgagaactaa

SEQ ID NO: 3197446 - DNA, 16 bp, Homo sapiens
aagtgtcgtctccgct

SEQ ID NO: 3197447 - DNA, 21 bp, Homo sapiens
aagtgtgaccccactgccaag

SEQ ID NO: 3197448 - DNA, 11 bp, Homo sapiens
aagtgtgagta

SEQ ID NO: 3197449 - DNA, 18 bp, Homo sapiens
aagtgtgagtaagagctg

SEQ ID NO: 3197450 - DNA, 20 bp, Homo sapiens
aagtgtgggtttggttagag

SEQ ID NO: 3197451 - DNA, 21 bp, Homo sapiens
aagtgtgtatatattttgtgt

SEQ ID NO: 3197452 - DNA, 23 bp, Homo sapiens
aagtgtgtggtcccaagttggaa

SEQ ID NO: 3197453 - DNA, 19 bp, Homo sapiens
aagtgttcaagaaataaaa

SEQ ID NO: 3197454 - DNA, 14 bp, Homo sapiens
aagtgttcattgtt

SEQ ID NO: 3197455 - DNA, 18 bp, Homo sapiens
aagtgttgaagggaggtg

SEQ ID NO: 3197456 - DNA, 16 bp, Homo sapiens
aagtgttgatcaacca

SEQ ID NO: 3197457 - DNA, 16 bp, Homo sapiens
aagtgttgctcttgga

SEQ ID NO: 3197458 - DNA, 14 bp, Homo sapiens
aagtgttggaaaaa

SEQ ID NO: 3197459 - DNA, 20 bp, Homo sapiens
aagtgttggaaaaaatttgt

SEQ ID NO: 3197460 - DNA, 23 bp, Homo sapiens
aagtgttggctaatgaagggaaa

SEQ ID NO: 3197461 - DNA, 16 bp, Homo sapiens
aagtgttggtctttct

SEQ ID NO: 3197462 - DNA, 12 bp, Homo sapiens
aagtgttgtatc

SEQ ID NO: 3197463 - DNA, 16 bp, Homo sapiens
aagtgtttatttttca

SEQ ID NO: 3197464 - DNA, 21 bp, Homo sapiens
aagtgtttatttttcatattg

SEQ ID NO: 3197465 - DNA, 16 bp, Homo sapiens
aagtgttttactcttt

SEQ ID NO: 3197466 - DNA, 23 bp, Homo sapiens
aagttaaaagtaaaattgtttca

SEQ ID NO: 3197467 - DNA, 18 bp, Homo sapiens
aagttaaacattgaagta

SEQ ID NO: 3197468 - DNA, 17 bp, Homo sapiens
aagttaaagtgaataac

SEQ ID NO: 3197469 - DNA, 17 bp, Homo sapiens
aagttaacaaggaatgc

SEQ ID NO: 3197470 - DNA, 19 bp, Homo sapiens
aagttaataacagctcctt

SEQ ID NO: 3197471 - DNA, 22 bp, Homo sapiens
aagttaatgtatataaaaatgg

SEQ ID NO: 3197472 - DNA, 19 bp, Homo sapiens
aagttacagaaatactata

SEQ ID NO: 3197473 - DNA, 15 bp, Homo sapiens
aagttacttattcta

SEQ ID NO: 3197474 - DNA, 12 bp, Homo sapiens
aagttactttgt

SEQ ID NO: 3197475 - DNA, 13 bp, Homo sapiens
aagttactttgta

SEQ ID NO: 3197476 - DNA, 16 bp, Homo sapiens
aagttactttgtaatt

SEQ ID NO: 3197477 - DNA, 17 bp, Homo sapiens
aagttagagaatatatt

SEQ ID NO: 3197478 - DNA, 17 bp, Homo sapiens
aagttagcctttgaatg

SEQ ID NO: 3197479 - DNA, 14 bp, Homo sapiens
aagttagctcagga

SEQ ID NO: 3197480 - DNA, 19 bp, Homo sapiens
aagttagtggaaatctgaa

SEQ ID NO: 3197481 - DNA, 18 bp, Homo sapiens
aagttataaatcaatgtc

SEQ ID NO: 3197482 - DNA, 19 bp, Homo sapiens
aagttataaatcaatgtca

SEQ ID NO: 3197483 - DNA, 20 bp, Homo sapiens
aagttataaatcaatgtcac

SEQ ID NO: 3197484 - DNA, 15 bp, Homo sapiens
aagttataagactct

SEQ ID NO: 3197485 - DNA, 15 bp, Homo sapiens
aagttatagtgaata

SEQ ID NO: 3197486 - DNA, 18 bp, Homo sapiens
aagttattcaaatttgta

SEQ ID NO: 3197487 - DNA, 19 bp, Homo sapiens
aagttattcaaatttgtac

SEQ ID NO: 3197488 - DNA, 21 bp, Homo sapiens
aagttattcaaatttgtacag

SEQ ID NO: 3197489 - DNA, 13 bp, Homo sapiens
aagttatttactt

SEQ ID NO: 3197490 - DNA, 14 bp, Homo sapiens
aagttatttatgct

SEQ ID NO: 3197491 - DNA, 15 bp, Homo sapiens
aagttatttgttcat

SEQ ID NO: 3197492 - DNA, 14 bp, Homo sapiens
aagttattttatga

SEQ ID NO: 3197493 - DNA, 23 bp, Homo sapiens
aagttcaaattcttctgaactca

SEQ ID NO: 3197494 - DNA, 11 bp, Homo sapiens
aagttcacaaa

SEQ ID NO: 3197495 - DNA, 21 bp, Homo sapiens
aagttcacgtaagatacaagt

SEQ ID NO: 3197496 - DNA, 22 bp, Homo sapiens
aagttcatattccatatttatt

SEQ ID NO: 3197497 - DNA, 23 bp, Homo sapiens
aagttcatgtgtggaaatgggac

SEQ ID NO: 3197498 - DNA, 15 bp, Homo sapiens
aagttccaagagtct

SEQ ID NO: 3197499 - DNA, 16 bp, Homo sapiens
aagttccaagagtcta

SEQ ID NO: 3197500 - DNA, 20 bp, Homo sapiens
aagttccccatccctgtcat

SEQ ID NO: 3197501 - DNA, 21 bp, Homo sapiens
aagttccccatccctgtcatt

SEQ ID NO: 3197502 - DNA, 14 bp, Homo sapiens
aagttcctctagtg

SEQ ID NO: 3197503 - DNA, 11 bp, Homo sapiens
aagttctaaga

SEQ ID NO: 3197504 - DNA, 14 bp, Homo sapiens
aagttctaagattc

SEQ ID NO: 3197505 - DNA, 15 bp, Homo sapiens
aagttctaagattct

SEQ ID NO: 3197506 - DNA, 16 bp, Homo sapiens
aagttctaagattctg

SEQ ID NO: 3197507 - DNA, 16 bp, Homo sapiens
aagttctaagttcatg

SEQ ID NO: 3197508 - DNA, 17 bp, Homo sapiens
aagttctaataatttct

SEQ ID NO: 3197509 - DNA, 19 bp, Homo sapiens
aagttctaataatttctaa

SEQ ID NO: 3197510 - DNA, 12 bp, Homo sapiens
aagttctgtgta

SEQ ID NO: 3197511 - DNA, 15 bp, Homo sapiens
aagttctgtgtttaa

SEQ ID NO: 3197512 - DNA, 22 bp, Homo sapiens
aagttctgtgtttaatttcttc

SEQ ID NO: 3197513 - DNA, 14 bp, Homo sapiens
aagttcttcacctc

SEQ ID NO: 3197514 - DNA, 14 bp, Homo sapiens
aagttgaagggaaa

SEQ ID NO: 3197515 - DNA, 19 bp, Homo sapiens
aagttgagatgttgtgtgg

SEQ ID NO: 3197516 - DNA, 18 bp, Homo sapiens
aagttgcactgatatttt

SEQ ID NO: 3197517 - DNA, 20 bp, Homo sapiens
aagttgcactgatattttac

SEQ ID NO: 3197518 - DNA, 15 bp, Homo sapiens
aagttgccattttgt

SEQ ID NO: 3197519 - DNA, 14 bp, Homo sapiens
aagttgcgacggag

SEQ ID NO: 3197520 - DNA, 22 bp, Homo sapiens
aagttgcgacggagagaaaaaa

SEQ ID NO: 3197521 - DNA, 13 bp, Homo sapiens
aagttgctgttta

SEQ ID NO: 3197522 - DNA, 18 bp, Homo sapiens
aagttggactaaatgcct

SEQ ID NO: 3197523 - DNA, 22 bp, Homo sapiens
aagttggactaaatgcctagtt

SEQ ID NO: 3197524 - DNA, 13 bp, Homo sapiens
aagttggactggg

SEQ ID NO: 3197525 - DNA, 19 bp, Homo sapiens
aagttggtattaataaaaa

SEQ ID NO: 3197526 - DNA, 15 bp, Homo sapiens
aagttgtaaaaatga

SEQ ID NO: 3197527 - DNA, 18 bp, Homo sapiens
aagttgtacaaatgtatt

SEQ ID NO: 3197528 - DNA, 23 bp, Homo sapiens
aagttgtacaaatgtattttgaa

SEQ ID NO: 3197529 - DNA, 17 bp, Homo sapiens
aagttgtataaaaacat

SEQ ID NO: 3197530 - DNA, 18 bp, Homo sapiens
aagttgtgccttttatag

SEQ ID NO: 3197531 - DNA, 18 bp, Homo sapiens
aagttgtggggagatcca

SEQ ID NO: 3197532 - DNA, 14 bp, Homo sapiens
aagttgttcaacta

SEQ ID NO: 3197533 - DNA, 18 bp, Homo sapiens
aagttgttcacatatatg

SEQ ID NO: 3197534 - DNA, 18 bp, Homo sapiens
aagttgttgtaacctgct

SEQ ID NO: 3197535 - DNA, 20 bp, Homo sapiens
aagtttcaaacttactattt

SEQ ID NO: 3197536 - DNA, 19 bp, Homo sapiens
aagtttcaagttttaaagt

SEQ ID NO: 3197537 - DNA, 20 bp, Homo sapiens
aagtttcaagttttaaagtt

SEQ ID NO: 3197538 - DNA, 20 bp, Homo sapiens
aagtttcacaggtcaataaa

SEQ ID NO: 3197539 - DNA, 22 bp, Homo sapiens
aagtttcaggtgacatgtgaaa

SEQ ID NO: 3197540 - DNA, 19 bp, Homo sapiens
aagtttcagtattagatgc

SEQ ID NO: 3197541 - DNA, 12 bp, Homo sapiens
aagtttccatat

SEQ ID NO: 3197542 - DNA, 18 bp, Homo sapiens
aagtttccatatgttata

SEQ ID NO: 3197543 - DNA, 14 bp, Homo sapiens
aagtttcccttcct

SEQ ID NO: 3197544 - DNA, 17 bp, Homo sapiens
aagtttctaagattcta

SEQ ID NO: 3197545 - DNA, 19 bp, Homo sapiens
aagtttctaagattctaaa

SEQ ID NO: 3197546 - DNA, 19 bp, Homo sapiens
aagtttctagctagaaata

SEQ ID NO: 3197547 - DNA, 12 bp, Homo sapiens
aagtttctattc

SEQ ID NO: 3197548 - DNA, 17 bp, Homo sapiens
aagtttctattctgtca

SEQ ID NO: 3197549 - DNA, 17 bp, Homo sapiens
aagtttctggtgccatt

SEQ ID NO: 3197550 - DNA, 16 bp, Homo sapiens
aagtttgatttcatta

SEQ ID NO: 3197551 - DNA, 15 bp, Homo sapiens
aagtttgatttttgt

SEQ ID NO: 3197552 - DNA, 22 bp, Homo sapiens
aagtttgatttttgtttttgta

SEQ ID NO: 3197553 - DNA, 13 bp, Homo sapiens
aagtttgcttaga

SEQ ID NO: 3197554 - DNA, 15 bp, Homo sapiens
aagtttgcttagaaa

SEQ ID NO: 3197555 - DNA, 19 bp, Homo sapiens
aagtttgtgttctgtttgt

SEQ ID NO: 3197556 - DNA, 23 bp, Homo sapiens
aagtttgttagatagctgcatgt

SEQ ID NO: 3197557 - DNA, 15 bp, Homo sapiens
aagttttaaagttca

SEQ ID NO: 3197558 - DNA, 16 bp, Homo sapiens
aagttttaacttccag

SEQ ID NO: 3197559 - DNA, 13 bp, Homo sapiens
aagttttaatgta

SEQ ID NO: 3197560 - DNA, 23 bp, Homo sapiens
aagttttcagaacctcttcccca

SEQ ID NO: 3197561 - DNA, 11 bp, Homo sapiens
aagttttcagg

SEQ ID NO: 3197562 - DNA, 15 bp, Homo sapiens
aagttttccagtatt

SEQ ID NO: 3197563 - DNA, 16 bp, Homo sapiens
aagttttccagtattg

SEQ ID NO: 3197564 - DNA, 20 bp, Homo sapiens
aagttttcctacacttgaga

SEQ ID NO: 3197565 - DNA, 14 bp, Homo sapiens
aagttttcctttgt

SEQ ID NO: 3197566 - DNA, 13 bp, Homo sapiens
aagttttgaaaag

SEQ ID NO: 3197567 - DNA, 13 bp, Homo sapiens
aagttttgatgaa

SEQ ID NO: 3197568 - DNA, 13 bp, Homo sapiens
aagttttgttctt

SEQ ID NO: 3197569 - DNA, 13 bp, Homo sapiens
aagtttttgtact

SEQ ID NO: 3197570 - DNA, 14 bp, Homo sapiens
aagtttttgtactg

SEQ ID NO: 3197571 - DNA, 15 bp, Homo sapiens
aagtttttgtttgga

SEQ ID NO: 3197572 - DNA, 14 bp, Homo sapiens
aataaaaaatctga

SEQ ID NO: 3197573 - DNA, 13 bp, Homo sapiens
aatatttatttat

SEQ ID NO: 3197574 - DNA, 19 bp, Homo sapiens
aatatttcctgacttgagt

SEQ ID NO: 3197575 - DNA, 14 bp, Homo sapiens
aatatttctattga

SEQ ID NO: 3197576 - DNA, 18 bp, Homo sapiens
aatatttctattgaattc

SEQ ID NO: 3197577 - DNA, 12 bp, Homo sapiens
aatatttctgaa

SEQ ID NO: 3197578 - DNA, 12 bp, Homo sapiens
aatatttcttca

SEQ ID NO: 3197579 - DNA, 23 bp, Homo sapiens
aatatttgacttgcatgaagaga

SEQ ID NO: 3197580 - DNA, 16 bp, Homo sapiens
aatattttcagcctac

SEQ ID NO: 3197581 - DNA, 20 bp, Homo sapiens
aatattttgataataaattg

SEQ ID NO: 3197582 - DNA, 22 bp, Homo sapiens
aatattttgataataatattgt

SEQ ID NO: 3197583 - DNA, 15 bp, Homo sapiens
aatattttggaaact

SEQ ID NO: 3197584 - DNA, 14 bp, Homo sapiens
aatattttgttctt

SEQ ID NO: 3197585 - DNA, 14 bp, Homo sapiens
aatatttttctaaa

SEQ ID NO: 3197586 - DNA, 16 bp, Homo sapiens
aatatttttggggcat

SEQ ID NO: 3197587 - DNA, 22 bp, Homo sapiens
aatatttttggggcatcctgga

SEQ ID NO: 3197588 - DNA, 23 bp, Homo sapiens
aatatttttggggcatcctggat

SEQ ID NO: 3197589 - DNA, 21 bp, Homo sapiens
aatattttttatatatacagt

SEQ ID NO: 3197590 - DNA, 13 bp, Homo sapiens
aatcaaagcaagg

SEQ ID NO: 3197591 - DNA, 19 bp, Homo sapiens
aatcaaagcaagggctcca

SEQ ID NO: 3197592 - DNA, 17 bp, Homo sapiens
aatcaaagccagggtct

SEQ ID NO: 3197593 - DNA, 17 bp, Homo sapiens
aatcaaatgatttcata

SEQ ID NO: 3197594 - DNA, 15 bp, Homo sapiens
aatcaacagaagcat

SEQ ID NO: 3197595 - DNA, 20 bp, Homo sapiens
aatcaaccacctatttttga

SEQ ID NO: 3197596 - DNA, 21 bp, Homo sapiens
aatcaaccctctcctgtctgc

SEQ ID NO: 3197597 - DNA, 14 bp, Homo sapiens
aatcaactttactg

SEQ ID NO: 3197598 - DNA, 16 bp, Homo sapiens
aatcaactttactgta

SEQ ID NO: 3197599 - DNA, 13 bp, Homo sapiens
aatcaagtattta

SEQ ID NO: 3197600 - DNA, 18 bp, Homo sapiens
aatcaatacactagttgt

SEQ ID NO: 3197601 - DNA, 21 bp, Homo sapiens
aatcaatctgcagtttaacaa

SEQ ID NO: 3197602 - DNA, 21 bp, Homo sapiens
aatcaatgaaaaatgtaattt

SEQ ID NO: 3197603 - DNA, 16 bp, Homo sapiens
aatcaatgaatattga

SEQ ID NO: 3197604 - DNA, 22 bp, Homo sapiens
aatcaatgaatattgaagtttc

SEQ ID NO: 3197605 - DNA, 17 bp, Homo sapiens
aatcaatgtcacttaaa

SEQ ID NO: 3197606 - DNA, 20 bp, Homo sapiens
aatcaattactggtccaaaa

SEQ ID NO: 3197607 - DNA, 16 bp, Homo sapiens
aatcaatttttaggaa

SEQ ID NO: 3197608 - DNA, 18 bp, Homo sapiens
aatcacaacaaactgaat

SEQ ID NO: 3197609 - DNA, 15 bp, Homo sapiens
aatcacagttggcct

SEQ ID NO: 3197610 - DNA, 16 bp, Homo sapiens
aatcaccaaaggagct

SEQ ID NO: 3197611 - DNA, 14 bp, Homo sapiens
aatcactaaacttt

SEQ ID NO: 3197612 - DNA, 16 bp, Homo sapiens
aatcactaacattata

SEQ ID NO: 3197613 - DNA, 22 bp, Homo sapiens
aatcactaacattatattgcaa

SEQ ID NO: 3197614 - DNA, 19 bp, Homo sapiens
aatcactaggtaacttatt

SEQ ID NO: 3197615 - DNA, 21 bp, Homo sapiens
aatcactctaattaattgtaa

SEQ ID NO: 3197616 - DNA, 21 bp, Homo sapiens
aatcactgcactgcatgcaaa

SEQ ID NO: 3197617 - DNA, 13 bp, Homo sapiens
aatcactgcagcc

SEQ ID NO: 3197618 - DNA, 15 bp, Homo sapiens
aatcactgcagccca

SEQ ID NO: 3197619 - DNA, 22 bp, Homo sapiens
aatcactgtttttagacacctt

SEQ ID NO: 3197620 - DNA, 16 bp, Homo sapiens
aatcacttaggaaatg

SEQ ID NO: 3197621 - DNA, 16 bp, Homo sapiens
aatcactttgtctaac

SEQ ID NO: 3197622 - DNA, 13 bp, Homo sapiens
aatcagaattaga

SEQ ID NO: 3197623 - DNA, 14 bp, Homo sapiens
aatcagaggagaga

SEQ ID NO: 3197624 - DNA, 19 bp, Homo sapiens
aatcagaggagagacggtg

SEQ ID NO: 3197625 - DNA, 14 bp, Homo sapiens
aatcagcactgaaa

SEQ ID NO: 3197626 - DNA, 15 bp, Homo sapiens
aatcagcactgaaaa

SEQ ID NO: 3197627 - DNA, 17 bp, Homo sapiens
aatcagcactgaaaata

SEQ ID NO: 3197628 - DNA, 19 bp, Homo sapiens
aatcagcattctcactcct

SEQ ID NO: 3197629 - DNA, 14 bp, Homo sapiens
aatcagcatttagt

SEQ ID NO: 3197630 - DNA, 16 bp, Homo sapiens
aatcagcctcttaaag

SEQ ID NO: 3197631 - DNA, 11 bp, Homo sapiens
aatcagctcct

SEQ ID NO: 3197632 - DNA, 12 bp, Homo sapiens
aatcagctctcc

SEQ ID NO: 3197633 - DNA, 15 bp, Homo sapiens
aatcagctctcctgg

SEQ ID NO: 3197634 - DNA, 16 bp, Homo sapiens
aatcagctctcctggc

SEQ ID NO: 3197635 - DNA, 19 bp, Homo sapiens
aatcagctctcctggctcc

SEQ ID NO: 3197636 - DNA, 20 bp, Homo sapiens
aatcaggaatattttccaaa

SEQ ID NO: 3197637 - DNA, 15 bp, Homo sapiens
aatcagggaccagct

SEQ ID NO: 3197638 - DNA, 18 bp, Homo sapiens
aatcagggaccagcttta

SEQ ID NO: 3197639 - DNA, 18 bp, Homo sapiens
aatcagggaggtcatttt

SEQ ID NO: 3197640 - DNA, 21 bp, Homo sapiens
aatcagtaatatttatatatt

SEQ ID NO: 3197641 - DNA, 14 bp, Homo sapiens
aatcagtataaaca

SEQ ID NO: 3197642 - DNA, 17 bp, Homo sapiens
aatcagtataaacaaag

SEQ ID NO: 3197643 - DNA, 13 bp, Homo sapiens
aatcagtattttt

SEQ ID NO: 3197644 - DNA, 16 bp, Homo sapiens
aatcagtcccctccca

SEQ ID NO: 3197645 - DNA, 18 bp, Homo sapiens
aatcagtcccctcccatc

SEQ ID NO: 3197646 - DNA, 21 bp, Homo sapiens
aatcagtgactgaaaccattt

SEQ ID NO: 3197647 - DNA, 17 bp, Homo sapiens
aatcagtgatctatgtt

SEQ ID NO: 3197648 - DNA, 22 bp, Homo sapiens
aatcagtgtgtctaaatttgaa

SEQ ID NO: 3197649 - DNA, 15 bp, Homo sapiens
aatcagttagttttt

SEQ ID NO: 3197650 - DNA, 13 bp, Homo sapiens
aatcagttttgta

SEQ ID NO: 3197651 - DNA, 13 bp, Homo sapiens
aatcagtttttca

SEQ ID NO: 3197652 - DNA, 22 bp, Homo sapiens
aatcatagtactctttgtagca

SEQ ID NO: 3197653 - DNA, 21 bp, Homo sapiens
aatcatataataaatgtacat

SEQ ID NO: 3197654 - DNA, 21 bp, Homo sapiens
aatcatattaaaattacagat

SEQ ID NO: 3197655 - DNA, 22 bp, Homo sapiens
aatcatattaaaattacagatg

SEQ ID NO: 3197656 - DNA, 23 bp, Homo sapiens
aatcatattgatgaaaagattta

SEQ ID NO: 3197657 - DNA, 16 bp, Homo sapiens
aatcatcaaaaagaaa

SEQ ID NO: 3197658 - DNA, 14 bp, Homo sapiens
aatcatcaaaaagt

SEQ ID NO: 3197659 - DNA, 23 bp, Homo sapiens
aatcatcctgttttctctgtgac

SEQ ID NO: 3197660 - DNA, 17 bp, Homo sapiens
aatcatcgaaaattcat

SEQ ID NO: 3197661 - DNA, 19 bp, Homo sapiens
aatcatcgaaaattcattt

SEQ ID NO: 3197662 - DNA, 15 bp, Homo sapiens
aatcatctataaaga

SEQ ID NO: 3197663 - DNA, 20 bp, Homo sapiens
aatcatctgcagttcttttt

SEQ ID NO: 3197664 - DNA, 15 bp, Homo sapiens
aatcatctgtgtgaa

SEQ ID NO: 3197665 - DNA, 18 bp, Homo sapiens
aatcatctgtgtgaaaat

SEQ ID NO: 3197666 - DNA, 17 bp, Homo sapiens
aatcatgaacagctctg

SEQ ID NO: 3197667 - DNA, 21 bp, Homo sapiens
aatcatgaacagctctgagat

SEQ ID NO: 3197668 - DNA, 22 bp, Homo sapiens
aatcatgaacagctctgagatc

SEQ ID NO: 3197669 - DNA, 18 bp, Homo sapiens
aatcatgagtcagacatt

SEQ ID NO: 3197670 - DNA, 15 bp, Homo sapiens
aatcatgccagtatt

SEQ ID NO: 3197671 - DNA, 18 bp, Homo sapiens
aatcatgccctgccttgt

SEQ ID NO: 3197672 - DNA, 15 bp, Homo sapiens
aatcatgtccatccc

SEQ ID NO: 3197673 - DNA, 18 bp, Homo sapiens
aatcatgtccatcccttt

SEQ ID NO: 3197674 - DNA, 22 bp, Homo sapiens
aatcatgtccatcccttttcct

SEQ ID NO: 3197675 - DNA, 18 bp, Homo sapiens
aatcatgtcgatcctggg

SEQ ID NO: 3197676 - DNA, 15 bp, Homo sapiens
aatcatgtgaacccg

SEQ ID NO: 3197677 - DNA, 16 bp, Homo sapiens
aatcatgtgaacccgg

SEQ ID NO: 3197678 - DNA, 21 bp, Homo sapiens
aatcatgtgggtgagccagtg

SEQ ID NO: 3197679 - DNA, 20 bp, Homo sapiens
aatcattagttttagaggca

SEQ ID NO: 3197680 - DNA, 19 bp, Homo sapiens
aatcattcagaaatgttga

SEQ ID NO: 3197681 - DNA, 22 bp, Homo sapiens
aatcattgctttgaagcagttg

SEQ ID NO: 3197682 - DNA, 21 bp, Homo sapiens
aatcattggcctggcaaaata

SEQ ID NO: 3197683 - DNA, 13 bp, Homo sapiens
aatcattgtagaa

SEQ ID NO: 3197684 - DNA, 14 bp, Homo sapiens
aatcattgtagaaa

SEQ ID NO: 3197685 - DNA, 18 bp, Homo sapiens
aatcattgttttgaatat

SEQ ID NO: 3197686 - DNA, 20 bp, Homo sapiens
aatcatttccccataactca

SEQ ID NO: 3197687 - DNA, 16 bp, Homo sapiens
aatcattttaattatt

SEQ ID NO: 3197688 - DNA, 22 bp, Homo sapiens
aatcattttaattattattctt

SEQ ID NO: 3197689 - DNA, 19 bp, Homo sapiens
aatcatttttcactgtaca

SEQ ID NO: 3197690 - DNA, 13 bp, Homo sapiens
aatccaaatggcg

SEQ ID NO: 3197691 - DNA, 13 bp, Homo sapiens
aatccaagctccc

SEQ ID NO: 3197692 - DNA, 20 bp, Homo sapiens
aatccaagctccctgcccca

SEQ ID NO: 3197693 - DNA, 15 bp, Homo sapiens
aatccacatttctaa

SEQ ID NO: 3197694 - DNA, 14 bp, Homo sapiens
aatccacctcggag

SEQ ID NO: 3197695 - DNA, 23 bp, Homo sapiens
aatccagaagttttaacttccag

SEQ ID NO: 3197696 - DNA, 13 bp, Homo sapiens
aatccagctccct

SEQ ID NO: 3197697 - DNA, 22 bp, Homo sapiens
aatccagctccctagactgcat

SEQ ID NO: 3197698 - DNA, 19 bp, Homo sapiens
aatccagttataagaagaa

SEQ ID NO: 3197699 - DNA, 20 bp, Homo sapiens
aatccataaatgtgttcctg

SEQ ID NO: 3197700 - DNA, 13 bp, Homo sapiens
aatccatatctta

SEQ ID NO: 3197701 - DNA, 19 bp, Homo sapiens
aatccatgttagtttttac

SEQ ID NO: 3197702 - DNA, 21 bp, Homo sapiens
aatccattcacaagcctcctg

SEQ ID NO: 3197703 - DNA, 15 bp, Homo sapiens
aatccattgtttaaa

SEQ ID NO: 3197704 - DNA, 17 bp, Homo sapiens
aatccattgtttaaaga

SEQ ID NO: 3197705 - DNA, 15 bp, Homo sapiens
aatcccagcactttg

SEQ ID NO: 3197706 - DNA, 12 bp, Homo sapiens
aatcccctcctt

SEQ ID NO: 3197707 - DNA, 17 bp, Homo sapiens
aatccctgggcattgct

SEQ ID NO: 3197708 - DNA, 21 bp, Homo sapiens
aatccctgggcattgctttcc

SEQ ID NO: 3197709 - DNA, 17 bp, Homo sapiens
aatccctgtttaatatt

SEQ ID NO: 3197710 - DNA, 23 bp, Homo sapiens
aatccctttattaccccctcctt

SEQ ID NO: 3197711 - DNA, 16 bp, Homo sapiens
aatcctaacacattat

SEQ ID NO: 3197712 - DNA, 16 bp, Homo sapiens
aatcctagacttgaaa

SEQ ID NO: 3197713 - DNA, 16 bp, Homo sapiens
aatcctatctggggag

SEQ ID NO: 3197714 - DNA, 16 bp, Homo sapiens
aatcctcactgggtgg

SEQ ID NO: 3197715 - DNA, 13 bp, Homo sapiens
aatcctctgttta

SEQ ID NO: 3197716 - DNA, 16 bp, Homo sapiens
aatcctgccatttaaa

SEQ ID NO: 3197717 - DNA, 13 bp, Homo sapiens
aatcctggcagcc

SEQ ID NO: 3197718 - DNA, 16 bp, Homo sapiens
aatcctggcagcccag

SEQ ID NO: 3197719 - DNA, 22 bp, Homo sapiens
aatccttctattctagcctgca

SEQ ID NO: 3197720 - DNA, 18 bp, Homo sapiens
aatccttgcttatgacat

SEQ ID NO: 3197721 - DNA, 13 bp, Homo sapiens
aatcctttactgt

SEQ ID NO: 3197722 - DNA, 20 bp, Homo sapiens
aatcctttttctttataaac

SEQ ID NO: 3197723 - DNA, 15 bp, Homo sapiens
aatcgatttcctccc

SEQ ID NO: 3197724 - DNA, 23 bp, Homo sapiens
aatcggatctggggctctgggat

SEQ ID NO: 3197725 - DNA, 18 bp, Homo sapiens
aatcggctggggactgct

SEQ ID NO: 3197726 - DNA, 17 bp, Homo sapiens
aatctaacaataatatt

SEQ ID NO: 3197727 - DNA, 18 bp, Homo sapiens
aatctaacaataatattt

SEQ ID NO: 3197728 - DNA, 14 bp, Homo sapiens
aatctaacaatgga

SEQ ID NO: 3197729 - DNA, 16 bp, Homo sapiens
aatctaacaatggaag

SEQ ID NO: 3197730 - DNA, 14 bp, Homo sapiens
aatctaaggataat

SEQ ID NO: 3197731 - DNA, 21 bp, Homo sapiens
aatctaaggataatgaaataa

SEQ ID NO: 3197732 - DNA, 17 bp, Homo sapiens
aatctaagtgatataaa

SEQ ID NO: 3197733 - DNA, 16 bp, Homo sapiens
aatctaatattaaaaa

SEQ ID NO: 3197734 - DNA, 19 bp, Homo sapiens
aatctaatattaaaaatat

SEQ ID NO: 3197735 - DNA, 19 bp, Homo sapiens
aatctaatctcttattcta

SEQ ID NO: 3197736 - DNA, 22 bp, Homo sapiens
aatctacagatcctttttccat

SEQ ID NO: 3197737 - DNA, 15 bp, Homo sapiens
aatctacttcctaca

SEQ ID NO: 3197738 - DNA, 23 bp, Homo sapiens
aatctacttcctacagagccaaa

SEQ ID NO: 3197739 - DNA, 16 bp, Homo sapiens
aatctagacaatatac

SEQ ID NO: 3197740 - DNA, 19 bp, Homo sapiens
aatctagtatttcatgctg

SEQ ID NO: 3197741 - DNA, 21 bp, Homo sapiens
aatctatccaaatctgaagat

SEQ ID NO: 3197742 - DNA, 12 bp, Homo sapiens
aatctattcaga

SEQ ID NO: 3197743 - DNA, 15 bp, Homo sapiens
aatctattgggttca

SEQ ID NO: 3197744 - DNA, 18 bp, Homo sapiens
aatctattgggttcatta

SEQ ID NO: 3197745 - DNA, 19 bp, Homo sapiens
aatctattgggttcattat

SEQ ID NO: 3197746 - DNA, 18 bp, Homo sapiens
aatctatttattaatatt

SEQ ID NO: 3197747 - DNA, 13 bp, Homo sapiens
aatctcaaaatta

SEQ ID NO: 3197748 - DNA, 15 bp, Homo sapiens
aatctcaaaggagaa

SEQ ID NO: 3197749 - DNA, 17 bp, Homo sapiens
aatctcaaaggagaaaa

SEQ ID NO: 3197750 - DNA, 19 bp, Homo sapiens
aatctcaatgaagccagct

SEQ ID NO: 3197751 - DNA, 13 bp, Homo sapiens
aatctcaccccat

SEQ ID NO: 3197752 - DNA, 11 bp, Homo sapiens
aatctcattcc

SEQ ID NO: 3197753 - DNA, 17 bp, Homo sapiens
aatctcattgcttacaa

SEQ ID NO: 3197754 - DNA, 23 bp, Homo sapiens
aatctcccacaagtatatacttt

SEQ ID NO: 3197755 - DNA, 18 bp, Homo sapiens
aatctcccattttggaat

SEQ ID NO: 3197756 - DNA, 12 bp, Homo sapiens
aatctcctgctg

SEQ ID NO: 3197757 - DNA, 13 bp, Homo sapiens
aatctcctgctga

SEQ ID NO: 3197758 - DNA, 14 bp, Homo sapiens
aatctcctgctgat

SEQ ID NO: 3197759 - DNA, 18 bp, Homo sapiens
aatctcgttcccaaagaa

SEQ ID NO: 3197760 - DNA, 18 bp, Homo sapiens
aatctctacccctttctt

SEQ ID NO: 3197761 - DNA, 17 bp, Homo sapiens
aatctctctctcttttt

SEQ ID NO: 3197762 - DNA, 13 bp, Homo sapiens
aatctctgtgcct

SEQ ID NO: 3197763 - DNA, 22 bp, Homo sapiens
aatctctgttctgtttggcact

SEQ ID NO: 3197764 - DNA, 16 bp, Homo sapiens
aatctcttgcttgtca

SEQ ID NO: 3197765 - DNA, 14 bp, Homo sapiens
aatctgaaattcta

SEQ ID NO: 3197766 - DNA, 15 bp, Homo sapiens
aatctgaaattctaa

SEQ ID NO: 3197767 - DNA, 12 bp, Homo sapiens
aatctgaagata

SEQ ID NO: 3197768 - DNA, 23 bp, Homo sapiens
aatctgaagatatatttcacttt

SEQ ID NO: 3197769 - DNA, 14 bp, Homo sapiens
aatctgacatatta

SEQ ID NO: 3197770 - DNA, 23 bp, Homo sapiens
aatctgatttttatgatgatgaa

SEQ ID NO: 3197771 - DNA, 15 bp, Homo sapiens
aatctgcaattcaaa

SEQ ID NO: 3197772 - DNA, 15 bp, Homo sapiens
aatctggaagaaaaa

SEQ ID NO: 3197773 - DNA, 15 bp, Homo sapiens
aatctggagaccagg

SEQ ID NO: 3197774 - DNA, 19 bp, Homo sapiens
aatctggatgcctcattat

SEQ ID NO: 3197775 - DNA, 11 bp, Homo sapiens
aatctggatta

SEQ ID NO: 3197776 - DNA, 16 bp, Homo sapiens
aatctgggaagggaag

SEQ ID NO: 3197777 - DNA, 20 bp, Homo sapiens
aatctggtaatggtgtccca

SEQ ID NO: 3197778 - DNA, 23 bp, Homo sapiens
aatctgtaaactgtgtattccaa

SEQ ID NO: 3197779 - DNA, 16 bp, Homo sapiens
aatctgtagggctgga

SEQ ID NO: 3197780 - DNA, 17 bp, Homo sapiens
aatctgtcaaaacactg

SEQ ID NO: 3197781 - DNA, 20 bp, Homo sapiens
aatctgtccaaaggaggctg

SEQ ID NO: 3197782 - DNA, 16 bp, Homo sapiens
aatctgtgcaaacagt

SEQ ID NO: 3197783 - DNA, 21 bp, Homo sapiens
aatctgtgtatattatttggc

SEQ ID NO: 3197784 - DNA, 20 bp, Homo sapiens
aatctgttatgtactagtgt

SEQ ID NO: 3197785 - DNA, 19 bp, Homo sapiens
aatcttaaacaatgtataa

SEQ ID NO: 3197786 - DNA, 23 bp, Homo sapiens
aatcttaaacaatgtataaagat

SEQ ID NO: 3197787 - DNA, 20 bp, Homo sapiens
aatcttaaacataataaatc

SEQ ID NO: 3197788 - DNA, 15 bp, Homo sapiens
aatcttaccagatgc

SEQ ID NO: 3197789 - DNA, 18 bp, Homo sapiens
aatcttagtgaatgggaa

SEQ ID NO: 3197790 - DNA, 23 bp, Homo sapiens
aatcttagtgtatgattactggc

SEQ ID NO: 3197791 - DNA, 13 bp, Homo sapiens
aatcttatacaac

SEQ ID NO: 3197792 - DNA, 20 bp, Homo sapiens
aatcttattccgagcattcc

SEQ ID NO: 3197793 - DNA, 22 bp, Homo sapiens
aatcttattccgagcattccag

SEQ ID NO: 3197794 - DNA, 22 bp, Homo sapiens
aatcttcagttttatctttaat

SEQ ID NO: 3197795 - DNA, 21 bp, Homo sapiens
aatcttctcatcttttatcta

SEQ ID NO: 3197796 - DNA, 14 bp, Homo sapiens
aatcttgaaattaa

SEQ ID NO: 3197797 - DNA, 17 bp, Homo sapiens
aatcttgaaattaagaa

SEQ ID NO: 3197798 - DNA, 14 bp, Homo sapiens
aatcttgaatttct

SEQ ID NO: 3197799 - DNA, 16 bp, Homo sapiens
aatcttgaatttctgc

SEQ ID NO: 3197800 - DNA, 16 bp, Homo sapiens
aatcttgtagacactt

SEQ ID NO: 3197801 - DNA, 13 bp, Homo sapiens
aatcttgtctaac

SEQ ID NO: 3197802 - DNA, 16 bp, Homo sapiens
aatcttgtgctagaat

SEQ ID NO: 3197803 - DNA, 19 bp, Homo sapiens
aatcttgtgctagaatact

SEQ ID NO: 3197804 - DNA, 17 bp, Homo sapiens
aatcttgttttgaaaat

SEQ ID NO: 3197805 - DNA, 23 bp, Homo sapiens
aatcttgttttgaaaataaccta

SEQ ID NO: 3197806 - DNA, 14 bp, Homo sapiens
aatctttatactgg

SEQ ID NO: 3197807 - DNA, 18 bp, Homo sapiens
aatctttcatccaaaata

SEQ ID NO: 3197808 - DNA, 15 bp, Homo sapiens
aatctttctatataa

SEQ ID NO: 3197809 - DNA, 20 bp, Homo sapiens
aatctttgtaccaaaatttt

SEQ ID NO: 3197810 - DNA, 23 bp, Homo sapiens
aatctttgtaccaaaattttaaa

SEQ ID NO: 3197811 - DNA, 19 bp, Homo sapiens
aatctttgttgaagtttga

SEQ ID NO: 3197812 - DNA, 23 bp, Homo sapiens
aatcttttacaactgcctcgaaa

SEQ ID NO: 3197813 - DNA, 15 bp, Homo sapiens
aatcttttcttattt

SEQ ID NO: 3197814 - DNA, 21 bp, Homo sapiens
aatcttttttagcataaaatt

SEQ ID NO: 3197815 - DNA, 17 bp, Homo sapiens
aatgaaaaattctcagt

SEQ ID NO: 3197816 - DNA, 17 bp, Homo sapiens
aatgaaaaatttaagca

SEQ ID NO: 3197817 - DNA, 19 bp, Homo sapiens
aatgaaaaatttaagcatt

SEQ ID NO: 3197818 - DNA, 22 bp, Homo sapiens
aatgaaaaatttaagcattgtt

SEQ ID NO: 3197819 - DNA, 13 bp, Homo sapiens
aatgaaaacattt

SEQ ID NO: 3197820 - DNA, 11 bp, Homo sapiens
aatgaaaataa

SEQ ID NO: 3197821 - DNA, 19 bp, Homo sapiens
aatgaaaataactgaacca

SEQ ID NO: 3197822 - DNA, 21 bp, Homo sapiens
aatgaaaataagtgaataata

SEQ ID NO: 3197823 - DNA, 16 bp, Homo sapiens
aatgaaaatgaatatc

SEQ ID NO: 3197824 - DNA, 14 bp, Homo sapiens
aatgaaaatgtcag

SEQ ID NO: 3197825 - DNA, 20 bp, Homo sapiens
aatgaaaatgtcagaaacca

SEQ ID NO: 3197826 - DNA, 17 bp, Homo sapiens
aatgaaagactgtacaa

SEQ ID NO: 3197827 - DNA, 13 bp, Homo sapiens
aatgaaagattaa

SEQ ID NO: 3197828 - DNA, 15 bp, Homo sapiens
aatgaaagattaaac

SEQ ID NO: 3197829 - DNA, 12 bp, Homo sapiens
aatgaaataatc

SEQ ID NO: 3197830 - DNA, 15 bp, Homo sapiens
aatgaaataatcagt

SEQ ID NO: 3197831 - DNA, 16 bp, Homo sapiens
aatgaaataatcagtg

SEQ ID NO: 3197832 - DNA, 21 bp, Homo sapiens
aatgaaataatgtacatctgg

SEQ ID NO: 3197833 - DNA, 14 bp, Homo sapiens
aatgaaatacacaa

SEQ ID NO: 3197834 - DNA, 14 bp, Homo sapiens
aatgaaattgtaaa

SEQ ID NO: 3197835 - DNA, 15 bp, Homo sapiens
aatgaacactctttt

SEQ ID NO: 3197836 - DNA, 13 bp, Homo sapiens
aatgaacattcca

SEQ ID NO: 3197837 - DNA, 18 bp, Homo sapiens
aatgaaccataaattcaa

SEQ ID NO: 3197838 - DNA, 19 bp, Homo sapiens
aatgaactaccatctgatg

SEQ ID NO: 3197839 - DNA, 15 bp, Homo sapiens
aatgaactgaagttt

SEQ ID NO: 3197840 - DNA, 13 bp, Homo sapiens
aatgaactgccca

SEQ ID NO: 3197841 - DNA, 17 bp, Homo sapiens
aatgaactgcttttcct

SEQ ID NO: 3197842 - DNA, 16 bp, Homo sapiens
aatgaacttgttactt

SEQ ID NO: 3197843 - DNA, 15 bp, Homo sapiens
aatgaagaattatgt

SEQ ID NO: 3197844 - DNA, 19 bp, Homo sapiens
aatgaagaattatgtaata

SEQ ID NO: 3197845 - DNA, 17 bp, Homo sapiens
aatgaataatggaaaat

SEQ ID NO: 3197846 - DNA, 13 bp, Homo sapiens
aatgaatactttc

SEQ ID NO: 3197847 - DNA, 14 bp, Homo sapiens
aatgaatatctatt

SEQ ID NO: 3197848 - DNA, 18 bp, Homo sapiens
aatgaatattttgataat

SEQ ID NO: 3197849 - DNA, 20 bp, Homo sapiens
aatgaatgcaaaattgtttt

SEQ ID NO: 3197850 - DNA, 16 bp, Homo sapiens
aatgaattaaatattg

SEQ ID NO: 3197851 - DNA, 14 bp, Homo sapiens
aatgaattataaca

SEQ ID NO: 3197852 - DNA, 16 bp, Homo sapiens
aatgaattataacagt

SEQ ID NO: 3197853 - DNA, 23 bp, Homo sapiens
aatgaattctttaaggagatgga

SEQ ID NO: 3197854 - DNA, 13 bp, Homo sapiens
aatgacaacactt

SEQ ID NO: 3197855 - DNA, 13 bp, Homo sapiens
aatgacaacagaa

SEQ ID NO: 3197856 - DNA, 14 bp, Homo sapiens
aatgacaacagaag

SEQ ID NO: 3197857 - DNA, 15 bp, Homo sapiens
aatgacaacagaagc

SEQ ID NO: 3197858 - DNA, 13 bp, Homo sapiens
aatgacatcttca

SEQ ID NO: 3197859 - DNA, 16 bp, Homo sapiens
aatgacatgcactgac

SEQ ID NO: 3197860 - DNA, 19 bp, Homo sapiens
aatgacatgcactgaccct

SEQ ID NO: 3197861 - DNA, 22 bp, Homo sapiens
aatgacatgcactgacccttcc

SEQ ID NO: 3197862 - DNA, 18 bp, Homo sapiens
aatgacccagacccaact

SEQ ID NO: 3197863 - DNA, 17 bp, Homo sapiens
aatgactaaaaatatta

SEQ ID NO: 3197864 - DNA, 24 bp, Homo sapiens
aatgactaaaaatattataactta

SEQ ID NO: 3197865 - DNA, 21 bp, Homo sapiens
aatgactatataatttatttc

SEQ ID NO: 3197866 - DNA, 19 bp, Homo sapiens
aatgactccactgtttttc

SEQ ID NO: 3197867 - DNA, 16 bp, Homo sapiens
aatgactctttctgaa

SEQ ID NO: 3197868 - DNA, 14 bp, Homo sapiens
aatgacttatttct

SEQ ID NO: 3197869 - DNA, 22 bp, Homo sapiens
aatgacttatttctgctctgga

SEQ ID NO: 3197870 - DNA, 23 bp, Homo sapiens
aatgacttatttctgctctggaa

SEQ ID NO: 3197871 - DNA, 19 bp, Homo sapiens
aatgagaattttatattct

SEQ ID NO: 3197872 - DNA, 19 bp, Homo sapiens
aatgagactctagggtcca

SEQ ID NO: 3197873 - DNA, 20 bp, Homo sapiens
aatgagagagagactgtgtg

SEQ ID NO: 3197874 - DNA, 16 bp, Homo sapiens
aatgagatagtagcat

SEQ ID NO: 3197875 - DNA, 17 bp, Homo sapiens
aatgagatcccgcctct

SEQ ID NO: 3197876 - DNA, 18 bp, Homo sapiens
aatgagattatatgtgga

SEQ ID NO: 3197877 - DNA, 13 bp, Homo sapiens
aatgagcacctcc

SEQ ID NO: 3197878 - DNA, 13 bp, Homo sapiens
aatgagcccagag

SEQ ID NO: 3197879 - DNA, 22 bp, Homo sapiens
aatgagctcgcatttgtcaatg

SEQ ID NO: 3197880 - DNA, 14 bp, Homo sapiens
aatgagctctgaaa

SEQ ID NO: 3197881 - DNA, 15 bp, Homo sapiens
aatgaggattattga

SEQ ID NO: 3197882 - DNA, 15 bp, Homo sapiens
aatgaggtcagcatg

SEQ ID NO: 3197883 - DNA, 16 bp, Homo sapiens
aatgagtatttggtaa

SEQ ID NO: 3197884 - DNA, 18 bp, Homo sapiens
aatgataatcccaccacc

SEQ ID NO: 3197885 - DNA, 18 bp, Homo sapiens
aatgatactgattatgaa

SEQ ID NO: 3197886 - DNA, 23 bp, Homo sapiens
aatgatatactgatcttcattac

SEQ ID NO: 3197887 - DNA, 17 bp, Homo sapiens
aatgatcagcatctgtg

SEQ ID NO: 3197888 - DNA, 18 bp, Homo sapiens
aatgatcgaaaaaataat

SEQ ID NO: 3197889 - DNA, 23 bp, Homo sapiens
aatgatcgaaaaaataattattt

SEQ ID NO: 3197890 - DNA, 16 bp, Homo sapiens
aatgatctcttctttt

SEQ ID NO: 3197891 - DNA, 17 bp, Homo sapiens
aatgatgagtttttatg

SEQ ID NO: 3197892 - DNA, 21 bp, Homo sapiens
aatgatgatcaattatagttt

SEQ ID NO: 3197893 - DNA, 23 bp, Homo sapiens
aatgatgatcaattatagtttct

SEQ ID NO: 3197894 - DNA, 21 bp, Homo sapiens
aatgatgatgatgatgatgaa

SEQ ID NO: 3197895 - DNA, 21 bp, Homo sapiens
aatgatgatgtggaagaactt

SEQ ID NO: 3197896 - DNA, 22 bp, Homo sapiens
aatgatggatcaccattatatt

SEQ ID NO: 3197897 - DNA, 17 bp, Homo sapiens
aatgatggcaattttgt

SEQ ID NO: 3197898 - DNA, 22 bp, Homo sapiens
aatgatggtaggaagaagctct

SEQ ID NO: 3197899 - DNA, 15 bp, Homo sapiens
aatgatgtccagaag

SEQ ID NO: 3197900 - DNA, 15 bp, Homo sapiens
aatgattaatcaaag

SEQ ID NO: 3197901 - DNA, 17 bp, Homo sapiens
aatgattaatcaaaggc

SEQ ID NO: 3197902 - DNA, 15 bp, Homo sapiens
aatgattattttcat

SEQ ID NO: 3197903 - DNA, 21 bp, Homo sapiens
aatgattattttcattacaat

SEQ ID NO: 3197904 - DNA, 13 bp, Homo sapiens
aatgattcataac

SEQ ID NO: 3197905 - DNA, 19 bp, Homo sapiens
aatgattcataacaatgta

SEQ ID NO: 3197906 - DNA, 12 bp, Homo sapiens
aatgattcttcc

SEQ ID NO: 3197907 - DNA, 13 bp, Homo sapiens
aatgatttcatat

SEQ ID NO: 3197908 - DNA, 15 bp, Homo sapiens
aatgatttcatattg

SEQ ID NO: 3197909 - DNA, 12 bp, Homo sapiens
aatgatttgtgt

SEQ ID NO: 3197910 - DNA, 19 bp, Homo sapiens
aatgcaaagctgaagacca

SEQ ID NO: 3197911 - DNA, 20 bp, Homo sapiens
aatgcaaagttctgtgttta

SEQ ID NO: 3197912 - DNA, 17 bp, Homo sapiens
aatgcaaccagaattgt

SEQ ID NO: 3197913 - DNA, 22 bp, Homo sapiens
aatgcaacttttaattactgtt

SEQ ID NO: 3197914 - DNA, 17 bp, Homo sapiens
aatgcaagctagtggct

SEQ ID NO: 3197915 - DNA, 16 bp, Homo sapiens
aatgcaaggggctgca

SEQ ID NO: 3197916 - DNA, 21 bp, Homo sapiens
aatgcaatgtaagcatacttt

SEQ ID NO: 3197917 - DNA, 16 bp, Homo sapiens
aatgcacaagctcaga

SEQ ID NO: 3197918 - DNA, 13 bp, Homo sapiens
aatgcacactagc

SEQ ID NO: 3197919 - DNA, 15 bp, Homo sapiens
aatgcactgttttta

SEQ ID NO: 3197920 - DNA, 16 bp, Homo sapiens
aatgcactgtttttaa

SEQ ID NO: 3197921 - DNA, 21 bp, Homo sapiens
aatgcagaaccacaaacaatt

SEQ ID NO: 3197922 - DNA, 17 bp, Homo sapiens
aatgcagtcctgaggag

SEQ ID NO: 3197923 - DNA, 20 bp, Homo sapiens
aatgcagtcctgaggagagg

SEQ ID NO: 3197924 - DNA, 14 bp, Homo sapiens
aatgcatacaagtt

SEQ ID NO: 3197925 - DNA, 16 bp, Homo sapiens
aatgcatagagccctg

SEQ ID NO: 3197926 - DNA, 17 bp, Homo sapiens
aatgcatagagccctgg

SEQ ID NO: 3197927 - DNA, 23 bp, Homo sapiens
aatgcatcacgtaccccactggg

SEQ ID NO: 3197928 - DNA, 15 bp, Homo sapiens
aatgcatcaggtcct

SEQ ID NO: 3197929 - DNA, 21 bp, Homo sapiens
aatgcatgaacaagttttaat

SEQ ID NO: 3197930 - DNA, 13 bp, Homo sapiens
aatgcattaaacc

SEQ ID NO: 3197931 - DNA, 15 bp, Homo sapiens
aatgcattaaacctg

SEQ ID NO: 3197932 - DNA, 13 bp, Homo sapiens
aatgcattattga

SEQ ID NO: 3197933 - DNA, 19 bp, Homo sapiens
aatgcattcttctctgttg

SEQ ID NO: 3197934 - DNA, 13 bp, Homo sapiens
aatgccaagataa

SEQ ID NO: 3197935 - DNA, 17 bp, Homo sapiens
aatgccaagataattca

SEQ ID NO: 3197936 - DNA, 13 bp, Homo sapiens
aatgccattctct

SEQ ID NO: 3197937 - DNA, 18 bp, Homo sapiens
aatgcccgtaatgcttag

SEQ ID NO: 3197938 - DNA, 22 bp, Homo sapiens
aatgccctcaggggacttgaat

SEQ ID NO: 3197939 - DNA, 19 bp, Homo sapiens
aatgccctcctaaatgtca

SEQ ID NO: 3197940 - DNA, 18 bp, Homo sapiens
aatgccggttaaattcca

SEQ ID NO: 3197941 - DNA, 24 bp, Homo sapiens
aatgcctagtttttagtaatctgt

SEQ ID NO: 3197942 - DNA, 17 bp, Homo sapiens
aatgcctcctgtgggga

SEQ ID NO: 3197943 - DNA, 16 bp, Homo sapiens
aatgcctcgctccctt

SEQ ID NO: 3197944 - DNA, 23 bp, Homo sapiens
aatgcctcttaaattatatattt

SEQ ID NO: 3197945 - DNA, 21 bp, Homo sapiens
aatgcctgctttttggaaagt

SEQ ID NO: 3197946 - DNA, 13 bp, Homo sapiens
aatgccttgaact

SEQ ID NO: 3197947 - DNA, 17 bp, Homo sapiens
aatgcctttatatttca

SEQ ID NO: 3197948 - DNA, 14 bp, Homo sapiens
aatgcctttgagac

SEQ ID NO: 3197949 - DNA, 16 bp, Homo sapiens
aatgcctttgagacag

SEQ ID NO: 3197950 - DNA, 18 bp, Homo sapiens
aatgcctttgagacagtt

SEQ ID NO: 3197951 - DNA, 19 bp, Homo sapiens
aatgcctttgagacagttt

SEQ ID NO: 3197952 - DNA, 20 bp, Homo sapiens
aatgcgctttattgcccatg

SEQ ID NO: 3197953 - DNA, 22 bp, Homo sapiens
aatgcggttataaaaaatggtt

SEQ ID NO: 3197954 - DNA, 13 bp, Homo sapiens
aatgctaagtcca

SEQ ID NO: 3197955 - DNA, 16 bp, Homo sapiens
aatgctacaattttaa

SEQ ID NO: 3197956 - DNA, 20 bp, Homo sapiens
aatgctacaattttaagagg

SEQ ID NO: 3197957 - DNA, 14 bp, Homo sapiens
aatgctattgaaaa

SEQ ID NO: 3197958 - DNA, 16 bp, Homo sapiens
aatgctattgaaaatg

SEQ ID NO: 3197959 - DNA, 15 bp, Homo sapiens
aatgctcccagctgt

SEQ ID NO: 3197960 - DNA, 16 bp, Homo sapiens
aatgctccccacagcg

SEQ ID NO: 3197961 - DNA, 16 bp, Homo sapiens
aatgctctatgtttgt

SEQ ID NO: 3197962 - DNA, 19 bp, Homo sapiens
aatgctctatgtttgtatt

SEQ ID NO: 3197963 - DNA, 20 bp, Homo sapiens
aatgctctatgtttgtattt

SEQ ID NO: 3197964 - DNA, 21 bp, Homo sapiens
aatgctctatgtttgtatttg

SEQ ID NO: 3197965 - DNA, 13 bp, Homo sapiens
aatgctctgtgcc

SEQ ID NO: 3197966 - DNA, 14 bp, Homo sapiens
aatgctctgtgcca

SEQ ID NO: 3197967 - DNA, 18 bp, Homo sapiens
aatgctgaatatatagaa

SEQ ID NO: 3197968 - DNA, 17 bp, Homo sapiens
aatgctgcacttcctgt

SEQ ID NO: 3197969 - DNA, 22 bp, Homo sapiens
aatgctgccttcccatgaatct

SEQ ID NO: 3197970 - DNA, 23 bp, Homo sapiens
aatgctgccttttctttaacttt

SEQ ID NO: 3197971 - DNA, 23 bp, Homo sapiens
aatgctggactggaggcccctgg

SEQ ID NO: 3197972 - DNA, 22 bp, Homo sapiens
aatgctggcaaaggctggctgt

SEQ ID NO: 3197973 - DNA, 21 bp, Homo sapiens
aatgctggctgttggctgggg

SEQ ID NO: 3197974 - DNA, 22 bp, Homo sapiens
aatgctggctgttggctggggg

SEQ ID NO: 3197975 - DNA, 19 bp, Homo sapiens
aatgctggttttcctaaat

SEQ ID NO: 3197976 - DNA, 22 bp, Homo sapiens
aatgctggttttcctaaatgca

SEQ ID NO: 3197977 - DNA, 23 bp, Homo sapiens
aatgctggttttcctaaatgcag

SEQ ID NO: 3197978 - DNA, 13 bp, Homo sapiens
aatgctgtacatc

SEQ ID NO: 3197979 - DNA, 23 bp, Homo sapiens
aatgctgtacatctattttggat

SEQ ID NO: 3197980 - DNA, 12 bp, Homo sapiens
aatgctgtgtta

SEQ ID NO: 3197981 - DNA, 16 bp, Homo sapiens
aatgctgttgtaaaca

SEQ ID NO: 3197982 - DNA, 15 bp, Homo sapiens
aatgcttaatttcta

SEQ ID NO: 3197983 - DNA, 20 bp, Homo sapiens
aatgcttatcatctaaagat

SEQ ID NO: 3197984 - DNA, 20 bp, Homo sapiens
aatgcttcaagtgttgctct

SEQ ID NO: 3197985 - DNA, 11 bp, Homo sapiens
aatgcttcaga

SEQ ID NO: 3197986 - DNA, 16 bp, Homo sapiens
aatgcttccaagcatg

SEQ ID NO: 3197987 - DNA, 17 bp, Homo sapiens
aatgcttctgtagcttc

SEQ ID NO: 3197988 - DNA, 19 bp, Homo sapiens
aatgcttctgtagcttcta

SEQ ID NO: 3197989 - DNA, 20 bp, Homo sapiens
aatgcttgtggattgagggt

SEQ ID NO: 3197990 - DNA, 23 bp, Homo sapiens
aatgcttttatatggcccagcct

SEQ ID NO: 3197991 - DNA, 14 bp, Homo sapiens
aatgctttttgaat

SEQ ID NO: 3197992 - DNA, 14 bp, Homo sapiens
aatggaaaaaaaca

SEQ ID NO: 3197993 - DNA, 19 bp, Homo sapiens
aatggaaaaaaacataaaa

SEQ ID NO: 3197994 - DNA, 17 bp, Homo sapiens
aatggaaacattacagt

SEQ ID NO: 3197995 - DNA, 19 bp, Homo sapiens
aatggaaagtaactcattt

SEQ ID NO: 3197996 - DNA, 22 bp, Homo sapiens
aatggaaatcatcgaaaattca

SEQ ID NO: 3197997 - DNA, 18 bp, Homo sapiens
aatggaactactgtactt

SEQ ID NO: 3197998 - DNA, 15 bp, Homo sapiens
aatggaagagaaatc

SEQ ID NO: 3197999 - DNA, 15 bp, Homo sapiens
aatggaagatttgcc

SEQ ID NO: 3198000 - DNA, 19 bp, Homo sapiens
aatggaagcaaagtgctgg

SEQ ID NO: 3198001 - DNA, 20 bp, Homo sapiens
aatggaaggtttgtatattg

SEQ ID NO: 3198002 - DNA, 22 bp, Homo sapiens
aatggaataaaaggcttgaagc

SEQ ID NO: 3198003 - DNA, 15 bp, Homo sapiens
aatggacacaaattt

SEQ ID NO: 3198004 - DNA, 20 bp, Homo sapiens
aatggacacaaattttcaag

SEQ ID NO: 3198005 - DNA, 17 bp, Homo sapiens
aatggactggaagggga

SEQ ID NO: 3198006 - DNA, 23 bp, Homo sapiens
aatggactggaaggggaagggac

SEQ ID NO: 3198007 - DNA, 18 bp, Homo sapiens
aatggaggcttttcactg

SEQ ID NO: 3198008 - DNA, 14 bp, Homo sapiens
aatggatattatta

SEQ ID NO: 3198009 - DNA, 14 bp, Homo sapiens
aatggatatttctc

SEQ ID NO: 3198010 - DNA, 16 bp, Homo sapiens
aatggatcacaagatg

SEQ ID NO: 3198011 - DNA, 17 bp, Homo sapiens
aatggatcacaagatgg

SEQ ID NO: 3198012 - DNA, 18 bp, Homo sapiens
aatggatcacaagatgga

SEQ ID NO: 3198013 - DNA, 14 bp, Homo sapiens
aatggattctattt

SEQ ID NO: 3198014 - DNA, 20 bp, Homo sapiens
aatggattggattatttaat

SEQ ID NO: 3198015 - DNA, 19 bp, Homo sapiens
aatggatttttaaattata

SEQ ID NO: 3198016 - DNA, 20 bp, Homo sapiens
aatggatttttctttaactg

SEQ ID NO: 3198017 - DNA, 16 bp, Homo sapiens
aatggcaagttttgat

SEQ ID NO: 3198018 - DNA, 19 bp, Homo sapiens
aatggcactgttgcaaact

SEQ ID NO: 3198019 - DNA, 11 bp, Homo sapiens
aatggcagagc

SEQ ID NO: 3198020 - DNA, 12 bp, Homo sapiens
aatggcagcctt

SEQ ID NO: 3198021 - DNA, 16 bp, Homo sapiens
aatggcagccttggca

SEQ ID NO: 3198022 - DNA, 18 bp, Homo sapiens
aatggcagctagtgcctt

SEQ ID NO: 3198023 - DNA, 22 bp, Homo sapiens
aatggcctcatgtggctggaag

SEQ ID NO: 3198024 - DNA, 20 bp, Homo sapiens
aatggcgtctggaagtccaa

SEQ ID NO: 3198025 - DNA, 22 bp, Homo sapiens
aatggctaataaactgtattaa

SEQ ID NO: 3198026 - DNA, 13 bp, Homo sapiens
aatggctgggtca

SEQ ID NO: 3198027 - DNA, 18 bp, Homo sapiens
aatgggagacagcctctt

SEQ ID NO: 3198028 - DNA, 16 bp, Homo sapiens
aatgggaggcctctga

SEQ ID NO: 3198029 - DNA, 13 bp, Homo sapiens
aatgggcctgccc

SEQ ID NO: 3198030 - DNA, 17 bp, Homo sapiens
aatggggatcacagaga

SEQ ID NO: 3198031 - DNA, 19 bp, Homo sapiens
aatgggggtagcagctgga

SEQ ID NO: 3198032 - DNA, 15 bp, Homo sapiens
aatggggtgggccca

SEQ ID NO: 3198033 - DNA, 15 bp, Homo sapiens
aatgggtcttttata

SEQ ID NO: 3198034 - DNA, 16 bp, Homo sapiens
aatgggtttttccctg

SEQ ID NO: 3198035 - DNA, 19 bp, Homo sapiens
aatggtacatgtcttccat

SEQ ID NO: 3198036 - DNA, 18 bp, Homo sapiens
aatggtactgactttgct

SEQ ID NO: 3198037 - DNA, 18 bp, Homo sapiens
aatggtatcaaaattaca

SEQ ID NO: 3198038 - DNA, 22 bp, Homo sapiens
aatggtgaaaataaaataaagc

SEQ ID NO: 3198039 - DNA, 16 bp, Homo sapiens
aatggtgtacataatg

SEQ ID NO: 3198040 - DNA, 19 bp, Homo sapiens
aatggtgtagaacactaat

SEQ ID NO: 3198041 - DNA, 20 bp, Homo sapiens
aatggtgtcagtatccaggc

SEQ ID NO: 3198042 - DNA, 22 bp, Homo sapiens
aatggtgtgaacccgggagcgg

SEQ ID NO: 3198043 - DNA, 17 bp, Homo sapiens
aatggttgatggaaaat

SEQ ID NO: 3198044 - DNA, 18 bp, Homo sapiens
aatggttgatggaaaata

SEQ ID NO: 3198045 - DNA, 23 bp, Homo sapiens
aatggttgatggaaaataaacat

SEQ ID NO: 3198046 - DNA, 15 bp, Homo sapiens
aatggttgccttaaa

SEQ ID NO: 3198047 - DNA, 21 bp, Homo sapiens
aatggtttctgaaaatgttta

SEQ ID NO: 3198048 - DNA, 17 bp, Homo sapiens
aatggtttggtgctttt

SEQ ID NO: 3198049 - DNA, 16 bp, Homo sapiens
aatggttttcaaaata

SEQ ID NO: 3198050 - DNA, 18 bp, Homo sapiens
aatggtttttatttctcg

SEQ ID NO: 3198051 - DNA, 12 bp, Homo sapiens
aatgtaaaagaa

SEQ ID NO: 3198052 - DNA, 21 bp, Homo sapiens
aatgtaaaattgaaaatatgt

SEQ ID NO: 3198053 - DNA, 15 bp, Homo sapiens
aatgtaaactgccat

SEQ ID NO: 3198054 - DNA, 12 bp, Homo sapiens
aatgtaaatatt

SEQ ID NO: 3198055 - DNA, 22 bp, Homo sapiens
aatgtaactccagatagagaaa

SEQ ID NO: 3198056 - DNA, 22 bp, Homo sapiens
aatgtaacttttgtaagacaaa

SEQ ID NO: 3198057 - DNA, 16 bp, Homo sapiens
aatgtaagaaaacaaa

SEQ ID NO: 3198058 - DNA, 16 bp, Homo sapiens
aatgtaagattataga

SEQ ID NO: 3198059 - DNA, 23 bp, Homo sapiens
aatgtaagattatagattctaaa

SEQ ID NO: 3198060 - DNA, 13 bp, Homo sapiens
aatgtaagcaaag

SEQ ID NO: 3198061 - DNA, 16 bp, Homo sapiens
aatgtaagcatacttt

SEQ ID NO: 3198062 - DNA, 15 bp, Homo sapiens
aatgtaagctgttta

SEQ ID NO: 3198063 - DNA, 20 bp, Homo sapiens
aatgtaatcggcttgaattt

SEQ ID NO: 3198064 - DNA, 15 bp, Homo sapiens
aatgtaatgatcata

SEQ ID NO: 3198065 - DNA, 21 bp, Homo sapiens
aatgtaatgatcataagtcta

SEQ ID NO: 3198066 - DNA, 16 bp, Homo sapiens
aatgtaatgatgctga

SEQ ID NO: 3198067 - DNA, 16 bp, Homo sapiens
aatgtaatttaaatga

SEQ ID NO: 3198068 - DNA, 16 bp, Homo sapiens
aatgtaatttagaaac

SEQ ID NO: 3198069 - DNA, 17 bp, Homo sapiens
aatgtaatttagaaact

SEQ ID NO: 3198070 - DNA, 16 bp, Homo sapiens
aatgtaatttgtgtaa

SEQ ID NO: 3198071 - DNA, 16 bp, Homo sapiens
aatgtacaagttttgt

SEQ ID NO: 3198072 - DNA, 20 bp, Homo sapiens
aatgtacaagttttgtataa

SEQ ID NO: 3198073 - DNA, 16 bp, Homo sapiens
aatgtacagttgaaat

SEQ ID NO: 3198074 - DNA, 17 bp, Homo sapiens
aatgtacagttgaaata

SEQ ID NO: 3198075 - DNA, 15 bp, Homo sapiens
aatgtaccttctttc

SEQ ID NO: 3198076 - DNA, 12 bp, Homo sapiens
aatgtactgaga

SEQ ID NO: 3198077 - DNA, 15 bp, Homo sapiens
aatgtagaaattctt

SEQ ID NO: 3198078 - DNA, 18 bp, Homo sapiens
aatgtagcgtgtttacat

SEQ ID NO: 3198079 - DNA, 21 bp, Homo sapiens
aatgtagcgtgtttacatgtg

SEQ ID NO: 3198080 - DNA, 21 bp, Homo sapiens
aatgtagctggtttcctcatt

SEQ ID NO: 3198081 - DNA, 15 bp, Homo sapiens
aatgtaggactgtat

SEQ ID NO: 3198082 - DNA, 16 bp, Homo sapiens
aatgtaggcttagttt

SEQ ID NO: 3198083 - DNA, 22 bp, Homo sapiens
aatgtaggcttagtttgtgtgt

SEQ ID NO: 3198084 - DNA, 15 bp, Homo sapiens
aatgtagttgtcaca

SEQ ID NO: 3198085 - DNA, 16 bp, Homo sapiens
aatgtataaagattgt

SEQ ID NO: 3198086 - DNA, 17 bp, Homo sapiens
aatgtataaagattgta

SEQ ID NO: 3198087 - DNA, 17 bp, Homo sapiens
aatgtatataaaaatgg

SEQ ID NO: 3198088 - DNA, 16 bp, Homo sapiens
aatgtatatacacata

SEQ ID NO: 3198089 - DNA, 18 bp, Homo sapiens
aatgtatatacacatata

SEQ ID NO: 3198090 - DNA, 20 bp, Homo sapiens
aatgtatatatttagtgctg

SEQ ID NO: 3198091 - DNA, 13 bp, Homo sapiens
aatgtatcaggaa

SEQ ID NO: 3198092 - DNA, 18 bp, Homo sapiens
aatgtatcaggaaatata

SEQ ID NO: 3198093 - DNA, 14 bp, Homo sapiens
aatgtatctgtgaa

SEQ ID NO: 3198094 - DNA, 17 bp, Homo sapiens
aatgtatctgtgaagta

SEQ ID NO: 3198095 - DNA, 13 bp, Homo sapiens
aatgtatcttatt

SEQ ID NO: 3198096 - DNA, 17 bp, Homo sapiens
aatgtatcttattcaca

SEQ ID NO: 3198097 - DNA, 21 bp, Homo sapiens
aatgtatgtgaaagtgtaaaa

SEQ ID NO: 3198098 - DNA, 19 bp, Homo sapiens
aatgtatgtgtaagtattc

SEQ ID NO: 3198099 - DNA, 20 bp, Homo sapiens
aatgtatgtgtaagtattct

SEQ ID NO: 3198100 - DNA, 21 bp, Homo sapiens
aatgtatgttaccaaaaataa

SEQ ID NO: 3198101 - DNA, 16 bp, Homo sapiens
aatgtattataacttt

SEQ ID NO: 3198102 - DNA, 16 bp, Homo sapiens
aatgtattattctgca

SEQ ID NO: 3198103 - DNA, 13 bp, Homo sapiens
aatgtattcaaat

SEQ ID NO: 3198104 - DNA, 12 bp, Homo sapiens
aatgtattcaag

SEQ ID NO: 3198105 - DNA, 22 bp, Homo sapiens
aatgtatttatgtgtatatttg

SEQ ID NO: 3198106 - DNA, 13 bp, Homo sapiens
aatgtatttgttc

SEQ ID NO: 3198107 - DNA, 18 bp, Homo sapiens
aatgtcacaacctctctg

SEQ ID NO: 3198108 - DNA, 14 bp, Homo sapiens
aatgtcacaggcag

SEQ ID NO: 3198109 - DNA, 19 bp, Homo sapiens
aatgtcacgtactgtctga

SEQ ID NO: 3198110 - DNA, 19 bp, Homo sapiens
aatgtcatatactgccatg

SEQ ID NO: 3198111 - DNA, 23 bp, Homo sapiens
aatgtcatggccttgaaacagtt

SEQ ID NO: 3198112 - DNA, 18 bp, Homo sapiens
aatgtccatgatggaata

SEQ ID NO: 3198113 - DNA, 23 bp, Homo sapiens
aatgtcccccatcatgtggccca

SEQ ID NO: 3198114 - DNA, 16 bp, Homo sapiens
aatgtcccctcaaact

SEQ ID NO: 3198115 - DNA, 20 bp, Homo sapiens
aatgtcccctcaaactcatt

SEQ ID NO: 3198116 - DNA, 22 bp, Homo sapiens
aatgtcccctcaaactcattgc

SEQ ID NO: 3198117 - DNA, 21 bp, Homo sapiens
aatgtcctccagaagcctctg

SEQ ID NO: 3198118 - DNA, 15 bp, Homo sapiens
aatgtctaaatgctg

SEQ ID NO: 3198119 - DNA, 16 bp, Homo sapiens
aatgtctatagagaaa

SEQ ID NO: 3198120 - DNA, 21 bp, Homo sapiens
aatgtctcctttgctcttgcc

SEQ ID NO: 3198121 - DNA, 23 bp, Homo sapiens
aatgtctcctttgctcttgccaa

SEQ ID NO: 3198122 - DNA, 17 bp, Homo sapiens
aatgtctgttaacttaa

SEQ ID NO: 3198123 - DNA, 12 bp, Homo sapiens
aatgtcttcata

SEQ ID NO: 3198124 - DNA, 16 bp, Homo sapiens
aatgtgaaaaaaatta

SEQ ID NO: 3198125 - DNA, 20 bp, Homo sapiens
aatgtgaaaagtatcactct

SEQ ID NO: 3198126 - DNA, 17 bp, Homo sapiens
aatgtgaaatctcagaa

SEQ ID NO: 3198127 - DNA, 22 bp, Homo sapiens
aatgtgaacttgtagctgtaaa

SEQ ID NO: 3198128 - DNA, 17 bp, Homo sapiens
aatgtgaaggcccaaga

SEQ ID NO: 3198129 - DNA, 16 bp, Homo sapiens
aatgtgagtcccagag

SEQ ID NO: 3198130 - DNA, 17 bp, Homo sapiens
aatgtgatgatgtaatt

SEQ ID NO: 3198131 - DNA, 14 bp, Homo sapiens
aatgtgatgttcta

SEQ ID NO: 3198132 - DNA, 15 bp, Homo sapiens
aatgtgatgttctaa

SEQ ID NO: 3198133 - DNA, 16 bp, Homo sapiens
aatgtgatgttctaag

SEQ ID NO: 3198134 - DNA, 22 bp, Homo sapiens
aatgtgattctaatgtcttcat

SEQ ID NO: 3198135 - DNA, 17 bp, Homo sapiens
aatgtgcaatagaaggt

SEQ ID NO: 3198136 - DNA, 20 bp, Homo sapiens
aatgtgcagatgcaattgtt

SEQ ID NO: 3198137 - DNA, 19 bp, Homo sapiens
aatgtgcaggtttgttaca

SEQ ID NO: 3198138 - DNA, 22 bp, Homo sapiens
aatgtgcaggtttgttacatag

SEQ ID NO: 3198139 - DNA, 21 bp, Homo sapiens
aatgtgctgaatggttttcaa

SEQ ID NO: 3198140 - DNA, 18 bp, Homo sapiens
aatgtggccacttatttc

SEQ ID NO: 3198141 - DNA, 21 bp, Homo sapiens
aatgtggcccctgaacaagaa

SEQ ID NO: 3198142 - DNA, 16 bp, Homo sapiens
aatgtggcttgagaaa

SEQ ID NO: 3198143 - DNA, 18 bp, Homo sapiens
aatgtgggagcagcggtt

SEQ ID NO: 3198144 - DNA, 14 bp, Homo sapiens
aatgtgtacagtga

SEQ ID NO: 3198145 - DNA, 15 bp, Homo sapiens
aatgtgtacagtgaa

SEQ ID NO: 3198146 - DNA, 21 bp, Homo sapiens
aatgtgtacagtgaattgtct

SEQ ID NO: 3198147 - DNA, 12 bp, Homo sapiens
aatgtgtcattg

SEQ ID NO: 3198148 - DNA, 16 bp, Homo sapiens
aatgtgtggcctgcac

SEQ ID NO: 3198149 - DNA, 12 bp, Homo sapiens
aatgtgtgtatg

SEQ ID NO: 3198150 - DNA, 13 bp, Homo sapiens
aatgtgtgtatgt

SEQ ID NO: 3198151 - DNA, 15 bp, Homo sapiens
aatgtgttgaaactg

SEQ ID NO: 3198152 - DNA, 13 bp, Homo sapiens
aatgtgtttgctg

SEQ ID NO: 3198153 - DNA, 15 bp, Homo sapiens
aatgtgtttgctgcc

SEQ ID NO: 3198154 - DNA, 12 bp, Homo sapiens
aatgttaaattt

SEQ ID NO: 3198155 - DNA, 18 bp, Homo sapiens
aatgttaaatttgtaagt

SEQ ID NO: 3198156 - DNA, 22 bp, Homo sapiens
aatgttaaatttgtaagtttca

SEQ ID NO: 3198157 - DNA, 18 bp, Homo sapiens
aatgttaaggaaactctt

SEQ ID NO: 3198158 - DNA, 21 bp, Homo sapiens
aatgttaaggacttctgcagc

SEQ ID NO: 3198159 - DNA, 23 bp, Homo sapiens
aatgttaattcagcactgatttc

SEQ ID NO: 3198160 - DNA, 17 bp, Homo sapiens
aatgttagaggttttaa

SEQ ID NO: 3198161 - DNA, 14 bp, Homo sapiens
aatgttagatattg

SEQ ID NO: 3198162 - DNA, 17 bp, Homo sapiens
aatgttagatattgcta

SEQ ID NO: 3198163 - DNA, 16 bp, Homo sapiens
aatgttagtcattgtt

SEQ ID NO: 3198164 - DNA, 17 bp, Homo sapiens
aatgttatcttctcaag

SEQ ID NO: 3198165 - DNA, 22 bp, Homo sapiens
aatgttatcttctcaagttcta

SEQ ID NO: 3198166 - DNA, 14 bp, Homo sapiens
aatgttatttaaca

SEQ ID NO: 3198167 - DNA, 23 bp, Homo sapiens
aatgttatttgttattttcagta

SEQ ID NO: 3198168 - DNA, 19 bp, Homo sapiens
aatgttattttttaattat

SEQ ID NO: 3198169 - DNA, 20 bp, Homo sapiens
aatgttattttttaattatt

SEQ ID NO: 3198170 - DNA, 12 bp, Homo sapiens
aatgttcattgt

SEQ ID NO: 3198171 - DNA, 21 bp, Homo sapiens
aatgttcattgtaatgttact

SEQ ID NO: 3198172 - DNA, 13 bp, Homo sapiens
aatgttctaagtt

SEQ ID NO: 3198173 - DNA, 19 bp, Homo sapiens
aatgttctaagtttctaag

SEQ ID NO: 3198174 - DNA, 22 bp, Homo sapiens
aatgttctaagtttctaagatt

SEQ ID NO: 3198175 - DNA, 15 bp, Homo sapiens
aatgttctgacatta

SEQ ID NO: 3198176 - DNA, 17 bp, Homo sapiens
aatgttctgacattaac

SEQ ID NO: 3198177 - DNA, 19 bp, Homo sapiens
aatgttctgacattaacag

SEQ ID NO: 3198178 - DNA, 20 bp, Homo sapiens
aatgttctttggaaagtaca

SEQ ID NO: 3198179 - DNA, 12 bp, Homo sapiens
aatgttgagaag

SEQ ID NO: 3198180 - DNA, 20 bp, Homo sapiens
aatgttggacacctttaggt

SEQ ID NO: 3198181 - DNA, 13 bp, Homo sapiens
aatgttggtttac

SEQ ID NO: 3198182 - DNA, 21 bp, Homo sapiens
aatgttggtttactttcaaat

SEQ ID NO: 3198183 - DNA, 17 bp, Homo sapiens
aatgttgtattcagtga

SEQ ID NO: 3198184 - DNA, 14 bp, Homo sapiens
aatgtttaaatata

SEQ ID NO: 3198185 - DNA, 16 bp, Homo sapiens
aatgtttaaatcatgt

SEQ ID NO: 3198186 - DNA, 21 bp, Homo sapiens
aatgtttaaatcatgtatgtt

SEQ ID NO: 3198187 - DNA, 14 bp, Homo sapiens
aatgtttaagtatt

SEQ ID NO: 3198188 - DNA, 18 bp, Homo sapiens
aatgtttacaagtaaata

SEQ ID NO: 3198189 - DNA, 22 bp, Homo sapiens
aatgtttacagggagcctcctg

SEQ ID NO: 3198190 - DNA, 16 bp, Homo sapiens
aatgtttatactgtat

SEQ ID NO: 3198191 - DNA, 23 bp, Homo sapiens
aatgtttatactgtatttctaag

SEQ ID NO: 3198192 - DNA, 16 bp, Homo sapiens
aatgtttatgagccag

SEQ ID NO: 3198193 - DNA, 18 bp, Homo sapiens
aatgtttatgagccagac

SEQ ID NO: 3198194 - DNA, 16 bp, Homo sapiens
aatgtttattaaatgc

SEQ ID NO: 3198195 - DNA, 12 bp, Homo sapiens
aatgtttctatc

SEQ ID NO: 3198196 - DNA, 22 bp, Homo sapiens
aatgtttcttctaggttctaaa

SEQ ID NO: 3198197 - DNA, 13 bp, Homo sapiens
aatgtttcttttc

SEQ ID NO: 3198198 - DNA, 18 bp, Homo sapiens
aatgtttcttttccctta

SEQ ID NO: 3198199 - DNA, 21 bp, Homo sapiens
aatgtttgaggagcatgtttt

SEQ ID NO: 3198200 - DNA, 12 bp, Homo sapiens
aatgtttgctat

SEQ ID NO: 3198201 - DNA, 20 bp, Homo sapiens
aatgttttactgtgaaactg

SEQ ID NO: 3198202 - DNA, 16 bp, Homo sapiens
aatgttttcaaaaggt

SEQ ID NO: 3198203 - DNA, 15 bp, Homo sapiens
aatgttttcattatg

SEQ ID NO: 3198204 - DNA, 13 bp, Homo sapiens
aatgttttgtaca

SEQ ID NO: 3198205 - DNA, 15 bp, Homo sapiens
aatgttttgtatata

SEQ ID NO: 3198206 - DNA, 15 bp, Homo sapiens
aatgtttttctgcca

SEQ ID NO: 3198207 - DNA, 16 bp, Homo sapiens
aattaaaaaaaaattg

SEQ ID NO: 3198208 - DNA, 14 bp, Homo sapiens
aattaaaaattttt

SEQ ID NO: 3198209 - DNA, 22 bp, Homo sapiens
aattaaaacatatttcatttta

SEQ ID NO: 3198210 - DNA, 21 bp, Homo sapiens
aattaaaacgaaaataaagta

SEQ ID NO: 3198211 - DNA, 20 bp, Homo sapiens
aattaaaactcaacattact

SEQ ID NO: 3198212 - DNA, 17 bp, Homo sapiens
aattaaaattgtgcata

SEQ ID NO: 3198213 - DNA, 18 bp, Homo sapiens
aattaaaattgtgcataa

SEQ ID NO: 3198214 - DNA, 19 bp, Homo sapiens
aattaaaattgtgcataat

SEQ ID NO: 3198215 - DNA, 19 bp, Homo sapiens
aattaaacttttaattcat

SEQ ID NO: 3198216 - DNA, 18 bp, Homo sapiens
aattaaagtctattcaaa

SEQ ID NO: 3198217 - DNA, 20 bp, Homo sapiens
aattttcagtataatttaac

SEQ ID NO: 3198218 - DNA, 19 bp, Homo sapiens
aattttcctcaatcacact

SEQ ID NO: 3198219 - DNA, 15 bp, Homo sapiens
aattttctaaaagct

SEQ ID NO: 3198220 - DNA, 17 bp, Homo sapiens
aattttctcaaaagcat

SEQ ID NO: 3198221 - DNA, 23 bp, Homo sapiens
aattttctcaaaagcatttatca

SEQ ID NO: 3198222 - DNA, 17 bp, Homo sapiens
aattttctcattttctt

SEQ ID NO: 3198223 - DNA, 13 bp, Homo sapiens
aattttctccctt

SEQ ID NO: 3198224 - DNA, 22 bp, Homo sapiens
aattttctggaatacatgaaat

SEQ ID NO: 3198225 - DNA, 22 bp, Homo sapiens
aattttcttcatgcaatgacat

SEQ ID NO: 3198226 - DNA, 14 bp, Homo sapiens
aattttctttgttt

SEQ ID NO: 3198227 - DNA, 14 bp, Homo sapiens
aattttgaagtgct

SEQ ID NO: 3198228 - DNA, 17 bp, Homo sapiens
aattttgagttgccaca

SEQ ID NO: 3198229 - DNA, 19 bp, Homo sapiens
aattttgatatacattgtg

SEQ ID NO: 3198230 - DNA, 15 bp, Homo sapiens
aattttgcaaatata

SEQ ID NO: 3198231 - DNA, 16 bp, Homo sapiens
aattttgcaaatataa

SEQ ID NO: 3198232 - DNA, 11 bp, Homo sapiens
aattttgcata

SEQ ID NO: 3198233 - DNA, 19 bp, Homo sapiens
aattttgcatactgaaaat

SEQ ID NO: 3198234 - DNA, 17 bp, Homo sapiens
aattttggccaaagtgt

SEQ ID NO: 3198235 - DNA, 16 bp, Homo sapiens
aattttgtatgttaaa

SEQ ID NO: 3198236 - DNA, 20 bp, Homo sapiens
aattttgtgatgaataaaat

SEQ ID NO: 3198237 - DNA, 23 bp, Homo sapiens
aattttgtgatgaataaaataat

SEQ ID NO: 3198238 - DNA, 12 bp, Homo sapiens
aattttgtgttg

SEQ ID NO: 3198239 - DNA, 20 bp, Homo sapiens
aatttttaaaatacttgttt

SEQ ID NO: 3198240 - DNA, 17 bp, Homo sapiens
aatttttattaaattat

SEQ ID NO: 3198241 - DNA, 19 bp, Homo sapiens
aatttttcagatgcttctg

SEQ ID NO: 3198242 - DNA, 19 bp, Homo sapiens
aatttttggggaaaaaagc

SEQ ID NO: 3198243 - DNA, 21 bp, Homo sapiens
aatttttggggaaaaaagcac

SEQ ID NO: 3198244 - DNA, 22 bp, Homo sapiens
aatttttggggaaaaaagcaca

SEQ ID NO: 3198245 - DNA, 14 bp, Homo sapiens
aatttttgtaattt

SEQ ID NO: 3198246 - DNA, 20 bp, Homo sapiens
aattttttatcatgcatgtc

SEQ ID NO: 3198247 - DNA, 23 bp, Homo sapiens
aatttttttatgttttgtttctg

SEQ ID NO: 3198248 - DNA, 15 bp, Homo sapiens
aatttttttattact

SEQ ID NO: 3198249 - DNA, 17 bp, Homo sapiens
aattttttttaatgtac

SEQ ID NO: 3198250 - DNA, 18 bp, Homo sapiens
aattttttttgttttttg

SEQ ID NO: 3198251 - DNA, 20 bp, Homo sapiens
aatttttttttcatagagat

SEQ ID NO: 3198252 - DNA, 14 bp, Homo sapiens
aattttttttttcc

SEQ ID NO: 3198253 - DNA, 17 bp, Homo sapiens
acaaaaaaaaagtttta

SEQ ID NO: 3198254 - DNA, 19 bp, Homo sapiens
acaaaaaaaccacaaaggc

SEQ ID NO: 3198255 - DNA, 19 bp, Homo sapiens
acaaaaaaagttgaaggcc

SEQ ID NO: 3198256 - DNA, 17 bp, Homo sapiens
acaaaaaaatatattta

SEQ ID NO: 3198257 - DNA, 20 bp, Homo sapiens
acaaaaaaatatatttaatg

SEQ ID NO: 3198258 - DNA, 17 bp, Homo sapiens
acaaaaaacagattcta

SEQ ID NO: 3198259 - DNA, 13 bp, Homo sapiens
acaaaaacaggta

SEQ ID NO: 3198260 - DNA, 20 bp, Homo sapiens
acaaaaacaggtatatactt

SEQ ID NO: 3198261 - DNA, 15 bp, Homo sapiens
acaaaaagacaaaca

SEQ ID NO: 3198262 - DNA, 12 bp, Homo sapiens
acaaaaataaca

SEQ ID NO: 3198263 - DNA, 19 bp, Homo sapiens
acaaaaatgaactgaagtt

SEQ ID NO: 3198264 - DNA, 23 bp, Homo sapiens
acaaaaatgaactgaagtttcac

SEQ ID NO: 3198265 - DNA, 12 bp, Homo sapiens
acaaaaatggga

SEQ ID NO: 3198266 - DNA, 15 bp, Homo sapiens
acaaaaattgactca

SEQ ID NO: 3198267 - DNA, 17 bp, Homo sapiens
acaaaactacatgagaa

SEQ ID NO: 3198268 - DNA, 23 bp, Homo sapiens
acaaaactacatgagaacaaaca

SEQ ID NO: 3198269 - DNA, 11 bp, Homo sapiens
acaaaactgtt

SEQ ID NO: 3198270 - DNA, 22 bp, Homo sapiens
acaaaactgttcttttgcattt

SEQ ID NO: 3198271 - DNA, 11 bp, Homo sapiens
acaaaacttcc

SEQ ID NO: 3198272 - DNA, 13 bp, Homo sapiens
acaaaacttcttg

SEQ ID NO: 3198273 - DNA, 17 bp, Homo sapiens
acaaaacttcttgtcag

SEQ ID NO: 3198274 - DNA, 20 bp, Homo sapiens
acaaaacttcttgtcagaca

SEQ ID NO: 3198275 - DNA, 18 bp, Homo sapiens
acaaaagaaataccttga

SEQ ID NO: 3198276 - DNA, 22 bp, Homo sapiens
acaaaagagcatggatgcattt

SEQ ID NO: 3198277 - DNA, 13 bp, Homo sapiens
acaaaagatgaaa

SEQ ID NO: 3198278 - DNA, 15 bp, Homo sapiens
acaaaataaaactgt

SEQ ID NO: 3198279 - DNA, 12 bp, Homo sapiens
acaaaataaaca

SEQ ID NO: 3198280 - DNA, 18 bp, Homo sapiens
acaaaatagaagctgtag

SEQ ID NO: 3198281 - DNA, 14 bp, Homo sapiens
acaaaatccaactc

SEQ ID NO: 3198282 - DNA, 16 bp, Homo sapiens
acaaaatctaaaacaa

SEQ ID NO: 3198283 - DNA, 14 bp, Homo sapiens
acaaaatctgaact

SEQ ID NO: 3198284 - DNA, 16 bp, Homo sapiens
acaaaattatttgtaa

SEQ ID NO: 3198285 - DNA, 20 bp, Homo sapiens
acaaaatttgactaatttta

SEQ ID NO: 3198286 - DNA, 15 bp, Homo sapiens
acaaaattttgttta

SEQ ID NO: 3198287 - DNA, 23 bp, Homo sapiens
acaaaattttgtttaaaactcag

SEQ ID NO: 3198288 - DNA, 13 bp, Homo sapiens
acaaacaatgaaa

SEQ ID NO: 3198289 - DNA, 15 bp, Homo sapiens
acaaacacctcccag

SEQ ID NO: 3198290 - DNA, 16 bp, Homo sapiens
acaaacaggaatgtct

SEQ ID NO: 3198291 - DNA, 19 bp, Homo sapiens
acaaacattgtgttgacat

SEQ ID NO: 3198292 - DNA, 14 bp, Homo sapiens
acaaacatttttca

SEQ ID NO: 3198293 - DNA, 15 bp, Homo sapiens
acaaacatttttcaa

SEQ ID NO: 3198294 - DNA, 17 bp, Homo sapiens
acaaaccaacatctttg

SEQ ID NO: 3198295 - DNA, 19 bp, Homo sapiens
acaaaccacaactgacaca

SEQ ID NO: 3198296 - DNA, 12 bp, Homo sapiens
acaaactaaaaa

SEQ ID NO: 3198297 - DNA, 16 bp, Homo sapiens
acaaactaaatgtagt

SEQ ID NO: 3198298 - DNA, 15 bp, Homo sapiens
acaaactacctctgg

SEQ ID NO: 3198299 - DNA, 17 bp, Homo sapiens
acaaactacctctggac

SEQ ID NO: 3198300 - DNA, 10 bp, Homo sapiens
acaaactgca

SEQ ID NO: 3198301 - DNA, 11 bp, Homo sapiens
acaaactgcaa

SEQ ID NO: 3198302 - DNA, 17 bp, Homo sapiens
acaaactggtattctgt

SEQ ID NO: 3198303 - DNA, 13 bp, Homo sapiens
acaaactgtaaat

SEQ ID NO: 3198304 - DNA, 18 bp, Homo sapiens
acaaagaaacaaagatgt

SEQ ID NO: 3198305 - DNA, 18 bp, Homo sapiens
acaaagacaaaagtctgt

SEQ ID NO: 3198306 - DNA, 18 bp, Homo sapiens
acaaagattgagaagcca

SEQ ID NO: 3198307 - DNA, 21 bp, Homo sapiens
acaaagattttctaaggaatg

SEQ ID NO: 3198308 - DNA, 15 bp, Homo sapiens
acaaagcacagtgtt

SEQ ID NO: 3198309 - DNA, 16 bp, Homo sapiens
acaaagcacagtgtta

SEQ ID NO: 3198310 - DNA, 17 bp, Homo sapiens
acaaagcactagagaat

SEQ ID NO: 3198311 - DNA, 19 bp, Homo sapiens
acaaagccaaactctgcca

SEQ ID NO: 3198312 - DNA, 23 bp, Homo sapiens
acaaagccttatcaagtgtcttc

SEQ ID NO: 3198313 - DNA, 20 bp, Homo sapiens
acaaagcgagatcccatctc

SEQ ID NO: 3198314 - DNA, 17 bp, Homo sapiens
acaaagctgctaaatct

SEQ ID NO: 3198315 - DNA, 17 bp, Homo sapiens
acaaagctgttaaactg

SEQ ID NO: 3198316 - DNA, 21 bp, Homo sapiens
acaaagcttctatcccaggag

SEQ ID NO: 3198317 - DNA, 19 bp, Homo sapiens
acaaagctttgctacaaat

SEQ ID NO: 3198318 - DNA, 20 bp, Homo sapiens
acaaagctttgctacaaatt

SEQ ID NO: 3198319 - DNA, 22 bp, Homo sapiens
acaaagctttgctacaaattta

SEQ ID NO: 3198320 - DNA, 19 bp, Homo sapiens
acaaaggaagtgccccctc

SEQ ID NO: 3198321 - DNA, 21 bp, Homo sapiens
acaaaggatgaagaacacagc

SEQ ID NO: 3198322 - DNA, 14 bp, Homo sapiens
acaaaggccaaact

SEQ ID NO: 3198323 - DNA, 15 bp, Homo sapiens
acaaaggccaaactg

SEQ ID NO: 3198324 - DNA, 14 bp, Homo sapiens
acaaagtaaataca

SEQ ID NO: 3198325 - DNA, 15 bp, Homo sapiens
acaaagtaatttctt

SEQ ID NO: 3198326 - DNA, 20 bp, Homo sapiens
acaaagtaatttctttgatc

SEQ ID NO: 3198327 - DNA, 14 bp, Homo sapiens
acaaagtgtattca

SEQ ID NO: 3198328 - DNA, 15 bp, Homo sapiens
acaaatactcttagg

SEQ ID NO: 3198329 - DNA, 17 bp, Homo sapiens
acaaatactcttaggaa

SEQ ID NO: 3198330 - DNA, 13 bp, Homo sapiens
acaaatagaaaat

SEQ ID NO: 3198331 - DNA, 20 bp, Homo sapiens
acaaatagtgcaactatgaa

SEQ ID NO: 3198332 - DNA, 14 bp, Homo sapiens
acaaatataagatt

SEQ ID NO: 3198333 - DNA, 21 bp, Homo sapiens
acaaatatcttgtgttgtcct

SEQ ID NO: 3198334 - DNA, 22 bp, Homo sapiens
acaaatatcttgtgttgtcctt

SEQ ID NO: 3198335 - DNA, 12 bp, Homo sapiens
acaaatatgcaa

SEQ ID NO: 3198336 - DNA, 19 bp, Homo sapiens
acaaatatgcaaaaggttc

SEQ ID NO: 3198337 - DNA, 16 bp, Homo sapiens
acaaatatgctaattt

SEQ ID NO: 3198338 - DNA, 15 bp, Homo sapiens
acaaatattatttgt

SEQ ID NO: 3198339 - DNA, 22 bp, Homo sapiens
acaaatatttattttctttctg

SEQ ID NO: 3198340 - DNA, 23 bp, Homo sapiens
acaaatatttattttctttctgt

SEQ ID NO: 3198341 - DNA, 14 bp, Homo sapiens
acaaatattttcat

SEQ ID NO: 3198342 - DNA, 13 bp, Homo sapiens
acaaatcaaattg

SEQ ID NO: 3198343 - DNA, 19 bp, Homo sapiens
acaaatcaacagaagcatt

SEQ ID NO: 3198344 - DNA, 21 bp, Homo sapiens
acaaatcaacagaagcatttg

SEQ ID NO: 3198345 - DNA, 23 bp, Homo sapiens
acaaatcaacagaagcatttgta

SEQ ID NO: 3198346 - DNA, 20 bp, Homo sapiens
acaaatcagaagtcatcttg

SEQ ID NO: 3198347 - DNA, 22 bp, Homo sapiens
acaaatctaatctcttattcta

SEQ ID NO: 3198348 - DNA, 17 bp, Homo sapiens
acaaatctgtgtatatt

SEQ ID NO: 3198349 - DNA, 22 bp, Homo sapiens
acaaatgtattttgaagaatat

SEQ ID NO: 3198350 - DNA, 14 bp, Homo sapiens
acaaatgtgatttt

SEQ ID NO: 3198351 - DNA, 18 bp, Homo sapiens
acaaatgtgatttttgta

SEQ ID NO: 3198352 - DNA, 16 bp, Homo sapiens
acaaattaaaaagatt

SEQ ID NO: 3198353 - DNA, 22 bp, Homo sapiens
acaaattagaaaatgttattta

SEQ ID NO: 3198354 - DNA, 22 bp, Homo sapiens
acaaattatgttacatctgttt

SEQ ID NO: 3198355 - DNA, 14 bp, Homo sapiens
acaaattgaaaaca

SEQ ID NO: 3198356 - DNA, 11 bp, Homo sapiens
acaaatttatg

SEQ ID NO: 3198357 - DNA, 19 bp, Homo sapiens
acaaatttatgcatttcat

SEQ ID NO: 3198358 - DNA, 17 bp, Homo sapiens
acaaattttcaagttta

SEQ ID NO: 3198359 - DNA, 18 bp, Homo sapiens
acaaattttcaagtttac

SEQ ID NO: 3198360 - DNA, 13 bp, Homo sapiens
acaacaaaaggac

SEQ ID NO: 3198361 - DNA, 17 bp, Homo sapiens
acaacaatactacctca

SEQ ID NO: 3198362 - DNA, 15 bp, Homo sapiens
acaacaccttcctcc

SEQ ID NO: 3198363 - DNA, 22 bp, Homo sapiens
acaacaccttcctcctgcagac

SEQ ID NO: 3198364 - DNA, 15 bp, Homo sapiens
acaacacttcatttt

SEQ ID NO: 3198365 - DNA, 14 bp, Homo sapiens
acaacagaaaaaca

SEQ ID NO: 3198366 - DNA, 21 bp, Homo sapiens
acaacagaaaaacaatcttat

SEQ ID NO: 3198367 - DNA, 19 bp, Homo sapiens
acaacagaataaagcagcc

SEQ ID NO: 3198368 - DNA, 20 bp, Homo sapiens
acaacagaataaagcagcct

SEQ ID NO: 3198369 - DNA, 22 bp, Homo sapiens
acaacagaataaagcagcctga

SEQ ID NO: 3198370 - DNA, 15 bp, Homo sapiens
acaacagcagtctcc

SEQ ID NO: 3198371 - DNA, 20 bp, Homo sapiens
acaacagctcgatccaaatt

SEQ ID NO: 3198372 - DNA, 22 bp, Homo sapiens
acaacagtgctttgtaaattgt

SEQ ID NO: 3198373 - DNA, 13 bp, Homo sapiens
acaaccaaaacat

SEQ ID NO: 3198374 - DNA, 22 bp, Homo sapiens
acaaccaacttgttgtggctct

SEQ ID NO: 3198375 - DNA, 21 bp, Homo sapiens
acaaccaatttacactgccat

SEQ ID NO: 3198376 - DNA, 15 bp, Homo sapiens
acaaccatccctgcc

SEQ ID NO: 3198377 - DNA, 19 bp, Homo sapiens
acaaccatccctgccacat

SEQ ID NO: 3198378 - DNA, 15 bp, Homo sapiens
acaacctccctcttg

SEQ ID NO: 3198379 - DNA, 17 bp, Homo sapiens
acaacctccctcttgtt

SEQ ID NO: 3198380 - DNA, 17 bp, Homo sapiens
acaacgatgaatttctt

SEQ ID NO: 3198381 - DNA, 16 bp, Homo sapiens
acaacgtgagagaaag

SEQ ID NO: 3198382 - DNA, 19 bp, Homo sapiens
acaacgtgtatagtgccta

SEQ ID NO: 3198383 - DNA, 11 bp, Homo sapiens
acaactaaaat

SEQ ID NO: 3198384 - DNA, 15 bp, Homo sapiens
acaactaaaattagg

SEQ ID NO: 3198385 - DNA, 12 bp, Homo sapiens
acaactagattt

SEQ ID NO: 3198386 - DNA, 23 bp, Homo sapiens
acaactagatttgtccttttatt

SEQ ID NO: 3198387 - DNA, 14 bp, Homo sapiens
acaactcccttgca

SEQ ID NO: 3198388 - DNA, 15 bp, Homo sapiens
acaactcccttgcac

SEQ ID NO: 3198389 - DNA, 18 bp, Homo sapiens
acaactcttccatttatt

SEQ ID NO: 3198390 - DNA, 12 bp, Homo sapiens
acaactgacaca

SEQ ID NO: 3198391 - DNA, 21 bp, Homo sapiens
acaactgcaataacttctgac

SEQ ID NO: 3198392 - DNA, 17 bp, Homo sapiens
acaactgtctaacttta

SEQ ID NO: 3198393 - DNA, 19 bp, Homo sapiens
acaactgtctaactttaga

SEQ ID NO: 3198394 - DNA, 15 bp, Homo sapiens
acaacttaaataata

SEQ ID NO: 3198395 - DNA, 15 bp, Homo sapiens
acaacttaatggaaa

SEQ ID NO: 3198396 - DNA, 23 bp, Homo sapiens
acaacttatttaaaaatatttca

SEQ ID NO: 3198397 - DNA, 17 bp, Homo sapiens
acaacttcaatatccaa

SEQ ID NO: 3198398 - DNA, 14 bp, Homo sapiens
acaacttcagcagt

SEQ ID NO: 3198399 - DNA, 15 bp, Homo sapiens
acaacttggcatttc

SEQ ID NO: 3198400 - DNA, 16 bp, Homo sapiens
acaacttttaaagaaa

SEQ ID NO: 3198401 - DNA, 20 bp, Homo sapiens
acaacttttaaagaaaaata

SEQ ID NO: 3198402 - DNA, 15 bp, Homo sapiens
acaacttttaaccaa

SEQ ID NO: 3198403 - DNA, 12 bp, Homo sapiens
acaagaaaacat

SEQ ID NO: 3198404 - DNA, 14 bp, Homo sapiens
acaagaaccatttg

SEQ ID NO: 3198405 - DNA, 14 bp, Homo sapiens
acaagaagaagggc

SEQ ID NO: 3198406 - DNA, 19 bp, Homo sapiens
acaagaccaccacttcgaa

SEQ ID NO: 3198407 - DNA, 18 bp, Homo sapiens
acaagactgttgtgatct

SEQ ID NO: 3198408 - DNA, 20 bp, Homo sapiens
acaagagcagcctgtggcat

SEQ ID NO: 3198409 - DNA, 20 bp, Homo sapiens
acaagagcccagcagggcct

SEQ ID NO: 3198410 - DNA, 22 bp, Homo sapiens
acaagagcctgatctcttcctg

SEQ ID NO: 3198411 - DNA, 18 bp, Homo sapiens
acaagaggttaaggtggg

SEQ ID NO: 3198412 - DNA, 13 bp, Homo sapiens
acaagagtgaatt

SEQ ID NO: 3198413 - DNA, 14 bp, Homo sapiens
acaagataccaggc

SEQ ID NO: 3198414 - DNA, 17 bp, Homo sapiens
acaagatattgatgata

SEQ ID NO: 3198415 - DNA, 19 bp, Homo sapiens
acaagatccatttgccttt

SEQ ID NO: 3198416 - DNA, 16 bp, Homo sapiens
acaagatctttcagga

SEQ ID NO: 3198417 - DNA, 19 bp, Homo sapiens
acaagcaatgcaagaaaaa

SEQ ID NO: 3198418 - DNA, 16 bp, Homo sapiens
acaagcactattttat

SEQ ID NO: 3198419 - DNA, 14 bp, Homo sapiens
acaagccaacttgt

SEQ ID NO: 3198420 - DNA, 11 bp, Homo sapiens
acaagccctgg

SEQ ID NO: 3198421 - DNA, 13 bp, Homo sapiens
acaagccctggca

SEQ ID NO: 3198422 - DNA, 14 bp, Homo sapiens
acaagcctgagaac

SEQ ID NO: 3198423 - DNA, 17 bp, Homo sapiens
acaagcgtgagccactg

SEQ ID NO: 3198424 - DNA, 18 bp, Homo sapiens
acaagctgtccctgcagg

SEQ ID NO: 3198425 - DNA, 18 bp, Homo sapiens
acaagctgtgcaggcatg

SEQ ID NO: 3198426 - DNA, 14 bp, Homo sapiens
acaaggaataaatg

SEQ ID NO: 3198427 - DNA, 11 bp, Homo sapiens
acaaggaatgc

SEQ ID NO: 3198428 - DNA, 19 bp, Homo sapiens
acaaggaatgcctgtgcca

SEQ ID NO: 3198429 - DNA, 15 bp, Homo sapiens
acaaggaggtagaga

SEQ ID NO: 3198430 - DNA, 18 bp, Homo sapiens
acaaggctgaccaagaga

SEQ ID NO: 3198431 - DNA, 22 bp, Homo sapiens
acaaggctgaccaagagagaaa

SEQ ID NO: 3198432 - DNA, 14 bp, Homo sapiens
acaaggctggccag

SEQ ID NO: 3198433 - DNA, 19 bp, Homo sapiens
acaagggagagacctcatc

SEQ ID NO: 3198434 - DNA, 14 bp, Homo sapiens
acaagggattctgg

SEQ ID NO: 3198435 - DNA, 17 bp, Homo sapiens
acaagggattctgggaa

SEQ ID NO: 3198436 - DNA, 18 bp, Homo sapiens
acaagggattctgggaag

SEQ ID NO: 3198437 - DNA, 21 bp, Homo sapiens
acaaggggctgttacataaca

SEQ ID NO: 3198438 - DNA, 20 bp, Homo sapiens
acaaggtccactccctgctc

SEQ ID NO: 3198439 - DNA, 22 bp, Homo sapiens
acaaggtccactccctgctcca

SEQ ID NO: 3198440 - DNA, 17 bp, Homo sapiens
acaaggttggcacccca

SEQ ID NO: 3198441 - DNA, 15 bp, Homo sapiens
acaagtaatttcagt

SEQ ID NO: 3198442 - DNA, 22 bp, Homo sapiens
acaagtaccaaagttttatcaa

SEQ ID NO: 3198443 - DNA, 13 bp, Homo sapiens
acaagtacttttg

SEQ ID NO: 3198444 - DNA, 14 bp, Homo sapiens
acaagtataattac

SEQ ID NO: 3198445 - DNA, 19 bp, Homo sapiens
acaagtatacttatatttc

SEQ ID NO: 3198446 - DNA, 19 bp, Homo sapiens
acaagtatatgtgaaaaaa

SEQ ID NO: 3198447 - DNA, 22 bp, Homo sapiens
acaagtatgaatattactctca

SEQ ID NO: 3198448 - DNA, 23 bp, Homo sapiens
acaagtcataggttaatatttaa

SEQ ID NO: 3198449 - DNA, 21 bp, Homo sapiens
acaagtcattttaactttatc

SEQ ID NO: 3198450 - DNA, 23 bp, Homo sapiens
acaagtcattttaactttatcac

SEQ ID NO: 3198451 - DNA, 20 bp, Homo sapiens
acaagtcctggatgttgtgt

SEQ ID NO: 3198452 - DNA, 16 bp, Homo sapiens
acaagtcctgtgaatt

SEQ ID NO: 3198453 - DNA, 19 bp, Homo sapiens
acaagtcctgtgaatttct

SEQ ID NO: 3198454 - DNA, 16 bp, Homo sapiens
acaagtgaagaacact

SEQ ID NO: 3198455 - DNA, 15 bp, Homo sapiens
acaagttaaataaat

SEQ ID NO: 3198456 - DNA, 16 bp, Homo sapiens
acaagttccctggaga

SEQ ID NO: 3198457 - DNA, 17 bp, Homo sapiens
acaagttgttattgttg

SEQ ID NO: 3198458 - DNA, 13 bp, Homo sapiens
acaagtttcagac

SEQ ID NO: 3198459 - DNA, 15 bp, Homo sapiens
acaataaaacattat

SEQ ID NO: 3198460 - DNA, 20 bp, Homo sapiens
acaataaacaggaattttat

SEQ ID NO: 3198461 - DNA, 12 bp, Homo sapiens
acaataaactgg

SEQ ID NO: 3198462 - DNA, 14 bp, Homo sapiens
acaataaagagatt

SEQ ID NO: 3198463 - DNA, 16 bp, Homo sapiens
acaataaagtgacaaa

SEQ ID NO: 3198464 - DNA, 12 bp, Homo sapiens
acaataaatgta

SEQ ID NO: 3198465 - DNA, 22 bp, Homo sapiens
acacacctccgagacagtccag

SEQ ID NO: 3198466 - DNA, 15 bp, Homo sapiens
acacacgatgcattt

SEQ ID NO: 3198467 - DNA, 20 bp, Homo sapiens
acacacgatgcatttaataa

SEQ ID NO: 3198468 - DNA, 21 bp, Homo sapiens
acacccgtgagcgcctgtgca

SEQ ID NO: 3198469 - DNA, 14 bp, Homo sapiens
acaccctcccccgc

SEQ ID NO: 3198470 - DNA, 13 bp, Homo sapiens
acaccctgcaagg

SEQ ID NO: 3198471 - DNA, 23 bp, Homo sapiens
acaccctgcaaggcccacaggag

SEQ ID NO: 3198472 - DNA, 12 bp, Homo sapiens
acaccctgcccc

SEQ ID NO: 3198473 - DNA, 14 bp, Homo sapiens
acaccctggcctga

SEQ ID NO: 3198474 - DNA, 11 bp, Homo sapiens
acacccttcct

SEQ ID NO: 3198475 - DNA, 16 bp, Homo sapiens
acaccgactagccagg

SEQ ID NO: 3198476 - DNA, 16 bp, Homo sapiens
acaccgggcactcaga

SEQ ID NO: 3198477 - DNA, 19 bp, Homo sapiens
acaggaaaagctgctgaca

SEQ ID NO: 3198478 - DNA, 16 bp, Homo sapiens
acaggaaagccctccc

SEQ ID NO: 3198479 - DNA, 18 bp, Homo sapiens
acaggaaagccctccccc

SEQ ID NO: 3198480 - DNA, 16 bp, Homo sapiens
acaggaaagtgttatt

SEQ ID NO: 3198481 - DNA, 22 bp, Homo sapiens
acaggaacccttgcatccattg

SEQ ID NO: 3198482 - DNA, 20 bp, Homo sapiens
acaggaagcaccccatgcca

SEQ ID NO: 3198483 - DNA, 16 bp, Homo sapiens
acaggaatagatgtgg

SEQ ID NO: 3198484 - DNA, 14 bp, Homo sapiens
acaggaatgaagaa

SEQ ID NO: 3198485 - DNA, 20 bp, Homo sapiens
acaggacaaagggagggagc

SEQ ID NO: 3198486 - DNA, 15 bp, Homo sapiens
acaggacagagttca

SEQ ID NO: 3198487 - DNA, 20 bp, Homo sapiens
acaggacagagttcacagga

SEQ ID NO: 3198488 - DNA, 17 bp, Homo sapiens
acaggacagtgcttcag

SEQ ID NO: 3198489 - DNA, 16 bp, Homo sapiens
acaggaccctcaggaa

SEQ ID NO: 3198490 - DNA, 17 bp, Homo sapiens
acaggaccctcaggaat

SEQ ID NO: 3198491 - DNA, 14 bp, Homo sapiens
acaggactctgcct

SEQ ID NO: 3198492 - DNA, 15 bp, Homo sapiens
acaggactgaaaagg

SEQ ID NO: 3198493 - DNA, 14 bp, Homo sapiens
acaggagacactgt

SEQ ID NO: 3198494 - DNA, 17 bp, Homo sapiens
acaggagaggcagcatg

SEQ ID NO: 3198495 - DNA, 18 bp, Homo sapiens
acaggagaggcagcatgc

SEQ ID NO: 3198496 - DNA, 18 bp, Homo sapiens
acaggaggaggagatggc

SEQ ID NO: 3198497 - DNA, 16 bp, Homo sapiens
acaggaggattgcctg

SEQ ID NO: 3198498 - DNA, 19 bp, Homo sapiens
acaggaggcaagcaagctc

SEQ ID NO: 3198499 - DNA, 15 bp, Homo sapiens
acaggaggggtctca

SEQ ID NO: 3198500 - DNA, 16 bp, Homo sapiens
acaggaggtgtgaatg

SEQ ID NO: 3198501 - DNA, 17 bp, Homo sapiens
acaggaggtgtgaatgc

SEQ ID NO: 3198502 - DNA, 19 bp, Homo sapiens
acaggaggtgtgaatgcac

SEQ ID NO: 3198503 - DNA, 21 bp, Homo sapiens
acaggagtgtcctcttccctc

SEQ ID NO: 3198504 - DNA, 23 bp, Homo sapiens
acaggagtgtcctcttccctctc

SEQ ID NO: 3198505 - DNA, 18 bp, Homo sapiens
acaggatgacctggataa

SEQ ID NO: 3198506 - DNA, 20 bp, Homo sapiens
acaggatgccagcccctgcc

SEQ ID NO: 3198507 - DNA, 22 bp, Homo sapiens
acaggatgccagcccctgcctg

SEQ ID NO: 3198508 - DNA, 19 bp, Homo sapiens
acaggcaaaatccttgctt

SEQ ID NO: 3198509 - DNA, 14 bp, Homo sapiens
acaggcaaatgcat

SEQ ID NO: 3198510 - DNA, 14 bp, Homo sapiens
acaggcaatgctgg

SEQ ID NO: 3198511 - DNA, 14 bp, Homo sapiens
acaggcacccacca

SEQ ID NO: 3198512 - DNA, 12 bp, Homo sapiens
acaggcactcca

SEQ ID NO: 3198513 - DNA, 12 bp, Homo sapiens
acaggcactttg

SEQ ID NO: 3198514 - DNA, 22 bp, Homo sapiens
acaggcagcgatggtctcagaa

SEQ ID NO: 3198515 - DNA, 20 bp, Homo sapiens
acaggcaggccagatggccc

SEQ ID NO: 3198516 - DNA, 17 bp, Homo sapiens
acaggcagtgcatgtga

SEQ ID NO: 3198517 - DNA, 21 bp, Homo sapiens
acaggcagtgcatgtgaagca

SEQ ID NO: 3198518 - DNA, 21 bp, Homo sapiens
acaggcataaaatagagtaaa

SEQ ID NO: 3198519 - DNA, 14 bp, Homo sapiens
acaggcatgttctc

SEQ ID NO: 3198520 - DNA, 18 bp, Homo sapiens
acaggccatgtgagccac

SEQ ID NO: 3198521 - DNA, 22 bp, Homo sapiens
acaggcccaagagatgaagagt

SEQ ID NO: 3198522 - DNA, 11 bp, Homo sapiens
acaggcccagc

SEQ ID NO: 3198523 - DNA, 18 bp, Homo sapiens
acaggcccagcattgctg

SEQ ID NO: 3198524 - DNA, 23 bp, Homo sapiens
acaggcccagcattgctggttct

SEQ ID NO: 3198525 - DNA, 19 bp, Homo sapiens
acaggcccagcgcggccag

SEQ ID NO: 3198526 - DNA, 15 bp, Homo sapiens
acaggcccagggagg

SEQ ID NO: 3198527 - DNA, 12 bp, Homo sapiens
acaggccccctt

SEQ ID NO: 3198528 - DNA, 15 bp, Homo sapiens
acaggccctgctcct

SEQ ID NO: 3198529 - DNA, 20 bp, Homo sapiens
acaggccctgctcctgcagc

SEQ ID NO: 3198530 - DNA, 13 bp, Homo sapiens
acaggcccttcct

SEQ ID NO: 3198531 - DNA, 15 bp, Homo sapiens
acaggcctcacctct

SEQ ID NO: 3198532 - DNA, 16 bp, Homo sapiens
acaggcctccctgttt

SEQ ID NO: 3198533 - DNA, 19 bp, Homo sapiens
acaggcctctcttttcccc

SEQ ID NO: 3198534 - DNA, 14 bp, Homo sapiens
acaggcctgaagat

SEQ ID NO: 3198535 - DNA, 19 bp, Homo sapiens
acaggcgagagaggagcca

SEQ ID NO: 3198536 - DNA, 13 bp, Homo sapiens
acaggcgcctgcc

SEQ ID NO: 3198537 - DNA, 17 bp, Homo sapiens
acaggcgggaggaggtg

SEQ ID NO: 3198538 - DNA, 19 bp, Homo sapiens
acaggctcttagcagcttc

SEQ ID NO: 3198539 - DNA, 19 bp, Homo sapiens
acaggctgtaaattgaact

SEQ ID NO: 3198540 - DNA, 21 bp, Homo sapiens
acaggctgttctgcactgaaa

SEQ ID NO: 3198541 - DNA, 14 bp, Homo sapiens
acagggaagcatgt

SEQ ID NO: 3198542 - DNA, 23 bp, Homo sapiens
acagggagaaaatccaggtcatg

SEQ ID NO: 3198543 - DNA, 15 bp, Homo sapiens
acagggagcctcctg

SEQ ID NO: 3198544 - DNA, 17 bp, Homo sapiens
acagggagcctcctgcc

SEQ ID NO: 3198545 - DNA, 20 bp, Homo sapiens
acagggaggacgctctctgg

SEQ ID NO: 3198546 - DNA, 20 bp, Homo sapiens
acagggcacaccgggcactc

SEQ ID NO: 3198547 - DNA, 22 bp, Homo sapiens
acagggcacaccgggcactcag

SEQ ID NO: 3198548 - DNA, 16 bp, Homo sapiens
acagggcagagccggg

SEQ ID NO: 3198549 - DNA, 24 bp, Homo sapiens
acagggcatgccccggccacctct

SEQ ID NO: 3198550 - DNA, 15 bp, Homo sapiens
acagggccacataga

SEQ ID NO: 3198551 - DNA, 18 bp, Homo sapiens
acagggccagtggggcct

SEQ ID NO: 3198552 - DNA, 18 bp, Homo sapiens
acagggcccggccacacc

SEQ ID NO: 3198553 - DNA, 22 bp, Homo sapiens
acagggctctttgatggaccca

SEQ ID NO: 3198554 - DNA, 14 bp, Homo sapiens
acaggggcaggcct

SEQ ID NO: 3198555 - DNA, 22 bp, Homo sapiens
acaggggccccagatctgcctg

SEQ ID NO: 3198556 - DNA, 19 bp, Homo sapiens
acaggggcggggcaggaat

SEQ ID NO: 3198557 - DNA, 17 bp, Homo sapiens
acaggggtagtttgttt

SEQ ID NO: 3198558 - DNA, 18 bp, Homo sapiens
acagggtaactgtgctga

SEQ ID NO: 3198559 - DNA, 18 bp, Homo sapiens
acagggtccccgagtgcc

SEQ ID NO: 3198560 - DNA, 15 bp, Homo sapiens
acagggtctgctctt

SEQ ID NO: 3198561 - DNA, 24 bp, Homo sapiens
acagggtctgctctttctctgcca

SEQ ID NO: 3198562 - DNA, 14 bp, Homo sapiens
acagggttgggccc

SEQ ID NO: 3198563 - DNA, 15 bp, Homo sapiens
acagggtttcaccat

SEQ ID NO: 3198564 - DNA, 19 bp, Homo sapiens
acagggttttgccatgttg

SEQ ID NO: 3198565 - DNA, 15 bp, Homo sapiens
acaggtaaaacaggg

SEQ ID NO: 3198566 - DNA, 12 bp, Homo sapiens
acaggtcaataa

SEQ ID NO: 3198567 - DNA, 13 bp, Homo sapiens
acaggtccctccc

SEQ ID NO: 3198568 - DNA, 16 bp, Homo sapiens
acaggtcttcatcgaa

SEQ ID NO: 3198569 - DNA, 16 bp, Homo sapiens
acaggtgtggtgtaat

SEQ ID NO: 3198570 - DNA, 21 bp, Homo sapiens
acaggttcttaaaaaggaaca

SEQ ID NO: 3198571 - DNA, 15 bp, Homo sapiens
acaggttggaagaga

SEQ ID NO: 3198572 - DNA, 20 bp, Homo sapiens
acaggttggaagagaatcac

SEQ ID NO: 3198573 - DNA, 17 bp, Homo sapiens
acagtaacggtgtttag

SEQ ID NO: 3198574 - DNA, 15 bp, Homo sapiens
acagtaactttatgt

SEQ ID NO: 3198575 - DNA, 11 bp, Homo sapiens
acagtacaatc

SEQ ID NO: 3198576 - DNA, 19 bp, Homo sapiens
acagtacagcatgtgcctt

SEQ ID NO: 3198577 - DNA, 17 bp, Homo sapiens
acagtactttattgtac

SEQ ID NO: 3198578 - DNA, 20 bp, Homo sapiens
acagtactttattgtacaga

SEQ ID NO: 3198579 - DNA, 22 bp, Homo sapiens
acagtactttattgtacagact

SEQ ID NO: 3198580 - DNA, 13 bp, Homo sapiens
acagtagaactgt

SEQ ID NO: 3198581 - DNA, 14 bp, Homo sapiens
acagtagagccagc

SEQ ID NO: 3198582 - DNA, 16 bp, Homo sapiens
acagtagagccagctt

SEQ ID NO: 3198583 - DNA, 16 bp, Homo sapiens
acagtaggaattggaa

SEQ ID NO: 3198584 - DNA, 22 bp, Homo sapiens
acagtaggaattggaaataatt

SEQ ID NO: 3198585 - DNA, 19 bp, Homo sapiens
acagtagttgtattcttct

SEQ ID NO: 3198586 - DNA, 21 bp, Homo sapiens
acagtagttgtattcttctgt

SEQ ID NO: 3198587 - DNA, 15 bp, Homo sapiens
acagtatcccacatc

SEQ ID NO: 3198588 - DNA, 15 bp, Homo sapiens
acagtatcttttctt

SEQ ID NO: 3198589 - DNA, 19 bp, Homo sapiens
acagtatgagtcaatgtgc

SEQ ID NO: 3198590 - DNA, 23 bp, Homo sapiens
acagtatgtgggatattgaatgt

SEQ ID NO: 3198591 - DNA, 16 bp, Homo sapiens
acagtattacttctgc

SEQ ID NO: 3198592 - DNA, 14 bp, Homo sapiens
acagtattctgtac

SEQ ID NO: 3198593 - DNA, 17 bp, Homo sapiens
acagtattctgtaccat

SEQ ID NO: 3198594 - DNA, 19 bp, Homo sapiens
acagtattgaaaaattatc

SEQ ID NO: 3198595 - DNA, 15 bp, Homo sapiens
acagtatttcattgc

SEQ ID NO: 3198596 - DNA, 14 bp, Homo sapiens
acagtattttccca

SEQ ID NO: 3198597 - DNA, 24 bp, Homo sapiens
acagtattttgctagtgcatttca

SEQ ID NO: 3198598 - DNA, 18 bp, Homo sapiens
acagtcaaaacagagatg

SEQ ID NO: 3198599 - DNA, 16 bp, Homo sapiens
acagtcaaaataattc

SEQ ID NO: 3198600 - DNA, 16 bp, Homo sapiens
acagtcaaatttacat

SEQ ID NO: 3198601 - DNA, 20 bp, Homo sapiens
acagtcaaatttacatttat

SEQ ID NO: 3198602 - DNA, 22 bp, Homo sapiens
acagtcaaatttacatttatct

SEQ ID NO: 3198603 - DNA, 19 bp, Homo sapiens
acagtcactgccactttgc

SEQ ID NO: 3198604 - DNA, 17 bp, Homo sapiens
acagtcagcatgcttcc

SEQ ID NO: 3198605 - DNA, 20 bp, Homo sapiens
acagtcagcatgcttcccag

SEQ ID NO: 3198606 - DNA, 22 bp, Homo sapiens
acagtcagcatgcttcccagag

SEQ ID NO: 3198607 - DNA, 18 bp, Homo sapiens
acagtcatcatcagggcc

SEQ ID NO: 3198608 - DNA, 21 bp, Homo sapiens
acagtcattggaataaggcat

SEQ ID NO: 3198609 - DNA, 13 bp, Homo sapiens
acagtcatttaaa

SEQ ID NO: 3198610 - DNA, 14 bp, Homo sapiens
acagtccccagact

SEQ ID NO: 3198611 - DNA, 16 bp, Homo sapiens
acagtccccagactca

SEQ ID NO: 3198612 - DNA, 17 bp, Homo sapiens
acagtccctaaagaaaa

SEQ ID NO: 3198613 - DNA, 19 bp, Homo sapiens
acagtcctaactggtatag

SEQ ID NO: 3198614 - DNA, 23 bp, Homo sapiens
acagtcctgggagaacctcaggc

SEQ ID NO: 3198615 - DNA, 16 bp, Homo sapiens
acagtcggaaaagcgt

SEQ ID NO: 3198616 - DNA, 15 bp, Homo sapiens
acagtctctttcttc

SEQ ID NO: 3198617 - DNA, 18 bp, Homo sapiens
acagtctctttcttcctt

SEQ ID NO: 3198618 - DNA, 19 bp, Homo sapiens
acagtctctttcttccttt

SEQ ID NO: 3198619 - DNA, 22 bp, Homo sapiens
acagtctctttcttcctttcta

SEQ ID NO: 3198620 - DNA, 13 bp, Homo sapiens
acagtctgtcatg

SEQ ID NO: 3198621 - DNA, 20 bp, Homo sapiens
acagtctttgatcatcatgt

SEQ ID NO: 3198622 - DNA, 17 bp, Homo sapiens
acagtgaagatgtttac

SEQ ID NO: 3198623 - DNA, 23 bp, Homo sapiens
acagtgaagttttactgtctatt

SEQ ID NO: 3198624 - DNA, 13 bp, Homo sapiens
acagtgaatgtgt

SEQ ID NO: 3198625 - DNA, 18 bp, Homo sapiens
acagtgaattgtctttta

SEQ ID NO: 3198626 - DNA, 17 bp, Homo sapiens
acagtgacttggcccca

SEQ ID NO: 3198627 - DNA, 24 bp, Homo sapiens
acagtgatgctgtgctatgaattt

SEQ ID NO: 3198628 - DNA, 10 bp, Homo sapiens
acagtgattt

SEQ ID NO: 3198629 - DNA, 16 bp, Homo sapiens
acagtgcagaggctct

SEQ ID NO: 3198630 - DNA, 15 bp, Homo sapiens
acagtgccattgtct

SEQ ID NO: 3198631 - DNA, 17 bp, Homo sapiens
acagtgccattgtcttt

SEQ ID NO: 3198632 - DNA, 14 bp, Homo sapiens
acagtgccttgctc

SEQ ID NO: 3198633 - DNA, 15 bp, Homo sapiens
acagtgctcttttct

SEQ ID NO: 3198634 - DNA, 17 bp, Homo sapiens
acagtgctcttttctcc

SEQ ID NO: 3198635 - DNA, 20 bp, Homo sapiens
acagtgctgaccagacagcc

SEQ ID NO: 3198636 - DNA, 14 bp, Homo sapiens
acagtgcttcagcc

SEQ ID NO: 3198637 - DNA, 17 bp, Homo sapiens
acagtgcttcagcctga

SEQ ID NO: 3198638 - DNA, 18 bp, Homo sapiens
acagtgcttcagcctgag

SEQ ID NO: 3198639 - DNA, 20 bp, Homo sapiens
acagtgcttcagcctgaggc

SEQ ID NO: 3198640 - DNA, 18 bp, Homo sapiens
acagtggatcacaaagtg

SEQ ID NO: 3198641 - DNA, 15 bp, Homo sapiens
acagtgggagccctg

SEQ ID NO: 3198642 - DNA, 17 bp, Homo sapiens
acagtgggagctgagct

SEQ ID NO: 3198643 - DNA, 13 bp, Homo sapiens
acagtgggcatca

SEQ ID NO: 3198644 - DNA, 22 bp, Homo sapiens
acagtgggcgttgggagcctag

SEQ ID NO: 3198645 - DNA, 21 bp, Homo sapiens
acagtgggtggcacctcctga

SEQ ID NO: 3198646 - DNA, 14 bp, Homo sapiens
acagtggttcttat

SEQ ID NO: 3198647 - DNA, 18 bp, Homo sapiens
acagtggttttatactga

SEQ ID NO: 3198648 - DNA, 19 bp, Homo sapiens
acagtgtaatccaggggtg

SEQ ID NO: 3198649 - DNA, 16 bp, Homo sapiens
acagtgtctgtgccat

SEQ ID NO: 3198650 - DNA, 23 bp, Homo sapiens
acagtgtgtgaactgctttcaag

SEQ ID NO: 3198651 - DNA, 14 bp, Homo sapiens
acagtgttaaatga

SEQ ID NO: 3198652 - DNA, 16 bp, Homo sapiens
acagtgttattttctt

SEQ ID NO: 3198653 - DNA, 12 bp, Homo sapiens
acagtgttcatt

SEQ ID NO: 3198654 - DNA, 21 bp, Homo sapiens
acagtgttcatttgaaagagg

SEQ ID NO: 3198655 - DNA, 19 bp, Homo sapiens
acagtgttgaaaatgttca

SEQ ID NO: 3198656 - DNA, 16 bp, Homo sapiens
acagtgtttcccataa

SEQ ID NO: 3198657 - DNA, 18 bp, Homo sapiens
acagtgtttcccataatt

SEQ ID NO: 3198658 - DNA, 22 bp, Homo sapiens
acagtgtttcccataattttct

SEQ ID NO: 3198659 - DNA, 23 bp, Homo sapiens
acagtgtttcccataattttctt

SEQ ID NO: 3198660 - DNA, 14 bp, Homo sapiens
acagtgttttcaga

SEQ ID NO: 3198661 - DNA, 16 bp, Homo sapiens
acagtgttttcagaag

SEQ ID NO: 3198662 - DNA, 23 bp, Homo sapiens
acagttagggttttgcaataact

SEQ ID NO: 3198663 - DNA, 17 bp, Homo sapiens
acagttataaaattaaa

SEQ ID NO: 3198664 - DNA, 11 bp, Homo sapiens
acagttatatt

SEQ ID NO: 3198665 - DNA, 23 bp, Homo sapiens
acagttatatttttgtgttttct

SEQ ID NO: 3198666 - DNA, 14 bp, Homo sapiens
acagttattttgga

SEQ ID NO: 3198667 - DNA, 16 bp, Homo sapiens
acagttattttggata

SEQ ID NO: 3198668 - DNA, 21 bp, Homo sapiens
acagttattttggatatatta

SEQ ID NO: 3198669 - DNA, 16 bp, Homo sapiens
acagttcaagaaagct

SEQ ID NO: 3198670 - DNA, 20 bp, Homo sapiens
acagttcaattctcatttgt

SEQ ID NO: 3198671 - DNA, 18 bp, Homo sapiens
acagttcacaccctgcaa

SEQ ID NO: 3198672 - DNA, 13 bp, Homo sapiens
acagttcagtggc

SEQ ID NO: 3198673 - DNA, 20 bp, Homo sapiens
acagttcatgtttgcttcat

SEQ ID NO: 3198674 - DNA, 14 bp, Homo sapiens
acagttccatttat

SEQ ID NO: 3198675 - DNA, 22 bp, Homo sapiens
acagttccctttatttcacata

SEQ ID NO: 3198676 - DNA, 16 bp, Homo sapiens
acagttctgctctggt

SEQ ID NO: 3198677 - DNA, 22 bp, Homo sapiens
acagttctgtggtttcatgtta

SEQ ID NO: 3198678 - DNA, 19 bp, Homo sapiens
acagttcttggtgactgtc

SEQ ID NO: 3198679 - DNA, 22 bp, Homo sapiens
acagttcttggtgactgtccca

SEQ ID NO: 3198680 - DNA, 18 bp, Homo sapiens
acagttgagagagaatct

SEQ ID NO: 3198681 - DNA, 22 bp, Homo sapiens
acagttgcaggagcgtgaagga

SEQ ID NO: 3198682 - DNA, 21 bp, Homo sapiens
acagttgccaccacctctgtg

SEQ ID NO: 3198683 - DNA, 16 bp, Homo sapiens
acagttggccttcaga

SEQ ID NO: 3198684 - DNA, 14 bp, Homo sapiens
acagttggtaactt

SEQ ID NO: 3198685 - DNA, 20 bp, Homo sapiens
acagttgtctagagatatat

SEQ ID NO: 3198686 - DNA, 19 bp, Homo sapiens
acagttgtctattctgagc

SEQ ID NO: 3198687 - DNA, 22 bp, Homo sapiens
acagttgtctattctgagcctt

SEQ ID NO: 3198688 - DNA, 19 bp, Homo sapiens
acagtttaccagttgcctt

SEQ ID NO: 3198689 - DNA, 14 bp, Homo sapiens
acagtttcttagct

SEQ ID NO: 3198690 - DNA, 23 bp, Homo sapiens
acagtttcttgcttggaagccag

SEQ ID NO: 3198691 - DNA, 15 bp, Homo sapiens
acagtttgaacaaaa

SEQ ID NO: 3198692 - DNA, 20 bp, Homo sapiens
acagtttgatgtcattaatg

SEQ ID NO: 3198693 - DNA, 12 bp, Homo sapiens
acagtttgctgt

SEQ ID NO: 3198694 - DNA, 17 bp, Homo sapiens
acagttttaactgtgga

SEQ ID NO: 3198695 - DNA, 22 bp, Homo sapiens
acagttttagaataaggaggag

SEQ ID NO: 3198696 - DNA, 19 bp, Homo sapiens
acagttttatgctcttttt

SEQ ID NO: 3198697 - DNA, 19 bp, Homo sapiens
acagttttccatgaaaacg

SEQ ID NO: 3198698 - DNA, 13 bp, Homo sapiens
acagttttctagc

SEQ ID NO: 3198699 - DNA, 11 bp, Homo sapiens
acataaaacaa

SEQ ID NO: 3198700 - DNA, 16 bp, Homo sapiens
acataaaattttctag

SEQ ID NO: 3198701 - DNA, 16 bp, Homo sapiens
acataaaccatttttg

SEQ ID NO: 3198702 - DNA, 22 bp, Homo sapiens
acataaaccatttttgttactc

SEQ ID NO: 3198703 - DNA, 16 bp, Homo sapiens
acataaactgtcactc

SEQ ID NO: 3198704 - DNA, 14 bp, Homo sapiens
acataacaagaaaa

SEQ ID NO: 3198705 - DNA, 22 bp, Homo sapiens
acataacaccaaacttcatttt

SEQ ID NO: 3198706 - DNA, 22 bp, Homo sapiens
acataacctcagagtatcttta

SEQ ID NO: 3198707 - DNA, 16 bp, Homo sapiens
acataacgtttttcct

SEQ ID NO: 3198708 - DNA, 20 bp, Homo sapiens
acataacgtttttcctttaa

SEQ ID NO: 3198709 - DNA, 21 bp, Homo sapiens
acataacgtttttcctttaaa

SEQ ID NO: 3198710 - DNA, 23 bp, Homo sapiens
acataacgtttttcctttaaaaa

SEQ ID NO: 3198711 - DNA, 15 bp, Homo sapiens
acataagcttccatt

SEQ ID NO: 3198712 - DNA, 17 bp, Homo sapiens
acataagcttccatttt

SEQ ID NO: 3198713 - DNA, 20 bp, Homo sapiens
acataaggggtttgccattt

SEQ ID NO: 3198714 - DNA, 21 bp, Homo sapiens
acataaggggtttgccatttg

SEQ ID NO: 3198715 - DNA, 15 bp, Homo sapiens
acataataaatcaca

SEQ ID NO: 3198716 - DNA, 21 bp, Homo sapiens
acataataaatcacacattca

SEQ ID NO: 3198717 - DNA, 20 bp, Homo sapiens
acataatcagtatatttggt

SEQ ID NO: 3198718 - DNA, 19 bp, Homo sapiens
acataatctagtttacaga

SEQ ID NO: 3198719 - DNA, 22 bp, Homo sapiens
acataatctagtttacagaaaa

SEQ ID NO: 3198720 - DNA, 23 bp, Homo sapiens
acataatcttctgccttctcatg

SEQ ID NO: 3198721 - DNA, 18 bp, Homo sapiens
acataatgcttaatttct

SEQ ID NO: 3198722 - DNA, 19 bp, Homo sapiens
acataatgcttaatttcta

SEQ ID NO: 3198723 - DNA, 20 bp, Homo sapiens
acataatgtattgttggtaa

SEQ ID NO: 3198724 - DNA, 18 bp, Homo sapiens
acataatttagttgtttc

SEQ ID NO: 3198725 - DNA, 15 bp, Homo sapiens
acatacagagtgggc

SEQ ID NO: 3198726 - DNA, 12 bp, Homo sapiens
acatacagattt

SEQ ID NO: 3198727 - DNA, 20 bp, Homo sapiens
acatacaggaaggtagaaat

SEQ ID NO: 3198728 - DNA, 10 bp, Homo sapiens
acatacatta

SEQ ID NO: 3198729 - DNA, 14 bp, Homo sapiens
acatacattaaaac

SEQ ID NO: 3198730 - DNA, 17 bp, Homo sapiens
acatacattaaaactag

SEQ ID NO: 3198731 - DNA, 23 bp, Homo sapiens
acataccaccaccaagaaagcct

SEQ ID NO: 3198732 - DNA, 21 bp, Homo sapiens
acataccctggccgccccctg

SEQ ID NO: 3198733 - DNA, 20 bp, Homo sapiens
acatacggtcaggtttaaca

SEQ ID NO: 3198734 - DNA, 21 bp, Homo sapiens
acatacggtcaggtttaacat

SEQ ID NO: 3198735 - DNA, 13 bp, Homo sapiens
acatacgtgcaca

SEQ ID NO: 3198736 - DNA, 15 bp, Homo sapiens
acatacgtgcacagg

SEQ ID NO: 3198737 - DNA, 13 bp, Homo sapiens
acatactgcatgt

SEQ ID NO: 3198738 - DNA, 14 bp, Homo sapiens
acatactgcatgta

SEQ ID NO: 3198739 - DNA, 13 bp, Homo sapiens
acatacttttgca

SEQ ID NO: 3198740 - DNA, 16 bp, Homo sapiens
acatagactagagaaa

SEQ ID NO: 3198741 - DNA, 16 bp, Homo sapiens
acatagaggtatattg

SEQ ID NO: 3198742 - DNA, 20 bp, Homo sapiens
acatagaggtatattggaag

SEQ ID NO: 3198743 - DNA, 21 bp, Homo sapiens
acatagaggtatattggaaga

SEQ ID NO: 3198744 - DNA, 18 bp, Homo sapiens
acatagatattttcacaa

SEQ ID NO: 3198745 - DNA, 13 bp, Homo sapiens
acatagatgtccc

SEQ ID NO: 3198746 - DNA, 15 bp, Homo sapiens
acatagatgtccctt

SEQ ID NO: 3198747 - DNA, 22 bp, Homo sapiens
acatagcccatccctgcctggt

SEQ ID NO: 3198748 - DNA, 16 bp, Homo sapiens
acatagcccctgcccc

SEQ ID NO: 3198749 - DNA, 13 bp, Homo sapiens
acatagcctatat

SEQ ID NO: 3198750 - DNA, 23 bp, Homo sapiens
acatagcgccgtgctgtaaataa

SEQ ID NO: 3198751 - DNA, 19 bp, Homo sapiens
acatagctatcaagtgtgc

SEQ ID NO: 3198752 - DNA, 21 bp, Homo sapiens
acatagtaattcttaagtctt

SEQ ID NO: 3198753 - DNA, 22 bp, Homo sapiens
acatagtaattcttaagtcttt

SEQ ID NO: 3198754 - DNA, 13 bp, Homo sapiens
acatagtgacatg

SEQ ID NO: 3198755 - DNA, 16 bp, Homo sapiens
acatagtgatggttcc

SEQ ID NO: 3198756 - DNA, 17 bp, Homo sapiens
acatagttcgtttacct

SEQ ID NO: 3198757 - DNA, 23 bp, Homo sapiens
acatagttctccagttgtatgga

SEQ ID NO: 3198758 - DNA, 19 bp, Homo sapiens
acatagttttaaactcatt

SEQ ID NO: 3198759 - DNA, 23 bp, Homo sapiens
acatataatgttgttatttaaag

SEQ ID NO: 3198760 - DNA, 19 bp, Homo sapiens
acatatacctataatgtgt

SEQ ID NO: 3198761 - DNA, 16 bp, Homo sapiens
acatatagaatgcaga

SEQ ID NO: 3198762 - DNA, 16 bp, Homo sapiens
acatatctttattaat

SEQ ID NO: 3198763 - DNA, 19 bp, Homo sapiens
acatatctttattaatcac

SEQ ID NO: 3198764 - DNA, 21 bp, Homo sapiens
acatatgagtgtggaagccgg

SEQ ID NO: 3198765 - DNA, 22 bp, Homo sapiens
acatatgatttcactagaaaag

SEQ ID NO: 3198766 - DNA, 15 bp, Homo sapiens
acatatgcaccttgt

SEQ ID NO: 3198767 - DNA, 16 bp, Homo sapiens
acatatgcaccttgtg

SEQ ID NO: 3198768 - DNA, 19 bp, Homo sapiens
acatatgcaccttgtgtct

SEQ ID NO: 3198769 - DNA, 16 bp, Homo sapiens
acatatgtacataaat

SEQ ID NO: 3198770 - DNA, 16 bp, Homo sapiens
acatatgtagactata

SEQ ID NO: 3198771 - DNA, 20 bp, Homo sapiens
acatattactgttgcattta

SEQ ID NO: 3198772 - DNA, 19 bp, Homo sapiens
acatattgcaggagacatt

SEQ ID NO: 3198773 - DNA, 22 bp, Homo sapiens
acatattgcaggagacattttc

SEQ ID NO: 3198774 - DNA, 14 bp, Homo sapiens
acatcaaagcctgg

SEQ ID NO: 3198775 - DNA, 15 bp, Homo sapiens
acatcaaagcctggc

SEQ ID NO: 3198776 - DNA, 19 bp, Homo sapiens
acatcaaataaatttctgg

SEQ ID NO: 3198777 - DNA, 14 bp, Homo sapiens
acatcaaataagaa

SEQ ID NO: 3198778 - DNA, 18 bp, Homo sapiens
acatcaacatcttggtca

SEQ ID NO: 3198779 - DNA, 16 bp, Homo sapiens
acatcaagcttttctg

SEQ ID NO: 3198780 - DNA, 18 bp, Homo sapiens
acatcaagcttttctgta

SEQ ID NO: 3198781 - DNA, 13 bp, Homo sapiens
acatcaatgttca

SEQ ID NO: 3198782 - DNA, 12 bp, Homo sapiens
acatcaccagtc

SEQ ID NO: 3198783 - DNA, 22 bp, Homo sapiens
acatcactatccatgcaccaaa

SEQ ID NO: 3198784 - DNA, 16 bp, Homo sapiens
acatcactctgctgct

SEQ ID NO: 3198785 - DNA, 19 bp, Homo sapiens
acatcactctgctgcttag

SEQ ID NO: 3198786 - DNA, 14 bp, Homo sapiens
acatcactgcttga

SEQ ID NO: 3198787 - DNA, 15 bp, Homo sapiens
acatcacttgtacaa

SEQ ID NO: 3198788 - DNA, 19 bp, Homo sapiens
acatcacttgtacaaaata

SEQ ID NO: 3198789 - DNA, 16 bp, Homo sapiens
acatcagacctgtctt

SEQ ID NO: 3198790 - DNA, 21 bp, Homo sapiens
acatcagacctgtcttccaag

SEQ ID NO: 3198791 - DNA, 16 bp, Homo sapiens
acatcagcattgtctc

SEQ ID NO: 3198792 - DNA, 20 bp, Homo sapiens
acatcagtctccaacatgtt

SEQ ID NO: 3198793 - DNA, 13 bp, Homo sapiens
acatcagtttgat

SEQ ID NO: 3198794 - DNA, 14 bp, Homo sapiens
acatcataattaca

SEQ ID NO: 3198795 - DNA, 15 bp, Homo sapiens
acatcataattacat

SEQ ID NO: 3198796 - DNA, 19 bp, Homo sapiens
acatcataattacattcct

SEQ ID NO: 3198797 - DNA, 21 bp, Homo sapiens
acatcataattacattcctaa

SEQ ID NO: 3198798 - DNA, 16 bp, Homo sapiens
acatcatgttatttta

SEQ ID NO: 3198799 - DNA, 21 bp, Homo sapiens
acatccaaaatagttaagaca

SEQ ID NO: 3198800 - DNA, 16 bp, Homo sapiens
acatccaactccagca

SEQ ID NO: 3198801 - DNA, 13 bp, Homo sapiens
acatccaaggaga

SEQ ID NO: 3198802 - DNA, 20 bp, Homo sapiens
acatccaatattttctttaa

SEQ ID NO: 3198803 - DNA, 13 bp, Homo sapiens
acatcccagcagc

SEQ ID NO: 3198804 - DNA, 17 bp, Homo sapiens
acatcccagcagcccaa

SEQ ID NO: 3198805 - DNA, 16 bp, Homo sapiens
acatccccagaatcca

SEQ ID NO: 3198806 - DNA, 20 bp, Homo sapiens
acatcccttattagttacaa

SEQ ID NO: 3198807 - DNA, 21 bp, Homo sapiens
acatcccttattagttacaaa

SEQ ID NO: 3198808 - DNA, 21 bp, Homo sapiens
acatcccttcctggaaacagc

SEQ ID NO: 3198809 - DNA, 19 bp, Homo sapiens
acatccgtcattgctgctg

SEQ ID NO: 3198810 - DNA, 12 bp, Homo sapiens
acatcctgggta

SEQ ID NO: 3198811 - DNA, 13 bp, Homo sapiens
acatcctgggtaa

SEQ ID NO: 3198812 - DNA, 20 bp, Homo sapiens
acatcctttgcagggcagcc

SEQ ID NO: 3198813 - DNA, 19 bp, Homo sapiens
acatctattttggattgta

SEQ ID NO: 3198814 - DNA, 19 bp, Homo sapiens
acatctcaggggccagagg

SEQ ID NO: 3198815 - DNA, 21 bp, Homo sapiens
acatctcctccatactcagga

SEQ ID NO: 3198816 - DNA, 22 bp, Homo sapiens
acatctcctggctaagcctctg

SEQ ID NO: 3198817 - DNA, 12 bp, Homo sapiens
acatctctcccc

SEQ ID NO: 3198818 - DNA, 23 bp, Homo sapiens
acatctcttcctccgaggccagt

SEQ ID NO: 3198819 - DNA, 13 bp, Homo sapiens
acatcttcaaagc

SEQ ID NO: 3198820 - DNA, 16 bp, Homo sapiens
acatcttcagcaaata

SEQ ID NO: 3198821 - DNA, 23 bp, Homo sapiens
acatcttccctagagggttcctg

SEQ ID NO: 3198822 - DNA, 19 bp, Homo sapiens
acatcttgctctgctgaca

SEQ ID NO: 3198823 - DNA, 19 bp, Homo sapiens
acatcttggtcagatttga

SEQ ID NO: 3198824 - DNA, 15 bp, Homo sapiens
acatctttaagtatt

SEQ ID NO: 3198825 - DNA, 16 bp, Homo sapiens
acatctttattgaaat

SEQ ID NO: 3198826 - DNA, 18 bp, Homo sapiens
acatctttcctcaagtat

SEQ ID NO: 3198827 - DNA, 14 bp, Homo sapiens
acatgaaaatttta

SEQ ID NO: 3198828 - DNA, 16 bp, Homo sapiens
acatgaaaattttaaa

SEQ ID NO: 3198829 - DNA, 18 bp, Homo sapiens
acatgaaaattttaaaaa

SEQ ID NO: 3198830 - DNA, 15 bp, Homo sapiens
acatgaaataaagaa

SEQ ID NO: 3198831 - DNA, 19 bp, Homo sapiens
acatgaaataaagaattta

SEQ ID NO: 3198832 - DNA, 22 bp, Homo sapiens
acatgaaataaagaatttaaag

SEQ ID NO: 3198833 - DNA, 13 bp, Homo sapiens
acatgaaatgccc

SEQ ID NO: 3198834 - DNA, 19 bp, Homo sapiens
acatgaacacccttagaaa

SEQ ID NO: 3198835 - DNA, 16 bp, Homo sapiens
acatgaagaatgcatt

SEQ ID NO: 3198836 - DNA, 17 bp, Homo sapiens
acatgaagctgtataat

SEQ ID NO: 3198837 - DNA, 19 bp, Homo sapiens
acatgaagctgttgtgtga

SEQ ID NO: 3198838 - DNA, 15 bp, Homo sapiens
acatgacaactttgc

SEQ ID NO: 3198839 - DNA, 15 bp, Homo sapiens
acatgacactgacct

SEQ ID NO: 3198840 - DNA, 18 bp, Homo sapiens
acatgacgacaaagctgc

SEQ ID NO: 3198841 - DNA, 19 bp, Homo sapiens
acatgacgacaaagctgct

SEQ ID NO: 3198842 - DNA, 18 bp, Homo sapiens
acatgactgggcctccct

SEQ ID NO: 3198843 - DNA, 15 bp, Homo sapiens
acatgagaaagatgt

SEQ ID NO: 3198844 - DNA, 22 bp, Homo sapiens
acatgagctatttccattccag

SEQ ID NO: 3198845 - DNA, 22 bp, Homo sapiens
acatgaggccatctcaggagat

SEQ ID NO: 3198846 - DNA, 15 bp, Homo sapiens
acatgagttattcat

SEQ ID NO: 3198847 - DNA, 19 bp, Homo sapiens
acatgatcttctttataat

SEQ ID NO: 3198848 - DNA, 13 bp, Homo sapiens
acatgatttcaaa

SEQ ID NO: 3198849 - DNA, 23 bp, Homo sapiens
acatgatttccttgaatgtggct

SEQ ID NO: 3198850 - DNA, 18 bp, Homo sapiens
acatgcaaaaagaaatga

SEQ ID NO: 3198851 - DNA, 15 bp, Homo sapiens
acatgcaaggcactg

SEQ ID NO: 3198852 - DNA, 18 bp, Homo sapiens
acatgcaataaaatttaa

SEQ ID NO: 3198853 - DNA, 21 bp, Homo sapiens
acatgcaatttattaaaatga

SEQ ID NO: 3198854 - DNA, 13 bp, Homo sapiens
acatgcacgtgtg

SEQ ID NO: 3198855 - DNA, 14 bp, Homo sapiens
acatgcactgaccc

SEQ ID NO: 3198856 - DNA, 17 bp, Homo sapiens
acatgcagcccatgccc

SEQ ID NO: 3198857 - DNA, 21 bp, Homo sapiens
acatgcagtacttttgttgta

SEQ ID NO: 3198858 - DNA, 12 bp, Homo sapiens
acatgcattgtt

SEQ ID NO: 3198859 - DNA, 21 bp, Homo sapiens
acatgcatttgaggtcaagta

SEQ ID NO: 3198860 - DNA, 19 bp, Homo sapiens
acatgccacatcaaacctt

SEQ ID NO: 3198861 - DNA, 23 bp, Homo sapiens
acatgccagaaggaatcttctca

SEQ ID NO: 3198862 - DNA, 12 bp, Homo sapiens
acatgccccctg

SEQ ID NO: 3198863 - DNA, 14 bp, Homo sapiens
acatgccctcctgg

SEQ ID NO: 3198864 - DNA, 18 bp, Homo sapiens
acatgccctcctggacaa

SEQ ID NO: 3198865 - DNA, 15 bp, Homo sapiens
acatgctaaagccag

SEQ ID NO: 3198866 - DNA, 16 bp, Homo sapiens
acatgctaaagccagg

SEQ ID NO: 3198867 - DNA, 17 bp, Homo sapiens
acatgctaaatagttct

SEQ ID NO: 3198868 - DNA, 16 bp, Homo sapiens
acatgctcacctctag

SEQ ID NO: 3198869 - DNA, 17 bp, Homo sapiens
acatgctgtgctctttg

SEQ ID NO: 3198870 - DNA, 13 bp, Homo sapiens
acatgcttagctt

SEQ ID NO: 3198871 - DNA, 18 bp, Homo sapiens
acatgcttagcttatctt

SEQ ID NO: 3198872 - DNA, 19 bp, Homo sapiens
acatgcttagcttatcttt

SEQ ID NO: 3198873 - DNA, 22 bp, Homo sapiens
acatgcttagcttatctttctt

SEQ ID NO: 3198874 - DNA, 23 bp, Homo sapiens
acatgcttagcttatctttcttt

SEQ ID NO: 3198875 - DNA, 17 bp, Homo sapiens
acatggacttgtatatt

SEQ ID NO: 3198876 - DNA, 16 bp, Homo sapiens
acatggagactcctgc

SEQ ID NO: 3198877 - DNA, 17 bp, Homo sapiens
acatggagactcctgcc

SEQ ID NO: 3198878 - DNA, 15 bp, Homo sapiens
acatggaggttctaa

SEQ ID NO: 3198879 - DNA, 18 bp, Homo sapiens
acatggaggttctaaggc

SEQ ID NO: 3198880 - DNA, 15 bp, Homo sapiens
acatggccagtgtga

SEQ ID NO: 3198881 - DNA, 18 bp, Homo sapiens
acatggcctatgcacata

SEQ ID NO: 3198882 - DNA, 20 bp, Homo sapiens
acatggcctatgcacatatg

SEQ ID NO: 3198883 - DNA, 22 bp, Homo sapiens
acatgggaaaggaggcatgcct

SEQ ID NO: 3198884 - DNA, 14 bp, Homo sapiens
acatggtactcttg

SEQ ID NO: 3198885 - DNA, 16 bp, Homo sapiens
acatggtgcctgagag

SEQ ID NO: 3198886 - DNA, 19 bp, Homo sapiens
acatggtgcctgagaggca

SEQ ID NO: 3198887 - DNA, 16 bp, Homo sapiens
agaggcaagctgaaat

SEQ ID NO: 3198888 - DNA, 18 bp, Homo sapiens
agaggcaagctgaaattt

SEQ ID NO: 3198889 - DNA, 22 bp, Homo sapiens
agaggcaagctgaaattttaga

SEQ ID NO: 3198890 - DNA, 14 bp, Homo sapiens
agaggcagagagcg

SEQ ID NO: 3198891 - DNA, 15 bp, Homo sapiens
agaggcagagagcgg

SEQ ID NO: 3198892 - DNA, 13 bp, Homo sapiens
agaggcagagcct

SEQ ID NO: 3198893 - DNA, 20 bp, Homo sapiens
agaggcagagttctgtgaag

SEQ ID NO: 3198894 - DNA, 22 bp, Homo sapiens
agaggcagcatgcttgggctga

SEQ ID NO: 3198895 - DNA, 23 bp, Homo sapiens
agaggcagccccattctgcctgc

SEQ ID NO: 3198896 - DNA, 16 bp, Homo sapiens
agaggcagcccgcaca

SEQ ID NO: 3198897 - DNA, 17 bp, Homo sapiens
agaggcatcctgcctgg

SEQ ID NO: 3198898 - DNA, 19 bp, Homo sapiens
agaggcatcctgcctgggt

SEQ ID NO: 3198899 - DNA, 21 bp, Homo sapiens
agaggcatcctgcctgggtgg

SEQ ID NO: 3198900 - DNA, 23 bp, Homo sapiens
agaggcatcctgcctgggtggga

SEQ ID NO: 3198901 - DNA, 19 bp, Homo sapiens
agaggccatgggcctcctg

SEQ ID NO: 3198902 - DNA, 21 bp, Homo sapiens
agaggcccccagcccagggct

SEQ ID NO: 3198903 - DNA, 12 bp, Homo sapiens
agaggccctgga

SEQ ID NO: 3198904 - DNA, 21 bp, Homo sapiens
agaggccgaaggtgcctcaga

SEQ ID NO: 3198905 - DNA, 17 bp, Homo sapiens
agaggcctcatgcctgc

SEQ ID NO: 3198906 - DNA, 16 bp, Homo sapiens
agaggcctgctgccag

SEQ ID NO: 3198907 - DNA, 16 bp, Homo sapiens
agaggcctggagccca

SEQ ID NO: 3198908 - DNA, 12 bp, Homo sapiens
agaggcctgggg

SEQ ID NO: 3198909 - DNA, 14 bp, Homo sapiens
agaggcgggccagc

SEQ ID NO: 3198910 - DNA, 18 bp, Homo sapiens
agaggcgggccagccagg

SEQ ID NO: 3198911 - DNA, 14 bp, Homo sapiens
agaggctccccagg

SEQ ID NO: 3198912 - DNA, 15 bp, Homo sapiens
agaggctccccaggg

SEQ ID NO: 3198913 - DNA, 19 bp, Homo sapiens
agaggctgaaagaggccaa

SEQ ID NO: 3198914 - DNA, 13 bp, Homo sapiens
agaggctgaggac

SEQ ID NO: 3198915 - DNA, 14 bp, Homo sapiens
agaggctgaggcct

SEQ ID NO: 3198916 - DNA, 17 bp, Homo sapiens
agaggctgaggcctgga

SEQ ID NO: 3198917 - DNA, 12 bp, Homo sapiens
agaggctgcccc

SEQ ID NO: 3198918 - DNA, 20 bp, Homo sapiens
agaggctgcccctctcacca

SEQ ID NO: 3198919 - DNA, 18 bp, Homo sapiens
agaggctgggctgggtgg

SEQ ID NO: 3198920 - DNA, 14 bp, Homo sapiens
agaggctgggttca

SEQ ID NO: 3198921 - DNA, 22 bp, Homo sapiens
agaggcttatgagatctaatgt

SEQ ID NO: 3198922 - DNA, 12 bp, Homo sapiens
agaggcttctcc

SEQ ID NO: 3198923 - DNA, 16 bp, Homo sapiens
agaggcttctccgcca

SEQ ID NO: 3198924 - DNA, 19 bp, Homo sapiens
agagggaatgttccctgca

SEQ ID NO: 3198925 - DNA, 17 bp, Homo sapiens
agagggaccagggtggg

SEQ ID NO: 3198926 - DNA, 17 bp, Homo sapiens
agagggaccatgtgtca

SEQ ID NO: 3198927 - DNA, 19 bp, Homo sapiens
agagggagaagcatgaaaa

SEQ ID NO: 3198928 - DNA, 13 bp, Homo sapiens
agacatatctcta

SEQ ID NO: 3198929 - DNA, 14 bp, Homo sapiens
agacatcagtctcc

SEQ ID NO: 3198930 - DNA, 20 bp, Homo sapiens
agacatcatgaattttacat

SEQ ID NO: 3198931 - DNA, 21 bp, Homo sapiens
agacatccatgtttgtaaaac

SEQ ID NO: 3198932 - DNA, 22 bp, Homo sapiens
agacatctcaggatttcaccag

SEQ ID NO: 3198933 - DNA, 22 bp, Homo sapiens
agacatgatttccttgaatgtg

SEQ ID NO: 3198934 - DNA, 15 bp, Homo sapiens
agacatggaggttct

SEQ ID NO: 3198935 - DNA, 17 bp, Homo sapiens
agacatggaggttctaa

SEQ ID NO: 3198936 - DNA, 15 bp, Homo sapiens
agacatgtgacattt

SEQ ID NO: 3198937 - DNA, 19 bp, Homo sapiens
agacatgtgaggaggaaaa

SEQ ID NO: 3198938 - DNA, 15 bp, Homo sapiens
agacatgtgtcaaca

SEQ ID NO: 3198939 - DNA, 18 bp, Homo sapiens
agacatgttttccgtgaa

SEQ ID NO: 3198940 - DNA, 12 bp, Homo sapiens
agacattctgtc

SEQ ID NO: 3198941 - DNA, 10 bp, Homo sapiens
agacatttct

SEQ ID NO: 3198942 - DNA, 11 bp, Homo sapiens
agacatttgta

SEQ ID NO: 3198943 - DNA, 14 bp, Homo sapiens
agacatttgtatat

SEQ ID NO: 3198944 - DNA, 15 bp, Homo sapiens
agacatttgtatatt

SEQ ID NO: 3198945 - DNA, 12 bp, Homo sapiens
agacattttcat

SEQ ID NO: 3198946 - DNA, 13 bp, Homo sapiens
agacattttcatg

SEQ ID NO: 3198947 - DNA, 13 bp, Homo sapiens
agacatttttatt

SEQ ID NO: 3198948 - DNA, 17 bp, Homo sapiens
agacatttttatttagt

SEQ ID NO: 3198949 - DNA, 22 bp, Homo sapiens
agacatttttccgtttgctttt

SEQ ID NO: 3198950 - DNA, 13 bp, Homo sapiens
agaccaaaataaa

SEQ ID NO: 3198951 - DNA, 18 bp, Homo sapiens
agaccaaaatgacaatga

SEQ ID NO: 3198952 - DNA, 13 bp, Homo sapiens
agaccaaacttca

SEQ ID NO: 3198953 - DNA, 18 bp, Homo sapiens
agaccaacgttactcagg

SEQ ID NO: 3198954 - DNA, 17 bp, Homo sapiens
agaccaagactctgaaa

SEQ ID NO: 3198955 - DNA, 17 bp, Homo sapiens
agaccacagagctgtca

SEQ ID NO: 3198956 - DNA, 20 bp, Homo sapiens
agaccaccagccgccccagc

SEQ ID NO: 3198957 - DNA, 21 bp, Homo sapiens
agaccaccagccgccccagcc

SEQ ID NO: 3198958 - DNA, 21 bp, Homo sapiens
agaccacgcccgtcctgcctg

SEQ ID NO: 3198959 - DNA, 24 bp, Homo sapiens
agaccacgcccgtcctgcctgtgg

SEQ ID NO: 3198960 - DNA, 16 bp, Homo sapiens
agaccactgagtacca

SEQ ID NO: 3198961 - DNA, 22 bp, Homo sapiens
agaccactgagtaccaggggct

SEQ ID NO: 3198962 - DNA, 12 bp, Homo sapiens
agaccagaaatt

SEQ ID NO: 3198963 - DNA, 13 bp, Homo sapiens
agaccagcctggc

SEQ ID NO: 3198964 - DNA, 14 bp, Homo sapiens
agaccagcctggcc

SEQ ID NO: 3198965 - DNA, 16 bp, Homo sapiens
agaccaggctgtgtcc

SEQ ID NO: 3198966 - DNA, 14 bp, Homo sapiens
agaccagtctggcc

SEQ ID NO: 3198967 - DNA, 19 bp, Homo sapiens
agaccagttgggagcactg

SEQ ID NO: 3198968 - DNA, 21 bp, Homo sapiens
agaccagttgggagcactgga

SEQ ID NO: 3198969 - DNA, 21 bp, Homo sapiens
agaccatcctggccaacatga

SEQ ID NO: 3198970 - DNA, 22 bp, Homo sapiens
agaccatgaagtaaattatgta

SEQ ID NO: 3198971 - DNA, 18 bp, Homo sapiens
agaccatttaacatgcaa

SEQ ID NO: 3198972 - DNA, 21 bp, Homo sapiens
agacccaactcgcctgtggac

SEQ ID NO: 3198973 - DNA, 21 bp, Homo sapiens
agacccaccccacctgcaggg

SEQ ID NO: 3198974 - DNA, 12 bp, Homo sapiens
agacccaggtct

SEQ ID NO: 3198975 - DNA, 20 bp, Homo sapiens
agacccaggtcttccagacc

SEQ ID NO: 3198976 - DNA, 12 bp, Homo sapiens
agacccccaggc

SEQ ID NO: 3198977 - DNA, 14 bp, Homo sapiens
agacccccaggcct

SEQ ID NO: 3198978 - DNA, 17 bp, Homo sapiens
agaccccgcacccggct

SEQ ID NO: 3198979 - DNA, 18 bp, Homo sapiens
agacccctgcctggactt

SEQ ID NO: 3198980 - DNA, 13 bp, Homo sapiens
agacccctgtctc

SEQ ID NO: 3198981 - DNA, 23 bp, Homo sapiens
agacccctgtctttgctgagagc

SEQ ID NO: 3198982 - DNA, 14 bp, Homo sapiens
agacccggctgcgt

SEQ ID NO: 3198983 - DNA, 19 bp, Homo sapiens
agaccctcgggccccatcc

SEQ ID NO: 3198984 - DNA, 21 bp, Homo sapiens
agaccctctgccaccagagac

SEQ ID NO: 3198985 - DNA, 20 bp, Homo sapiens
agaccctcttgcccatcctg

SEQ ID NO: 3198986 - DNA, 13 bp, Homo sapiens
agaccctgagact

SEQ ID NO: 3198987 - DNA, 22 bp, Homo sapiens
agaccctgcaaacagaacaggg

SEQ ID NO: 3198988 - DNA, 19 bp, Homo sapiens
agaccctgggtgggctctg

SEQ ID NO: 3198989 - DNA, 18 bp, Homo sapiens
agaccgcttcacccctgc

SEQ ID NO: 3198990 - DNA, 20 bp, Homo sapiens
agaccgcttcacccctgcac

SEQ ID NO: 3198991 - DNA, 21 bp, Homo sapiens
agacctacattccctctcctg

SEQ ID NO: 3198992 - DNA, 23 bp, Homo sapiens
agacctacattccctctcctgcc

SEQ ID NO: 3198993 - DNA, 21 bp, Homo sapiens
agactcagccaagacaaggag

SEQ ID NO: 3198994 - DNA, 19 bp, Homo sapiens
agactcagcgctcctcctg

SEQ ID NO: 3198995 - DNA, 20 bp, Homo sapiens
agactcagcgctcctcctgt

SEQ ID NO: 3198996 - DNA, 23 bp, Homo sapiens
agactcagcgctcctcctgtgtg

SEQ ID NO: 3198997 - DNA, 23 bp, Homo sapiens
agactcagctggaagtctacctg

SEQ ID NO: 3198998 - DNA, 17 bp, Homo sapiens
agactcagtttgtcaga

SEQ ID NO: 3198999 - DNA, 17 bp, Homo sapiens
agactcattcttctgta

SEQ ID NO: 3199000 - DNA, 22 bp, Homo sapiens
agactccagaatctgctgttgc

SEQ ID NO: 3199001 - DNA, 14 bp, Homo sapiens
agactccggcctgt

SEQ ID NO: 3199002 - DNA, 15 bp, Homo sapiens
agactccggcctgta

SEQ ID NO: 3199003 - DNA, 16 bp, Homo sapiens
agactcctctgggcct

SEQ ID NO: 3199004 - DNA, 15 bp, Homo sapiens
agactcctgccctgt

SEQ ID NO: 3199005 - DNA, 17 bp, Homo sapiens
agactctacagaggcca

SEQ ID NO: 3199006 - DNA, 17 bp, Homo sapiens
agactctagagtccaag

SEQ ID NO: 3199007 - DNA, 21 bp, Homo sapiens
agactctagagtccaaggttt

SEQ ID NO: 3199008 - DNA, 17 bp, Homo sapiens
agactctaggttataca

SEQ ID NO: 3199009 - DNA, 19 bp, Homo sapiens
agactctaggttatacaat

SEQ ID NO: 3199010 - DNA, 15 bp, Homo sapiens
agactctattctcaa

SEQ ID NO: 3199011 - DNA, 20 bp, Homo sapiens
agactctcagcccagaagaa

SEQ ID NO: 3199012 - DNA, 16 bp, Homo sapiens
agactctgaaatctca

SEQ ID NO: 3199013 - DNA, 20 bp, Homo sapiens
agactctgaaatctcagaat

SEQ ID NO: 3199014 - DNA, 17 bp, Homo sapiens
agactctttagagcagc

SEQ ID NO: 3199015 - DNA, 21 bp, Homo sapiens
agactcttttccttccctttt

SEQ ID NO: 3199016 - DNA, 21 bp, Homo sapiens
agactgaaagcagcagctagg

SEQ ID NO: 3199017 - DNA, 14 bp, Homo sapiens
agactgaacatgtt

SEQ ID NO: 3199018 - DNA, 21 bp, Homo sapiens
agactgaatagatatgaaagc

SEQ ID NO: 3199019 - DNA, 22 bp, Homo sapiens
agactgaatagatatgaaagct

SEQ ID NO: 3199020 - DNA, 24 bp, Homo sapiens
agactgaatagatatgaaagctga

SEQ ID NO: 3199021 - DNA, 15 bp, Homo sapiens
agactgatgaagaaa

SEQ ID NO: 3199022 - DNA, 14 bp, Homo sapiens
agactgcagagggg

SEQ ID NO: 3199023 - DNA, 20 bp, Homo sapiens
agactgcgggatggtcctgg

SEQ ID NO: 3199024 - DNA, 23 bp, Homo sapiens
agactgcgggatggtcctggggc

SEQ ID NO: 3199025 - DNA, 15 bp, Homo sapiens
agactgctgggactg

SEQ ID NO: 3199026 - DNA, 20 bp, Homo sapiens
agactgctgggactggccag

SEQ ID NO: 3199027 - DNA, 19 bp, Homo sapiens
agactgcttccaattttct

SEQ ID NO: 3199028 - DNA, 22 bp, Homo sapiens
agactgcttcccatcctaccct

SEQ ID NO: 3199029 - DNA, 14 bp, Homo sapiens
agactggaaaaaat

SEQ ID NO: 3199030 - DNA, 17 bp, Homo sapiens
agactggaaaaaatgag

SEQ ID NO: 3199031 - DNA, 14 bp, Homo sapiens
agactggaagctaa

SEQ ID NO: 3199032 - DNA, 14 bp, Homo sapiens
agactggaagttca

SEQ ID NO: 3199033 - DNA, 15 bp, Homo sapiens
agactggcaataaac

SEQ ID NO: 3199034 - DNA, 13 bp, Homo sapiens
agactggcaggcg

SEQ ID NO: 3199035 - DNA, 13 bp, Homo sapiens
agactggccgggc

SEQ ID NO: 3199036 - DNA, 23 bp, Homo sapiens
agactgggaagataggctctgca

SEQ ID NO: 3199037 - DNA, 23 bp, Homo sapiens
agactggtctcgaactcctggcc

SEQ ID NO: 3199038 - DNA, 17 bp, Homo sapiens
agactgtaagatgttgt

SEQ ID NO: 3199039 - DNA, 15 bp, Homo sapiens
agactgtacaaagta

SEQ ID NO: 3199040 - DNA, 16 bp, Homo sapiens
agactgtacaaagtag

SEQ ID NO: 3199041 - DNA, 19 bp, Homo sapiens
agactgtactggccagtgt

SEQ ID NO: 3199042 - DNA, 23 bp, Homo sapiens
agactgtagatatgtattctttt

SEQ ID NO: 3199043 - DNA, 23 bp, Homo sapiens
agactgtagattgcttctgtagt

SEQ ID NO: 3199044 - DNA, 22 bp, Homo sapiens
agactgtaggaagagtagcatt

SEQ ID NO: 3199045 - DNA, 21 bp, Homo sapiens
agactgtcggagaggctgtct

SEQ ID NO: 3199046 - DNA, 22 bp, Homo sapiens
agactgtgaacttgactgggtg

SEQ ID NO: 3199047 - DNA, 17 bp, Homo sapiens
agactgtgattcagaaa

SEQ ID NO: 3199048 - DNA, 19 bp, Homo sapiens
agactgtggctagtgacaa

SEQ ID NO: 3199049 - DNA, 23 bp, Homo sapiens
agactgttgctcaaatctattca

SEQ ID NO: 3199050 - DNA, 15 bp, Homo sapiens
agactgtttttaagt

SEQ ID NO: 3199051 - DNA, 18 bp, Homo sapiens
agactgtttttaagtaac

SEQ ID NO: 3199052 - DNA, 20 bp, Homo sapiens
agacttattcttttataata

SEQ ID NO: 3199053 - DNA, 21 bp, Homo sapiens
agacttattcttttataataa

SEQ ID NO: 3199054 - DNA, 17 bp, Homo sapiens
agacttcaaaaataaaa

SEQ ID NO: 3199055 - DNA, 21 bp, Homo sapiens
agacttcaaaaggaatgaact

SEQ ID NO: 3199056 - DNA, 20 bp, Homo sapiens
agacttccaaacctgacaga

SEQ ID NO: 3199057 - DNA, 19 bp, Homo sapiens
agacttcccaacagcctta

SEQ ID NO: 3199058 - DNA, 15 bp, Homo sapiens
agacttcccagcttc

SEQ ID NO: 3199059 - DNA, 18 bp, Homo sapiens
agacttcccagcttctgc

SEQ ID NO: 3199060 - DNA, 14 bp, Homo sapiens
agacttccttgaga

SEQ ID NO: 3199061 - DNA, 20 bp, Homo sapiens
agacttcgactcaggatcca

SEQ ID NO: 3199062 - DNA, 22 bp, Homo sapiens
agagacacatacagagtgggcc

SEQ ID NO: 3199063 - DNA, 12 bp, Homo sapiens
agagacagaatg

SEQ ID NO: 3199064 - DNA, 17 bp, Homo sapiens
agagacagacttgagaa

SEQ ID NO: 3199065 - DNA, 19 bp, Homo sapiens
agagacagacttgagaact

SEQ ID NO: 3199066 - DNA, 16 bp, Homo sapiens
agagacagcccaggat

SEQ ID NO: 3199067 - DNA, 16 bp, Homo sapiens
agagacatggaagaga

SEQ ID NO: 3199068 - DNA, 15 bp, Homo sapiens
agagacccccaggcc

SEQ ID NO: 3199069 - DNA, 15 bp, Homo sapiens
agagaccgtcctcac

SEQ ID NO: 3199070 - DNA, 16 bp, Homo sapiens
agagacctacctcagg

SEQ ID NO: 3199071 - DNA, 17 bp, Homo sapiens
agagacctacctcaggt

SEQ ID NO: 3199072 - DNA, 13 bp, Homo sapiens
agagacggcagaa

SEQ ID NO: 3199073 - DNA, 19 bp, Homo sapiens
agagacggcagcctgacct

SEQ ID NO: 3199074 - DNA, 22 bp, Homo sapiens
agagactatggagcctggcaca

SEQ ID NO: 3199075 - DNA, 22 bp, Homo sapiens
agagactcagcgctcctcctgt

SEQ ID NO: 3199076 - DNA, 23 bp, Homo sapiens
agagactgaaagcagcagctagg

SEQ ID NO: 3199077 - DNA, 20 bp, Homo sapiens
agagactgagcagccgccag

SEQ ID NO: 3199078 - DNA, 15 bp, Homo sapiens
agagactgcgttctg

SEQ ID NO: 3199079 - DNA, 18 bp, Homo sapiens
agagactgcgttctgcaa

SEQ ID NO: 3199080 - DNA, 23 bp, Homo sapiens
agagactgggaagataggctctg

SEQ ID NO: 3199081 - DNA, 22 bp, Homo sapiens
agagactgggagccacttctcc

SEQ ID NO: 3199082 - DNA, 22 bp, Homo sapiens
agagactgtagattgcttctgt

SEQ ID NO: 3199083 - DNA, 16 bp, Homo sapiens
agagacttaaaggaca

SEQ ID NO: 3199084 - DNA, 18 bp, Homo sapiens
agagacttaaaggacagg

SEQ ID NO: 3199085 - DNA, 13 bp, Homo sapiens
agagagaaaaaaa

SEQ ID NO: 3199086 - DNA, 21 bp, Homo sapiens
agagagaaagaagtaggcatg

SEQ ID NO: 3199087 - DNA, 14 bp, Homo sapiens
agagagaaagccag

SEQ ID NO: 3199088 - DNA, 14 bp, Homo sapiens
agagagaaattctg

SEQ ID NO: 3199089 - DNA, 20 bp, Homo sapiens
agagagaacaactactgtga

SEQ ID NO: 3199090 - DNA, 18 bp, Homo sapiens
agagagaagccagccaca

SEQ ID NO: 3199091 - DNA, 21 bp, Homo sapiens
agagagaatctcaagattcta

SEQ ID NO: 3199092 - DNA, 14 bp, Homo sapiens
agagagacaagaag

SEQ ID NO: 3199093 - DNA, 19 bp, Homo sapiens
agagagaccccgcacccgg

SEQ ID NO: 3199094 - DNA, 14 bp, Homo sapiens
agagagactgtgtg

SEQ ID NO: 3199095 - DNA, 12 bp, Homo sapiens
agagagagagaa

SEQ ID NO: 3199096 - DNA, 15 bp, Homo sapiens
agagagagagagagg

SEQ ID NO: 3199097 - DNA, 14 bp, Homo sapiens
agagagagaggaca

SEQ ID NO: 3199098 - DNA, 15 bp, Homo sapiens
agagagagaggacag

SEQ ID NO: 3199099 - DNA, 21 bp, Homo sapiens
agagagagccatgaagcatta

SEQ ID NO: 3199100 - DNA, 13 bp, Homo sapiens
agagagaggaggc

SEQ ID NO: 3199101 - DNA, 12 bp, Homo sapiens
agagagccagga

SEQ ID NO: 3199102 - DNA, 16 bp, Homo sapiens
agagagccaggatgcc

SEQ ID NO: 3199103 - DNA, 17 bp, Homo sapiens
agagagccattttgtga

SEQ ID NO: 3199104 - DNA, 23 bp, Homo sapiens
agagagccttggttcatcagtgt

SEQ ID NO: 3199105 - DNA, 21 bp, Homo sapiens
agagagcggtctcaggctggt

SEQ ID NO: 3199106 - DNA, 13 bp, Homo sapiens
agagaggacagct

SEQ ID NO: 3199107 - DNA, 16 bp, Homo sapiens
agagaggagaaacaca

SEQ ID NO: 3199108 - DNA, 13 bp, Homo sapiens
agagaggagagga

SEQ ID NO: 3199109 - DNA, 13 bp, Homo sapiens
agagaggagcacc

SEQ ID NO: 3199110 - DNA, 13 bp, Homo sapiens
agagaggaggcag

SEQ ID NO: 3199111 - DNA, 19 bp, Homo sapiens
agagaggatgtgcaagcga

SEQ ID NO: 3199112 - DNA, 23 bp, Homo sapiens
agagaggatgtggaaagcacttt

SEQ ID NO: 3199113 - DNA, 13 bp, Homo sapiens
agagaggcagaga

SEQ ID NO: 3199114 - DNA, 14 bp, Homo sapiens
agagaggccttttg

SEQ ID NO: 3199115 - DNA, 14 bp, Homo sapiens
agagagggcccagc

SEQ ID NO: 3199116 - DNA, 23 bp, Homo sapiens
agagagggtggtgacctctgcct

SEQ ID NO: 3199117 - DNA, 20 bp, Homo sapiens
agagaggttatagagtagaa

SEQ ID NO: 3199118 - DNA, 20 bp, Homo sapiens
agagagtcccactgcctcag

SEQ ID NO: 3199119 - DNA, 14 bp, Homo sapiens
agagagtggctcct

SEQ ID NO: 3199120 - DNA, 18 bp, Homo sapiens
agagatattgatattgaa

SEQ ID NO: 3199121 - DNA, 22 bp, Homo sapiens
agagatcaaccccttcgctcct

SEQ ID NO: 3199122 - DNA, 22 bp, Homo sapiens
agagatcccttaagaagttaga

SEQ ID NO: 3199123 - DNA, 19 bp, Homo sapiens
agagatctttctttccaaa

SEQ ID NO: 3199124 - DNA, 18 bp, Homo sapiens
agagatgccagcccttca

SEQ ID NO: 3199125 - DNA, 21 bp, Homo sapiens
agagatgctgtaacttaaaat

SEQ ID NO: 3199126 - DNA, 17 bp, Homo sapiens
agagatgtcatcagagc

SEQ ID NO: 3199127 - DNA, 21 bp, Homo sapiens
agagatgtgcaattgatttct

SEQ ID NO: 3199128 - DNA, 19 bp, Homo sapiens
agagatgtggcaaagtgct

SEQ ID NO: 3199129 - DNA, 18 bp, Homo sapiens
agagatttcaacaagaat

SEQ ID NO: 3199130 - DNA, 12 bp, Homo sapiens
agagatttctca

SEQ ID NO: 3199131 - DNA, 14 bp, Homo sapiens
agagatttgtctaa

SEQ ID NO: 3199132 - DNA, 15 bp, Homo sapiens
agagcaacccctgta

SEQ ID NO: 3199133 - DNA, 21 bp, Homo sapiens
agagcaacccctgtacccagc

SEQ ID NO: 3199134 - DNA, 17 bp, Homo sapiens
agagcaacctctcactc

SEQ ID NO: 3199135 - DNA, 14 bp, Homo sapiens
agagcaactctgag

SEQ ID NO: 3199136 - DNA, 21 bp, Homo sapiens
agagcaagaaggaaagatttg

SEQ ID NO: 3199137 - DNA, 14 bp, Homo sapiens
agagcaagactctg

SEQ ID NO: 3199138 - DNA, 14 bp, Homo sapiens
acttagaggaaaat

SEQ ID NO: 3199139 - DNA, 19 bp, Homo sapiens
acttagaggcaacaggatt

SEQ ID NO: 3199140 - DNA, 22 bp, Homo sapiens
acttagaggcaacaggattgat

SEQ ID NO: 3199141 - DNA, 15 bp, Homo sapiens
acttagcatgcacaa

SEQ ID NO: 3199142 - DNA, 23 bp, Homo sapiens
acttagcatgcacaaagtgtatt

SEQ ID NO: 3199143 - DNA, 12 bp, Homo sapiens
acttagccagag

SEQ ID NO: 3199144 - DNA, 18 bp, Homo sapiens
acttagccagttcaaagt

SEQ ID NO: 3199145 - DNA, 22 bp, Homo sapiens
acttagcccaagaggtctgagc

SEQ ID NO: 3199146 - DNA, 23 bp, Homo sapiens
acttagcccaagaggtctgagcc

SEQ ID NO: 3199147 - DNA, 23 bp, Homo sapiens
acttagccgcaccctgcacctgc

SEQ ID NO: 3199148 - DNA, 23 bp, Homo sapiens
acttagccgtccatggcaccagc

SEQ ID NO: 3199149 - DNA, 17 bp, Homo sapiens
acttagcctttacctgt

SEQ ID NO: 3199150 - DNA, 18 bp, Homo sapiens
acttaggcatgcacagct

SEQ ID NO: 3199151 - DNA, 18 bp, Homo sapiens
acttaggccctagcggca

SEQ ID NO: 3199152 - DNA, 23 bp, Homo sapiens
acttagggcaccaggggtttctc

SEQ ID NO: 3199153 - DNA, 16 bp, Homo sapiens
acttagtaacttttta

SEQ ID NO: 3199154 - DNA, 20 bp, Homo sapiens
acttagtgatcatttaaaaa

SEQ ID NO: 3199155 - DNA, 16 bp, Homo sapiens
acttagtggtatgtct

SEQ ID NO: 3199156 - DNA, 19 bp, Homo sapiens
acttagtggtatgtctctt

SEQ ID NO: 3199157 - DNA, 20 bp, Homo sapiens
acttagtggtatgtctcttt

SEQ ID NO: 3199158 - DNA, 18 bp, Homo sapiens
acttataaagaaggttgg

SEQ ID NO: 3199159 - DNA, 15 bp, Homo sapiens
acttatattttcgta

SEQ ID NO: 3199160 - DNA, 21 bp, Homo sapiens
acttatattttcgtatgaaaa

SEQ ID NO: 3199161 - DNA, 23 bp, Homo sapiens
acttatattttcgtatgaaaatg

SEQ ID NO: 3199162 - DNA, 19 bp, Homo sapiens
acttatatttttaataaaa

SEQ ID NO: 3199163 - DNA, 20 bp, Homo sapiens
acttatcagctacttaagag

SEQ ID NO: 3199164 - DNA, 18 bp, Homo sapiens
acttatcctaaaacaaat

SEQ ID NO: 3199165 - DNA, 14 bp, Homo sapiens
acttatcttctgga

SEQ ID NO: 3199166 - DNA, 23 bp, Homo sapiens
acttatgacctcttcctttagga

SEQ ID NO: 3199167 - DNA, 15 bp, Homo sapiens
acttatgtacttgat

SEQ ID NO: 3199168 - DNA, 23 bp, Homo sapiens
acttatgttactggtgtccagct

SEQ ID NO: 3199169 - DNA, 16 bp, Homo sapiens
acttatgtttttaaat

SEQ ID NO: 3199170 - DNA, 21 bp, Homo sapiens
acttattaagttcgaacatgt

SEQ ID NO: 3199171 - DNA, 13 bp, Homo sapiens
acttattacaatt

SEQ ID NO: 3199172 - DNA, 16 bp, Homo sapiens
acttattacaatttgt

SEQ ID NO: 3199173 - DNA, 13 bp, Homo sapiens
acttattagaaac

SEQ ID NO: 3199174 - DNA, 14 bp, Homo sapiens
acttattagaaacc

SEQ ID NO: 3199175 - DNA, 21 bp, Homo sapiens
acttattccctcatcctttca

SEQ ID NO: 3199176 - DNA, 20 bp, Homo sapiens
acttattcttttataataat

SEQ ID NO: 3199177 - DNA, 20 bp, Homo sapiens
acttatttaaaaatatttca

SEQ ID NO: 3199178 - DNA, 21 bp, Homo sapiens
acttatttaaaaatatttcag

SEQ ID NO: 3199179 - DNA, 11 bp, Homo sapiens
acttatttcac

SEQ ID NO: 3199180 - DNA, 20 bp, Homo sapiens
acttatttcactatcttctt

SEQ ID NO: 3199181 - DNA, 11 bp, Homo sapiens
acttatttctg

SEQ ID NO: 3199182 - DNA, 15 bp, Homo sapiens
acttatttcttcaaa

SEQ ID NO: 3199183 - DNA, 16 bp, Homo sapiens
acttatttcttcaaat

SEQ ID NO: 3199184 - DNA, 17 bp, Homo sapiens
acttattttatttccat

SEQ ID NO: 3199185 - DNA, 23 bp, Homo sapiens
acttattttgtcttattcttaag

SEQ ID NO: 3199186 - DNA, 14 bp, Homo sapiens
acttatttttgaca

SEQ ID NO: 3199187 - DNA, 20 bp, Homo sapiens
acttcaaaaactaaaatcat

SEQ ID NO: 3199188 - DNA, 22 bp, Homo sapiens
acttcaaaaataaaaaatctga

SEQ ID NO: 3199189 - DNA, 16 bp, Homo sapiens
acttcaaaaataatgt

SEQ ID NO: 3199190 - DNA, 15 bp, Homo sapiens
acttcaaaagccata

SEQ ID NO: 3199191 - DNA, 16 bp, Homo sapiens
acttcaaagctgaata

SEQ ID NO: 3199192 - DNA, 17 bp, Homo sapiens
acttcaaagctgaatat

SEQ ID NO: 3199193 - DNA, 18 bp, Homo sapiens
acttcaaagctgaatatt

SEQ ID NO: 3199194 - DNA, 22 bp, Homo sapiens
acttcaagcagaatcctcagtt

SEQ ID NO: 3199195 - DNA, 18 bp, Homo sapiens
acttcaagggagaatata

SEQ ID NO: 3199196 - DNA, 23 bp, Homo sapiens
acttcaaggtgacagaaggacca

SEQ ID NO: 3199197 - DNA, 14 bp, Homo sapiens
acttcaattaatgc

SEQ ID NO: 3199198 - DNA, 22 bp, Homo sapiens
acttcagaaacccggcttcctg

SEQ ID NO: 3199199 - DNA, 23 bp, Homo sapiens
acttcagaaacccggcttcctgt

SEQ ID NO: 3199200 - DNA, 15 bp, Homo sapiens
acttcagaattccat

SEQ ID NO: 3199201 - DNA, 15 bp, Homo sapiens
acttcagagagctgg

SEQ ID NO: 3199202 - DNA, 16 bp, Homo sapiens
acttcagagagctggt

SEQ ID NO: 3199203 - DNA, 17 bp, Homo sapiens
acttcagagagctggta

SEQ ID NO: 3199204 - DNA, 16 bp, Homo sapiens
acttcagctgcctgaa

SEQ ID NO: 3199205 - DNA, 21 bp, Homo sapiens
acttcagctgcctgaaacagc

SEQ ID NO: 3199206 - DNA, 18 bp, Homo sapiens
acttcaggctcttctcct

SEQ ID NO: 3199207 - DNA, 20 bp, Homo sapiens
acttcaggctcttctccttt

SEQ ID NO: 3199208 - DNA, 18 bp, Homo sapiens
acttcaggggatgggtgt

SEQ ID NO: 3199209 - DNA, 18 bp, Homo sapiens
acttcagtgtcccacctt

SEQ ID NO: 3199210 - DNA, 20 bp, Homo sapiens
acttcagtttaatgtctcct

SEQ ID NO: 3199211 - DNA, 19 bp, Homo sapiens
acttcataaatgttcagct

SEQ ID NO: 3199212 - DNA, 17 bp, Homo sapiens
acttcatactggcagga

SEQ ID NO: 3199213 - DNA, 19 bp, Homo sapiens
acttcatatagcattgata

SEQ ID NO: 3199214 - DNA, 15 bp, Homo sapiens
acttcatggaatgga

SEQ ID NO: 3199215 - DNA, 14 bp, Homo sapiens
acttcatgtcaact

SEQ ID NO: 3199216 - DNA, 19 bp, Homo sapiens
acttcattcttgaaagctg

SEQ ID NO: 3199217 - DNA, 21 bp, Homo sapiens
acttcattcttgaaagctgtg

SEQ ID NO: 3199218 - DNA, 20 bp, Homo sapiens
acttcatttaaaaaaatcac

SEQ ID NO: 3199219 - DNA, 15 bp, Homo sapiens
acttcattttatatt

SEQ ID NO: 3199220 - DNA, 14 bp, Homo sapiens
acttcattttcagg

SEQ ID NO: 3199221 - DNA, 22 bp, Homo sapiens
acttcattttcaggaaatctac

SEQ ID NO: 3199222 - DNA, 14 bp, Homo sapiens
acttccaaaattct

SEQ ID NO: 3199223 - DNA, 19 bp, Homo sapiens
acttccaaaattcttattt

SEQ ID NO: 3199224 - DNA, 22 bp, Homo sapiens
acttccaaggccctgctttttt

SEQ ID NO: 3199225 - DNA, 19 bp, Homo sapiens
acttccaagtgataatttt

SEQ ID NO: 3199226 - DNA, 20 bp, Homo sapiens
acttccaagtgataatttta

SEQ ID NO: 3199227 - DNA, 18 bp, Homo sapiens
acttccaatttacatact

SEQ ID NO: 3199228 - DNA, 14 bp, Homo sapiens
acttccaatttata

SEQ ID NO: 3199229 - DNA, 22 bp, Homo sapiens
acttccacaagagtgaatttga

SEQ ID NO: 3199230 - DNA, 18 bp, Homo sapiens
acttccacagcagcagaa

SEQ ID NO: 3199231 - DNA, 18 bp, Homo sapiens
acttccacatttttgcac

SEQ ID NO: 3199232 - DNA, 23 bp, Homo sapiens
acttccacctccaccacatctgc

SEQ ID NO: 3199233 - DNA, 18 bp, Homo sapiens
acttccaggggaacctgc

SEQ ID NO: 3199234 - DNA, 21 bp, Homo sapiens
acttccaggggaacctgccat

SEQ ID NO: 3199235 - DNA, 13 bp, Homo sapiens
acttccagtggct

SEQ ID NO: 3199236 - DNA, 17 bp, Homo sapiens
acttcccaacagcctta

SEQ ID NO: 3199237 - DNA, 16 bp, Homo sapiens
acttcccagaggcaga

SEQ ID NO: 3199238 - DNA, 19 bp, Homo sapiens
acttccccctcttcttctg

SEQ ID NO: 3199239 - DNA, 20 bp, Homo sapiens
acttttcattctcttttaat

SEQ ID NO: 3199240 - DNA, 23 bp, Homo sapiens
acttttcctggacttaaagaaaa

SEQ ID NO: 3199241 - DNA, 23 bp, Homo sapiens
acttttcctgggtttcctgcagg

SEQ ID NO: 3199242 - DNA, 16 bp, Homo sapiens
acttttcgttaacatt

SEQ ID NO: 3199243 - DNA, 18 bp, Homo sapiens
acttttctaagaaaagca

SEQ ID NO: 3199244 - DNA, 19 bp, Homo sapiens
acttttctaagaaaagcat

SEQ ID NO: 3199245 - DNA, 22 bp, Homo sapiens
acttttctaagaaaagcatttt

SEQ ID NO: 3199246 - DNA, 21 bp, Homo sapiens
acttttgtaaagaaatttact

SEQ ID NO: 3199247 - DNA, 12 bp, Homo sapiens
acttttgtaaga

SEQ ID NO: 3199248 - DNA, 14 bp, Homo sapiens
acttttgtacatct

SEQ ID NO: 3199249 - DNA, 15 bp, Homo sapiens
acttttgttattcca

SEQ ID NO: 3199250 - DNA, 16 bp, Homo sapiens
acttttgttattccat

SEQ ID NO: 3199251 - DNA, 19 bp, Homo sapiens
actttttatgtaatacttt

SEQ ID NO: 3199252 - DNA, 22 bp, Homo sapiens
actttttatttaattaaatgta

SEQ ID NO: 3199253 - DNA, 21 bp, Homo sapiens
actttttgcaccttattttct

SEQ ID NO: 3199254 - DNA, 13 bp, Homo sapiens
actttttgcattt

SEQ ID NO: 3199255 - DNA, 21 bp, Homo sapiens
actttttggtggatgtaaata

SEQ ID NO: 3199256 - DNA, 14 bp, Homo sapiens
actttttggtttga

SEQ ID NO: 3199257 - DNA, 13 bp, Homo sapiens
acttttttaaata

SEQ ID NO: 3199258 - DNA, 14 bp, Homo sapiens
acttttttaaataa

SEQ ID NO: 3199259 - DNA, 20 bp, Homo sapiens
acttttttaaataaactttt

SEQ ID NO: 3199260 - DNA, 18 bp, Homo sapiens
acttttttacactgataa

SEQ ID NO: 3199261 - DNA, 20 bp, Homo sapiens
acttttttacactgataaaa

SEQ ID NO: 3199262 - DNA, 18 bp, Homo sapiens
acttttttgagtcattga

SEQ ID NO: 3199263 - DNA, 14 bp, Homo sapiens
acttttttgtgtat

SEQ ID NO: 3199264 - DNA, 16 bp, Homo sapiens
actttttttcaatgtg

SEQ ID NO: 3199265 - DNA, 18 bp, Homo sapiens
actttttttcttctactt

SEQ ID NO: 3199266 - DNA, 19 bp, Homo sapiens
actttttttggtataatgt

SEQ ID NO: 3199267 - DNA, 17 bp, Homo sapiens
actttttttttttttcc

SEQ ID NO: 3199268 - DNA, 19 bp, Homo sapiens
agaaaaaaaaccttgtaaa

SEQ ID NO: 3199269 - DNA, 17 bp, Homo sapiens
agaaaaaaaataacaca

SEQ ID NO: 3199270 - DNA, 12 bp, Homo sapiens
agaaaaaaacaa

SEQ ID NO: 3199271 - DNA, 18 bp, Homo sapiens
agaaaaaaaccacacaaa

SEQ ID NO: 3199272 - DNA, 13 bp, Homo sapiens
agaaaaaaaccat

SEQ ID NO: 3199273 - DNA, 16 bp, Homo sapiens
agaaaaaaacttactg

SEQ ID NO: 3199274 - DNA, 17 bp, Homo sapiens
agaaaaaaagatttatt

SEQ ID NO: 3199275 - DNA, 14 bp, Homo sapiens
agaaaaaaatcttc

SEQ ID NO: 3199276 - DNA, 16 bp, Homo sapiens
agaaaaaaatgtacat

SEQ ID NO: 3199277 - DNA, 18 bp, Homo sapiens
agaaataaagtttgctta

SEQ ID NO: 3199278 - DNA, 14 bp, Homo sapiens
agaaataaatcaga

SEQ ID NO: 3199279 - DNA, 20 bp, Homo sapiens
agaaataaatcagagagcaa

SEQ ID NO: 3199280 - DNA, 11 bp, Homo sapiens
agaaataaatt

SEQ ID NO: 3199281 - DNA, 17 bp, Homo sapiens
agaaataaattcctaaa

SEQ ID NO: 3199282 - DNA, 22 bp, Homo sapiens
agaaataagtggttatttctca

SEQ ID NO: 3199283 - DNA, 17 bp, Homo sapiens
agaaataatgctacaat

SEQ ID NO: 3199284 - DNA, 15 bp, Homo sapiens
agaaataatggtctt

SEQ ID NO: 3199285 - DNA, 21 bp, Homo sapiens
agaaatactataacatatgta

SEQ ID NO: 3199286 - DNA, 23 bp, Homo sapiens
agaaatactttcgaaatttcatt

SEQ ID NO: 3199287 - DNA, 17 bp, Homo sapiens
agaaatagacaaaaagt

SEQ ID NO: 3199288 - DNA, 21 bp, Homo sapiens
agaaatagacaaaaagtatat

SEQ ID NO: 3199289 - DNA, 18 bp, Homo sapiens
agaaatagacagtatatt

SEQ ID NO: 3199290 - DNA, 18 bp, Homo sapiens
agaaatataacacatttt

SEQ ID NO: 3199291 - DNA, 19 bp, Homo sapiens
agaaatataacacattttt

SEQ ID NO: 3199292 - DNA, 14 bp, Homo sapiens
agaaatataattga

SEQ ID NO: 3199293 - DNA, 18 bp, Homo sapiens
agaaatatatatacatat

SEQ ID NO: 3199294 - DNA, 19 bp, Homo sapiens
agaaatatatatacatatg

SEQ ID NO: 3199295 - DNA, 13 bp, Homo sapiens
agaaatatgattt

SEQ ID NO: 3199296 - DNA, 15 bp, Homo sapiens
agaaatatgatttta

SEQ ID NO: 3199297 - DNA, 19 bp, Homo sapiens
agaaatcaagtaatgaatc

SEQ ID NO: 3199298 - DNA, 16 bp, Homo sapiens
agaaatcacaggggcg

SEQ ID NO: 3199299 - DNA, 14 bp, Homo sapiens
agaaatctagaaga

SEQ ID NO: 3199300 - DNA, 23 bp, Homo sapiens
agaaatctagtatttcatgctgg

SEQ ID NO: 3199301 - DNA, 13 bp, Homo sapiens
agaaatctatctt

SEQ ID NO: 3199302 - DNA, 13 bp, Homo sapiens
agaaatctttcca

SEQ ID NO: 3199303 - DNA, 16 bp, Homo sapiens
agaaatctttccagtt

SEQ ID NO: 3199304 - DNA, 16 bp, Homo sapiens
agaaatgaacattcca

SEQ ID NO: 3199305 - DNA, 12 bp, Homo sapiens
agaaatgaataa

SEQ ID NO: 3199306 - DNA, 23 bp, Homo sapiens
agaaatgaccaatattatactaa

SEQ ID NO: 3199307 - DNA, 12 bp, Homo sapiens
agaaatgcagaa

SEQ ID NO: 3199308 - DNA, 12 bp, Homo sapiens
agaaatgctttg

SEQ ID NO: 3199309 - DNA, 16 bp, Homo sapiens
agaaatggaaattttg

SEQ ID NO: 3199310 - DNA, 14 bp, Homo sapiens
agaaatgtattcct

SEQ ID NO: 3199311 - DNA, 12 bp, Homo sapiens
agaaattagaaa

SEQ ID NO: 3199312 - DNA, 17 bp, Homo sapiens
agaaattagaaacctta

SEQ ID NO: 3199313 - DNA, 14 bp, Homo sapiens
agaaattagccggg

SEQ ID NO: 3199314 - DNA, 16 bp, Homo sapiens
agaaattatttaataa

SEQ ID NO: 3199315 - DNA, 19 bp, Homo sapiens
agaaattcaatttggattt

SEQ ID NO: 3199316 - DNA, 20 bp, Homo sapiens
agaaattcgtgtgttttttt

SEQ ID NO: 3199317 - DNA, 18 bp, Homo sapiens
agaaattctgttaaaatc

SEQ ID NO: 3199318 - DNA, 19 bp, Homo sapiens
agaaattctgttaaaatct

SEQ ID NO: 3199319 - DNA, 22 bp, Homo sapiens
agaaattggaacagaatgtttt

SEQ ID NO: 3199320 - DNA, 13 bp, Homo sapiens
agaaatttactat

SEQ ID NO: 3199321 - DNA, 14 bp, Homo sapiens
agaaatttactata

SEQ ID NO: 3199322 - DNA, 19 bp, Homo sapiens
agaaatttactatatatat

SEQ ID NO: 3199323 - DNA, 21 bp, Homo sapiens
agaaatttctgtgaaacctgt

SEQ ID NO: 3199324 - DNA, 13 bp, Homo sapiens
agaaattttcaac

SEQ ID NO: 3199325 - DNA, 15 bp, Homo sapiens
agaaatttttatcag

SEQ ID NO: 3199326 - DNA, 16 bp, Homo sapiens
agaaatttttatcagt

SEQ ID NO: 3199327 - DNA, 19 bp, Homo sapiens
agaaatttttatttttgaa

SEQ ID NO: 3199328 - DNA, 18 bp, Homo sapiens
agaaatttttcagatgct

SEQ ID NO: 3199329 - DNA, 22 bp, Homo sapiens
agaacaaaaagaaatcttgtct

SEQ ID NO: 3199330 - DNA, 17 bp, Homo sapiens
agaacaaggtagttttt

SEQ ID NO: 3199331 - DNA, 19 bp, Homo sapiens
agaacaaggtagtttttac

SEQ ID NO: 3199332 - DNA, 17 bp, Homo sapiens
agaacaagtcacagctg

SEQ ID NO: 3199333 - DNA, 15 bp, Homo sapiens
agaacacaaagcggg

SEQ ID NO: 3199334 - DNA, 18 bp, Homo sapiens
agaacacggctcacgctt

SEQ ID NO: 3199335 - DNA, 18 bp, Homo sapiens
agaacactaactcaccag

SEQ ID NO: 3199336 - DNA, 19 bp, Homo sapiens
agaacactattttcagaat

SEQ ID NO: 3199337 - DNA, 23 bp, Homo sapiens
agaacactattttcagaatctga

SEQ ID NO: 3199338 - DNA, 18 bp, Homo sapiens
agaacagcagaggttctt

SEQ ID NO: 3199339 - DNA, 14 bp, Homo sapiens
agaacagcttcagg

SEQ ID NO: 3199340 - DNA, 16 bp, Homo sapiens
agaacagcttcaggtt

SEQ ID NO: 3199341 - DNA, 22 bp, Homo sapiens
agaacagcttcaggttatcgaa

SEQ ID NO: 3199342 - DNA, 22 bp, Homo sapiens
agaacagggaaaataggcagga

SEQ ID NO: 3199343 - DNA, 11 bp, Homo sapiens
agaacagggtc

SEQ ID NO: 3199344 - DNA, 14 bp, Homo sapiens
agaacagtaaacat

SEQ ID NO: 3199345 - DNA, 11 bp, Homo sapiens
agaacatagaa

SEQ ID NO: 3199346 - DNA, 16 bp, Homo sapiens
agaacatattttcctt

SEQ ID NO: 3199347 - DNA, 19 bp, Homo sapiens
agaacatcataaaattttt

SEQ ID NO: 3199348 - DNA, 20 bp, Homo sapiens
agaacatcattagaacaaag

SEQ ID NO: 3199349 - DNA, 22 bp, Homo sapiens
agaacatctttgacactctgca

SEQ ID NO: 3199350 - DNA, 16 bp, Homo sapiens
agaacatggacttgta

SEQ ID NO: 3199351 - DNA, 19 bp, Homo sapiens
agaacatggacttgtatat

SEQ ID NO: 3199352 - DNA, 13 bp, Homo sapiens
agaacatgtgaga

SEQ ID NO: 3199353 - DNA, 12 bp, Homo sapiens
agaacatgttaa

SEQ ID NO: 3199354 - DNA, 13 bp, Homo sapiens
agaacatgttaag

SEQ ID NO: 3199355 - DNA, 21 bp, Homo sapiens
agaacatgttaagataactta

SEQ ID NO: 3199356 - DNA, 16 bp, Homo sapiens
agaacattcagctctg

SEQ ID NO: 3199357 - DNA, 21 bp, Homo sapiens
agaacatttaataatgtatgt

SEQ ID NO: 3199358 - DNA, 16 bp, Homo sapiens
agaaccaaaacttcca

SEQ ID NO: 3199359 - DNA, 20 bp, Homo sapiens
agaaccaaaagttttcctga

SEQ ID NO: 3199360 - DNA, 16 bp, Homo sapiens
agaaccacacttgaaa

SEQ ID NO: 3199361 - DNA, 17 bp, Homo sapiens
agaaccaccactgcctg

SEQ ID NO: 3199362 - DNA, 13 bp, Homo sapiens
agaaccacttcct

SEQ ID NO: 3199363 - DNA, 16 bp, Homo sapiens
agaaccagtctcctca

SEQ ID NO: 3199364 - DNA, 19 bp, Homo sapiens
agaacccagggctctgccc

SEQ ID NO: 3199365 - DNA, 14 bp, Homo sapiens
agaaccgagcaaag

SEQ ID NO: 3199366 - DNA, 18 bp, Homo sapiens
agaaccgagcaaagatca

SEQ ID NO: 3199367 - DNA, 20 bp, Homo sapiens
agaaccgagcaaagatcaaa

SEQ ID NO: 3199368 - DNA, 12 bp, Homo sapiens
agaacctcaggc

SEQ ID NO: 3199369 - DNA, 22 bp, Homo sapiens
agaacctcaggtacggagaaga

SEQ ID NO: 3199370 - DNA, 23 bp, Homo sapiens
agaacctcaggtacggagaagaa

SEQ ID NO: 3199371 - DNA, 13 bp, Homo sapiens
agaacctcttccc

SEQ ID NO: 3199372 - DNA, 15 bp, Homo sapiens
agaacctcttcccca

SEQ ID NO: 3199373 - DNA, 11 bp, Homo sapiens
agaacctgggc

SEQ ID NO: 3199374 - DNA, 15 bp, Homo sapiens
agaaccttaatgaca

SEQ ID NO: 3199375 - DNA, 21 bp, Homo sapiens
agaaccttctagaacctgggc

SEQ ID NO: 3199376 - DNA, 20 bp, Homo sapiens
agaacgaacacaagaaaaag

SEQ ID NO: 3199377 - DNA, 16 bp, Homo sapiens
agaacgcggtgtgtaa

SEQ ID NO: 3199378 - DNA, 18 bp, Homo sapiens
agaacgcggtgtgtaaca

SEQ ID NO: 3199379 - DNA, 21 bp, Homo sapiens
agaacgtgtttaattaaattt

SEQ ID NO: 3199380 - DNA, 16 bp, Homo sapiens
agaacgttttttcctc

SEQ ID NO: 3199381 - DNA, 19 bp, Homo sapiens
agaactaaactagtttttc

SEQ ID NO: 3199382 - DNA, 14 bp, Homo sapiens
agaactaccccctt

SEQ ID NO: 3199383 - DNA, 19 bp, Homo sapiens
agaactatatgtgaatcct

SEQ ID NO: 3199384 - DNA, 21 bp, Homo sapiens
agaactatatgtgaatcctct

SEQ ID NO: 3199385 - DNA, 15 bp, Homo sapiens
agaactcactctggg

SEQ ID NO: 3199386 - DNA, 14 bp, Homo sapiens
agaactcactgggg

SEQ ID NO: 3199387 - DNA, 20 bp, Homo sapiens
agaactcattctatccccaa

SEQ ID NO: 3199388 - DNA, 17 bp, Homo sapiens
agaactccctttcaaca

SEQ ID NO: 3199389 - DNA, 11 bp, Homo sapiens
agaactcctga

SEQ ID NO: 3199390 - DNA, 15 bp, Homo sapiens
agaactcctgactgt

SEQ ID NO: 3199391 - DNA, 17 bp, Homo sapiens
agaactccttattttgt

SEQ ID NO: 3199392 - DNA, 18 bp, Homo sapiens
agaactcgcgctcagtaa

SEQ ID NO: 3199393 - DNA, 13 bp, Homo sapiens
agaactctctgga

SEQ ID NO: 3199394 - DNA, 20 bp, Homo sapiens
agaactgaagtgtgctgtga

SEQ ID NO: 3199395 - DNA, 17 bp, Homo sapiens
agaactgaattttggga

SEQ ID NO: 3199396 - DNA, 15 bp, Homo sapiens
agaactgcaggccct

SEQ ID NO: 3199397 - DNA, 16 bp, Homo sapiens
agaactgcaggccctg

SEQ ID NO: 3199398 - DNA, 20 bp, Homo sapiens
agaactgcaggccctggcct

SEQ ID NO: 3199399 - DNA, 17 bp, Homo sapiens
agaactgcatggaccta

SEQ ID NO: 3199400 - DNA, 20 bp, Homo sapiens
agaactgcatggacctaaca

SEQ ID NO: 3199401 - DNA, 23 bp, Homo sapiens
agaactgcatggacctaacattc

SEQ ID NO: 3199402 - DNA, 11 bp, Homo sapiens
agaactgccat

SEQ ID NO: 3199403 - DNA, 23 bp, Homo sapiens
agaactgccattattttctgtca

SEQ ID NO: 3199404 - DNA, 13 bp, Homo sapiens
agaactgccattg

SEQ ID NO: 3199405 - DNA, 20 bp, Homo sapiens
agaactgcccttgctgcccg

SEQ ID NO: 3199406 - DNA, 19 bp, Homo sapiens
agaactgcttcatgtgaac

SEQ ID NO: 3199407 - DNA, 15 bp, Homo sapiens
agaagctttatttct

SEQ ID NO: 3199408 - DNA, 20 bp, Homo sapiens
agaagctttttttcttgcta

SEQ ID NO: 3199409 - DNA, 15 bp, Homo sapiens
agaaggaaagatggt

SEQ ID NO: 3199410 - DNA, 15 bp, Homo sapiens
agaaggaagggcaga

SEQ ID NO: 3199411 - DNA, 18 bp, Homo sapiens
agaaggagagaaagtggg

SEQ ID NO: 3199412 - DNA, 18 bp, Homo sapiens
agaaggagggcagagcca

SEQ ID NO: 3199413 - DNA, 20 bp, Homo sapiens
agaaggagtcagaaactgtt

SEQ ID NO: 3199414 - DNA, 15 bp, Homo sapiens
agaaggcatgagaaa

SEQ ID NO: 3199415 - DNA, 16 bp, Homo sapiens
agaaggcatgagaaag

SEQ ID NO: 3199416 - DNA, 21 bp, Homo sapiens
agaaggccgaggcaggagaat

SEQ ID NO: 3199417 - DNA, 21 bp, Homo sapiens
agaagggataaccctacaccc

SEQ ID NO: 3199418 - DNA, 14 bp, Homo sapiens
agaagggggccctg

SEQ ID NO: 3199419 - DNA, 16 bp, Homo sapiens
agaagggggccctgct

SEQ ID NO: 3199420 - DNA, 20 bp, Homo sapiens
agaagggggccctgctacct

SEQ ID NO: 3199421 - DNA, 21 bp, Homo sapiens
agaaggtattagcaaagcaaa

SEQ ID NO: 3199422 - DNA, 21 bp, Homo sapiens
agaaggtattccttttgtgta

SEQ ID NO: 3199423 - DNA, 20 bp, Homo sapiens
agaagtaagaggctacctct

SEQ ID NO: 3199424 - DNA, 21 bp, Homo sapiens
agaagtaagaggctacctctt

SEQ ID NO: 3199425 - DNA, 16 bp, Homo sapiens
agaagtcatcttgcta

SEQ ID NO: 3199426 - DNA, 17 bp, Homo sapiens
agaagtcttagatgtat

SEQ ID NO: 3199427 - DNA, 18 bp, Homo sapiens
agaagtgagcaaaaaaga

SEQ ID NO: 3199428 - DNA, 14 bp, Homo sapiens
agaagtgcatttct

SEQ ID NO: 3199429 - DNA, 16 bp, Homo sapiens
agaagtgcatttctga

SEQ ID NO: 3199430 - DNA, 19 bp, Homo sapiens
agaagtgcatttctgaata

SEQ ID NO: 3199431 - DNA, 14 bp, Homo sapiens
agaagtgccttctc

SEQ ID NO: 3199432 - DNA, 22 bp, Homo sapiens
agaagtgccttctccttcccca

SEQ ID NO: 3199433 - DNA, 22 bp, Homo sapiens
agaagtggaagtgcttgatatg

SEQ ID NO: 3199434 - DNA, 12 bp, Homo sapiens
agaagtggtact

SEQ ID NO: 3199435 - DNA, 16 bp, Homo sapiens
agaagtggtactagtg

SEQ ID NO: 3199436 - DNA, 17 bp, Homo sapiens
agaagttactttgtaat

SEQ ID NO: 3199437 - DNA, 20 bp, Homo sapiens
agaagttactttgtaatttt

SEQ ID NO: 3199438 - DNA, 13 bp, Homo sapiens
agaagttgtttga

SEQ ID NO: 3199439 - DNA, 16 bp, Homo sapiens
agaagtttcccttcct

SEQ ID NO: 3199440 - DNA, 18 bp, Homo sapiens
agaagtttcccttcctcc

SEQ ID NO: 3199441 - DNA, 13 bp, Homo sapiens
agaagtttgtcca

SEQ ID NO: 3199442 - DNA, 15 bp, Homo sapiens
agaagtttttgtact

SEQ ID NO: 3199443 - DNA, 20 bp, Homo sapiens
agaagtttttgtactgtaaa

SEQ ID NO: 3199444 - DNA, 22 bp, Homo sapiens
agaataaaagctataaagtata

SEQ ID NO: 3199445 - DNA, 15 bp, Homo sapiens
agaataaaaggtagt

SEQ ID NO: 3199446 - DNA, 13 bp, Homo sapiens
agaataaagcagc

SEQ ID NO: 3199447 - DNA, 14 bp, Homo sapiens
agaataaagcagcc

SEQ ID NO: 3199448 - DNA, 13 bp, Homo sapiens
agaataaggagga

SEQ ID NO: 3199449 - DNA, 22 bp, Homo sapiens
agaataaggaggaggagggaga

SEQ ID NO: 3199450 - DNA, 22 bp, Homo sapiens
agaataatatgctgccaaattt

SEQ ID NO: 3199451 - DNA, 20 bp, Homo sapiens
agaataatccagtattgctg

SEQ ID NO: 3199452 - DNA, 22 bp, Homo sapiens
agaataatccagtattgctgat

SEQ ID NO: 3199453 - DNA, 23 bp, Homo sapiens
agaataatggaaacattacagtt

SEQ ID NO: 3199454 - DNA, 17 bp, Homo sapiens
agaataatgtgttaaac

SEQ ID NO: 3199455 - DNA, 16 bp, Homo sapiens
agaataatgttctatt

SEQ ID NO: 3199456 - DNA, 14 bp, Homo sapiens
agaataattttatt

SEQ ID NO: 3199457 - DNA, 12 bp, Homo sapiens
agaatacagaaa

SEQ ID NO: 3199458 - DNA, 22 bp, Homo sapiens
agaatacagtaagctgctctat

SEQ ID NO: 3199459 - DNA, 16 bp, Homo sapiens
agaatactgcttgctt

SEQ ID NO: 3199460 - DNA, 17 bp, Homo sapiens
agaatagaggtcctcat

SEQ ID NO: 3199461 - DNA, 18 bp, Homo sapiens
agaatgttgtattcagtg

SEQ ID NO: 3199462 - DNA, 19 bp, Homo sapiens
agaatgttgtattcagtga

SEQ ID NO: 3199463 - DNA, 19 bp, Homo sapiens
agaatgttttactgtgaaa

SEQ ID NO: 3199464 - DNA, 15 bp, Homo sapiens
agaattaaactttta

SEQ ID NO: 3199465 - DNA, 17 bp, Homo sapiens
agaattagtatgtctgt

SEQ ID NO: 3199466 - DNA, 19 bp, Homo sapiens
agaattagtatgtctgttt

SEQ ID NO: 3199467 - DNA, 19 bp, Homo sapiens
agaattagtgccagaattt

SEQ ID NO: 3199468 - DNA, 21 bp, Homo sapiens
agaattagtgccagaatttta

SEQ ID NO: 3199469 - DNA, 13 bp, Homo sapiens
agaattatatagg

SEQ ID NO: 3199470 - DNA, 22 bp, Homo sapiens
agaattatataggttgtgcaaa

SEQ ID NO: 3199471 - DNA, 16 bp, Homo sapiens
agaattatatatttct

SEQ ID NO: 3199472 - DNA, 15 bp, Homo sapiens
agaattatctaattt

SEQ ID NO: 3199473 - DNA, 21 bp, Homo sapiens
agaattatctaatttataaaa

SEQ ID NO: 3199474 - DNA, 23 bp, Homo sapiens
agaattatttttaaaaagaaatc

SEQ ID NO: 3199475 - DNA, 20 bp, Homo sapiens
agaattcaaactggggcctc

SEQ ID NO: 3199476 - DNA, 16 bp, Homo sapiens
agaattctaattgtca

SEQ ID NO: 3199477 - DNA, 20 bp, Homo sapiens
agaattctcagaatctcaaa

SEQ ID NO: 3199478 - DNA, 19 bp, Homo sapiens
agaattgaaaagtttttgt

SEQ ID NO: 3199479 - DNA, 21 bp, Homo sapiens
agaattgaccatctgctttta

SEQ ID NO: 3199480 - DNA, 17 bp, Homo sapiens
agaattgagtaatggtg

SEQ ID NO: 3199481 - DNA, 19 bp, Homo sapiens
agaattgcacacagatgtg

SEQ ID NO: 3199482 - DNA, 21 bp, Homo sapiens
agaattggagagtaaaaactg

SEQ ID NO: 3199483 - DNA, 13 bp, Homo sapiens
agaattggctcaa

SEQ ID NO: 3199484 - DNA, 16 bp, Homo sapiens
agaattggctcaataa

SEQ ID NO: 3199485 - DNA, 20 bp, Homo sapiens
agaattgtatctcatactgt

SEQ ID NO: 3199486 - DNA, 20 bp, Homo sapiens
agaatttagatcttatattg

SEQ ID NO: 3199487 - DNA, 22 bp, Homo sapiens
agaatttagatcttatattggt

SEQ ID NO: 3199488 - DNA, 19 bp, Homo sapiens
agaatttagggagaaatgt

SEQ ID NO: 3199489 - DNA, 21 bp, Homo sapiens
agaatttatcacacttctgtg

SEQ ID NO: 3199490 - DNA, 13 bp, Homo sapiens
agaatttattcaa

SEQ ID NO: 3199491 - DNA, 14 bp, Homo sapiens
agaatttgaattat

SEQ ID NO: 3199492 - DNA, 16 bp, Homo sapiens
agaatttgtattttgc

SEQ ID NO: 3199493 - DNA, 17 bp, Homo sapiens
agaatttgtattttgct

SEQ ID NO: 3199494 - DNA, 18 bp, Homo sapiens
agaattttaaattataac

SEQ ID NO: 3199495 - DNA, 21 bp, Homo sapiens
agaattttaagtgctttgtaa

SEQ ID NO: 3199496 - DNA, 16 bp, Homo sapiens
agaattttaatgtgaa

SEQ ID NO: 3199497 - DNA, 13 bp, Homo sapiens
agaattttaggaa

SEQ ID NO: 3199498 - DNA, 22 bp, Homo sapiens
agaattttaggaacttcagaga

SEQ ID NO: 3199499 - DNA, 18 bp, Homo sapiens
agacaaaaaaatttaaaa

SEQ ID NO: 3199500 - DNA, 12 bp, Homo sapiens
agacaaaaagta

SEQ ID NO: 3199501 - DNA, 19 bp, Homo sapiens
agacaaaaagtatattaaa

SEQ ID NO: 3199502 - DNA, 23 bp, Homo sapiens
agacaaagtcccagaattgtatc

SEQ ID NO: 3199503 - DNA, 12 bp, Homo sapiens
agacaaatattt

SEQ ID NO: 3199504 - DNA, 12 bp, Homo sapiens
agacaaccaaaa

SEQ ID NO: 3199505 - DNA, 14 bp, Homo sapiens
agacaaccaaaaca

SEQ ID NO: 3199506 - DNA, 19 bp, Homo sapiens
agacaacgatgaatttctt

SEQ ID NO: 3199507 - DNA, 12 bp, Homo sapiens
agacaactagat

SEQ ID NO: 3199508 - DNA, 20 bp, Homo sapiens
agacaagcactattttatat

SEQ ID NO: 3199509 - DNA, 13 bp, Homo sapiens
agacaagcagccc

SEQ ID NO: 3199510 - DNA, 15 bp, Homo sapiens
agacaagcagccctt

SEQ ID NO: 3199511 - DNA, 15 bp, Homo sapiens
agacaagttccatgg

SEQ ID NO: 3199512 - DNA, 14 bp, Homo sapiens
agacaatagtattt

SEQ ID NO: 3199513 - DNA, 17 bp, Homo sapiens
agacaatagtatttctc

SEQ ID NO: 3199514 - DNA, 20 bp, Homo sapiens
agacaatatgtgagtgcctt

SEQ ID NO: 3199515 - DNA, 12 bp, Homo sapiens
agacacaaatgc

SEQ ID NO: 3199516 - DNA, 12 bp, Homo sapiens
agacacacacac

SEQ ID NO: 3199517 - DNA, 14 bp, Homo sapiens
agacacagaacaca

SEQ ID NO: 3199518 - DNA, 12 bp, Homo sapiens
agacacagactg

SEQ ID NO: 3199519 - DNA, 16 bp, Homo sapiens
agacacagactggcaa

SEQ ID NO: 3199520 - DNA, 23 bp, Homo sapiens
acttacattgttcaattagaata

SEQ ID NO: 3199521 - DNA, 21 bp, Homo sapiens
acttacctaagtgacatttgt

SEQ ID NO: 3199522 - DNA, 12 bp, Homo sapiens
acttacctcaaa

SEQ ID NO: 3199523 - DNA, 17 bp, Homo sapiens
acttacctcaaattaag

SEQ ID NO: 3199524 - DNA, 14 bp, Homo sapiens
acttactctaagat

SEQ ID NO: 3199525 - DNA, 16 bp, Homo sapiens
acttactctaagatct

SEQ ID NO: 3199526 - DNA, 22 bp, Homo sapiens
acttactgggtaggtgattcta

SEQ ID NO: 3199527 - DNA, 20 bp, Homo sapiens
acttactgggtgaggaaatc

SEQ ID NO: 3199528 - DNA, 14 bp, Homo sapiens
acttactgtatatg

SEQ ID NO: 3199529 - DNA, 15 bp, Homo sapiens
acttactgtatatgt

SEQ ID NO: 3199530 - DNA, 21 bp, Homo sapiens
acttactgtttctgtcaggag

SEQ ID NO: 3199531 - DNA, 15 bp, Homo sapiens
acttacttgcttatt

SEQ ID NO: 3199532 - DNA, 16 bp, Homo sapiens
acttacttgcttattt

SEQ ID NO: 3199533 - DNA, 15 bp, Homo sapiens
acttacttttgtaaa

SEQ ID NO: 3199534 - DNA, 16 bp, Homo sapiens
acttagaaagcagggg

SEQ ID NO: 3199535 - DNA, 20 bp, Homo sapiens
acttagacccatgctggtca

SEQ ID NO: 3199536 - DNA, 18 bp, Homo sapiens
actggcaagaggcctcat

SEQ ID NO: 3199537 - DNA, 13 bp, Homo sapiens
actggcaataaac

SEQ ID NO: 3199538 - DNA, 16 bp, Homo sapiens
actggcacacacccct

SEQ ID NO: 3199539 - DNA, 16 bp, Homo sapiens
actggcactgaattaa

SEQ ID NO: 3199540 - DNA, 23 bp, Homo sapiens
actggcactggtggtttttgctc

SEQ ID NO: 3199541 - DNA, 11 bp, Homo sapiens
actggcagctc

SEQ ID NO: 3199542 - DNA, 22 bp, Homo sapiens
actggcaggagggtgaggaggt

SEQ ID NO: 3199543 - DNA, 21 bp, Homo sapiens
actggcaggtgcagatgggct

SEQ ID NO: 3199544 - DNA, 22 bp, Homo sapiens
actggcaggtgcagatgggctg

SEQ ID NO: 3199545 - DNA, 23 bp, Homo sapiens
actggcatggatatagttttact

SEQ ID NO: 3199546 - DNA, 15 bp, Homo sapiens
actggccaccaggct

SEQ ID NO: 3199547 - DNA, 19 bp, Homo sapiens
actggccagagagggccca

SEQ ID NO: 3199548 - DNA, 20 bp, Homo sapiens
actggccagagagggcccag

SEQ ID NO: 3199549 - DNA, 21 bp, Homo sapiens
actggccagagagggcccagc

SEQ ID NO: 3199550 - DNA, 21 bp, Homo sapiens
actggccagttgcccagagca

SEQ ID NO: 3199551 - DNA, 16 bp, Homo sapiens
actggccgggcaggcg

SEQ ID NO: 3199552 - DNA, 21 bp, Homo sapiens
actggcgttcacctccctgct

SEQ ID NO: 3199553 - DNA, 22 bp, Homo sapiens
actggctccatgattctctgag

SEQ ID NO: 3199554 - DNA, 17 bp, Homo sapiens
actggctctccaagtgc

SEQ ID NO: 3199555 - DNA, 22 bp, Homo sapiens
actggctctccaagtgccagag

SEQ ID NO: 3199556 - DNA, 12 bp, Homo sapiens
actggctctggg

SEQ ID NO: 3199557 - DNA, 15 bp, Homo sapiens
actggctctgggact

SEQ ID NO: 3199558 - DNA, 16 bp, Homo sapiens
actggctggcctgagc

SEQ ID NO: 3199559 - DNA, 14 bp, Homo sapiens
actggctggctcct

SEQ ID NO: 3199560 - DNA, 13 bp, Homo sapiens
actggctggggca

SEQ ID NO: 3199561 - DNA, 14 bp, Homo sapiens
actggctgtctgcc

SEQ ID NO: 3199562 - DNA, 18 bp, Homo sapiens
actggcttacctcctcat

SEQ ID NO: 3199563 - DNA, 15 bp, Homo sapiens
actggcttcagcaag

SEQ ID NO: 3199564 - DNA, 20 bp, Homo sapiens
actgggagccacttctcccc

SEQ ID NO: 3199565 - DNA, 16 bp, Homo sapiens
actgggataactgatt

SEQ ID NO: 3199566 - DNA, 21 bp, Homo sapiens
actgggataactgatttctat

SEQ ID NO: 3199567 - DNA, 22 bp, Homo sapiens
actgggatgggaacactggtgg

SEQ ID NO: 3199568 - DNA, 15 bp, Homo sapiens
actgggccagccctg

SEQ ID NO: 3199569 - DNA, 21 bp, Homo sapiens
actgggccagccctgcagccc

SEQ ID NO: 3199570 - DNA, 21 bp, Homo sapiens
actgggcctgttgccctttct

SEQ ID NO: 3199571 - DNA, 21 bp, Homo sapiens
actgggccttagtgggccagg

SEQ ID NO: 3199572 - DNA, 23 bp, Homo sapiens
actggggactttatttatttcta

SEQ ID NO: 3199573 - DNA, 15 bp, Homo sapiens
actggggagtctttg

SEQ ID NO: 3199574 - DNA, 12 bp, Homo sapiens
actggggcctcc

SEQ ID NO: 3199575 - DNA, 23 bp, Homo sapiens
actggggcctggggctctagccc

SEQ ID NO: 3199576 - DNA, 19 bp, Homo sapiens
actggggctttgccttgca

SEQ ID NO: 3199577 - DNA, 23 bp, Homo sapiens
actggggctttgccttgcagcca

SEQ ID NO: 3199578 - DNA, 17 bp, Homo sapiens
actggggtgggaggtct

SEQ ID NO: 3199579 - DNA, 21 bp, Homo sapiens
actggggtgggaggtcttgct

SEQ ID NO: 3199580 - DNA, 22 bp, Homo sapiens
actggggtgggaggtcttgcta

SEQ ID NO: 3199581 - DNA, 23 bp, Homo sapiens
actgggtacttgtggacacagct

SEQ ID NO: 3199582 - DNA, 18 bp, Homo sapiens
actgggtggtggcctggt

SEQ ID NO: 3199583 - DNA, 22 bp, Homo sapiens
actgggtttggaccccagctgg

SEQ ID NO: 3199584 - DNA, 15 bp, Homo sapiens
actggtaggaccaag

SEQ ID NO: 3199585 - DNA, 18 bp, Homo sapiens
actggtaggttgggacac

SEQ ID NO: 3199586 - DNA, 16 bp, Homo sapiens
actggtattctgttct

SEQ ID NO: 3199587 - DNA, 12 bp, Homo sapiens
actggtccagct

SEQ ID NO: 3199588 - DNA, 15 bp, Homo sapiens
actggtccagctctg

SEQ ID NO: 3199589 - DNA, 16 bp, Homo sapiens
actggtccagctctga

SEQ ID NO: 3199590 - DNA, 23 bp, Homo sapiens
actggtccagctctgacatccct

SEQ ID NO: 3199591 - DNA, 20 bp, Homo sapiens
actggtctcgaactcctggc

SEQ ID NO: 3199592 - DNA, 21 bp, Homo sapiens
actggtctcgaactcctggcc

SEQ ID NO: 3199593 - DNA, 15 bp, Homo sapiens
actggtctgtaggga

SEQ ID NO: 3199594 - DNA, 16 bp, Homo sapiens
actggttccttcttcc

SEQ ID NO: 3199595 - DNA, 17 bp, Homo sapiens
actggtttacaggccct

SEQ ID NO: 3199596 - DNA, 17 bp, Homo sapiens
actggttttaagtgctt

SEQ ID NO: 3199597 - DNA, 16 bp, Homo sapiens
actggttttacttaca

SEQ ID NO: 3199598 - DNA, 21 bp, Homo sapiens
actggttttacttacaaaaat

SEQ ID NO: 3199599 - DNA, 14 bp, Homo sapiens
actggttttctgcc

SEQ ID NO: 3199600 - DNA, 15 bp, Homo sapiens
actggttttctgcca

SEQ ID NO: 3199601 - DNA, 16 bp, Homo sapiens
actgtaaaatgaaatt

SEQ ID NO: 3199602 - DNA, 17 bp, Homo sapiens
actgtaaacttctgcaa

SEQ ID NO: 3199603 - DNA, 23 bp, Homo sapiens
actgtaaagagacctacctcagg

SEQ ID NO: 3199604 - DNA, 18 bp, Homo sapiens
actgtaaataaaaagaaa

SEQ ID NO: 3199605 - DNA, 22 bp, Homo sapiens
actgtaaatatttatttatgtg

SEQ ID NO: 3199606 - DNA, 11 bp, Homo sapiens
actgtaaatca

SEQ ID NO: 3199607 - DNA, 12 bp, Homo sapiens
actgtaaatcat

SEQ ID NO: 3199608 - DNA, 17 bp, Homo sapiens
actgtaagaagagccat

SEQ ID NO: 3199609 - DNA, 16 bp, Homo sapiens
actgtacaaagtagaa

SEQ ID NO: 3199610 - DNA, 15 bp, Homo sapiens
actgtacatttaaaa

SEQ ID NO: 3199611 - DNA, 14 bp, Homo sapiens
actgtactaattct

SEQ ID NO: 3199612 - DNA, 17 bp, Homo sapiens
actgtactagtctgtgt

SEQ ID NO: 3199613 - DNA, 17 bp, Homo sapiens
actgtactgacttgagg

SEQ ID NO: 3199614 - DNA, 16 bp, Homo sapiens
actgtactttgccatt

SEQ ID NO: 3199615 - DNA, 17 bp, Homo sapiens
actgtactttgccattt

SEQ ID NO: 3199616 - DNA, 19 bp, Homo sapiens
actgtactttgccattttt

SEQ ID NO: 3199617 - DNA, 12 bp, Homo sapiens
actgtacttttt

SEQ ID NO: 3199618 - DNA, 22 bp, Homo sapiens
actgtagaagaagcccatatca

SEQ ID NO: 3199619 - DNA, 17 bp, Homo sapiens
actgtagattgcttctg

SEQ ID NO: 3199620 - DNA, 18 bp, Homo sapiens
actgtagattgcttctgt

SEQ ID NO: 3199621 - DNA, 16 bp, Homo sapiens
actgtagctcaagttt

SEQ ID NO: 3199622 - DNA, 19 bp, Homo sapiens
actgtagctcaagtttaaa

SEQ ID NO: 3199623 - DNA, 19 bp, Homo sapiens
actgtagcttttaggaata

SEQ ID NO: 3199624 - DNA, 19 bp, Homo sapiens
actgtaggaagagtagcat

SEQ ID NO: 3199625 - DNA, 18 bp, Homo sapiens
actgtaggttatttaaaa

SEQ ID NO: 3199626 - DNA, 16 bp, Homo sapiens
actgtagttctaagac

SEQ ID NO: 3199627 - DNA, 22 bp, Homo sapiens
actgtataaataggagaggatg

SEQ ID NO: 3199628 - DNA, 15 bp, Homo sapiens
actgtataagtacta

SEQ ID NO: 3199629 - DNA, 16 bp, Homo sapiens
actgtatcaaatctgt

SEQ ID NO: 3199630 - DNA, 17 bp, Homo sapiens
actgtatcaaatctgta

SEQ ID NO: 3199631 - DNA, 14 bp, Homo sapiens
actgtatcattttc

SEQ ID NO: 3199632 - DNA, 21 bp, Homo sapiens
actgtatggaaacactgattt

SEQ ID NO: 3199633 - DNA, 22 bp, Homo sapiens
actgtatggaaacactgatttt

SEQ ID NO: 3199634 - DNA, 23 bp, Homo sapiens
actgtatggaaacactgattttg

SEQ ID NO: 3199635 - DNA, 22 bp, Homo sapiens
actgtatgtgtgtaggttatct

SEQ ID NO: 3199636 - DNA, 14 bp, Homo sapiens
actgtattaaatct

SEQ ID NO: 3199637 - DNA, 15 bp, Homo sapiens
actgtattaaatctt

SEQ ID NO: 3199638 - DNA, 18 bp, Homo sapiens
actgtattaaatcttaaa

SEQ ID NO: 3199639 - DNA, 20 bp, Homo sapiens
actgtattaaatcttaaaca

SEQ ID NO: 3199640 - DNA, 22 bp, Homo sapiens
actgtattaaatcttaaacaat

SEQ ID NO: 3199641 - DNA, 20 bp, Homo sapiens
actgtattcgtgcatttttg

SEQ ID NO: 3199642 - DNA, 21 bp, Homo sapiens
actgtatttctaagaagttgt

SEQ ID NO: 3199643 - DNA, 13 bp, Homo sapiens
actgtatttgtat

SEQ ID NO: 3199644 - DNA, 14 bp, Homo sapiens
actgtcaataaaca

SEQ ID NO: 3199645 - DNA, 15 bp, Homo sapiens
actgtcaataaacag

SEQ ID NO: 3199646 - DNA, 18 bp, Homo sapiens
actgtcaataaacagctt

SEQ ID NO: 3199647 - DNA, 13 bp, Homo sapiens
actgtcatagaaa

SEQ ID NO: 3199648 - DNA, 22 bp, Homo sapiens
actgtcatcctcaaagaaagtg

SEQ ID NO: 3199649 - DNA, 24 bp, Homo sapiens
actgtcatgcttcatcattccctc

SEQ ID NO: 3199650 - DNA, 13 bp, Homo sapiens
actgtccagagag

SEQ ID NO: 3199651 - DNA, 18 bp, Homo sapiens
actgtccccctacccacc

SEQ ID NO: 3199652 - DNA, 19 bp, Homo sapiens
actgtccccctacccaccg

SEQ ID NO: 3199653 - DNA, 15 bp, Homo sapiens
actgtcctaacatgg

SEQ ID NO: 3199654 - DNA, 23 bp, Homo sapiens
actgtcctacccaccctcctttc

SEQ ID NO: 3199655 - DNA, 13 bp, Homo sapiens
actgtcctctaca

SEQ ID NO: 3199656 - DNA, 14 bp, Homo sapiens
actgtcctttcctt

SEQ ID NO: 3199657 - DNA, 17 bp, Homo sapiens
actgtctattaatattc

SEQ ID NO: 3199658 - DNA, 18 bp, Homo sapiens
actgtctcagtttcactt

SEQ ID NO: 3199659 - DNA, 12 bp, Homo sapiens
actgaacatgtt

SEQ ID NO: 3199660 - DNA, 13 bp, Homo sapiens
actgaacatgttt

SEQ ID NO: 3199661 - DNA, 14 bp, Homo sapiens
actgaacatgttta

SEQ ID NO: 3199662 - DNA, 16 bp, Homo sapiens
actgaacatttgcttt

SEQ ID NO: 3199663 - DNA, 13 bp, Homo sapiens
actgaaccaaatt

SEQ ID NO: 3199664 - DNA, 14 bp, Homo sapiens
actgaaccaaattg

SEQ ID NO: 3199665 - DNA, 22 bp, Homo sapiens
actgaaccaaattgcactgaag

SEQ ID NO: 3199666 - DNA, 24 bp, Homo sapiens
actgaaccaaattgcactgaagtt

SEQ ID NO: 3199667 - DNA, 17 bp, Homo sapiens
actgaaccacaaaaaaa

SEQ ID NO: 3199668 - DNA, 23 bp, Homo sapiens
actgaaccacaaaaaaaaaggct

SEQ ID NO: 3199669 - DNA, 13 bp, Homo sapiens
actgaacttcagg

SEQ ID NO: 3199670 - DNA, 21 bp, Homo sapiens
actgaacttcaggataataaa

SEQ ID NO: 3199671 - DNA, 21 bp, Homo sapiens
actgaagcagcctctccccag

SEQ ID NO: 3199672 - DNA, 16 bp, Homo sapiens
actgaagcctgcagga

SEQ ID NO: 3199673 - DNA, 19 bp, Homo sapiens
actgaagcctgcaggagtt

SEQ ID NO: 3199674 - DNA, 20 bp, Homo sapiens
actgaaggaaaaacacaagc

SEQ ID NO: 3199675 - DNA, 20 bp, Homo sapiens
actgaaggggcacaccactg

SEQ ID NO: 3199676 - DNA, 14 bp, Homo sapiens
actgaagtttttga

SEQ ID NO: 3199677 - DNA, 22 bp, Homo sapiens
actgaagtttttgaaatacctt

SEQ ID NO: 3199678 - DNA, 23 bp, Homo sapiens
actgaagtttttgaaataccttt

SEQ ID NO: 3199679 - DNA, 18 bp, Homo sapiens
actgaatatttatatttc

SEQ ID NO: 3199680 - DNA, 15 bp, Homo sapiens
actgaatattttgga

SEQ ID NO: 3199681 - DNA, 21 bp, Homo sapiens
actgaatctcataattggaat

SEQ ID NO: 3199682 - DNA, 20 bp, Homo sapiens
actgaatgaagcagtatttt

SEQ ID NO: 3199683 - DNA, 16 bp, Homo sapiens
actgaatgcataaata

SEQ ID NO: 3199684 - DNA, 19 bp, Homo sapiens
actgaatgcataaataaat

SEQ ID NO: 3199685 - DNA, 16 bp, Homo sapiens
actgaatgctctgtgc

SEQ ID NO: 3199686 - DNA, 19 bp, Homo sapiens
actgaatgtttattccttg

SEQ ID NO: 3199687 - DNA, 15 bp, Homo sapiens
actgaattaaacatg

SEQ ID NO: 3199688 - DNA, 13 bp, Homo sapiens
actgaattaatca

SEQ ID NO: 3199689 - DNA, 20 bp, Homo sapiens
actgaattttgggacttcta

SEQ ID NO: 3199690 - DNA, 22 bp, Homo sapiens
actgacatgtggggccaggtca

SEQ ID NO: 3199691 - DNA, 22 bp, Homo sapiens
actgacattgttggccaaagcc

SEQ ID NO: 3199692 - DNA, 13 bp, Homo sapiens
actgacatttctt

SEQ ID NO: 3199693 - DNA, 20 bp, Homo sapiens
actgaccagcctccatgctg

SEQ ID NO: 3199694 - DNA, 23 bp, Homo sapiens
actgaccatccactctaccctcc

SEQ ID NO: 3199695 - DNA, 17 bp, Homo sapiens
actgaccccctcccctg

SEQ ID NO: 3199696 - DNA, 18 bp, Homo sapiens
actgaccccctcccctga

SEQ ID NO: 3199697 - DNA, 22 bp, Homo sapiens
actgacctgtcatgcccccctc

SEQ ID NO: 3199698 - DNA, 21 bp, Homo sapiens
actgaccttggagagacacag

SEQ ID NO: 3199699 - DNA, 23 bp, Homo sapiens
actgactgaaggaaaagcaagaa

SEQ ID NO: 3199700 - DNA, 20 bp, Homo sapiens
actgacttgtttgtcttcca

SEQ ID NO: 3199701 - DNA, 14 bp, Homo sapiens
actgactttatcct

SEQ ID NO: 3199702 - DNA, 18 bp, Homo sapiens
actgactttctgattact

SEQ ID NO: 3199703 - DNA, 17 bp, Homo sapiens
actgactttgcttgctt

SEQ ID NO: 3199704 - DNA, 22 bp, Homo sapiens
actgagacagccacttggtttt

SEQ ID NO: 3199705 - DNA, 12 bp, Homo sapiens
actgagaggcct

SEQ ID NO: 3199706 - DNA, 23 bp, Homo sapiens
actgagagggcaatctttgcctt

SEQ ID NO: 3199707 - DNA, 16 bp, Homo sapiens
actgagatttcttaaa

SEQ ID NO: 3199708 - DNA, 19 bp, Homo sapiens
actgagatttcttaaatct

SEQ ID NO: 3199709 - DNA, 15 bp, Homo sapiens
actgagcagccgcca

SEQ ID NO: 3199710 - DNA, 16 bp, Homo sapiens
actgagcagccgccag

SEQ ID NO: 3199711 - DNA, 20 bp, Homo sapiens
actgagccaaggaggcctgg

SEQ ID NO: 3199712 - DNA, 13 bp, Homo sapiens
actgagccccccc

SEQ ID NO: 3199713 - DNA, 22 bp, Homo sapiens
actgagcccccccaacactgtg

SEQ ID NO: 3199714 - DNA, 18 bp, Homo sapiens
actgagccccgcagacct

SEQ ID NO: 3199715 - DNA, 23 bp, Homo sapiens
actgagccccgcagacctcccca

SEQ ID NO: 3199716 - DNA, 20 bp, Homo sapiens
actgagcggccgcagagact

SEQ ID NO: 3199717 - DNA, 15 bp, Homo sapiens
actgagctccccaga

SEQ ID NO: 3199718 - DNA, 18 bp, Homo sapiens
actgagctccccagatct

SEQ ID NO: 3199719 - DNA, 19 bp, Homo sapiens
actgagctccccagatctc

SEQ ID NO: 3199720 - DNA, 20 bp, Homo sapiens
actgagctccccagatctcc

SEQ ID NO: 3199721 - DNA, 21 bp, Homo sapiens
actgagctgagaccactgagt

SEQ ID NO: 3199722 - DNA, 15 bp, Homo sapiens
actgaggaccagcca

SEQ ID NO: 3199723 - DNA, 23 bp, Homo sapiens
actgaggagatgaccagggatgc

SEQ ID NO: 3199724 - DNA, 13 bp, Homo sapiens
actgaggcttaga

SEQ ID NO: 3199725 - DNA, 23 bp, Homo sapiens
actgaggcttagagagaggaggc

SEQ ID NO: 3199726 - DNA, 23 bp, Homo sapiens
actgagtaccaggggctgggctc

SEQ ID NO: 3199727 - DNA, 21 bp, Homo sapiens
actgagtcccctccaggaaga

SEQ ID NO: 3199728 - DNA, 15 bp, Homo sapiens
actgataaagaaaga

SEQ ID NO: 3199729 - DNA, 13 bp, Homo sapiens
actgataagactg

SEQ ID NO: 3199730 - DNA, 19 bp, Homo sapiens
actgatcaatccttcttat

SEQ ID NO: 3199731 - DNA, 15 bp, Homo sapiens
actgatcatgcattg

SEQ ID NO: 3199732 - DNA, 22 bp, Homo sapiens
actgatctctactaccacaagg

SEQ ID NO: 3199733 - DNA, 13 bp, Homo sapiens
actgatgcaagga

SEQ ID NO: 3199734 - DNA, 20 bp, Homo sapiens
actgatgctgttctcttctt

SEQ ID NO: 3199735 - DNA, 18 bp, Homo sapiens
actgatgttgtgttttta

SEQ ID NO: 3199736 - DNA, 13 bp, Homo sapiens
actgatgttttag

SEQ ID NO: 3199737 - DNA, 17 bp, Homo sapiens
actgatttcacaacaga

SEQ ID NO: 3199738 - DNA, 20 bp, Homo sapiens
actgatttcacaacagatca

SEQ ID NO: 3199739 - DNA, 12 bp, Homo sapiens
actgatttcaga

SEQ ID NO: 3199740 - DNA, 14 bp, Homo sapiens
actgatttcagtaa

SEQ ID NO: 3199741 - DNA, 15 bp, Homo sapiens
actgatttcagtaag

SEQ ID NO: 3199742 - DNA, 14 bp, Homo sapiens
actgatttcctttg

SEQ ID NO: 3199743 - DNA, 12 bp, Homo sapiens
actgatttctat

SEQ ID NO: 3199744 - DNA, 16 bp, Homo sapiens
actgatttctatggct

SEQ ID NO: 3199745 - DNA, 21 bp, Homo sapiens
actgatttctatggctttcaa

SEQ ID NO: 3199746 - DNA, 23 bp, Homo sapiens
actgatttctatggctttcaaag

SEQ ID NO: 3199747 - DNA, 19 bp, Homo sapiens
actgatttcttcagaatta

SEQ ID NO: 3199748 - DNA, 22 bp, Homo sapiens
actgattttgttatttttatat

SEQ ID NO: 3199749 - DNA, 13 bp, Homo sapiens
actgcaaactttt

SEQ ID NO: 3199750 - DNA, 15 bp, Homo sapiens
actgcaaaggcgcag

SEQ ID NO: 3199751 - DNA, 16 bp, Homo sapiens
actgcaaataaagcct

SEQ ID NO: 3199752 - DNA, 17 bp, Homo sapiens
actgcaaataaagcctt

SEQ ID NO: 3199753 - DNA, 14 bp, Homo sapiens
actgcaacctccgc

SEQ ID NO: 3199754 - DNA, 16 bp, Homo sapiens
actgcaacctccgcct

SEQ ID NO: 3199755 - DNA, 21 bp, Homo sapiens
actgcaatagagactgtagat

SEQ ID NO: 3199756 - DNA, 16 bp, Homo sapiens
actgcacacacagctc

SEQ ID NO: 3199757 - DNA, 17 bp, Homo sapiens
actgcacacacagctcc

SEQ ID NO: 3199758 - DNA, 15 bp, Homo sapiens
actgcacagagctct

SEQ ID NO: 3199759 - DNA, 17 bp, Homo sapiens
actgcacagagctctcc

SEQ ID NO: 3199760 - DNA, 18 bp, Homo sapiens
actgcacagagctctcca

SEQ ID NO: 3199761 - DNA, 19 bp, Homo sapiens
actgcacagagctctccag

SEQ ID NO: 3199762 - DNA, 18 bp, Homo sapiens
actgcacagtgcatctca

SEQ ID NO: 3199763 - DNA, 14 bp, Homo sapiens
actgcacagtgctg

SEQ ID NO: 3199764 - DNA, 19 bp, Homo sapiens
actgcacagtgctgttggt

SEQ ID NO: 3199765 - DNA, 14 bp, Homo sapiens
actgcacccagctc

SEQ ID NO: 3199766 - DNA, 17 bp, Homo sapiens
actgcacccagctccag

SEQ ID NO: 3199767 - DNA, 18 bp, Homo sapiens
actgcacccagctccagg

SEQ ID NO: 3199768 - DNA, 19 bp, Homo sapiens
actgcacccagctccaggg

SEQ ID NO: 3199769 - DNA, 20 bp, Homo sapiens
actgcactatagcctaggtg

SEQ ID NO: 3199770 - DNA, 14 bp, Homo sapiens
actgcactccagcc

SEQ ID NO: 3199771 - DNA, 18 bp, Homo sapiens
actgcactccagcctggg

SEQ ID NO: 3199772 - DNA, 20 bp, Homo sapiens
actgcactccagcctgggcg

SEQ ID NO: 3199773 - DNA, 21 bp, Homo sapiens
actgcactccagcctgggcga

SEQ ID NO: 3199774 - DNA, 21 bp, Homo sapiens
actgcagaccatgaagtaaat

SEQ ID NO: 3199775 - DNA, 12 bp, Homo sapiens
actgcagcacct

SEQ ID NO: 3199776 - DNA, 16 bp, Homo sapiens
actgcagcacctccag

SEQ ID NO: 3199777 - DNA, 19 bp, Homo sapiens
actgcagcctcaacctcct

SEQ ID NO: 3199778 - DNA, 22 bp, Homo sapiens
actgcagcctcaacctcctggg

SEQ ID NO: 3199779 - DNA, 16 bp, Homo sapiens
actgcaggccctggcc

SEQ ID NO: 3199780 - DNA, 18 bp, Homo sapiens
actgcaggccctggcctc

SEQ ID NO: 3199781 - DNA, 22 bp, Homo sapiens
actgcaggccctggcctcccct

SEQ ID NO: 3199782 - DNA, 18 bp, Homo sapiens
actgcagggactgccagt

SEQ ID NO: 3199783 - DNA, 20 bp, Homo sapiens
actgcagggccaggactgag

SEQ ID NO: 3199784 - DNA, 22 bp, Homo sapiens
actgcagtccgcagtctggcct

SEQ ID NO: 3199785 - DNA, 13 bp, Homo sapiens
actgcatactttt

SEQ ID NO: 3199786 - DNA, 16 bp, Homo sapiens
actgcatactttttaa

SEQ ID NO: 3199787 - DNA, 13 bp, Homo sapiens
acgtacacacaca

SEQ ID NO: 3199788 - DNA, 15 bp, Homo sapiens
acgtagtaaaagtca

SEQ ID NO: 3199789 - DNA, 16 bp, Homo sapiens
acgtagtaaaagtcat

SEQ ID NO: 3199790 - DNA, 16 bp, Homo sapiens
acgtatgagaaaccta

SEQ ID NO: 3199791 - DNA, 15 bp, Homo sapiens
acgtatgcaagtctg

SEQ ID NO: 3199792 - DNA, 15 bp, Homo sapiens
acgtattacaaacaa

SEQ ID NO: 3199793 - DNA, 17 bp, Homo sapiens
acgtatttatatttgga

SEQ ID NO: 3199794 - DNA, 14 bp, Homo sapiens
acgtattttaaaag

SEQ ID NO: 3199795 - DNA, 18 bp, Homo sapiens
acgtcatcggaggctggg

SEQ ID NO: 3199796 - DNA, 21 bp, Homo sapiens
acgtcatcggaggctgggccc

SEQ ID NO: 3199797 - DNA, 12 bp, Homo sapiens
acgtcatgtatt

SEQ ID NO: 3199798 - DNA, 20 bp, Homo sapiens
acgtccatcacgttagctgt

SEQ ID NO: 3199799 - DNA, 18 bp, Homo sapiens
acgtcccagcatccctgg

SEQ ID NO: 3199800 - DNA, 19 bp, Homo sapiens
acgtcccagcatccctgga

SEQ ID NO: 3199801 - DNA, 22 bp, Homo sapiens
acgtcgcccgctgagctgagtg

SEQ ID NO: 3199802 - DNA, 23 bp, Homo sapiens
acgtcgcccgctgagctgagtgg

SEQ ID NO: 3199803 - DNA, 19 bp, Homo sapiens
acgtctgccaggcccatct

SEQ ID NO: 3199804 - DNA, 14 bp, Homo sapiens
acgtctggggtgtg

SEQ ID NO: 3199805 - DNA, 16 bp, Homo sapiens
acgtgacagtgcctgg

SEQ ID NO: 3199806 - DNA, 19 bp, Homo sapiens
acgtgacagtgcctgggaa

SEQ ID NO: 3199807 - DNA, 20 bp, Homo sapiens
acgtgagagaaagagagaag

SEQ ID NO: 3199808 - DNA, 11 bp, Homo sapiens
acgtgcacagg

SEQ ID NO: 3199809 - DNA, 21 bp, Homo sapiens
acgtgcacctgtactcaggag

SEQ ID NO: 3199810 - DNA, 22 bp, Homo sapiens
acgtgccttttgcacccctccc

SEQ ID NO: 3199811 - DNA, 17 bp, Homo sapiens
acgtggacgtttttaat

SEQ ID NO: 3199812 - DNA, 16 bp, Homo sapiens
acgtggagagctggtg

SEQ ID NO: 3199813 - DNA, 11 bp, Homo sapiens
acgtgggagac

SEQ ID NO: 3199814 - DNA, 15 bp, Homo sapiens
acgtggtcactgtgc

SEQ ID NO: 3199815 - DNA, 16 bp, Homo sapiens
acgtggtggctcacac

SEQ ID NO: 3199816 - DNA, 21 bp, Homo sapiens
acgtggtggctcacacctgca

SEQ ID NO: 3199817 - DNA, 17 bp, Homo sapiens
acgtgtattttcattac

SEQ ID NO: 3199818 - DNA, 22 bp, Homo sapiens
acgtgtcagaagcctccaagcc

SEQ ID NO: 3199819 - DNA, 21 bp, Homo sapiens
acgtgtgtaaatatgtacatt

SEQ ID NO: 3199820 - DNA, 22 bp, Homo sapiens
acgtgtgtaaatatgtacattt

SEQ ID NO: 3199821 - DNA, 18 bp, Homo sapiens
acgtgtttaattaaattt

SEQ ID NO: 3199822 - DNA, 19 bp, Homo sapiens
acgttactcagggctcctc

SEQ ID NO: 3199823 - DNA, 18 bp, Homo sapiens
acgttcacccatcttatc

SEQ ID NO: 3199824 - DNA, 22 bp, Homo sapiens
acgttcactggtctctaagtgt

SEQ ID NO: 3199825 - DNA, 13 bp, Homo sapiens
acgttccacagtt

SEQ ID NO: 3199826 - DNA, 14 bp, Homo sapiens
acgttcgatttcta

SEQ ID NO: 3199827 - DNA, 16 bp, Homo sapiens
acgttcgatttctacc

SEQ ID NO: 3199828 - DNA, 19 bp, Homo sapiens
acgttggacttttcgttaa

SEQ ID NO: 3199829 - DNA, 23 bp, Homo sapiens
acgttggacttttcgttaacatt

SEQ ID NO: 3199830 - DNA, 21 bp, Homo sapiens
acgttggcctcagggccagga

SEQ ID NO: 3199831 - DNA, 22 bp, Homo sapiens
acgttggcctcagggccaggaa

SEQ ID NO: 3199832 - DNA, 13 bp, Homo sapiens
acgtttaaagttc

SEQ ID NO: 3199833 - DNA, 14 bp, Homo sapiens
acgtttaaagttct

SEQ ID NO: 3199834 - DNA, 19 bp, Homo sapiens
acgtttcagtaataaaaca

SEQ ID NO: 3199835 - DNA, 13 bp, Homo sapiens
acgtttgtatgtg

SEQ ID NO: 3199836 - DNA, 18 bp, Homo sapiens
acgttttattgtgttttt

SEQ ID NO: 3199837 - DNA, 14 bp, Homo sapiens
acgtttttccttta

SEQ ID NO: 3199838 - DNA, 17 bp, Homo sapiens
acgttttttcctcagtg

SEQ ID NO: 3199839 - DNA, 18 bp, Homo sapiens
acgttttttcctcagtgc

SEQ ID NO: 3199840 - DNA, 15 bp, Homo sapiens
actaaaaaaaagatg

SEQ ID NO: 3199841 - DNA, 15 bp, Homo sapiens
actaaaaagtaccag

SEQ ID NO: 3199842 - DNA, 18 bp, Homo sapiens
actaaaaagttgaaccat

SEQ ID NO: 3199843 - DNA, 14 bp, Homo sapiens
actaaaaatacaaa

SEQ ID NO: 3199844 - DNA, 18 bp, Homo sapiens
actaaaatcattgtcaaa

SEQ ID NO: 3199845 - DNA, 13 bp, Homo sapiens
actaaacattttg

SEQ ID NO: 3199846 - DNA, 19 bp, Homo sapiens
actaaactatctgtattta

SEQ ID NO: 3199847 - DNA, 16 bp, Homo sapiens
actaaagagagaatgt

SEQ ID NO: 3199848 - DNA, 21 bp, Homo sapiens
actaaagagagaatgtagata

SEQ ID NO: 3199849 - DNA, 11 bp, Homo sapiens
actaaagcaaa

SEQ ID NO: 3199850 - DNA, 13 bp, Homo sapiens
actaaagccaagg

SEQ ID NO: 3199851 - DNA, 15 bp, Homo sapiens
actaaagccagcctg

SEQ ID NO: 3199852 - DNA, 15 bp, Homo sapiens
actaaagtatagaga

SEQ ID NO: 3199853 - DNA, 20 bp, Homo sapiens
actaaagtatagagaaaagt

SEQ ID NO: 3199854 - DNA, 22 bp, Homo sapiens
actaaagtatagagaaaagtgt

SEQ ID NO: 3199855 - DNA, 14 bp, Homo sapiens
actaaagtatgtaa

SEQ ID NO: 3199856 - DNA, 22 bp, Homo sapiens
actaaagtatgtaaagtatgta

SEQ ID NO: 3199857 - DNA, 15 bp, Homo sapiens
actaaataatgaata

SEQ ID NO: 3199858 - DNA, 21 bp, Homo sapiens
actaaataatgaataaactga

SEQ ID NO: 3199859 - DNA, 19 bp, Homo sapiens
actcattgaaatgtcacgt

SEQ ID NO: 3199860 - DNA, 17 bp, Homo sapiens
actcattgcagcagata

SEQ ID NO: 3199861 - DNA, 20 bp, Homo sapiens
actcattgcagcagataact

SEQ ID NO: 3199862 - DNA, 22 bp, Homo sapiens
actcattgcagcagataacttt

SEQ ID NO: 3199863 - DNA, 19 bp, Homo sapiens
actcattgcccccacctct

SEQ ID NO: 3199864 - DNA, 20 bp, Homo sapiens
actcattgcccccacctctg

SEQ ID NO: 3199865 - DNA, 21 bp, Homo sapiens
actcattgcccccacctctgg

SEQ ID NO: 3199866 - DNA, 15 bp, Homo sapiens
actcattgctgagcc

SEQ ID NO: 3199867 - DNA, 17 bp, Homo sapiens
actcatttctaaaagaa

SEQ ID NO: 3199868 - DNA, 18 bp, Homo sapiens
actcatttctaaaagaat

SEQ ID NO: 3199869 - DNA, 19 bp, Homo sapiens
actcatttctaaaagaata

SEQ ID NO: 3199870 - DNA, 16 bp, Homo sapiens
actcatttttttaatt

SEQ ID NO: 3199871 - DNA, 18 bp, Homo sapiens
actccaaaacccatgtgg

SEQ ID NO: 3199872 - DNA, 16 bp, Homo sapiens
actccaaacctgtctt

SEQ ID NO: 3199873 - DNA, 17 bp, Homo sapiens
actccaaagtccacaca

SEQ ID NO: 3199874 - DNA, 20 bp, Homo sapiens
actccaactcccttaaaata

SEQ ID NO: 3199875 - DNA, 20 bp, Homo sapiens
actccaatgtctgctgagga

SEQ ID NO: 3199876 - DNA, 15 bp, Homo sapiens
actccacatctgcct

SEQ ID NO: 3199877 - DNA, 16 bp, Homo sapiens
actccacatctgcctt

SEQ ID NO: 3199878 - DNA, 16 bp, Homo sapiens
actccactctccttcg

SEQ ID NO: 3199879 - DNA, 13 bp, Homo sapiens
actccactgccct

SEQ ID NO: 3199880 - DNA, 13 bp, Homo sapiens
actccactgtttt

SEQ ID NO: 3199881 - DNA, 16 bp, Homo sapiens
actccagaatctgctg

SEQ ID NO: 3199882 - DNA, 23 bp, Homo sapiens
actccagaatctgctgttgccat

SEQ ID NO: 3199883 - DNA, 13 bp, Homo sapiens
actccagacccct

SEQ ID NO: 3199884 - DNA, 19 bp, Homo sapiens
actccagacccctggcttt

SEQ ID NO: 3199885 - DNA, 14 bp, Homo sapiens
actccagagtctga

SEQ ID NO: 3199886 - DNA, 18 bp, Homo sapiens
actccagagtctgagccc

SEQ ID NO: 3199887 - DNA, 15 bp, Homo sapiens
actccagatagagaa

SEQ ID NO: 3199888 - DNA, 12 bp, Homo sapiens
actccagcctgg

SEQ ID NO: 3199889 - DNA, 13 bp, Homo sapiens
actccagcctggg

SEQ ID NO: 3199890 - DNA, 18 bp, Homo sapiens
actccaggccctcctctc

SEQ ID NO: 3199891 - DNA, 13 bp, Homo sapiens
actccaggccctg

SEQ ID NO: 3199892 - DNA, 15 bp, Homo sapiens
actccaggccctgcc

SEQ ID NO: 3199893 - DNA, 14 bp, Homo sapiens
actccagtgtacat

SEQ ID NO: 3199894 - DNA, 16 bp, Homo sapiens
actccatctctcatcc

SEQ ID NO: 3199895 - DNA, 20 bp, Homo sapiens
actccatgtttggtgtttgt

SEQ ID NO: 3199896 - DNA, 12 bp, Homo sapiens
actccattccca

SEQ ID NO: 3199897 - DNA, 21 bp, Homo sapiens
actccatttggtcctttctcc

SEQ ID NO: 3199898 - DNA, 16 bp, Homo sapiens
actcccacctgacaca

SEQ ID NO: 3199899 - DNA, 17 bp, Homo sapiens
actcccagcactcccct

SEQ ID NO: 3199900 - DNA, 22 bp, Homo sapiens
actcccagtccaaatgtcctcc

SEQ ID NO: 3199901 - DNA, 15 bp, Homo sapiens
actccccaaccccca

SEQ ID NO: 3199902 - DNA, 19 bp, Homo sapiens
actccccaaggaagagcca

SEQ ID NO: 3199903 - DNA, 18 bp, Homo sapiens
actccccagagctgtgcc

SEQ ID NO: 3199904 - DNA, 22 bp, Homo sapiens
actccccctaaacccctgtccc

SEQ ID NO: 3199905 - DNA, 17 bp, Homo sapiens
actccccgaagtctttt

SEQ ID NO: 3199906 - DNA, 23 bp, Homo sapiens
actcccctgtttcaatcactgtc

SEQ ID NO: 3199907 - DNA, 18 bp, Homo sapiens
actcccgggccacgcccc

SEQ ID NO: 3199908 - DNA, 21 bp, Homo sapiens
actccctaatttatgtgctat

SEQ ID NO: 3199909 - DNA, 17 bp, Homo sapiens
actccctacactgatgc

SEQ ID NO: 3199910 - DNA, 19 bp, Homo sapiens
actccctcctcacctctgg

SEQ ID NO: 3199911 - DNA, 22 bp, Homo sapiens
actccctcctcacctctggact

SEQ ID NO: 3199912 - DNA, 16 bp, Homo sapiens
actccctctgccttca

SEQ ID NO: 3199913 - DNA, 23 bp, Homo sapiens
actccctctgccttcaggcttct

SEQ ID NO: 3199914 - DNA, 16 bp, Homo sapiens
actccctgctccacga

SEQ ID NO: 3199915 - DNA, 21 bp, Homo sapiens
actccctggatgtgtggggca

SEQ ID NO: 3199916 - DNA, 22 bp, Homo sapiens
actccctgtagtgaatcctctg

SEQ ID NO: 3199917 - DNA, 16 bp, Homo sapiens
actcccttcctggcct

SEQ ID NO: 3199918 - DNA, 17 bp, Homo sapiens
actcccttgctggcccc

SEQ ID NO: 3199919 - DNA, 21 bp, Homo sapiens
actcccttgctggccccagcc

SEQ ID NO: 3199920 - DNA, 22 bp, Homo sapiens
actcccttggtggcaagagccc

SEQ ID NO: 3199921 - DNA, 15 bp, Homo sapiens
actccgaagaaaaga

SEQ ID NO: 3199922 - DNA, 16 bp, Homo sapiens
actccgaagaaaagaa

SEQ ID NO: 3199923 - DNA, 18 bp, Homo sapiens
actccgcccccagcctat

SEQ ID NO: 3199924 - DNA, 15 bp, Homo sapiens
actccgttggccact

SEQ ID NO: 3199925 - DNA, 15 bp, Homo sapiens
actcctacctcagcc

SEQ ID NO: 3199926 - DNA, 16 bp, Homo sapiens
actcctacctgccctg

SEQ ID NO: 3199927 - DNA, 20 bp, Homo sapiens
actcctagactttgggatca

SEQ ID NO: 3199928 - DNA, 14 bp, Homo sapiens
actcctaggagagc

SEQ ID NO: 3199929 - DNA, 15 bp, Homo sapiens
actcctaggagagcc

SEQ ID NO: 3199930 - DNA, 11 bp, Homo sapiens
actcctccctc

SEQ ID NO: 3199931 - DNA, 13 bp, Homo sapiens
actcctccctccg

SEQ ID NO: 3199932 - DNA, 18 bp, Homo sapiens
actcctcctcactaaaaa

SEQ ID NO: 3199933 - DNA, 15 bp, Homo sapiens
actcctcctttctcc

SEQ ID NO: 3199934 - DNA, 17 bp, Homo sapiens
actcctctgcagtgcct

SEQ ID NO: 3199935 - DNA, 11 bp, Homo sapiens
actcctctggg

SEQ ID NO: 3199936 - DNA, 12 bp, Homo sapiens
actcctctgggc

SEQ ID NO: 3199937 - DNA, 14 bp, Homo sapiens
actcctctgggcct

SEQ ID NO: 3199938 - DNA, 16 bp, Homo sapiens
actcctctgggcctgg

SEQ ID NO: 3199939 - DNA, 19 bp, Homo sapiens
actcctgacagtcttgtgc

SEQ ID NO: 3199940 - DNA, 15 bp, Homo sapiens
actcctgacctcaag

SEQ ID NO: 3199941 - DNA, 19 bp, Homo sapiens
actcctgacgtctgaagct

SEQ ID NO: 3199942 - DNA, 18 bp, Homo sapiens
actcctgactcctacctg

SEQ ID NO: 3199943 - DNA, 9 bp, Homo sapiens
actcctgcc

SEQ ID NO: 3199944 - DNA, 20 bp, Homo sapiens
actcctgccaccagcatcca

SEQ ID NO: 3199945 - DNA, 19 bp, Homo sapiens
actcctgccattcttctgg

SEQ ID NO: 3199946 - DNA, 20 bp, Homo sapiens
actcctgcctccgctggctt

SEQ ID NO: 3199947 - DNA, 21 bp, Homo sapiens
actcctgctggtacctgccct

SEQ ID NO: 3199948 - DNA, 12 bp, Homo sapiens
actcctggcctc

SEQ ID NO: 3199949 - DNA, 14 bp, Homo sapiens
actcctggcctcaa

SEQ ID NO: 3199950 - DNA, 21 bp, Homo sapiens
actcctggggcctcttgggtc

SEQ ID NO: 3199951 - DNA, 17 bp, Homo sapiens
actcctggtgcccctcg

SEQ ID NO: 3199952 - DNA, 22 bp, Homo sapiens
actcctggtgcccctcgccagc

SEQ ID NO: 3199953 - DNA, 15 bp, Homo sapiens
actcctgtacactga

SEQ ID NO: 3199954 - DNA, 19 bp, Homo sapiens
actcctgtcccgccttcct

SEQ ID NO: 3199955 - DNA, 21 bp, Homo sapiens
actcctgtcccgccttcctcc

SEQ ID NO: 3199956 - DNA, 16 bp, Homo sapiens
actcctgtgctctgga

SEQ ID NO: 3199957 - DNA, 20 bp, Homo sapiens
actcctgttacttacctaaa

SEQ ID NO: 3199958 - DNA, 15 bp, Homo sapiens
actccttattttgta

SEQ ID NO: 3199959 - DNA, 14 bp, Homo sapiens
actccttggcctag

SEQ ID NO: 3199960 - DNA, 16 bp, Homo sapiens
actcgaggcctgcaaa

SEQ ID NO: 3199961 - DNA, 21 bp, Homo sapiens
actcgcctgtggacggggagg

SEQ ID NO: 3199962 - DNA, 15 bp, Homo sapiens
actcgcgctcagtaa

SEQ ID NO: 3199963 - DNA, 14 bp, Homo sapiens
actcggtttctcca

SEQ ID NO: 3199964 - DNA, 16 bp, Homo sapiens
actcggtttctccaaa

SEQ ID NO: 3199965 - DNA, 15 bp, Homo sapiens
actctaaaaggttca

SEQ ID NO: 3199966 - DNA, 18 bp, Homo sapiens
actctaaaaggttcaggg

SEQ ID NO: 3199967 - DNA, 21 bp, Homo sapiens
actctaaaattataaatgaca

SEQ ID NO: 3199968 - DNA, 23 bp, Homo sapiens
actctaaattctttatttctgtc

SEQ ID NO: 3199969 - DNA, 17 bp, Homo sapiens
actctaagatcttagat

SEQ ID NO: 3199970 - DNA, 14 bp, Homo sapiens
actctaagctgtgt

SEQ ID NO: 3199971 - DNA, 13 bp, Homo sapiens
actctaatatgat

SEQ ID NO: 3199972 - DNA, 17 bp, Homo sapiens
actctaatatgattata

SEQ ID NO: 3199973 - DNA, 20 bp, Homo sapiens
actctaattcccattttgca

SEQ ID NO: 3199974 - DNA, 22 bp, Homo sapiens
actctaattcccattttgcaaa

SEQ ID NO: 3199975 - DNA, 14 bp, Homo sapiens
actctacccctgct

SEQ ID NO: 3199976 - DNA, 15 bp, Homo sapiens
actctacccctgctc

SEQ ID NO: 3199977 - DNA, 16 bp, Homo sapiens
actctacccctgctcc

SEQ ID NO: 3199978 - DNA, 19 bp, Homo sapiens
actctacccctgctcccat

SEQ ID NO: 3199979 - DNA, 19 bp, Homo sapiens
actctaccctcccaccccc

SEQ ID NO: 3199980 - DNA, 23 bp, Homo sapiens
actctacctaatgtctcactgtt

SEQ ID NO: 3199981 - DNA, 10 bp, Homo sapiens
actctacctc

SEQ ID NO: 3199982 - DNA, 21 bp, Homo sapiens
actctagatgaagttttacat

SEQ ID NO: 3199983 - DNA, 13 bp, Homo sapiens
actctaggaagaa

SEQ ID NO: 3199984 - DNA, 21 bp, Homo sapiens
actctaggatgtatattttat

SEQ ID NO: 3199985 - DNA, 21 bp, Homo sapiens
actctaggggtcaggctccat

SEQ ID NO: 3199986 - DNA, 17 bp, Homo sapiens
actctaggttatacaat

SEQ ID NO: 3199987 - DNA, 15 bp, Homo sapiens
actctatagactcta

SEQ ID NO: 3199988 - DNA, 20 bp, Homo sapiens
accttatagttactgtgtaa

SEQ ID NO: 3199989 - DNA, 23 bp, Homo sapiens
accttatagttactgtgtaatta

SEQ ID NO: 3199990 - DNA, 16 bp, Homo sapiens
accttatcaggatggt

SEQ ID NO: 3199991 - DNA, 19 bp, Homo sapiens
accttattggatatttgat

SEQ ID NO: 3199992 - DNA, 22 bp, Homo sapiens
accttattgtacctctcttata

SEQ ID NO: 3199993 - DNA, 19 bp, Homo sapiens
accttcaaagaaacttgaa

SEQ ID NO: 3199994 - DNA, 16 bp, Homo sapiens
accttcatgcccttct

SEQ ID NO: 3199995 - DNA, 18 bp, Homo sapiens
accttcatgcccttctga

SEQ ID NO: 3199996 - DNA, 18 bp, Homo sapiens
accttcatttcaggaggg

SEQ ID NO: 3199997 - DNA, 13 bp, Homo sapiens
accttcattttga

SEQ ID NO: 3199998 - DNA, 17 bp, Homo sapiens
accttcattttgagggg

SEQ ID NO: 3199999 - DNA, 13 bp, Homo sapiens
accttccagctcc

SEQ ID NO: 3200000 - DNA, 17 bp, Homo sapiens
accttccagctcctgta

SEQ ID NO: 3200001 - DNA, 14 bp, Homo sapiens
accttccagggccc

SEQ ID NO: 3200002 - DNA, 15 bp, Homo sapiens
accttccagggccct

SEQ ID NO: 3200003 - DNA, 17 bp, Homo sapiens
accttccagggccctag

SEQ ID NO: 3200004 - DNA, 14 bp, Homo sapiens
accttcccaaacgc

SEQ ID NO: 3200005 - DNA, 19 bp, Homo sapiens
accttcccaaacgcctccc

SEQ ID NO: 3200006 - DNA, 22 bp, Homo sapiens
accttcccaaacgcctcccctg

SEQ ID NO: 3200007 - DNA, 14 bp, Homo sapiens
accttcctcctccc

SEQ ID NO: 3200008 - DNA, 16 bp, Homo sapiens
accttcctctggggct

SEQ ID NO: 3200009 - DNA, 20 bp, Homo sapiens
accttcctgggaggacaggc

SEQ ID NO: 3200010 - DNA, 17 bp, Homo sapiens
accttccttaagccagg

SEQ ID NO: 3200011 - DNA, 15 bp, Homo sapiens
accttcgggctgtgc

SEQ ID NO: 3200012 - DNA, 20 bp, Homo sapiens
accttcggggcctgtctgaa

SEQ ID NO: 3200013 - DNA, 21 bp, Homo sapiens
accttcggggcctgtctgaag

SEQ ID NO: 3200014 - DNA, 16 bp, Homo sapiens
accttctctatatcat

SEQ ID NO: 3200015 - DNA, 19 bp, Homo sapiens
accttctggcttccttctc

SEQ ID NO: 3200016 - DNA, 14 bp, Homo sapiens
accttctttgtaat

SEQ ID NO: 3200017 - DNA, 16 bp, Homo sapiens
accttgaaaaaaaaca

SEQ ID NO: 3200018 - DNA, 18 bp, Homo sapiens
accttgaaaaaaaacagt

SEQ ID NO: 3200019 - DNA, 22 bp, Homo sapiens
accttgaaaaaaaacagtggat

SEQ ID NO: 3200020 - DNA, 14 bp, Homo sapiens
accttgacagggca

SEQ ID NO: 3200021 - DNA, 18 bp, Homo sapiens
accttgagtcagaaaaca

SEQ ID NO: 3200022 - DNA, 15 bp, Homo sapiens
accttgccttagaaa

SEQ ID NO: 3200023 - DNA, 11 bp, Homo sapiens
accttgctgtc

SEQ ID NO: 3200024 - DNA, 12 bp, Homo sapiens
accttgctgtcc

SEQ ID NO: 3200025 - DNA, 14 bp, Homo sapiens
accttgctgtcctg

SEQ ID NO: 3200026 - DNA, 23 bp, Homo sapiens
accttgctgtcctgatctgtgat

SEQ ID NO: 3200027 - DNA, 22 bp, Homo sapiens
accttgcttcttactgataatt

SEQ ID NO: 3200028 - DNA, 14 bp, Homo sapiens
accttggctcaagt

SEQ ID NO: 3200029 - DNA, 20 bp, Homo sapiens
accttggctctgccagtgga

SEQ ID NO: 3200030 - DNA, 12 bp, Homo sapiens
accttggctgca

SEQ ID NO: 3200031 - DNA, 15 bp, Homo sapiens
accttggtgagatgg

SEQ ID NO: 3200032 - DNA, 17 bp, Homo sapiens
accttgtaaccagtgca

SEQ ID NO: 3200033 - DNA, 20 bp, Homo sapiens
accttgtagcatgtgaagaa

SEQ ID NO: 3200034 - DNA, 14 bp, Homo sapiens
accttgtgatcatg

SEQ ID NO: 3200035 - DNA, 13 bp, Homo sapiens
accttgtgtctgt

SEQ ID NO: 3200036 - DNA, 18 bp, Homo sapiens
accttgtgtctgtacacg

SEQ ID NO: 3200037 - DNA, 16 bp, Homo sapiens
accttgttacttctga

SEQ ID NO: 3200038 - DNA, 14 bp, Homo sapiens
accttgttctattt

SEQ ID NO: 3200039 - DNA, 15 bp, Homo sapiens
accttgttctatttt

SEQ ID NO: 3200040 - DNA, 22 bp, Homo sapiens
acctttaggtcaaactccctag

SEQ ID NO: 3200041 - DNA, 14 bp, Homo sapiens
acctttatctttca

SEQ ID NO: 3200042 - DNA, 22 bp, Homo sapiens
acctttattgggtatcaagaca

SEQ ID NO: 3200043 - DNA, 17 bp, Homo sapiens
acctttgggactaagct

SEQ ID NO: 3200044 - DNA, 13 bp, Homo sapiens
acctttgtagtta

SEQ ID NO: 3200045 - DNA, 23 bp, Homo sapiens
acctttgtggggtttttggagaa

SEQ ID NO: 3200046 - DNA, 14 bp, Homo sapiens
accttttaactcac

SEQ ID NO: 3200047 - DNA, 18 bp, Homo sapiens
accttttaagacattttc

SEQ ID NO: 3200048 - DNA, 20 bp, Homo sapiens
accttttatgtagtaattga

SEQ ID NO: 3200049 - DNA, 15 bp, Homo sapiens
accttttcttcaaaa

SEQ ID NO: 3200050 - DNA, 13 bp, Homo sapiens
accttttcttcat

SEQ ID NO: 3200051 - DNA, 17 bp, Homo sapiens
accttttgaggagcccc

SEQ ID NO: 3200052 - DNA, 16 bp, Homo sapiens
accttttgggaatgtt

SEQ ID NO: 3200053 - DNA, 17 bp, Homo sapiens
acctttttgtaaatact

SEQ ID NO: 3200054 - DNA, 13 bp, Homo sapiens
accttttttgtct

SEQ ID NO: 3200055 - DNA, 19 bp, Homo sapiens
acgaaacacaaaccacaac

SEQ ID NO: 3200056 - DNA, 23 bp, Homo sapiens
acgaaatgttattttttaattat

SEQ ID NO: 3200057 - DNA, 12 bp, Homo sapiens
acgaagccttaa

SEQ ID NO: 3200058 - DNA, 21 bp, Homo sapiens
acgacaaagctgctaaatctc

SEQ ID NO: 3200059 - DNA, 20 bp, Homo sapiens
acgacaacgatgatgcttgt

SEQ ID NO: 3200060 - DNA, 12 bp, Homo sapiens
acgaccagcccc

SEQ ID NO: 3200061 - DNA, 20 bp, Homo sapiens
acgaccagccccttcctggg

SEQ ID NO: 3200062 - DNA, 21 bp, Homo sapiens
acgaccggggccagcaccact

SEQ ID NO: 3200063 - DNA, 18 bp, Homo sapiens
acgagcactggccagaga

SEQ ID NO: 3200064 - DNA, 19 bp, Homo sapiens
acgagcactggccagagag

SEQ ID NO: 3200065 - DNA, 22 bp, Homo sapiens
acgaggaaaagaacaaacaaaa

SEQ ID NO: 3200066 - DNA, 16 bp, Homo sapiens
acgagtcacctgcaag

SEQ ID NO: 3200067 - DNA, 17 bp, Homo sapiens
acgagtcacctgcaagc

SEQ ID NO: 3200068 - DNA, 17 bp, Homo sapiens
acgatagttacataatc

SEQ ID NO: 3200069 - DNA, 17 bp, Homo sapiens
acgatcccctcccccaa

SEQ ID NO: 3200070 - DNA, 16 bp, Homo sapiens
acgatgaatttcttct

SEQ ID NO: 3200071 - DNA, 19 bp, Homo sapiens
acgatgcatttaataaaga

SEQ ID NO: 3200072 - DNA, 20 bp, Homo sapiens
acgcaagggcatcaggcact

SEQ ID NO: 3200073 - DNA, 18 bp, Homo sapiens
acgcacaccctgcccctg

SEQ ID NO: 3200074 - DNA, 19 bp, Homo sapiens
acgcaccgccgccaccagc

SEQ ID NO: 3200075 - DNA, 13 bp, Homo sapiens
acgcacgcacaca

SEQ ID NO: 3200076 - DNA, 17 bp, Homo sapiens
acgcacgctcgctgcca

SEQ ID NO: 3200077 - DNA, 21 bp, Homo sapiens
acgcacgctcgctgccatcac

SEQ ID NO: 3200078 - DNA, 21 bp, Homo sapiens
acgcactgggccacggaggag

SEQ ID NO: 3200079 - DNA, 19 bp, Homo sapiens
acgcagatgatccatgagt

SEQ ID NO: 3200080 - DNA, 17 bp, Homo sapiens
acgcaggggttgcagtg

SEQ ID NO: 3200081 - DNA, 18 bp, Homo sapiens
acgcatacacacatgccc

SEQ ID NO: 3200082 - DNA, 22 bp, Homo sapiens
acgcatagactgaggtataaag

SEQ ID NO: 3200083 - DNA, 20 bp, Homo sapiens
acgcatctcaaaacagaggg

SEQ ID NO: 3200084 - DNA, 22 bp, Homo sapiens
acgcatggagtgtgtattgttc

SEQ ID NO: 3200085 - DNA, 19 bp, Homo sapiens
acgcatggtcaaccctcag

SEQ ID NO: 3200086 - DNA, 18 bp, Homo sapiens
acgccaccattcctggaa

SEQ ID NO: 3200087 - DNA, 15 bp, Homo sapiens
acgccagataaaatg

SEQ ID NO: 3200088 - DNA, 20 bp, Homo sapiens
acgccccgggcaaagggtct

SEQ ID NO: 3200089 - DNA, 21 bp, Homo sapiens
acgccccggggcgcctagagc

SEQ ID NO: 3200090 - DNA, 15 bp, Homo sapiens
acgcccctgtggcca

SEQ ID NO: 3200091 - DNA, 15 bp, Homo sapiens
acgcccgcacccccg

SEQ ID NO: 3200092 - DNA, 16 bp, Homo sapiens
acgccctactccactg

SEQ ID NO: 3200093 - DNA, 19 bp, Homo sapiens
acgccctactccactgccc

SEQ ID NO: 3200094 - DNA, 24 bp, Homo sapiens
acgccctactccactgccctggca

SEQ ID NO: 3200095 - DNA, 19 bp, Homo sapiens
acgccctcccctcccctgc

SEQ ID NO: 3200096 - DNA, 19 bp, Homo sapiens
acgccctgcgttggagcca

SEQ ID NO: 3200097 - DNA, 17 bp, Homo sapiens
acgccctttcctcctca

SEQ ID NO: 3200098 - DNA, 16 bp, Homo sapiens
acgcctatgatcccag

SEQ ID NO: 3200099 - DNA, 22 bp, Homo sapiens
acgcctcactgaaacatggctg

SEQ ID NO: 3200100 - DNA, 13 bp, Homo sapiens
acgcctcctggcc

SEQ ID NO: 3200101 - DNA, 20 bp, Homo sapiens
acgcctcttttccctctcta

SEQ ID NO: 3200102 - DNA, 21 bp, Homo sapiens
acgcctcttttccctctctag

SEQ ID NO: 3200103 - DNA, 15 bp, Homo sapiens
acgcctgaggcaatt

SEQ ID NO: 3200104 - DNA, 19 bp, Homo sapiens
acgcctgaggcaattagac

SEQ ID NO: 3200105 - DNA, 19 bp, Homo sapiens
acgcctgccctccccagag

SEQ ID NO: 3200106 - DNA, 18 bp, Homo sapiens
acgcctgtcctcctggaa

SEQ ID NO: 3200107 - DNA, 14 bp, Homo sapiens
acgccttcccctca

SEQ ID NO: 3200108 - DNA, 20 bp, Homo sapiens
acgcgtgcacacaccagagc

SEQ ID NO: 3200109 - DNA, 20 bp, Homo sapiens
acgcgtggtaaatgacccag

SEQ ID NO: 3200110 - DNA, 16 bp, Homo sapiens
acgctaaagagccctt

SEQ ID NO: 3200111 - DNA, 18 bp, Homo sapiens
acgctaaagagcccttgc

SEQ ID NO: 3200112 - DNA, 20 bp, Homo sapiens
acgctaaagagcccttgcct

SEQ ID NO: 3200113 - DNA, 18 bp, Homo sapiens
acgctaacaatttctcat

SEQ ID NO: 3200114 - DNA, 15 bp, Homo sapiens
acgctacctctctgt

SEQ ID NO: 3200115 - DNA, 21 bp, Homo sapiens
acgctcccccgcagtccccag

SEQ ID NO: 3200116 - DNA, 17 bp, Homo sapiens
acgctccccgcctgttc

SEQ ID NO: 3200117 - DNA, 20 bp, Homo sapiens
acctctccaagggcttctgc

SEQ ID NO: 3200118 - DNA, 22 bp, Homo sapiens
acctctccaagggcttctgcac

SEQ ID NO: 3200119 - DNA, 18 bp, Homo sapiens
acctctccaagtctctct

SEQ ID NO: 3200120 - DNA, 15 bp, Homo sapiens
acctctccctcaaca

SEQ ID NO: 3200121 - DNA, 12 bp, Homo sapiens
acctctctgtcc

SEQ ID NO: 3200122 - DNA, 14 bp, Homo sapiens
acctctctgtccct

SEQ ID NO: 3200123 - DNA, 16 bp, Homo sapiens
acctctctgtcccttg

SEQ ID NO: 3200124 - DNA, 22 bp, Homo sapiens
acctctcttatagaatatttat

SEQ ID NO: 3200125 - DNA, 19 bp, Homo sapiens
acctctgaaggcaaatata

SEQ ID NO: 3200126 - DNA, 12 bp, Homo sapiens
acctctgagaag

SEQ ID NO: 3200127 - DNA, 15 bp, Homo sapiens
acctctgatacctca

SEQ ID NO: 3200128 - DNA, 21 bp, Homo sapiens
acctctgcactactgacatgt

SEQ ID NO: 3200129 - DNA, 20 bp, Homo sapiens
acctctgcctgaagtcacac

SEQ ID NO: 3200130 - DNA, 23 bp, Homo sapiens
acctctgcctgaagtcacacagt

SEQ ID NO: 3200131 - DNA, 12 bp, Homo sapiens
acctctggccct

SEQ ID NO: 3200132 - DNA, 14 bp, Homo sapiens
acctctggccctgt

SEQ ID NO: 3200133 - DNA, 13 bp, Homo sapiens
acctctggccctt

SEQ ID NO: 3200134 - DNA, 14 bp, Homo sapiens
acctctggcccttg

SEQ ID NO: 3200135 - DNA, 20 bp, Homo sapiens
acctctggggaccccaacct

SEQ ID NO: 3200136 - DNA, 13 bp, Homo sapiens
acctctgtaattt

SEQ ID NO: 3200137 - DNA, 23 bp, Homo sapiens
acctctgtaatttttcagctctc

SEQ ID NO: 3200138 - DNA, 20 bp, Homo sapiens
acctctgtctcatcctcctg

SEQ ID NO: 3200139 - DNA, 23 bp, Homo sapiens
acctctgtctcatcctcctggaa

SEQ ID NO: 3200140 - DNA, 17 bp, Homo sapiens
acctctgtgacctcagg

SEQ ID NO: 3200141 - DNA, 18 bp, Homo sapiens
acctctgtgacctcaggc

SEQ ID NO: 3200142 - DNA, 19 bp, Homo sapiens
acctctgtgacctcaggca

SEQ ID NO: 3200143 - DNA, 11 bp, Homo sapiens
acctctgtgtg

SEQ ID NO: 3200144 - DNA, 15 bp, Homo sapiens
acctctgtgtgctcc

SEQ ID NO: 3200145 - DNA, 23 bp, Homo sapiens
acctctgttcatttcacacagtg

SEQ ID NO: 3200146 - DNA, 19 bp, Homo sapiens
acctcttccggagatgtag

SEQ ID NO: 3200147 - DNA, 14 bp, Homo sapiens
acctcttctatgca

SEQ ID NO: 3200148 - DNA, 12 bp, Homo sapiens
acctcttgctgt

SEQ ID NO: 3200149 - DNA, 14 bp, Homo sapiens
acctcttgctgtct

SEQ ID NO: 3200150 - DNA, 17 bp, Homo sapiens
acctcttgctgtctctg

SEQ ID NO: 3200151 - DNA, 20 bp, Homo sapiens
acctcttgctgtctctgctc

SEQ ID NO: 3200152 - DNA, 18 bp, Homo sapiens
acctcttttctgcatcat

SEQ ID NO: 3200153 - DNA, 12 bp, Homo sapiens
acctgaaaagta

SEQ ID NO: 3200154 - DNA, 15 bp, Homo sapiens
acctgaaattccaaa

SEQ ID NO: 3200155 - DNA, 14 bp, Homo sapiens
acctgaacattgta

SEQ ID NO: 3200156 - DNA, 21 bp, Homo sapiens
acctgaaccccatgggcttgg

SEQ ID NO: 3200157 - DNA, 16 bp, Homo sapiens
acctgaactgaacacc

SEQ ID NO: 3200158 - DNA, 15 bp, Homo sapiens
acctgaactttcatt

SEQ ID NO: 3200159 - DNA, 13 bp, Homo sapiens
acctgaagactga

SEQ ID NO: 3200160 - DNA, 16 bp, Homo sapiens
acctgaagactgagga

SEQ ID NO: 3200161 - DNA, 21 bp, Homo sapiens
acctgaagtttttttgctgct

SEQ ID NO: 3200162 - DNA, 18 bp, Homo sapiens
acctgaataccacttacc

SEQ ID NO: 3200163 - DNA, 20 bp, Homo sapiens
acctgaataccacttacctc

SEQ ID NO: 3200164 - DNA, 16 bp, Homo sapiens
acctgacaatggcagc

SEQ ID NO: 3200165 - DNA, 19 bp, Homo sapiens
acctgacaatggcagctag

SEQ ID NO: 3200166 - DNA, 12 bp, Homo sapiens
acctgacacaag

SEQ ID NO: 3200167 - DNA, 20 bp, Homo sapiens
acctgacactaaccagagtc

SEQ ID NO: 3200168 - DNA, 17 bp, Homo sapiens
acctgacccctgctcag

SEQ ID NO: 3200169 - DNA, 17 bp, Homo sapiens
acctgacctcttgctgt

SEQ ID NO: 3200170 - DNA, 20 bp, Homo sapiens
acctgacctcttgctgtctc

SEQ ID NO: 3200171 - DNA, 13 bp, Homo sapiens
acctgactctgaa

SEQ ID NO: 3200172 - DNA, 22 bp, Homo sapiens
acctgagacgggcatcgcagga

SEQ ID NO: 3200173 - DNA, 14 bp, Homo sapiens
acctgaggataact

SEQ ID NO: 3200174 - DNA, 16 bp, Homo sapiens
acctgaggtgggccca

SEQ ID NO: 3200175 - DNA, 15 bp, Homo sapiens
acctgaggtgggctg

SEQ ID NO: 3200176 - DNA, 21 bp, Homo sapiens
acctgagtcggccccacatgg

SEQ ID NO: 3200177 - DNA, 18 bp, Homo sapiens
acctgatcactagcctgt

SEQ ID NO: 3200178 - DNA, 19 bp, Homo sapiens
acctgatcactagcctgtc

SEQ ID NO: 3200179 - DNA, 14 bp, Homo sapiens
acctgatcttacag

SEQ ID NO: 3200180 - DNA, 20 bp, Homo sapiens
acctgattttttttcctttt

SEQ ID NO: 3200181 - DNA, 13 bp, Homo sapiens
acctgcaaaaaat

SEQ ID NO: 3200182 - DNA, 12 bp, Homo sapiens
acctgcaagccc

SEQ ID NO: 3200183 - DNA, 15 bp, Homo sapiens
acctgcaagccccag

SEQ ID NO: 3200184 - DNA, 17 bp, Homo sapiens
acctgcaagccccaggg

SEQ ID NO: 3200185 - DNA, 19 bp, Homo sapiens
acctgcaagccccagggcc

SEQ ID NO: 3200186 - DNA, 15 bp, Homo sapiens
acctgcagttaacag

SEQ ID NO: 3200187 - DNA, 18 bp, Homo sapiens
acctgcagttaacaggat

SEQ ID NO: 3200188 - DNA, 23 bp, Homo sapiens
acctgcatttttcactttgctct

SEQ ID NO: 3200189 - DNA, 14 bp, Homo sapiens
acctgccagcctgg

SEQ ID NO: 3200190 - DNA, 16 bp, Homo sapiens
acctgccagcctggct

SEQ ID NO: 3200191 - DNA, 18 bp, Homo sapiens
acctgccagcctggcttc

SEQ ID NO: 3200192 - DNA, 18 bp, Homo sapiens
acctgccaggcaggggtg

SEQ ID NO: 3200193 - DNA, 16 bp, Homo sapiens
acctgccatgccagga

SEQ ID NO: 3200194 - DNA, 15 bp, Homo sapiens
acctgccatttgcac

SEQ ID NO: 3200195 - DNA, 19 bp, Homo sapiens
acctgccatttgcaccctc

SEQ ID NO: 3200196 - DNA, 13 bp, Homo sapiens
acctgcccaacct

SEQ ID NO: 3200197 - DNA, 21 bp, Homo sapiens
acctgcccaacctgctctcct

SEQ ID NO: 3200198 - DNA, 15 bp, Homo sapiens
acctgccccctggtg

SEQ ID NO: 3200199 - DNA, 16 bp, Homo sapiens
acctgccccgcccagc

SEQ ID NO: 3200200 - DNA, 17 bp, Homo sapiens
acctgccccgcccagct

SEQ ID NO: 3200201 - DNA, 17 bp, Homo sapiens
acctgccctcaagggtg

SEQ ID NO: 3200202 - DNA, 12 bp, Homo sapiens
acctgccctcta

SEQ ID NO: 3200203 - DNA, 23 bp, Homo sapiens
acctgccctctatttattagcca

SEQ ID NO: 3200204 - DNA, 15 bp, Homo sapiens
acctgccctggaaca

SEQ ID NO: 3200205 - DNA, 19 bp, Homo sapiens
acctgcctaggtttttcct

SEQ ID NO: 3200206 - DNA, 18 bp, Homo sapiens
acctgcctcctcgttcct

SEQ ID NO: 3200207 - DNA, 16 bp, Homo sapiens
acctgctcacgtcaaa

SEQ ID NO: 3200208 - DNA, 18 bp, Homo sapiens
acctgctccgctgctcct

SEQ ID NO: 3200209 - DNA, 22 bp, Homo sapiens
acctgctccgctgctccttggc

SEQ ID NO: 3200210 - DNA, 17 bp, Homo sapiens
acctgctctcctcttgc

SEQ ID NO: 3200211 - DNA, 17 bp, Homo sapiens
acctgctgcgtccccac

SEQ ID NO: 3200212 - DNA, 19 bp, Homo sapiens
acctgcttccacccgtctc

SEQ ID NO: 3200213 - DNA, 20 bp, Homo sapiens
acctgcttcctgaaataaac

SEQ ID NO: 3200214 - DNA, 22 bp, Homo sapiens
acctgcttcctgaaataaacac

SEQ ID NO: 3200215 - DNA, 22 bp, Homo sapiens
acctggacttaagcatctggct

SEQ ID NO: 3200216 - DNA, 13 bp, Homo sapiens
acctggatgtact

SEQ ID NO: 3200217 - DNA, 18 bp, Homo sapiens
acctggcatcatggtgga

SEQ ID NO: 3200218 - DNA, 16 bp, Homo sapiens
acctggccacctgagg

SEQ ID NO: 3200219 - DNA, 18 bp, Homo sapiens
acctggccacctgaggtg

SEQ ID NO: 3200220 - DNA, 12 bp, Homo sapiens
acctggcctgct

SEQ ID NO: 3200221 - DNA, 22 bp, Homo sapiens
acctggctgaggttcctctgcc

SEQ ID NO: 3200222 - DNA, 17 bp, Homo sapiens
acctggcttatttaata

SEQ ID NO: 3200223 - DNA, 16 bp, Homo sapiens
acctggcttttacttt

SEQ ID NO: 3200224 - DNA, 17 bp, Homo sapiens
acccttattgctgtcct

SEQ ID NO: 3200225 - DNA, 21 bp, Homo sapiens
acccttattgctgtcctggag

SEQ ID NO: 3200226 - DNA, 17 bp, Homo sapiens
acccttcagggccagaa

SEQ ID NO: 3200227 - DNA, 13 bp, Homo sapiens
acccttccacctc

SEQ ID NO: 3200228 - DNA, 22 bp, Homo sapiens
acccttcccgcctccctctcag

SEQ ID NO: 3200229 - DNA, 16 bp, Homo sapiens
acccttccctgcacta

SEQ ID NO: 3200230 - DNA, 17 bp, Homo sapiens
acccttcctgcatttct

SEQ ID NO: 3200231 - DNA, 14 bp, Homo sapiens
acccttctttcctc

SEQ ID NO: 3200232 - DNA, 15 bp, Homo sapiens
acccttgctgcttta

SEQ ID NO: 3200233 - DNA, 11 bp, Homo sapiens
acccttggcct

SEQ ID NO: 3200234 - DNA, 12 bp, Homo sapiens
acccttggcctg

SEQ ID NO: 3200235 - DNA, 18 bp, Homo sapiens
acccttgtgagagcccat

SEQ ID NO: 3200236 - DNA, 17 bp, Homo sapiens
acccttgtgcttggtgg

SEQ ID NO: 3200237 - DNA, 19 bp, Homo sapiens
accctttaagatatccatc

SEQ ID NO: 3200238 - DNA, 23 bp, Homo sapiens
accctttgctgtgaggctgtcct

SEQ ID NO: 3200239 - DNA, 14 bp, Homo sapiens
accctttgtttctt

SEQ ID NO: 3200240 - DNA, 19 bp, Homo sapiens
acccttttcctttgtggtt

SEQ ID NO: 3200241 - DNA, 17 bp, Homo sapiens
accctttttctccagct

SEQ ID NO: 3200242 - DNA, 16 bp, Homo sapiens
acccttttttctaagt

SEQ ID NO: 3200243 - DNA, 23 bp, Homo sapiens
accgacctggtttttaaatagag

SEQ ID NO: 3200244 - DNA, 15 bp, Homo sapiens
accgactaccccagt

SEQ ID NO: 3200245 - DNA, 20 bp, Homo sapiens
accgactaccccagtcccag

SEQ ID NO: 3200246 - DNA, 15 bp, Homo sapiens
accgagaccaaactc

SEQ ID NO: 3200247 - DNA, 15 bp, Homo sapiens
accgagcaaagatca

SEQ ID NO: 3200248 - DNA, 20 bp, Homo sapiens
accgaggcgatgccacgctt

SEQ ID NO: 3200249 - DNA, 21 bp, Homo sapiens
accgagtgaacctaccttcat

SEQ ID NO: 3200250 - DNA, 13 bp, Homo sapiens
accgatggagccc

SEQ ID NO: 3200251 - DNA, 24 bp, Homo sapiens
accgattctttggagttgtcacat

SEQ ID NO: 3200252 - DNA, 21 bp, Homo sapiens
accgcagtcgtcgcacagtct

SEQ ID NO: 3200253 - DNA, 20 bp, Homo sapiens
accgccacgtcccagcatcc

SEQ ID NO: 3200254 - DNA, 15 bp, Homo sapiens
accgcccccacccct

SEQ ID NO: 3200255 - DNA, 19 bp, Homo sapiens
accgccccctcctctagct

SEQ ID NO: 3200256 - DNA, 13 bp, Homo sapiens
accgccctgggct

SEQ ID NO: 3200257 - DNA, 14 bp, Homo sapiens
accgccctgggctg

SEQ ID NO: 3200258 - DNA, 13 bp, Homo sapiens
accgcctctggcc

SEQ ID NO: 3200259 - DNA, 21 bp, Homo sapiens
accgcggaggaggctggtgac

SEQ ID NO: 3200260 - DNA, 16 bp, Homo sapiens
accgctctcttttctg

SEQ ID NO: 3200261 - DNA, 22 bp, Homo sapiens
accgctctcttttctgtacttc

SEQ ID NO: 3200262 - DNA, 13 bp, Homo sapiens
accgctgggtggt

SEQ ID NO: 3200263 - DNA, 17 bp, Homo sapiens
accgctgggtggttttt

SEQ ID NO: 3200264 - DNA, 14 bp, Homo sapiens
accgcttcacccct

SEQ ID NO: 3200265 - DNA, 15 bp, Homo sapiens
accgcttcacccctg

SEQ ID NO: 3200266 - DNA, 18 bp, Homo sapiens
accgcttcacccctgcac

SEQ ID NO: 3200267 - DNA, 19 bp, Homo sapiens
accgcttccctcctgcccg

SEQ ID NO: 3200268 - DNA, 15 bp, Homo sapiens
accgcttctgccttt

SEQ ID NO: 3200269 - DNA, 15 bp, Homo sapiens
accggacttttctgc

SEQ ID NO: 3200270 - DNA, 13 bp, Homo sapiens
accggagagagaa

SEQ ID NO: 3200271 - DNA, 12 bp, Homo sapiens
accggcagaaaa

SEQ ID NO: 3200272 - DNA, 14 bp, Homo sapiens
accggcccctggca

SEQ ID NO: 3200273 - DNA, 14 bp, Homo sapiens
accggcgctgcagg

SEQ ID NO: 3200274 - DNA, 18 bp, Homo sapiens
accgggaataaccttcca

SEQ ID NO: 3200275 - DNA, 19 bp, Homo sapiens
accgggatgaacctatcct

SEQ ID NO: 3200276 - DNA, 22 bp, Homo sapiens
accgggccagtatctatatatg

SEQ ID NO: 3200277 - DNA, 21 bp, Homo sapiens
accgggctccatgcctctgga

SEQ ID NO: 3200278 - DNA, 21 bp, Homo sapiens
accgggctgggagctctgcag

SEQ ID NO: 3200279 - DNA, 17 bp, Homo sapiens
accgggtgggcctggcc

SEQ ID NO: 3200280 - DNA, 19 bp, Homo sapiens
accgggtgggcctggcctg

SEQ ID NO: 3200281 - DNA, 20 bp, Homo sapiens
accgggtgggcctggcctga

SEQ ID NO: 3200282 - DNA, 21 bp, Homo sapiens
accgggtgggcctggcctgag

SEQ ID NO: 3200283 - DNA, 14 bp, Homo sapiens
accggtcagtgcct

SEQ ID NO: 3200284 - DNA, 23 bp, Homo sapiens
accggtccagctggcctggacag

SEQ ID NO: 3200285 - DNA, 18 bp, Homo sapiens
accggtgcttctggaaac

SEQ ID NO: 3200286 - DNA, 19 bp, Homo sapiens
accgtactctcacatgtgg

SEQ ID NO: 3200287 - DNA, 13 bp, Homo sapiens
accgtcctcaccc

SEQ ID NO: 3200288 - DNA, 18 bp, Homo sapiens
accgtcctcacccctgtc

SEQ ID NO: 3200289 - DNA, 14 bp, Homo sapiens
accgtcttccttca

SEQ ID NO: 3200290 - DNA, 20 bp, Homo sapiens
accgtgagcaggaaggcctg

SEQ ID NO: 3200291 - DNA, 21 bp, Homo sapiens
accgtgagcaggaaggcctgg

SEQ ID NO: 3200292 - DNA, 22 bp, Homo sapiens
accgtgagcaggaaggcctggg

SEQ ID NO: 3200293 - DNA, 16 bp, Homo sapiens
accgtgcagagctgca

SEQ ID NO: 3200294 - DNA, 20 bp, Homo sapiens
accgtggccctgccctctcc

SEQ ID NO: 3200295 - DNA, 19 bp, Homo sapiens
accgtgtcccaaggagctg

SEQ ID NO: 3200296 - DNA, 21 bp, Homo sapiens
accgtgtcccaaggagctgat

SEQ ID NO: 3200297 - DNA, 16 bp, Homo sapiens
accgtgttagccagga

SEQ ID NO: 3200298 - DNA, 19 bp, Homo sapiens
accgttcagtgtcccaggc

SEQ ID NO: 3200299 - DNA, 16 bp, Homo sapiens
accgttgcttgaaatt

SEQ ID NO: 3200300 - DNA, 22 bp, Homo sapiens
accgtttcttcctgccagcagg

SEQ ID NO: 3200301 - DNA, 19 bp, Homo sapiens
acctaaacggttcagtttc

SEQ ID NO: 3200302 - DNA, 15 bp, Homo sapiens
acctaaatggcctca

SEQ ID NO: 3200303 - DNA, 17 bp, Homo sapiens
acctaactcttttctat

SEQ ID NO: 3200304 - DNA, 23 bp, Homo sapiens
acctaagtactgtaataatacct

SEQ ID NO: 3200305 - DNA, 18 bp, Homo sapiens
acctaagtcctttatgtg

SEQ ID NO: 3200306 - DNA, 18 bp, Homo sapiens
acctaatgtctcactgtt

SEQ ID NO: 3200307 - DNA, 22 bp, Homo sapiens
acctaattcgatgaaggctgcc

SEQ ID NO: 3200308 - DNA, 16 bp, Homo sapiens
acctacaataaactgg

SEQ ID NO: 3200309 - DNA, 17 bp, Homo sapiens
acctacagacaaggagg

SEQ ID NO: 3200310 - DNA, 18 bp, Homo sapiens
acctacagttttaactgt

SEQ ID NO: 3200311 - DNA, 19 bp, Homo sapiens
acctacagttttaactgtg

SEQ ID NO: 3200312 - DNA, 16 bp, Homo sapiens
acctacattccctctc

SEQ ID NO: 3200313 - DNA, 14 bp, Homo sapiens
acctaccaaaatgg

SEQ ID NO: 3200314 - DNA, 14 bp, Homo sapiens
acctaccaggacag

SEQ ID NO: 3200315 - DNA, 16 bp, Homo sapiens
acctaccaggacagaa

SEQ ID NO: 3200316 - DNA, 14 bp, Homo sapiens
acctaccatgctgc

SEQ ID NO: 3200317 - DNA, 15 bp, Homo sapiens
acctaccatgctgct

SEQ ID NO: 3200318 - DNA, 20 bp, Homo sapiens
acctaccccatgaagatatt

SEQ ID NO: 3200319 - DNA, 12 bp, Homo sapiens
acctacctcagg

SEQ ID NO: 3200320 - DNA, 14 bp, Homo sapiens
acctacctcaggtt

SEQ ID NO: 3200321 - DNA, 15 bp, Homo sapiens
acctacctcaggttg

SEQ ID NO: 3200322 - DNA, 20 bp, Homo sapiens
acctacctcaggttgctggt

SEQ ID NO: 3200323 - DNA, 18 bp, Homo sapiens
acctaccttcatttcagg

SEQ ID NO: 3200324 - DNA, 17 bp, Homo sapiens
acctactaaaaaagtta

SEQ ID NO: 3200325 - DNA, 21 bp, Homo sapiens
acctactaaaaaagttattat

SEQ ID NO: 3200326 - DNA, 17 bp, Homo sapiens
acctactaatagtttgt

SEQ ID NO: 3200327 - DNA, 17 bp, Homo sapiens
acctactatgtgctggg

SEQ ID NO: 3200328 - DNA, 17 bp, Homo sapiens
acccctgtcctcactgc

SEQ ID NO: 3200329 - DNA, 18 bp, Homo sapiens
acccctgtcctcactgct

SEQ ID NO: 3200330 - DNA, 10 bp, Homo sapiens
acccctgtgt

SEQ ID NO: 3200331 - DNA, 14 bp, Homo sapiens
accccttagcctcc

SEQ ID NO: 3200332 - DNA, 18 bp, Homo sapiens
accccttagcctccctga

SEQ ID NO: 3200333 - DNA, 11 bp, Homo sapiens
accccttaggc

SEQ ID NO: 3200334 - DNA, 18 bp, Homo sapiens
accccttaggccccgtgg

SEQ ID NO: 3200335 - DNA, 13 bp, Homo sapiens
accccttccagat

SEQ ID NO: 3200336 - DNA, 15 bp, Homo sapiens
accccttccagatca

SEQ ID NO: 3200337 - DNA, 20 bp, Homo sapiens
accccttccagatcactgcc

SEQ ID NO: 3200338 - DNA, 21 bp, Homo sapiens
accccttccagatcactgcca

SEQ ID NO: 3200339 - DNA, 14 bp, Homo sapiens
accccttccccagg

SEQ ID NO: 3200340 - DNA, 15 bp, Homo sapiens
accccttccccaggc

SEQ ID NO: 3200341 - DNA, 20 bp, Homo sapiens
accccttcgctcctgtgtct

SEQ ID NO: 3200342 - DNA, 17 bp, Homo sapiens
accccttctctcctccc

SEQ ID NO: 3200343 - DNA, 23 bp, Homo sapiens
accccttctctcctccccaaatc

SEQ ID NO: 3200344 - DNA, 19 bp, Homo sapiens
accccttctttgcagggct

SEQ ID NO: 3200345 - DNA, 21 bp, Homo sapiens
accccttggaggagagagacc

SEQ ID NO: 3200346 - DNA, 20 bp, Homo sapiens
acccctttcttctcgggcca

SEQ ID NO: 3200347 - DNA, 12 bp, Homo sapiens
acccctttgatt

SEQ ID NO: 3200348 - DNA, 23 bp, Homo sapiens
acccgaaatgccacgtggtcact

SEQ ID NO: 3200349 - DNA, 14 bp, Homo sapiens
acccgatgctgctt

SEQ ID NO: 3200350 - DNA, 23 bp, Homo sapiens
acccgatgctgctttcccctgtg

SEQ ID NO: 3200351 - DNA, 16 bp, Homo sapiens
acccgccgcctcccac

SEQ ID NO: 3200352 - DNA, 19 bp, Homo sapiens
acccgccgcctcccacggc

SEQ ID NO: 3200353 - DNA, 23 bp, Homo sapiens
acccgcctctcccgtcagggccc

SEQ ID NO: 3200354 - DNA, 24 bp, Homo sapiens
acccgcctctcccgtcagggccca

SEQ ID NO: 3200355 - DNA, 18 bp, Homo sapiens
acccggaggggcctggca

SEQ ID NO: 3200356 - DNA, 17 bp, Homo sapiens
acccggcccctgctggt

SEQ ID NO: 3200357 - DNA, 22 bp, Homo sapiens
acccggcccctgctggttcagg

SEQ ID NO: 3200358 - DNA, 15 bp, Homo sapiens
acccggggccagaga

SEQ ID NO: 3200359 - DNA, 19 bp, Homo sapiens
acccggggccagagacata

SEQ ID NO: 3200360 - DNA, 16 bp, Homo sapiens
acccgggggagcccag

SEQ ID NO: 3200361 - DNA, 17 bp, Homo sapiens
acccgggggagcccagt

SEQ ID NO: 3200362 - DNA, 19 bp, Homo sapiens
acccgggggagcccagtga

SEQ ID NO: 3200363 - DNA, 18 bp, Homo sapiens
acccggtttctttttaag

SEQ ID NO: 3200364 - DNA, 18 bp, Homo sapiens
acccgtggggtgctgccc

SEQ ID NO: 3200365 - DNA, 20 bp, Homo sapiens
acccgttctgctggcctgga

SEQ ID NO: 3200366 - DNA, 22 bp, Homo sapiens
acccgttctgctggcctggatc

SEQ ID NO: 3200367 - DNA, 17 bp, Homo sapiens
accctacctgtgcctga

SEQ ID NO: 3200368 - DNA, 20 bp, Homo sapiens
accctactttgcttccgcca

SEQ ID NO: 3200369 - DNA, 21 bp, Homo sapiens
accctactttgcttccgccac

SEQ ID NO: 3200370 - DNA, 16 bp, Homo sapiens
accctagccaatgtct

SEQ ID NO: 3200371 - DNA, 19 bp, Homo sapiens
accctagccagagaataga

SEQ ID NO: 3200372 - DNA, 16 bp, Homo sapiens
accctagccattcctg

SEQ ID NO: 3200373 - DNA, 22 bp, Homo sapiens
accctagttctcttatctttga

SEQ ID NO: 3200374 - DNA, 23 bp, Homo sapiens
accctatagagagggggctctcc

SEQ ID NO: 3200375 - DNA, 14 bp, Homo sapiens
accctatctcctga

SEQ ID NO: 3200376 - DNA, 14 bp, Homo sapiens
accctatgggtcta

SEQ ID NO: 3200377 - DNA, 16 bp, Homo sapiens
accctatgggtctagg

SEQ ID NO: 3200378 - DNA, 21 bp, Homo sapiens
accctcaacctcttctggctc

SEQ ID NO: 3200379 - DNA, 14 bp, Homo sapiens
accctcacacacac

SEQ ID NO: 3200380 - DNA, 17 bp, Homo sapiens
accctcacacacacagc

SEQ ID NO: 3200381 - DNA, 22 bp, Homo sapiens
accctcacacacacagctgggc

SEQ ID NO: 3200382 - DNA, 21 bp, Homo sapiens
accctcaccccctcctggcaa

SEQ ID NO: 3200383 - DNA, 18 bp, Homo sapiens
accctcagagccacccct

SEQ ID NO: 3200384 - DNA, 17 bp, Homo sapiens
accctcagcaccccttc

SEQ ID NO: 3200385 - DNA, 18 bp, Homo sapiens
accctcagcaccccttcc

SEQ ID NO: 3200386 - DNA, 18 bp, Homo sapiens
accctcatacacagaaac

SEQ ID NO: 3200387 - DNA, 23 bp, Homo sapiens
accctccaagtctgtacctcaaa

SEQ ID NO: 3200388 - DNA, 13 bp, Homo sapiens
accctccaccctg

SEQ ID NO: 3200389 - DNA, 15 bp, Homo sapiens
accctccaccttcca

SEQ ID NO: 3200390 - DNA, 12 bp, Homo sapiens
accctcccaccc

SEQ ID NO: 3200391 - DNA, 13 bp, Homo sapiens
accctcccccgca

SEQ ID NO: 3200392 - DNA, 14 bp, Homo sapiens
accctcccccgcag

SEQ ID NO: 3200393 - DNA, 23 bp, Homo sapiens
accctccccgcaccccccaagct

SEQ ID NO: 3200394 - DNA, 19 bp, Homo sapiens
accctcccctctcttgcac

SEQ ID NO: 3200395 - DNA, 22 bp, Homo sapiens
accctccgccttcactccggtg

SEQ ID NO: 3200396 - DNA, 11 bp, Homo sapiens
accctcctggc

SEQ ID NO: 3200397 - DNA, 13 bp, Homo sapiens
accctccttccac

SEQ ID NO: 3200398 - DNA, 21 bp, Homo sapiens
accctcgaagcgcgccactcg

SEQ ID NO: 3200399 - DNA, 13 bp, Homo sapiens
accctcgggccca

SEQ ID NO: 3200400 - DNA, 17 bp, Homo sapiens
accctcgggcccacctg

SEQ ID NO: 3200401 - DNA, 20 bp, Homo sapiens
accctcgggcccacctggcc

SEQ ID NO: 3200402 - DNA, 22 bp, Homo sapiens
accctcgggcccacctggccac

SEQ ID NO: 3200403 - DNA, 15 bp, Homo sapiens
accctctcagctcca

SEQ ID NO: 3200404 - DNA, 12 bp, Homo sapiens
accctctgggaa

SEQ ID NO: 3200405 - DNA, 22 bp, Homo sapiens
accctctgggaacctcccagag

SEQ ID NO: 3200406 - DNA, 20 bp, Homo sapiens
accctcttcctgtgatccac

SEQ ID NO: 3200407 - DNA, 23 bp, Homo sapiens
accctcttgcccatcctgactga

SEQ ID NO: 3200408 - DNA, 21 bp, Homo sapiens
accctgaatggttccatgcct

SEQ ID NO: 3200409 - DNA, 15 bp, Homo sapiens
accctgcaaggccca

SEQ ID NO: 3200410 - DNA, 23 bp, Homo sapiens
accctgcaaggcccacaggaggc

SEQ ID NO: 3200411 - DNA, 13 bp, Homo sapiens
accctgcacctgc

SEQ ID NO: 3200412 - DNA, 15 bp, Homo sapiens
accctgcacctgctg

SEQ ID NO: 3200413 - DNA, 16 bp, Homo sapiens
accctgcacctgctgc

SEQ ID NO: 3200414 - DNA, 17 bp, Homo sapiens
accctgcacctgctgcg

SEQ ID NO: 3200415 - DNA, 22 bp, Homo sapiens
accctgcacctgctgcgtcccc

SEQ ID NO: 3200416 - DNA, 20 bp, Homo sapiens
accctgccaagactcctcag

SEQ ID NO: 3200417 - DNA, 22 bp, Homo sapiens
accctgccaagactcctcaggc

SEQ ID NO: 3200418 - DNA, 13 bp, Homo sapiens
accctgcccctgc

SEQ ID NO: 3200419 - DNA, 16 bp, Homo sapiens
accctgcccgctccca

SEQ ID NO: 3200420 - DNA, 17 bp, Homo sapiens
accctgcccgctcccaa

SEQ ID NO: 3200421 - DNA, 14 bp, Homo sapiens
accctgccttatct

SEQ ID NO: 3200422 - DNA, 18 bp, Homo sapiens
accctgcgaaggggccct

SEQ ID NO: 3200423 - DNA, 19 bp, Homo sapiens
accctgcgaaggggccctg

SEQ ID NO: 3200424 - DNA, 12 bp, Homo sapiens
accctgctccct

SEQ ID NO: 3200425 - DNA, 15 bp, Homo sapiens
accctgctccctgct

SEQ ID NO: 3200426 - DNA, 21 bp, Homo sapiens
accctgctcctcctgccctgt

SEQ ID NO: 3200427 - DNA, 13 bp, Homo sapiens
accctgcttcacc

SEQ ID NO: 3200428 - DNA, 23 bp, Homo sapiens
accctggaaatggactggtttga

SEQ ID NO: 3200429 - DNA, 10 bp, Homo sapiens
accctggaat

SEQ ID NO: 3200430 - DNA, 21 bp, Homo sapiens
accctggaattcagcaccctg

SEQ ID NO: 3200431 - DNA, 17 bp, Homo sapiens
accctggccgccccctg

SEQ ID NO: 3200432 - DNA, 22 bp, Homo sapiens
accctggccgccccctgccccc

SEQ ID NO: 3200433 - DNA, 16 bp, Homo sapiens
accctggcctgaactg

SEQ ID NO: 3200434 - DNA, 20 bp, Homo sapiens
accctggcctgaactgagga

SEQ ID NO: 3200435 - DNA, 14 bp, Homo sapiens
accctgggagacag

SEQ ID NO: 3200436 - DNA, 14 bp, Homo sapiens
accctgggagagaa

SEQ ID NO: 3200437 - DNA, 14 bp, Homo sapiens
accctgggccctgg

SEQ ID NO: 3200438 - DNA, 18 bp, Homo sapiens
accctgggccctgggctg

SEQ ID NO: 3200439 - DNA, 14 bp, Homo sapiens
accctggtctccgt

SEQ ID NO: 3200440 - DNA, 20 bp, Homo sapiens
accctggtctccgtggcact

SEQ ID NO: 3200441 - DNA, 16 bp, Homo sapiens
accctgtacctcatcc

SEQ ID NO: 3200442 - DNA, 20 bp, Homo sapiens
accctgtactgttctgtgtc

SEQ ID NO: 3200443 - DNA, 22 bp, Homo sapiens
accctgtcaagttaacaaggaa

SEQ ID NO: 3200444 - DNA, 21 bp, Homo sapiens
accctgtcccccagctctggt

SEQ ID NO: 3200445 - DNA, 16 bp, Homo sapiens
accctgtccggcccag

SEQ ID NO: 3200446 - DNA, 18 bp, Homo sapiens
accctgtccggcccagtg

SEQ ID NO: 3200447 - DNA, 21 bp, Homo sapiens
accctgtccggcccagtgcca

SEQ ID NO: 3200448 - DNA, 14 bp, Homo sapiens
accctgtctctact

SEQ ID NO: 3200449 - DNA, 17 bp, Homo sapiens
accctgtcttctgggca

SEQ ID NO: 3200450 - DNA, 23 bp, Homo sapiens
accctgtgctggtgtcctgacca

SEQ ID NO: 3200451 - DNA, 16 bp, Homo sapiens
accctgtggccctggc

SEQ ID NO: 3200452 - DNA, 16 bp, Homo sapiens
accctgttttatactg

SEQ ID NO: 3200453 - DNA, 18 bp, Homo sapiens
acccttacagtgaagatg

SEQ ID NO: 3200454 - DNA, 18 bp, Homo sapiens
acccagtgctgccatgcc

SEQ ID NO: 3200455 - DNA, 18 bp, Homo sapiens
acccagtgggtctgggat

SEQ ID NO: 3200456 - DNA, 13 bp, Homo sapiens
acccagttacttt

SEQ ID NO: 3200457 - DNA, 21 bp, Homo sapiens
acccatagatcttctgaaatg

SEQ ID NO: 3200458 - DNA, 16 bp, Homo sapiens
acccatatatcttatg

SEQ ID NO: 3200459 - DNA, 16 bp, Homo sapiens
acccatattgtaaaac

SEQ ID NO: 3200460 - DNA, 13 bp, Homo sapiens
acccatctgtagt

SEQ ID NO: 3200461 - DNA, 20 bp, Homo sapiens
acccatctgtagtaatttat

SEQ ID NO: 3200462 - DNA, 17 bp, Homo sapiens
acccatcttcctgctgc

SEQ ID NO: 3200463 - DNA, 20 bp, Homo sapiens
acccatcttcctgctgctgt

SEQ ID NO: 3200464 - DNA, 14 bp, Homo sapiens
acccatgagcctgc

SEQ ID NO: 3200465 - DNA, 15 bp, Homo sapiens
acccatgagcctgcc

SEQ ID NO: 3200466 - DNA, 16 bp, Homo sapiens
acccatgagcctgccc

SEQ ID NO: 3200467 - DNA, 18 bp, Homo sapiens
acccatgagcctgcccgc

SEQ ID NO: 3200468 - DNA, 19 bp, Homo sapiens
acccatgagcctgcccgct

SEQ ID NO: 3200469 - DNA, 20 bp, Homo sapiens
acccatgagcctgcccgctg

SEQ ID NO: 3200470 - DNA, 14 bp, Homo sapiens
acccatgctggtca

SEQ ID NO: 3200471 - DNA, 23 bp, Homo sapiens
acccatgtcaccggtcagtgcct

SEQ ID NO: 3200472 - DNA, 22 bp, Homo sapiens
acccattaaggggaagaatgaa

SEQ ID NO: 3200473 - DNA, 18 bp, Homo sapiens
acccattcactacaggtg

SEQ ID NO: 3200474 - DNA, 19 bp, Homo sapiens
acccattcccccatgtggc

SEQ ID NO: 3200475 - DNA, 18 bp, Homo sapiens
acccatttaatcaccatg

SEQ ID NO: 3200476 - DNA, 14 bp, Homo sapiens
acccattttcacat

SEQ ID NO: 3200477 - DNA, 20 bp, Homo sapiens
accccaaacaccttccagct

SEQ ID NO: 3200478 - DNA, 23 bp, Homo sapiens
accccaaacaccttccagctcct

SEQ ID NO: 3200479 - DNA, 15 bp, Homo sapiens
accccaaagctttcc

SEQ ID NO: 3200480 - DNA, 17 bp, Homo sapiens
accccaaagctttcctg

SEQ ID NO: 3200481 - DNA, 12 bp, Homo sapiens
accccaacccaa

SEQ ID NO: 3200482 - DNA, 17 bp, Homo sapiens
accccaacgcacaggaa

SEQ ID NO: 3200483 - DNA, 14 bp, Homo sapiens
accccacagaacct

SEQ ID NO: 3200484 - DNA, 16 bp, Homo sapiens
accccaccccaccccc

SEQ ID NO: 3200485 - DNA, 13 bp, Homo sapiens
accccacccttcc

SEQ ID NO: 3200486 - DNA, 19 bp, Homo sapiens
accccacccttcccctcct

SEQ ID NO: 3200487 - DNA, 13 bp, Homo sapiens
accccacctgcag

SEQ ID NO: 3200488 - DNA, 14 bp, Homo sapiens
accccacctgcagg

SEQ ID NO: 3200489 - DNA, 16 bp, Homo sapiens
accccacgccttatcc

SEQ ID NO: 3200490 - DNA, 22 bp, Homo sapiens
accccactctacctccttagct

SEQ ID NO: 3200491 - DNA, 22 bp, Homo sapiens
accccactgggccagccctgca

SEQ ID NO: 3200492 - DNA, 20 bp, Homo sapiens
accccagcccaccctgctcc

SEQ ID NO: 3200493 - DNA, 21 bp, Homo sapiens
accccagcccaccctgctcct

SEQ ID NO: 3200494 - DNA, 23 bp, Homo sapiens
accccagccgctcggaggcccca

SEQ ID NO: 3200495 - DNA, 14 bp, Homo sapiens
accccagcctgacc

SEQ ID NO: 3200496 - DNA, 21 bp, Homo sapiens
accccagcctgacctgagact

SEQ ID NO: 3200497 - DNA, 13 bp, Homo sapiens
accccagctggga

SEQ ID NO: 3200498 - DNA, 17 bp, Homo sapiens
accccagctgtgagcct

SEQ ID NO: 3200499 - DNA, 18 bp, Homo sapiens
accccagctgtgagcctt

SEQ ID NO: 3200500 - DNA, 19 bp, Homo sapiens
accccagctgtgagccttg

SEQ ID NO: 3200501 - DNA, 22 bp, Homo sapiens
accccagctgtgagccttggct

SEQ ID NO: 3200502 - DNA, 15 bp, Homo sapiens
accccagtcccaggg

SEQ ID NO: 3200503 - DNA, 19 bp, Homo sapiens
accccagttctgctcctct

SEQ ID NO: 3200504 - DNA, 20 bp, Homo sapiens
accccagttctgctcctctc

SEQ ID NO: 3200505 - DNA, 22 bp, Homo sapiens
accccagttctgctcctctcca

SEQ ID NO: 3200506 - DNA, 17 bp, Homo sapiens
accccatccagttcatg

SEQ ID NO: 3200507 - DNA, 15 bp, Homo sapiens
accccatcccacacc

SEQ ID NO: 3200508 - DNA, 17 bp, Homo sapiens
accccatccctccccag

SEQ ID NO: 3200509 - DNA, 15 bp, Homo sapiens
accccatctccaaga

SEQ ID NO: 3200510 - DNA, 16 bp, Homo sapiens
accccatgccaaagct

SEQ ID NO: 3200511 - DNA, 13 bp, Homo sapiens
accccatgggctt

SEQ ID NO: 3200512 - DNA, 17 bp, Homo sapiens
accccatgggcttggac

SEQ ID NO: 3200513 - DNA, 13 bp, Homo sapiens
accccattctttg

SEQ ID NO: 3200514 - DNA, 23 bp, Homo sapiens
accccattctttgcttgaacaca

SEQ ID NO: 3200515 - DNA, 21 bp, Homo sapiens
acccccacaagctgtccctgc

SEQ ID NO: 3200516 - DNA, 14 bp, Homo sapiens
acccccacccacct

SEQ ID NO: 3200517 - DNA, 18 bp, Homo sapiens
acccccacccacctccac

SEQ ID NO: 3200518 - DNA, 15 bp, Homo sapiens
acccccaccccacac

SEQ ID NO: 3200519 - DNA, 16 bp, Homo sapiens
acccccaccccacact

SEQ ID NO: 3200520 - DNA, 14 bp, Homo sapiens
acccccacccccag

SEQ ID NO: 3200521 - DNA, 15 bp, Homo sapiens
acccccacccccagc

SEQ ID NO: 3200522 - DNA, 14 bp, Homo sapiens
acccccagccaggc

SEQ ID NO: 3200523 - DNA, 14 bp, Homo sapiens
acccccagcctgct

SEQ ID NO: 3200524 - DNA, 18 bp, Homo sapiens
acccccatcttccacctg

SEQ ID NO: 3200525 - DNA, 21 bp, Homo sapiens
acccccatcttccacctgtgc

SEQ ID NO: 3200526 - DNA, 20 bp, Homo sapiens
acccccatggccccaggccc

SEQ ID NO: 3200527 - DNA, 18 bp, Homo sapiens
acccccatttctatttat

SEQ ID NO: 3200528 - DNA, 14 bp, Homo sapiens
accccccaagctgt

SEQ ID NO: 3200529 - DNA, 12 bp, Homo sapiens
acccccctcctg

SEQ ID NO: 3200530 - DNA, 16 bp, Homo sapiens
acccccctcctgctcc

SEQ ID NO: 3200531 - DNA, 17 bp, Homo sapiens
acccccctcctgctcct

SEQ ID NO: 3200532 - DNA, 23 bp, Homo sapiens
acccccctcctgctcctccctgc

SEQ ID NO: 3200533 - DNA, 11 bp, Homo sapiens
acccccctctg

SEQ ID NO: 3200534 - DNA, 17 bp, Homo sapiens
accccctcaagccccag

SEQ ID NO: 3200535 - DNA, 13 bp, Homo sapiens
accccctcacccc

SEQ ID NO: 3200536 - DNA, 19 bp, Homo sapiens
accccctccttcagacacc

SEQ ID NO: 3200537 - DNA, 14 bp, Homo sapiens
accccctgccctgc

SEQ ID NO: 3200538 - DNA, 19 bp, Homo sapiens
accccctgctccaccagca

SEQ ID NO: 3200539 - DNA, 14 bp, Homo sapiens
acccccttctctgc

SEQ ID NO: 3200540 - DNA, 23 bp, Homo sapiens
acccccttctctgctccaccaca

SEQ ID NO: 3200541 - DNA, 18 bp, Homo sapiens
accccctttgctgtgagg

SEQ ID NO: 3200542 - DNA, 17 bp, Homo sapiens
accccgatgtggacctc

SEQ ID NO: 3200543 - DNA, 17 bp, Homo sapiens
accccgcagacaccttg

SEQ ID NO: 3200544 - DNA, 13 bp, Homo sapiens
accccgcagcccg

SEQ ID NO: 3200545 - DNA, 14 bp, Homo sapiens
accccggcaggccc

SEQ ID NO: 3200546 - DNA, 16 bp, Homo sapiens
accccggcaggccctg

SEQ ID NO: 3200547 - DNA, 20 bp, Homo sapiens
accccggcaggccctgcagt

SEQ ID NO: 3200548 - DNA, 16 bp, Homo sapiens
accccggcctcagggc

SEQ ID NO: 3200549 - DNA, 17 bp, Homo sapiens
accccggcctcagggcg

SEQ ID NO: 3200550 - DNA, 15 bp, Homo sapiens
accccggcctccact

SEQ ID NO: 3200551 - DNA, 16 bp, Homo sapiens
accccgggatgcaagg

SEQ ID NO: 3200552 - DNA, 15 bp, Homo sapiens
accccgggctctctg

SEQ ID NO: 3200553 - DNA, 19 bp, Homo sapiens
accccgtctctataccaac

SEQ ID NO: 3200554 - DNA, 15 bp, Homo sapiens
acccctaagtgccca

SEQ ID NO: 3200555 - DNA, 16 bp, Homo sapiens
acccctacatgaaaca

SEQ ID NO: 3200556 - DNA, 14 bp, Homo sapiens
acccctagttccct

SEQ ID NO: 3200557 - DNA, 15 bp, Homo sapiens
acccctagttccctc

SEQ ID NO: 3200558 - DNA, 13 bp, Homo sapiens
acccctcccctcc

SEQ ID NO: 3200559 - DNA, 19 bp, Homo sapiens
acccctcccctccatccct

SEQ ID NO: 3200560 - DNA, 13 bp, Homo sapiens
acccctcctcact

SEQ ID NO: 3200561 - DNA, 18 bp, Homo sapiens
acccctcctcactggcca

SEQ ID NO: 3200562 - DNA, 23 bp, Homo sapiens
acccctcctcactggccatccct

SEQ ID NO: 3200563 - DNA, 14 bp, Homo sapiens
acccctctggccag

SEQ ID NO: 3200564 - DNA, 13 bp, Homo sapiens
acccctgccccca

SEQ ID NO: 3200565 - DNA, 22 bp, Homo sapiens
acccctgcctcccatgcctggt

SEQ ID NO: 3200566 - DNA, 23 bp, Homo sapiens
acccctgctcccattcctccctc

SEQ ID NO: 3200567 - DNA, 14 bp, Homo sapiens
acccctgcttctga

SEQ ID NO: 3200568 - DNA, 12 bp, Homo sapiens
acccctggcttt

SEQ ID NO: 3200569 - DNA, 15 bp, Homo sapiens
acccctggcttttca

SEQ ID NO: 3200570 - DNA, 18 bp, Homo sapiens
acccctggcttttcactg

SEQ ID NO: 3200571 - DNA, 21 bp, Homo sapiens
acccctggcttttcactgctg

SEQ ID NO: 3200572 - DNA, 17 bp, Homo sapiens
acccctgtacccagctc

SEQ ID NO: 3200573 - DNA, 19 bp, Homo sapiens
acccctgtacccagctcct

SEQ ID NO: 3200574 - DNA, 22 bp, Homo sapiens
acccctgtcccatgcaggccct

SEQ ID NO: 3200575 - DNA, 12 bp, Homo sapiens
acacttcatttt

SEQ ID NO: 3200576 - DNA, 20 bp, Homo sapiens
acacttctgtgagaccccca

SEQ ID NO: 3200577 - DNA, 17 bp, Homo sapiens
acacttcttaccccagc

SEQ ID NO: 3200578 - DNA, 16 bp, Homo sapiens
acacttgagaggatga

SEQ ID NO: 3200579 - DNA, 23 bp, Homo sapiens
acacttgatggagtgtgagccac

SEQ ID NO: 3200580 - DNA, 22 bp, Homo sapiens
acacttgcaggggtccctgcta

SEQ ID NO: 3200581 - DNA, 15 bp, Homo sapiens
acacttggagcccgt

SEQ ID NO: 3200582 - DNA, 20 bp, Homo sapiens
acacttgtataaatgtatat

SEQ ID NO: 3200583 - DNA, 21 bp, Homo sapiens
acactttgccatttgcttgta

SEQ ID NO: 3200584 - DNA, 20 bp, Homo sapiens
acactttgcctcctgtgtac

SEQ ID NO: 3200585 - DNA, 14 bp, Homo sapiens
acactttgtattac

SEQ ID NO: 3200586 - DNA, 13 bp, Homo sapiens
acagaaaaagcat

SEQ ID NO: 3200587 - DNA, 17 bp, Homo sapiens
acagaaaaagcatgatg

SEQ ID NO: 3200588 - DNA, 22 bp, Homo sapiens
acagaaaaatcttgtgctagaa

SEQ ID NO: 3200589 - DNA, 21 bp, Homo sapiens
accagttgggagcactggagt

SEQ ID NO: 3200590 - DNA, 21 bp, Homo sapiens
accagtttagatttcaagaaa

SEQ ID NO: 3200591 - DNA, 20 bp, Homo sapiens
accataaaaccctatacaag

SEQ ID NO: 3200592 - DNA, 18 bp, Homo sapiens
accataaatgaatcatca

SEQ ID NO: 3200593 - DNA, 15 bp, Homo sapiens
accataatgttacat

SEQ ID NO: 3200594 - DNA, 19 bp, Homo sapiens
accatattcagtgctgtgg

SEQ ID NO: 3200595 - DNA, 21 bp, Homo sapiens
accatatttatccatttgtaa

SEQ ID NO: 3200596 - DNA, 21 bp, Homo sapiens
accatcaccaccgcctctggc

SEQ ID NO: 3200597 - DNA, 15 bp, Homo sapiens
accatcagggacagg

SEQ ID NO: 3200598 - DNA, 16 bp, Homo sapiens
accatcatgtctggct

SEQ ID NO: 3200599 - DNA, 19 bp, Homo sapiens
accatcattggaaatgaaa

SEQ ID NO: 3200600 - DNA, 12 bp, Homo sapiens
accatcctggct

SEQ ID NO: 3200601 - DNA, 18 bp, Homo sapiens
accatctgcttttattaa

SEQ ID NO: 3200602 - DNA, 15 bp, Homo sapiens
accatctggcctggc

SEQ ID NO: 3200603 - DNA, 23 bp, Homo sapiens
accatctggcctggcctggccct

SEQ ID NO: 3200604 - DNA, 18 bp, Homo sapiens
accatctggggcacctgc

SEQ ID NO: 3200605 - DNA, 20 bp, Homo sapiens
accatctggggcacctgctt

SEQ ID NO: 3200606 - DNA, 20 bp, Homo sapiens
accatcttttattctttttt

SEQ ID NO: 3200607 - DNA, 14 bp, Homo sapiens
accatgaagacagg

SEQ ID NO: 3200608 - DNA, 20 bp, Homo sapiens
accatgaagtaaattatgta

SEQ ID NO: 3200609 - DNA, 15 bp, Homo sapiens
accatgactgtgacc

SEQ ID NO: 3200610 - DNA, 21 bp, Homo sapiens
accatgagaagagggcctgtg

SEQ ID NO: 3200611 - DNA, 16 bp, Homo sapiens
accatgcaaatgctat

SEQ ID NO: 3200612 - DNA, 14 bp, Homo sapiens
accatgcagagcgc

SEQ ID NO: 3200613 - DNA, 21 bp, Homo sapiens
accatgcaggaaggaaaacta

SEQ ID NO: 3200614 - DNA, 20 bp, Homo sapiens
accatgcccggctaattttt

SEQ ID NO: 3200615 - DNA, 17 bp, Homo sapiens
accatgcctcactaatt

SEQ ID NO: 3200616 - DNA, 21 bp, Homo sapiens
accatgctgctttttggcaca

SEQ ID NO: 3200617 - DNA, 18 bp, Homo sapiens
accatggatttttacaag

SEQ ID NO: 3200618 - DNA, 15 bp, Homo sapiens
accatggccagccaa

SEQ ID NO: 3200619 - DNA, 23 bp, Homo sapiens
accatggctgaaggaaaccagtg

SEQ ID NO: 3200620 - DNA, 19 bp, Homo sapiens
accatggttaagagtccaa

SEQ ID NO: 3200621 - DNA, 17 bp, Homo sapiens
accatgtacatgaagaa

SEQ ID NO: 3200622 - DNA, 14 bp, Homo sapiens
accacctctgtggc

SEQ ID NO: 3200623 - DNA, 14 bp, Homo sapiens
accacctttactgt

SEQ ID NO: 3200624 - DNA, 16 bp, Homo sapiens
accacctttactgtgc

SEQ ID NO: 3200625 - DNA, 19 bp, Homo sapiens
accacgactggccagggcc

SEQ ID NO: 3200626 - DNA, 24 bp, Homo sapiens
accacgactggccagggccacgct

SEQ ID NO: 3200627 - DNA, 19 bp, Homo sapiens
accacgcccagctaatttt

SEQ ID NO: 3200628 - DNA, 18 bp, Homo sapiens
accacgcccgtcctgcct

SEQ ID NO: 3200629 - DNA, 16 bp, Homo sapiens
accacgctggaccttg

SEQ ID NO: 3200630 - DNA, 20 bp, Homo sapiens
accacggacgtttccatcag

SEQ ID NO: 3200631 - DNA, 15 bp, Homo sapiens
accacgtctgccagg

SEQ ID NO: 3200632 - DNA, 18 bp, Homo sapiens
accacgtctgccaggccc

SEQ ID NO: 3200633 - DNA, 19 bp, Homo sapiens
accacgtctgccaggccca

SEQ ID NO: 3200634 - DNA, 16 bp, Homo sapiens
accactaactcctgag

SEQ ID NO: 3200635 - DNA, 17 bp, Homo sapiens
accactaactcctgaga

SEQ ID NO: 3200636 - DNA, 17 bp, Homo sapiens
accactacatgcagccc

SEQ ID NO: 3200637 - DNA, 14 bp, Homo sapiens
accactatttaagt

SEQ ID NO: 3200638 - DNA, 13 bp, Homo sapiens
accactcagcccc

SEQ ID NO: 3200639 - DNA, 16 bp, Homo sapiens
accactcagcccctag

SEQ ID NO: 3200640 - DNA, 16 bp, Homo sapiens
accactcgaggcctgc

SEQ ID NO: 3200641 - DNA, 19 bp, Homo sapiens
accactcgaggcctgcaaa

SEQ ID NO: 3200642 - DNA, 14 bp, Homo sapiens
accactcgtgcatc

SEQ ID NO: 3200643 - DNA, 17 bp, Homo sapiens
accactcgtgcatccct

SEQ ID NO: 3200644 - DNA, 21 bp, Homo sapiens
accactcgtgcatccctgaga

SEQ ID NO: 3200645 - DNA, 19 bp, Homo sapiens
accactgcactccagcctg

SEQ ID NO: 3200646 - DNA, 14 bp, Homo sapiens
accactgccctgcc

SEQ ID NO: 3200647 - DNA, 16 bp, Homo sapiens
accactgccctgcctg

SEQ ID NO: 3200648 - DNA, 17 bp, Homo sapiens
accactgccctgcctgc

SEQ ID NO: 3200649 - DNA, 20 bp, Homo sapiens
accactgccctgcctgccca

SEQ ID NO: 3200650 - DNA, 12 bp, Homo sapiens
accactggccac

SEQ ID NO: 3200651 - DNA, 14 bp, Homo sapiens
accactggccacca

SEQ ID NO: 3200652 - DNA, 17 bp, Homo sapiens
accactggccaccaggc

SEQ ID NO: 3200653 - DNA, 19 bp, Homo sapiens
accactggccaccaggctg

SEQ ID NO: 3200654 - DNA, 21 bp, Homo sapiens
accactggccaccaggctggc

SEQ ID NO: 3200655 - DNA, 16 bp, Homo sapiens
accactgtgtatttaa

SEQ ID NO: 3200656 - DNA, 13 bp, Homo sapiens
accacttacctca

SEQ ID NO: 3200657 - DNA, 13 bp, Homo sapiens
accacttcattct

SEQ ID NO: 3200658 - DNA, 14 bp, Homo sapiens
accacttccagggg

SEQ ID NO: 3200659 - DNA, 23 bp, Homo sapiens
accacttccaggggaacctgcca

SEQ ID NO: 3200660 - DNA, 19 bp, Homo sapiens
accacttcctgctacagga

SEQ ID NO: 3200661 - DNA, 13 bp, Homo sapiens
accacttcgaaac

SEQ ID NO: 3200662 - DNA, 14 bp, Homo sapiens
accagaaaagcaat

SEQ ID NO: 3200663 - DNA, 17 bp, Homo sapiens
accagaaaagcccaagt

SEQ ID NO: 3200664 - DNA, 16 bp, Homo sapiens
accagaaaatgagggc

SEQ ID NO: 3200665 - DNA, 14 bp, Homo sapiens
accagaataaaata

SEQ ID NO: 3200666 - DNA, 14 bp, Homo sapiens
accagaattgtcct

SEQ ID NO: 3200667 - DNA, 21 bp, Homo sapiens
accagacaaaaaaatttaaaa

SEQ ID NO: 3200668 - DNA, 15 bp, Homo sapiens
accagacagcacagg

SEQ ID NO: 3200669 - DNA, 18 bp, Homo sapiens
accagacagcacagggca

SEQ ID NO: 3200670 - DNA, 16 bp, Homo sapiens
accagagcagatgcag

SEQ ID NO: 3200671 - DNA, 20 bp, Homo sapiens
accagagcatttccaacacc

SEQ ID NO: 3200672 - DNA, 21 bp, Homo sapiens
accagagccagatgcaggaca

SEQ ID NO: 3200673 - DNA, 12 bp, Homo sapiens
accagagcccac

SEQ ID NO: 3200674 - DNA, 15 bp, Homo sapiens
accagagctgtctga

SEQ ID NO: 3200675 - DNA, 15 bp, Homo sapiens
accagatttatttta

SEQ ID NO: 3200676 - DNA, 17 bp, Homo sapiens
accagatttattttaaa

SEQ ID NO: 3200677 - DNA, 17 bp, Homo sapiens
accagcaatatgtaaat

SEQ ID NO: 3200678 - DNA, 23 bp, Homo sapiens
accagcaggtgtggtggctcatg

SEQ ID NO: 3200679 - DNA, 21 bp, Homo sapiens
accagcatccacactgccggc

SEQ ID NO: 3200680 - DNA, 20 bp, Homo sapiens
accagcatgttaactttatt

SEQ ID NO: 3200681 - DNA, 18 bp, Homo sapiens
accagccccactgccagc

SEQ ID NO: 3200682 - DNA, 21 bp, Homo sapiens
accagccccactgccagcagc

SEQ ID NO: 3200683 - DNA, 16 bp, Homo sapiens
accagccccagtgccc

SEQ ID NO: 3200684 - DNA, 17 bp, Homo sapiens
accagccccagtgccca

SEQ ID NO: 3200685 - DNA, 19 bp, Homo sapiens
accagccccagtgcccaca

SEQ ID NO: 3200686 - DNA, 21 bp, Homo sapiens
accagcccccaggaagacatt

SEQ ID NO: 3200687 - DNA, 16 bp, Homo sapiens
accagccccctggatg

SEQ ID NO: 3200688 - DNA, 19 bp, Homo sapiens
accagccccctggatgggc

SEQ ID NO: 3200689 - DNA, 21 bp, Homo sapiens
accagccccctggatgggcat

SEQ ID NO: 3200690 - DNA, 11 bp, Homo sapiens
accagcccctg

SEQ ID NO: 3200691 - DNA, 16 bp, Homo sapiens
accagcccctgcccca

SEQ ID NO: 3200692 - DNA, 21 bp, Homo sapiens
accagcccgacagtgccatcc

SEQ ID NO: 3200693 - DNA, 21 bp, Homo sapiens
accagcccggcctgctcccag

SEQ ID NO: 3200694 - DNA, 17 bp, Homo sapiens
accagccctggggctgg

SEQ ID NO: 3200695 - DNA, 16 bp, Homo sapiens
accagccgctgcaggg

SEQ ID NO: 3200696 - DNA, 16 bp, Homo sapiens
accagccgtattttac

SEQ ID NO: 3200697 - DNA, 20 bp, Homo sapiens
accagcctcgccaacatggt

SEQ ID NO: 3200698 - DNA, 19 bp, Homo sapiens
accagcgccaaatgttcat

SEQ ID NO: 3200699 - DNA, 19 bp, Homo sapiens
accagcgctctaaaagcac

SEQ ID NO: 3200700 - DNA, 22 bp, Homo sapiens
accagcgtcctcgttcaaaaca

SEQ ID NO: 3200701 - DNA, 20 bp, Homo sapiens
accagctaaggagtccctgg

SEQ ID NO: 3200702 - DNA, 16 bp, Homo sapiens
accagctaccctgtgt

SEQ ID NO: 3200703 - DNA, 16 bp, Homo sapiens
accagctctgtggcct

SEQ ID NO: 3200704 - DNA, 23 bp, Homo sapiens
accagctctgtggcctgtgtcca

SEQ ID NO: 3200705 - DNA, 16 bp, Homo sapiens
accagctgcgcttgct

SEQ ID NO: 3200706 - DNA, 19 bp, Homo sapiens
accagctgcgcttgctttt

SEQ ID NO: 3200707 - DNA, 14 bp, Homo sapiens
accagctgctctgc

SEQ ID NO: 3200708 - DNA, 17 bp, Homo sapiens
accagctgctctgcccc

SEQ ID NO: 3200709 - DNA, 17 bp, Homo sapiens
accagctgctgctctga

SEQ ID NO: 3200710 - DNA, 21 bp, Homo sapiens
accagctggggcgtggggagg

SEQ ID NO: 3200711 - DNA, 23 bp, Homo sapiens
accagctggggcgtggggagggc

SEQ ID NO: 3200712 - DNA, 19 bp, Homo sapiens
accagcttgttctgggctc

SEQ ID NO: 3200713 - DNA, 14 bp, Homo sapiens
accaggactccctc

SEQ ID NO: 3200714 - DNA, 15 bp, Homo sapiens
accaggactccctcc

SEQ ID NO: 3200715 - DNA, 14 bp, Homo sapiens
accaggagaaccac

SEQ ID NO: 3200716 - DNA, 18 bp, Homo sapiens
accaggagaaccactaca

SEQ ID NO: 3200717 - DNA, 19 bp, Homo sapiens
accaggagaaccactacat

SEQ ID NO: 3200718 - DNA, 11 bp, Homo sapiens
accaggagaca

SEQ ID NO: 3200719 - DNA, 12 bp, Homo sapiens
accaggagacag

SEQ ID NO: 3200720 - DNA, 17 bp, Homo sapiens
accaggccacctcccca

SEQ ID NO: 3200721 - DNA, 18 bp, Homo sapiens
accaggcccagccagttg

SEQ ID NO: 3200722 - DNA, 19 bp, Homo sapiens
accaggctggcgcagccaa

SEQ ID NO: 3200723 - DNA, 23 bp, Homo sapiens
accaggctggcgcagccaaggcc

SEQ ID NO: 3200724 - DNA, 13 bp, Homo sapiens
accaggctgtgtc

SEQ ID NO: 3200725 - DNA, 10 bp, Homo sapiens
accagggaca

SEQ ID NO: 3200726 - DNA, 14 bp, Homo sapiens
accagggatgctgg

SEQ ID NO: 3200727 - DNA, 21 bp, Homo sapiens
accagggatgctgggctgggc

SEQ ID NO: 3200728 - DNA, 23 bp, Homo sapiens
accagggcattcgggccacaggg

SEQ ID NO: 3200729 - DNA, 18 bp, Homo sapiens
accagggcgctgggaagg

SEQ ID NO: 3200730 - DNA, 15 bp, Homo sapiens
accaggggaggagcc

SEQ ID NO: 3200731 - DNA, 16 bp, Homo sapiens
accaggggtttctcgc

SEQ ID NO: 3200732 - DNA, 18 bp, Homo sapiens
accaggtccattttgcct

SEQ ID NO: 3200733 - DNA, 16 bp, Homo sapiens
accaggtgagaagtga

SEQ ID NO: 3200734 - DNA, 18 bp, Homo sapiens
accagtacctctgtatag

SEQ ID NO: 3200735 - DNA, 23 bp, Homo sapiens
accagtacctctgtatagaaatc

SEQ ID NO: 3200736 - DNA, 13 bp, Homo sapiens
accagtctcctca

SEQ ID NO: 3200737 - DNA, 17 bp, Homo sapiens
accagtctcctcactct

SEQ ID NO: 3200738 - DNA, 14 bp, Homo sapiens
accagtctgtctac

SEQ ID NO: 3200739 - DNA, 19 bp, Homo sapiens
accagtctttaaaggccca

SEQ ID NO: 3200740 - DNA, 22 bp, Homo sapiens
accagtgaccccagaaaagcat

SEQ ID NO: 3200741 - DNA, 13 bp, Homo sapiens
accagtgccaagg

SEQ ID NO: 3200742 - DNA, 17 bp, Homo sapiens
accagtgccaaggacct

SEQ ID NO: 3200743 - DNA, 22 bp, Homo sapiens
accagtgcccaaagtctgtgtg

SEQ ID NO: 3200744 - DNA, 23 bp, Homo sapiens
accagtgcccaaagtctgtgtga

SEQ ID NO: 3200745 - DNA, 13 bp, Homo sapiens
accagttaatttt

SEQ ID NO: 3200746 - DNA, 17 bp, Homo sapiens
accagttatgtgaatga

SEQ ID NO: 3200747 - DNA, 12 bp, Homo sapiens
accagttgcctt

SEQ ID NO: 3200748 - DNA, 13 bp, Homo sapiens
accagttgccttt

SEQ ID NO: 3200749 - DNA, 15 bp, Homo sapiens
accagttgcctttta

SEQ ID NO: 3200750 - DNA, 20 bp, Homo sapiens
accagttgggagcactggag

SEQ ID NO: 3200751 - DNA, 20 bp, Homo sapiens
caagtgccagaggtgggcag

SEQ ID NO: 3200752 - DNA, 12 bp, Homo sapiens
caagtgcctaga

SEQ ID NO: 3200753 - DNA, 20 bp, Homo sapiens
caagtgccttttgctgcgca

SEQ ID NO: 3200754 - DNA, 20 bp, Homo sapiens
caattgtgtagcctttttgt

SEQ ID NO: 3200755 - DNA, 14 bp, Homo sapiens
caattgttgacagt

SEQ ID NO: 3200756 - DNA, 23 bp, Homo sapiens
caatttaagtgttggaaaaaatt

SEQ ID NO: 3200757 - DNA, 13 bp, Homo sapiens
caatttaattcct

SEQ ID NO: 3200758 - DNA, 14 bp, Homo sapiens
caatttattaaaat

SEQ ID NO: 3200759 - DNA, 23 bp, Homo sapiens
caatttattaaaatgattgtaaa

SEQ ID NO: 3200760 - DNA, 14 bp, Homo sapiens
caatttattctgat

SEQ ID NO: 3200761 - DNA, 15 bp, Homo sapiens
caatttattctgata

SEQ ID NO: 3200762 - DNA, 19 bp, Homo sapiens
caatttcaaggttctaacc

SEQ ID NO: 3200763 - DNA, 14 bp, Homo sapiens
caatttcaataaaa

SEQ ID NO: 3200764 - DNA, 13 bp, Homo sapiens
caatttccctcag

SEQ ID NO: 3200765 - DNA, 14 bp, Homo sapiens
caatttcctggccc

SEQ ID NO: 3200766 - DNA, 19 bp, Homo sapiens
caatttcctttatatttag

SEQ ID NO: 3200767 - DNA, 21 bp, Homo sapiens
caatttcctttatatttagtg

SEQ ID NO: 3200768 - DNA, 21 bp, Homo sapiens
caatttcggattttttccaaa

SEQ ID NO: 3200769 - DNA, 22 bp, Homo sapiens
caatttcggattttttccaaaa

SEQ ID NO: 3200770 - DNA, 15 bp, Homo sapiens
caatttcttccttcc

SEQ ID NO: 3200771 - DNA, 21 bp, Homo sapiens
caatttgcactaaatcagaga

SEQ ID NO: 3200772 - DNA, 23 bp, Homo sapiens
caatttggatttaaaagcctgct

SEQ ID NO: 3200773 - DNA, 13 bp, Homo sapiens
caatttggtaaaa

SEQ ID NO: 3200774 - DNA, 16 bp, Homo sapiens
caattttctaagcaat

SEQ ID NO: 3200775 - DNA, 12 bp, Homo sapiens
caattttgtaac

SEQ ID NO: 3200776 - DNA, 15 bp, Homo sapiens
caatttttaataaat

SEQ ID NO: 3200777 - DNA, 18 bp, Homo sapiens
caatttttatttctttta

SEQ ID NO: 3200778 - DNA, 18 bp, Homo sapiens
caatttttgtctcagaag

SEQ ID NO: 3200779 - DNA, 19 bp, Homo sapiens
caatttttgtctcagaagt

SEQ ID NO: 3200780 - DNA, 21 bp, Homo sapiens
caattttttttttcctcttca

SEQ ID NO: 3200781 - DNA, 22 bp, Homo sapiens
cacaaaaaaagttgaaggcctt

SEQ ID NO: 3200782 - DNA, 14 bp, Homo sapiens
cacaaaaatgttga

SEQ ID NO: 3200783 - DNA, 16 bp, Homo sapiens
cacaaaaatgttgaac

SEQ ID NO: 3200784 - DNA, 19 bp, Homo sapiens
cacaaaaatgttgaaccaa

SEQ ID NO: 3200785 - DNA, 12 bp, Homo sapiens
cacaaacatttt

SEQ ID NO: 3200786 - DNA, 15 bp, Homo sapiens
cacaaacatttttca

SEQ ID NO: 3200787 - DNA, 15 bp, Homo sapiens
cacaaaccatgcaaa

SEQ ID NO: 3200788 - DNA, 16 bp, Homo sapiens
cacaaactacctctgg

SEQ ID NO: 3200789 - DNA, 14 bp, Homo sapiens
cacaaactgtaaat

SEQ ID NO: 3200790 - DNA, 15 bp, Homo sapiens
cacaaagattttcta

SEQ ID NO: 3200791 - DNA, 18 bp, Homo sapiens
cacaaagcacagtttgaa

SEQ ID NO: 3200792 - DNA, 15 bp, Homo sapiens
cacaaagcagatcct

SEQ ID NO: 3200793 - DNA, 16 bp, Homo sapiens
cacaaaggtataattt

SEQ ID NO: 3200794 - DNA, 23 bp, Homo sapiens
cacaaatattatttgtgtttcct

SEQ ID NO: 3200795 - DNA, 18 bp, Homo sapiens
cacaaatcaaagcaaggg

SEQ ID NO: 3200796 - DNA, 20 bp, Homo sapiens
cacaaattttcaagtttaca

SEQ ID NO: 3200797 - DNA, 22 bp, Homo sapiens
cacaaattttcaagtttacact

SEQ ID NO: 3200798 - DNA, 18 bp, Homo sapiens
cacaacagaataaagcag

SEQ ID NO: 3200799 - DNA, 21 bp, Homo sapiens
cacaacagaataaagcagcct

SEQ ID NO: 3200800 - DNA, 23 bp, Homo sapiens
cacaaccaccgttacaagtatac

SEQ ID NO: 3200801 - DNA, 23 bp, Homo sapiens
cacaacctctctgatcttgtgct

SEQ ID NO: 3200802 - DNA, 14 bp, Homo sapiens
cacaacctgaaaga

SEQ ID NO: 3200803 - DNA, 17 bp, Homo sapiens
cacaacctgaaagacaa

SEQ ID NO: 3200804 - DNA, 19 bp, Homo sapiens
cacaaccttcggctccggg

SEQ ID NO: 3200805 - DNA, 19 bp, Homo sapiens
cacaaccttctgtggctca

SEQ ID NO: 3200806 - DNA, 18 bp, Homo sapiens
cacaacgtaaaaataaaa

SEQ ID NO: 3200807 - DNA, 19 bp, Homo sapiens
cacaacgtaaaaataaaag

SEQ ID NO: 3200808 - DNA, 14 bp, Homo sapiens
cacaactatttttc

SEQ ID NO: 3200809 - DNA, 16 bp, Homo sapiens
cacaactcccttgcac

SEQ ID NO: 3200810 - DNA, 17 bp, Homo sapiens
cacaactcccttgcacg

SEQ ID NO: 3200811 - DNA, 15 bp, Homo sapiens
cacaactgacacagg

SEQ ID NO: 3200812 - DNA, 20 bp, Homo sapiens
cacaactgcaataacttctg

SEQ ID NO: 3200813 - DNA, 15 bp, Homo sapiens
cacaacttttaacca

SEQ ID NO: 3200814 - DNA, 12 bp, Homo sapiens
cacaagaaaaag

SEQ ID NO: 3200815 - DNA, 14 bp, Homo sapiens
cacaagaaaaagat

SEQ ID NO: 3200816 - DNA, 14 bp, Homo sapiens
cacaagaatggatc

SEQ ID NO: 3200817 - DNA, 15 bp, Homo sapiens
cacaagagacttaaa

SEQ ID NO: 3200818 - DNA, 21 bp, Homo sapiens
cacaagagcccagcagggcct

SEQ ID NO: 3200819 - DNA, 14 bp, Homo sapiens
cacaagagtgaatt

SEQ ID NO: 3200820 - DNA, 23 bp, Homo sapiens
cacaagcagagtgcacagctgtc

SEQ ID NO: 3200821 - DNA, 14 bp, Homo sapiens
cacaagcgctccca

SEQ ID NO: 3200822 - DNA, 17 bp, Homo sapiens
cacaagcgctcccagcc

SEQ ID NO: 3200823 - DNA, 18 bp, Homo sapiens
cacaagcgctcccagcct

SEQ ID NO: 3200824 - DNA, 17 bp, Homo sapiens
cacaagctgtccctgca

SEQ ID NO: 3200825 - DNA, 18 bp, Homo sapiens
cacaagctgtccctgcag

SEQ ID NO: 3200826 - DNA, 20 bp, Homo sapiens
cacaagctgtccctgcaggg

SEQ ID NO: 3200827 - DNA, 18 bp, Homo sapiens
cacaaggctgaccaagag

SEQ ID NO: 3200828 - DNA, 12 bp, Homo sapiens
cacaaggctggc

SEQ ID NO: 3200829 - DNA, 20 bp, Homo sapiens
cacaaggctggccagcaagg

SEQ ID NO: 3200830 - DNA, 13 bp, Homo sapiens
cacaagtaaacat

SEQ ID NO: 3200831 - DNA, 19 bp, Homo sapiens
cacaagtatatacttttaa

SEQ ID NO: 3200832 - DNA, 20 bp, Homo sapiens
cacaagtatatacttttaaa

SEQ ID NO: 3200833 - DNA, 21 bp, Homo sapiens
cacaagtcctggatgttgtgt

SEQ ID NO: 3200834 - DNA, 14 bp, Homo sapiens
cacaagttccctgg

SEQ ID NO: 3200835 - DNA, 20 bp, Homo sapiens
cacaagttccctggagaaaa

SEQ ID NO: 3200836 - DNA, 19 bp, Homo sapiens
cacaataaatgtattcaaa

SEQ ID NO: 3200837 - DNA, 21 bp, Homo sapiens
cacaataacactaaaatttta

SEQ ID NO: 3200838 - DNA, 11 bp, Homo sapiens
cacaataccta

SEQ ID NO: 3200839 - DNA, 14 bp, Homo sapiens
cacaatatgtatgc

SEQ ID NO: 3200840 - DNA, 20 bp, Homo sapiens
cacaatcactaaactttatt

SEQ ID NO: 3200841 - DNA, 15 bp, Homo sapiens
cacaatcccacctag

SEQ ID NO: 3200842 - DNA, 18 bp, Homo sapiens
cacaatcccacctagccc

SEQ ID NO: 3200843 - DNA, 19 bp, Homo sapiens
cacaatcccacctagccca

SEQ ID NO: 3200844 - DNA, 20 bp, Homo sapiens
cacaatcccacctagcccag

SEQ ID NO: 3200845 - DNA, 20 bp, Homo sapiens
cacaatctggcttagtgcca

SEQ ID NO: 3200846 - DNA, 21 bp, Homo sapiens
cacaatctggcttagtgccac

SEQ ID NO: 3200847 - DNA, 23 bp, Homo sapiens
cacaatgagattgaatttcactg

SEQ ID NO: 3200848 - DNA, 17 bp, Homo sapiens
cacaatggagtgtgtaa

SEQ ID NO: 3200849 - DNA, 15 bp, Homo sapiens
cacaattattaaatt

SEQ ID NO: 3200850 - DNA, 17 bp, Homo sapiens
cacaattatttatttca

SEQ ID NO: 3200851 - DNA, 18 bp, Homo sapiens
cacaattcattggctcct

SEQ ID NO: 3200852 - DNA, 18 bp, Homo sapiens
cacacaaagattttctaa

SEQ ID NO: 3200853 - DNA, 22 bp, Homo sapiens
cacacaacgtaaaaataaaagc

SEQ ID NO: 3200854 - DNA, 16 bp, Homo sapiens
cacacaagaagaaggg

SEQ ID NO: 3200855 - DNA, 20 bp, Homo sapiens
cacacaattcattggctcct

SEQ ID NO: 3200856 - DNA, 10 bp, Homo sapiens
cacacacaca

SEQ ID NO: 3200857 - DNA, 12 bp, Homo sapiens
cacacacacaca

SEQ ID NO: 3200858 - DNA, 14 bp, Homo sapiens
cacacacacacaaa

SEQ ID NO: 3200859 - DNA, 15 bp, Homo sapiens
cacacacacacacaa

SEQ ID NO: 3200860 - DNA, 14 bp, Homo sapiens
cacacacacacacg

SEQ ID NO: 3200861 - DNA, 15 bp, Homo sapiens
cacacacacacacga

SEQ ID NO: 3200862 - DNA, 14 bp, Homo sapiens
cacacacacacgca

SEQ ID NO: 3200863 - DNA, 12 bp, Homo sapiens
cacacacacatc

SEQ ID NO: 3200864 - DNA, 15 bp, Homo sapiens
cacacacacgatgca

SEQ ID NO: 3200865 - DNA, 16 bp, Homo sapiens
cacacacacgatgcat

SEQ ID NO: 3200866 - DNA, 16 bp, Homo sapiens
cacacacagctgggca

SEQ ID NO: 3200867 - DNA, 15 bp, Homo sapiens
cacacaccagagccc

SEQ ID NO: 3200868 - DNA, 20 bp, Homo sapiens
cacacaccagagcccacctt

SEQ ID NO: 3200869 - DNA, 18 bp, Homo sapiens
cacacaccctgaggtcag

SEQ ID NO: 3200870 - DNA, 22 bp, Homo sapiens
cacacacgatgcatttaataaa

SEQ ID NO: 3200871 - DNA, 19 bp, Homo sapiens
cacacacgcacggcttcct

SEQ ID NO: 3200872 - DNA, 14 bp, Homo sapiens
cacacactgatgct

SEQ ID NO: 3200873 - DNA, 14 bp, Homo sapiens
cacacagaaatata

SEQ ID NO: 3200874 - DNA, 21 bp, Homo sapiens
cacacagaaatatatatacat

SEQ ID NO: 3200875 - DNA, 18 bp, Homo sapiens
cacacagaggaagagcag

SEQ ID NO: 3200876 - DNA, 19 bp, Homo sapiens
cacacagaggctgcctctc

SEQ ID NO: 3200877 - DNA, 17 bp, Homo sapiens
cacacagatacacacac

SEQ ID NO: 3200878 - DNA, 18 bp, Homo sapiens
cacagctgagcacttagc

SEQ ID NO: 3200879 - DNA, 13 bp, Homo sapiens
cacagctgcagct

SEQ ID NO: 3200880 - DNA, 21 bp, Homo sapiens
cacagctgcagctgggcccca

SEQ ID NO: 3200881 - DNA, 19 bp, Homo sapiens
cacagctgggcaaagccac

SEQ ID NO: 3200882 - DNA, 22 bp, Homo sapiens
cacagcttaacaatgcaacttt

SEQ ID NO: 3200883 - DNA, 19 bp, Homo sapiens
cacagcttgacctgaggct

SEQ ID NO: 3200884 - DNA, 15 bp, Homo sapiens
cacaggaaagagtca

SEQ ID NO: 3200885 - DNA, 22 bp, Homo sapiens
cacaggaagcctgcagtcctgg

SEQ ID NO: 3200886 - DNA, 16 bp, Homo sapiens
cacaggactgaaaagg

SEQ ID NO: 3200887 - DNA, 15 bp, Homo sapiens
cacaggaggccagtg

SEQ ID NO: 3200888 - DNA, 18 bp, Homo sapiens
cacaggagtgggaaaaca

SEQ ID NO: 3200889 - DNA, 16 bp, Homo sapiens
cacaggatgccagccc

SEQ ID NO: 3200890 - DNA, 18 bp, Homo sapiens
cacaggatgccagcccct

SEQ ID NO: 3200891 - DNA, 16 bp, Homo sapiens
cacaggatgctggcct

SEQ ID NO: 3200892 - DNA, 17 bp, Homo sapiens
cacaggcacacagggcc

SEQ ID NO: 3200893 - DNA, 13 bp, Homo sapiens
cacaggcagcttt

SEQ ID NO: 3200894 - DNA, 10 bp, Homo sapiens
cacaggcagg

SEQ ID NO: 3200895 - DNA, 15 bp, Homo sapiens
cacaggcaggtccag

SEQ ID NO: 3200896 - DNA, 20 bp, Homo sapiens
cacaggccatatttgtggcc

SEQ ID NO: 3200897 - DNA, 14 bp, Homo sapiens
cacaggcccagaag

SEQ ID NO: 3200898 - DNA, 12 bp, Homo sapiens
cacaggccccct

SEQ ID NO: 3200899 - DNA, 13 bp, Homo sapiens
cacaggccccctt

SEQ ID NO: 3200900 - DNA, 14 bp, Homo sapiens
cacaggcccggctc

SEQ ID NO: 3200901 - DNA, 20 bp, Homo sapiens
cacaggcccggctccaggct

SEQ ID NO: 3200902 - DNA, 18 bp, Homo sapiens
cacaggcccttcctctcc

SEQ ID NO: 3200903 - DNA, 19 bp, Homo sapiens
cacaggcccttcctctcca

SEQ ID NO: 3200904 - DNA, 11 bp, Homo sapiens
cacaggcctcc

SEQ ID NO: 3200905 - DNA, 22 bp, Homo sapiens
cacaggctatcaacatgttatt

SEQ ID NO: 3200906 - DNA, 14 bp, Homo sapiens
cacaggctggtgtg

SEQ ID NO: 3200907 - DNA, 13 bp, Homo sapiens
cacagggcaccag

SEQ ID NO: 3200908 - DNA, 15 bp, Homo sapiens
cacagggcaccagag

SEQ ID NO: 3200909 - DNA, 18 bp, Homo sapiens
cacagggcaccagaggcc

SEQ ID NO: 3200910 - DNA, 14 bp, Homo sapiens
cacagggccagagg

SEQ ID NO: 3200911 - DNA, 15 bp, Homo sapiens
cacagggccagaggg

SEQ ID NO: 3200912 - DNA, 14 bp, Homo sapiens
cacagggccccaga

SEQ ID NO: 3200913 - DNA, 16 bp, Homo sapiens
cacaggggacacagct

SEQ ID NO: 3200914 - DNA, 15 bp, Homo sapiens
cacaggggcaggcct

SEQ ID NO: 3200915 - DNA, 13 bp, Homo sapiens
cacaggggcccca

SEQ ID NO: 3200916 - DNA, 14 bp, Homo sapiens
cacaggggcggggc

SEQ ID NO: 3200917 - DNA, 16 bp, Homo sapiens
cacagggtctgctctt

SEQ ID NO: 3200918 - DNA, 19 bp, Homo sapiens
cacagggtctgctctttct

SEQ ID NO: 3200919 - DNA, 22 bp, Homo sapiens
cacagggttgggcccagatctg

SEQ ID NO: 3200920 - DNA, 18 bp, Homo sapiens
cacaggtcgggcgcagga

SEQ ID NO: 3200921 - DNA, 21 bp, Homo sapiens
cacaggtctcattgcttctga

SEQ ID NO: 3200922 - DNA, 16 bp, Homo sapiens
cacaggtgtggtgtaa

SEQ ID NO: 3200923 - DNA, 19 bp, Homo sapiens
cacaggttcatgccaccat

SEQ ID NO: 3200924 - DNA, 15 bp, Homo sapiens
cacaggttggaagag

SEQ ID NO: 3200925 - DNA, 16 bp, Homo sapiens
cacaggttggaagaga

SEQ ID NO: 3200926 - DNA, 23 bp, Homo sapiens
cacaggttttagcattgtcttgt

SEQ ID NO: 3200927 - DNA, 14 bp, Homo sapiens
cacagtaaaaataa

SEQ ID NO: 3200928 - DNA, 15 bp, Homo sapiens
cacagtaaaaataaa

SEQ ID NO: 3200929 - DNA, 16 bp, Homo sapiens
cacagtactttattgt

SEQ ID NO: 3200930 - DNA, 17 bp, Homo sapiens
cacagtactttattgta

SEQ ID NO: 3200931 - DNA, 13 bp, Homo sapiens
cacagtagaactg

SEQ ID NO: 3200932 - DNA, 19 bp, Homo sapiens
cacagtattacttctgcta

SEQ ID NO: 3200933 - DNA, 20 bp, Homo sapiens
cacagtcagcatgcttccca

SEQ ID NO: 3200934 - DNA, 15 bp, Homo sapiens
cacagtgaagtgctg

SEQ ID NO: 3200935 - DNA, 17 bp, Homo sapiens
cacagtgacccttccca

SEQ ID NO: 3200936 - DNA, 18 bp, Homo sapiens
cacagtgagtcgaggaca

SEQ ID NO: 3200937 - DNA, 11 bp, Homo sapiens
cacagtgattt

SEQ ID NO: 3200938 - DNA, 14 bp, Homo sapiens
cacagtgcatctca

SEQ ID NO: 3200939 - DNA, 18 bp, Homo sapiens
cacagtgctcttttctcc

SEQ ID NO: 3200940 - DNA, 17 bp, Homo sapiens
cacagtggactcagcag

SEQ ID NO: 3200941 - DNA, 20 bp, Homo sapiens
cacagtggactcagcagtga

SEQ ID NO: 3200942 - DNA, 15 bp, Homo sapiens
cacagtgggtggcac

SEQ ID NO: 3200943 - DNA, 17 bp, Homo sapiens
cacagtgggtggcacct

SEQ ID NO: 3200944 - DNA, 22 bp, Homo sapiens
cacagtgggtggcacctcctga

SEQ ID NO: 3200945 - DNA, 21 bp, Homo sapiens
cacagtgtaatccaggggtgt

SEQ ID NO: 3200946 - DNA, 18 bp, Homo sapiens
cacagtgtctgtatcgga

SEQ ID NO: 3200947 - DNA, 15 bp, Homo sapiens
cacagtgtgtgaact

SEQ ID NO: 3200948 - DNA, 21 bp, Homo sapiens
cacagtgtgtgacttacagaa

SEQ ID NO: 3200949 - DNA, 23 bp, Homo sapiens
cacagtgttaaatgaaattgtaa

SEQ ID NO: 3200950 - DNA, 19 bp, Homo sapiens
cacagtgttgcccaggctg

SEQ ID NO: 3200951 - DNA, 16 bp, Homo sapiens
cacagtgttggaggtt

SEQ ID NO: 3200952 - DNA, 23 bp, Homo sapiens
cacagttgaagggaggggctgtg

SEQ ID NO: 3200953 - DNA, 17 bp, Homo sapiens
cacagttgccaccacct

SEQ ID NO: 3200954 - DNA, 22 bp, Homo sapiens
cacagttgccaccacctctgtg

SEQ ID NO: 3200955 - DNA, 17 bp, Homo sapiens
cacagttggctggatga

SEQ ID NO: 3200956 - DNA, 22 bp, Homo sapiens
cacagttttagaataaggagga

SEQ ID NO: 3200957 - DNA, 22 bp, Homo sapiens
cacagttttgaaagaaaaatac

SEQ ID NO: 3200958 - DNA, 23 bp, Homo sapiens
cacataaaaaagaagcactttga

SEQ ID NO: 3200959 - DNA, 12 bp, Homo sapiens
cacataaattat

SEQ ID NO: 3200960 - DNA, 20 bp, Homo sapiens
cacataaattatgagatttt

SEQ ID NO: 3200961 - DNA, 17 bp, Homo sapiens
cacataaccttaaaaag

SEQ ID NO: 3200962 - DNA, 21 bp, Homo sapiens
cacataaggggtttgccattt

SEQ ID NO: 3200963 - DNA, 14 bp, Homo sapiens
cacatacagtttta

SEQ ID NO: 3200964 - DNA, 15 bp, Homo sapiens
cacatacattaaaac

SEQ ID NO: 3200965 - DNA, 16 bp, Homo sapiens
cacatacgtgcacagg

SEQ ID NO: 3200966 - DNA, 13 bp, Homo sapiens
cacatagattaat

SEQ ID NO: 3200967 - DNA, 20 bp, Homo sapiens
cacatagattaatggcactg

SEQ ID NO: 3200968 - DNA, 22 bp, Homo sapiens
cacatagattaatggcactgat

SEQ ID NO: 3200969 - DNA, 20 bp, Homo sapiens
caagtgctgaacagtggagg

SEQ ID NO: 3200970 - DNA, 17 bp, Homo sapiens
caagtggatgtttttaa

SEQ ID NO: 3200971 - DNA, 22 bp, Homo sapiens
caagtggggatggggcctccct

SEQ ID NO: 3200972 - DNA, 21 bp, Homo sapiens
caagtggggtgctgggaggag

SEQ ID NO: 3200973 - DNA, 14 bp, Homo sapiens
caagtgtcttccat

SEQ ID NO: 3200974 - DNA, 18 bp, Homo sapiens
caagtgtgaccccactgc

SEQ ID NO: 3200975 - DNA, 16 bp, Homo sapiens
caagtgtgctaaaaat

SEQ ID NO: 3200976 - DNA, 14 bp, Homo sapiens
caagttaaataaat

SEQ ID NO: 3200977 - DNA, 16 bp, Homo sapiens
caagttataaatcaat

SEQ ID NO: 3200978 - DNA, 20 bp, Homo sapiens
caagttatattagtgaagat

SEQ ID NO: 3200979 - DNA, 21 bp, Homo sapiens
caagttatattagtgaagatg

SEQ ID NO: 3200980 - DNA, 17 bp, Homo sapiens
caagttcatgcagctgt

SEQ ID NO: 3200981 - DNA, 18 bp, Homo sapiens
caagttccaagttgctaa

SEQ ID NO: 3200982 - DNA, 22 bp, Homo sapiens
caagttccccatccctgtcatt

SEQ ID NO: 3200983 - DNA, 17 bp, Homo sapiens
caagttccctggagaaa

SEQ ID NO: 3200984 - DNA, 17 bp, Homo sapiens
caagttctaagattcta

SEQ ID NO: 3200985 - DNA, 18 bp, Homo sapiens
caagttcttcacctctat

SEQ ID NO: 3200986 - DNA, 16 bp, Homo sapiens
caagttgccattttgt

SEQ ID NO: 3200987 - DNA, 16 bp, Homo sapiens
caagttgctgtcactg

SEQ ID NO: 3200988 - DNA, 14 bp, Homo sapiens
caagttggactggg

SEQ ID NO: 3200989 - DNA, 16 bp, Homo sapiens
caagttgtaaaaatga

SEQ ID NO: 3200990 - DNA, 20 bp, Homo sapiens
caagtttaaaagccatgtat

SEQ ID NO: 3200991 - DNA, 15 bp, Homo sapiens
caagttttaaagttc

SEQ ID NO: 3200992 - DNA, 13 bp, Homo sapiens
caagttttgtata

SEQ ID NO: 3200993 - DNA, 19 bp, Homo sapiens
caagttttgtataaataat

SEQ ID NO: 3200994 - DNA, 13 bp, Homo sapiens
caagttttgtgta

SEQ ID NO: 3200995 - DNA, 16 bp, Homo sapiens
caataaaaagttcaga

SEQ ID NO: 3200996 - DNA, 20 bp, Homo sapiens
caataaaaatgtttaacggt

SEQ ID NO: 3200997 - DNA, 12 bp, Homo sapiens
caataaaagctt

SEQ ID NO: 3200998 - DNA, 11 bp, Homo sapiens
caataaaattt

SEQ ID NO: 3200999 - DNA, 18 bp, Homo sapiens
caataaaatttctaagag

SEQ ID NO: 3201000 - DNA, 21 bp, Homo sapiens
caataaacaacagctgaagca

SEQ ID NO: 3201001 - DNA, 15 bp, Homo sapiens
caataaacaggaatt

SEQ ID NO: 3201002 - DNA, 13 bp, Homo sapiens
caataaaccaggt

SEQ ID NO: 3201003 - DNA, 11 bp, Homo sapiens
caataaactat

SEQ ID NO: 3201004 - DNA, 22 bp, Homo sapiens
caataaagagttagaatgaaaa

SEQ ID NO: 3201005 - DNA, 13 bp, Homo sapiens
caataaagcaatg

SEQ ID NO: 3201006 - DNA, 15 bp, Homo sapiens
caataaagcatttat

SEQ ID NO: 3201007 - DNA, 16 bp, Homo sapiens
caataaagcatttata

SEQ ID NO: 3201008 - DNA, 12 bp, Homo sapiens
caataaaggcag

SEQ ID NO: 3201009 - DNA, 14 bp, Homo sapiens
caataaaggcagct

SEQ ID NO: 3201010 - DNA, 15 bp, Homo sapiens
caataaaggcagctg

SEQ ID NO: 3201011 - DNA, 23 bp, Homo sapiens
caataaaggcagctgcctctgct

SEQ ID NO: 3201012 - DNA, 16 bp, Homo sapiens
caataaagtgccttct

SEQ ID NO: 3201013 - DNA, 17 bp, Homo sapiens
caataaagtgccttctg

SEQ ID NO: 3201014 - DNA, 14 bp, Homo sapiens
caataaatccacac

SEQ ID NO: 3201015 - DNA, 14 bp, Homo sapiens
caataaatgtattc

SEQ ID NO: 3201016 - DNA, 15 bp, Homo sapiens
caataaatgtattca

SEQ ID NO: 3201017 - DNA, 17 bp, Homo sapiens
caataaatttatatact

SEQ ID NO: 3201018 - DNA, 13 bp, Homo sapiens
caataacccagtt

SEQ ID NO: 3201019 - DNA, 17 bp, Homo sapiens
caataacccagttactt

SEQ ID NO: 3201020 - DNA, 18 bp, Homo sapiens
caataactactgtgttcc

SEQ ID NO: 3201021 - DNA, 19 bp, Homo sapiens
caataactactgtgttcct

SEQ ID NO: 3201022 - DNA, 20 bp, Homo sapiens
caataagaatttagggagaa

SEQ ID NO: 3201023 - DNA, 21 bp, Homo sapiens
caataagcgttaagggcagag

SEQ ID NO: 3201024 - DNA, 22 bp, Homo sapiens
caataagcgttaagggcagagt

SEQ ID NO: 3201025 - DNA, 23 bp, Homo sapiens
caataaggtcaagggaaaacccc

SEQ ID NO: 3201026 - DNA, 11 bp, Homo sapiens
caataataaaa

SEQ ID NO: 3201027 - DNA, 24 bp, Homo sapiens
caataataaaaaatattcttgtca

SEQ ID NO: 3201028 - DNA, 12 bp, Homo sapiens
caataatcagaa

SEQ ID NO: 3201029 - DNA, 13 bp, Homo sapiens
caataatcagaaa

SEQ ID NO: 3201030 - DNA, 18 bp, Homo sapiens
caataatcagaaaagtaa

SEQ ID NO: 3201031 - DNA, 12 bp, Homo sapiens
caataattgttt

SEQ ID NO: 3201032 - DNA, 14 bp, Homo sapiens
caatacagcttcat

SEQ ID NO: 3201033 - DNA, 23 bp, Homo sapiens
caatacagtgaaggtctttgtta

SEQ ID NO: 3201034 - DNA, 15 bp, Homo sapiens
caatacatgagaaag

SEQ ID NO: 3201035 - DNA, 14 bp, Homo sapiens
caatactacctctg

SEQ ID NO: 3201036 - DNA, 18 bp, Homo sapiens
caatactgtatgccttct

SEQ ID NO: 3201037 - DNA, 14 bp, Homo sapiens
caatagagactgta

SEQ ID NO: 3201038 - DNA, 23 bp, Homo sapiens
caatagatttaggagcagaaatg

SEQ ID NO: 3201039 - DNA, 19 bp, Homo sapiens
caatagcaacgtagcttct

SEQ ID NO: 3201040 - DNA, 19 bp, Homo sapiens
caatagcagacagtgtttt

SEQ ID NO: 3201041 - DNA, 14 bp, Homo sapiens
caatagcagttata

SEQ ID NO: 3201042 - DNA, 23 bp, Homo sapiens
caatagggtagaatgattaatca

SEQ ID NO: 3201043 - DNA, 13 bp, Homo sapiens
caatagtatttct

SEQ ID NO: 3201044 - DNA, 15 bp, Homo sapiens
caatagttgaattag

SEQ ID NO: 3201045 - DNA, 16 bp, Homo sapiens
caatagttttttactt

SEQ ID NO: 3201046 - DNA, 21 bp, Homo sapiens
caatagttttttacttctctt

SEQ ID NO: 3201047 - DNA, 15 bp, Homo sapiens
caatataagaaggaa

SEQ ID NO: 3201048 - DNA, 16 bp, Homo sapiens
caatataagaaggaaa

SEQ ID NO: 3201049 - DNA, 18 bp, Homo sapiens
caatatataaaaatatat

SEQ ID NO: 3201050 - DNA, 21 bp, Homo sapiens
caatatataaaaatatatata

SEQ ID NO: 3201051 - DNA, 18 bp, Homo sapiens
caatatatagaattgtag

SEQ ID NO: 3201052 - DNA, 16 bp, Homo sapiens
caatatattaccagca

SEQ ID NO: 3201053 - DNA, 18 bp, Homo sapiens
caatatattaccagcaag

SEQ ID NO: 3201054 - DNA, 18 bp, Homo sapiens
caatatccctcttgtaag

SEQ ID NO: 3201055 - DNA, 16 bp, Homo sapiens
caatatctaatatata

SEQ ID NO: 3201056 - DNA, 13 bp, Homo sapiens
caatatctgaagc

SEQ ID NO: 3201057 - DNA, 11 bp, Homo sapiens
caatatgcaag

SEQ ID NO: 3201058 - DNA, 20 bp, Homo sapiens
caatatgcaagcagcttttt

SEQ ID NO: 3201059 - DNA, 12 bp, Homo sapiens
caatatgtatgc

SEQ ID NO: 3201060 - DNA, 17 bp, Homo sapiens
caatatgtatgcttttt

SEQ ID NO: 3201061 - DNA, 13 bp, Homo sapiens
caatatgtattgt

SEQ ID NO: 3201062 - DNA, 15 bp, Homo sapiens
caatatgtattgtaa

SEQ ID NO: 3201063 - DNA, 23 bp, Homo sapiens
caatatgtattgtaaacatgtgt

SEQ ID NO: 3201064 - DNA, 18 bp, Homo sapiens
caatattatactaagaaa

SEQ ID NO: 3201065 - DNA, 21 bp, Homo sapiens
caatattatactaagaaaaga

SEQ ID NO: 3201066 - DNA, 13 bp, Homo sapiens
caatattcctgaa

SEQ ID NO: 3201067 - DNA, 17 bp, Homo sapiens
caatatttataaagaat

SEQ ID NO: 3201068 - DNA, 19 bp, Homo sapiens
caatatttatggatgcaac

SEQ ID NO: 3201069 - DNA, 12 bp, Homo sapiens
caatatttatta

SEQ ID NO: 3201070 - DNA, 13 bp, Homo sapiens
caatatttattat

SEQ ID NO: 3201071 - DNA, 22 bp, Homo sapiens
caatatttctgctttctttgat

SEQ ID NO: 3201072 - DNA, 23 bp, Homo sapiens
caatatttctgctttctttgatt

SEQ ID NO: 3201073 - DNA, 19 bp, Homo sapiens
caatatttgaattttaaat

SEQ ID NO: 3201074 - DNA, 16 bp, Homo sapiens
caatattttctttaat

SEQ ID NO: 3201075 - DNA, 14 bp, Homo sapiens
caatcaaagaatta

SEQ ID NO: 3201076 - DNA, 16 bp, Homo sapiens
caatcaaagaattaca

SEQ ID NO: 3201077 - DNA, 17 bp, Homo sapiens
caatcaaataagtattt

SEQ ID NO: 3201078 - DNA, 23 bp, Homo sapiens
caatcaaataagtatttataata

SEQ ID NO: 3201079 - DNA, 20 bp, Homo sapiens
caatcaaatctcctgctgat

SEQ ID NO: 3201080 - DNA, 15 bp, Homo sapiens
caatcaactctaata

SEQ ID NO: 3201081 - DNA, 16 bp, Homo sapiens
caatcaactttactgt

SEQ ID NO: 3201082 - DNA, 13 bp, Homo sapiens
caatcaagttttt

SEQ ID NO: 3201083 - DNA, 13 bp, Homo sapiens
caatcacactaca

SEQ ID NO: 3201084 - DNA, 15 bp, Homo sapiens
caatcactaaacttt

SEQ ID NO: 3201085 - DNA, 17 bp, Homo sapiens
caatcactaaactttat

SEQ ID NO: 3201086 - DNA, 15 bp, Homo sapiens
caatcactgtcctcc

SEQ ID NO: 3201087 - DNA, 14 bp, Homo sapiens
caatcagcactgaa

SEQ ID NO: 3201088 - DNA, 22 bp, Homo sapiens
caatcagtcccctcccatctgg

SEQ ID NO: 3201089 - DNA, 15 bp, Homo sapiens
caatcatctgtgtga

SEQ ID NO: 3201090 - DNA, 17 bp, Homo sapiens
caatcatgaaatatgca

SEQ ID NO: 3201091 - DNA, 23 bp, Homo sapiens
caatcatgaacagctctgagatc

SEQ ID NO: 3201092 - DNA, 20 bp, Homo sapiens
caatcattgttttgaatatt

SEQ ID NO: 3201093 - DNA, 14 bp, Homo sapiens
caatcatttctcac

SEQ ID NO: 3201094 - DNA, 17 bp, Homo sapiens
caatcatttctcactgt

SEQ ID NO: 3201095 - DNA, 18 bp, Homo sapiens
caatcatttctcactgtg

SEQ ID NO: 3201096 - DNA, 13 bp, Homo sapiens
caatccaacccgg

SEQ ID NO: 3201097 - DNA, 19 bp, Homo sapiens
caatccatgtgattaatgt

SEQ ID NO: 3201098 - DNA, 21 bp, Homo sapiens
caatccatgttagtttttact

SEQ ID NO: 3201099 - DNA, 17 bp, Homo sapiens
caactaggcttcagcat

SEQ ID NO: 3201100 - DNA, 19 bp, Homo sapiens
caactataagcccactgtt

SEQ ID NO: 3201101 - DNA, 22 bp, Homo sapiens
caactatgatatggtaaaagtt

SEQ ID NO: 3201102 - DNA, 16 bp, Homo sapiens
caactatggatcagaa

SEQ ID NO: 3201103 - DNA, 13 bp, Homo sapiens
caactccagcaac

SEQ ID NO: 3201104 - DNA, 20 bp, Homo sapiens
caactccagcaacttcttct

SEQ ID NO: 3201105 - DNA, 15 bp, Homo sapiens
caactcccttgcacg

SEQ ID NO: 3201106 - DNA, 16 bp, Homo sapiens
caactcgcctgtggac

SEQ ID NO: 3201107 - DNA, 16 bp, Homo sapiens
caactctacccctgct

SEQ ID NO: 3201108 - DNA, 13 bp, Homo sapiens
caactctccagcc

SEQ ID NO: 3201109 - DNA, 14 bp, Homo sapiens
caactctctgagag

SEQ ID NO: 3201110 - DNA, 18 bp, Homo sapiens
caactcttgattatccat

SEQ ID NO: 3201111 - DNA, 14 bp, Homo sapiens
caactgaaaagact

SEQ ID NO: 3201112 - DNA, 15 bp, Homo sapiens
caactgacacaggaa

SEQ ID NO: 3201113 - DNA, 19 bp, Homo sapiens
caactgcaaaaaaagcctc

SEQ ID NO: 3201114 - DNA, 19 bp, Homo sapiens
caactgcaaagaaagtggg

SEQ ID NO: 3201115 - DNA, 15 bp, Homo sapiens
caactgcctactcca

SEQ ID NO: 3201116 - DNA, 18 bp, Homo sapiens
caactgcctactccaaaa

SEQ ID NO: 3201117 - DNA, 15 bp, Homo sapiens
caactgctaatgcaa

SEQ ID NO: 3201118 - DNA, 16 bp, Homo sapiens
caagatatttatatat

SEQ ID NO: 3201119 - DNA, 13 bp, Homo sapiens
caagatccatttg

SEQ ID NO: 3201120 - DNA, 14 bp, Homo sapiens
caagatccatttgc

SEQ ID NO: 3201121 - DNA, 22 bp, Homo sapiens
caagatccatttgcctttctgg

SEQ ID NO: 3201122 - DNA, 14 bp, Homo sapiens
caagatgaaataat

SEQ ID NO: 3201123 - DNA, 17 bp, Homo sapiens
caagatgaaataatttt

SEQ ID NO: 3201124 - DNA, 19 bp, Homo sapiens
caagatgaaataatttttc

SEQ ID NO: 3201125 - DNA, 15 bp, Homo sapiens
caagatgactggggt

SEQ ID NO: 3201126 - DNA, 18 bp, Homo sapiens
caagatgccatctgtgtc

SEQ ID NO: 3201127 - DNA, 16 bp, Homo sapiens
caagatgtcagactgg

SEQ ID NO: 3201128 - DNA, 12 bp, Homo sapiens
caagattagaag

SEQ ID NO: 3201129 - DNA, 20 bp, Homo sapiens
caagattagaagctgaaaac

SEQ ID NO: 3201130 - DNA, 19 bp, Homo sapiens
caagattcacacctgactc

SEQ ID NO: 3201131 - DNA, 18 bp, Homo sapiens
caagattccggatcctaa

SEQ ID NO: 3201132 - DNA, 12 bp, Homo sapiens
caagattctaga

SEQ ID NO: 3201133 - DNA, 13 bp, Homo sapiens
caagatttccttg

SEQ ID NO: 3201134 - DNA, 16 bp, Homo sapiens
caagatttccttgtgc

SEQ ID NO: 3201135 - DNA, 22 bp, Homo sapiens
caagattttgaatgcttcctga

SEQ ID NO: 3201136 - DNA, 11 bp, Homo sapiens
caagcaaacat

SEQ ID NO: 3201137 - DNA, 19 bp, Homo sapiens
caagcaaaccaatggtgat

SEQ ID NO: 3201138 - DNA, 19 bp, Homo sapiens
caagcaacctgggtccaaa

SEQ ID NO: 3201139 - DNA, 19 bp, Homo sapiens
caagcaataattgtttcca

SEQ ID NO: 3201140 - DNA, 13 bp, Homo sapiens
caagcaatgcaag

SEQ ID NO: 3201141 - DNA, 18 bp, Homo sapiens
caagcacctagcctcgct

SEQ ID NO: 3201142 - DNA, 15 bp, Homo sapiens
caagcacctcctgcc

SEQ ID NO: 3201143 - DNA, 17 bp, Homo sapiens
caagcacctcctgcctc

SEQ ID NO: 3201144 - DNA, 15 bp, Homo sapiens
caagcactattttat

SEQ ID NO: 3201145 - DNA, 12 bp, Homo sapiens
caagcactgata

SEQ ID NO: 3201146 - DNA, 17 bp, Homo sapiens
caagcagaggtggccag

SEQ ID NO: 3201147 - DNA, 18 bp, Homo sapiens
caagcagaggtggccaga

SEQ ID NO: 3201148 - DNA, 20 bp, Homo sapiens
caagcagagtgcacagctgt

SEQ ID NO: 3201149 - DNA, 22 bp, Homo sapiens
caagcagccagccagtcttgcc

SEQ ID NO: 3201150 - DNA, 17 bp, Homo sapiens
caagcagggaaagctcc

SEQ ID NO: 3201151 - DNA, 23 bp, Homo sapiens
caagcagggaaagctccacggtg

SEQ ID NO: 3201152 - DNA, 15 bp, Homo sapiens
caagcagtcgtgcct

SEQ ID NO: 3201153 - DNA, 19 bp, Homo sapiens
caagcagtcgtgcctgtgt

SEQ ID NO: 3201154 - DNA, 21 bp, Homo sapiens
caagcagtcgtgcctgtgtcc

SEQ ID NO: 3201155 - DNA, 23 bp, Homo sapiens
caagcagttactccctacactga

SEQ ID NO: 3201156 - DNA, 23 bp, Homo sapiens
caagccaaagtggcatgttttgt

SEQ ID NO: 3201157 - DNA, 18 bp, Homo sapiens
caagccaacgacaaagcc

SEQ ID NO: 3201158 - DNA, 18 bp, Homo sapiens
caagccaacttgtaaata

SEQ ID NO: 3201159 - DNA, 23 bp, Homo sapiens
caagccaagggaacctgtgtccg

SEQ ID NO: 3201160 - DNA, 15 bp, Homo sapiens
caagccaatcccctc

SEQ ID NO: 3201161 - DNA, 22 bp, Homo sapiens
caagccaatcccctccttgggc

SEQ ID NO: 3201162 - DNA, 17 bp, Homo sapiens
caagccagctctaggct

SEQ ID NO: 3201163 - DNA, 15 bp, Homo sapiens
caagcccaggccacc

SEQ ID NO: 3201164 - DNA, 19 bp, Homo sapiens
caagccccagcagccctca

SEQ ID NO: 3201165 - DNA, 21 bp, Homo sapiens
caagccccagcagccctcaac

SEQ ID NO: 3201166 - DNA, 17 bp, Homo sapiens
caagccccagggcctgg

SEQ ID NO: 3201167 - DNA, 13 bp, Homo sapiens
caagccccatctc

SEQ ID NO: 3201168 - DNA, 14 bp, Homo sapiens
caagccccatctca

SEQ ID NO: 3201169 - DNA, 21 bp, Homo sapiens
caagccccatctcatcctggc

SEQ ID NO: 3201170 - DNA, 17 bp, Homo sapiens
caagccccatttcctca

SEQ ID NO: 3201171 - DNA, 16 bp, Homo sapiens
caagcccctcagccct

SEQ ID NO: 3201172 - DNA, 17 bp, Homo sapiens
caagcccctcagccctt

SEQ ID NO: 3201173 - DNA, 18 bp, Homo sapiens
caagcccctcagcccttg

SEQ ID NO: 3201174 - DNA, 19 bp, Homo sapiens
caagcccctcagcccttgc

SEQ ID NO: 3201175 - DNA, 18 bp, Homo sapiens
caagcccgttagccccag

SEQ ID NO: 3201176 - DNA, 13 bp, Homo sapiens
caagccctactcg

SEQ ID NO: 3201177 - DNA, 21 bp, Homo sapiens
caagccctgaggcctgaggcc

SEQ ID NO: 3201178 - DNA, 22 bp, Homo sapiens
caagccctgaggcctgaggcct

SEQ ID NO: 3201179 - DNA, 14 bp, Homo sapiens
caagccctgagggg

SEQ ID NO: 3201180 - DNA, 23 bp, Homo sapiens
caagccctggagaaatgggagct

SEQ ID NO: 3201181 - DNA, 18 bp, Homo sapiens
caagcctaagggatcctg

SEQ ID NO: 3201182 - DNA, 13 bp, Homo sapiens
caagcctgagaac

SEQ ID NO: 3201183 - DNA, 15 bp, Homo sapiens
caagcctgcctccca

SEQ ID NO: 3201184 - DNA, 13 bp, Homo sapiens
caagcctgctggc

SEQ ID NO: 3201185 - DNA, 22 bp, Homo sapiens
caagcctgggcttgagctgcag

SEQ ID NO: 3201186 - DNA, 22 bp, Homo sapiens
caagcgattcttctgcttcagc

SEQ ID NO: 3201187 - DNA, 20 bp, Homo sapiens
caagcgctcccagcctgccc

SEQ ID NO: 3201188 - DNA, 16 bp, Homo sapiens
caagcgtgagccactg

SEQ ID NO: 3201189 - DNA, 17 bp, Homo sapiens
caagcgtgagccactgc

SEQ ID NO: 3201190 - DNA, 22 bp, Homo sapiens
caagctaagcactgccactggg

SEQ ID NO: 3201191 - DNA, 21 bp, Homo sapiens
caagctaggccccagaggccc

SEQ ID NO: 3201192 - DNA, 16 bp, Homo sapiens
caagctatctaaagtt

SEQ ID NO: 3201193 - DNA, 20 bp, Homo sapiens
caagctattctcatgcctca

SEQ ID NO: 3201194 - DNA, 22 bp, Homo sapiens
caagctattctcatgcctcagc

SEQ ID NO: 3201195 - DNA, 21 bp, Homo sapiens
caagctcactccccaaccccc

SEQ ID NO: 3201196 - DNA, 19 bp, Homo sapiens
caagctccaagccccatct

SEQ ID NO: 3201197 - DNA, 14 bp, Homo sapiens
caagctccctggag

SEQ ID NO: 3201198 - DNA, 15 bp, Homo sapiens
caagctccctggagc

SEQ ID NO: 3201199 - DNA, 18 bp, Homo sapiens
caagctccctggagccct

SEQ ID NO: 3201200 - DNA, 20 bp, Homo sapiens
caagctccctggagccctgt

SEQ ID NO: 3201201 - DNA, 12 bp, Homo sapiens
caagctcctcct

SEQ ID NO: 3201202 - DNA, 19 bp, Homo sapiens
caagctcctcctcggaacc

SEQ ID NO: 3201203 - DNA, 12 bp, Homo sapiens
caagctctcttg

SEQ ID NO: 3201204 - DNA, 13 bp, Homo sapiens
caagctctgctcc

SEQ ID NO: 3201205 - DNA, 14 bp, Homo sapiens
caagctctgctcct

SEQ ID NO: 3201206 - DNA, 15 bp, Homo sapiens
caagctctgctcctc

SEQ ID NO: 3201207 - DNA, 14 bp, Homo sapiens
caagctgaaatttt

SEQ ID NO: 3201208 - DNA, 13 bp, Homo sapiens
caagctgacttgg

SEQ ID NO: 3201209 - DNA, 22 bp, Homo sapiens
caagctgagtttcctatgggaa

SEQ ID NO: 3201210 - DNA, 18 bp, Homo sapiens
caagctgcctctgggcca

SEQ ID NO: 3201211 - DNA, 23 bp, Homo sapiens
caagctgcttgtcctgggcctgc

SEQ ID NO: 3201212 - DNA, 22 bp, Homo sapiens
caagctggtcccactcagtcca

SEQ ID NO: 3201213 - DNA, 23 bp, Homo sapiens
caagctggtcccactcagtccat

SEQ ID NO: 3201214 - DNA, 19 bp, Homo sapiens
caagctgtcccctctgtca

SEQ ID NO: 3201215 - DNA, 16 bp, Homo sapiens
caagctgtccctgcag

SEQ ID NO: 3201216 - DNA, 17 bp, Homo sapiens
caagctgtccctgcagg

SEQ ID NO: 3201217 - DNA, 18 bp, Homo sapiens
caagctgtccctgcaggg

SEQ ID NO: 3201218 - DNA, 22 bp, Homo sapiens
caagctgtccctgcagggccat

SEQ ID NO: 3201219 - DNA, 22 bp, Homo sapiens
caagcttaatagccctccccct

SEQ ID NO: 3201220 - DNA, 20 bp, Homo sapiens
caagcttgttatcagctttc

SEQ ID NO: 3201221 - DNA, 16 bp, Homo sapiens
caagctttaaattatg

SEQ ID NO: 3201222 - DNA, 14 bp, Homo sapiens
caaggaaaactgca

SEQ ID NO: 3201223 - DNA, 20 bp, Homo sapiens
caaggaaacgctacctctct

SEQ ID NO: 3201224 - DNA, 18 bp, Homo sapiens
caaggaacaaaaaaacca

SEQ ID NO: 3201225 - DNA, 11 bp, Homo sapiens
caaggaagagc

SEQ ID NO: 3201226 - DNA, 17 bp, Homo sapiens
caaggaagatatacatg

SEQ ID NO: 3201227 - DNA, 14 bp, Homo sapiens
caaggaataaatga

SEQ ID NO: 3201228 - DNA, 16 bp, Homo sapiens
caaggaataaatgaga

SEQ ID NO: 3201229 - DNA, 18 bp, Homo sapiens
caaggaatgcctgtgcca

SEQ ID NO: 3201230 - DNA, 12 bp, Homo sapiens
caaggaatttct

SEQ ID NO: 3201231 - DNA, 20 bp, Homo sapiens
caaggacctcctcttccccc

SEQ ID NO: 3201232 - DNA, 16 bp, Homo sapiens
caaggacttgaaagca

SEQ ID NO: 3201233 - DNA, 15 bp, Homo sapiens
caaggactttgcagc

SEQ ID NO: 3201234 - DNA, 22 bp, Homo sapiens
caaggagaccaagtcctggcta

SEQ ID NO: 3201235 - DNA, 16 bp, Homo sapiens
caaggagcacaggtcc

SEQ ID NO: 3201236 - DNA, 14 bp, Homo sapiens
caaggagctcaccc

SEQ ID NO: 3201237 - DNA, 19 bp, Homo sapiens
caaggagctcaccctgccc

SEQ ID NO: 3201238 - DNA, 20 bp, Homo sapiens
caaggagctcaccctgcccg

SEQ ID NO: 3201239 - DNA, 13 bp, Homo sapiens
caaggaggcctgg

SEQ ID NO: 3201240 - DNA, 18 bp, Homo sapiens
caaggaggggctgtaaaa

SEQ ID NO: 3201241 - DNA, 18 bp, Homo sapiens
caaggataccttcttatt

SEQ ID NO: 3201242 - DNA, 16 bp, Homo sapiens
caaggattacagaaac

SEQ ID NO: 3201243 - DNA, 20 bp, Homo sapiens
caaggattacagaaactgat

SEQ ID NO: 3201244 - DNA, 15 bp, Homo sapiens
caaggcaaggcaggt

SEQ ID NO: 3201245 - DNA, 16 bp, Homo sapiens
caaggcaaggcaggtg

SEQ ID NO: 3201246 - DNA, 16 bp, Homo sapiens
caaggcactgtactag

SEQ ID NO: 3201247 - DNA, 22 bp, Homo sapiens
caaactgtgaagcatttacaga

SEQ ID NO: 3201248 - DNA, 14 bp, Homo sapiens
caaacttactattt

SEQ ID NO: 3201249 - DNA, 17 bp, Homo sapiens
caaacttcactctgggc

SEQ ID NO: 3201250 - DNA, 22 bp, Homo sapiens
caaacttcattttttaaaaaat

SEQ ID NO: 3201251 - DNA, 21 bp, Homo sapiens
caaactttaggtttttttaat

SEQ ID NO: 3201252 - DNA, 23 bp, Homo sapiens
caaacttttattagccagtgaaa

SEQ ID NO: 3201253 - DNA, 21 bp, Homo sapiens
caaagaaaaaaaaaaaagcca

SEQ ID NO: 3201254 - DNA, 16 bp, Homo sapiens
caaagaaacaaagatg

SEQ ID NO: 3201255 - DNA, 17 bp, Homo sapiens
caaagaaacaaagatgt

SEQ ID NO: 3201256 - DNA, 20 bp, Homo sapiens
caaagaaacaagctgtgcag

SEQ ID NO: 3201257 - DNA, 18 bp, Homo sapiens
caaagaaacttgaagctt

SEQ ID NO: 3201258 - DNA, 14 bp, Homo sapiens
caaagaaatgaaca

SEQ ID NO: 3201259 - DNA, 21 bp, Homo sapiens
caaagaaggcatttgcagggt

SEQ ID NO: 3201260 - DNA, 15 bp, Homo sapiens
caaagaattacagta

SEQ ID NO: 3201261 - DNA, 13 bp, Homo sapiens
caaagacatcagt

SEQ ID NO: 3201262 - DNA, 15 bp, Homo sapiens
caaagactcctctgg

SEQ ID NO: 3201263 - DNA, 19 bp, Homo sapiens
caaagactcctctgggcct

SEQ ID NO: 3201264 - DNA, 16 bp, Homo sapiens
caaagacttagtatat

SEQ ID NO: 3201265 - DNA, 15 bp, Homo sapiens
caaagagaaaactta

SEQ ID NO: 3201266 - DNA, 16 bp, Homo sapiens
caaagagagaaaataa

SEQ ID NO: 3201267 - DNA, 19 bp, Homo sapiens
caaagagagaaaataaaga

SEQ ID NO: 3201268 - DNA, 20 bp, Homo sapiens
caaagagcacaaacattttt

SEQ ID NO: 3201269 - DNA, 14 bp, Homo sapiens
caaagagccttcag

SEQ ID NO: 3201270 - DNA, 23 bp, Homo sapiens
caaagagcgagtcccctgcccgg

SEQ ID NO: 3201271 - DNA, 20 bp, Homo sapiens
caaagaggactcgcttgtaa

SEQ ID NO: 3201272 - DNA, 12 bp, Homo sapiens
caaagaggctgc

SEQ ID NO: 3201273 - DNA, 14 bp, Homo sapiens
caaagagggcttcc

SEQ ID NO: 3201274 - DNA, 21 bp, Homo sapiens
caaagataaggactagatact

SEQ ID NO: 3201275 - DNA, 15 bp, Homo sapiens
caaagatcaaaataa

SEQ ID NO: 3201276 - DNA, 16 bp, Homo sapiens
caaagatcaaaataaa

SEQ ID NO: 3201277 - DNA, 23 bp, Homo sapiens
caaagatgcagccgccttccttg

SEQ ID NO: 3201278 - DNA, 18 bp, Homo sapiens
caaagatgtttgtcagat

SEQ ID NO: 3201279 - DNA, 21 bp, Homo sapiens
caaagattaaatgtgtcattg

SEQ ID NO: 3201280 - DNA, 14 bp, Homo sapiens
caaagattgagaag

SEQ ID NO: 3201281 - DNA, 16 bp, Homo sapiens
caaagattgagaagcc

SEQ ID NO: 3201282 - DNA, 14 bp, Homo sapiens
caaagattttctaa

SEQ ID NO: 3201283 - DNA, 22 bp, Homo sapiens
caaagattttctaaggaatgca

SEQ ID NO: 3201284 - DNA, 18 bp, Homo sapiens
caaagcaagggctccagc

SEQ ID NO: 3201285 - DNA, 20 bp, Homo sapiens
caaagcaatgtgagtcccag

SEQ ID NO: 3201286 - DNA, 15 bp, Homo sapiens
caaagcacagtgtta

SEQ ID NO: 3201287 - DNA, 16 bp, Homo sapiens
caaagcacagtttgaa

SEQ ID NO: 3201288 - DNA, 18 bp, Homo sapiens
caacaatactacctcact

SEQ ID NO: 3201289 - DNA, 19 bp, Homo sapiens
caacaatggggtgggccca

SEQ ID NO: 3201290 - DNA, 14 bp, Homo sapiens
caacaattggtaaa

SEQ ID NO: 3201291 - DNA, 19 bp, Homo sapiens
caacaattggtaaaactca

SEQ ID NO: 3201292 - DNA, 16 bp, Homo sapiens
caacaatttatgaatt

SEQ ID NO: 3201293 - DNA, 18 bp, Homo sapiens
caacacaatgttattcgt

SEQ ID NO: 3201294 - DNA, 15 bp, Homo sapiens
caacaccacagacac

SEQ ID NO: 3201295 - DNA, 13 bp, Homo sapiens
caacaccagcccc

SEQ ID NO: 3201296 - DNA, 17 bp, Homo sapiens
caacaccagcccctgcc

SEQ ID NO: 3201297 - DNA, 22 bp, Homo sapiens
caacaccagcccctgccccagc

SEQ ID NO: 3201298 - DNA, 13 bp, Homo sapiens
caacaccttcctc

SEQ ID NO: 3201299 - DNA, 15 bp, Homo sapiens
caacaccttcctcct

SEQ ID NO: 3201300 - DNA, 16 bp, Homo sapiens
caacactccaggccct

SEQ ID NO: 3201301 - DNA, 19 bp, Homo sapiens
caacactccaggccctgcc

SEQ ID NO: 3201302 - DNA, 20 bp, Homo sapiens
caacactccaggccctgccc

SEQ ID NO: 3201303 - DNA, 16 bp, Homo sapiens
caacactgtgccctgg

SEQ ID NO: 3201304 - DNA, 21 bp, Homo sapiens
caacactttgagcatttttaa

SEQ ID NO: 3201305 - DNA, 20 bp, Homo sapiens
caacagaaaaacaatcttat

SEQ ID NO: 3201306 - DNA, 22 bp, Homo sapiens
caacagaaacctatcctcactg

SEQ ID NO: 3201307 - DNA, 15 bp, Homo sapiens
caacagaagcatttg

SEQ ID NO: 3201308 - DNA, 17 bp, Homo sapiens
caacagaagcatttgta

SEQ ID NO: 3201309 - DNA, 18 bp, Homo sapiens
caacagaagcatttgtat

SEQ ID NO: 3201310 - DNA, 22 bp, Homo sapiens
caacagaataaagcagcctgat

SEQ ID NO: 3201311 - DNA, 23 bp, Homo sapiens
caacagagtgagaccctgtctct

SEQ ID NO: 3201312 - DNA, 17 bp, Homo sapiens
caacagatcaatttgta

SEQ ID NO: 3201313 - DNA, 15 bp, Homo sapiens
caacagcaaacaggt

SEQ ID NO: 3201314 - DNA, 14 bp, Homo sapiens
caacagcaaaccct

SEQ ID NO: 3201315 - DNA, 22 bp, Homo sapiens
caacagcaagaaataaatcaga

SEQ ID NO: 3201316 - DNA, 20 bp, Homo sapiens
caacagcagtctccttcagc

SEQ ID NO: 3201317 - DNA, 14 bp, Homo sapiens
caacagcccaggca

SEQ ID NO: 3201318 - DNA, 18 bp, Homo sapiens
caacagctcgatccaaat

SEQ ID NO: 3201319 - DNA, 16 bp, Homo sapiens
caacaggacagagttc

SEQ ID NO: 3201320 - DNA, 18 bp, Homo sapiens
caacaggacagagttcac

SEQ ID NO: 3201321 - DNA, 22 bp, Homo sapiens
caacaggagtcagtctctttct

SEQ ID NO: 3201322 - DNA, 17 bp, Homo sapiens
caacaggctgggcttca

SEQ ID NO: 3201323 - DNA, 20 bp, Homo sapiens
caacaggctgggcttcagtg

SEQ ID NO: 3201324 - DNA, 21 bp, Homo sapiens
caacaggctgttctgcactga

SEQ ID NO: 3201325 - DNA, 24 bp, Homo sapiens
caacaggctgttctgcactgaaaa

SEQ ID NO: 3201326 - DNA, 16 bp, Homo sapiens
caacaggggaggaaaa

SEQ ID NO: 3201327 - DNA, 22 bp, Homo sapiens
caacaggggaggaaaaaagaac

SEQ ID NO: 3201328 - DNA, 16 bp, Homo sapiens
caacaggtcacttgat

SEQ ID NO: 3201329 - DNA, 14 bp, Homo sapiens
caacagtcaaaaca

SEQ ID NO: 3201330 - DNA, 18 bp, Homo sapiens
caacataacccacttgtc

SEQ ID NO: 3201331 - DNA, 23 bp, Homo sapiens
caacatagtgagacccctgtctc

SEQ ID NO: 3201332 - DNA, 21 bp, Homo sapiens
caacatagtgagaccttgtct

SEQ ID NO: 3201333 - DNA, 18 bp, Homo sapiens
caacatcaatgttcattg

SEQ ID NO: 3201334 - DNA, 23 bp, Homo sapiens
caacatccatgtcctatgtgtga

SEQ ID NO: 3201335 - DNA, 16 bp, Homo sapiens
caacatcctgccagcc

SEQ ID NO: 3201336 - DNA, 23 bp, Homo sapiens
caacatgcctgccccaaacaaat

SEQ ID NO: 3201337 - DNA, 23 bp, Homo sapiens
caacatgttgggaaacttggctc

SEQ ID NO: 3201338 - DNA, 13 bp, Homo sapiens
caacatgtttctg

SEQ ID NO: 3201339 - DNA, 14 bp, Homo sapiens
caaccaagtgtgct

SEQ ID NO: 3201340 - DNA, 17 bp, Homo sapiens
caaccactaaagtatag

SEQ ID NO: 3201341 - DNA, 14 bp, Homo sapiens
caaccactgtaaaa

SEQ ID NO: 3201342 - DNA, 19 bp, Homo sapiens
caaccactgtaaaatgaaa

SEQ ID NO: 3201343 - DNA, 11 bp, Homo sapiens
caaccagacag

SEQ ID NO: 3201344 - DNA, 14 bp, Homo sapiens
caaccagacagcac

SEQ ID NO: 3201345 - DNA, 16 bp, Homo sapiens
caaccagacagcacag

SEQ ID NO: 3201346 - DNA, 14 bp, Homo sapiens
caaccatccctgcc

SEQ ID NO: 3201347 - DNA, 14 bp, Homo sapiens
caaccattccccat

SEQ ID NO: 3201348 - DNA, 17 bp, Homo sapiens
caacccaataggagtct

SEQ ID NO: 3201349 - DNA, 13 bp, Homo sapiens
caacccacctctg

SEQ ID NO: 3201350 - DNA, 22 bp, Homo sapiens
caacccacctctggccctgtgt

SEQ ID NO: 3201351 - DNA, 23 bp, Homo sapiens
caaccccagccgctcggaggccc

SEQ ID NO: 3201352 - DNA, 17 bp, Homo sapiens
caaccccagttctgctc

SEQ ID NO: 3201353 - DNA, 19 bp, Homo sapiens
caaccccagttctgctcct

SEQ ID NO: 3201354 - DNA, 13 bp, Homo sapiens
caacccccacccc

SEQ ID NO: 3201355 - DNA, 14 bp, Homo sapiens
caacccccagcctg

SEQ ID NO: 3201356 - DNA, 16 bp, Homo sapiens
caaccccccacctgcc

SEQ ID NO: 3201357 - DNA, 19 bp, Homo sapiens
caacccccctcctgctcct

SEQ ID NO: 3201358 - DNA, 21 bp, Homo sapiens
caaccccgcggtgctctggcg

SEQ ID NO: 3201359 - DNA, 14 bp, Homo sapiens
caaccccttcgctc

SEQ ID NO: 3201360 - DNA, 14 bp, Homo sapiens
caaccctattcatt

SEQ ID NO: 3201361 - DNA, 21 bp, Homo sapiens
caaccctcagagccaccccta

SEQ ID NO: 3201362 - DNA, 18 bp, Homo sapiens
caaccctcaggggaaaac

SEQ ID NO: 3201363 - DNA, 12 bp, Homo sapiens
caaccctctcct

SEQ ID NO: 3201364 - DNA, 15 bp, Homo sapiens
caaccctctcctgtc

SEQ ID NO: 3201365 - DNA, 21 bp, Homo sapiens
caaccctctcctgtctgccct

SEQ ID NO: 3201366 - DNA, 20 bp, Homo sapiens
caaccctggggaaggagcca

SEQ ID NO: 3201367 - DNA, 21 bp, Homo sapiens
caaccgcttccctatttattt

SEQ ID NO: 3201368 - DNA, 22 bp, Homo sapiens
caacctatcatttattctgctt

SEQ ID NO: 3201369 - DNA, 13 bp, Homo sapiens
caacctcagaggc

SEQ ID NO: 3201370 - DNA, 19 bp, Homo sapiens
caacctcagaggcagcttc

SEQ ID NO: 3201371 - DNA, 20 bp, Homo sapiens
caacctcagaggcagcttca

SEQ ID NO: 3201372 - DNA, 17 bp, Homo sapiens
caacctcagggctccca

SEQ ID NO: 3201373 - DNA, 18 bp, Homo sapiens
caacctcagggctcccag

SEQ ID NO: 3201374 - DNA, 20 bp, Homo sapiens
caacctcagggctcccaggg

SEQ ID NO: 3201375 - DNA, 13 bp, Homo sapiens
caacctccctctt

SEQ ID NO: 3201376 - DNA, 16 bp, Homo sapiens
caacctccctcttgtt

SEQ ID NO: 3201377 - DNA, 15 bp, Homo sapiens
caacctcctgggcta

SEQ ID NO: 3201378 - DNA, 24 bp, Homo sapiens
caacctcggcttgtgggctggtgc

SEQ ID NO: 3201379 - DNA, 13 bp, Homo sapiens
caacctctcactc

SEQ ID NO: 3201380 - DNA, 14 bp, Homo sapiens
caacctctcactcc

SEQ ID NO: 3201381 - DNA, 16 bp, Homo sapiens
caacctctctgatctt

SEQ ID NO: 3201382 - DNA, 17 bp, Homo sapiens
caacctcttctggctca

SEQ ID NO: 3201383 - DNA, 18 bp, Homo sapiens
caacctcttctggctcaa

SEQ ID NO: 3201384 - DNA, 15 bp, Homo sapiens
caacctgaaatttat

SEQ ID NO: 3201385 - DNA, 16 bp, Homo sapiens
caacctgaaatttatt

SEQ ID NO: 3201386 - DNA, 23 bp, Homo sapiens
caacctgcccaaagattgatttg

SEQ ID NO: 3201387 - DNA, 13 bp, Homo sapiens
caacctgggtcca

SEQ ID NO: 3201388 - DNA, 16 bp, Homo sapiens
caacctgggtccaaat

SEQ ID NO: 3201389 - DNA, 17 bp, Homo sapiens
caacctggtggcaccag

SEQ ID NO: 3201390 - DNA, 15 bp, Homo sapiens
caaccttcaaagaaa

SEQ ID NO: 3201391 - DNA, 21 bp, Homo sapiens
caaccttcaaagaaacttgaa

SEQ ID NO: 3201392 - DNA, 18 bp, Homo sapiens
caaccttcggctccgggc

SEQ ID NO: 3201393 - DNA, 20 bp, Homo sapiens
caaccttctgtggctcacag

SEQ ID NO: 3201394 - DNA, 21 bp, Homo sapiens
caaccttgtttattaaattgc

SEQ ID NO: 3201395 - DNA, 19 bp, Homo sapiens
caacctttaaaattgtcac

SEQ ID NO: 3201396 - DNA, 21 bp, Homo sapiens
caacctttcacctttgtgtat

SEQ ID NO: 3201397 - DNA, 16 bp, Homo sapiens
caacctttttccctct

SEQ ID NO: 3201398 - DNA, 15 bp, Homo sapiens
caacgaatttacagt

SEQ ID NO: 3201399 - DNA, 19 bp, Homo sapiens
caacgaccagggccgagga

SEQ ID NO: 3201400 - DNA, 14 bp, Homo sapiens
caacgcacaggaaa

SEQ ID NO: 3201401 - DNA, 12 bp, Homo sapiens
caacgcagccct

SEQ ID NO: 3201402 - DNA, 13 bp, Homo sapiens
caacgcagccctg

SEQ ID NO: 3201403 - DNA, 12 bp, Homo sapiens
caacgcccctgt

SEQ ID NO: 3201404 - DNA, 14 bp, Homo sapiens
caacgcccctgtgg

SEQ ID NO: 3201405 - DNA, 17 bp, Homo sapiens
caacgcccctgtggcca

SEQ ID NO: 3201406 - DNA, 14 bp, Homo sapiens
caacggcaagacag

SEQ ID NO: 3201407 - DNA, 18 bp, Homo sapiens
caacggccctgcagccag

SEQ ID NO: 3201408 - DNA, 19 bp, Homo sapiens
caacggccctgcagccagc

SEQ ID NO: 3201409 - DNA, 15 bp, Homo sapiens
caacgggaaaggaaa

SEQ ID NO: 3201410 - DNA, 21 bp, Homo sapiens
caacgggaccccctggccctg

SEQ ID NO: 3201411 - DNA, 23 bp, Homo sapiens
caacgtgagagaaagagagaagc

SEQ ID NO: 3201412 - DNA, 18 bp, Homo sapiens
caacgttactcagggctc

SEQ ID NO: 3201413 - DNA, 21 bp, Homo sapiens
caacgttcgatttctacctca

SEQ ID NO: 3201414 - DNA, 15 bp, Homo sapiens
caactaaaattagga

SEQ ID NO: 3201415 - DNA, 15 bp, Homo sapiens
caactactaatagaa

SEQ ID NO: 3201416 - DNA, 21 bp, Homo sapiens
caactagacattctgtcgcct

SEQ ID NO: 3201417 - DNA, 16 bp, Homo sapiens
attttcagtcttgtag

SEQ ID NO: 3201418 - DNA, 18 bp, Homo sapiens
attttcagtgcatcatta

SEQ ID NO: 3201419 - DNA, 14 bp, Homo sapiens
attttcatcactgg

SEQ ID NO: 3201420 - DNA, 17 bp, Homo sapiens
attttcatgaaaatacc

SEQ ID NO: 3201421 - DNA, 21 bp, Homo sapiens
attttcatgaaaataccattt

SEQ ID NO: 3201422 - DNA, 19 bp, Homo sapiens
attttcatgcacagtagat

SEQ ID NO: 3201423 - DNA, 13 bp, Homo sapiens
attttcatgtgtg

SEQ ID NO: 3201424 - DNA, 15 bp, Homo sapiens
attttcattaaactt

SEQ ID NO: 3201425 - DNA, 13 bp, Homo sapiens
attttcatttgta

SEQ ID NO: 3201426 - DNA, 14 bp, Homo sapiens
attttcatttgtac

SEQ ID NO: 3201427 - DNA, 20 bp, Homo sapiens
attttcccatcatcctttgt

SEQ ID NO: 3201428 - DNA, 23 bp, Homo sapiens
attttcccatcatcctttgttct

SEQ ID NO: 3201429 - DNA, 15 bp, Homo sapiens
attttccccccactc

SEQ ID NO: 3201430 - DNA, 13 bp, Homo sapiens
attttcctcaatc

SEQ ID NO: 3201431 - DNA, 13 bp, Homo sapiens
attttcctggatt

SEQ ID NO: 3201432 - DNA, 18 bp, Homo sapiens
attttcctggtgccaatt

SEQ ID NO: 3201433 - DNA, 22 bp, Homo sapiens
attttccttcagaatatcttaa

SEQ ID NO: 3201434 - DNA, 13 bp, Homo sapiens
attttcctttaga

SEQ ID NO: 3201435 - DNA, 16 bp, Homo sapiens
attttcgttcattact

SEQ ID NO: 3201436 - DNA, 15 bp, Homo sapiens
attttctaaaagctt

SEQ ID NO: 3201437 - DNA, 21 bp, Homo sapiens
attttctaaaagctttcatgt

SEQ ID NO: 3201438 - DNA, 16 bp, Homo sapiens
attttctaaggaatgc

SEQ ID NO: 3201439 - DNA, 19 bp, Homo sapiens
attttctaaggaatgcaca

SEQ ID NO: 3201440 - DNA, 21 bp, Homo sapiens
attttctaaggaatgcacaaa

SEQ ID NO: 3201441 - DNA, 14 bp, Homo sapiens
attttctacagtgg

SEQ ID NO: 3201442 - DNA, 20 bp, Homo sapiens
attttctcaaaagcatttat

SEQ ID NO: 3201443 - DNA, 16 bp, Homo sapiens
attttctctgtacttt

SEQ ID NO: 3201444 - DNA, 18 bp, Homo sapiens
attttctctgtgtttgtt

SEQ ID NO: 3201445 - DNA, 16 bp, Homo sapiens
attttctgacatgcat

SEQ ID NO: 3201446 - DNA, 23 bp, Homo sapiens
attttctggggctcctcacatag

SEQ ID NO: 3201447 - DNA, 17 bp, Homo sapiens
attttctggtagataga

SEQ ID NO: 3201448 - DNA, 20 bp, Homo sapiens
attttctggtagatagaaat

SEQ ID NO: 3201449 - DNA, 17 bp, Homo sapiens
attttctggttctaaca

SEQ ID NO: 3201450 - DNA, 20 bp, Homo sapiens
attttctgtcagatgagaac

SEQ ID NO: 3201451 - DNA, 16 bp, Homo sapiens
attttctgtgcctgaa

SEQ ID NO: 3201452 - DNA, 21 bp, Homo sapiens
attttcttacccaatttccca

SEQ ID NO: 3201453 - DNA, 19 bp, Homo sapiens
attttcttattgcgctgct

SEQ ID NO: 3201454 - DNA, 14 bp, Homo sapiens
attttcttcatgca

SEQ ID NO: 3201455 - DNA, 21 bp, Homo sapiens
attttcttccaagcaaaggtg

SEQ ID NO: 3201456 - DNA, 12 bp, Homo sapiens
attttctttaat

SEQ ID NO: 3201457 - DNA, 19 bp, Homo sapiens
attttctttaatgctttta

SEQ ID NO: 3201458 - DNA, 18 bp, Homo sapiens
attttctttatcattgct

SEQ ID NO: 3201459 - DNA, 23 bp, Homo sapiens
attttctttgtgtagctttgctc

SEQ ID NO: 3201460 - DNA, 15 bp, Homo sapiens
attttctttgtttct

SEQ ID NO: 3201461 - DNA, 13 bp, Homo sapiens
attttcttttctt

SEQ ID NO: 3201462 - DNA, 20 bp, Homo sapiens
attttcttttctttcaactt

SEQ ID NO: 3201463 - DNA, 14 bp, Homo sapiens
attttgaagaatat

SEQ ID NO: 3201464 - DNA, 16 bp, Homo sapiens
attttgaagaatattt

SEQ ID NO: 3201465 - DNA, 22 bp, Homo sapiens
attttgaagaatatttaagaaa

SEQ ID NO: 3201466 - DNA, 23 bp, Homo sapiens
attttgaagaatatttaagaaaa

SEQ ID NO: 3201467 - DNA, 13 bp, Homo sapiens
attttgaagtgct

SEQ ID NO: 3201468 - DNA, 19 bp, Homo sapiens
attttgaagtgctgtttat

SEQ ID NO: 3201469 - DNA, 20 bp, Homo sapiens
attttgaataaataaatgta

SEQ ID NO: 3201470 - DNA, 19 bp, Homo sapiens
attttgacttagtaacttt

SEQ ID NO: 3201471 - DNA, 12 bp, Homo sapiens
attttgcagcag

SEQ ID NO: 3201472 - DNA, 14 bp, Homo sapiens
attttgcagcagtg

SEQ ID NO: 3201473 - DNA, 18 bp, Homo sapiens
attttgcatatatgttct

SEQ ID NO: 3201474 - DNA, 16 bp, Homo sapiens
atttttttgagacaga

SEQ ID NO: 3201475 - DNA, 22 bp, Homo sapiens
atttttttgcatgcatgcaaat

SEQ ID NO: 3201476 - DNA, 16 bp, Homo sapiens
attttttttatattta

SEQ ID NO: 3201477 - DNA, 20 bp, Homo sapiens
attttttttatcatgtcgta

SEQ ID NO: 3201478 - DNA, 14 bp, Homo sapiens
attttttttcaaaa

SEQ ID NO: 3201479 - DNA, 15 bp, Homo sapiens
attttttttggcctg

SEQ ID NO: 3201480 - DNA, 21 bp, Homo sapiens
attttttttgttttttgtaac

SEQ ID NO: 3201481 - DNA, 15 bp, Homo sapiens
atttttttttcaatc

SEQ ID NO: 3201482 - DNA, 21 bp, Homo sapiens
atttttttttcatacacttat

SEQ ID NO: 3201483 - DNA, 13 bp, Homo sapiens
atttttttttcca

SEQ ID NO: 3201484 - DNA, 14 bp, Homo sapiens
atttttttttctaa

SEQ ID NO: 3201485 - DNA, 18 bp, Homo sapiens
atttttttttctaagaga

SEQ ID NO: 3201486 - DNA, 19 bp, Homo sapiens
atttttttttctaagagaa

SEQ ID NO: 3201487 - DNA, 22 bp, Homo sapiens
attttttttttaaataaaagca

SEQ ID NO: 3201488 - DNA, 17 bp, Homo sapiens
attttttttttcctctt

SEQ ID NO: 3201489 - DNA, 14 bp, Homo sapiens
caaaaaaaaaagaa

SEQ ID NO: 3201490 - DNA, 18 bp, Homo sapiens
caaaaaaaaaccatgcat

SEQ ID NO: 3201491 - DNA, 17 bp, Homo sapiens
caaaaaaaaagttttat

SEQ ID NO: 3201492 - DNA, 20 bp, Homo sapiens
caaaaaaaaagttttatttt

SEQ ID NO: 3201493 - DNA, 17 bp, Homo sapiens
caaaaaaaccacaaagg

SEQ ID NO: 3201494 - DNA, 19 bp, Homo sapiens
caaaaaaagcctccaaggg

SEQ ID NO: 3201495 - DNA, 13 bp, Homo sapiens
caaaaaaaggaaa

SEQ ID NO: 3201496 - DNA, 20 bp, Homo sapiens
caaaaaaatttaaaattacg

SEQ ID NO: 3201497 - DNA, 13 bp, Homo sapiens
caaaaaaggaaaa

SEQ ID NO: 3201498 - DNA, 12 bp, Homo sapiens
caaaaaatgagc

SEQ ID NO: 3201499 - DNA, 14 bp, Homo sapiens
caaaaaattaaaac

SEQ ID NO: 3201500 - DNA, 16 bp, Homo sapiens
caaaaaattagccaag

SEQ ID NO: 3201501 - DNA, 17 bp, Homo sapiens
caaaaacaaaaaagcaa

SEQ ID NO: 3201502 - DNA, 16 bp, Homo sapiens
caaaaactacacatat

SEQ ID NO: 3201503 - DNA, 16 bp, Homo sapiens
caaaaagaaatgacta

SEQ ID NO: 3201504 - DNA, 18 bp, Homo sapiens
caaaaagaatctgcattt

SEQ ID NO: 3201505 - DNA, 22 bp, Homo sapiens
caaaaagctcttacactacatt

SEQ ID NO: 3201506 - DNA, 17 bp, Homo sapiens
caaaaaggtataaataa

SEQ ID NO: 3201507 - DNA, 19 bp, Homo sapiens
caaaaataaaaaatctgaa

SEQ ID NO: 3201508 - DNA, 12 bp, Homo sapiens
caaaaataatgt

SEQ ID NO: 3201509 - DNA, 13 bp, Homo sapiens
caaaaatacaaaa

SEQ ID NO: 3201510 - DNA, 17 bp, Homo sapiens
caaaaatatcccttccg

SEQ ID NO: 3201511 - DNA, 17 bp, Homo sapiens
caaaaattagccgggca

SEQ ID NO: 3201512 - DNA, 12 bp, Homo sapiens
caaaaattatta

SEQ ID NO: 3201513 - DNA, 18 bp, Homo sapiens
caaaacaaaaattaggta

SEQ ID NO: 3201514 - DNA, 19 bp, Homo sapiens
caaaacactcggcatttca

SEQ ID NO: 3201515 - DNA, 12 bp, Homo sapiens
caaaacactgtg

SEQ ID NO: 3201516 - DNA, 14 bp, Homo sapiens
caaaacactgtgga

SEQ ID NO: 3201517 - DNA, 15 bp, Homo sapiens
caaaacactgtggaa

SEQ ID NO: 3201518 - DNA, 13 bp, Homo sapiens
caaaacattccaa

SEQ ID NO: 3201519 - DNA, 16 bp, Homo sapiens
caaaacattccaagaa

SEQ ID NO: 3201520 - DNA, 13 bp, Homo sapiens
caaaaccatctct

SEQ ID NO: 3201521 - DNA, 23 bp, Homo sapiens
caaaaccatcttctgtgtttatg

SEQ ID NO: 3201522 - DNA, 20 bp, Homo sapiens
caaaacccaggacatctcct

SEQ ID NO: 3201523 - DNA, 16 bp, Homo sapiens
caaaacccttacagtg

SEQ ID NO: 3201524 - DNA, 18 bp, Homo sapiens
caaaacctgatgttaaaa

SEQ ID NO: 3201525 - DNA, 17 bp, Homo sapiens
caaaacctgcagttaac

SEQ ID NO: 3201526 - DNA, 13 bp, Homo sapiens
caaaacctgtgcc

SEQ ID NO: 3201527 - DNA, 19 bp, Homo sapiens
caaaacctgtgccaggctg

SEQ ID NO: 3201528 - DNA, 23 bp, Homo sapiens
caaaaccttgctaattttctcaa

SEQ ID NO: 3201529 - DNA, 15 bp, Homo sapiens
caaaacgatgaagtt

SEQ ID NO: 3201530 - DNA, 17 bp, Homo sapiens
caaaacgggtcagtatt

SEQ ID NO: 3201531 - DNA, 14 bp, Homo sapiens
caaaacgtcttatt

SEQ ID NO: 3201532 - DNA, 15 bp, Homo sapiens
caaaacgtcttattg

SEQ ID NO: 3201533 - DNA, 15 bp, Homo sapiens
caaaactagaattgt

SEQ ID NO: 3201534 - DNA, 15 bp, Homo sapiens
caaaactatttttgt

SEQ ID NO: 3201535 - DNA, 23 bp, Homo sapiens
caaaactatttttgtaaaagaca

SEQ ID NO: 3201536 - DNA, 20 bp, Homo sapiens
caaaactccgcccccagcct

SEQ ID NO: 3201537 - DNA, 17 bp, Homo sapiens
caaaactgcctgaaagc

SEQ ID NO: 3201538 - DNA, 20 bp, Homo sapiens
caaaactgtaaataaaatgt

SEQ ID NO: 3201539 - DNA, 21 bp, Homo sapiens
caaaactgtaaataaaatgtg

SEQ ID NO: 3201540 - DNA, 21 bp, Homo sapiens
caaaactgttcttttgcattt

SEQ ID NO: 3201541 - DNA, 21 bp, Homo sapiens
caaaacttcttgtcagacata

SEQ ID NO: 3201542 - DNA, 20 bp, Homo sapiens
caaaacttggtatttttcag

SEQ ID NO: 3201543 - DNA, 14 bp, Homo sapiens
caaaagaagagttt

SEQ ID NO: 3201544 - DNA, 19 bp, Homo sapiens
caaaagaatcagaaacagg

SEQ ID NO: 3201545 - DNA, 17 bp, Homo sapiens
caaaagagcatggatgc

SEQ ID NO: 3201546 - DNA, 14 bp, Homo sapiens
caaaagagtagaaa

SEQ ID NO: 3201547 - DNA, 20 bp, Homo sapiens
caaaagatgctcttctgtgg

SEQ ID NO: 3201548 - DNA, 21 bp, Homo sapiens
caaaagatgtatccttccaat

SEQ ID NO: 3201549 - DNA, 20 bp, Homo sapiens
caaaagattgctgaaatttt

SEQ ID NO: 3201550 - DNA, 14 bp, Homo sapiens
caaaagcacccttg

SEQ ID NO: 3201551 - DNA, 13 bp, Homo sapiens
caaaagccttgtg

SEQ ID NO: 3201552 - DNA, 19 bp, Homo sapiens
caaaattatagcttttaag

SEQ ID NO: 3201553 - DNA, 18 bp, Homo sapiens
caaaattcatttctaatt

SEQ ID NO: 3201554 - DNA, 15 bp, Homo sapiens
caaaattgatgtgtt

SEQ ID NO: 3201555 - DNA, 22 bp, Homo sapiens
caaaattgatgtgtttatttat

SEQ ID NO: 3201556 - DNA, 16 bp, Homo sapiens
caaaattgcaaatctt

SEQ ID NO: 3201557 - DNA, 18 bp, Homo sapiens
caaaattgcctttttctc

SEQ ID NO: 3201558 - DNA, 20 bp, Homo sapiens
caaaattgcctttttctcta

SEQ ID NO: 3201559 - DNA, 18 bp, Homo sapiens
caaaattgttttcacttg

SEQ ID NO: 3201560 - DNA, 20 bp, Homo sapiens
caaaattgttttcacttgta

SEQ ID NO: 3201561 - DNA, 21 bp, Homo sapiens
caaaattgttttcacttgtat

SEQ ID NO: 3201562 - DNA, 17 bp, Homo sapiens
caaaatttagtttttgt

SEQ ID NO: 3201563 - DNA, 12 bp, Homo sapiens
caaaatttgaaa

SEQ ID NO: 3201564 - DNA, 19 bp, Homo sapiens
caaaatttgatgccaggac

SEQ ID NO: 3201565 - DNA, 13 bp, Homo sapiens
caaaatttgtttg

SEQ ID NO: 3201566 - DNA, 14 bp, Homo sapiens
caaaattttaaaaa

SEQ ID NO: 3201567 - DNA, 20 bp, Homo sapiens
caaaattttagtccaaataa

SEQ ID NO: 3201568 - DNA, 23 bp, Homo sapiens
caaaattttatagctcagtttat

SEQ ID NO: 3201569 - DNA, 19 bp, Homo sapiens
caaaattttattttgtgct

SEQ ID NO: 3201570 - DNA, 17 bp, Homo sapiens
caaaattttctcatttt

SEQ ID NO: 3201571 - DNA, 14 bp, Homo sapiens
caaacaaaacttaa

SEQ ID NO: 3201572 - DNA, 15 bp, Homo sapiens
caaacaaatatgcaa

SEQ ID NO: 3201573 - DNA, 17 bp, Homo sapiens
caaacaaatatgcaaaa

SEQ ID NO: 3201574 - DNA, 18 bp, Homo sapiens
caaacaacagaaagtcat

SEQ ID NO: 3201575 - DNA, 16 bp, Homo sapiens
caaacaaccatttttt

SEQ ID NO: 3201576 - DNA, 17 bp, Homo sapiens
caaacaagaatgtccct

SEQ ID NO: 3201577 - DNA, 21 bp, Homo sapiens
caaacaaggggctgttacata

SEQ ID NO: 3201578 - DNA, 22 bp, Homo sapiens
caaacaagtggatgtttttaat

SEQ ID NO: 3201579 - DNA, 20 bp, Homo sapiens
caaacaatcccaatctttct

SEQ ID NO: 3201580 - DNA, 19 bp, Homo sapiens
caaacacaatggagtgtgt

SEQ ID NO: 3201581 - DNA, 14 bp, Homo sapiens
caaacaccttccag

SEQ ID NO: 3201582 - DNA, 21 bp, Homo sapiens
caaacaccttccagctcctgt

SEQ ID NO: 3201583 - DNA, 18 bp, Homo sapiens
caaacactccaccctcca

SEQ ID NO: 3201584 - DNA, 20 bp, Homo sapiens
caaacagccaactagcccct

SEQ ID NO: 3201585 - DNA, 19 bp, Homo sapiens
caaacatcaaataaatttc

SEQ ID NO: 3201586 - DNA, 17 bp, Homo sapiens
caaacatcactctgctg

SEQ ID NO: 3201587 - DNA, 15 bp, Homo sapiens
caaacatgcagtact

SEQ ID NO: 3201588 - DNA, 17 bp, Homo sapiens
caaacatgcagtacttt

SEQ ID NO: 3201589 - DNA, 22 bp, Homo sapiens
caaacatgcagtacttttgttg

SEQ ID NO: 3201590 - DNA, 22 bp, Homo sapiens
caaacatggatacttcctgggt

SEQ ID NO: 3201591 - DNA, 13 bp, Homo sapiens
caaacatgtattt

SEQ ID NO: 3201592 - DNA, 21 bp, Homo sapiens
caaacattcgtgagctgggga

SEQ ID NO: 3201593 - DNA, 18 bp, Homo sapiens
caaacattgtgttgacat

SEQ ID NO: 3201594 - DNA, 15 bp, Homo sapiens
caaaccaaataaaaa

SEQ ID NO: 3201595 - DNA, 17 bp, Homo sapiens
caaaccaaattttaatt

SEQ ID NO: 3201596 - DNA, 22 bp, Homo sapiens
caaaccaagtcggaacagcaga

SEQ ID NO: 3201597 - DNA, 17 bp, Homo sapiens
caaaccaatttcttcct

SEQ ID NO: 3201598 - DNA, 21 bp, Homo sapiens
caaaccacaactgacacagga

SEQ ID NO: 3201599 - DNA, 17 bp, Homo sapiens
caaaccagtatcgctca

SEQ ID NO: 3201600 - DNA, 20 bp, Homo sapiens
caaaccattataccttactt

SEQ ID NO: 3201601 - DNA, 23 bp, Homo sapiens
caaacccacgattttctccagct

SEQ ID NO: 3201602 - DNA, 17 bp, Homo sapiens
caaacccagaaagattt

SEQ ID NO: 3201603 - DNA, 20 bp, Homo sapiens
caaacccagacaaccaaaac

SEQ ID NO: 3201604 - DNA, 18 bp, Homo sapiens
caaaccccctttgtgctg

SEQ ID NO: 3201605 - DNA, 18 bp, Homo sapiens
caaaccccgaccacctgc

SEQ ID NO: 3201606 - DNA, 21 bp, Homo sapiens
caaaccccgaccacctgccca

SEQ ID NO: 3201607 - DNA, 22 bp, Homo sapiens
caaaccctggtggtattttatt

SEQ ID NO: 3201608 - DNA, 16 bp, Homo sapiens
caaacctcactgagag

SEQ ID NO: 3201609 - DNA, 15 bp, Homo sapiens
caaacctgggacccc

SEQ ID NO: 3201610 - DNA, 13 bp, Homo sapiens
caaaccttcctgg

SEQ ID NO: 3201611 - DNA, 14 bp, Homo sapiens
caaaccttcctggg

SEQ ID NO: 3201612 - DNA, 16 bp, Homo sapiens
caaaccttcctgggag

SEQ ID NO: 3201613 - DNA, 20 bp, Homo sapiens
caaacgccctttcctcctca

SEQ ID NO: 3201614 - DNA, 14 bp, Homo sapiens
caaacgcctcccct

SEQ ID NO: 3201615 - DNA, 20 bp, Homo sapiens
caaactaaaaatattcctcc

SEQ ID NO: 3201616 - DNA, 22 bp, Homo sapiens
caaactacagacctgctttttg

SEQ ID NO: 3201617 - DNA, 22 bp, Homo sapiens
caaactacgcgatagtctctgt

SEQ ID NO: 3201618 - DNA, 23 bp, Homo sapiens
caaactcataacagtcttactgc

SEQ ID NO: 3201619 - DNA, 18 bp, Homo sapiens
caaactcattgcagcaga

SEQ ID NO: 3201620 - DNA, 20 bp, Homo sapiens
caaactcttgacctcaggtg

SEQ ID NO: 3201621 - DNA, 17 bp, Homo sapiens
caaactgaagcagcctc

SEQ ID NO: 3201622 - DNA, 22 bp, Homo sapiens
caaactgaggaatttcacctgt

SEQ ID NO: 3201623 - DNA, 19 bp, Homo sapiens
caaactgatggaccgggtg

SEQ ID NO: 3201624 - DNA, 11 bp, Homo sapiens
caaactgcaat

SEQ ID NO: 3201625 - DNA, 13 bp, Homo sapiens
caaactgcaatag

SEQ ID NO: 3201626 - DNA, 19 bp, Homo sapiens
caaactgcaatagagactg

SEQ ID NO: 3201627 - DNA, 21 bp, Homo sapiens
caaactgcacacacagctcct

SEQ ID NO: 3201628 - DNA, 12 bp, Homo sapiens
caaactgcagct

SEQ ID NO: 3201629 - DNA, 16 bp, Homo sapiens
caaactggagtctgga

SEQ ID NO: 3201630 - DNA, 20 bp, Homo sapiens
caaactggagtctggagtgg

SEQ ID NO: 3201631 - DNA, 12 bp, Homo sapiens
caaactgtaaat

SEQ ID NO: 3201632 - DNA, 21 bp, Homo sapiens
caaactgtaaataaaaagaaa

SEQ ID NO: 3201633 - DNA, 14 bp, Homo sapiens
caaactgtgaagca

SEQ ID NO: 3201634 - DNA, 17 bp, Homo sapiens
attggtgctatttgaag

SEQ ID NO: 3201635 - DNA, 21 bp, Homo sapiens
attggtgctatttgaagaaaa

SEQ ID NO: 3201636 - DNA, 21 bp, Homo sapiens
attggtggcagattttacaaa

SEQ ID NO: 3201637 - DNA, 17 bp, Homo sapiens
attggtggttctcagca

SEQ ID NO: 3201638 - DNA, 15 bp, Homo sapiens
attggtttaaagaaa

SEQ ID NO: 3201639 - DNA, 17 bp, Homo sapiens
attggtttaaagaaagt

SEQ ID NO: 3201640 - DNA, 17 bp, Homo sapiens
attggtttgcacaagtt

SEQ ID NO: 3201641 - DNA, 20 bp, Homo sapiens
attggtttgcacaagttccc

SEQ ID NO: 3201642 - DNA, 15 bp, Homo sapiens
attggttttcctgtg

SEQ ID NO: 3201643 - DNA, 20 bp, Homo sapiens
attgtaaaaaaaaatgcctt

SEQ ID NO: 3201644 - DNA, 23 bp, Homo sapiens
attgtaaaaaaaaatgcctttga

SEQ ID NO: 3201645 - DNA, 22 bp, Homo sapiens
attgtaaaaaaggttttctata

SEQ ID NO: 3201646 - DNA, 14 bp, Homo sapiens
attgtaaaaataat

SEQ ID NO: 3201647 - DNA, 15 bp, Homo sapiens
attgtaaaatagctt

SEQ ID NO: 3201648 - DNA, 22 bp, Homo sapiens
attgtaaaatagcttgtatagt

SEQ ID NO: 3201649 - DNA, 20 bp, Homo sapiens
attgtaaaattatttcatga

SEQ ID NO: 3201650 - DNA, 14 bp, Homo sapiens
attgtaaacaaact

SEQ ID NO: 3201651 - DNA, 15 bp, Homo sapiens
attgtaaacatgtgt

SEQ ID NO: 3201652 - DNA, 16 bp, Homo sapiens
attgtaaacatgtgtt

SEQ ID NO: 3201653 - DNA, 14 bp, Homo sapiens
attgtaaactgtac

SEQ ID NO: 3201654 - DNA, 20 bp, Homo sapiens
attgtaaatatttactcttt

SEQ ID NO: 3201655 - DNA, 16 bp, Homo sapiens
attgtaaattgaatca

SEQ ID NO: 3201656 - DNA, 15 bp, Homo sapiens
attgtaaattttaga

SEQ ID NO: 3201657 - DNA, 18 bp, Homo sapiens
attgtaacctgcattttt

SEQ ID NO: 3201658 - DNA, 15 bp, Homo sapiens
attgtaactattaac

SEQ ID NO: 3201659 - DNA, 17 bp, Homo sapiens
attgtaatgttactgat

SEQ ID NO: 3201660 - DNA, 15 bp, Homo sapiens
attgtacaaaattaa

SEQ ID NO: 3201661 - DNA, 13 bp, Homo sapiens
attgtacaaatgt

SEQ ID NO: 3201662 - DNA, 14 bp, Homo sapiens
attgtacaaatgta

SEQ ID NO: 3201663 - DNA, 20 bp, Homo sapiens
attgtacaaatgtaagcaaa

SEQ ID NO: 3201664 - DNA, 19 bp, Homo sapiens
attgtacctctcttataga

SEQ ID NO: 3201665 - DNA, 22 bp, Homo sapiens
attgtactcaatggatttgatg

SEQ ID NO: 3201666 - DNA, 14 bp, Homo sapiens
attgtacttagcca

SEQ ID NO: 3201667 - DNA, 19 bp, Homo sapiens
attgtagaaacacagtttt

SEQ ID NO: 3201668 - DNA, 17 bp, Homo sapiens
attgtagaattgtatat

SEQ ID NO: 3201669 - DNA, 15 bp, Homo sapiens
attgtagcatttctt

SEQ ID NO: 3201670 - DNA, 15 bp, Homo sapiens
attgtaggtgcaaga

SEQ ID NO: 3201671 - DNA, 17 bp, Homo sapiens
attgtataaactatcag

SEQ ID NO: 3201672 - DNA, 17 bp, Homo sapiens
attgtataagtcaagca

SEQ ID NO: 3201673 - DNA, 18 bp, Homo sapiens
attgtataagtcaagcac

SEQ ID NO: 3201674 - DNA, 19 bp, Homo sapiens
attgtataagtcaagcaca

SEQ ID NO: 3201675 - DNA, 20 bp, Homo sapiens
attgtataagtcaagcacat

SEQ ID NO: 3201676 - DNA, 17 bp, Homo sapiens
attgtatcagaggccta

SEQ ID NO: 3201677 - DNA, 14 bp, Homo sapiens
attgtatctagtgc

SEQ ID NO: 3201678 - DNA, 18 bp, Homo sapiens
attgtatctagtgcagct

SEQ ID NO: 3201679 - DNA, 22 bp, Homo sapiens
attgtatgaaaatccttttaac

SEQ ID NO: 3201680 - DNA, 15 bp, Homo sapiens
attgtatgatgtgtt

SEQ ID NO: 3201681 - DNA, 17 bp, Homo sapiens
attgtattatttggagt

SEQ ID NO: 3201682 - DNA, 19 bp, Homo sapiens
attgtcacctctgttaagg

SEQ ID NO: 3201683 - DNA, 14 bp, Homo sapiens
attgtcagatattt

SEQ ID NO: 3201684 - DNA, 13 bp, Homo sapiens
attgtcagctact

SEQ ID NO: 3201685 - DNA, 13 bp, Homo sapiens
attgtccttcaga

SEQ ID NO: 3201686 - DNA, 16 bp, Homo sapiens
attgtccttcagagct

SEQ ID NO: 3201687 - DNA, 18 bp, Homo sapiens
attgtccttcagagctct

SEQ ID NO: 3201688 - DNA, 14 bp, Homo sapiens
attgtcgtttttat

SEQ ID NO: 3201689 - DNA, 12 bp, Homo sapiens
attgtctattta

SEQ ID NO: 3201690 - DNA, 15 bp, Homo sapiens
attgtctcagggccg

SEQ ID NO: 3201691 - DNA, 22 bp, Homo sapiens
attgtctcctatatatttctat

SEQ ID NO: 3201692 - DNA, 17 bp, Homo sapiens
attgtcttgcaacttca

SEQ ID NO: 3201693 - DNA, 20 bp, Homo sapiens
attgtcttgcaacttcagtt

SEQ ID NO: 3201694 - DNA, 14 bp, Homo sapiens
attgtcttgttctg

SEQ ID NO: 3201695 - DNA, 19 bp, Homo sapiens
attgtctttaaaaactgtt

SEQ ID NO: 3201696 - DNA, 20 bp, Homo sapiens
attgtctttaaaaactgttt

SEQ ID NO: 3201697 - DNA, 13 bp, Homo sapiens
attgtctttatga

SEQ ID NO: 3201698 - DNA, 14 bp, Homo sapiens
attgtctttgctgt

SEQ ID NO: 3201699 - DNA, 15 bp, Homo sapiens
attgtcttttagaca

SEQ ID NO: 3201700 - DNA, 22 bp, Homo sapiens
attgtcttttagacaactagat

SEQ ID NO: 3201701 - DNA, 14 bp, Homo sapiens
attgtgaactcatt

SEQ ID NO: 3201702 - DNA, 17 bp, Homo sapiens
attgtgaactcattgct

SEQ ID NO: 3201703 - DNA, 15 bp, Homo sapiens
attgtgaagtacata

SEQ ID NO: 3201704 - DNA, 16 bp, Homo sapiens
attgtgagccaccacg

SEQ ID NO: 3201705 - DNA, 23 bp, Homo sapiens
attgtgatcagaccataatgtta

SEQ ID NO: 3201706 - DNA, 16 bp, Homo sapiens
attgtgcataatgctt

SEQ ID NO: 3201707 - DNA, 17 bp, Homo sapiens
attgtgcataatgcttt

SEQ ID NO: 3201708 - DNA, 23 bp, Homo sapiens
attgtgcataatgctttggaaaa

SEQ ID NO: 3201709 - DNA, 17 bp, Homo sapiens
attgtgccaatatgtat

SEQ ID NO: 3201710 - DNA, 15 bp, Homo sapiens
attgtgcttcacagt

SEQ ID NO: 3201711 - DNA, 24 bp, Homo sapiens
attgtgcttcacagtagagccagc

SEQ ID NO: 3201712 - DNA, 17 bp, Homo sapiens
attgtgcttctccccag

SEQ ID NO: 3201713 - DNA, 20 bp, Homo sapiens
attgtgcttctccccagaat

SEQ ID NO: 3201714 - DNA, 11 bp, Homo sapiens
attgtggaaaa

SEQ ID NO: 3201715 - DNA, 15 bp, Homo sapiens
attgtggaaaaccag

SEQ ID NO: 3201716 - DNA, 16 bp, Homo sapiens
attgtggaaaaccagg

SEQ ID NO: 3201717 - DNA, 16 bp, Homo sapiens
attgtggatgtgttca

SEQ ID NO: 3201718 - DNA, 17 bp, Homo sapiens
attgtggatgtgttcat

SEQ ID NO: 3201719 - DNA, 21 bp, Homo sapiens
attgtggattataaaaaatgt

SEQ ID NO: 3201720 - DNA, 12 bp, Homo sapiens
attgtggctcct

SEQ ID NO: 3201721 - DNA, 20 bp, Homo sapiens
attgtggctcctatctgtgt

SEQ ID NO: 3201722 - DNA, 20 bp, Homo sapiens
attgtgggccatgaaccaaa

SEQ ID NO: 3201723 - DNA, 20 bp, Homo sapiens
atttaagtggggcaaaacct

SEQ ID NO: 3201724 - DNA, 16 bp, Homo sapiens
atttaataaaaaaaca

SEQ ID NO: 3201725 - DNA, 11 bp, Homo sapiens
atttaataaag

SEQ ID NO: 3201726 - DNA, 13 bp, Homo sapiens
atttaataaagat

SEQ ID NO: 3201727 - DNA, 16 bp, Homo sapiens
atttaataaagatgag

SEQ ID NO: 3201728 - DNA, 12 bp, Homo sapiens
atttaataacat

SEQ ID NO: 3201729 - DNA, 13 bp, Homo sapiens
atttaatacagca

SEQ ID NO: 3201730 - DNA, 14 bp, Homo sapiens
atttaatatattga

SEQ ID NO: 3201731 - DNA, 20 bp, Homo sapiens
atttaatatctggcactgtt

SEQ ID NO: 3201732 - DNA, 23 bp, Homo sapiens
atttaatatctggcactgttaat

SEQ ID NO: 3201733 - DNA, 23 bp, Homo sapiens
atttaatccagttataagaagaa

SEQ ID NO: 3201734 - DNA, 16 bp, Homo sapiens
atttaatccattttta

SEQ ID NO: 3201735 - DNA, 19 bp, Homo sapiens
atttaatcttttcttattt

SEQ ID NO: 3201736 - DNA, 15 bp, Homo sapiens
atttaatgaaagact

SEQ ID NO: 3201737 - DNA, 16 bp, Homo sapiens
atttaatgaaagactg

SEQ ID NO: 3201738 - DNA, 20 bp, Homo sapiens
atttaatgaaagactgtaca

SEQ ID NO: 3201739 - DNA, 17 bp, Homo sapiens
atttaatgcattaaacc

SEQ ID NO: 3201740 - DNA, 18 bp, Homo sapiens
atttaatgcattaaacct

SEQ ID NO: 3201741 - DNA, 19 bp, Homo sapiens
atttaatgcattaaacctg

SEQ ID NO: 3201742 - DNA, 15 bp, Homo sapiens
atttaatggcagcta

SEQ ID NO: 3201743 - DNA, 19 bp, Homo sapiens
atttaatggccaaatggtt

SEQ ID NO: 3201744 - DNA, 15 bp, Homo sapiens
atttaattaaatgta

SEQ ID NO: 3201745 - DNA, 18 bp, Homo sapiens
atttaattcttcaccttt

SEQ ID NO: 3201746 - DNA, 23 bp, Homo sapiens
atttaattctttctattttcaca

SEQ ID NO: 3201747 - DNA, 24 bp, Homo sapiens
atttaattctttctattttcacaa

SEQ ID NO: 3201748 - DNA, 15 bp, Homo sapiens
atttaattgtaaact

SEQ ID NO: 3201749 - DNA, 22 bp, Homo sapiens
atttaattttcctggaaagact

SEQ ID NO: 3201750 - DNA, 20 bp, Homo sapiens
atttacaccacactttcaaa

SEQ ID NO: 3201751 - DNA, 22 bp, Homo sapiens
atttacagtctagtacttatta

SEQ ID NO: 3201752 - DNA, 17 bp, Homo sapiens
atttacagtctctttct

SEQ ID NO: 3201753 - DNA, 21 bp, Homo sapiens
atttacagtgaaaatgtaagc

SEQ ID NO: 3201754 - DNA, 14 bp, Homo sapiens
atttacatttatct

SEQ ID NO: 3201755 - DNA, 18 bp, Homo sapiens
atttaccagggatgtaga

SEQ ID NO: 3201756 - DNA, 19 bp, Homo sapiens
atttaccagggatgtagat

SEQ ID NO: 3201757 - DNA, 19 bp, Homo sapiens
atttacccagaatgtcaga

SEQ ID NO: 3201758 - DNA, 15 bp, Homo sapiens
atttaccctttatag

SEQ ID NO: 3201759 - DNA, 16 bp, Homo sapiens
atttaccctttataga

SEQ ID NO: 3201760 - DNA, 17 bp, Homo sapiens
atttaccctttatagaa

SEQ ID NO: 3201761 - DNA, 14 bp, Homo sapiens
atttacctaagatt

SEQ ID NO: 3201762 - DNA, 21 bp, Homo sapiens
atttacctgcaggctgagcca

SEQ ID NO: 3201763 - DNA, 15 bp, Homo sapiens
atttaccttttaaga

SEQ ID NO: 3201764 - DNA, 22 bp, Homo sapiens
atttaccttttaagacattttc

SEQ ID NO: 3201765 - DNA, 15 bp, Homo sapiens
atttacgctttgatt

SEQ ID NO: 3201766 - DNA, 17 bp, Homo sapiens
atttacgctttgattca

SEQ ID NO: 3201767 - DNA, 15 bp, Homo sapiens
atttacgtaaaaaga

SEQ ID NO: 3201768 - DNA, 14 bp, Homo sapiens
atttactaaacata

SEQ ID NO: 3201769 - DNA, 21 bp, Homo sapiens
atttactaagccacaagaaat

SEQ ID NO: 3201770 - DNA, 15 bp, Homo sapiens
atttactctttgcaa

SEQ ID NO: 3201771 - DNA, 14 bp, Homo sapiens
atttacttcttata

SEQ ID NO: 3201772 - DNA, 16 bp, Homo sapiens
atttacttgttttgga

SEQ ID NO: 3201773 - DNA, 13 bp, Homo sapiens
atttagaaaaaag

SEQ ID NO: 3201774 - DNA, 16 bp, Homo sapiens
atttagaaactgattt

SEQ ID NO: 3201775 - DNA, 23 bp, Homo sapiens
atttagaaactgatttcttcaga

SEQ ID NO: 3201776 - DNA, 15 bp, Homo sapiens
atttagaagaaagat

SEQ ID NO: 3201777 - DNA, 13 bp, Homo sapiens
atttagaagccaa

SEQ ID NO: 3201778 - DNA, 19 bp, Homo sapiens
atttagaatggttgagtta

SEQ ID NO: 3201779 - DNA, 20 bp, Homo sapiens
atttagaatggttgagttac

SEQ ID NO: 3201780 - DNA, 23 bp, Homo sapiens
atttagacaacctgaaatttatt

SEQ ID NO: 3201781 - DNA, 17 bp, Homo sapiens
atttagataatttgaaa

SEQ ID NO: 3201782 - DNA, 18 bp, Homo sapiens
atttagcgtagctaagtg

SEQ ID NO: 3201783 - DNA, 23 bp, Homo sapiens
atttagctaaacggattccaaag

SEQ ID NO: 3201784 - DNA, 21 bp, Homo sapiens
atttaggagtgtgtgacattc

SEQ ID NO: 3201785 - DNA, 19 bp, Homo sapiens
atttagggtactaaattta

SEQ ID NO: 3201786 - DNA, 14 bp, Homo sapiens
atttagtaagaata

SEQ ID NO: 3201787 - DNA, 15 bp, Homo sapiens
atttagtaagaatac

SEQ ID NO: 3201788 - DNA, 14 bp, Homo sapiens
atttagtcatgtga

SEQ ID NO: 3201789 - DNA, 16 bp, Homo sapiens
atttagtcatgtgacc

SEQ ID NO: 3201790 - DNA, 12 bp, Homo sapiens
atttagtcctgt

SEQ ID NO: 3201791 - DNA, 14 bp, Homo sapiens
atttagtcctgtac

SEQ ID NO: 3201792 - DNA, 15 bp, Homo sapiens
atttagtgaactacg

SEQ ID NO: 3201793 - DNA, 15 bp, Homo sapiens
atttagtgtatccat

SEQ ID NO: 3201794 - DNA, 14 bp, Homo sapiens
atttagttatagtt

SEQ ID NO: 3201795 - DNA, 16 bp, Homo sapiens
atttagttctttgtta

SEQ ID NO: 3201796 - DNA, 17 bp, Homo sapiens
atttagttgtttctaga

SEQ ID NO: 3201797 - DNA, 23 bp, Homo sapiens
atttagtttcagtagattgcaga

SEQ ID NO: 3201798 - DNA, 14 bp, Homo sapiens
atttagtttttaac

SEQ ID NO: 3201799 - DNA, 16 bp, Homo sapiens
atttagtttttgttct

SEQ ID NO: 3201800 - DNA, 21 bp, Homo sapiens
atttataaaacttctcaagat

SEQ ID NO: 3201801 - DNA, 21 bp, Homo sapiens
atttataaaattagaaagcaa

SEQ ID NO: 3201802 - DNA, 15 bp, Homo sapiens
atttataaacagaca

SEQ ID NO: 3201803 - DNA, 23 bp, Homo sapiens
atttataaacagacaatatgtga

SEQ ID NO: 3201804 - DNA, 22 bp, Homo sapiens
atttataaatatatttaagata

SEQ ID NO: 3201805 - DNA, 14 bp, Homo sapiens
atttataacaaata

SEQ ID NO: 3201806 - DNA, 19 bp, Homo sapiens
atttataactcatcataaa

SEQ ID NO: 3201807 - DNA, 21 bp, Homo sapiens
atttataactcatcataaaat

SEQ ID NO: 3201808 - DNA, 23 bp, Homo sapiens
atttataactcatcataaaataa

SEQ ID NO: 3201809 - DNA, 22 bp, Homo sapiens
atttataagcagatttaacaat

SEQ ID NO: 3201810 - DNA, 18 bp, Homo sapiens
atttataatacagaatct

SEQ ID NO: 3201811 - DNA, 20 bp, Homo sapiens
atttataatgttagtagaaa

SEQ ID NO: 3201812 - DNA, 18 bp, Homo sapiens
atttatacaaattagaaa

SEQ ID NO: 3201813 - DNA, 22 bp, Homo sapiens
atttatacaagattgaaaatct

SEQ ID NO: 3201814 - DNA, 14 bp, Homo sapiens
atttatactttgca

SEQ ID NO: 3201815 - DNA, 19 bp, Homo sapiens
atttatagcaagatattga

SEQ ID NO: 3201816 - DNA, 21 bp, Homo sapiens
atttatagcaagatattgatc

SEQ ID NO: 3201817 - DNA, 14 bp, Homo sapiens
atttataggccagg

SEQ ID NO: 3201818 - DNA, 22 bp, Homo sapiens
atttatagtttgtacatgcatt

SEQ ID NO: 3201819 - DNA, 18 bp, Homo sapiens
atttatataaatgtaaaa

SEQ ID NO: 3201820 - DNA, 15 bp, Homo sapiens
atttatatatgtatt

SEQ ID NO: 3201821 - DNA, 15 bp, Homo sapiens
atttatatatttata

SEQ ID NO: 3201822 - DNA, 18 bp, Homo sapiens
atttatatatttataact

SEQ ID NO: 3201823 - DNA, 13 bp, Homo sapiens
atttatatatttg

SEQ ID NO: 3201824 - DNA, 19 bp, Homo sapiens
atttatatggggaatatat

SEQ ID NO: 3201825 - DNA, 20 bp, Homo sapiens
atttatatggggaatatatt

SEQ ID NO: 3201826 - DNA, 21 bp, Homo sapiens
atttatcaaaccctagccttg

SEQ ID NO: 3201827 - DNA, 16 bp, Homo sapiens
atttatcacacttctg

SEQ ID NO: 3201828 - DNA, 18 bp, Homo sapiens
atttatcctcacataaaa

SEQ ID NO: 3201829 - DNA, 18 bp, Homo sapiens
atttatcctgaaatttca

SEQ ID NO: 3201830 - DNA, 19 bp, Homo sapiens
atttatcctgaaatttcag

SEQ ID NO: 3201831 - DNA, 15 bp, Homo sapiens
atttatctaaattaa

SEQ ID NO: 3201832 - DNA, 20 bp, Homo sapiens
atttatctaaattaaagcct

SEQ ID NO: 3201833 - DNA, 20 bp, Homo sapiens
atttatctgggattatggtt

SEQ ID NO: 3201834 - DNA, 15 bp, Homo sapiens
atttatctttataca

SEQ ID NO: 3201835 - DNA, 15 bp, Homo sapiens
atttatgagtttttg

SEQ ID NO: 3201836 - DNA, 13 bp, Homo sapiens
atttatgatttaa

SEQ ID NO: 3201837 - DNA, 14 bp, Homo sapiens
atttatgcactgtg

SEQ ID NO: 3201838 - DNA, 15 bp, Homo sapiens
atttatgcatttcat

SEQ ID NO: 3201839 - DNA, 18 bp, Homo sapiens
atttatgcatttcattca

SEQ ID NO: 3201840 - DNA, 23 bp, Homo sapiens
atttatgcatttcattcaaatca

SEQ ID NO: 3201841 - DNA, 20 bp, Homo sapiens
atttatgcctctgtatttaa

SEQ ID NO: 3201842 - DNA, 23 bp, Homo sapiens
atttatgctataaattttttgaa

SEQ ID NO: 3201843 - DNA, 18 bp, Homo sapiens
atttatgtaatgaagtaa

SEQ ID NO: 3201844 - DNA, 12 bp, Homo sapiens
atttatgtagat

SEQ ID NO: 3201845 - DNA, 14 bp, Homo sapiens
atttatgtagatgt

SEQ ID NO: 3201846 - DNA, 18 bp, Homo sapiens
atttatgtagatgtgcat

SEQ ID NO: 3201847 - DNA, 12 bp, Homo sapiens
atttatgtgtat

SEQ ID NO: 3201848 - DNA, 15 bp, Homo sapiens
atttatgtgtatatg

SEQ ID NO: 3201849 - DNA, 22 bp, Homo sapiens
atttatgtttgcacttgtgatt

SEQ ID NO: 3201850 - DNA, 15 bp, Homo sapiens
atttattaaaaatgt

SEQ ID NO: 3201851 - DNA, 20 bp, Homo sapiens
atttattaaaaatgttctca

SEQ ID NO: 3201852 - DNA, 23 bp, Homo sapiens
atttattaaacagatttttacaa

SEQ ID NO: 3201853 - DNA, 16 bp, Homo sapiens
atttattaaataaaat

SEQ ID NO: 3201854 - DNA, 15 bp, Homo sapiens
atttattaagtctgg

SEQ ID NO: 3201855 - DNA, 23 bp, Homo sapiens
atttattaatatttaacattatt

SEQ ID NO: 3201856 - DNA, 11 bp, Homo sapiens
atttattaatt

SEQ ID NO: 3201857 - DNA, 16 bp, Homo sapiens
atttattaatttgaaa

SEQ ID NO: 3201858 - DNA, 18 bp, Homo sapiens
atttattaatttgaaacc

SEQ ID NO: 3201859 - DNA, 19 bp, Homo sapiens
atttattaatttgaaacca

SEQ ID NO: 3201860 - DNA, 12 bp, Homo sapiens
atttattacata

SEQ ID NO: 3201861 - DNA, 15 bp, Homo sapiens
atttattacctctga

SEQ ID NO: 3201862 - DNA, 15 bp, Homo sapiens
atttattagccaact

SEQ ID NO: 3201863 - DNA, 12 bp, Homo sapiens
atttattattga

SEQ ID NO: 3201864 - DNA, 17 bp, Homo sapiens
atttattattgaaattg

SEQ ID NO: 3201865 - DNA, 14 bp, Homo sapiens
atttattatttacc

SEQ ID NO: 3201866 - DNA, 14 bp, Homo sapiens
atttattatttgaa

SEQ ID NO: 3201867 - DNA, 21 bp, Homo sapiens
atttattattttcacctgttt

SEQ ID NO: 3201868 - DNA, 12 bp, Homo sapiens
atttattcaagt

SEQ ID NO: 3201869 - DNA, 18 bp, Homo sapiens
atttattcaattcctctg

SEQ ID NO: 3201870 - DNA, 21 bp, Homo sapiens
atttattcacatatatcaaag

SEQ ID NO: 3201871 - DNA, 18 bp, Homo sapiens
atttattcagcttcattt

SEQ ID NO: 3201872 - DNA, 14 bp, Homo sapiens
atttattgactttg

SEQ ID NO: 3201873 - DNA, 17 bp, Homo sapiens
atttattgactttgaca

SEQ ID NO: 3201874 - DNA, 20 bp, Homo sapiens
atttattgggatgtgagccc

SEQ ID NO: 3201875 - DNA, 23 bp, Homo sapiens
atttattgggatgtgagccccag

SEQ ID NO: 3201876 - DNA, 14 bp, Homo sapiens
atttattgtctgtc

SEQ ID NO: 3201877 - DNA, 19 bp, Homo sapiens
atttattgtttatgtaaat

SEQ ID NO: 3201878 - DNA, 19 bp, Homo sapiens
atttattgtttatttatca

SEQ ID NO: 3201879 - DNA, 21 bp, Homo sapiens
atttattgtttatttatcagt

SEQ ID NO: 3201880 - DNA, 14 bp, Homo sapiens
atttatttaaagca

SEQ ID NO: 3201881 - DNA, 12 bp, Homo sapiens
atttatttaaat

SEQ ID NO: 3201882 - DNA, 14 bp, Homo sapiens
atttatttaaattt

SEQ ID NO: 3201883 - DNA, 13 bp, Homo sapiens
atttatttacaga

SEQ ID NO: 3201884 - DNA, 23 bp, Homo sapiens
atttatttacagatgaatgtatt

SEQ ID NO: 3201885 - DNA, 13 bp, Homo sapiens
atttatttatgaa

SEQ ID NO: 3201886 - DNA, 14 bp, Homo sapiens
atttatttatttaa

SEQ ID NO: 3201887 - DNA, 16 bp, Homo sapiens
atttatttcatccagt

SEQ ID NO: 3201888 - DNA, 22 bp, Homo sapiens
atttatttctagttctttcctc

SEQ ID NO: 3201889 - DNA, 13 bp, Homo sapiens
atttatttgtttc

SEQ ID NO: 3201890 - DNA, 15 bp, Homo sapiens
atttattttaatgta

SEQ ID NO: 3201891 - DNA, 18 bp, Homo sapiens
atttattttattctatgt

SEQ ID NO: 3201892 - DNA, 21 bp, Homo sapiens
atttattttattctatgtatg

SEQ ID NO: 3201893 - DNA, 14 bp, Homo sapiens
atttattttcagta

SEQ ID NO: 3201894 - DNA, 19 bp, Homo sapiens
atttattttcctaaagaga

SEQ ID NO: 3201895 - DNA, 16 bp, Homo sapiens
atttatttttcagttc

SEQ ID NO: 3201896 - DNA, 23 bp, Homo sapiens
atttatttttcagttccaagaaa

SEQ ID NO: 3201897 - DNA, 22 bp, Homo sapiens
attgacgacaagtgctgaacag

SEQ ID NO: 3201898 - DNA, 19 bp, Homo sapiens
attgactaactcaaataca

SEQ ID NO: 3201899 - DNA, 12 bp, Homo sapiens
attgactcttgc

SEQ ID NO: 3201900 - DNA, 21 bp, Homo sapiens
attgactggtttacaggccct

SEQ ID NO: 3201901 - DNA, 14 bp, Homo sapiens
attgacttcaatga

SEQ ID NO: 3201902 - DNA, 18 bp, Homo sapiens
attgacttcaatgatagt

SEQ ID NO: 3201903 - DNA, 15 bp, Homo sapiens
attgacttcatttta

SEQ ID NO: 3201904 - DNA, 13 bp, Homo sapiens
attgactttatgt

SEQ ID NO: 3201905 - DNA, 15 bp, Homo sapiens
attgacttttataaa

SEQ ID NO: 3201906 - DNA, 18 bp, Homo sapiens
attgacttttataaagca

SEQ ID NO: 3201907 - DNA, 13 bp, Homo sapiens
attgagaaatgtg

SEQ ID NO: 3201908 - DNA, 18 bp, Homo sapiens
attgagaacctggcctgt

SEQ ID NO: 3201909 - DNA, 11 bp, Homo sapiens
attgagaagcc

SEQ ID NO: 3201910 - DNA, 20 bp, Homo sapiens
attgagagttttgtcttgaa

SEQ ID NO: 3201911 - DNA, 19 bp, Homo sapiens
attgagattagagggaggt

SEQ ID NO: 3201912 - DNA, 17 bp, Homo sapiens
attgagctagcgatttc

SEQ ID NO: 3201913 - DNA, 12 bp, Homo sapiens
attgaggaagag

SEQ ID NO: 3201914 - DNA, 17 bp, Homo sapiens
attgaggggattaatat

SEQ ID NO: 3201915 - DNA, 22 bp, Homo sapiens
attgaggggattaatatgaaaa

SEQ ID NO: 3201916 - DNA, 15 bp, Homo sapiens
attgaggggccctgg

SEQ ID NO: 3201917 - DNA, 19 bp, Homo sapiens
attgaggggccctggccag

SEQ ID NO: 3201918 - DNA, 14 bp, Homo sapiens
attgagtaagaaca

SEQ ID NO: 3201919 - DNA, 19 bp, Homo sapiens
attgagtaatggtgtagaa

SEQ ID NO: 3201920 - DNA, 20 bp, Homo sapiens
attgagtaatggtgtagaac

SEQ ID NO: 3201921 - DNA, 21 bp, Homo sapiens
attgagtattgtttaaaatgt

SEQ ID NO: 3201922 - DNA, 20 bp, Homo sapiens
attgagtgagcacctcccca

SEQ ID NO: 3201923 - DNA, 20 bp, Homo sapiens
attgagtttgtaggtaaaat

SEQ ID NO: 3201924 - DNA, 17 bp, Homo sapiens
attgataatcttcaggt

SEQ ID NO: 3201925 - DNA, 18 bp, Homo sapiens
attgataatgctttcaca

SEQ ID NO: 3201926 - DNA, 17 bp, Homo sapiens
attgatatgcttataca

SEQ ID NO: 3201927 - DNA, 15 bp, Homo sapiens
attgatcaaattcat

SEQ ID NO: 3201928 - DNA, 17 bp, Homo sapiens
attgatcaaattcattt

SEQ ID NO: 3201929 - DNA, 19 bp, Homo sapiens
attgatcattttcccccca

SEQ ID NO: 3201930 - DNA, 23 bp, Homo sapiens
attgatcggagcctcctctctca

SEQ ID NO: 3201931 - DNA, 17 bp, Homo sapiens
attgatctttttatcat

SEQ ID NO: 3201932 - DNA, 18 bp, Homo sapiens
attgatctttttatcatg

SEQ ID NO: 3201933 - DNA, 14 bp, Homo sapiens
attgatgaaatcat

SEQ ID NO: 3201934 - DNA, 21 bp, Homo sapiens
attgatgataacacttaaaat

SEQ ID NO: 3201935 - DNA, 16 bp, Homo sapiens
attgatggatgtcttc

SEQ ID NO: 3201936 - DNA, 22 bp, Homo sapiens
attgatgggagaaatgaggaaa

SEQ ID NO: 3201937 - DNA, 12 bp, Homo sapiens
attgatgtatat

SEQ ID NO: 3201938 - DNA, 23 bp, Homo sapiens
attgattctgaaatttttttcct

SEQ ID NO: 3201939 - DNA, 19 bp, Homo sapiens
attgattgggaaaacattt

SEQ ID NO: 3201940 - DNA, 20 bp, Homo sapiens
attgattgggaaaacatttg

SEQ ID NO: 3201941 - DNA, 14 bp, Homo sapiens
attgatttgattgg

SEQ ID NO: 3201942 - DNA, 16 bp, Homo sapiens
attgatttttctcttc

SEQ ID NO: 3201943 - DNA, 15 bp, Homo sapiens
attgcaaaatagcat

SEQ ID NO: 3201944 - DNA, 19 bp, Homo sapiens
attgcaaatcttgaaatta

SEQ ID NO: 3201945 - DNA, 15 bp, Homo sapiens
attgcaacaggctgg

SEQ ID NO: 3201946 - DNA, 16 bp, Homo sapiens
attgcaacaggctggg

SEQ ID NO: 3201947 - DNA, 14 bp, Homo sapiens
attgcaataaagta

SEQ ID NO: 3201948 - DNA, 15 bp, Homo sapiens
attgcaataaagtat

SEQ ID NO: 3201949 - DNA, 16 bp, Homo sapiens
attgcaatgaaggaaa

SEQ ID NO: 3201950 - DNA, 13 bp, Homo sapiens
attgcactctaaa

SEQ ID NO: 3201951 - DNA, 20 bp, Homo sapiens
attgcactctaaaaggttca

SEQ ID NO: 3201952 - DNA, 21 bp, Homo sapiens
attgcactgaagtttttgaaa

SEQ ID NO: 3201953 - DNA, 20 bp, Homo sapiens
attgcactgctgttcctgct

SEQ ID NO: 3201954 - DNA, 20 bp, Homo sapiens
attgcactgcttatatgcca

SEQ ID NO: 3201955 - DNA, 21 bp, Homo sapiens
attgcacttggcctcatgctg

SEQ ID NO: 3201956 - DNA, 23 bp, Homo sapiens
attgcagcagataacttttttga

SEQ ID NO: 3201957 - DNA, 17 bp, Homo sapiens
attgcagtctaaaactt

SEQ ID NO: 3201958 - DNA, 22 bp, Homo sapiens
attgcagtctaaaacttcaaaa

SEQ ID NO: 3201959 - DNA, 15 bp, Homo sapiens
attgcataaagcata

SEQ ID NO: 3201960 - DNA, 15 bp, Homo sapiens
attgcatactttgta

SEQ ID NO: 3201961 - DNA, 21 bp, Homo sapiens
attgcatactttgtattttga

SEQ ID NO: 3201962 - DNA, 15 bp, Homo sapiens
attgcatcactgtat

SEQ ID NO: 3201963 - DNA, 21 bp, Homo sapiens
attgcatctaggtaattttta

SEQ ID NO: 3201964 - DNA, 20 bp, Homo sapiens
attgccagtgtctttctttg

SEQ ID NO: 3201965 - DNA, 21 bp, Homo sapiens
attgccagtgtctttctttgg

SEQ ID NO: 3201966 - DNA, 13 bp, Homo sapiens
attgcccccacct

SEQ ID NO: 3201967 - DNA, 15 bp, Homo sapiens
attgcccccacctct

SEQ ID NO: 3201968 - DNA, 21 bp, Homo sapiens
attgcctcctgttctgcccac

SEQ ID NO: 3201969 - DNA, 18 bp, Homo sapiens
attgcctctgaaaagtgt

SEQ ID NO: 3201970 - DNA, 15 bp, Homo sapiens
attgcggccccagga

SEQ ID NO: 3201971 - DNA, 16 bp, Homo sapiens
attgcggccccaggag

SEQ ID NO: 3201972 - DNA, 19 bp, Homo sapiens
attgctactataatcaaat

SEQ ID NO: 3201973 - DNA, 22 bp, Homo sapiens
attgctactgtcctacccaccc

SEQ ID NO: 3201974 - DNA, 16 bp, Homo sapiens
attgctgaaattttat

SEQ ID NO: 3201975 - DNA, 21 bp, Homo sapiens
attgctgagagaaatatggaa

SEQ ID NO: 3201976 - DNA, 22 bp, Homo sapiens
attgctgagagaaatatggaac

SEQ ID NO: 3201977 - DNA, 23 bp, Homo sapiens
attgctgagcctctgctccccag

SEQ ID NO: 3201978 - DNA, 15 bp, Homo sapiens
attgctgctgctacc

SEQ ID NO: 3201979 - DNA, 21 bp, Homo sapiens
attgctggtagagacccccag

SEQ ID NO: 3201980 - DNA, 21 bp, Homo sapiens
attgctgtaccacatctgctc

SEQ ID NO: 3201981 - DNA, 14 bp, Homo sapiens
attgctgtcctgga

SEQ ID NO: 3201982 - DNA, 22 bp, Homo sapiens
attgctgttgagatggtaacag

SEQ ID NO: 3201983 - DNA, 23 bp, Homo sapiens
attgctgttgagatggtaacaga

SEQ ID NO: 3201984 - DNA, 17 bp, Homo sapiens
attgcttaaaagacatt

SEQ ID NO: 3201985 - DNA, 21 bp, Homo sapiens
attgcttacaagcctaagaat

SEQ ID NO: 3201986 - DNA, 22 bp, Homo sapiens
attgcttacatttttacaataa

SEQ ID NO: 3201987 - DNA, 15 bp, Homo sapiens
attgcttagtaaaat

SEQ ID NO: 3201988 - DNA, 16 bp, Homo sapiens
attgcttagtaaaatt

SEQ ID NO: 3201989 - DNA, 15 bp, Homo sapiens
atttccatatggatt

SEQ ID NO: 3201990 - DNA, 17 bp, Homo sapiens
atttccattatttatat

SEQ ID NO: 3201991 - DNA, 13 bp, Homo sapiens
atttccattgctt

SEQ ID NO: 3201992 - DNA, 14 bp, Homo sapiens
atttccatttctga

SEQ ID NO: 3201993 - DNA, 19 bp, Homo sapiens
atttcccaagtcagacaga

SEQ ID NO: 3201994 - DNA, 24 bp, Homo sapiens
atttcccaagtcagacagatgtca

SEQ ID NO: 3201995 - DNA, 15 bp, Homo sapiens
atttcccatctgcac

SEQ ID NO: 3201996 - DNA, 15 bp, Homo sapiens
atttccccatctgcc

SEQ ID NO: 3201997 - DNA, 15 bp, Homo sapiens
atttccccctcctca

SEQ ID NO: 3201998 - DNA, 22 bp, Homo sapiens
atttccccgatgtcccctgcgg

SEQ ID NO: 3201999 - DNA, 14 bp, Homo sapiens
atttccccttggac

SEQ ID NO: 3202000 - DNA, 23 bp, Homo sapiens
atttcccttcttgcatccttcct

SEQ ID NO: 3202001 - DNA, 23 bp, Homo sapiens
atttccgcacttcagaattccat

SEQ ID NO: 3202002 - DNA, 18 bp, Homo sapiens
atttcctatcacctattt

SEQ ID NO: 3202003 - DNA, 22 bp, Homo sapiens
atttcctcaacgttgctcccca

SEQ ID NO: 3202004 - DNA, 13 bp, Homo sapiens
atttcctcctggc

SEQ ID NO: 3202005 - DNA, 18 bp, Homo sapiens
atttcctctattgatgta

SEQ ID NO: 3202006 - DNA, 13 bp, Homo sapiens
atttcctggccct

SEQ ID NO: 3202007 - DNA, 19 bp, Homo sapiens
atttcctgtacaatcatga

SEQ ID NO: 3202008 - DNA, 22 bp, Homo sapiens
atttcctgtacaatcatgaaca

SEQ ID NO: 3202009 - DNA, 16 bp, Homo sapiens
atttcctgtatgttgt

SEQ ID NO: 3202010 - DNA, 23 bp, Homo sapiens
atttccttgaatgtggcttgaga

SEQ ID NO: 3202011 - DNA, 15 bp, Homo sapiens
atttccttgtgcaaa

SEQ ID NO: 3202012 - DNA, 16 bp, Homo sapiens
atttcctttgcttcaa

SEQ ID NO: 3202013 - DNA, 13 bp, Homo sapiens
atttcgttccctg

SEQ ID NO: 3202014 - DNA, 20 bp, Homo sapiens
atttcgttccctgattattt

SEQ ID NO: 3202015 - DNA, 21 bp, Homo sapiens
atttctaaagataatattact

SEQ ID NO: 3202016 - DNA, 16 bp, Homo sapiens
atttctaagaagttgt

SEQ ID NO: 3202017 - DNA, 17 bp, Homo sapiens
atttctaagaagttgtt

SEQ ID NO: 3202018 - DNA, 23 bp, Homo sapiens
atttctaagaagttgtttgaggc

SEQ ID NO: 3202019 - DNA, 16 bp, Homo sapiens
atttctaagtatttaa

SEQ ID NO: 3202020 - DNA, 22 bp, Homo sapiens
atttctaagtatttaaatgttc

SEQ ID NO: 3202021 - DNA, 18 bp, Homo sapiens
atttctacaactggagtt

SEQ ID NO: 3202022 - DNA, 21 bp, Homo sapiens
atttctacaactggagttttt

SEQ ID NO: 3202023 - DNA, 21 bp, Homo sapiens
atttctactttttgcacctta

SEQ ID NO: 3202024 - DNA, 16 bp, Homo sapiens
atttctagctttttaa

SEQ ID NO: 3202025 - DNA, 21 bp, Homo sapiens
atttctagtccaaaattacaa

SEQ ID NO: 3202026 - DNA, 12 bp, Homo sapiens
atttctatactt

SEQ ID NO: 3202027 - DNA, 18 bp, Homo sapiens
atttctatactttacagg

SEQ ID NO: 3202028 - DNA, 13 bp, Homo sapiens
atttctatggctt

SEQ ID NO: 3202029 - DNA, 19 bp, Homo sapiens
atttctatggctttcaaag

SEQ ID NO: 3202030 - DNA, 13 bp, Homo sapiens
atttctatttatt

SEQ ID NO: 3202031 - DNA, 16 bp, Homo sapiens
atttctccatctttat

SEQ ID NO: 3202032 - DNA, 17 bp, Homo sapiens
atttctcctcccttcct

SEQ ID NO: 3202033 - DNA, 14 bp, Homo sapiens
atttctctccccac

SEQ ID NO: 3202034 - DNA, 20 bp, Homo sapiens
atttctgaaggtagcattct

SEQ ID NO: 3202035 - DNA, 16 bp, Homo sapiens
atttctgaattcaaag

SEQ ID NO: 3202036 - DNA, 17 bp, Homo sapiens
atttctgaattcaaagc

SEQ ID NO: 3202037 - DNA, 20 bp, Homo sapiens
atttctgaattcaaagcttg

SEQ ID NO: 3202038 - DNA, 13 bp, Homo sapiens
atttctgcatatg

SEQ ID NO: 3202039 - DNA, 13 bp, Homo sapiens
atttctgctctgg

SEQ ID NO: 3202040 - DNA, 18 bp, Homo sapiens
atttctgctctggaataa

SEQ ID NO: 3202041 - DNA, 16 bp, Homo sapiens
atttctgctttctttg

SEQ ID NO: 3202042 - DNA, 17 bp, Homo sapiens
atttctgctttctttga

SEQ ID NO: 3202043 - DNA, 15 bp, Homo sapiens
atttctgggatattt

SEQ ID NO: 3202044 - DNA, 22 bp, Homo sapiens
atttgcatattctattgtatta

SEQ ID NO: 3202045 - DNA, 19 bp, Homo sapiens
atttgcatatttattgcat

SEQ ID NO: 3202046 - DNA, 21 bp, Homo sapiens
atttgcatggctccagaaatg

SEQ ID NO: 3202047 - DNA, 16 bp, Homo sapiens
atttgcattgaacaca

SEQ ID NO: 3202048 - DNA, 21 bp, Homo sapiens
atttgcattgaacacaaactg

SEQ ID NO: 3202049 - DNA, 13 bp, Homo sapiens
atttgcattgtgt

SEQ ID NO: 3202050 - DNA, 20 bp, Homo sapiens
atttgccagagccaaatttt

SEQ ID NO: 3202051 - DNA, 13 bp, Homo sapiens
atttgccagcaca

SEQ ID NO: 3202052 - DNA, 24 bp, Homo sapiens
atttgccatgggcttcactgtata

SEQ ID NO: 3202053 - DNA, 21 bp, Homo sapiens
atttgcccatttacacttttg

SEQ ID NO: 3202054 - DNA, 13 bp, Homo sapiens
atttgccttgcag

SEQ ID NO: 3202055 - DNA, 16 bp, Homo sapiens
atttgctactgttgta

SEQ ID NO: 3202056 - DNA, 21 bp, Homo sapiens
atttgctgacaaccattaaag

SEQ ID NO: 3202057 - DNA, 12 bp, Homo sapiens
atttgcttcatt

SEQ ID NO: 3202058 - DNA, 14 bp, Homo sapiens
atttgcttcattgt

SEQ ID NO: 3202059 - DNA, 18 bp, Homo sapiens
atttgcttgtactgggac

SEQ ID NO: 3202060 - DNA, 15 bp, Homo sapiens
atttgctttaattaa

SEQ ID NO: 3202061 - DNA, 23 bp, Homo sapiens
atttgcttttcatgtagaactca

SEQ ID NO: 3202062 - DNA, 18 bp, Homo sapiens
atttgctttttcaccaga

SEQ ID NO: 3202063 - DNA, 21 bp, Homo sapiens
atttggagacacaactatttt

SEQ ID NO: 3202064 - DNA, 20 bp, Homo sapiens
atttggagcacaaaattcaa

SEQ ID NO: 3202065 - DNA, 20 bp, Homo sapiens
atttggagttaggtcctcac

SEQ ID NO: 3202066 - DNA, 15 bp, Homo sapiens
atttggcagtttggt

SEQ ID NO: 3202067 - DNA, 14 bp, Homo sapiens
atttggcttaaata

SEQ ID NO: 3202068 - DNA, 16 bp, Homo sapiens
atttggcttaaatata

SEQ ID NO: 3202069 - DNA, 23 bp, Homo sapiens
atttgggaaggtttgtgttttct

SEQ ID NO: 3202070 - DNA, 13 bp, Homo sapiens
atttgggagctga

SEQ ID NO: 3202071 - DNA, 23 bp, Homo sapiens
atttggggtataggtctcatctc

SEQ ID NO: 3202072 - DNA, 20 bp, Homo sapiens
atttggtaaaaatgctgctc

SEQ ID NO: 3202073 - DNA, 20 bp, Homo sapiens
atttggtccaaaaaaaggaa

SEQ ID NO: 3202074 - DNA, 14 bp, Homo sapiens
atttggtcctttct

SEQ ID NO: 3202075 - DNA, 16 bp, Homo sapiens
atttggtgttcctgga

SEQ ID NO: 3202076 - DNA, 22 bp, Homo sapiens
atttggtgtttgcttgaatgct

SEQ ID NO: 3202077 - DNA, 12 bp, Homo sapiens
atttggtttcta

SEQ ID NO: 3202078 - DNA, 20 bp, Homo sapiens
atttggtttgttaattctta

SEQ ID NO: 3202079 - DNA, 12 bp, Homo sapiens
atttgtaaacca

SEQ ID NO: 3202080 - DNA, 15 bp, Homo sapiens
atttgtaaacttctg

SEQ ID NO: 3202081 - DNA, 17 bp, Homo sapiens
atttgtaaacttctgaa

SEQ ID NO: 3202082 - DNA, 17 bp, Homo sapiens
atttgtaaatctgccac

SEQ ID NO: 3202083 - DNA, 16 bp, Homo sapiens
atttgtaacctcagct

SEQ ID NO: 3202084 - DNA, 17 bp, Homo sapiens
atttgtaacctcagctc

SEQ ID NO: 3202085 - DNA, 19 bp, Homo sapiens
atttgtaacctcagctctg

SEQ ID NO: 3202086 - DNA, 21 bp, Homo sapiens
atttgtaacctcagctctggg

SEQ ID NO: 3202087 - DNA, 18 bp, Homo sapiens
atttgtaagatatttgca

SEQ ID NO: 3202088 - DNA, 14 bp, Homo sapiens
atttgtaagtttca

SEQ ID NO: 3202089 - DNA, 17 bp, Homo sapiens
atttgtaagtttcaggt

SEQ ID NO: 3202090 - DNA, 18 bp, Homo sapiens
atttgtaataaagtatat

SEQ ID NO: 3202091 - DNA, 16 bp, Homo sapiens
atttgtaattaaatta

SEQ ID NO: 3202092 - DNA, 15 bp, Homo sapiens
atttgtaattgctta

SEQ ID NO: 3202093 - DNA, 19 bp, Homo sapiens
atttgtaattgcttacatt

SEQ ID NO: 3202094 - DNA, 23 bp, Homo sapiens
atttgtaattgcttacattttta

SEQ ID NO: 3202095 - DNA, 12 bp, Homo sapiens
atttgtacaagg

SEQ ID NO: 3202096 - DNA, 19 bp, Homo sapiens
atttgtacagaattttgga

SEQ ID NO: 3202097 - DNA, 18 bp, Homo sapiens
atttgtagcataactgta

SEQ ID NO: 3202098 - DNA, 14 bp, Homo sapiens
atttgtaggagaaa

SEQ ID NO: 3202099 - DNA, 16 bp, Homo sapiens
atttgtatatggtatt

SEQ ID NO: 3202100 - DNA, 14 bp, Homo sapiens
atttgtatattgtg

SEQ ID NO: 3202101 - DNA, 18 bp, Homo sapiens
atttgtatgtcaaagctt

SEQ ID NO: 3202102 - DNA, 17 bp, Homo sapiens
atttgtattaataaagc

SEQ ID NO: 3202103 - DNA, 18 bp, Homo sapiens
atttgtattaataaagca

SEQ ID NO: 3202104 - DNA, 16 bp, Homo sapiens
atttgtattttgtgtg

SEQ ID NO: 3202105 - DNA, 13 bp, Homo sapiens
atctttattaatc

SEQ ID NO: 3202106 - DNA, 17 bp, Homo sapiens
atctttattcaaacttt

SEQ ID NO: 3202107 - DNA, 22 bp, Homo sapiens
atctttattttagtcttgatgt

SEQ ID NO: 3202108 - DNA, 15 bp, Homo sapiens
atctttcacctttct

SEQ ID NO: 3202109 - DNA, 21 bp, Homo sapiens
atctttcacttgaaagatttt

SEQ ID NO: 3202110 - DNA, 12 bp, Homo sapiens
atctttcagaaa

SEQ ID NO: 3202111 - DNA, 22 bp, Homo sapiens
atctttcctcaagtatcttcta

SEQ ID NO: 3202112 - DNA, 23 bp, Homo sapiens
atctttcctcaagtatcttctat

SEQ ID NO: 3202113 - DNA, 11 bp, Homo sapiens
atctttcctgt

SEQ ID NO: 3202114 - DNA, 17 bp, Homo sapiens
atctttcgcacagcagt

SEQ ID NO: 3202115 - DNA, 14 bp, Homo sapiens
atctttctttacct

SEQ ID NO: 3202116 - DNA, 20 bp, Homo sapiens
atctttctttacctgagacc

SEQ ID NO: 3202117 - DNA, 20 bp, Homo sapiens
atctttctttccaaaacatt

SEQ ID NO: 3202118 - DNA, 23 bp, Homo sapiens
atctttctttccaaaacatttct

SEQ ID NO: 3202119 - DNA, 21 bp, Homo sapiens
atctttcttttgattcttcct

SEQ ID NO: 3202120 - DNA, 17 bp, Homo sapiens
atctttgactgaaaaaa

SEQ ID NO: 3202121 - DNA, 13 bp, Homo sapiens
atctttgccttgg

SEQ ID NO: 3202122 - DNA, 16 bp, Homo sapiens
atctttgctgtatact

SEQ ID NO: 3202123 - DNA, 15 bp, Homo sapiens
atctttgtaccaaaa

SEQ ID NO: 3202124 - DNA, 21 bp, Homo sapiens
atctttgtaccaaaattttaa

SEQ ID NO: 3202125 - DNA, 14 bp, Homo sapiens
atctttgtgacagg

SEQ ID NO: 3202126 - DNA, 21 bp, Homo sapiens
atctttgtgacaggaaagccc

SEQ ID NO: 3202127 - DNA, 13 bp, Homo sapiens
atcttttattctt

SEQ ID NO: 3202128 - DNA, 14 bp, Homo sapiens
atcttttattcttt

SEQ ID NO: 3202129 - DNA, 12 bp, Homo sapiens
atcttttcataa

SEQ ID NO: 3202130 - DNA, 13 bp, Homo sapiens
atcttttcttatt

SEQ ID NO: 3202131 - DNA, 16 bp, Homo sapiens
atcttttgaagcatag

SEQ ID NO: 3202132 - DNA, 22 bp, Homo sapiens
atcttttgaagggagaagacac

SEQ ID NO: 3202133 - DNA, 17 bp, Homo sapiens
atctttttaaaaatgat

SEQ ID NO: 3202134 - DNA, 21 bp, Homo sapiens
atcttttttggaactaaagca

SEQ ID NO: 3202135 - DNA, 19 bp, Homo sapiens
atgaaaaatttaagcattg

SEQ ID NO: 3202136 - DNA, 11 bp, Homo sapiens
atgaaaacaag

SEQ ID NO: 3202137 - DNA, 19 bp, Homo sapiens
atgaaaacgttttattgtg

SEQ ID NO: 3202138 - DNA, 20 bp, Homo sapiens
atgaaaacgttttattgtgt

SEQ ID NO: 3202139 - DNA, 15 bp, Homo sapiens
atgaaaagatttaag

SEQ ID NO: 3202140 - DNA, 21 bp, Homo sapiens
atgaaaaggttgcctgaaaaa

SEQ ID NO: 3202141 - DNA, 16 bp, Homo sapiens
atgaaaagtatattga

SEQ ID NO: 3202142 - DNA, 12 bp, Homo sapiens
atgaaaagttat

SEQ ID NO: 3202143 - DNA, 16 bp, Homo sapiens
atgaaaataaatagct

SEQ ID NO: 3202144 - DNA, 13 bp, Homo sapiens
atgaaaataactg

SEQ ID NO: 3202145 - DNA, 21 bp, Homo sapiens
atgaaaataactgaaccaaat

SEQ ID NO: 3202146 - DNA, 22 bp, Homo sapiens
atgaaaatacaacttaaataat

SEQ ID NO: 3202147 - DNA, 19 bp, Homo sapiens
atgaaaatgagttgtgaaa

SEQ ID NO: 3202148 - DNA, 19 bp, Homo sapiens
atgaaaatgtcagaaacca

SEQ ID NO: 3202149 - DNA, 11 bp, Homo sapiens
atgaaaattgt

SEQ ID NO: 3202150 - DNA, 13 bp, Homo sapiens
atgaaaatttgag

SEQ ID NO: 3202151 - DNA, 18 bp, Homo sapiens
atgaaacagaaacaaaaa

SEQ ID NO: 3202152 - DNA, 20 bp, Homo sapiens
atgaaactcctgattttgta

SEQ ID NO: 3202153 - DNA, 16 bp, Homo sapiens
atgaaactctacattt

SEQ ID NO: 3202154 - DNA, 12 bp, Homo sapiens
atgaaagcatgt

SEQ ID NO: 3202155 - DNA, 18 bp, Homo sapiens
atgaaagcatgtggcatg

SEQ ID NO: 3202156 - DNA, 21 bp, Homo sapiens
atgaaagctgattactgtcaa

SEQ ID NO: 3202157 - DNA, 16 bp, Homo sapiens
atgaaagctgttcctt

SEQ ID NO: 3202158 - DNA, 18 bp, Homo sapiens
atgaaagctgttccttgg

SEQ ID NO: 3202159 - DNA, 17 bp, Homo sapiens
atgaaagtgactttaaa

SEQ ID NO: 3202160 - DNA, 19 bp, Homo sapiens
atgaaatacacaagtaaac

SEQ ID NO: 3202161 - DNA, 13 bp, Homo sapiens
atgaaatatcaga

SEQ ID NO: 3202162 - DNA, 21 bp, Homo sapiens
atgaaatgccctcctaaatgt

SEQ ID NO: 3202163 - DNA, 13 bp, Homo sapiens
atgaaatgtatgt

SEQ ID NO: 3202164 - DNA, 20 bp, Homo sapiens
atgaaatgtcccctcaaact

SEQ ID NO: 3202165 - DNA, 18 bp, Homo sapiens
atgaaattaccagatata

SEQ ID NO: 3202166 - DNA, 20 bp, Homo sapiens
atgaaattgtctagcagagc

SEQ ID NO: 3202167 - DNA, 22 bp, Homo sapiens
atgaaattgtctagcagagcag

SEQ ID NO: 3202168 - DNA, 12 bp, Homo sapiens
atgaaatttaaa

SEQ ID NO: 3202169 - DNA, 15 bp, Homo sapiens
atgaaatttaaacat

SEQ ID NO: 3202170 - DNA, 16 bp, Homo sapiens
atgaacaaaattattt

SEQ ID NO: 3202171 - DNA, 13 bp, Homo sapiens
atgaacaagtttt

SEQ ID NO: 3202172 - DNA, 21 bp, Homo sapiens
atgaacaagttttaatgtata

SEQ ID NO: 3202173 - DNA, 14 bp, Homo sapiens
atgaacagctctga

SEQ ID NO: 3202174 - DNA, 16 bp, Homo sapiens
atgaacagctctgaga

SEQ ID NO: 3202175 - DNA, 17 bp, Homo sapiens
atgaacatgcagttcat

SEQ ID NO: 3202176 - DNA, 12 bp, Homo sapiens
atgaacattcca

SEQ ID NO: 3202177 - DNA, 13 bp, Homo sapiens
atgaaccacatct

SEQ ID NO: 3202178 - DNA, 22 bp, Homo sapiens
atgaaccacatcttgctctgct

SEQ ID NO: 3202179 - DNA, 22 bp, Homo sapiens
atgaacccaggacgcttctgaa

SEQ ID NO: 3202180 - DNA, 19 bp, Homo sapiens
atgaacctattttcatttg

SEQ ID NO: 3202181 - DNA, 21 bp, Homo sapiens
atgaacctattttcatttgta

SEQ ID NO: 3202182 - DNA, 21 bp, Homo sapiens
atctccagggagcaagacaga

SEQ ID NO: 3202183 - DNA, 23 bp, Homo sapiens
atctccagggagcaagacagaga

SEQ ID NO: 3202184 - DNA, 18 bp, Homo sapiens
atctcccattttggaatt

SEQ ID NO: 3202185 - DNA, 14 bp, Homo sapiens
atctccccactcta

SEQ ID NO: 3202186 - DNA, 13 bp, Homo sapiens
atctccccaggcc

SEQ ID NO: 3202187 - DNA, 14 bp, Homo sapiens
atctccccaggcct

SEQ ID NO: 3202188 - DNA, 17 bp, Homo sapiens
atctccccaggcctcca

SEQ ID NO: 3202189 - DNA, 18 bp, Homo sapiens
atctccccaggcctccag

SEQ ID NO: 3202190 - DNA, 12 bp, Homo sapiens
atctcccttcct

SEQ ID NO: 3202191 - DNA, 18 bp, Homo sapiens
atctcctataatctgtca

SEQ ID NO: 3202192 - DNA, 19 bp, Homo sapiens
atctcctataatctgtcaa

SEQ ID NO: 3202193 - DNA, 13 bp, Homo sapiens
atctcctattttt

SEQ ID NO: 3202194 - DNA, 19 bp, Homo sapiens
atctcctcaagtccccaag

SEQ ID NO: 3202195 - DNA, 17 bp, Homo sapiens
atctcctgacagaaggt

SEQ ID NO: 3202196 - DNA, 17 bp, Homo sapiens
atctcctgacctcgtga

SEQ ID NO: 3202197 - DNA, 12 bp, Homo sapiens
atctcctgctga

SEQ ID NO: 3202198 - DNA, 19 bp, Homo sapiens
atctcctgtgcatgggtga

SEQ ID NO: 3202199 - DNA, 18 bp, Homo sapiens
atctccttactgtgtttc

SEQ ID NO: 3202200 - DNA, 17 bp, Homo sapiens
atctccttttatctggt

SEQ ID NO: 3202201 - DNA, 19 bp, Homo sapiens
atctcggagcatcccggag

SEQ ID NO: 3202202 - DNA, 24 bp, Homo sapiens
atctcggttctgcgccacttcctt

SEQ ID NO: 3202203 - DNA, 15 bp, Homo sapiens
atctcgtgggagagc

SEQ ID NO: 3202204 - DNA, 22 bp, Homo sapiens
atctcgtttttcttcttaagac

SEQ ID NO: 3202205 - DNA, 15 bp, Homo sapiens
atctctagaatttta

SEQ ID NO: 3202206 - DNA, 21 bp, Homo sapiens
atctctagaattttaagtgct

SEQ ID NO: 3202207 - DNA, 13 bp, Homo sapiens
atctctatttaat

SEQ ID NO: 3202208 - DNA, 16 bp, Homo sapiens
atctctatttaatatt

SEQ ID NO: 3202209 - DNA, 15 bp, Homo sapiens
atctctcaaaacttg

SEQ ID NO: 3202210 - DNA, 17 bp, Homo sapiens
atctctcagagccctca

SEQ ID NO: 3202211 - DNA, 13 bp, Homo sapiens
atctctcaggagc

SEQ ID NO: 3202212 - DNA, 21 bp, Homo sapiens
atctctcaggagcacaggcag

SEQ ID NO: 3202213 - DNA, 16 bp, Homo sapiens
atctctcatcctccag

SEQ ID NO: 3202214 - DNA, 19 bp, Homo sapiens
atctctcggttccacgtcc

SEQ ID NO: 3202215 - DNA, 21 bp, Homo sapiens
atctctctactcctacctcag

SEQ ID NO: 3202216 - DNA, 20 bp, Homo sapiens
atctctctctgtgtctttct

SEQ ID NO: 3202217 - DNA, 22 bp, Homo sapiens
atctctctctgtgtctttctct

SEQ ID NO: 3202218 - DNA, 16 bp, Homo sapiens
atctctgaatgcccca

SEQ ID NO: 3202219 - DNA, 22 bp, Homo sapiens
atctctgcctagaatctttatt

SEQ ID NO: 3202220 - DNA, 22 bp, Homo sapiens
atctctgctctctatgtatgta

SEQ ID NO: 3202221 - DNA, 24 bp, Homo sapiens
atctctgctctctatgtatgtagc

SEQ ID NO: 3202222 - DNA, 13 bp, Homo sapiens
atctctgtgcctt

SEQ ID NO: 3202223 - DNA, 14 bp, Homo sapiens
atctctgtgccttc

SEQ ID NO: 3202224 - DNA, 19 bp, Homo sapiens
atctctgtgtgcacaaata

SEQ ID NO: 3202225 - DNA, 18 bp, Homo sapiens
atctcttattctaataaa

SEQ ID NO: 3202226 - DNA, 22 bp, Homo sapiens
atctcttcctacccaaccactc

SEQ ID NO: 3202227 - DNA, 11 bp, Homo sapiens
atctcttcctg

SEQ ID NO: 3202228 - DNA, 12 bp, Homo sapiens
atctcttcctgt

SEQ ID NO: 3202229 - DNA, 13 bp, Homo sapiens
atctcttggaaaa

SEQ ID NO: 3202230 - DNA, 22 bp, Homo sapiens
atctcttggaaaataagacaat

SEQ ID NO: 3202231 - DNA, 13 bp, Homo sapiens
atctctttcacat

SEQ ID NO: 3202232 - DNA, 19 bp, Homo sapiens
atctcttttatatttgtag

SEQ ID NO: 3202233 - DNA, 23 bp, Homo sapiens
atctcttttccactccattgtcg

SEQ ID NO: 3202234 - DNA, 19 bp, Homo sapiens
atctctttttaagatagac

SEQ ID NO: 3202235 - DNA, 12 bp, Homo sapiens
atctgaaaatgt

SEQ ID NO: 3202236 - DNA, 20 bp, Homo sapiens
atctgaaaatgtatgtgtaa

SEQ ID NO: 3202237 - DNA, 14 bp, Homo sapiens
atctgaaaatgtga

SEQ ID NO: 3202238 - DNA, 13 bp, Homo sapiens
atctgaacattct

SEQ ID NO: 3202239 - DNA, 20 bp, Homo sapiens
atctgaagaggcttctcctg

SEQ ID NO: 3202240 - DNA, 21 bp, Homo sapiens
atctgaataaagtgtaacaat

SEQ ID NO: 3202241 - DNA, 18 bp, Homo sapiens
atctgaatgaaaataact

SEQ ID NO: 3202242 - DNA, 18 bp, Homo sapiens
atctgaattaaataaata

SEQ ID NO: 3202243 - DNA, 21 bp, Homo sapiens
atctggggttggcaacaggac

SEQ ID NO: 3202244 - DNA, 23 bp, Homo sapiens
atctggggttggcaacaggacag

SEQ ID NO: 3202245 - DNA, 19 bp, Homo sapiens
atctgggtaagaagaaagc

SEQ ID NO: 3202246 - DNA, 15 bp, Homo sapiens
atctgggtatctttc

SEQ ID NO: 3202247 - DNA, 17 bp, Homo sapiens
atctgggttcactgcaa

SEQ ID NO: 3202248 - DNA, 19 bp, Homo sapiens
atctggtcttgttagaaaa

SEQ ID NO: 3202249 - DNA, 16 bp, Homo sapiens
atctggtgcctcctca

SEQ ID NO: 3202250 - DNA, 13 bp, Homo sapiens
atctgtaaactgt

SEQ ID NO: 3202251 - DNA, 16 bp, Homo sapiens
atctgtaagctctttg

SEQ ID NO: 3202252 - DNA, 19 bp, Homo sapiens
atctgtaagtaacttcaca

SEQ ID NO: 3202253 - DNA, 16 bp, Homo sapiens
atctgtacattttgtt

SEQ ID NO: 3202254 - DNA, 22 bp, Homo sapiens
atctgtacattttgttgtaaaa

SEQ ID NO: 3202255 - DNA, 17 bp, Homo sapiens
atctgtacttcttcgat

SEQ ID NO: 3202256 - DNA, 22 bp, Homo sapiens
atctgtagatactagctatcta

SEQ ID NO: 3202257 - DNA, 23 bp, Homo sapiens
atctgtagtaatttattgtctgt

SEQ ID NO: 3202258 - DNA, 20 bp, Homo sapiens
atctgtatatgttgtaataa

SEQ ID NO: 3202259 - DNA, 15 bp, Homo sapiens
atctgtatctctctc

SEQ ID NO: 3202260 - DNA, 19 bp, Homo sapiens
atctgtatttattatttga

SEQ ID NO: 3202261 - DNA, 18 bp, Homo sapiens
atctgtcaaaacactgtg

SEQ ID NO: 3202262 - DNA, 21 bp, Homo sapiens
atctgtcatatagtaaacact

SEQ ID NO: 3202263 - DNA, 16 bp, Homo sapiens
atctgtcatctctctg

SEQ ID NO: 3202264 - DNA, 17 bp, Homo sapiens
atctgtcatctctctgg

SEQ ID NO: 3202265 - DNA, 16 bp, Homo sapiens
atctgtcattatattc

SEQ ID NO: 3202266 - DNA, 18 bp, Homo sapiens
atctgtcattatattcta

SEQ ID NO: 3202267 - DNA, 18 bp, Homo sapiens
atctgtccaaaggaggct

SEQ ID NO: 3202268 - DNA, 20 bp, Homo sapiens
atctgtccatggcctttcta

SEQ ID NO: 3202269 - DNA, 21 bp, Homo sapiens
atctgtccatggcctttctaa

SEQ ID NO: 3202270 - DNA, 13 bp, Homo sapiens
atctgtctccaag

SEQ ID NO: 3202271 - DNA, 18 bp, Homo sapiens
atctgtctcccagttatg

SEQ ID NO: 3202272 - DNA, 14 bp, Homo sapiens
atctgtctggtggc

SEQ ID NO: 3202273 - DNA, 17 bp, Homo sapiens
atctgtgaattcagatt

SEQ ID NO: 3202274 - DNA, 21 bp, Homo sapiens
atctgtgatgacattccctgc

SEQ ID NO: 3202275 - DNA, 12 bp, Homo sapiens
atctgtgatgat

SEQ ID NO: 3202276 - DNA, 14 bp, Homo sapiens
atctgtgcaaacag

SEQ ID NO: 3202277 - DNA, 15 bp, Homo sapiens
atctgtgccccatgc

SEQ ID NO: 3202278 - DNA, 17 bp, Homo sapiens
atctgtggagctgccac

SEQ ID NO: 3202279 - DNA, 20 bp, Homo sapiens
atctgtgtatattatttggc

SEQ ID NO: 3202280 - DNA, 13 bp, Homo sapiens
atctgtgtgaaaa

SEQ ID NO: 3202281 - DNA, 19 bp, Homo sapiens
atctgttcccctgtcctgt

SEQ ID NO: 3202282 - DNA, 20 bp, Homo sapiens
atctgttcccctgtcctgtg

SEQ ID NO: 3202283 - DNA, 22 bp, Homo sapiens
atctgttcccctgtcctgtgaa

SEQ ID NO: 3202284 - DNA, 15 bp, Homo sapiens
atctgttgttttgtt

SEQ ID NO: 3202285 - DNA, 19 bp, Homo sapiens
atctgttttgaaggcaaaa

SEQ ID NO: 3202286 - DNA, 18 bp, Homo sapiens
atctgtttttacgtatgt

SEQ ID NO: 3202287 - DNA, 12 bp, Homo sapiens
atcttaaaaagt

SEQ ID NO: 3202288 - DNA, 17 bp, Homo sapiens
atcttaaaaagttgttc

SEQ ID NO: 3202289 - DNA, 17 bp, Homo sapiens
atcttaaacaatgtata

SEQ ID NO: 3202290 - DNA, 18 bp, Homo sapiens
atcttaaacaatgtataa

SEQ ID NO: 3202291 - DNA, 19 bp, Homo sapiens
atcttaaacaatgtataaa

SEQ ID NO: 3202292 - DNA, 23 bp, Homo sapiens
atcttaaacaatgtataaagatt

SEQ ID NO: 3202293 - DNA, 20 bp, Homo sapiens
atcttaaacataataaatca

SEQ ID NO: 3202294 - DNA, 19 bp, Homo sapiens
atcttaaaccttaagatac

SEQ ID NO: 3202295 - DNA, 19 bp, Homo sapiens
atcttaaagaaacagcttt

SEQ ID NO: 3202296 - DNA, 20 bp, Homo sapiens
atcttaaagaaacagctttc

SEQ ID NO: 3202297 - DNA, 21 bp, Homo sapiens
atcttaaagaaacagctttca

SEQ ID NO: 3202298 - DNA, 19 bp, Homo sapiens
atcttaattctttgttctg

SEQ ID NO: 3202299 - DNA, 15 bp, Homo sapiens
atcttaatttattat

SEQ ID NO: 3202300 - DNA, 19 bp, Homo sapiens
atcttaattttttttaatg

SEQ ID NO: 3202301 - DNA, 14 bp, Homo sapiens
atcttaccagatgc

SEQ ID NO: 3202302 - DNA, 12 bp, Homo sapiens
atcttagagaca

SEQ ID NO: 3202303 - DNA, 13 bp, Homo sapiens
atcttagattctc

SEQ ID NO: 3202304 - DNA, 15 bp, Homo sapiens
atcttagggtgaacc

SEQ ID NO: 3202305 - DNA, 18 bp, Homo sapiens
atcttagtgcctgagagt

SEQ ID NO: 3202306 - DNA, 13 bp, Homo sapiens
atcttagtgtatg

SEQ ID NO: 3202307 - DNA, 17 bp, Homo sapiens
atcttatagttctaggc

SEQ ID NO: 3202308 - DNA, 21 bp, Homo sapiens
atgaatctcgttcccaaagaa

SEQ ID NO: 3202309 - DNA, 22 bp, Homo sapiens
atgaatctgatttttatgatga

SEQ ID NO: 3202310 - DNA, 17 bp, Homo sapiens
atgaatctgctcacttt

SEQ ID NO: 3202311 - DNA, 20 bp, Homo sapiens
atgaatctggtgttggggaa

SEQ ID NO: 3202312 - DNA, 23 bp, Homo sapiens
atgaatctgtctcccagttatga

SEQ ID NO: 3202313 - DNA, 21 bp, Homo sapiens
atgaatgggctgagctgcctg

SEQ ID NO: 3202314 - DNA, 19 bp, Homo sapiens
atgaatgtatattttgtgt

SEQ ID NO: 3202315 - DNA, 16 bp, Homo sapiens
atgaatgtatgtgcac

SEQ ID NO: 3202316 - DNA, 20 bp, Homo sapiens
atgaatgtatttatttggga

SEQ ID NO: 3202317 - DNA, 16 bp, Homo sapiens
atgaattataacagtt

SEQ ID NO: 3202318 - DNA, 17 bp, Homo sapiens
atgaattcttatgctta

SEQ ID NO: 3202319 - DNA, 11 bp, Homo sapiens
atgaatttaaa

SEQ ID NO: 3202320 - DNA, 23 bp, Homo sapiens
atgaatttaaatataattctgta

SEQ ID NO: 3202321 - DNA, 18 bp, Homo sapiens
atgaatttcttctaatta

SEQ ID NO: 3202322 - DNA, 22 bp, Homo sapiens
atgaattttaaagtatgcatta

SEQ ID NO: 3202323 - DNA, 18 bp, Homo sapiens
atgaattttcaagtaatt

SEQ ID NO: 3202324 - DNA, 14 bp, Homo sapiens
atgacaaaaaatgt

SEQ ID NO: 3202325 - DNA, 17 bp, Homo sapiens
atgacaaataagtggaa

SEQ ID NO: 3202326 - DNA, 13 bp, Homo sapiens
atgacaaattata

SEQ ID NO: 3202327 - DNA, 14 bp, Homo sapiens
atgacaacagaaaa

SEQ ID NO: 3202328 - DNA, 17 bp, Homo sapiens
atgacaacagaaaaaca

SEQ ID NO: 3202329 - DNA, 20 bp, Homo sapiens
atgacaacagaaaaacaatc

SEQ ID NO: 3202330 - DNA, 14 bp, Homo sapiens
atgacaatgatgat

SEQ ID NO: 3202331 - DNA, 21 bp, Homo sapiens
atgacacaaaggtggaataaa

SEQ ID NO: 3202332 - DNA, 18 bp, Homo sapiens
atgacacccaccctgtgc

SEQ ID NO: 3202333 - DNA, 23 bp, Homo sapiens
atgacacccaccctgtgccatca

SEQ ID NO: 3202334 - DNA, 22 bp, Homo sapiens
atgacagatatatttaagcctt

SEQ ID NO: 3202335 - DNA, 16 bp, Homo sapiens
atgacagatgttgaat

SEQ ID NO: 3202336 - DNA, 17 bp, Homo sapiens
atgacagattctgacat

SEQ ID NO: 3202337 - DNA, 22 bp, Homo sapiens
atgacagattctgacatttata

SEQ ID NO: 3202338 - DNA, 17 bp, Homo sapiens
atgacagccatttgtaa

SEQ ID NO: 3202339 - DNA, 23 bp, Homo sapiens
atgacaggcctgaagatattact

SEQ ID NO: 3202340 - DNA, 17 bp, Homo sapiens
atgacagtgttccccga

SEQ ID NO: 3202341 - DNA, 22 bp, Homo sapiens
atgacagttatactgtcggttt

SEQ ID NO: 3202342 - DNA, 14 bp, Homo sapiens
atgacatcacttgt

SEQ ID NO: 3202343 - DNA, 18 bp, Homo sapiens
atgacatgaaaagttatt

SEQ ID NO: 3202344 - DNA, 17 bp, Homo sapiens
atgacatgcactgaccc

SEQ ID NO: 3202345 - DNA, 23 bp, Homo sapiens
atgacatgttatatattttttgt

SEQ ID NO: 3202346 - DNA, 14 bp, Homo sapiens
atgaccagggatgc

SEQ ID NO: 3202347 - DNA, 17 bp, Homo sapiens
atgaccagggatgctgg

SEQ ID NO: 3202348 - DNA, 19 bp, Homo sapiens
atgaccattgagtccctgc

SEQ ID NO: 3202349 - DNA, 20 bp, Homo sapiens
atgaccattgagtccctgct

SEQ ID NO: 3202350 - DNA, 16 bp, Homo sapiens
atgacccacccctgtg

SEQ ID NO: 3202351 - DNA, 19 bp, Homo sapiens
atgacccacccctgtgctc

SEQ ID NO: 3202352 - DNA, 14 bp, Homo sapiens
atgacccagaccca

SEQ ID NO: 3202353 - DNA, 19 bp, Homo sapiens
atgaccgcacgttctctgc

SEQ ID NO: 3202354 - DNA, 12 bp, Homo sapiens
atgacctaccag

SEQ ID NO: 3202355 - DNA, 19 bp, Homo sapiens
atgacctaccaggacagaa

SEQ ID NO: 3202356 - DNA, 20 bp, Homo sapiens
atgacctctgtcctccctct

SEQ ID NO: 3202357 - DNA, 14 bp, Homo sapiens
atgacctggataac

SEQ ID NO: 3202358 - DNA, 22 bp, Homo sapiens
atgacgccagataaaatgttca

SEQ ID NO: 3202359 - DNA, 23 bp, Homo sapiens
atgacgccagataaaatgttcag

SEQ ID NO: 3202360 - DNA, 15 bp, Homo sapiens
atgacggaagaacat

SEQ ID NO: 3202361 - DNA, 13 bp, Homo sapiens
atgactaaagaga

SEQ ID NO: 3202362 - DNA, 18 bp, Homo sapiens
atgactaaagagagaatg

SEQ ID NO: 3202363 - DNA, 19 bp, Homo sapiens
atgactaaagagagaatgt

SEQ ID NO: 3202364 - DNA, 23 bp, Homo sapiens
atgactaaagagagaatgtagat

SEQ ID NO: 3202365 - DNA, 15 bp, Homo sapiens
atgactagaggcagg

SEQ ID NO: 3202366 - DNA, 19 bp, Homo sapiens
atgactatgtatttttcta

SEQ ID NO: 3202367 - DNA, 22 bp, Homo sapiens
atgactccactgtttttctcta

SEQ ID NO: 3202368 - DNA, 20 bp, Homo sapiens
atgactctttctgaaggaag

SEQ ID NO: 3202369 - DNA, 16 bp, Homo sapiens
atgactgcacccagct

SEQ ID NO: 3202370 - DNA, 23 bp, Homo sapiens
atgactgctccccagccctggct

SEQ ID NO: 3202371 - DNA, 14 bp, Homo sapiens
atgactgctgattt

SEQ ID NO: 3202372 - DNA, 18 bp, Homo sapiens
atgactgctttgtttgga

SEQ ID NO: 3202373 - DNA, 12 bp, Homo sapiens
atgactggctgt

SEQ ID NO: 3202374 - DNA, 16 bp, Homo sapiens
atgactggctgtctgc

SEQ ID NO: 3202375 - DNA, 20 bp, Homo sapiens
atgactgtgaccaccttctg

SEQ ID NO: 3202376 - DNA, 15 bp, Homo sapiens
atgactttttataaa

SEQ ID NO: 3202377 - DNA, 15 bp, Homo sapiens
atgagaaacagctca

SEQ ID NO: 3202378 - DNA, 19 bp, Homo sapiens
atgagaaacagctcagcca

SEQ ID NO: 3202379 - DNA, 20 bp, Homo sapiens
atgagaaacagctcagccag

SEQ ID NO: 3202380 - DNA, 22 bp, Homo sapiens
atgagaaacagctcagccagtg

SEQ ID NO: 3202381 - DNA, 13 bp, Homo sapiens
atgagaacaaagc

SEQ ID NO: 3202382 - DNA, 18 bp, Homo sapiens
atgagaacaaagctgtta

SEQ ID NO: 3202383 - DNA, 22 bp, Homo sapiens
atgagaacaaagctgttaaact

SEQ ID NO: 3202384 - DNA, 23 bp, Homo sapiens
atgagaacaagtcacagctgcag

SEQ ID NO: 3202385 - DNA, 18 bp, Homo sapiens
atgagaagagggcctgtg

SEQ ID NO: 3202386 - DNA, 16 bp, Homo sapiens
atgagaatcatgcact

SEQ ID NO: 3202387 - DNA, 11 bp, Homo sapiens
atgagaatcta

SEQ ID NO: 3202388 - DNA, 14 bp, Homo sapiens
atgagaatttctaa

SEQ ID NO: 3202389 - DNA, 16 bp, Homo sapiens
atgagtcaatgtgcag

SEQ ID NO: 3202390 - DNA, 19 bp, Homo sapiens
atgagtcaatgtgcagtgt

SEQ ID NO: 3202391 - DNA, 16 bp, Homo sapiens
atgagtccttgaaaat

SEQ ID NO: 3202392 - DNA, 12 bp, Homo sapiens
atgagtctagat

SEQ ID NO: 3202393 - DNA, 13 bp, Homo sapiens
atgagtctagatg

SEQ ID NO: 3202394 - DNA, 15 bp, Homo sapiens
atgagtgaataaatg

SEQ ID NO: 3202395 - DNA, 16 bp, Homo sapiens
atgagtgaataaatgt

SEQ ID NO: 3202396 - DNA, 21 bp, Homo sapiens
atgagtggaaattaagacttt

SEQ ID NO: 3202397 - DNA, 18 bp, Homo sapiens
atgagttaactgtgaaat

SEQ ID NO: 3202398 - DNA, 16 bp, Homo sapiens
atgagttattcataaa

SEQ ID NO: 3202399 - DNA, 15 bp, Homo sapiens
atgagttgtgaaagt

SEQ ID NO: 3202400 - DNA, 15 bp, Homo sapiens
atgagtttgccctgg

SEQ ID NO: 3202401 - DNA, 19 bp, Homo sapiens
atgagtttttgatagcttt

SEQ ID NO: 3202402 - DNA, 20 bp, Homo sapiens
atgataaagagacagtgata

SEQ ID NO: 3202403 - DNA, 17 bp, Homo sapiens
atgataagtaaatgcta

SEQ ID NO: 3202404 - DNA, 19 bp, Homo sapiens
atgataatagattctcttg

SEQ ID NO: 3202405 - DNA, 18 bp, Homo sapiens
atgataccacctttactg

SEQ ID NO: 3202406 - DNA, 19 bp, Homo sapiens
atgataccacctttactgt

SEQ ID NO: 3202407 - DNA, 22 bp, Homo sapiens
atgatagcccagaacaaaaaga

SEQ ID NO: 3202408 - DNA, 14 bp, Homo sapiens
atgatatccctgat

SEQ ID NO: 3202409 - DNA, 22 bp, Homo sapiens
atgatatgtaaacataattctt

SEQ ID NO: 3202410 - DNA, 19 bp, Homo sapiens
atgatattccccatttcct

SEQ ID NO: 3202411 - DNA, 22 bp, Homo sapiens
atgatattccccatttcctgta

SEQ ID NO: 3202412 - DNA, 18 bp, Homo sapiens
atgatattgtttaaaatt

SEQ ID NO: 3202413 - DNA, 12 bp, Homo sapiens
atgatatttctt

SEQ ID NO: 3202414 - DNA, 23 bp, Homo sapiens
atgatcacggctcactgcagcct

SEQ ID NO: 3202415 - DNA, 18 bp, Homo sapiens
atgatcagctgtttgtca

SEQ ID NO: 3202416 - DNA, 14 bp, Homo sapiens
atgatcagtactga

SEQ ID NO: 3202417 - DNA, 22 bp, Homo sapiens
atgatcataaaagtgattcttt

SEQ ID NO: 3202418 - DNA, 21 bp, Homo sapiens
atgatcattgaaatacttttt

SEQ ID NO: 3202419 - DNA, 21 bp, Homo sapiens
atgatccaactaatgccttac

SEQ ID NO: 3202420 - DNA, 14 bp, Homo sapiens
atgatccagagcag

SEQ ID NO: 3202421 - DNA, 17 bp, Homo sapiens
atgatccagagcagagt

SEQ ID NO: 3202422 - DNA, 13 bp, Homo sapiens
atgatccctgtgt

SEQ ID NO: 3202423 - DNA, 19 bp, Homo sapiens
atgatccttttttgtcatt

SEQ ID NO: 3202424 - DNA, 23 bp, Homo sapiens
atgatccttttttgtcattttat

SEQ ID NO: 3202425 - DNA, 13 bp, Homo sapiens
atgatctatttgt

SEQ ID NO: 3202426 - DNA, 15 bp, Homo sapiens
atgatcttctttata

SEQ ID NO: 3202427 - DNA, 17 bp, Homo sapiens
atgatctttgcagacag

SEQ ID NO: 3202428 - DNA, 15 bp, Homo sapiens
atgatgaactcacct

SEQ ID NO: 3202429 - DNA, 17 bp, Homo sapiens
atgatgacgacgacaac

SEQ ID NO: 3202430 - DNA, 15 bp, Homo sapiens
atgatgagattcact

SEQ ID NO: 3202431 - DNA, 23 bp, Homo sapiens
atgatgattccttgagcatttta

SEQ ID NO: 3202432 - DNA, 19 bp, Homo sapiens
atgatgccctgctccaggg

SEQ ID NO: 3202433 - DNA, 15 bp, Homo sapiens
atgatggaatttcat

SEQ ID NO: 3202434 - DNA, 21 bp, Homo sapiens
atgatggatcaccattatatt

SEQ ID NO: 3202435 - DNA, 19 bp, Homo sapiens
atgatggatgccaatatta

SEQ ID NO: 3202436 - DNA, 14 bp, Homo sapiens
atgatggatggcag

SEQ ID NO: 3202437 - DNA, 15 bp, Homo sapiens
atgatggatggcaga

SEQ ID NO: 3202438 - DNA, 16 bp, Homo sapiens
atgatggatggcagac

SEQ ID NO: 3202439 - DNA, 14 bp, Homo sapiens
atgatggttcacgt

SEQ ID NO: 3202440 - DNA, 18 bp, Homo sapiens
atgatggttgcaaaagac

SEQ ID NO: 3202441 - DNA, 12 bp, Homo sapiens
atgatgtatatt

SEQ ID NO: 3202442 - DNA, 13 bp, Homo sapiens
atgatgtatattt

SEQ ID NO: 3202443 - DNA, 15 bp, Homo sapiens
atgatgtccagaaga

SEQ ID NO: 3202444 - DNA, 19 bp, Homo sapiens
atgatgtccagaagaatat

SEQ ID NO: 3202445 - DNA, 20 bp, Homo sapiens
atgatgtgaaacactttgcc

SEQ ID NO: 3202446 - DNA, 19 bp, Homo sapiens
atgatgtgtacccaaacgt

SEQ ID NO: 3202447 - DNA, 14 bp, Homo sapiens
atgatgtgttgtga

SEQ ID NO: 3202448 - DNA, 11 bp, Homo sapiens
atgattaaatt

SEQ ID NO: 3202449 - DNA, 23 bp, Homo sapiens
atgattaaattttagtacatttt

SEQ ID NO: 3202450 - DNA, 16 bp, Homo sapiens
atgattaattcacctt

SEQ ID NO: 3202451 - DNA, 14 bp, Homo sapiens
atgattagcaagtt

SEQ ID NO: 3202452 - DNA, 20 bp, Homo sapiens
atgattagttaaaaaaagaa

SEQ ID NO: 3202453 - DNA, 15 bp, Homo sapiens
atgattattttcatt

SEQ ID NO: 3202454 - DNA, 21 bp, Homo sapiens
atgattcaaattgctgcttgg

SEQ ID NO: 3202455 - DNA, 15 bp, Homo sapiens
atgattcataacaat

SEQ ID NO: 3202456 - DNA, 19 bp, Homo sapiens
atgattcctggacatcacc

SEQ ID NO: 3202457 - DNA, 22 bp, Homo sapiens
atgattccttgatggagatatt

SEQ ID NO: 3202458 - DNA, 18 bp, Homo sapiens
atgattctattatatatt

SEQ ID NO: 3202459 - DNA, 23 bp, Homo sapiens
atgattctatttatatgtacatg

SEQ ID NO: 3202460 - DNA, 13 bp, Homo sapiens
atgattggattat

SEQ ID NO: 3202461 - DNA, 16 bp, Homo sapiens
atgattggattattca

SEQ ID NO: 3202462 - DNA, 22 bp, Homo sapiens
atgattggattattcatttaaa

SEQ ID NO: 3202463 - DNA, 14 bp, Homo sapiens
atgattgtaaaata

SEQ ID NO: 3202464 - DNA, 17 bp, Homo sapiens
atgattgtactttgaat

SEQ ID NO: 3202465 - DNA, 18 bp, Homo sapiens
atgattgtttcttcttca

SEQ ID NO: 3202466 - DNA, 13 bp, Homo sapiens
atgatttaataaa

SEQ ID NO: 3202467 - DNA, 14 bp, Homo sapiens
atgatttaataaaa

SEQ ID NO: 3202468 - DNA, 12 bp, Homo sapiens
atgatttcatat

SEQ ID NO: 3202469 - DNA, 14 bp, Homo sapiens
atgatttcatattg

SEQ ID NO: 3202470 - DNA, 19 bp, Homo sapiens
atgatttcatcttctggaa

SEQ ID NO: 3202471 - DNA, 21 bp, Homo sapiens
atgatttccttgaatgtggct

SEQ ID NO: 3202472 - DNA, 19 bp, Homo sapiens
atgatttgggggaggcttt

SEQ ID NO: 3202473 - DNA, 16 bp, Homo sapiens
atgatttgtaacattc

SEQ ID NO: 3202474 - DNA, 17 bp, Homo sapiens
atgatttgtcccagcct

SEQ ID NO: 3202475 - DNA, 19 bp, Homo sapiens
atgcacagatatactttgt

SEQ ID NO: 3202476 - DNA, 21 bp, Homo sapiens
atgcacatatggactctgcac

SEQ ID NO: 3202477 - DNA, 17 bp, Homo sapiens
atgcacatccattccca

SEQ ID NO: 3202478 - DNA, 13 bp, Homo sapiens
atgcaccagccct

SEQ ID NO: 3202479 - DNA, 13 bp, Homo sapiens
atgcaccctccct

SEQ ID NO: 3202480 - DNA, 16 bp, Homo sapiens
atgcaccctccctcct

SEQ ID NO: 3202481 - DNA, 15 bp, Homo sapiens
atgcaccttgtgtct

SEQ ID NO: 3202482 - DNA, 18 bp, Homo sapiens
atgcaccttgtgtctgta

SEQ ID NO: 3202483 - DNA, 19 bp, Homo sapiens
atgcaccttgtgtctgtac

SEQ ID NO: 3202484 - DNA, 13 bp, Homo sapiens
atgcacggcctcg

SEQ ID NO: 3202485 - DNA, 18 bp, Homo sapiens
atgcacggcctcgcgtct

SEQ ID NO: 3202486 - DNA, 18 bp, Homo sapiens
atgcactatatgtttaca

SEQ ID NO: 3202487 - DNA, 23 bp, Homo sapiens
atgcactatatgtttacacaatt

SEQ ID NO: 3202488 - DNA, 14 bp, Homo sapiens
atgcactatgtata

SEQ ID NO: 3202489 - DNA, 20 bp, Homo sapiens
atgcactgaaaacttagcca

SEQ ID NO: 3202490 - DNA, 18 bp, Homo sapiens
atgcagaaatagacaaaa

SEQ ID NO: 3202491 - DNA, 21 bp, Homo sapiens
atgcagaaatagacaaaaagt

SEQ ID NO: 3202492 - DNA, 22 bp, Homo sapiens
atgcagaaatagacaaaaagta

SEQ ID NO: 3202493 - DNA, 22 bp, Homo sapiens
atgcagacaacaccttcctcct

SEQ ID NO: 3202494 - DNA, 23 bp, Homo sapiens
atgcagacaacaccttcctcctg

SEQ ID NO: 3202495 - DNA, 21 bp, Homo sapiens
atgcagaggaggtgagagtgg

SEQ ID NO: 3202496 - DNA, 16 bp, Homo sapiens
atgcagattcctgggc

SEQ ID NO: 3202497 - DNA, 22 bp, Homo sapiens
atgcagcccatgcccacctgcc

SEQ ID NO: 3202498 - DNA, 23 bp, Homo sapiens
atgcagcccatgcccacctgccc

SEQ ID NO: 3202499 - DNA, 18 bp, Homo sapiens
atgcagccgccttccttg

SEQ ID NO: 3202500 - DNA, 20 bp, Homo sapiens
atgcagcgccgtgtcctctc

SEQ ID NO: 3202501 - DNA, 14 bp, Homo sapiens
atgcagctttgcaa

SEQ ID NO: 3202502 - DNA, 13 bp, Homo sapiens
atgcaggacagga

SEQ ID NO: 3202503 - DNA, 21 bp, Homo sapiens
atgcaggcacttattgtaaat

SEQ ID NO: 3202504 - DNA, 12 bp, Homo sapiens
atgcaggccctt

SEQ ID NO: 3202505 - DNA, 23 bp, Homo sapiens
atgcagggaagagggcagtacct

SEQ ID NO: 3202506 - DNA, 14 bp, Homo sapiens
atgcagtcctgagg

SEQ ID NO: 3202507 - DNA, 16 bp, Homo sapiens
atgcagtgaattgtga

SEQ ID NO: 3202508 - DNA, 23 bp, Homo sapiens
atgcagtgatatggcagaagaca

SEQ ID NO: 3202509 - DNA, 13 bp, Homo sapiens
atgcagtgcttcc

SEQ ID NO: 3202510 - DNA, 19 bp, Homo sapiens
atgcagttagctgaagaat

SEQ ID NO: 3202511 - DNA, 17 bp, Homo sapiens
atgcagttcattatttt

SEQ ID NO: 3202512 - DNA, 19 bp, Homo sapiens
atgcagttcattattttgt

SEQ ID NO: 3202513 - DNA, 13 bp, Homo sapiens
atgcagttcctgg

SEQ ID NO: 3202514 - DNA, 17 bp, Homo sapiens
atgcataaatatgcagt

SEQ ID NO: 3202515 - DNA, 18 bp, Homo sapiens
atgcatacagttttctag

SEQ ID NO: 3202516 - DNA, 14 bp, Homo sapiens
atgcatactttatt

SEQ ID NO: 3202517 - DNA, 23 bp, Homo sapiens
atgcatagtcccagctacccagg

SEQ ID NO: 3202518 - DNA, 17 bp, Homo sapiens
atgcatatcctgagcca

SEQ ID NO: 3202519 - DNA, 12 bp, Homo sapiens
atgcatcactgg

SEQ ID NO: 3202520 - DNA, 19 bp, Homo sapiens
atgcatcctttgcactgtc

SEQ ID NO: 3202521 - DNA, 19 bp, Homo sapiens
atgcatcgggaaagaagaa

SEQ ID NO: 3202522 - DNA, 21 bp, Homo sapiens
atgcatgaacaagttttaatg

SEQ ID NO: 3202523 - DNA, 13 bp, Homo sapiens
atgcatgcaaatg

SEQ ID NO: 3202524 - DNA, 16 bp, Homo sapiens
atgcatgcaaatgagc

SEQ ID NO: 3202525 - DNA, 12 bp, Homo sapiens
atgcatggaaac

SEQ ID NO: 3202526 - DNA, 23 bp, Homo sapiens
atgcatggaaacctgaaaaaaag

SEQ ID NO: 3202527 - DNA, 18 bp, Homo sapiens
atgcatgtcttttaaaat

SEQ ID NO: 3202528 - DNA, 13 bp, Homo sapiens
atgcatgttacta

SEQ ID NO: 3202529 - DNA, 14 bp, Homo sapiens
atgcattaaacctg

SEQ ID NO: 3202530 - DNA, 15 bp, Homo sapiens
atgcattaaacctgt

SEQ ID NO: 3202531 - DNA, 17 bp, Homo sapiens
atgcattaaacctgtct

SEQ ID NO: 3202532 - DNA, 22 bp, Homo sapiens
atgcattataggatcatttgtt

SEQ ID NO: 3202533 - DNA, 18 bp, Homo sapiens
atgcattatatcaaatct

SEQ ID NO: 3202534 - DNA, 19 bp, Homo sapiens
atgcattcacatttagaaa

SEQ ID NO: 3202535 - DNA, 15 bp, Homo sapiens
atgcattgaaagaat

SEQ ID NO: 3202536 - DNA, 16 bp, Homo sapiens
atgcattgtcttgtgg

SEQ ID NO: 3202537 - DNA, 15 bp, Homo sapiens
atgcatttaataaag

SEQ ID NO: 3202538 - DNA, 17 bp, Homo sapiens
atgcatttaataaagat

SEQ ID NO: 3202539 - DNA, 13 bp, Homo sapiens
atgcatttcaaat

SEQ ID NO: 3202540 - DNA, 17 bp, Homo sapiens
atgcatttcaaatgtta

SEQ ID NO: 3202541 - DNA, 14 bp, Homo sapiens
atgcatttcattca

SEQ ID NO: 3202542 - DNA, 15 bp, Homo sapiens
atgcatttcattcaa

SEQ ID NO: 3202543 - DNA, 16 bp, Homo sapiens
atgcatttcattcaaa

SEQ ID NO: 3202544 - DNA, 14 bp, Homo sapiens
atgcatttgcattt

SEQ ID NO: 3202545 - DNA, 18 bp, Homo sapiens
atgcattttcttgtatga

SEQ ID NO: 3202546 - DNA, 18 bp, Homo sapiens
atgcattttgcagcagtg

SEQ ID NO: 3202547 - DNA, 22 bp, Homo sapiens
atgccaaagctagggtggccct

SEQ ID NO: 3202548 - DNA, 14 bp, Homo sapiens
atgccaacttgtcc

SEQ ID NO: 3202549 - DNA, 22 bp, Homo sapiens
atgccaagaaaagggctgacat

SEQ ID NO: 3202550 - DNA, 15 bp, Homo sapiens
atgccacacagagtg

SEQ ID NO: 3202551 - DNA, 20 bp, Homo sapiens
atgccaccctgttttcagct

SEQ ID NO: 3202552 - DNA, 23 bp, Homo sapiens
atgccacgtggtcactgtgcact

SEQ ID NO: 3202553 - DNA, 22 bp, Homo sapiens
atgccactgccaggcacctggc

SEQ ID NO: 3202554 - DNA, 15 bp, Homo sapiens
atgccactgccttcg

SEQ ID NO: 3202555 - DNA, 14 bp, Homo sapiens
atgccagcccctgc

SEQ ID NO: 3202556 - DNA, 15 bp, Homo sapiens
atgccagcccctgcc

SEQ ID NO: 3202557 - DNA, 16 bp, Homo sapiens
atgccagcccctgcct

SEQ ID NO: 3202558 - DNA, 22 bp, Homo sapiens
atgccaggccagagggcagtgg

SEQ ID NO: 3202559 - DNA, 22 bp, Homo sapiens
atgccagtaacgcgtcttcctg

SEQ ID NO: 3202560 - DNA, 14 bp, Homo sapiens
atgccagtattttt

SEQ ID NO: 3202561 - DNA, 15 bp, Homo sapiens
atgccatttgtttat

SEQ ID NO: 3202562 - DNA, 16 bp, Homo sapiens
atgcccaccccctgcc

SEQ ID NO: 3202563 - DNA, 20 bp, Homo sapiens
atgcccaccccctgccctgc

SEQ ID NO: 3202564 - DNA, 16 bp, Homo sapiens
atgcccacctgcccat

SEQ ID NO: 3202565 - DNA, 19 bp, Homo sapiens
atgcccacctgcccatcac

SEQ ID NO: 3202566 - DNA, 17 bp, Homo sapiens
atgcctgtccagcctgg

SEQ ID NO: 3202567 - DNA, 21 bp, Homo sapiens
atgcctgtctctgttcagatg

SEQ ID NO: 3202568 - DNA, 16 bp, Homo sapiens
atgccttactcttctt

SEQ ID NO: 3202569 - DNA, 15 bp, Homo sapiens
atgccttctgtattt

SEQ ID NO: 3202570 - DNA, 16 bp, Homo sapiens
atgccttgaactgttg

SEQ ID NO: 3202571 - DNA, 23 bp, Homo sapiens
atgccttgaactgttgtctggga

SEQ ID NO: 3202572 - DNA, 21 bp, Homo sapiens
atgccttgataaatatatatg

SEQ ID NO: 3202573 - DNA, 20 bp, Homo sapiens
atgccttggggaggacaaaa

SEQ ID NO: 3202574 - DNA, 19 bp, Homo sapiens
atgccttgtgctgttaata

SEQ ID NO: 3202575 - DNA, 13 bp, Homo sapiens
atgcctttgagac

SEQ ID NO: 3202576 - DNA, 19 bp, Homo sapiens
atgcgaaccacccaaaaca

SEQ ID NO: 3202577 - DNA, 17 bp, Homo sapiens
atgcgcaaaactgcctg

SEQ ID NO: 3202578 - DNA, 18 bp, Homo sapiens
atgcgccccctccgccct

SEQ ID NO: 3202579 - DNA, 13 bp, Homo sapiens
atgcgccttgctg

SEQ ID NO: 3202580 - DNA, 15 bp, Homo sapiens
atgcgctcagggcca

SEQ ID NO: 3202581 - DNA, 17 bp, Homo sapiens
atgcgctttattgccca

SEQ ID NO: 3202582 - DNA, 16 bp, Homo sapiens
atgcggatcctgctgg

SEQ ID NO: 3202583 - DNA, 19 bp, Homo sapiens
atgcggttaattttgaagt

SEQ ID NO: 3202584 - DNA, 21 bp, Homo sapiens
atgcggttataaaaaatggtt

SEQ ID NO: 3202585 - DNA, 16 bp, Homo sapiens
atgcgtaaacgacact

SEQ ID NO: 3202586 - DNA, 13 bp, Homo sapiens
atgctaaccttgt

SEQ ID NO: 3202587 - DNA, 14 bp, Homo sapiens
atgctaacgtgtca

SEQ ID NO: 3202588 - DNA, 16 bp, Homo sapiens
atgctaatttaaagag

SEQ ID NO: 3202589 - DNA, 17 bp, Homo sapiens
atgctaatttaaagaga

SEQ ID NO: 3202590 - DNA, 14 bp, Homo sapiens
atgctactgtctca

SEQ ID NO: 3202591 - DNA, 13 bp, Homo sapiens
atgctagccccag

SEQ ID NO: 3202592 - DNA, 15 bp, Homo sapiens
atgctatttgaacaa

SEQ ID NO: 3202593 - DNA, 13 bp, Homo sapiens
atgctcacctcta

SEQ ID NO: 3202594 - DNA, 13 bp, Homo sapiens
atgctcatctgct

SEQ ID NO: 3202595 - DNA, 18 bp, Homo sapiens
atgctccaagattctaga

SEQ ID NO: 3202596 - DNA, 22 bp, Homo sapiens
atgctccaggatctttgactga

SEQ ID NO: 3202597 - DNA, 20 bp, Homo sapiens
atgctccatcccattcactt

SEQ ID NO: 3202598 - DNA, 19 bp, Homo sapiens
atgctcccagctgtgctgt

SEQ ID NO: 3202599 - DNA, 22 bp, Homo sapiens
atgctcccagctgtgctgtgga

SEQ ID NO: 3202600 - DNA, 21 bp, Homo sapiens
atgctccccacagcgtccctg

SEQ ID NO: 3202601 - DNA, 13 bp, Homo sapiens
atgctccctcagc

SEQ ID NO: 3202602 - DNA, 19 bp, Homo sapiens
atgctccctcagcctcaga

SEQ ID NO: 3202603 - DNA, 20 bp, Homo sapiens
atgctccctcagcctcagag

SEQ ID NO: 3202604 - DNA, 21 bp, Homo sapiens
atgctccctcagcctcagagg

SEQ ID NO: 3202605 - DNA, 22 bp, Homo sapiens
atgctccctcagcctcagagga

SEQ ID NO: 3202606 - DNA, 14 bp, Homo sapiens
atgctccctcccct

SEQ ID NO: 3202607 - DNA, 16 bp, Homo sapiens
atgctccctcccctgc

SEQ ID NO: 3202608 - DNA, 20 bp, Homo sapiens
atgctctcatatatatttta

SEQ ID NO: 3202609 - DNA, 18 bp, Homo sapiens
atgctctgtcttcaatga

SEQ ID NO: 3202610 - DNA, 13 bp, Homo sapiens
atgctcttctgtg

SEQ ID NO: 3202611 - DNA, 19 bp, Homo sapiens
atgctcttttttactcatt

SEQ ID NO: 3202612 - DNA, 22 bp, Homo sapiens
atgctcttttttactcattgaa

SEQ ID NO: 3202613 - DNA, 24 bp, Homo sapiens
atgctcttttttactcattgaaat

SEQ ID NO: 3202614 - DNA, 17 bp, Homo sapiens
atgctgaaaaatatagc

SEQ ID NO: 3202615 - DNA, 17 bp, Homo sapiens
atgctgaacgcagaaga

SEQ ID NO: 3202616 - DNA, 23 bp, Homo sapiens
atgctgaatatacagcaggtgct

SEQ ID NO: 3202617 - DNA, 22 bp, Homo sapiens
atgctgaatatctgttcacttt

SEQ ID NO: 3202618 - DNA, 17 bp, Homo sapiens
atgctgaatccacctcg

SEQ ID NO: 3202619 - DNA, 21 bp, Homo sapiens
atgctgaatccacctcggagc

SEQ ID NO: 3202620 - DNA, 20 bp, Homo sapiens
atgctgactgtactcctccc

SEQ ID NO: 3202621 - DNA, 23 bp, Homo sapiens
atgctgaggatataagcttttag

SEQ ID NO: 3202622 - DNA, 14 bp, Homo sapiens
atgctgaggcctgg

SEQ ID NO: 3202623 - DNA, 15 bp, Homo sapiens
atgctgaggcctggg

SEQ ID NO: 3202624 - DNA, 19 bp, Homo sapiens
atgctgatcatcgccagag

SEQ ID NO: 3202625 - DNA, 13 bp, Homo sapiens
atgctgatggagc

SEQ ID NO: 3202626 - DNA, 18 bp, Homo sapiens
atgctgcaggacttgaga

SEQ ID NO: 3202627 - DNA, 22 bp, Homo sapiens
atgctgccttcccatgaatctg

SEQ ID NO: 3202628 - DNA, 23 bp, Homo sapiens
atgctgccttcccatgaatctgt

SEQ ID NO: 3202629 - DNA, 13 bp, Homo sapiens
atgctgctactta

SEQ ID NO: 3202630 - DNA, 22 bp, Homo sapiens
atgctgctttttggcacagttg

SEQ ID NO: 3202631 - DNA, 16 bp, Homo sapiens
atgctggactggaggc

SEQ ID NO: 3202632 - DNA, 17 bp, Homo sapiens
atgctggagaagagagg

SEQ ID NO: 3202633 - DNA, 18 bp, Homo sapiens
atgctggagaagagagga

SEQ ID NO: 3202634 - DNA, 19 bp, Homo sapiens
atgctggagaagagaggag

SEQ ID NO: 3202635 - DNA, 15 bp, Homo sapiens
atgctggagggaggc

SEQ ID NO: 3202636 - DNA, 13 bp, Homo sapiens
atgctggccagca

SEQ ID NO: 3202637 - DNA, 16 bp, Homo sapiens
atgctggccagcaccc

SEQ ID NO: 3202638 - DNA, 14 bp, Homo sapiens
atgctggccagcct

SEQ ID NO: 3202639 - DNA, 15 bp, Homo sapiens
atgctggccagcctg

SEQ ID NO: 3202640 - DNA, 17 bp, Homo sapiens
atgctggccagcctggg

SEQ ID NO: 3202641 - DNA, 23 bp, Homo sapiens
atgctggccagcctggggcctgg

SEQ ID NO: 3202642 - DNA, 17 bp, Homo sapiens
atgctggcctttgctct

SEQ ID NO: 3202643 - DNA, 18 bp, Homo sapiens
atgctggctgttggctgg

SEQ ID NO: 3202644 - DNA, 20 bp, Homo sapiens
atgctggctgttggctgggg

SEQ ID NO: 3202645 - DNA, 22 bp, Homo sapiens
atgctggctgttggctgggggc

SEQ ID NO: 3202646 - DNA, 23 bp, Homo sapiens
atgctgggaagacgcctgagctc

SEQ ID NO: 3202647 - DNA, 10 bp, Homo sapiens
atgctgggac

SEQ ID NO: 3202648 - DNA, 15 bp, Homo sapiens
atgctgggactcagc

SEQ ID NO: 3202649 - DNA, 16 bp, Homo sapiens
atgctgggctgggccc

SEQ ID NO: 3202650 - DNA, 21 bp, Homo sapiens
atgctggttttcctaaatgca

SEQ ID NO: 3202651 - DNA, 14 bp, Homo sapiens
atgctgtatatgtt

SEQ ID NO: 3202652 - DNA, 23 bp, Homo sapiens
atgctgtgacacatggcccctcc

SEQ ID NO: 3202653 - DNA, 16 bp, Homo sapiens
atgctgtgctctttga

SEQ ID NO: 3202654 - DNA, 19 bp, Homo sapiens
atgctgtgggggactggct

SEQ ID NO: 3202655 - DNA, 15 bp, Homo sapiens
atgctgttgtaaaca

SEQ ID NO: 3202656 - DNA, 15 bp, Homo sapiens
atgcttaaaaggttg

SEQ ID NO: 3202657 - DNA, 17 bp, Homo sapiens
atgcttaaaataagcag

SEQ ID NO: 3202658 - DNA, 19 bp, Homo sapiens
atgcttaaactaaataatg

SEQ ID NO: 3202659 - DNA, 23 bp, Homo sapiens
atgcttactgatatattttacaa

SEQ ID NO: 3202660 - DNA, 17 bp, Homo sapiens
atgcttagatgttccag

SEQ ID NO: 3202661 - DNA, 16 bp, Homo sapiens
atcctcactgccctcc

SEQ ID NO: 3202662 - DNA, 16 bp, Homo sapiens
atcctcatatggccca

SEQ ID NO: 3202663 - DNA, 15 bp, Homo sapiens
atcctcattgcctcc

SEQ ID NO: 3202664 - DNA, 17 bp, Homo sapiens
atcctccacatcctgtg

SEQ ID NO: 3202665 - DNA, 12 bp, Homo sapiens
atcctccagctt

SEQ ID NO: 3202666 - DNA, 14 bp, Homo sapiens
atcctccagcttct

SEQ ID NO: 3202667 - DNA, 19 bp, Homo sapiens
atcctccagtaccttgctt

SEQ ID NO: 3202668 - DNA, 20 bp, Homo sapiens
atcctccagtaccttgcttc

SEQ ID NO: 3202669 - DNA, 18 bp, Homo sapiens
atcctcccacctcagcct

SEQ ID NO: 3202670 - DNA, 20 bp, Homo sapiens
atcctcccacctcagcctcc

SEQ ID NO: 3202671 - DNA, 16 bp, Homo sapiens
atcctccctggcagac

SEQ ID NO: 3202672 - DNA, 19 bp, Homo sapiens
atcctccctggcagacaca

SEQ ID NO: 3202673 - DNA, 16 bp, Homo sapiens
atcctcctcagccccc

SEQ ID NO: 3202674 - DNA, 22 bp, Homo sapiens
atcctcctcagcccccaggcca

SEQ ID NO: 3202675 - DNA, 12 bp, Homo sapiens
atcctcctggaa

SEQ ID NO: 3202676 - DNA, 16 bp, Homo sapiens
atcctcctggaacctt

SEQ ID NO: 3202677 - DNA, 16 bp, Homo sapiens
atcctctactgtgcat

SEQ ID NO: 3202678 - DNA, 23 bp, Homo sapiens
atcctctataattagttatgaca

SEQ ID NO: 3202679 - DNA, 19 bp, Homo sapiens
atcctctattttgtgatga

SEQ ID NO: 3202680 - DNA, 16 bp, Homo sapiens
atcctctcacctcagc

SEQ ID NO: 3202681 - DNA, 14 bp, Homo sapiens
atcctctcctttga

SEQ ID NO: 3202682 - DNA, 15 bp, Homo sapiens
atcctctcctttgaa

SEQ ID NO: 3202683 - DNA, 19 bp, Homo sapiens
atcctctggttcttcattt

SEQ ID NO: 3202684 - DNA, 14 bp, Homo sapiens
atcctctttgtaat

SEQ ID NO: 3202685 - DNA, 22 bp, Homo sapiens
atcctctttgtaatttaatgaa

SEQ ID NO: 3202686 - DNA, 16 bp, Homo sapiens
atcctgaaagggcact

SEQ ID NO: 3202687 - DNA, 20 bp, Homo sapiens
atcctgaactttctccctca

SEQ ID NO: 3202688 - DNA, 17 bp, Homo sapiens
atcctgaatctgtgcaa

SEQ ID NO: 3202689 - DNA, 12 bp, Homo sapiens
atcctgagccat

SEQ ID NO: 3202690 - DNA, 24 bp, Homo sapiens
atcctgagccatcggtgaaactaa

SEQ ID NO: 3202691 - DNA, 23 bp, Homo sapiens
atcctgagccccgccctcttcct

SEQ ID NO: 3202692 - DNA, 18 bp, Homo sapiens
atcctgaggctccacttg

SEQ ID NO: 3202693 - DNA, 22 bp, Homo sapiens
atcctgcaggaacgagcactgg

SEQ ID NO: 3202694 - DNA, 17 bp, Homo sapiens
atcctgccagccccaca

SEQ ID NO: 3202695 - DNA, 22 bp, Homo sapiens
atcctgccagccccacacagct

SEQ ID NO: 3202696 - DNA, 15 bp, Homo sapiens
atcctgcccagtgtt

SEQ ID NO: 3202697 - DNA, 22 bp, Homo sapiens
atcctgcccagtgttgtttgta

SEQ ID NO: 3202698 - DNA, 15 bp, Homo sapiens
atcctgcctgggtgg

SEQ ID NO: 3202699 - DNA, 20 bp, Homo sapiens
atcctgcctgggtgggacag

SEQ ID NO: 3202700 - DNA, 16 bp, Homo sapiens
atcctggagaagcctc

SEQ ID NO: 3202701 - DNA, 23 bp, Homo sapiens
atcctggatgatttcatcttctg

SEQ ID NO: 3202702 - DNA, 22 bp, Homo sapiens
atcctggcacccggcccctgct

SEQ ID NO: 3202703 - DNA, 23 bp, Homo sapiens
atcctggcacccggcccctgctg

SEQ ID NO: 3202704 - DNA, 12 bp, Homo sapiens
atcctggcagcc

SEQ ID NO: 3202705 - DNA, 15 bp, Homo sapiens
atcctggcagcccag

SEQ ID NO: 3202706 - DNA, 19 bp, Homo sapiens
atcctggcagcccagagac

SEQ ID NO: 3202707 - DNA, 16 bp, Homo sapiens
atcctggggccctcag

SEQ ID NO: 3202708 - DNA, 21 bp, Homo sapiens
atcctgggggacccaatgtag

SEQ ID NO: 3202709 - DNA, 12 bp, Homo sapiens
atcctgggtaat

SEQ ID NO: 3202710 - DNA, 18 bp, Homo sapiens
atcctgtaccaaatctga

SEQ ID NO: 3202711 - DNA, 20 bp, Homo sapiens
atcctgtaccaaatctgaca

SEQ ID NO: 3202712 - DNA, 15 bp, Homo sapiens
atcctgtctttctga

SEQ ID NO: 3202713 - DNA, 15 bp, Homo sapiens
atcctgtgacatgta

SEQ ID NO: 3202714 - DNA, 18 bp, Homo sapiens
atcctgtgccagaggaag

SEQ ID NO: 3202715 - DNA, 23 bp, Homo sapiens
atcctgtgccagaggaaggaaaa

SEQ ID NO: 3202716 - DNA, 20 bp, Homo sapiens
atcctgtgtcagaaaccctg

SEQ ID NO: 3202717 - DNA, 13 bp, Homo sapiens
atcctgttttctc

SEQ ID NO: 3202718 - DNA, 16 bp, Homo sapiens
atcctgttttctctgt

SEQ ID NO: 3202719 - DNA, 18 bp, Homo sapiens
atcctgttttctctgtga

SEQ ID NO: 3202720 - DNA, 13 bp, Homo sapiens
atccttagaggtc

SEQ ID NO: 3202721 - DNA, 18 bp, Homo sapiens
atccttccaaagaattct

SEQ ID NO: 3202722 - DNA, 22 bp, Homo sapiens
atccttccaaagaattcttata

SEQ ID NO: 3202723 - DNA, 14 bp, Homo sapiens
atccttccagtggc

SEQ ID NO: 3202724 - DNA, 11 bp, Homo sapiens
atccttcccca

SEQ ID NO: 3202725 - DNA, 19 bp, Homo sapiens
atccttccccaacttccct

SEQ ID NO: 3202726 - DNA, 16 bp, Homo sapiens
atccttccctttggag

SEQ ID NO: 3202727 - DNA, 21 bp, Homo sapiens
atccttccctttggagatgct

SEQ ID NO: 3202728 - DNA, 12 bp, Homo sapiens
atccttcctata

SEQ ID NO: 3202729 - DNA, 11 bp, Homo sapiens
atccttccttc

SEQ ID NO: 3202730 - DNA, 12 bp, Homo sapiens
atccttccttca

SEQ ID NO: 3202731 - DNA, 23 bp, Homo sapiens
atccttctgcaactgaaattaca

SEQ ID NO: 3202732 - DNA, 20 bp, Homo sapiens
atcctttcaaaagaagagtt

SEQ ID NO: 3202733 - DNA, 13 bp, Homo sapiens
atcctttctaaca

SEQ ID NO: 3202734 - DNA, 17 bp, Homo sapiens
atcctttgatcccagaa

SEQ ID NO: 3202735 - DNA, 17 bp, Homo sapiens
atcctttgcagggcagc

SEQ ID NO: 3202736 - DNA, 19 bp, Homo sapiens
atcctttgttttctgacta

SEQ ID NO: 3202737 - DNA, 23 bp, Homo sapiens
atcctttgttttctgactaatta

SEQ ID NO: 3202738 - DNA, 15 bp, Homo sapiens
atccttttctgcaga

SEQ ID NO: 3202739 - DNA, 14 bp, Homo sapiens
atcgaaaaaataat

SEQ ID NO: 3202740 - DNA, 22 bp, Homo sapiens
atcgaaataacaatgttaagga

SEQ ID NO: 3202741 - DNA, 18 bp, Homo sapiens
atcgaatctactaattcc

SEQ ID NO: 3202742 - DNA, 15 bp, Homo sapiens
atcgagaccatcctg

SEQ ID NO: 3202743 - DNA, 15 bp, Homo sapiens
atcgatatgtatatc

SEQ ID NO: 3202744 - DNA, 22 bp, Homo sapiens
atcgcaggagtctctgccaccc

SEQ ID NO: 3202745 - DNA, 21 bp, Homo sapiens
atcgccaaggactgactgaga

SEQ ID NO: 3202746 - DNA, 20 bp, Homo sapiens
atcgccagaggtgcttcacc

SEQ ID NO: 3202747 - DNA, 17 bp, Homo sapiens
atcgcctgagcccagga

SEQ ID NO: 3202748 - DNA, 14 bp, Homo sapiens
atcgcttgagccca

SEQ ID NO: 3202749 - DNA, 15 bp, Homo sapiens
atcgcttgagcccag

SEQ ID NO: 3202750 - DNA, 19 bp, Homo sapiens
atcgcttgagcccaggagt

SEQ ID NO: 3202751 - DNA, 22 bp, Homo sapiens
atcggaagcagtgccttccata

SEQ ID NO: 3202752 - DNA, 15 bp, Homo sapiens
atcggagcctcctct

SEQ ID NO: 3202753 - DNA, 21 bp, Homo sapiens
atcggaggctgggcccctggg

SEQ ID NO: 3202754 - DNA, 21 bp, Homo sapiens
atcggatctggggctctggga

SEQ ID NO: 3202755 - DNA, 15 bp, Homo sapiens
atcgggaaagaagaa

SEQ ID NO: 3202756 - DNA, 16 bp, Homo sapiens
atcgggaaagaagaaa

SEQ ID NO: 3202757 - DNA, 15 bp, Homo sapiens
atcgggaacagtgtt

SEQ ID NO: 3202758 - DNA, 15 bp, Homo sapiens
atcgggagcacccag

SEQ ID NO: 3202759 - DNA, 16 bp, Homo sapiens
atcggggtagaaatgc

SEQ ID NO: 3202760 - DNA, 14 bp, Homo sapiens
atcgtcctgggact

SEQ ID NO: 3202761 - DNA, 18 bp, Homo sapiens
atcgtctcctttgacatt

SEQ ID NO: 3202762 - DNA, 23 bp, Homo sapiens
atcgtctcctttgacatttcctt

SEQ ID NO: 3202763 - DNA, 16 bp, Homo sapiens
atcgtgacccttcagg

SEQ ID NO: 3202764 - DNA, 14 bp, Homo sapiens
atcgtgctactgca

SEQ ID NO: 3202765 - DNA, 21 bp, Homo sapiens
atcgtgggtcactacagggag

SEQ ID NO: 3202766 - DNA, 22 bp, Homo sapiens
atcgttagtatctaacatgtat

SEQ ID NO: 3202767 - DNA, 14 bp, Homo sapiens
atcgtttttgtatt

SEQ ID NO: 3202768 - DNA, 13 bp, Homo sapiens
atctaaaacaaaa

SEQ ID NO: 3202769 - DNA, 20 bp, Homo sapiens
atctaaaacaaaatctgaac

SEQ ID NO: 3202770 - DNA, 17 bp, Homo sapiens
atctaaagtgtgttgtt

SEQ ID NO: 3202771 - DNA, 13 bp, Homo sapiens
atctaaatctatt

SEQ ID NO: 3202772 - DNA, 22 bp, Homo sapiens
atctaaatctatttattaatat

SEQ ID NO: 3202773 - DNA, 18 bp, Homo sapiens
atctaaatttcttttgct

SEQ ID NO: 3202774 - DNA, 20 bp, Homo sapiens
atctaacaataatatttcaa

SEQ ID NO: 3202775 - DNA, 15 bp, Homo sapiens
atctaacaatggaag

SEQ ID NO: 3202776 - DNA, 17 bp, Homo sapiens
atctaagaataataaaa

SEQ ID NO: 3202777 - DNA, 18 bp, Homo sapiens
atctaaggatgtcacagg

SEQ ID NO: 3202778 - DNA, 21 bp, Homo sapiens
atctaagtgcctcacattttt

SEQ ID NO: 3202779 - DNA, 15 bp, Homo sapiens
atctaatacctctgt

SEQ ID NO: 3202780 - DNA, 19 bp, Homo sapiens
atctaatacctctgtgtgc

SEQ ID NO: 3202781 - DNA, 22 bp, Homo sapiens
atctaatacctctgtgtgctcc

SEQ ID NO: 3202782 - DNA, 17 bp, Homo sapiens
atctaatatatatgaat

SEQ ID NO: 3202783 - DNA, 18 bp, Homo sapiens
atctaatatatatgaata

SEQ ID NO: 3202784 - DNA, 19 bp, Homo sapiens
atctaatatatatgaataa

SEQ ID NO: 3202785 - DNA, 16 bp, Homo sapiens
atctaatatggccaca

SEQ ID NO: 3202786 - DNA, 23 bp, Homo sapiens
atctaatatggccacagtagtct

SEQ ID NO: 3202787 - DNA, 18 bp, Homo sapiens
atctaatatgtaacaagc

SEQ ID NO: 3202788 - DNA, 23 bp, Homo sapiens
atctaatatgtaacaagccaccc

SEQ ID NO: 3202789 - DNA, 17 bp, Homo sapiens
atctaatgcttgtttat

SEQ ID NO: 3202790 - DNA, 16 bp, Homo sapiens
atatttcacaggctgt

SEQ ID NO: 3202791 - DNA, 18 bp, Homo sapiens
atatttccatatggattt

SEQ ID NO: 3202792 - DNA, 21 bp, Homo sapiens
atatttcccatttgtgccaga

SEQ ID NO: 3202793 - DNA, 16 bp, Homo sapiens
atatttccccttggac

SEQ ID NO: 3202794 - DNA, 15 bp, Homo sapiens
atatttcctgacttg

SEQ ID NO: 3202795 - DNA, 15 bp, Homo sapiens
atatttcgaaagctg

SEQ ID NO: 3202796 - DNA, 13 bp, Homo sapiens
atatttctcataa

SEQ ID NO: 3202797 - DNA, 14 bp, Homo sapiens
atatttcttgcttt

SEQ ID NO: 3202798 - DNA, 10 bp, Homo sapiens
atatttgaat

SEQ ID NO: 3202799 - DNA, 16 bp, Homo sapiens
atatttgaatgaaaac

SEQ ID NO: 3202800 - DNA, 16 bp, Homo sapiens
atatttgatatttggt

SEQ ID NO: 3202801 - DNA, 23 bp, Homo sapiens
atatttgcagtttttcattttaa

SEQ ID NO: 3202802 - DNA, 15 bp, Homo sapiens
atatttgccaataaa

SEQ ID NO: 3202803 - DNA, 13 bp, Homo sapiens
atatttgcttttt

SEQ ID NO: 3202804 - DNA, 14 bp, Homo sapiens
atatttggaaagag

SEQ ID NO: 3202805 - DNA, 15 bp, Homo sapiens
atatttggaaagaga

SEQ ID NO: 3202806 - DNA, 16 bp, Homo sapiens
atatttggaaagagac

SEQ ID NO: 3202807 - DNA, 21 bp, Homo sapiens
atatttggaagaaaaaaatct

SEQ ID NO: 3202808 - DNA, 23 bp, Homo sapiens
atatttggaagaaaaaaatcttc

SEQ ID NO: 3202809 - DNA, 17 bp, Homo sapiens
atatttggttatttaat

SEQ ID NO: 3202810 - DNA, 11 bp, Homo sapiens
atatttgtaca

SEQ ID NO: 3202811 - DNA, 18 bp, Homo sapiens
atatttgtagatttatcc

SEQ ID NO: 3202812 - DNA, 21 bp, Homo sapiens
atatttgtcatgctgggattt

SEQ ID NO: 3202813 - DNA, 17 bp, Homo sapiens
atatttgtgctatttaa

SEQ ID NO: 3202814 - DNA, 15 bp, Homo sapiens
atatttgttatgtag

SEQ ID NO: 3202815 - DNA, 15 bp, Homo sapiens
atattttagaagcta

SEQ ID NO: 3202816 - DNA, 14 bp, Homo sapiens
atattttagcattt

SEQ ID NO: 3202817 - DNA, 23 bp, Homo sapiens
atattttagcattttaattctct

SEQ ID NO: 3202818 - DNA, 22 bp, Homo sapiens
atattttatataaagtattctt

SEQ ID NO: 3202819 - DNA, 15 bp, Homo sapiens
atattttatgtgaga

SEQ ID NO: 3202820 - DNA, 19 bp, Homo sapiens
atattttcaacgcagccct

SEQ ID NO: 3202821 - DNA, 13 bp, Homo sapiens
atattttcacaat

SEQ ID NO: 3202822 - DNA, 21 bp, Homo sapiens
atattttcctagtagatctat

SEQ ID NO: 3202823 - DNA, 13 bp, Homo sapiens
atattttccttta

SEQ ID NO: 3202824 - DNA, 18 bp, Homo sapiens
atattttctctgtacttt

SEQ ID NO: 3202825 - DNA, 19 bp, Homo sapiens
atattttcttccaagcaaa

SEQ ID NO: 3202826 - DNA, 18 bp, Homo sapiens
atattttctttaatgctt

SEQ ID NO: 3202827 - DNA, 23 bp, Homo sapiens
atattttgataataaattgaaat

SEQ ID NO: 3202828 - DNA, 14 bp, Homo sapiens
atattttgctgttt

SEQ ID NO: 3202829 - DNA, 13 bp, Homo sapiens
atattttggaaac

SEQ ID NO: 3202830 - DNA, 23 bp, Homo sapiens
atattttggaaactgctaaattc

SEQ ID NO: 3202831 - DNA, 13 bp, Homo sapiens
atattttgtgtga

SEQ ID NO: 3202832 - DNA, 18 bp, Homo sapiens
atattttgtgtgaaattg

SEQ ID NO: 3202833 - DNA, 15 bp, Homo sapiens
atatttttaataaaa

SEQ ID NO: 3202834 - DNA, 19 bp, Homo sapiens
atatttttaataaaagttg

SEQ ID NO: 3202835 - DNA, 22 bp, Homo sapiens
atatttttatctttatatgaag

SEQ ID NO: 3202836 - DNA, 14 bp, Homo sapiens
atatttttccattt

SEQ ID NO: 3202837 - DNA, 16 bp, Homo sapiens
atatttttgatggtaa

SEQ ID NO: 3202838 - DNA, 15 bp, Homo sapiens
atatttttggggcat

SEQ ID NO: 3202839 - DNA, 15 bp, Homo sapiens
atatttttgtacata

SEQ ID NO: 3202840 - DNA, 14 bp, Homo sapiens
atatttttgtactt

SEQ ID NO: 3202841 - DNA, 22 bp, Homo sapiens
atatttttgtgttttcttgtaa

SEQ ID NO: 3202842 - DNA, 18 bp, Homo sapiens
atattttttcagaaatat

SEQ ID NO: 3202843 - DNA, 16 bp, Homo sapiens
atattttttgcttttg

SEQ ID NO: 3202844 - DNA, 21 bp, Homo sapiens
atatttttttaaaatgttaaa

SEQ ID NO: 3202845 - DNA, 17 bp, Homo sapiens
atcaaaaaaagactcag

SEQ ID NO: 3202846 - DNA, 20 bp, Homo sapiens
atcaaaaaaagactcagcca

SEQ ID NO: 3202847 - DNA, 14 bp, Homo sapiens
atcaaaacacacta

SEQ ID NO: 3202848 - DNA, 21 bp, Homo sapiens
atcaaaatccctatttaattt

SEQ ID NO: 3202849 - DNA, 12 bp, Homo sapiens
atcaaaatgctt

SEQ ID NO: 3202850 - DNA, 13 bp, Homo sapiens
atcaaaatgcttt

SEQ ID NO: 3202851 - DNA, 14 bp, Homo sapiens
atcaaaattacata

SEQ ID NO: 3202852 - DNA, 23 bp, Homo sapiens
atcaaacagccccagtcttcctt

SEQ ID NO: 3202853 - DNA, 22 bp, Homo sapiens
atcaaaccctagccttgcttgt

SEQ ID NO: 3202854 - DNA, 13 bp, Homo sapiens
atcaaagaattac

SEQ ID NO: 3202855 - DNA, 16 bp, Homo sapiens
atcaaagaattacagt

SEQ ID NO: 3202856 - DNA, 17 bp, Homo sapiens
atcaaagaattacagta

SEQ ID NO: 3202857 - DNA, 15 bp, Homo sapiens
atcaaagcaagggct

SEQ ID NO: 3202858 - DNA, 23 bp, Homo sapiens
atcaaagcacttggactcttgct

SEQ ID NO: 3202859 - DNA, 17 bp, Homo sapiens
atcaaagcatagatgtt

SEQ ID NO: 3202860 - DNA, 16 bp, Homo sapiens
atcaaagccagggtct

SEQ ID NO: 3202861 - DNA, 13 bp, Homo sapiens
atcaaagcctggc

SEQ ID NO: 3202862 - DNA, 13 bp, Homo sapiens
atcaaagtatttg

SEQ ID NO: 3202863 - DNA, 14 bp, Homo sapiens
atcaaataaatttc

SEQ ID NO: 3202864 - DNA, 17 bp, Homo sapiens
atcaaataaatttctgg

SEQ ID NO: 3202865 - DNA, 15 bp, Homo sapiens
atcaaataagaaata

SEQ ID NO: 3202866 - DNA, 17 bp, Homo sapiens
atcaaataagtatttat

SEQ ID NO: 3202867 - DNA, 21 bp, Homo sapiens
atcaaatagaaccactatgaa

SEQ ID NO: 3202868 - DNA, 20 bp, Homo sapiens
atcaaatctaccactgtatg

SEQ ID NO: 3202869 - DNA, 14 bp, Homo sapiens
atcaaatgatttca

SEQ ID NO: 3202870 - DNA, 20 bp, Homo sapiens
atcaaatgatttcatattga

SEQ ID NO: 3202871 - DNA, 21 bp, Homo sapiens
atcaaatgatttcatattgat

SEQ ID NO: 3202872 - DNA, 18 bp, Homo sapiens
atcaaattctacaacttt

SEQ ID NO: 3202873 - DNA, 12 bp, Homo sapiens
atcaaattctat

SEQ ID NO: 3202874 - DNA, 21 bp, Homo sapiens
atcaaattttgagcaaagaaa

SEQ ID NO: 3202875 - DNA, 22 bp, Homo sapiens
atcaacagaagcatttgtattt

SEQ ID NO: 3202876 - DNA, 15 bp, Homo sapiens
atcaaccaccatgga

SEQ ID NO: 3202877 - DNA, 19 bp, Homo sapiens
atcaaccccttcgctcctg

SEQ ID NO: 3202878 - DNA, 22 bp, Homo sapiens
atcaaccccttcgctcctgtgt

SEQ ID NO: 3202879 - DNA, 16 bp, Homo sapiens
atcaaccctctcctgt

SEQ ID NO: 3202880 - DNA, 13 bp, Homo sapiens
atcaactctaata

SEQ ID NO: 3202881 - DNA, 13 bp, Homo sapiens
atcaactgaatga

SEQ ID NO: 3202882 - DNA, 14 bp, Homo sapiens
atcaactttactgt

SEQ ID NO: 3202883 - DNA, 16 bp, Homo sapiens
atcaagaaatactttc

SEQ ID NO: 3202884 - DNA, 18 bp, Homo sapiens
atcaagatgtcagactgg

SEQ ID NO: 3202885 - DNA, 15 bp, Homo sapiens
atcaagcactaaaaa

SEQ ID NO: 3202886 - DNA, 17 bp, Homo sapiens
atcaagcttttctgtag

SEQ ID NO: 3202887 - DNA, 21 bp, Homo sapiens
atcaaggactctggtttctca

SEQ ID NO: 3202888 - DNA, 21 bp, Homo sapiens
atcaaggcaaaaatatcagga

SEQ ID NO: 3202889 - DNA, 21 bp, Homo sapiens
atcaagtatttgggaagtgaa

SEQ ID NO: 3202890 - DNA, 17 bp, Homo sapiens
atcaagtcaatcatttc

SEQ ID NO: 3202891 - DNA, 18 bp, Homo sapiens
atcaagtcaatcatttct

SEQ ID NO: 3202892 - DNA, 12 bp, Homo sapiens
atcaagtcaccg

SEQ ID NO: 3202893 - DNA, 16 bp, Homo sapiens
atcaataaaatgtgat

SEQ ID NO: 3202894 - DNA, 23 bp, Homo sapiens
atcagctgctactactcctgtag

SEQ ID NO: 3202895 - DNA, 22 bp, Homo sapiens
atcaggaatattttccaaagag

SEQ ID NO: 3202896 - DNA, 12 bp, Homo sapiens
atcaggatgaac

SEQ ID NO: 3202897 - DNA, 13 bp, Homo sapiens
atcaggatgaacc

SEQ ID NO: 3202898 - DNA, 18 bp, Homo sapiens
atcaggatgaacccagga

SEQ ID NO: 3202899 - DNA, 19 bp, Homo sapiens
atcaggatgaacccaggac

SEQ ID NO: 3202900 - DNA, 22 bp, Homo sapiens
atcaggcacccggggccagaga

SEQ ID NO: 3202901 - DNA, 23 bp, Homo sapiens
atcaggcacccggggccagagac

SEQ ID NO: 3202902 - DNA, 14 bp, Homo sapiens
atcagggaatccag

SEQ ID NO: 3202903 - DNA, 18 bp, Homo sapiens
atcagggaatccagctcc

SEQ ID NO: 3202904 - DNA, 19 bp, Homo sapiens
atcagggaatccagctccc

SEQ ID NO: 3202905 - DNA, 13 bp, Homo sapiens
atcagggaccagc

SEQ ID NO: 3202906 - DNA, 13 bp, Homo sapiens
atcagggcctggg

SEQ ID NO: 3202907 - DNA, 14 bp, Homo sapiens
atcagggcctgggg

SEQ ID NO: 3202908 - DNA, 19 bp, Homo sapiens
atcagggcctggggcctga

SEQ ID NO: 3202909 - DNA, 21 bp, Homo sapiens
atcagggcctggggcctgaga

SEQ ID NO: 3202910 - DNA, 23 bp, Homo sapiens
atcagggcctggggcctgagaga

SEQ ID NO: 3202911 - DNA, 15 bp, Homo sapiens
atcaggttccatccc

SEQ ID NO: 3202912 - DNA, 22 bp, Homo sapiens
atcagtaacccccttaaattta

SEQ ID NO: 3202913 - DNA, 23 bp, Homo sapiens
atcagtaagaggtgttatttgga

SEQ ID NO: 3202914 - DNA, 15 bp, Homo sapiens
atcagtaatatttat

SEQ ID NO: 3202915 - DNA, 14 bp, Homo sapiens
atcagtataaacaa

SEQ ID NO: 3202916 - DNA, 18 bp, Homo sapiens
atcagtataaacaaagtt

SEQ ID NO: 3202917 - DNA, 15 bp, Homo sapiens
atcagtattaatact

SEQ ID NO: 3202918 - DNA, 21 bp, Homo sapiens
atcagtatttttttttaattt

SEQ ID NO: 3202919 - DNA, 15 bp, Homo sapiens
atcagtcccctccca

SEQ ID NO: 3202920 - DNA, 23 bp, Homo sapiens
atcagtcccctcccatctgggag

SEQ ID NO: 3202921 - DNA, 19 bp, Homo sapiens
atcagtctgattcccaagc

SEQ ID NO: 3202922 - DNA, 22 bp, Homo sapiens
atcagtgatctatgtttgtgtg

SEQ ID NO: 3202923 - DNA, 22 bp, Homo sapiens
atcagtgggcaggataaactga

SEQ ID NO: 3202924 - DNA, 20 bp, Homo sapiens
atcagtgttttaaattctga

SEQ ID NO: 3202925 - DNA, 20 bp, Homo sapiens
atccaaattgtgcttctccc

SEQ ID NO: 3202926 - DNA, 23 bp, Homo sapiens
atccaaattgtgcttctccccag

SEQ ID NO: 3202927 - DNA, 19 bp, Homo sapiens
atccaacacaactatcaaa

SEQ ID NO: 3202928 - DNA, 17 bp, Homo sapiens
atccaaccattttcatt

SEQ ID NO: 3202929 - DNA, 15 bp, Homo sapiens
atccaactccagcaa

SEQ ID NO: 3202930 - DNA, 16 bp, Homo sapiens
atccaactctctgaga

SEQ ID NO: 3202931 - DNA, 15 bp, Homo sapiens
atccaagattctgct

SEQ ID NO: 3202932 - DNA, 15 bp, Homo sapiens
atccaagcctccaca

SEQ ID NO: 3202933 - DNA, 19 bp, Homo sapiens
atccaagcctccacagcga

SEQ ID NO: 3202934 - DNA, 13 bp, Homo sapiens
atccaagctccct

SEQ ID NO: 3202935 - DNA, 18 bp, Homo sapiens
atccaagctccctgcccc

SEQ ID NO: 3202936 - DNA, 15 bp, Homo sapiens
atccaaggcaaacaa

SEQ ID NO: 3202937 - DNA, 18 bp, Homo sapiens
atccaaggcaaacaatcc

SEQ ID NO: 3202938 - DNA, 17 bp, Homo sapiens
atccaatcctcactggg

SEQ ID NO: 3202939 - DNA, 18 bp, Homo sapiens
atccaatcctcactgggt

SEQ ID NO: 3202940 - DNA, 20 bp, Homo sapiens
atccaattgatgtatatgtt

SEQ ID NO: 3202941 - DNA, 17 bp, Homo sapiens
atccacaaaagaagtga

SEQ ID NO: 3202942 - DNA, 13 bp, Homo sapiens
atccacagagagt

SEQ ID NO: 3202943 - DNA, 19 bp, Homo sapiens
atccacagagagtcccact

SEQ ID NO: 3202944 - DNA, 15 bp, Homo sapiens
atccacatttctaaa

SEQ ID NO: 3202945 - DNA, 20 bp, Homo sapiens
atccacccagtgctgccatg

SEQ ID NO: 3202946 - DNA, 10 bp, Homo sapiens
atccacccca

SEQ ID NO: 3202947 - DNA, 15 bp, Homo sapiens
atccaccccctgccc

SEQ ID NO: 3202948 - DNA, 15 bp, Homo sapiens
atccaccttggctct

SEQ ID NO: 3202949 - DNA, 19 bp, Homo sapiens
atccactctaccctcccac

SEQ ID NO: 3202950 - DNA, 20 bp, Homo sapiens
atccactctaccctcccacc

SEQ ID NO: 3202951 - DNA, 12 bp, Homo sapiens
atccactttgca

SEQ ID NO: 3202952 - DNA, 16 bp, Homo sapiens
atccagacatcatgaa

SEQ ID NO: 3202953 - DNA, 21 bp, Homo sapiens
atccagacatcatgaatttta

SEQ ID NO: 3202954 - DNA, 18 bp, Homo sapiens
atccagatccagactgta

SEQ ID NO: 3202955 - DNA, 12 bp, Homo sapiens
atccagccactt

SEQ ID NO: 3202956 - DNA, 19 bp, Homo sapiens
atccagccggaggccagag

SEQ ID NO: 3202957 - DNA, 16 bp, Homo sapiens
atccaggcaccaggac

SEQ ID NO: 3202958 - DNA, 21 bp, Homo sapiens
atccaggtcatgcagttcctg

SEQ ID NO: 3202959 - DNA, 19 bp, Homo sapiens
atccaggttccctcccaga

SEQ ID NO: 3202960 - DNA, 20 bp, Homo sapiens
atccagtttgttctccgggt

SEQ ID NO: 3202961 - DNA, 22 bp, Homo sapiens
atccctgccacatacaggtgct

SEQ ID NO: 3202962 - DNA, 23 bp, Homo sapiens
atccctgccacatacaggtgctc

SEQ ID NO: 3202963 - DNA, 19 bp, Homo sapiens
atccctgcggcctccacac

SEQ ID NO: 3202964 - DNA, 18 bp, Homo sapiens
atccctggagcaggagcc

SEQ ID NO: 3202965 - DNA, 22 bp, Homo sapiens
atccctggagcaggagccccgc

SEQ ID NO: 3202966 - DNA, 18 bp, Homo sapiens
atccctgggcattgcttt

SEQ ID NO: 3202967 - DNA, 11 bp, Homo sapiens
atccctgggcc

SEQ ID NO: 3202968 - DNA, 21 bp, Homo sapiens
atccctgggcccctccacgcc

SEQ ID NO: 3202969 - DNA, 12 bp, Homo sapiens
atccctgtgagg

SEQ ID NO: 3202970 - DNA, 18 bp, Homo sapiens
atccctgtgttgtctcta

SEQ ID NO: 3202971 - DNA, 19 bp, Homo sapiens
atccctgttacccagagaa

SEQ ID NO: 3202972 - DNA, 13 bp, Homo sapiens
atccctgtttaat

SEQ ID NO: 3202973 - DNA, 15 bp, Homo sapiens
atccctgtttaatat

SEQ ID NO: 3202974 - DNA, 16 bp, Homo sapiens
atccctgtttaatatt

SEQ ID NO: 3202975 - DNA, 13 bp, Homo sapiens
atcccttaaaatt

SEQ ID NO: 3202976 - DNA, 14 bp, Homo sapiens
atcccttcctggaa

SEQ ID NO: 3202977 - DNA, 14 bp, Homo sapiens
atcccttctcacag

SEQ ID NO: 3202978 - DNA, 13 bp, Homo sapiens
atccctttattac

SEQ ID NO: 3202979 - DNA, 12 bp, Homo sapiens
atccctttctcc

SEQ ID NO: 3202980 - DNA, 13 bp, Homo sapiens
atcccttttcctg

SEQ ID NO: 3202981 - DNA, 14 bp, Homo sapiens
atcccttttcctgt

SEQ ID NO: 3202982 - DNA, 17 bp, Homo sapiens
atcccttttcctgtcag

SEQ ID NO: 3202983 - DNA, 17 bp, Homo sapiens
atccgactctaagctgt

SEQ ID NO: 3202984 - DNA, 18 bp, Homo sapiens
atccgccttttgtataca

SEQ ID NO: 3202985 - DNA, 23 bp, Homo sapiens
atccgctggccgggggaggtggg

SEQ ID NO: 3202986 - DNA, 21 bp, Homo sapiens
atccggtcccctgcctggaac

SEQ ID NO: 3202987 - DNA, 19 bp, Homo sapiens
atccgtcattgctgctgct

SEQ ID NO: 3202988 - DNA, 18 bp, Homo sapiens
atcctaactgaagagaca

SEQ ID NO: 3202989 - DNA, 14 bp, Homo sapiens
atcctaagacacaa

SEQ ID NO: 3202990 - DNA, 20 bp, Homo sapiens
atcctaagacacaaatgcat

SEQ ID NO: 3202991 - DNA, 18 bp, Homo sapiens
atcctaagcatctaagtt

SEQ ID NO: 3202992 - DNA, 12 bp, Homo sapiens
atcctaagctat

SEQ ID NO: 3202993 - DNA, 19 bp, Homo sapiens
atcctaagggtcgaaagct

SEQ ID NO: 3202994 - DNA, 22 bp, Homo sapiens
atcctaagggtcgaaagctcta

SEQ ID NO: 3202995 - DNA, 16 bp, Homo sapiens
atcctacaatatttta

SEQ ID NO: 3202996 - DNA, 14 bp, Homo sapiens
atcctacagtacaa

SEQ ID NO: 3202997 - DNA, 16 bp, Homo sapiens
atcctacctgttttgt

SEQ ID NO: 3202998 - DNA, 15 bp, Homo sapiens
atcctagacttgaaa

SEQ ID NO: 3202999 - DNA, 18 bp, Homo sapiens
atcctagtttcctctcct

SEQ ID NO: 3203000 - DNA, 18 bp, Homo sapiens
atcctatccactgggcac

SEQ ID NO: 3203001 - DNA, 18 bp, Homo sapiens
atcctcaaacatggaaga

SEQ ID NO: 3203002 - DNA, 18 bp, Homo sapiens
atcctcaaagaaagtgta

SEQ ID NO: 3203003 - DNA, 16 bp, Homo sapiens
atggaaaaatggttga

SEQ ID NO: 3203004 - DNA, 12 bp, Homo sapiens
atggaaaaggaa

SEQ ID NO: 3203005 - DNA, 14 bp, Homo sapiens
atggaaaataaaca

SEQ ID NO: 3203006 - DNA, 13 bp, Homo sapiens
atggaaacactga

SEQ ID NO: 3203007 - DNA, 16 bp, Homo sapiens
atggaaacactgattt

SEQ ID NO: 3203008 - DNA, 17 bp, Homo sapiens
atggaaacactgatttt

SEQ ID NO: 3203009 - DNA, 23 bp, Homo sapiens
atggaaacctgaaaaaaagttta

SEQ ID NO: 3203010 - DNA, 12 bp, Homo sapiens
atggaaagaggt

SEQ ID NO: 3203011 - DNA, 20 bp, Homo sapiens
atggaaagaggtgaaaatga

SEQ ID NO: 3203012 - DNA, 15 bp, Homo sapiens
atggaaccttccctc

SEQ ID NO: 3203013 - DNA, 18 bp, Homo sapiens
atggaaccttccctccaa

SEQ ID NO: 3203014 - DNA, 21 bp, Homo sapiens
atggaaccttccctccaaatt

SEQ ID NO: 3203015 - DNA, 15 bp, Homo sapiens
atggaactactgtac

SEQ ID NO: 3203016 - DNA, 13 bp, Homo sapiens
atggaagagaaat

SEQ ID NO: 3203017 - DNA, 16 bp, Homo sapiens
atggaagattttaaat

SEQ ID NO: 3203018 - DNA, 17 bp, Homo sapiens
atggaagcaaagtgctg

SEQ ID NO: 3203019 - DNA, 16 bp, Homo sapiens
atggaaggagacttag

SEQ ID NO: 3203020 - DNA, 17 bp, Homo sapiens
atggaagtaaagcctca

SEQ ID NO: 3203021 - DNA, 13 bp, Homo sapiens
atggaataaaagg

SEQ ID NO: 3203022 - DNA, 14 bp, Homo sapiens
atggaataacatgt

SEQ ID NO: 3203023 - DNA, 16 bp, Homo sapiens
atggaatacagtgtta

SEQ ID NO: 3203024 - DNA, 16 bp, Homo sapiens
atggaatatcatctgt

SEQ ID NO: 3203025 - DNA, 21 bp, Homo sapiens
atggaatcccactgtatgatt

SEQ ID NO: 3203026 - DNA, 18 bp, Homo sapiens
atggaatcgatttcctcc

SEQ ID NO: 3203027 - DNA, 14 bp, Homo sapiens
atggaatcttctcc

SEQ ID NO: 3203028 - DNA, 23 bp, Homo sapiens
atggaattattttgaatgtcaca

SEQ ID NO: 3203029 - DNA, 14 bp, Homo sapiens
atggaattgatttg

SEQ ID NO: 3203030 - DNA, 17 bp, Homo sapiens
atggaattgatttgcat

SEQ ID NO: 3203031 - DNA, 21 bp, Homo sapiens
atggaatttaatgctgaatat

SEQ ID NO: 3203032 - DNA, 13 bp, Homo sapiens
atggacactccag

SEQ ID NO: 3203033 - DNA, 17 bp, Homo sapiens
atggacactccagtgcc

SEQ ID NO: 3203034 - DNA, 18 bp, Homo sapiens
atggacagggcatgccac

SEQ ID NO: 3203035 - DNA, 21 bp, Homo sapiens
atggacagtgggcatcagcag

SEQ ID NO: 3203036 - DNA, 19 bp, Homo sapiens
atggacagttcacaccctg

SEQ ID NO: 3203037 - DNA, 15 bp, Homo sapiens
atggacatcctgtat

SEQ ID NO: 3203038 - DNA, 19 bp, Homo sapiens
atggacatgatcttcttta

SEQ ID NO: 3203039 - DNA, 13 bp, Homo sapiens
atggaccactttt

SEQ ID NO: 3203040 - DNA, 18 bp, Homo sapiens
atggacccaagataaaag

SEQ ID NO: 3203041 - DNA, 22 bp, Homo sapiens
atggacccacgaacgctcttag

SEQ ID NO: 3203042 - DNA, 18 bp, Homo sapiens
atggaccgggtgggcctg

SEQ ID NO: 3203043 - DNA, 20 bp, Homo sapiens
atggaccgggtgggcctggc

SEQ ID NO: 3203044 - DNA, 20 bp, Homo sapiens
atggactatctgtctggtgg

SEQ ID NO: 3203045 - DNA, 21 bp, Homo sapiens
atggactccagcctgcctggc

SEQ ID NO: 3203046 - DNA, 16 bp, Homo sapiens
atggactggcttggcc

SEQ ID NO: 3203047 - DNA, 17 bp, Homo sapiens
atggactggtttgagat

SEQ ID NO: 3203048 - DNA, 19 bp, Homo sapiens
atggacttatttcttcaaa

SEQ ID NO: 3203049 - DNA, 22 bp, Homo sapiens
atggacttgtatatttgtacaa

SEQ ID NO: 3203050 - DNA, 23 bp, Homo sapiens
atggacttgtatatttgtacaaa

SEQ ID NO: 3203051 - DNA, 19 bp, Homo sapiens
atggagaaagaagtggaga

SEQ ID NO: 3203052 - DNA, 20 bp, Homo sapiens
atggagaatctgctgcatag

SEQ ID NO: 3203053 - DNA, 18 bp, Homo sapiens
atggagactcctgccctg

SEQ ID NO: 3203054 - DNA, 21 bp, Homo sapiens
atggagactggtcctgtgtgc

SEQ ID NO: 3203055 - DNA, 16 bp, Homo sapiens
atggagagaattaaaa

SEQ ID NO: 3203056 - DNA, 15 bp, Homo sapiens
atggagagaggggaa

SEQ ID NO: 3203057 - DNA, 19 bp, Homo sapiens
atggagaggacagagcagg

SEQ ID NO: 3203058 - DNA, 14 bp, Homo sapiens
atggagcccaggcg

SEQ ID NO: 3203059 - DNA, 14 bp, Homo sapiens
atggagcctgctct

SEQ ID NO: 3203060 - DNA, 22 bp, Homo sapiens
atggagcctggcacaggactga

SEQ ID NO: 3203061 - DNA, 23 bp, Homo sapiens
atggagcgcacctgccccctggt

SEQ ID NO: 3203062 - DNA, 14 bp, Homo sapiens
atggagctgggcta

SEQ ID NO: 3203063 - DNA, 12 bp, Homo sapiens
atggaggaaaaa

SEQ ID NO: 3203064 - DNA, 13 bp, Homo sapiens
atggaggaaaaag

SEQ ID NO: 3203065 - DNA, 16 bp, Homo sapiens
atggaggccctcctgt

SEQ ID NO: 3203066 - DNA, 20 bp, Homo sapiens
atggaggccctcctgtgctg

SEQ ID NO: 3203067 - DNA, 16 bp, Homo sapiens
atggagggaataatac

SEQ ID NO: 3203068 - DNA, 14 bp, Homo sapiens
atggagggcttggc

SEQ ID NO: 3203069 - DNA, 15 bp, Homo sapiens
atggaggggaattca

SEQ ID NO: 3203070 - DNA, 16 bp, Homo sapiens
atggaggggggtgctg

SEQ ID NO: 3203071 - DNA, 17 bp, Homo sapiens
atggaggttctaaggcc

SEQ ID NO: 3203072 - DNA, 22 bp, Homo sapiens
atggaggttctcagagccaagt

SEQ ID NO: 3203073 - DNA, 17 bp, Homo sapiens
atggagtaatggtcacg

SEQ ID NO: 3203074 - DNA, 20 bp, Homo sapiens
atggagtccagggaagagaa

SEQ ID NO: 3203075 - DNA, 18 bp, Homo sapiens
atggagtgtgtattgttc

SEQ ID NO: 3203076 - DNA, 14 bp, Homo sapiens
atggagtttctaag

SEQ ID NO: 3203077 - DNA, 16 bp, Homo sapiens
atggataaactgagcc

SEQ ID NO: 3203078 - DNA, 18 bp, Homo sapiens
atggataacctatatgat

SEQ ID NO: 3203079 - DNA, 19 bp, Homo sapiens
atggatactacatctttaa

SEQ ID NO: 3203080 - DNA, 16 bp, Homo sapiens
atggatatcacacata

SEQ ID NO: 3203081 - DNA, 18 bp, Homo sapiens
atggatattattagaaat

SEQ ID NO: 3203082 - DNA, 15 bp, Homo sapiens
atggatcacaagatg

SEQ ID NO: 3203083 - DNA, 22 bp, Homo sapiens
atggatgaatctcccactccag

SEQ ID NO: 3203084 - DNA, 14 bp, Homo sapiens
atggatgattaaat

SEQ ID NO: 3203085 - DNA, 21 bp, Homo sapiens
atggatgattcagaaattgga

SEQ ID NO: 3203086 - DNA, 22 bp, Homo sapiens
atggatgcaaagtacaatgtgt

SEQ ID NO: 3203087 - DNA, 16 bp, Homo sapiens
atggatgcatttcaaa

SEQ ID NO: 3203088 - DNA, 20 bp, Homo sapiens
atggatgcatttcaaatgtt

SEQ ID NO: 3203089 - DNA, 15 bp, Homo sapiens
atggatggcacaatg

SEQ ID NO: 3203090 - DNA, 16 bp, Homo sapiens
atggatggcagactct

SEQ ID NO: 3203091 - DNA, 18 bp, Homo sapiens
atggattcattacagctt

SEQ ID NO: 3203092 - DNA, 16 bp, Homo sapiens
atggattctatttatt

SEQ ID NO: 3203093 - DNA, 19 bp, Homo sapiens
atggattctcagatattta

SEQ ID NO: 3203094 - DNA, 20 bp, Homo sapiens
atggattggattatttaata

SEQ ID NO: 3203095 - DNA, 20 bp, Homo sapiens
atggatttaatccattttta

SEQ ID NO: 3203096 - DNA, 18 bp, Homo sapiens
atggatttcttagagatt

SEQ ID NO: 3203097 - DNA, 14 bp, Homo sapiens
atggcaaaaatggc

SEQ ID NO: 3203098 - DNA, 15 bp, Homo sapiens
atggcaattttgtaa

SEQ ID NO: 3203099 - DNA, 12 bp, Homo sapiens
atggcagaaggg

SEQ ID NO: 3203100 - DNA, 13 bp, Homo sapiens
atggcagaaggga

SEQ ID NO: 3203101 - DNA, 16 bp, Homo sapiens
atggcagaagggaatt

SEQ ID NO: 3203102 - DNA, 12 bp, Homo sapiens
atggcagagcag

SEQ ID NO: 3203103 - DNA, 22 bp, Homo sapiens
atggcagagtttgtgtgttgtc

SEQ ID NO: 3203104 - DNA, 16 bp, Homo sapiens
atggtcacacactgat

SEQ ID NO: 3203105 - DNA, 19 bp, Homo sapiens
atggtcacacactgatgct

SEQ ID NO: 3203106 - DNA, 19 bp, Homo sapiens
atggtcagcgttgcatgtc

SEQ ID NO: 3203107 - DNA, 17 bp, Homo sapiens
atggtccaggatctcca

SEQ ID NO: 3203108 - DNA, 13 bp, Homo sapiens
atggtcccatcca

SEQ ID NO: 3203109 - DNA, 19 bp, Homo sapiens
atggtcctggggctctgtg

SEQ ID NO: 3203110 - DNA, 20 bp, Homo sapiens
atggtcctggggctctgtgc

SEQ ID NO: 3203111 - DNA, 17 bp, Homo sapiens
atggtcctttctggaag

SEQ ID NO: 3203112 - DNA, 15 bp, Homo sapiens
atggtctagaaatgc

SEQ ID NO: 3203113 - DNA, 16 bp, Homo sapiens
atggtgaaaatgtact

SEQ ID NO: 3203114 - DNA, 17 bp, Homo sapiens
atggtgaaatttattag

SEQ ID NO: 3203115 - DNA, 13 bp, Homo sapiens
atggtgagctggg

SEQ ID NO: 3203116 - DNA, 12 bp, Homo sapiens
atggtgaggctg

SEQ ID NO: 3203117 - DNA, 19 bp, Homo sapiens
atggtgatcctctattttg

SEQ ID NO: 3203118 - DNA, 21 bp, Homo sapiens
atggtgatcctctattttgtg

SEQ ID NO: 3203119 - DNA, 21 bp, Homo sapiens
atggtgcagagaagctggact

SEQ ID NO: 3203120 - DNA, 22 bp, Homo sapiens
atggtgcagagaagctggactt

SEQ ID NO: 3203121 - DNA, 14 bp, Homo sapiens
atggtgcctgagag

SEQ ID NO: 3203122 - DNA, 17 bp, Homo sapiens
atgtagatgtgcatttt

SEQ ID NO: 3203123 - DNA, 16 bp, Homo sapiens
atgtagcacataaact

SEQ ID NO: 3203124 - DNA, 18 bp, Homo sapiens
atgtagcattatgcaatt

SEQ ID NO: 3203125 - DNA, 20 bp, Homo sapiens
atgtagccagcagaactgaa

SEQ ID NO: 3203126 - DNA, 16 bp, Homo sapiens
atgtagcccatccttc

SEQ ID NO: 3203127 - DNA, 19 bp, Homo sapiens
atgtagccccctggcctct

SEQ ID NO: 3203128 - DNA, 23 bp, Homo sapiens
atgtagccccctggcctctgtgc

SEQ ID NO: 3203129 - DNA, 19 bp, Homo sapiens
atgtagctgaaacaaaaat

SEQ ID NO: 3203130 - DNA, 23 bp, Homo sapiens
atgtaggagctgccttggctcag

SEQ ID NO: 3203131 - DNA, 20 bp, Homo sapiens
atgtaggtaagactgtagat

SEQ ID NO: 3203132 - DNA, 17 bp, Homo sapiens
atgtagtaattgacatg

SEQ ID NO: 3203133 - DNA, 19 bp, Homo sapiens
atgtagtattaaaagttgc

SEQ ID NO: 3203134 - DNA, 23 bp, Homo sapiens
atgtctggagtggtaacagctct

SEQ ID NO: 3203135 - DNA, 22 bp, Homo sapiens
atgtctgtaataaataaatata

SEQ ID NO: 3203136 - DNA, 20 bp, Homo sapiens
atgtctgtaatcatgtactt

SEQ ID NO: 3203137 - DNA, 18 bp, Homo sapiens
atgtctgtagctcctcaa

SEQ ID NO: 3203138 - DNA, 13 bp, Homo sapiens
atgtctgttacca

SEQ ID NO: 3203139 - DNA, 11 bp, Homo sapiens
atgtcttattt

SEQ ID NO: 3203140 - DNA, 15 bp, Homo sapiens
atgtcttatttttag

SEQ ID NO: 3203141 - DNA, 15 bp, Homo sapiens
atgtcttcataaagt

SEQ ID NO: 3203142 - DNA, 19 bp, Homo sapiens
atgtcttcatttcattgta

SEQ ID NO: 3203143 - DNA, 18 bp, Homo sapiens
atgtcttccatgtatctt

SEQ ID NO: 3203144 - DNA, 15 bp, Homo sapiens
atgtcttcttttgtg

SEQ ID NO: 3203145 - DNA, 20 bp, Homo sapiens
atgtcttggaacattggaat

SEQ ID NO: 3203146 - DNA, 20 bp, Homo sapiens
atgtcttggacactgtacaa

SEQ ID NO: 3203147 - DNA, 22 bp, Homo sapiens
atgtcttgtacatgtgtagcct

SEQ ID NO: 3203148 - DNA, 17 bp, Homo sapiens
atgtctttactggacct

SEQ ID NO: 3203149 - DNA, 16 bp, Homo sapiens
atgtcttttatatttg

SEQ ID NO: 3203150 - DNA, 16 bp, Homo sapiens
atgtgaaaaaaattat

SEQ ID NO: 3203151 - DNA, 19 bp, Homo sapiens
atgtgaaaaatctgctgtt

SEQ ID NO: 3203152 - DNA, 16 bp, Homo sapiens
atgtgaaaatatactt

SEQ ID NO: 3203153 - DNA, 23 bp, Homo sapiens
atgtgaaaccttttttaagattt

SEQ ID NO: 3203154 - DNA, 22 bp, Homo sapiens
atgtgaacaaatcaaattgctt

SEQ ID NO: 3203155 - DNA, 23 bp, Homo sapiens
atgtgaacaaatcaaattgctta

SEQ ID NO: 3203156 - DNA, 16 bp, Homo sapiens
atgtgaacagcataag

SEQ ID NO: 3203157 - DNA, 13 bp, Homo sapiens
atgtgaacttgta

SEQ ID NO: 3203158 - DNA, 14 bp, Homo sapiens
atgtgaacttgtag

SEQ ID NO: 3203159 - DNA, 23 bp, Homo sapiens
atgtgaacttgtagctgtaaaac

SEQ ID NO: 3203160 - DNA, 17 bp, Homo sapiens
atgtgaactttattaaa

SEQ ID NO: 3203161 - DNA, 11 bp, Homo sapiens
atgtgaagaat

SEQ ID NO: 3203162 - DNA, 14 bp, Homo sapiens
atgtgaagaattta

SEQ ID NO: 3203163 - DNA, 16 bp, Homo sapiens
atgtgaagaatttaga

SEQ ID NO: 3203164 - DNA, 19 bp, Homo sapiens
atgtgaagaatttagatct

SEQ ID NO: 3203165 - DNA, 15 bp, Homo sapiens
atgtgaagacatttt

SEQ ID NO: 3203166 - DNA, 13 bp, Homo sapiens
atgtgaagcatgc

SEQ ID NO: 3203167 - DNA, 16 bp, Homo sapiens
atgtgaagcatgcttt

SEQ ID NO: 3203168 - DNA, 11 bp, Homo sapiens
atgtgaatttt

SEQ ID NO: 3203169 - DNA, 19 bp, Homo sapiens
atgtgaatttttatttctt

SEQ ID NO: 3203170 - DNA, 20 bp, Homo sapiens
atgtgacaattttgtacaaa

SEQ ID NO: 3203171 - DNA, 19 bp, Homo sapiens
atgtgacacctaactcttt

SEQ ID NO: 3203172 - DNA, 22 bp, Homo sapiens
atgtgacattccatgacgacat

SEQ ID NO: 3203173 - DNA, 13 bp, Homo sapiens
atgtgacatttat

SEQ ID NO: 3203174 - DNA, 14 bp, Homo sapiens
atgtgacatttata

SEQ ID NO: 3203175 - DNA, 19 bp, Homo sapiens
atgtgaccactctgtcttg

SEQ ID NO: 3203176 - DNA, 15 bp, Homo sapiens
atgtgaccataatgt

SEQ ID NO: 3203177 - DNA, 16 bp, Homo sapiens
atgtgacccaccagtg

SEQ ID NO: 3203178 - DNA, 19 bp, Homo sapiens
atgtgacccaccagtgcct

SEQ ID NO: 3203179 - DNA, 14 bp, Homo sapiens
atgtgactgtataa

SEQ ID NO: 3203180 - DNA, 14 bp, Homo sapiens
atgtgagagaaagt

SEQ ID NO: 3203181 - DNA, 15 bp, Homo sapiens
atgtgagagaaagtg

SEQ ID NO: 3203182 - DNA, 16 bp, Homo sapiens
atgtgagaggtttgac

SEQ ID NO: 3203183 - DNA, 17 bp, Homo sapiens
atgtgagaggtttgact

SEQ ID NO: 3203184 - DNA, 21 bp, Homo sapiens
atgtgagccaccgctgccagc

SEQ ID NO: 3203185 - DNA, 22 bp, Homo sapiens
atgtgagccaccgctgccagca

SEQ ID NO: 3203186 - DNA, 15 bp, Homo sapiens
atgtgagccccaggg

SEQ ID NO: 3203187 - DNA, 21 bp, Homo sapiens
atgtgagtcccagagcccgct

SEQ ID NO: 3203188 - DNA, 23 bp, Homo sapiens
atgtgagtgccttttgcagaaga

SEQ ID NO: 3203189 - DNA, 22 bp, Homo sapiens
atgtgagtgtgtgtttgtgctg

SEQ ID NO: 3203190 - DNA, 21 bp, Homo sapiens
atgtgatacccatagcttcca

SEQ ID NO: 3203191 - DNA, 16 bp, Homo sapiens
atgtgatattctaaga

SEQ ID NO: 3203192 - DNA, 20 bp, Homo sapiens
atgtgatcatgtgtggaagt

SEQ ID NO: 3203193 - DNA, 17 bp, Homo sapiens
atgtgatgatgtaattg

SEQ ID NO: 3203194 - DNA, 16 bp, Homo sapiens
atgtgatggatggcac

SEQ ID NO: 3203195 - DNA, 20 bp, Homo sapiens
atgtgatggatggcacaatg

SEQ ID NO: 3203196 - DNA, 21 bp, Homo sapiens
atgtgatggatggcacaatga

SEQ ID NO: 3203197 - DNA, 16 bp, Homo sapiens
atgtgatgttctaagg

SEQ ID NO: 3203198 - DNA, 17 bp, Homo sapiens
atgtgatgttctaaggc

SEQ ID NO: 3203199 - DNA, 11 bp, Homo sapiens
atgtgattaat

SEQ ID NO: 3203200 - DNA, 21 bp, Homo sapiens
atgtgattaatgttttcatta

SEQ ID NO: 3203201 - DNA, 15 bp, Homo sapiens
atgtgatttttctga

SEQ ID NO: 3203202 - DNA, 13 bp, Homo sapiens
atgtgatttttgt

SEQ ID NO: 3203203 - DNA, 16 bp, Homo sapiens
atgtgatttttgtaat

SEQ ID NO: 3203204 - DNA, 19 bp, Homo sapiens
atgtgcaaggattgtacac

SEQ ID NO: 3203205 - DNA, 13 bp, Homo sapiens
atgtgcaatagaa

SEQ ID NO: 3203206 - DNA, 18 bp, Homo sapiens
atgtgcaattgatttctt

SEQ ID NO: 3203207 - DNA, 15 bp, Homo sapiens
atgtgcactgtcact

SEQ ID NO: 3203208 - DNA, 17 bp, Homo sapiens
atgtgcaggtttgttac

SEQ ID NO: 3203209 - DNA, 17 bp, Homo sapiens
atgtgcatttcacctgt

SEQ ID NO: 3203210 - DNA, 18 bp, Homo sapiens
atgtgcatttcacctgtg

SEQ ID NO: 3203211 - DNA, 21 bp, Homo sapiens
atgtgcatttcacctgtgaca

SEQ ID NO: 3203212 - DNA, 22 bp, Homo sapiens
atgtgcatttcacctgtgacaa

SEQ ID NO: 3203213 - DNA, 20 bp, Homo sapiens
atgtgcatttttgtgaaatg

SEQ ID NO: 3203214 - DNA, 21 bp, Homo sapiens
atgtgcatttttgtgaaatga

SEQ ID NO: 3203215 - DNA, 20 bp, Homo sapiens
atgtgccagggcaatgatga

SEQ ID NO: 3203216 - DNA, 21 bp, Homo sapiens
atgtgccagggcaatgatgaa

SEQ ID NO: 3203217 - DNA, 16 bp, Homo sapiens
atgtgcccaggggagc

SEQ ID NO: 3203218 - DNA, 17 bp, Homo sapiens
atgtgccgaatgtgcag

SEQ ID NO: 3203219 - DNA, 15 bp, Homo sapiens
atgtgcctgcaccag

SEQ ID NO: 3203220 - DNA, 19 bp, Homo sapiens
atgtgcctgcaccaggaga

SEQ ID NO: 3203221 - DNA, 17 bp, Homo sapiens
atgtgccttatgttgaa

SEQ ID NO: 3203222 - DNA, 14 bp, Homo sapiens
atgtgctactgatt

SEQ ID NO: 3203223 - DNA, 18 bp, Homo sapiens
atgtgctatacacacaca

SEQ ID NO: 3203224 - DNA, 19 bp, Homo sapiens
atgtgctatactgcatact

SEQ ID NO: 3203225 - DNA, 13 bp, Homo sapiens
atgtgctcagaag

SEQ ID NO: 3203226 - DNA, 18 bp, Homo sapiens
atgtgctgggtgcctccc

SEQ ID NO: 3203227 - DNA, 19 bp, Homo sapiens
atgtgctgggtgcctccca

SEQ ID NO: 3203228 - DNA, 13 bp, Homo sapiens
atgtggaaaacag

SEQ ID NO: 3203229 - DNA, 21 bp, Homo sapiens
atgtggaagaaaatggtttat

SEQ ID NO: 3203230 - DNA, 17 bp, Homo sapiens
atgtggcattggggggc

SEQ ID NO: 3203231 - DNA, 18 bp, Homo sapiens
atgtggcccctgaacaag

SEQ ID NO: 3203232 - DNA, 22 bp, Homo sapiens
atgtggcccctgaacaagaatt

SEQ ID NO: 3203233 - DNA, 14 bp, Homo sapiens
atgtggctggaaga

SEQ ID NO: 3203234 - DNA, 15 bp, Homo sapiens
atgtgggcacggagg

SEQ ID NO: 3203235 - DNA, 16 bp, Homo sapiens
atgtgggtgtcctgca

SEQ ID NO: 3203236 - DNA, 21 bp, Homo sapiens
atgtggttacttcctactgta

SEQ ID NO: 3203237 - DNA, 19 bp, Homo sapiens
atgtggtttatagagggcc

SEQ ID NO: 3203238 - DNA, 17 bp, Homo sapiens
atgtggtttggttcctc

SEQ ID NO: 3203239 - DNA, 23 bp, Homo sapiens
atgtggtttggttcctctctggt

SEQ ID NO: 3203240 - DNA, 16 bp, Homo sapiens
atgtggttttagattt

SEQ ID NO: 3203241 - DNA, 17 bp, Homo sapiens
atgtggtttttaatttt

SEQ ID NO: 3203242 - DNA, 15 bp, Homo sapiens
atgtgtaaaatgtga

SEQ ID NO: 3203243 - DNA, 21 bp, Homo sapiens
atgtgtacagtgaattgtctt

SEQ ID NO: 3203244 - DNA, 14 bp, Homo sapiens
atgtgtacatggca

SEQ ID NO: 3203245 - DNA, 23 bp, Homo sapiens
atgtgtagcctgtgcatgtatgt

SEQ ID NO: 3203246 - DNA, 21 bp, Homo sapiens
atgtgtagctgcaaaaataat

SEQ ID NO: 3203247 - DNA, 22 bp, Homo sapiens
atgtgtataattttaaagtaat

SEQ ID NO: 3203248 - DNA, 23 bp, Homo sapiens
atgtgtataattttaaagtaatt

SEQ ID NO: 3203249 - DNA, 14 bp, Homo sapiens
atgtgtatgtgtct

SEQ ID NO: 3203250 - DNA, 21 bp, Homo sapiens
atgtgtcactactcacagtct

SEQ ID NO: 3203251 - DNA, 13 bp, Homo sapiens
atgtgtcccctca

SEQ ID NO: 3203252 - DNA, 15 bp, Homo sapiens
atgtgtcccctcact

SEQ ID NO: 3203253 - DNA, 13 bp, Homo sapiens
atgtgtcctggtt

SEQ ID NO: 3203254 - DNA, 18 bp, Homo sapiens
atgtgtctgctaatgtaa

SEQ ID NO: 3203255 - DNA, 19 bp, Homo sapiens
atgtgtgaggagctgctgg

SEQ ID NO: 3203256 - DNA, 22 bp, Homo sapiens
atgtgtgcaacagggtatggac

SEQ ID NO: 3203257 - DNA, 16 bp, Homo sapiens
atgtgtgcatgtgtgt

SEQ ID NO: 3203258 - DNA, 20 bp, Homo sapiens
atgtgtgcatgtgtgtataa

SEQ ID NO: 3203259 - DNA, 20 bp, Homo sapiens
atgtgtgccatagagtttaa

SEQ ID NO: 3203260 - DNA, 15 bp, Homo sapiens
atgtgtgcctgtggc

SEQ ID NO: 3203261 - DNA, 23 bp, Homo sapiens
atgtgtgcctgtggcagaaaaga

SEQ ID NO: 3203262 - DNA, 17 bp, Homo sapiens
atgtttggattctctta

SEQ ID NO: 3203263 - DNA, 12 bp, Homo sapiens
atgtttggggtc

SEQ ID NO: 3203264 - DNA, 19 bp, Homo sapiens
atgtttggtgcatagaact

SEQ ID NO: 3203265 - DNA, 21 bp, Homo sapiens
atgtttggtgcatagaactgg

SEQ ID NO: 3203266 - DNA, 14 bp, Homo sapiens
atgtttgtaaaact

SEQ ID NO: 3203267 - DNA, 19 bp, Homo sapiens
atgtttgtaaattaatact

SEQ ID NO: 3203268 - DNA, 20 bp, Homo sapiens
atgtttgtctcagttggaaa

SEQ ID NO: 3203269 - DNA, 21 bp, Homo sapiens
atgtttgtctcagttggaaat

SEQ ID NO: 3203270 - DNA, 13 bp, Homo sapiens
atgtttgtggcct

SEQ ID NO: 3203271 - DNA, 14 bp, Homo sapiens
atgtttgtggcctc

SEQ ID NO: 3203272 - DNA, 16 bp, Homo sapiens
atgttttactgtgaaa

SEQ ID NO: 3203273 - DNA, 15 bp, Homo sapiens
atgttttagcatttt

SEQ ID NO: 3203274 - DNA, 18 bp, Homo sapiens
atgttttattatttctat

SEQ ID NO: 3203275 - DNA, 16 bp, Homo sapiens
atgttttcaaaaggta

SEQ ID NO: 3203276 - DNA, 22 bp, Homo sapiens
atgttttggtagattaaatata

SEQ ID NO: 3203277 - DNA, 14 bp, Homo sapiens
atgttttgtacaat

SEQ ID NO: 3203278 - DNA, 17 bp, Homo sapiens
atgttttgtatatacag

SEQ ID NO: 3203279 - DNA, 20 bp, Homo sapiens
atgttttgtatatacagtta

SEQ ID NO: 3203280 - DNA, 21 bp, Homo sapiens
atgttttgtgactatatagag

SEQ ID NO: 3203281 - DNA, 16 bp, Homo sapiens
atgttttgtgcatttg

SEQ ID NO: 3203282 - DNA, 21 bp, Homo sapiens
atgttttgtttctgaaaattc

SEQ ID NO: 3203283 - DNA, 22 bp, Homo sapiens
atgtttttaaaagtttcaatgt

SEQ ID NO: 3203284 - DNA, 22 bp, Homo sapiens
atgtttttaaatgcataaaata

SEQ ID NO: 3203285 - DNA, 20 bp, Homo sapiens
atgtttttataaaaataaat

SEQ ID NO: 3203286 - DNA, 21 bp, Homo sapiens
atgtttttgttttctttgaat

SEQ ID NO: 3203287 - DNA, 19 bp, Homo sapiens
atgttttttgccacagctt

SEQ ID NO: 3203288 - DNA, 22 bp, Homo sapiens
atgttttttgccacagcttttg

SEQ ID NO: 3203289 - DNA, 18 bp, Homo sapiens
atgtttttttaattaaaa

SEQ ID NO: 3203290 - DNA, 17 bp, Homo sapiens
attaaaaaaaaattgta

SEQ ID NO: 3203291 - DNA, 18 bp, Homo sapiens
attaaaaaagcatacttc

SEQ ID NO: 3203292 - DNA, 22 bp, Homo sapiens
attaaaaagattctttttctga

SEQ ID NO: 3203293 - DNA, 15 bp, Homo sapiens
attaaaaatgttctc

SEQ ID NO: 3203294 - DNA, 21 bp, Homo sapiens
attaaaacatatttcatttta

SEQ ID NO: 3203295 - DNA, 23 bp, Homo sapiens
attaaaaccagtctcagatatca

SEQ ID NO: 3203296 - DNA, 15 bp, Homo sapiens
attaaaactaggtaa

SEQ ID NO: 3203297 - DNA, 14 bp, Homo sapiens
attaaaactgcttt

SEQ ID NO: 3203298 - DNA, 16 bp, Homo sapiens
attaaaaggatagtat

SEQ ID NO: 3203299 - DNA, 18 bp, Homo sapiens
attaaaatgattgtaaaa

SEQ ID NO: 3203300 - DNA, 14 bp, Homo sapiens
attaaaatggattt

SEQ ID NO: 3203301 - DNA, 19 bp, Homo sapiens
attaaaattgccattttat

SEQ ID NO: 3203302 - DNA, 20 bp, Homo sapiens
attaaacaaagtttcagagt

SEQ ID NO: 3203303 - DNA, 14 bp, Homo sapiens
attaaacattttca

SEQ ID NO: 3203304 - DNA, 14 bp, Homo sapiens
attaaaccctggat

SEQ ID NO: 3203305 - DNA, 20 bp, Homo sapiens
attaaacctgtctccactgt

SEQ ID NO: 3203306 - DNA, 21 bp, Homo sapiens
attaaacttccaaagaaagtt

SEQ ID NO: 3203307 - DNA, 15 bp, Homo sapiens
attaaacttccttct

SEQ ID NO: 3203308 - DNA, 16 bp, Homo sapiens
attaaacttcttttct

SEQ ID NO: 3203309 - DNA, 14 bp, Homo sapiens
attaaacttgaagc

SEQ ID NO: 3203310 - DNA, 19 bp, Homo sapiens
attaaacttttaattcatt

SEQ ID NO: 3203311 - DNA, 21 bp, Homo sapiens
attaaagaagggttgagctgg

SEQ ID NO: 3203312 - DNA, 13 bp, Homo sapiens
attaaaggaagga

SEQ ID NO: 3203313 - DNA, 17 bp, Homo sapiens
attaaaggtcctgccct

SEQ ID NO: 3203314 - DNA, 23 bp, Homo sapiens
attaaagtgctaaggttctaagg

SEQ ID NO: 3203315 - DNA, 19 bp, Homo sapiens
attaaataaaatcaatttt

SEQ ID NO: 3203316 - DNA, 12 bp, Homo sapiens
attaaatacaga

SEQ ID NO: 3203317 - DNA, 17 bp, Homo sapiens
attaaatacagacacta

SEQ ID NO: 3203318 - DNA, 19 bp, Homo sapiens
attaaatacagacactaag

SEQ ID NO: 3203319 - DNA, 14 bp, Homo sapiens
attaaatatagatt

SEQ ID NO: 3203320 - DNA, 15 bp, Homo sapiens
attaaatccaataaa

SEQ ID NO: 3203321 - DNA, 19 bp, Homo sapiens
attaaatgaatattttgat

SEQ ID NO: 3203322 - DNA, 16 bp, Homo sapiens
attaaatgccttgtat

SEQ ID NO: 3203323 - DNA, 16 bp, Homo sapiens
attaaatgcttcattt

SEQ ID NO: 3203324 - DNA, 16 bp, Homo sapiens
attaaatgtgtcattg

SEQ ID NO: 3203325 - DNA, 19 bp, Homo sapiens
attaaatttcacaatataa

SEQ ID NO: 3203326 - DNA, 20 bp, Homo sapiens
attaaattttgagttctaca

SEQ ID NO: 3203327 - DNA, 12 bp, Homo sapiens
attaacaaatat

SEQ ID NO: 3203328 - DNA, 14 bp, Homo sapiens
attaacaaatgctc

SEQ ID NO: 3203329 - DNA, 20 bp, Homo sapiens
attaacaatttaacagagaa

SEQ ID NO: 3203330 - DNA, 15 bp, Homo sapiens
attaacacaaaggaa

SEQ ID NO: 3203331 - DNA, 14 bp, Homo sapiens
attaacagttttcc

SEQ ID NO: 3203332 - DNA, 13 bp, Homo sapiens
attaacctctgca

SEQ ID NO: 3203333 - DNA, 16 bp, Homo sapiens
attaacctggtgctgg

SEQ ID NO: 3203334 - DNA, 17 bp, Homo sapiens
attaacctggtgctgga

SEQ ID NO: 3203335 - DNA, 15 bp, Homo sapiens
attaacttagcatgt

SEQ ID NO: 3203336 - DNA, 12 bp, Homo sapiens
attaacttattt

SEQ ID NO: 3203337 - DNA, 15 bp, Homo sapiens
attaacttatttaga

SEQ ID NO: 3203338 - DNA, 22 bp, Homo sapiens
attaagaaggcaaaaatgtaaa

SEQ ID NO: 3203339 - DNA, 14 bp, Homo sapiens
attaagacagtgta

SEQ ID NO: 3203340 - DNA, 15 bp, Homo sapiens
attaagatacaaatt

SEQ ID NO: 3203341 - DNA, 16 bp, Homo sapiens
attaagatacaaatta

SEQ ID NO: 3203342 - DNA, 14 bp, Homo sapiens
attaagatacttag

SEQ ID NO: 3203343 - DNA, 15 bp, Homo sapiens
attaagatggattct

SEQ ID NO: 3203344 - DNA, 23 bp, Homo sapiens
attaagatggattctcagatatt

SEQ ID NO: 3203345 - DNA, 13 bp, Homo sapiens
attaagatttcca

SEQ ID NO: 3203346 - DNA, 13 bp, Homo sapiens
attaagcagcttg

SEQ ID NO: 3203347 - DNA, 22 bp, Homo sapiens
attaagctgttcctgttcagta

SEQ ID NO: 3203348 - DNA, 17 bp, Homo sapiens
attaagctttttggaat

SEQ ID NO: 3203349 - DNA, 19 bp, Homo sapiens
attaaggggaagaatgaaa

SEQ ID NO: 3203350 - DNA, 16 bp, Homo sapiens
attaaggtgatgtgat

SEQ ID NO: 3203351 - DNA, 12 bp, Homo sapiens
attaaggttttc

SEQ ID NO: 3203352 - DNA, 15 bp, Homo sapiens
attaagtaatcaata

SEQ ID NO: 3203353 - DNA, 18 bp, Homo sapiens
attaagtaatcaataaag

SEQ ID NO: 3203354 - DNA, 14 bp, Homo sapiens
attaagtactatgt

SEQ ID NO: 3203355 - DNA, 18 bp, Homo sapiens
attaagtagaacaaaaaa

SEQ ID NO: 3203356 - DNA, 21 bp, Homo sapiens
attaagtagaacaaaaaaccc

SEQ ID NO: 3203357 - DNA, 20 bp, Homo sapiens
attaagtatctgggattatt

SEQ ID NO: 3203358 - DNA, 18 bp, Homo sapiens
attaagtcatgtgtgaac

SEQ ID NO: 3203359 - DNA, 13 bp, Homo sapiens
attaagttacaat

SEQ ID NO: 3203360 - DNA, 13 bp, Homo sapiens
attaagttatctt

SEQ ID NO: 3203361 - DNA, 16 bp, Homo sapiens
attaataaaaaatgga

SEQ ID NO: 3203362 - DNA, 19 bp, Homo sapiens
attaataaaaaatggaaag

SEQ ID NO: 3203363 - DNA, 15 bp, Homo sapiens
attaataaagcattc

SEQ ID NO: 3203364 - DNA, 16 bp, Homo sapiens
attaataaagcattct

SEQ ID NO: 3203365 - DNA, 16 bp, Homo sapiens
attaataatcttatta

SEQ ID NO: 3203366 - DNA, 20 bp, Homo sapiens
attaatactaaaatatgtct

SEQ ID NO: 3203367 - DNA, 17 bp, Homo sapiens
attaatagcagcctttc

SEQ ID NO: 3203368 - DNA, 16 bp, Homo sapiens
attaatatatagtcca

SEQ ID NO: 3203369 - DNA, 16 bp, Homo sapiens
attaatatatgtatta

SEQ ID NO: 3203370 - DNA, 14 bp, Homo sapiens
attaatatcttgct

SEQ ID NO: 3203371 - DNA, 14 bp, Homo sapiens
attaatatctttct

SEQ ID NO: 3203372 - DNA, 17 bp, Homo sapiens
attaatatctttctgca

SEQ ID NO: 3203373 - DNA, 15 bp, Homo sapiens
attaatatgaaaact

SEQ ID NO: 3203374 - DNA, 16 bp, Homo sapiens
attaatcaaaattgtc

SEQ ID NO: 3203375 - DNA, 11 bp, Homo sapiens
attaatcaaag

SEQ ID NO: 3203376 - DNA, 23 bp, Homo sapiens
attaatcaatcatctgtgtgaaa

SEQ ID NO: 3203377 - DNA, 22 bp, Homo sapiens
attaatcaccctaccaacttta

SEQ ID NO: 3203378 - DNA, 21 bp, Homo sapiens
attaatcaccttctttgtaat

SEQ ID NO: 3203379 - DNA, 16 bp, Homo sapiens
attaatcactattgtt

SEQ ID NO: 3203380 - DNA, 18 bp, Homo sapiens
attaatctttctttacct

SEQ ID NO: 3203381 - DNA, 19 bp, Homo sapiens
attaatgatgatcttcaga

SEQ ID NO: 3203382 - DNA, 15 bp, Homo sapiens
attaatgcctgcttt

SEQ ID NO: 3203383 - DNA, 22 bp, Homo sapiens
attaatgcctgctttttggaaa

SEQ ID NO: 3203384 - DNA, 15 bp, Homo sapiens
attaatggcactgat

SEQ ID NO: 3203385 - DNA, 15 bp, Homo sapiens
attaatggtctaaaa

SEQ ID NO: 3203386 - DNA, 17 bp, Homo sapiens
attaatgttttcaaaag

SEQ ID NO: 3203387 - DNA, 16 bp, Homo sapiens
attaatgttttcatta

SEQ ID NO: 3203388 - DNA, 14 bp, Homo sapiens
attaatgttttgta

SEQ ID NO: 3203389 - DNA, 16 bp, Homo sapiens
attaattaatttggag

SEQ ID NO: 3203390 - DNA, 16 bp, Homo sapiens
attaattacaattatg

SEQ ID NO: 3203391 - DNA, 23 bp, Homo sapiens
attaattagttgattgctgttga

SEQ ID NO: 3203392 - DNA, 12 bp, Homo sapiens
attaattcttca

SEQ ID NO: 3203393 - DNA, 20 bp, Homo sapiens
attaattgtaatctgaataa

SEQ ID NO: 3203394 - DNA, 21 bp, Homo sapiens
attaatttgattaacaaatat

SEQ ID NO: 3203395 - DNA, 16 bp, Homo sapiens
attaattttgtgcatt

SEQ ID NO: 3203396 - DNA, 17 bp, Homo sapiens
attaattttgtgcattc

SEQ ID NO: 3203397 - DNA, 19 bp, Homo sapiens
attaattttgtgcattctt

SEQ ID NO: 3203398 - DNA, 16 bp, Homo sapiens
attacaaatcagaagt

SEQ ID NO: 3203399 - DNA, 19 bp, Homo sapiens
attacaaatcagaagtcat

SEQ ID NO: 3203400 - DNA, 18 bp, Homo sapiens
attacaactgaccaagtt

SEQ ID NO: 3203401 - DNA, 15 bp, Homo sapiens
attacaagccctggg

SEQ ID NO: 3203402 - DNA, 22 bp, Homo sapiens
attacaagcgtgagccactgca

SEQ ID NO: 3203403 - DNA, 16 bp, Homo sapiens
attacaatttgtatta

SEQ ID NO: 3203404 - DNA, 22 bp, Homo sapiens
attacaatttttaataaattga

SEQ ID NO: 3203405 - DNA, 19 bp, Homo sapiens
attacactgtatttgtatc

SEQ ID NO: 3203406 - DNA, 20 bp, Homo sapiens
attacactgtatttgtatct

SEQ ID NO: 3203407 - DNA, 16 bp, Homo sapiens
attacactgtgccttt

SEQ ID NO: 3203408 - DNA, 14 bp, Homo sapiens
attacagaaactga

SEQ ID NO: 3203409 - DNA, 16 bp, Homo sapiens
attacagaaactgatg

SEQ ID NO: 3203410 - DNA, 21 bp, Homo sapiens
attacagaaactgatgccaag

SEQ ID NO: 3203411 - DNA, 17 bp, Homo sapiens
attacagagaggagaaa

SEQ ID NO: 3203412 - DNA, 19 bp, Homo sapiens
attacagagaggagaaaca

SEQ ID NO: 3203413 - DNA, 21 bp, Homo sapiens
attacagagaggagaaacaca

SEQ ID NO: 3203414 - DNA, 19 bp, Homo sapiens
attacagatgggcaaatta

SEQ ID NO: 3203415 - DNA, 18 bp, Homo sapiens
attacaggaatgaagaac

SEQ ID NO: 3203416 - DNA, 20 bp, Homo sapiens
attacaggaatgaagaactg

SEQ ID NO: 3203417 - DNA, 15 bp, Homo sapiens
attacaggcttgagc

SEQ ID NO: 3203418 - DNA, 24 bp, Homo sapiens
attacaggtgggatatgctagaaa

SEQ ID NO: 3203419 - DNA, 16 bp, Homo sapiens
attacaggtgtgaacc

SEQ ID NO: 3203420 - DNA, 23 bp, Homo sapiens
attacataatttagttgtttcta

SEQ ID NO: 3203421 - DNA, 23 bp, Homo sapiens
attacatctctaattttggataa

SEQ ID NO: 3203422 - DNA, 16 bp, Homo sapiens
attacatgtaatttga

SEQ ID NO: 3203423 - DNA, 19 bp, Homo sapiens
attacattcctaactagaa

SEQ ID NO: 3203424 - DNA, 23 bp, Homo sapiens
attacattcctaactagaattag

SEQ ID NO: 3203425 - DNA, 15 bp, Homo sapiens
attacattttcagtg

SEQ ID NO: 3203426 - DNA, 18 bp, Homo sapiens
attaccaaaaaagtattt

SEQ ID NO: 3203427 - DNA, 16 bp, Homo sapiens
attaccaacctgttac

SEQ ID NO: 3203428 - DNA, 22 bp, Homo sapiens
attaccaataggcaaattaatc

SEQ ID NO: 3203429 - DNA, 23 bp, Homo sapiens
attaccagtctttaaaggcccag

SEQ ID NO: 3203430 - DNA, 13 bp, Homo sapiens
attaccatggaga

SEQ ID NO: 3203431 - DNA, 13 bp, Homo sapiens
attacccactgtc

SEQ ID NO: 3203432 - DNA, 21 bp, Homo sapiens
attacccactgtcaggcctct

SEQ ID NO: 3203433 - DNA, 22 bp, Homo sapiens
attaccccctcattgtttatta

SEQ ID NO: 3203434 - DNA, 16 bp, Homo sapiens
attaccgtcacactct

SEQ ID NO: 3203435 - DNA, 20 bp, Homo sapiens
attaccgtcacactcttcag

SEQ ID NO: 3203436 - DNA, 18 bp, Homo sapiens
attacctgccaattgcta

SEQ ID NO: 3203437 - DNA, 19 bp, Homo sapiens
attacctgccaattgctac

SEQ ID NO: 3203438 - DNA, 19 bp, Homo sapiens
attacctggatgttctttt

SEQ ID NO: 3203439 - DNA, 14 bp, Homo sapiens
attacgtatgcaag

SEQ ID NO: 3203440 - DNA, 22 bp, Homo sapiens
attactaaggcaggtgggcaga

SEQ ID NO: 3203441 - DNA, 19 bp, Homo sapiens
attactaattttacacatt

SEQ ID NO: 3203442 - DNA, 15 bp, Homo sapiens
attactacaaaattt

SEQ ID NO: 3203443 - DNA, 13 bp, Homo sapiens
attactcagcaca

SEQ ID NO: 3203444 - DNA, 14 bp, Homo sapiens
attactcaggtttg

SEQ ID NO: 3203445 - DNA, 16 bp, Homo sapiens
attactcctatttttg

SEQ ID NO: 3203446 - DNA, 16 bp, Homo sapiens
attactgacatttctt

SEQ ID NO: 3203447 - DNA, 18 bp, Homo sapiens
attactgcaaattgattg

SEQ ID NO: 3203448 - DNA, 13 bp, Homo sapiens
attactgccattc

SEQ ID NO: 3203449 - DNA, 20 bp, Homo sapiens
attactgctttaatcagaaa

SEQ ID NO: 3203450 - DNA, 21 bp, Homo sapiens
attactgctttaatcagaaac

SEQ ID NO: 3203451 - DNA, 12 bp, Homo sapiens
attactgggcct

SEQ ID NO: 3203452 - DNA, 13 bp, Homo sapiens
attactgggcctt

SEQ ID NO: 3203453 - DNA, 14 bp, Homo sapiens
attactgggcctta

SEQ ID NO: 3203454 - DNA, 20 bp, Homo sapiens
attactgtatataaactcct

SEQ ID NO: 3203455 - DNA, 16 bp, Homo sapiens
attactgtcaataaac

SEQ ID NO: 3203456 - DNA, 18 bp, Homo sapiens
attactgtctggttttaa

SEQ ID NO: 3203457 - DNA, 20 bp, Homo sapiens
attactgttgcatttacttt

SEQ ID NO: 3203458 - DNA, 19 bp, Homo sapiens
attacttatttttgacagt

SEQ ID NO: 3203459 - DNA, 14 bp, Homo sapiens
attacttctgctac

SEQ ID NO: 3203460 - DNA, 19 bp, Homo sapiens
attacttgattaagatttt

SEQ ID NO: 3203461 - DNA, 20 bp, Homo sapiens
attacttgttgcaaaggtct

SEQ ID NO: 3203462 - DNA, 15 bp, Homo sapiens
attactttatcactt

SEQ ID NO: 3203463 - DNA, 16 bp, Homo sapiens
attactttatcacttt

SEQ ID NO: 3203464 - DNA, 15 bp, Homo sapiens
attactttctctgta

SEQ ID NO: 3203465 - DNA, 22 bp, Homo sapiens
attacttttaaaaatgtagaaa

SEQ ID NO: 3203466 - DNA, 16 bp, Homo sapiens
attagaaaaaaattac

SEQ ID NO: 3203467 - DNA, 19 bp, Homo sapiens
attagaaaatgttatttaa

SEQ ID NO: 3203468 - DNA, 22 bp, Homo sapiens
attagaaattacctgtggatat

SEQ ID NO: 3203469 - DNA, 20 bp, Homo sapiens
attagaaattagctgtgtga

SEQ ID NO: 3203470 - DNA, 13 bp, Homo sapiens
attagaatagtgt

SEQ ID NO: 3203471 - DNA, 14 bp, Homo sapiens
attagactgtgatt

SEQ ID NO: 3203472 - DNA, 19 bp, Homo sapiens
attagactttagaaataaa

SEQ ID NO: 3203473 - DNA, 23 bp, Homo sapiens
attagagtcaactacacaaagca

SEQ ID NO: 3203474 - DNA, 16 bp, Homo sapiens
attagatcaaatagtt

SEQ ID NO: 3203475 - DNA, 19 bp, Homo sapiens
attagatgattatatattg

SEQ ID NO: 3203476 - DNA, 19 bp, Homo sapiens
attagatggaaaaatgtga

SEQ ID NO: 3203477 - DNA, 21 bp, Homo sapiens
attagatggaaaaatgtgaaa

SEQ ID NO: 3203478 - DNA, 16 bp, Homo sapiens
attagatggcttattt

SEQ ID NO: 3203479 - DNA, 14 bp, Homo sapiens
attagcaaggctgg

SEQ ID NO: 3203480 - DNA, 16 bp, Homo sapiens
attagcaaggctgggt

SEQ ID NO: 3203481 - DNA, 19 bp, Homo sapiens
attagcaaggtcatttctt

SEQ ID NO: 3203482 - DNA, 15 bp, Homo sapiens
attagcacagatttt

SEQ ID NO: 3203483 - DNA, 16 bp, Homo sapiens
attagcacagatttta

SEQ ID NO: 3203484 - DNA, 12 bp, Homo sapiens
attagcattctg

SEQ ID NO: 3203485 - DNA, 21 bp, Homo sapiens
attagccaggatcatggtgta

SEQ ID NO: 3203486 - DNA, 15 bp, Homo sapiens
attagccaggctggt

SEQ ID NO: 3203487 - DNA, 15 bp, Homo sapiens
attagccaggtaatg

SEQ ID NO: 3203488 - DNA, 18 bp, Homo sapiens
attagccgggcatggtgg

SEQ ID NO: 3203489 - DNA, 15 bp, Homo sapiens
attaggaaaatatgg

SEQ ID NO: 3203490 - DNA, 16 bp, Homo sapiens
attaggaataaataaa

SEQ ID NO: 3203491 - DNA, 15 bp, Homo sapiens
attaggactgtataa

SEQ ID NO: 3203492 - DNA, 21 bp, Homo sapiens
attaggaggctcaacaataaa

SEQ ID NO: 3203493 - DNA, 22 bp, Homo sapiens
attaggatctgcaaacaatgaa

SEQ ID NO: 3203494 - DNA, 14 bp, Homo sapiens
attaggattttgat

SEQ ID NO: 3203495 - DNA, 15 bp, Homo sapiens
attaggctgtaacta

SEQ ID NO: 3203496 - DNA, 22 bp, Homo sapiens
attaggctgtaactactttata

SEQ ID NO: 3203497 - DNA, 13 bp, Homo sapiens
attaggtattttg

SEQ ID NO: 3203498 - DNA, 22 bp, Homo sapiens
attagtaccatagtaccattta

SEQ ID NO: 3203499 - DNA, 19 bp, Homo sapiens
attagtactgctcttgttt

SEQ ID NO: 3203500 - DNA, 14 bp, Homo sapiens
attagtatgtctgt

SEQ ID NO: 3203501 - DNA, 19 bp, Homo sapiens
attagtatgtctgtttttg

SEQ ID NO: 3203502 - DNA, 13 bp, Homo sapiens
attagtgattctg

SEQ ID NO: 3203503 - DNA, 16 bp, Homo sapiens
attagtgattctgatt

SEQ ID NO: 3203504 - DNA, 17 bp, Homo sapiens
attagtgattctgattt

SEQ ID NO: 3203505 - DNA, 18 bp, Homo sapiens
attagtgattctgatttc

SEQ ID NO: 3203506 - DNA, 22 bp, Homo sapiens
attagtgattctgatttcagtt

SEQ ID NO: 3203507 - DNA, 18 bp, Homo sapiens
attagtgccacttaatgt

SEQ ID NO: 3203508 - DNA, 18 bp, Homo sapiens
attagttccccaaataca

SEQ ID NO: 3203509 - DNA, 19 bp, Homo sapiens
attagttccccaaatacaa

SEQ ID NO: 3203510 - DNA, 20 bp, Homo sapiens
attagttccccaaatacaaa

SEQ ID NO: 3203511 - DNA, 18 bp, Homo sapiens
attagttccctgtctctt

SEQ ID NO: 3203512 - DNA, 12 bp, Homo sapiens
attagtttcctt

SEQ ID NO: 3203513 - DNA, 19 bp, Homo sapiens
attataaaaaatgtaacat

SEQ ID NO: 3203514 - DNA, 11 bp, Homo sapiens
attataaaaat

SEQ ID NO: 3203515 - DNA, 12 bp, Homo sapiens
attataaaacca

SEQ ID NO: 3203516 - DNA, 19 bp, Homo sapiens
attataaatatatataaag

SEQ ID NO: 3203517 - DNA, 17 bp, Homo sapiens
attataacaagtgtgtc

SEQ ID NO: 3203518 - DNA, 12 bp, Homo sapiens
attataacagtt

SEQ ID NO: 3203519 - DNA, 15 bp, Homo sapiens
attataacttaaaaa

SEQ ID NO: 3203520 - DNA, 16 bp, Homo sapiens
attataacttaaaata

SEQ ID NO: 3203521 - DNA, 17 bp, Homo sapiens
attataacttattagca

SEQ ID NO: 3203522 - DNA, 17 bp, Homo sapiens
attataagcattgaaat

SEQ ID NO: 3203523 - DNA, 15 bp, Homo sapiens
attataagtcttaca

SEQ ID NO: 3203524 - DNA, 17 bp, Homo sapiens
attataagtcttacata

SEQ ID NO: 3203525 - DNA, 22 bp, Homo sapiens
attataatatactatatttatg

SEQ ID NO: 3203526 - DNA, 14 bp, Homo sapiens
attataatcatact

SEQ ID NO: 3203527 - DNA, 12 bp, Homo sapiens
attataatttta

SEQ ID NO: 3203528 - DNA, 17 bp, Homo sapiens
attatactaagaaaaga

SEQ ID NO: 3203529 - DNA, 21 bp, Homo sapiens
attatactttatatctgtaat

SEQ ID NO: 3203530 - DNA, 20 bp, Homo sapiens
attatagacaacgatgaatt

SEQ ID NO: 3203531 - DNA, 23 bp, Homo sapiens
attatagacaacgatgaatttct

SEQ ID NO: 3203532 - DNA, 20 bp, Homo sapiens
attatagagtatactaaaaa

SEQ ID NO: 3203533 - DNA, 17 bp, Homo sapiens
attataggatcatttgt

SEQ ID NO: 3203534 - DNA, 13 bp, Homo sapiens
attatataggttg

SEQ ID NO: 3203535 - DNA, 20 bp, Homo sapiens
attatatgaccatatttact

SEQ ID NO: 3203536 - DNA, 15 bp, Homo sapiens
attatattgcaatga

SEQ ID NO: 3203537 - DNA, 13 bp, Homo sapiens
attatattggtgg

SEQ ID NO: 3203538 - DNA, 20 bp, Homo sapiens
attatattggtggttctcag

SEQ ID NO: 3203539 - DNA, 16 bp, Homo sapiens
attatatttgaaatcg

SEQ ID NO: 3203540 - DNA, 11 bp, Homo sapiens
attatcactgt

SEQ ID NO: 3203541 - DNA, 19 bp, Homo sapiens
attatccatcctctgagat

SEQ ID NO: 3203542 - DNA, 16 bp, Homo sapiens
attatcctagattata

SEQ ID NO: 3203543 - DNA, 14 bp, Homo sapiens
attatcctctttgt

SEQ ID NO: 3203544 - DNA, 16 bp, Homo sapiens
attatcctctttgtaa

SEQ ID NO: 3203545 - DNA, 16 bp, Homo sapiens
attatcggaagcagtg

SEQ ID NO: 3203546 - DNA, 17 bp, Homo sapiens
attatcgggaacagtgt

SEQ ID NO: 3203547 - DNA, 22 bp, Homo sapiens
attatcgggaacagtgtttccc

SEQ ID NO: 3203548 - DNA, 17 bp, Homo sapiens
attatcgggagcagtgt

SEQ ID NO: 3203549 - DNA, 19 bp, Homo sapiens
attatcgggagcagtgtct

SEQ ID NO: 3203550 - DNA, 21 bp, Homo sapiens
attatcgggagcagtgtcttc

SEQ ID NO: 3203551 - DNA, 13 bp, Homo sapiens
attatctaattta

SEQ ID NO: 3203552 - DNA, 18 bp, Homo sapiens
attatcttggaaagaaac

SEQ ID NO: 3203553 - DNA, 22 bp, Homo sapiens
attatcttgggatagttcccaa

SEQ ID NO: 3203554 - DNA, 18 bp, Homo sapiens
attatcttgttcaggaaa

SEQ ID NO: 3203555 - DNA, 15 bp, Homo sapiens
attatgacagttata

SEQ ID NO: 3203556 - DNA, 16 bp, Homo sapiens
attatgagctttcttt

SEQ ID NO: 3203557 - DNA, 17 bp, Homo sapiens
attatgcctgaatgact

SEQ ID NO: 3203558 - DNA, 19 bp, Homo sapiens
attatggaaaaataaaact

SEQ ID NO: 3203559 - DNA, 22 bp, Homo sapiens
attatggaaaaataaaactgtc

SEQ ID NO: 3203560 - DNA, 17 bp, Homo sapiens
attatggaagattttaa

SEQ ID NO: 3203561 - DNA, 22 bp, Homo sapiens
attatggaatatcatctgtcat

SEQ ID NO: 3203562 - DNA, 23 bp, Homo sapiens
attatggatacgtgttttgaatt

SEQ ID NO: 3203563 - DNA, 21 bp, Homo sapiens
attatggcctttttaagtatt

SEQ ID NO: 3203564 - DNA, 17 bp, Homo sapiens
attatggcttgtgaact

SEQ ID NO: 3203565 - DNA, 21 bp, Homo sapiens
attatggcttgtgaactgctg

SEQ ID NO: 3203566 - DNA, 14 bp, Homo sapiens
attatgtaaaagaa

SEQ ID NO: 3203567 - DNA, 19 bp, Homo sapiens
attatgtaatatattgtac

SEQ ID NO: 3203568 - DNA, 20 bp, Homo sapiens
attatgtaatatattgtaca

SEQ ID NO: 3203569 - DNA, 16 bp, Homo sapiens
attatgtatgtttaca

SEQ ID NO: 3203570 - DNA, 17 bp, Homo sapiens
attatgtcttcttttgt

SEQ ID NO: 3203571 - DNA, 19 bp, Homo sapiens
attatgtcttttatatttg

SEQ ID NO: 3203572 - DNA, 14 bp, Homo sapiens
attatgtgaagaat

SEQ ID NO: 3203573 - DNA, 16 bp, Homo sapiens
attatgtgaagaattt

SEQ ID NO: 3203574 - DNA, 21 bp, Homo sapiens
attatgtgtgcatgtgtgtat

SEQ ID NO: 3203575 - DNA, 13 bp, Homo sapiens
attatgttcatgt

SEQ ID NO: 3203576 - DNA, 13 bp, Homo sapiens
attatgttgttca

SEQ ID NO: 3203577 - DNA, 20 bp, Homo sapiens
attatgtttattacaatttt

SEQ ID NO: 3203578 - DNA, 20 bp, Homo sapiens
attatgttttttaaaatatt

SEQ ID NO: 3203579 - DNA, 23 bp, Homo sapiens
attattaaattgtaaaactccaa

SEQ ID NO: 3203580 - DNA, 14 bp, Homo sapiens
attattaactacat

SEQ ID NO: 3203581 - DNA, 13 bp, Homo sapiens
attattaattgca

SEQ ID NO: 3203582 - DNA, 21 bp, Homo sapiens
attattacttatttttgacag

SEQ ID NO: 3203583 - DNA, 22 bp, Homo sapiens
attattagccaggtaatgtgaa

SEQ ID NO: 3203584 - DNA, 16 bp, Homo sapiens
attattataaaaatat

SEQ ID NO: 3203585 - DNA, 19 bp, Homo sapiens
attattataaaagggggtc

SEQ ID NO: 3203586 - DNA, 20 bp, Homo sapiens
attattataagcattgaaat

SEQ ID NO: 3203587 - DNA, 17 bp, Homo sapiens
attattattattgctga

SEQ ID NO: 3203588 - DNA, 15 bp, Homo sapiens
attattattcttcat

SEQ ID NO: 3203589 - DNA, 15 bp, Homo sapiens
attattatttgtgtt

SEQ ID NO: 3203590 - DNA, 22 bp, Homo sapiens
attattcaaaccaatttcttcc

SEQ ID NO: 3203591 - DNA, 15 bp, Homo sapiens
attattcatttaaaa

SEQ ID NO: 3203592 - DNA, 16 bp, Homo sapiens
attattcatttaaaat

SEQ ID NO: 3203593 - DNA, 19 bp, Homo sapiens
attattcatttaaaatgat

SEQ ID NO: 3203594 - DNA, 20 bp, Homo sapiens
attattcatttaaaatgatt

SEQ ID NO: 3203595 - DNA, 21 bp, Homo sapiens
attattcatttaaaatgatta

SEQ ID NO: 3203596 - DNA, 13 bp, Homo sapiens
attattcatttag

SEQ ID NO: 3203597 - DNA, 13 bp, Homo sapiens
attattcctccag

SEQ ID NO: 3203598 - DNA, 14 bp, Homo sapiens
attattctgttttg

SEQ ID NO: 3203599 - DNA, 13 bp, Homo sapiens
attattcttgtag

SEQ ID NO: 3203600 - DNA, 23 bp, Homo sapiens
attattctttgaaaacagatgac

SEQ ID NO: 3203601 - DNA, 21 bp, Homo sapiens
attattgagttccagttgaag

SEQ ID NO: 3203602 - DNA, 15 bp, Homo sapiens
attattgatagtact

SEQ ID NO: 3203603 - DNA, 12 bp, Homo sapiens
attattgcatta

SEQ ID NO: 3203604 - DNA, 19 bp, Homo sapiens
attattgcttattgcttag

SEQ ID NO: 3203605 - DNA, 23 bp, Homo sapiens
attattgtggtaggccttttaac

SEQ ID NO: 3203606 - DNA, 12 bp, Homo sapiens
attatttaaaca

SEQ ID NO: 3203607 - DNA, 13 bp, Homo sapiens
attatttattaca

SEQ ID NO: 3203608 - DNA, 17 bp, Homo sapiens
attatttatttaataac

SEQ ID NO: 3203609 - DNA, 11 bp, Homo sapiens
attatttggca

SEQ ID NO: 3203610 - DNA, 18 bp, Homo sapiens
attatttgggggaactgg

SEQ ID NO: 3203611 - DNA, 12 bp, Homo sapiens
attatttgtgtt

SEQ ID NO: 3203612 - DNA, 13 bp, Homo sapiens
attattttaaaat

SEQ ID NO: 3203613 - DNA, 17 bp, Homo sapiens
attattttcattacaat

SEQ ID NO: 3203614 - DNA, 21 bp, Homo sapiens
attattttcattacaatggaa

SEQ ID NO: 3203615 - DNA, 14 bp, Homo sapiens
attattttctccaa

SEQ ID NO: 3203616 - DNA, 19 bp, Homo sapiens
attattttctccaaataaa

SEQ ID NO: 3203617 - DNA, 22 bp, Homo sapiens
attattttctgtcagatgagaa

SEQ ID NO: 3203618 - DNA, 12 bp, Homo sapiens
attattttgggg

SEQ ID NO: 3203619 - DNA, 14 bp, Homo sapiens
attattttggggtc

SEQ ID NO: 3203620 - DNA, 19 bp, Homo sapiens
attattttggtacttttat

SEQ ID NO: 3203621 - DNA, 14 bp, Homo sapiens
attattttgtggtt

SEQ ID NO: 3203622 - DNA, 18 bp, Homo sapiens
attatttttataattgta

SEQ ID NO: 3203623 - DNA, 17 bp, Homo sapiens
attatttttttaaaatt

SEQ ID NO: 3203624 - DNA, 18 bp, Homo sapiens
attatttttttaaaattt

SEQ ID NO: 3203625 - DNA, 19 bp, Homo sapiens
attatttttttaaaatttt

SEQ ID NO: 3203626 - DNA, 20 bp, Homo sapiens
attatttttttaaaattttg

SEQ ID NO: 3203627 - DNA, 17 bp, Homo sapiens
attcaaaaagtgtttat

SEQ ID NO: 3203628 - DNA, 22 bp, Homo sapiens
attcaaggaatttcttaacttc

SEQ ID NO: 3203629 - DNA, 18 bp, Homo sapiens
attcaaggagaatatgat

SEQ ID NO: 3203630 - DNA, 19 bp, Homo sapiens
attcaaggagaatatgata

SEQ ID NO: 3203631 - DNA, 20 bp, Homo sapiens
attcaaggagaatatgataa

SEQ ID NO: 3203632 - DNA, 15 bp, Homo sapiens
attcaaggtggccaa

SEQ ID NO: 3203633 - DNA, 15 bp, Homo sapiens
attcaatctgtaaac

SEQ ID NO: 3203634 - DNA, 18 bp, Homo sapiens
attcaatctgtaaactgt

SEQ ID NO: 3203635 - DNA, 22 bp, Homo sapiens
attcaatctgtaaactgtgtat

SEQ ID NO: 3203636 - DNA, 21 bp, Homo sapiens
attcaattgtaaattgaatca

SEQ ID NO: 3203637 - DNA, 18 bp, Homo sapiens
attcacaagcctcctgta

SEQ ID NO: 3203638 - DNA, 14 bp, Homo sapiens
attcacaatagaaa

SEQ ID NO: 3203639 - DNA, 14 bp, Homo sapiens
attcacaattattc

SEQ ID NO: 3203640 - DNA, 21 bp, Homo sapiens
attcacactttttatttaatt

SEQ ID NO: 3203641 - DNA, 19 bp, Homo sapiens
attcacagtgctcttttct

SEQ ID NO: 3203642 - DNA, 20 bp, Homo sapiens
attcacagtgctcttttctc

SEQ ID NO: 3203643 - DNA, 15 bp, Homo sapiens
attcaccctccactt

SEQ ID NO: 3203644 - DNA, 17 bp, Homo sapiens
attcaccctccacttcc

SEQ ID NO: 3203645 - DNA, 20 bp, Homo sapiens
attcacctatgttattttgt

SEQ ID NO: 3203646 - DNA, 23 bp, Homo sapiens
attcaccttccagtgtctcggag

SEQ ID NO: 3203647 - DNA, 14 bp, Homo sapiens
attcaccttttctt

SEQ ID NO: 3203648 - DNA, 17 bp, Homo sapiens
attcaccttttcttcaa

SEQ ID NO: 3203649 - DNA, 20 bp, Homo sapiens
attcaccttttcttcaaaat

SEQ ID NO: 3203650 - DNA, 14 bp, Homo sapiens
attcacgtttttct

SEQ ID NO: 3203651 - DNA, 20 bp, Homo sapiens
attcacgtttttctggacca

SEQ ID NO: 3203652 - DNA, 21 bp, Homo sapiens
attcactcaagcactgatatc

SEQ ID NO: 3203653 - DNA, 20 bp, Homo sapiens
attcactgaagttctcctga

SEQ ID NO: 3203654 - DNA, 14 bp, Homo sapiens
attcacttctgcat

SEQ ID NO: 3203655 - DNA, 22 bp, Homo sapiens
attcacttctgcattcctgtaa

SEQ ID NO: 3203656 - DNA, 14 bp, Homo sapiens
attcacttgcattt

SEQ ID NO: 3203657 - DNA, 19 bp, Homo sapiens
attcagaaaatgttctgtt

SEQ ID NO: 3203658 - DNA, 20 bp, Homo sapiens
attcagaaaatgttctgttt

SEQ ID NO: 3203659 - DNA, 16 bp, Homo sapiens
attcagagaatatcaa

SEQ ID NO: 3203660 - DNA, 18 bp, Homo sapiens
attcagatatatttttca

SEQ ID NO: 3203661 - DNA, 20 bp, Homo sapiens
attcagatcaaaatgccttt

SEQ ID NO: 3203662 - DNA, 18 bp, Homo sapiens
attcagattgtcttgcaa

SEQ ID NO: 3203663 - DNA, 19 bp, Homo sapiens
attcagattttaaaaagtc

SEQ ID NO: 3203664 - DNA, 15 bp, Homo sapiens
attcagctcagcttc

SEQ ID NO: 3203665 - DNA, 16 bp, Homo sapiens
attcagctctggagaa

SEQ ID NO: 3203666 - DNA, 17 bp, Homo sapiens
attcagctctggagaac

SEQ ID NO: 3203667 - DNA, 12 bp, Homo sapiens
attcagcttcat

SEQ ID NO: 3203668 - DNA, 16 bp, Homo sapiens
attcaggaagataaaa

SEQ ID NO: 3203669 - DNA, 22 bp, Homo sapiens
attcaggagagtagaacagata

SEQ ID NO: 3203670 - DNA, 14 bp, Homo sapiens
attcaggccagccc

SEQ ID NO: 3203671 - DNA, 15 bp, Homo sapiens
attcaggccagccca

SEQ ID NO: 3203672 - DNA, 19 bp, Homo sapiens
attcaggccagcccagcca

SEQ ID NO: 3203673 - DNA, 23 bp, Homo sapiens
attcaggccagcccagccaggcc

SEQ ID NO: 3203674 - DNA, 11 bp, Homo sapiens
attcaggctgc

SEQ ID NO: 3203675 - DNA, 16 bp, Homo sapiens
attcaggctgcttggg

SEQ ID NO: 3203676 - DNA, 20 bp, Homo sapiens
attcaggggctgacacttca

SEQ ID NO: 3203677 - DNA, 18 bp, Homo sapiens
attcagggtaaataggaa

SEQ ID NO: 3203678 - DNA, 18 bp, Homo sapiens
attcaggtgaaaatgttc

SEQ ID NO: 3203679 - DNA, 19 bp, Homo sapiens
attcaggtgaaaatgttca

SEQ ID NO: 3203680 - DNA, 15 bp, Homo sapiens
attcagtgagggtct

SEQ ID NO: 3203681 - DNA, 21 bp, Homo sapiens
attcagtgagggtcttcttac

SEQ ID NO: 3203682 - DNA, 19 bp, Homo sapiens
attcagtgcttcttaaaga

SEQ ID NO: 3203683 - DNA, 19 bp, Homo sapiens
attcagtggcgagaaataa

SEQ ID NO: 3203684 - DNA, 17 bp, Homo sapiens
attcagtttcataaaag

SEQ ID NO: 3203685 - DNA, 13 bp, Homo sapiens
attcagttttcat

SEQ ID NO: 3203686 - DNA, 19 bp, Homo sapiens
attcagtttttgtatcttg

SEQ ID NO: 3203687 - DNA, 20 bp, Homo sapiens
attcagtttttgtatcttgg

SEQ ID NO: 3203688 - DNA, 19 bp, Homo sapiens
attcagtttttttccagtt

SEQ ID NO: 3203689 - DNA, 15 bp, Homo sapiens
attcataaaaactgc

SEQ ID NO: 3203690 - DNA, 18 bp, Homo sapiens
attcataacaatgtatgt

SEQ ID NO: 3203691 - DNA, 11 bp, Homo sapiens
attcataataa

SEQ ID NO: 3203692 - DNA, 15 bp, Homo sapiens
attcataatgaatta

SEQ ID NO: 3203693 - DNA, 21 bp, Homo sapiens
attcatagggaaaggttttgt

SEQ ID NO: 3203694 - DNA, 17 bp, Homo sapiens
attcatagtaacttctt

SEQ ID NO: 3203695 - DNA, 18 bp, Homo sapiens
attcatagtaacttctta

SEQ ID NO: 3203696 - DNA, 14 bp, Homo sapiens
attcatattaagac

SEQ ID NO: 3203697 - DNA, 15 bp, Homo sapiens
attcatattaagaca

SEQ ID NO: 3203698 - DNA, 23 bp, Homo sapiens
attcatattaagacagtgtacaa

SEQ ID NO: 3203699 - DNA, 18 bp, Homo sapiens
attcatatttacttctta

SEQ ID NO: 3203700 - DNA, 19 bp, Homo sapiens
attcatatttacttcttat

SEQ ID NO: 3203701 - DNA, 16 bp, Homo sapiens
attcatcccaactgtc

SEQ ID NO: 3203702 - DNA, 12 bp, Homo sapiens
attcatgtaaac

SEQ ID NO: 3203703 - DNA, 22 bp, Homo sapiens
attcattctgtgatcatttatt

SEQ ID NO: 3203704 - DNA, 13 bp, Homo sapiens
attcatttcacat

SEQ ID NO: 3203705 - DNA, 22 bp, Homo sapiens
attcatttcacattaatggtct

SEQ ID NO: 3203706 - DNA, 11 bp, Homo sapiens
attcatttgta

SEQ ID NO: 3203707 - DNA, 23 bp, Homo sapiens
attcatttgtattgcttatttta

SEQ ID NO: 3203708 - DNA, 18 bp, Homo sapiens
attcatttgttttttcaa

SEQ ID NO: 3203709 - DNA, 18 bp, Homo sapiens
attcattttcatcactgg

SEQ ID NO: 3203710 - DNA, 18 bp, Homo sapiens
attcattttctgacatgc

SEQ ID NO: 3203711 - DNA, 17 bp, Homo sapiens
attcattttttaaattc

SEQ ID NO: 3203712 - DNA, 14 bp, Homo sapiens
attccaaaatatta

SEQ ID NO: 3203713 - DNA, 14 bp, Homo sapiens
attccaaaccaaat

SEQ ID NO: 3203714 - DNA, 23 bp, Homo sapiens
attccaacaatggggtgggccca

SEQ ID NO: 3203715 - DNA, 15 bp, Homo sapiens
attccaatatttctg

SEQ ID NO: 3203716 - DNA, 16 bp, Homo sapiens
attccaattaaattta

SEQ ID NO: 3203717 - DNA, 16 bp, Homo sapiens
attccactacacctgg

SEQ ID NO: 3203718 - DNA, 12 bp, Homo sapiens
attccactggac

SEQ ID NO: 3203719 - DNA, 12 bp, Homo sapiens
attccagaatat

SEQ ID NO: 3203720 - DNA, 16 bp, Homo sapiens
attccagaatatctgg

SEQ ID NO: 3203721 - DNA, 19 bp, Homo sapiens
attccagaatgctgtacat

SEQ ID NO: 3203722 - DNA, 13 bp, Homo sapiens
attccagacttca

SEQ ID NO: 3203723 - DNA, 18 bp, Homo sapiens
attccagagacatcagca

SEQ ID NO: 3203724 - DNA, 18 bp, Homo sapiens
attccagagagtggctcc

SEQ ID NO: 3203725 - DNA, 21 bp, Homo sapiens
attccagagagtggctcctcc

SEQ ID NO: 3203726 - DNA, 19 bp, Homo sapiens
attccagatctttcagaaa

SEQ ID NO: 3203727 - DNA, 13 bp, Homo sapiens
attccagcccctc

SEQ ID NO: 3203728 - DNA, 14 bp, Homo sapiens
attccagcccctct

SEQ ID NO: 3203729 - DNA, 17 bp, Homo sapiens
attccagcccctctggt

SEQ ID NO: 3203730 - DNA, 17 bp, Homo sapiens
attccagtaactttttt

SEQ ID NO: 3203731 - DNA, 14 bp, Homo sapiens
attccatcaataaa

SEQ ID NO: 3203732 - DNA, 15 bp, Homo sapiens
attccatcaataaat

SEQ ID NO: 3203733 - DNA, 17 bp, Homo sapiens
attccatcaataaatgc

SEQ ID NO: 3203734 - DNA, 23 bp, Homo sapiens
attccatcaataaatgctctatt

SEQ ID NO: 3203735 - DNA, 15 bp, Homo sapiens
attccatccataaat

SEQ ID NO: 3203736 - DNA, 14 bp, Homo sapiens
attccatccatata

SEQ ID NO: 3203737 - DNA, 18 bp, Homo sapiens
attccctttgacttcagc

SEQ ID NO: 3203738 - DNA, 13 bp, Homo sapiens
attcccttttaat

SEQ ID NO: 3203739 - DNA, 22 bp, Homo sapiens
attccgaagagggaatggatgg

SEQ ID NO: 3203740 - DNA, 17 bp, Homo sapiens
attccgagcattccagt

SEQ ID NO: 3203741 - DNA, 19 bp, Homo sapiens
attccggatcctaagcatc

SEQ ID NO: 3203742 - DNA, 18 bp, Homo sapiens
attcctaacttttcaatg

SEQ ID NO: 3203743 - DNA, 15 bp, Homo sapiens
attcctagataaaaa

SEQ ID NO: 3203744 - DNA, 23 bp, Homo sapiens
attcctaggcaactattaataat

SEQ ID NO: 3203745 - DNA, 20 bp, Homo sapiens
attcctagtggatgactgtt

SEQ ID NO: 3203746 - DNA, 19 bp, Homo sapiens
attcctatatcctgtgact

SEQ ID NO: 3203747 - DNA, 20 bp, Homo sapiens
attcctatatcctgtgactg

SEQ ID NO: 3203748 - DNA, 22 bp, Homo sapiens
attcctatgaagttggcacatt

SEQ ID NO: 3203749 - DNA, 22 bp, Homo sapiens
attcctcacagccttggctcct

SEQ ID NO: 3203750 - DNA, 11 bp, Homo sapiens
attcctccctc

SEQ ID NO: 3203751 - DNA, 22 bp, Homo sapiens
attcctctgggaatgttacatt

SEQ ID NO: 3203752 - DNA, 13 bp, Homo sapiens
attcctctgtatt

SEQ ID NO: 3203753 - DNA, 20 bp, Homo sapiens
attcctcttgcctctctcag

SEQ ID NO: 3203754 - DNA, 19 bp, Homo sapiens
attcctgaaaagctgcatt

SEQ ID NO: 3203755 - DNA, 19 bp, Homo sapiens
attcctgaatgaaatatca

SEQ ID NO: 3203756 - DNA, 12 bp, Homo sapiens
attcctgaccca

SEQ ID NO: 3203757 - DNA, 20 bp, Homo sapiens
attcctgcctttaagccaaa

SEQ ID NO: 3203758 - DNA, 15 bp, Homo sapiens
attcctggacatcac

SEQ ID NO: 3203759 - DNA, 20 bp, Homo sapiens
attcctggacatcaccagtc

SEQ ID NO: 3203760 - DNA, 15 bp, Homo sapiens
attcctgggcctgtc

SEQ ID NO: 3203761 - DNA, 17 bp, Homo sapiens
attcctgggcctgtccc

SEQ ID NO: 3203762 - DNA, 15 bp, Homo sapiens
attcctggtacccag

SEQ ID NO: 3203763 - DNA, 17 bp, Homo sapiens
attcctgtaacttttaa

SEQ ID NO: 3203764 - DNA, 18 bp, Homo sapiens
attcctgtaacttttaat

SEQ ID NO: 3203765 - DNA, 13 bp, Homo sapiens
attcctgtatgtt

SEQ ID NO: 3203766 - DNA, 19 bp, Homo sapiens
attccttagactcttttcc

SEQ ID NO: 3203767 - DNA, 22 bp, Homo sapiens
attccttagactcttttccttc

SEQ ID NO: 3203768 - DNA, 14 bp, Homo sapiens
attccttctctgaa

SEQ ID NO: 3203769 - DNA, 15 bp, Homo sapiens
attccttctctgaac

SEQ ID NO: 3203770 - DNA, 14 bp, Homo sapiens
attccttctttgat

SEQ ID NO: 3203771 - DNA, 23 bp, Homo sapiens
attccttctttgataatgttaaa

SEQ ID NO: 3203772 - DNA, 19 bp, Homo sapiens
attccttgatcattttggg

SEQ ID NO: 3203773 - DNA, 20 bp, Homo sapiens
attccttgatcattttggga

SEQ ID NO: 3203774 - DNA, 16 bp, Homo sapiens
attccttgccccacag

SEQ ID NO: 3203775 - DNA, 17 bp, Homo sapiens
attccttgccccacagt

SEQ ID NO: 3203776 - DNA, 15 bp, Homo sapiens
attcctttcccttta

SEQ ID NO: 3203777 - DNA, 17 bp, Homo sapiens
attcctttctatcattt

SEQ ID NO: 3203778 - DNA, 23 bp, Homo sapiens
attcctttgtcttcaaactgtga

SEQ ID NO: 3203779 - DNA, 22 bp, Homo sapiens
attcgaatggggtagaaacatt

SEQ ID NO: 3203780 - DNA, 23 bp, Homo sapiens
attcgaatggggtagaaacattg

SEQ ID NO: 3203781 - DNA, 16 bp, Homo sapiens
attcgacctataagaa

SEQ ID NO: 3203782 - DNA, 15 bp, Homo sapiens
attcgggccacaggg

SEQ ID NO: 3203783 - DNA, 16 bp, Homo sapiens
attcggggctgacgat

SEQ ID NO: 3203784 - DNA, 14 bp, Homo sapiens
attcgtgagctggg

SEQ ID NO: 3203785 - DNA, 19 bp, Homo sapiens
attctaaagagcacttact

SEQ ID NO: 3203786 - DNA, 18 bp, Homo sapiens
attctaaagattctatag

SEQ ID NO: 3203787 - DNA, 19 bp, Homo sapiens
attctaaagattctatagt

SEQ ID NO: 3203788 - DNA, 14 bp, Homo sapiens
attctaaatacatg

SEQ ID NO: 3203789 - DNA, 17 bp, Homo sapiens
attctaaatgaatgttt

SEQ ID NO: 3203790 - DNA, 18 bp, Homo sapiens
attctaaatgaatgttta

SEQ ID NO: 3203791 - DNA, 18 bp, Homo sapiens
attctaacggtctgttct

SEQ ID NO: 3203792 - DNA, 12 bp, Homo sapiens
attctaagactt

SEQ ID NO: 3203793 - DNA, 22 bp, Homo sapiens
attctaagacttactctaagat

SEQ ID NO: 3203794 - DNA, 22 bp, Homo sapiens
attctaagccagttttcatttt

SEQ ID NO: 3203795 - DNA, 19 bp, Homo sapiens
attctaagttatttacttt

SEQ ID NO: 3203796 - DNA, 21 bp, Homo sapiens
attctaagttatttactttta

SEQ ID NO: 3203797 - DNA, 18 bp, Homo sapiens
attctaataaatatacta

SEQ ID NO: 3203798 - DNA, 20 bp, Homo sapiens
attctaataaatatactatg

SEQ ID NO: 3203799 - DNA, 13 bp, Homo sapiens
attctaatctaac

SEQ ID NO: 3203800 - DNA, 23 bp, Homo sapiens
attctaatgatgatcaattatag

SEQ ID NO: 3203801 - DNA, 12 bp, Homo sapiens
attctaatgtct

SEQ ID NO: 3203802 - DNA, 13 bp, Homo sapiens
attctaatgtctt

SEQ ID NO: 3203803 - DNA, 16 bp, Homo sapiens
attctaatgtcttcat

SEQ ID NO: 3203804 - DNA, 15 bp, Homo sapiens
attctactaagttat

SEQ ID NO: 3203805 - DNA, 16 bp, Homo sapiens
attctactaagttatt

SEQ ID NO: 3203806 - DNA, 22 bp, Homo sapiens
attctactcttgtcatttttaa

SEQ ID NO: 3203807 - DNA, 14 bp, Homo sapiens
attctacttgctta

SEQ ID NO: 3203808 - DNA, 17 bp, Homo sapiens
attctactttaagcact

SEQ ID NO: 3203809 - DNA, 23 bp, Homo sapiens
attctagatcagatgctccaaga

SEQ ID NO: 3203810 - DNA, 14 bp, Homo sapiens
attctagcagggaa

SEQ ID NO: 3203811 - DNA, 17 bp, Homo sapiens
attctagccaaactatt

SEQ ID NO: 3203812 - DNA, 20 bp, Homo sapiens
attctagccaaactattcta

SEQ ID NO: 3203813 - DNA, 21 bp, Homo sapiens
attctagggtttcttaaatat

SEQ ID NO: 3203814 - DNA, 22 bp, Homo sapiens
attctagggtttcttaaatata

SEQ ID NO: 3203815 - DNA, 15 bp, Homo sapiens
attctataaaactct

SEQ ID NO: 3203816 - DNA, 15 bp, Homo sapiens
attctataaggccat

SEQ ID NO: 3203817 - DNA, 23 bp, Homo sapiens
attctatacacaccctgcccctg

SEQ ID NO: 3203818 - DNA, 14 bp, Homo sapiens
attctatatgaatt

SEQ ID NO: 3203819 - DNA, 15 bp, Homo sapiens
attctatatgaattt

SEQ ID NO: 3203820 - DNA, 16 bp, Homo sapiens
attctatatgaattta

SEQ ID NO: 3203821 - DNA, 17 bp, Homo sapiens
attctatatgaatttaa

SEQ ID NO: 3203822 - DNA, 20 bp, Homo sapiens
attctatattattatatata

SEQ ID NO: 3203823 - DNA, 19 bp, Homo sapiens
attctatccccaatcagct

SEQ ID NO: 3203824 - DNA, 21 bp, Homo sapiens
attctatccccaatcagctcc

SEQ ID NO: 3203825 - DNA, 20 bp, Homo sapiens
attctatgaagcccacccag

SEQ ID NO: 3203826 - DNA, 16 bp, Homo sapiens
attctatgtatgttaa

SEQ ID NO: 3203827 - DNA, 13 bp, Homo sapiens
attctatgttaaa

SEQ ID NO: 3203828 - DNA, 24 bp, Homo sapiens
attctatgttaaatactgtgcaga

SEQ ID NO: 3203829 - DNA, 14 bp, Homo sapiens
attctattaacttt

SEQ ID NO: 3203830 - DNA, 15 bp, Homo sapiens
attctattatatatt

SEQ ID NO: 3203831 - DNA, 20 bp, Homo sapiens
attctatttatatgtacatg

SEQ ID NO: 3203832 - DNA, 14 bp, Homo sapiens
attctcagaatctc

SEQ ID NO: 3203833 - DNA, 18 bp, Homo sapiens
attctcagaatctcaaat

SEQ ID NO: 3203834 - DNA, 20 bp, Homo sapiens
attctcagaatctcaaataa

SEQ ID NO: 3203835 - DNA, 23 bp, Homo sapiens
attctcagatatttatattttta

SEQ ID NO: 3203836 - DNA, 15 bp, Homo sapiens
attctcataatcctt

SEQ ID NO: 3203837 - DNA, 19 bp, Homo sapiens
attctcataggagactgcg

SEQ ID NO: 3203838 - DNA, 21 bp, Homo sapiens
attctcccaggtaccagctgc

SEQ ID NO: 3203839 - DNA, 12 bp, Homo sapiens
attgaaaagtac

SEQ ID NO: 3203840 - DNA, 15 bp, Homo sapiens
attgaaaatcttgtg

SEQ ID NO: 3203841 - DNA, 18 bp, Homo sapiens
attgaaagagaaccagtt

SEQ ID NO: 3203842 - DNA, 12 bp, Homo sapiens
attgaaattata

SEQ ID NO: 3203843 - DNA, 12 bp, Homo sapiens
attgaaattcta

SEQ ID NO: 3203844 - DNA, 19 bp, Homo sapiens
attgaacacaaactgtaaa

SEQ ID NO: 3203845 - DNA, 20 bp, Homo sapiens
attgaacacaaactgtaaat

SEQ ID NO: 3203846 - DNA, 18 bp, Homo sapiens
attgaaccagctcatctc

SEQ ID NO: 3203847 - DNA, 16 bp, Homo sapiens
attgaagaaaagcact

SEQ ID NO: 3203848 - DNA, 15 bp, Homo sapiens
attgaagccctccaa

SEQ ID NO: 3203849 - DNA, 18 bp, Homo sapiens
attgaagccgactctggc

SEQ ID NO: 3203850 - DNA, 19 bp, Homo sapiens
attgaaggaagccaaattt

SEQ ID NO: 3203851 - DNA, 20 bp, Homo sapiens
attgaaggaagccaaattta

SEQ ID NO: 3203852 - DNA, 15 bp, Homo sapiens
attgaaggcttaaac

SEQ ID NO: 3203853 - DNA, 19 bp, Homo sapiens
attgaaggcttaaacccat

SEQ ID NO: 3203854 - DNA, 19 bp, Homo sapiens
attgaagtattttgctgga

SEQ ID NO: 3203855 - DNA, 19 bp, Homo sapiens
attgaataaagttgaagct

SEQ ID NO: 3203856 - DNA, 20 bp, Homo sapiens
attgaatcagtataaacaaa

SEQ ID NO: 3203857 - DNA, 23 bp, Homo sapiens
attgaatctgattggacattttc

SEQ ID NO: 3203858 - DNA, 13 bp, Homo sapiens
attgacaaatctg

SEQ ID NO: 3203859 - DNA, 15 bp, Homo sapiens
attgacaaatctgtg

SEQ ID NO: 3203860 - DNA, 20 bp, Homo sapiens
attgacaaatctgtgtatat

SEQ ID NO: 3203861 - DNA, 18 bp, Homo sapiens
attgacaggattattgga

SEQ ID NO: 3203862 - DNA, 16 bp, Homo sapiens
attgaccaagaactgc

SEQ ID NO: 3203863 - DNA, 20 bp, Homo sapiens
attgaccaagaactgcatgg

SEQ ID NO: 3203864 - DNA, 14 bp, Homo sapiens
attgaccatctgct

SEQ ID NO: 3203865 - DNA, 18 bp, Homo sapiens
attgacctctcagggcct

SEQ ID NO: 3203866 - DNA, 19 bp, Homo sapiens
attgacctctcagggcctg

SEQ ID NO: 3203867 - DNA, 20 bp, Homo sapiens
attgacctctcagggcctgg

SEQ ID NO: 3203868 - DNA, 12 bp, Homo sapiens
attgacctgctc

SEQ ID NO: 3203869 - DNA, 21 bp, Homo sapiens
attgacctgctccgctgctcc

SEQ ID NO: 3203870 - DNA, 14 bp, Homo sapiens
atacaaatatattg

SEQ ID NO: 3203871 - DNA, 20 bp, Homo sapiens
atacaaatggattttgggag

SEQ ID NO: 3203872 - DNA, 15 bp, Homo sapiens
atacaaattagaaaa

SEQ ID NO: 3203873 - DNA, 22 bp, Homo sapiens
atacaaccctggcattatgtcc

SEQ ID NO: 3203874 - DNA, 17 bp, Homo sapiens
atacaacctccctcttg

SEQ ID NO: 3203875 - DNA, 18 bp, Homo sapiens
atacaagactgttgtgat

SEQ ID NO: 3203876 - DNA, 17 bp, Homo sapiens
atacaagattgaaaatc

SEQ ID NO: 3203877 - DNA, 22 bp, Homo sapiens
atacaagccattctaaggaaat

SEQ ID NO: 3203878 - DNA, 10 bp, Homo sapiens
atacaataaa

SEQ ID NO: 3203879 - DNA, 12 bp, Homo sapiens
atacaataaact

SEQ ID NO: 3203880 - DNA, 21 bp, Homo sapiens
atacaataaactattggaaag

SEQ ID NO: 3203881 - DNA, 14 bp, Homo sapiens
atacaataacccag

SEQ ID NO: 3203882 - DNA, 13 bp, Homo sapiens
atacaatatataa

SEQ ID NO: 3203883 - DNA, 19 bp, Homo sapiens
atacaatatataaaaatat

SEQ ID NO: 3203884 - DNA, 20 bp, Homo sapiens
atacaatatataaaaatata

SEQ ID NO: 3203885 - DNA, 17 bp, Homo sapiens
atacaatgaacacttat

SEQ ID NO: 3203886 - DNA, 13 bp, Homo sapiens
atacaattaaagg

SEQ ID NO: 3203887 - DNA, 14 bp, Homo sapiens
atacaattaaaggt

SEQ ID NO: 3203888 - DNA, 18 bp, Homo sapiens
atacacaagcaatgcaag

SEQ ID NO: 3203889 - DNA, 19 bp, Homo sapiens
atacacaagcaatgcaaga

SEQ ID NO: 3203890 - DNA, 19 bp, Homo sapiens
atacacagtactttattgt

SEQ ID NO: 3203891 - DNA, 15 bp, Homo sapiens
atacacatttcacat

SEQ ID NO: 3203892 - DNA, 14 bp, Homo sapiens
atacacatttgcta

SEQ ID NO: 3203893 - DNA, 19 bp, Homo sapiens
atacacccagttctgaata

SEQ ID NO: 3203894 - DNA, 14 bp, Homo sapiens
atacaccgggcctg

SEQ ID NO: 3203895 - DNA, 22 bp, Homo sapiens
atacactatttgtgagcaaagg

SEQ ID NO: 3203896 - DNA, 20 bp, Homo sapiens
atacactcaaacaatcatga

SEQ ID NO: 3203897 - DNA, 13 bp, Homo sapiens
atacacttacact

SEQ ID NO: 3203898 - DNA, 19 bp, Homo sapiens
atacacttcttttgaacat

SEQ ID NO: 3203899 - DNA, 22 bp, Homo sapiens
atacacttgtataaatgtatat

SEQ ID NO: 3203900 - DNA, 15 bp, Homo sapiens
atacacttttttcca

SEQ ID NO: 3203901 - DNA, 13 bp, Homo sapiens
atacagaaatgca

SEQ ID NO: 3203902 - DNA, 15 bp, Homo sapiens
atacagaaatgcaaa

SEQ ID NO: 3203903 - DNA, 20 bp, Homo sapiens
atacagaatcttgttttgaa

SEQ ID NO: 3203904 - DNA, 20 bp, Homo sapiens
atacagacaaacttgatttc

SEQ ID NO: 3203905 - DNA, 14 bp, Homo sapiens
atacagacactaag

SEQ ID NO: 3203906 - DNA, 18 bp, Homo sapiens
atacagacactaagttat

SEQ ID NO: 3203907 - DNA, 15 bp, Homo sapiens
atacagataacatta

SEQ ID NO: 3203908 - DNA, 21 bp, Homo sapiens
atacagataattcatttgtat

SEQ ID NO: 3203909 - DNA, 22 bp, Homo sapiens
atacagatgaaaatttgagact

SEQ ID NO: 3203910 - DNA, 20 bp, Homo sapiens
atacagctgtattgtctgaa

SEQ ID NO: 3203911 - DNA, 12 bp, Homo sapiens
atacagcttcat

SEQ ID NO: 3203912 - DNA, 21 bp, Homo sapiens
atacagggcatgcattttgca

SEQ ID NO: 3203913 - DNA, 19 bp, Homo sapiens
atacagggtctcttccttc

SEQ ID NO: 3203914 - DNA, 19 bp, Homo sapiens
atacagtaagcatagttaa

SEQ ID NO: 3203915 - DNA, 14 bp, Homo sapiens
atacagtattctgt

SEQ ID NO: 3203916 - DNA, 15 bp, Homo sapiens
atacagtattctgta

SEQ ID NO: 3203917 - DNA, 18 bp, Homo sapiens
atacagtccctaaagaaa

SEQ ID NO: 3203918 - DNA, 20 bp, Homo sapiens
atacagtccctaaagaaaaa

SEQ ID NO: 3203919 - DNA, 22 bp, Homo sapiens
atacagtccctaaagaaaaaaa

SEQ ID NO: 3203920 - DNA, 14 bp, Homo sapiens
atacagtgccttgc

SEQ ID NO: 3203921 - DNA, 15 bp, Homo sapiens
atacagtgttatttt

SEQ ID NO: 3203922 - DNA, 15 bp, Homo sapiens
atacagttataaaat

SEQ ID NO: 3203923 - DNA, 18 bp, Homo sapiens
atacagttattaaaatgt

SEQ ID NO: 3203924 - DNA, 16 bp, Homo sapiens
atacagttattttgga

SEQ ID NO: 3203925 - DNA, 19 bp, Homo sapiens
atacagttcaataaactta

SEQ ID NO: 3203926 - DNA, 21 bp, Homo sapiens
atacagtttatttttaaagat

SEQ ID NO: 3203927 - DNA, 14 bp, Homo sapiens
atacagttttatgc

SEQ ID NO: 3203928 - DNA, 15 bp, Homo sapiens
atacagttttatgct

SEQ ID NO: 3203929 - DNA, 15 bp, Homo sapiens
atacataaatagtag

SEQ ID NO: 3203930 - DNA, 19 bp, Homo sapiens
atacataactaaatttgat

SEQ ID NO: 3203931 - DNA, 22 bp, Homo sapiens
atacataactaaatttgatact

SEQ ID NO: 3203932 - DNA, 21 bp, Homo sapiens
atacataagcggcgtaagttt

SEQ ID NO: 3203933 - DNA, 20 bp, Homo sapiens
atacataatgtttttccttt

SEQ ID NO: 3203934 - DNA, 22 bp, Homo sapiens
atacataatgtttttcctttct

SEQ ID NO: 3203935 - DNA, 22 bp, Homo sapiens
atacatacacttgtataaatgt

SEQ ID NO: 3203936 - DNA, 13 bp, Homo sapiens
atacatatcttta

SEQ ID NO: 3203937 - DNA, 16 bp, Homo sapiens
atacatatctttatta

SEQ ID NO: 3203938 - DNA, 20 bp, Homo sapiens
atacatatctttattaatca

SEQ ID NO: 3203939 - DNA, 14 bp, Homo sapiens
atacatatgtagaa

SEQ ID NO: 3203940 - DNA, 20 bp, Homo sapiens
atacatatgtagaaacattt

SEQ ID NO: 3203941 - DNA, 13 bp, Homo sapiens
atacatcactgct

SEQ ID NO: 3203942 - DNA, 14 bp, Homo sapiens
atacatcagttatt

SEQ ID NO: 3203943 - DNA, 16 bp, Homo sapiens
atacatgcaaaaagaa

SEQ ID NO: 3203944 - DNA, 14 bp, Homo sapiens
atacatgctacttt

SEQ ID NO: 3203945 - DNA, 13 bp, Homo sapiens
atacatgtgtgta

SEQ ID NO: 3203946 - DNA, 17 bp, Homo sapiens
atacatgtgtgtatata

SEQ ID NO: 3203947 - DNA, 20 bp, Homo sapiens
atacatgtgtgtatatatgt

SEQ ID NO: 3203948 - DNA, 21 bp, Homo sapiens
atacatgtgtgtatatatgtg

SEQ ID NO: 3203949 - DNA, 13 bp, Homo sapiens
atacattaaaact

SEQ ID NO: 3203950 - DNA, 14 bp, Homo sapiens
atacatttaaaact

SEQ ID NO: 3203951 - DNA, 21 bp, Homo sapiens
atacatttataatgtttgcta

SEQ ID NO: 3203952 - DNA, 23 bp, Homo sapiens
atacatttataatgtttgctatt

SEQ ID NO: 3203953 - DNA, 14 bp, Homo sapiens
atacattttctggt

SEQ ID NO: 3203954 - DNA, 16 bp, Homo sapiens
atacattttctggtgg

SEQ ID NO: 3203955 - DNA, 19 bp, Homo sapiens
atacattttgttatagaat

SEQ ID NO: 3203956 - DNA, 21 bp, Homo sapiens
atacattttgttatagaatac

SEQ ID NO: 3203957 - DNA, 22 bp, Homo sapiens
atacattttgttatagaatact

SEQ ID NO: 3203958 - DNA, 20 bp, Homo sapiens
atacattttttaagcttcag

SEQ ID NO: 3203959 - DNA, 17 bp, Homo sapiens
ataccaaattaaaaaaa

SEQ ID NO: 3203960 - DNA, 13 bp, Homo sapiens
ataccacaagcct

SEQ ID NO: 3203961 - DNA, 17 bp, Homo sapiens
ataccactctttacctt

SEQ ID NO: 3203962 - DNA, 21 bp, Homo sapiens
ataccactctttacctttatt

SEQ ID NO: 3203963 - DNA, 19 bp, Homo sapiens
ataccagagccttcaagtg

SEQ ID NO: 3203964 - DNA, 12 bp, Homo sapiens
ataccagtgtgg

SEQ ID NO: 3203965 - DNA, 17 bp, Homo sapiens
ataccattaaaactgct

SEQ ID NO: 3203966 - DNA, 18 bp, Homo sapiens
ataccattaaaactgctt

SEQ ID NO: 3203967 - DNA, 17 bp, Homo sapiens
ataccatttcctcagct

SEQ ID NO: 3203968 - DNA, 17 bp, Homo sapiens
atacccccccatgcagt

SEQ ID NO: 3203969 - DNA, 17 bp, Homo sapiens
ataccccttaaccccgg

SEQ ID NO: 3203970 - DNA, 19 bp, Homo sapiens
ataccctggccgccccctg

SEQ ID NO: 3203971 - DNA, 15 bp, Homo sapiens
atacctaattgtgga

SEQ ID NO: 3203972 - DNA, 19 bp, Homo sapiens
atacctacaataaactggt

SEQ ID NO: 3203973 - DNA, 13 bp, Homo sapiens
atacctataatgt

SEQ ID NO: 3203974 - DNA, 20 bp, Homo sapiens
atacctcatgtttatgaaaa

SEQ ID NO: 3203975 - DNA, 17 bp, Homo sapiens
atacctccattaaatgg

SEQ ID NO: 3203976 - DNA, 14 bp, Homo sapiens
atacctctgtgtgc

SEQ ID NO: 3203977 - DNA, 16 bp, Homo sapiens
atacctctgtgtgctc

SEQ ID NO: 3203978 - DNA, 20 bp, Homo sapiens
atacctgattttttttcctt

SEQ ID NO: 3203979 - DNA, 23 bp, Homo sapiens
atacctggcttttactttattaa

SEQ ID NO: 3203980 - DNA, 14 bp, Homo sapiens
atacgaaacacaaa

SEQ ID NO: 3203981 - DNA, 13 bp, Homo sapiens
atacgactttatt

SEQ ID NO: 3203982 - DNA, 21 bp, Homo sapiens
atacgctggcaacacagaggc

SEQ ID NO: 3203983 - DNA, 15 bp, Homo sapiens
atacgtgcacagggt

SEQ ID NO: 3203984 - DNA, 14 bp, Homo sapiens
atactaaaagcaaa

SEQ ID NO: 3203985 - DNA, 14 bp, Homo sapiens
atactacatcttta

SEQ ID NO: 3203986 - DNA, 16 bp, Homo sapiens
atactacatctttaaa

SEQ ID NO: 3203987 - DNA, 16 bp, Homo sapiens
atactaccctttgctg

SEQ ID NO: 3203988 - DNA, 14 bp, Homo sapiens
atactaccttgaaa

SEQ ID NO: 3203989 - DNA, 17 bp, Homo sapiens
atactaccttgaaaata

SEQ ID NO: 3203990 - DNA, 20 bp, Homo sapiens
atactaggatacagaaatgc

SEQ ID NO: 3203991 - DNA, 22 bp, Homo sapiens
atactatttaaagcctcctcat

SEQ ID NO: 3203992 - DNA, 18 bp, Homo sapiens
atactatttagattttct

SEQ ID NO: 3203993 - DNA, 12 bp, Homo sapiens
atactcaagttt

SEQ ID NO: 3203994 - DNA, 13 bp, Homo sapiens
atactccagtgta

SEQ ID NO: 3203995 - DNA, 12 bp, Homo sapiens
atactccttccc

SEQ ID NO: 3203996 - DNA, 13 bp, Homo sapiens
atactctgctatt

SEQ ID NO: 3203997 - DNA, 22 bp, Homo sapiens
atactctgctatttctcttgct

SEQ ID NO: 3203998 - DNA, 16 bp, Homo sapiens
atactctgcttagaat

SEQ ID NO: 3203999 - DNA, 12 bp, Homo sapiens
atactctgtcag

SEQ ID NO: 3204000 - DNA, 13 bp, Homo sapiens
atactctgtcaga

SEQ ID NO: 3204001 - DNA, 14 bp, Homo sapiens
atactctgtcagat

SEQ ID NO: 3204002 - DNA, 16 bp, Homo sapiens
atactctgtcagatgg

SEQ ID NO: 3204003 - DNA, 16 bp, Homo sapiens
atactctttctgtata

SEQ ID NO: 3204004 - DNA, 19 bp, Homo sapiens
atactgaaaaaaaaagctt

SEQ ID NO: 3204005 - DNA, 13 bp, Homo sapiens
atactgaaggaaa

SEQ ID NO: 3204006 - DNA, 20 bp, Homo sapiens
atactgaatgcataaataaa

SEQ ID NO: 3204007 - DNA, 14 bp, Homo sapiens
atactgattatgaa

SEQ ID NO: 3204008 - DNA, 15 bp, Homo sapiens
atactgattttgaaa

SEQ ID NO: 3204009 - DNA, 14 bp, Homo sapiens
atactgcagggcca

SEQ ID NO: 3204010 - DNA, 17 bp, Homo sapiens
atactgcagggccagga

SEQ ID NO: 3204011 - DNA, 22 bp, Homo sapiens
atactgcgactttctgcctgga

SEQ ID NO: 3204012 - DNA, 22 bp, Homo sapiens
atactgctacagcaatttctaa

SEQ ID NO: 3204013 - DNA, 16 bp, Homo sapiens
atactgctactgtaat

SEQ ID NO: 3204014 - DNA, 14 bp, Homo sapiens
atactgcttgctta

SEQ ID NO: 3204015 - DNA, 21 bp, Homo sapiens
atactgcttgcttacaatctt

SEQ ID NO: 3204016 - DNA, 14 bp, Homo sapiens
atactggaagtttt

SEQ ID NO: 3204017 - DNA, 16 bp, Homo sapiens
atactggaagttttgc

SEQ ID NO: 3204018 - DNA, 20 bp, Homo sapiens
atactggaagttttgcattt

SEQ ID NO: 3204019 - DNA, 15 bp, Homo sapiens
atactggaggaacac

SEQ ID NO: 3204020 - DNA, 23 bp, Homo sapiens
atactgggttcttgttttatata

SEQ ID NO: 3204021 - DNA, 15 bp, Homo sapiens
atactgggtttcaag

SEQ ID NO: 3204022 - DNA, 17 bp, Homo sapiens
atactgggtttcaagaa

SEQ ID NO: 3204023 - DNA, 20 bp, Homo sapiens
atactgggtttcaagaaaat

SEQ ID NO: 3204024 - DNA, 16 bp, Homo sapiens
atactgtagtattctt

SEQ ID NO: 3204025 - DNA, 20 bp, Homo sapiens
atactgtcccacttctcatc

SEQ ID NO: 3204026 - DNA, 13 bp, Homo sapiens
atactgtgcagaa

SEQ ID NO: 3204027 - DNA, 16 bp, Homo sapiens
atactgtgcagaataa

SEQ ID NO: 3204028 - DNA, 17 bp, Homo sapiens
atactgtgcagaataat

SEQ ID NO: 3204029 - DNA, 18 bp, Homo sapiens
atactgtgcagaataatg

SEQ ID NO: 3204030 - DNA, 21 bp, Homo sapiens
atactgtgcagaataatggaa

SEQ ID NO: 3204031 - DNA, 15 bp, Homo sapiens
atactgtgtgggata

SEQ ID NO: 3204032 - DNA, 18 bp, Homo sapiens
atactgtgtgggatactt

SEQ ID NO: 3204033 - DNA, 14 bp, Homo sapiens
atacttagtggtat

SEQ ID NO: 3204034 - DNA, 22 bp, Homo sapiens
atacttatattttcgtatgaaa

SEQ ID NO: 3204035 - DNA, 21 bp, Homo sapiens
atacttatatttttaataaaa

SEQ ID NO: 3204036 - DNA, 18 bp, Homo sapiens
atacttcaaaaataatgt

SEQ ID NO: 3204037 - DNA, 17 bp, Homo sapiens
atacttcaaaagccata

SEQ ID NO: 3204038 - DNA, 20 bp, Homo sapiens
atacttcatttaaaaaaatc

SEQ ID NO: 3204039 - DNA, 15 bp, Homo sapiens
atacttcctgggtca

SEQ ID NO: 3204040 - DNA, 12 bp, Homo sapiens
atacttgactct

SEQ ID NO: 3204041 - DNA, 17 bp, Homo sapiens
atacttgactctaatat

SEQ ID NO: 3204042 - DNA, 20 bp, Homo sapiens
atacttgactctaatatgat

SEQ ID NO: 3204043 - DNA, 22 bp, Homo sapiens
atacttgtttcagcttctctgc

SEQ ID NO: 3204044 - DNA, 12 bp, Homo sapiens
atactttacatg

SEQ ID NO: 3204045 - DNA, 18 bp, Homo sapiens
atactttagtagacattt

SEQ ID NO: 3204046 - DNA, 20 bp, Homo sapiens
atactttagtagacatttat

SEQ ID NO: 3204047 - DNA, 14 bp, Homo sapiens
atactttagtatga

SEQ ID NO: 3204048 - DNA, 17 bp, Homo sapiens
atactttatatctgtaa

SEQ ID NO: 3204049 - DNA, 20 bp, Homo sapiens
atactttatatctgtaatga

SEQ ID NO: 3204050 - DNA, 21 bp, Homo sapiens
atactttatatctgtaatgat

SEQ ID NO: 3204051 - DNA, 19 bp, Homo sapiens
atactttcgaaatttcatt

SEQ ID NO: 3204052 - DNA, 18 bp, Homo sapiens
atactttgtcctaagaga

SEQ ID NO: 3204053 - DNA, 18 bp, Homo sapiens
atactttgtttattgtaa

SEQ ID NO: 3204054 - DNA, 17 bp, Homo sapiens
atacttttaaattatgg

SEQ ID NO: 3204055 - DNA, 15 bp, Homo sapiens
atacttttactctgc

SEQ ID NO: 3204056 - DNA, 17 bp, Homo sapiens
atacttttactctgcct

SEQ ID NO: 3204057 - DNA, 23 bp, Homo sapiens
atactttttgaggggttcttctg

SEQ ID NO: 3204058 - DNA, 13 bp, Homo sapiens
atacttttttcta

SEQ ID NO: 3204059 - DNA, 19 bp, Homo sapiens
atacttttttcttatttaa

SEQ ID NO: 3204060 - DNA, 14 bp, Homo sapiens
atactttttttcac

SEQ ID NO: 3204061 - DNA, 17 bp, Homo sapiens
atagaaaactgaaaatc

SEQ ID NO: 3204062 - DNA, 18 bp, Homo sapiens
atagaaaaggaagacagc

SEQ ID NO: 3204063 - DNA, 15 bp, Homo sapiens
atagaaacatgacac

SEQ ID NO: 3204064 - DNA, 12 bp, Homo sapiens
atagaaatggaa

SEQ ID NO: 3204065 - DNA, 15 bp, Homo sapiens
atagaactctgggct

SEQ ID NO: 3204066 - DNA, 14 bp, Homo sapiens
atagaagctgtagt

SEQ ID NO: 3204067 - DNA, 16 bp, Homo sapiens
atagaaggaatttgta

SEQ ID NO: 3204068 - DNA, 20 bp, Homo sapiens
atagaaggaatttgtacttc

SEQ ID NO: 3204069 - DNA, 22 bp, Homo sapiens
atagaataaaggcagttttcta

SEQ ID NO: 3204070 - DNA, 13 bp, Homo sapiens
atagaatactttt

SEQ ID NO: 3204071 - DNA, 21 bp, Homo sapiens
atagaatacttttttctagtt

SEQ ID NO: 3204072 - DNA, 22 bp, Homo sapiens
atagaatacttttttctagttt

SEQ ID NO: 3204073 - DNA, 22 bp, Homo sapiens
atagaatatttattacctctga

SEQ ID NO: 3204074 - DNA, 16 bp, Homo sapiens
atagaatcaatcagta

SEQ ID NO: 3204075 - DNA, 20 bp, Homo sapiens
atagaatgtggccacttatt

SEQ ID NO: 3204076 - DNA, 23 bp, Homo sapiens
atagaatgtggccacttatttca

SEQ ID NO: 3204077 - DNA, 16 bp, Homo sapiens
atagacaaaaagtata

SEQ ID NO: 3204078 - DNA, 17 bp, Homo sapiens
atagacaacgatgaatt

SEQ ID NO: 3204079 - DNA, 22 bp, Homo sapiens
atagacactccccgaagtcttt

SEQ ID NO: 3204080 - DNA, 21 bp, Homo sapiens
atagacagtaacggtgtttag

SEQ ID NO: 3204081 - DNA, 13 bp, Homo sapiens
atagacatgaaag

SEQ ID NO: 3204082 - DNA, 15 bp, Homo sapiens
atagactagagaaac

SEQ ID NO: 3204083 - DNA, 15 bp, Homo sapiens
atagacttaaatctc

SEQ ID NO: 3204084 - DNA, 18 bp, Homo sapiens
atagagaaaagtgtatta

SEQ ID NO: 3204085 - DNA, 13 bp, Homo sapiens
atagagacaatct

SEQ ID NO: 3204086 - DNA, 17 bp, Homo sapiens
atagagcaaaattgatg

SEQ ID NO: 3204087 - DNA, 23 bp, Homo sapiens
atagagcatatttgccaataaag

SEQ ID NO: 3204088 - DNA, 20 bp, Homo sapiens
atagagccctggccagccct

SEQ ID NO: 3204089 - DNA, 21 bp, Homo sapiens
atagagccctggccagccctt

SEQ ID NO: 3204090 - DNA, 22 bp, Homo sapiens
atagagctgcagggtggattgt

SEQ ID NO: 3204091 - DNA, 13 bp, Homo sapiens
atagaggaagaaa

SEQ ID NO: 3204092 - DNA, 21 bp, Homo sapiens
atagaggcttctccgccagcc

SEQ ID NO: 3204093 - DNA, 17 bp, Homo sapiens
atagagtatactaaaaa

SEQ ID NO: 3204094 - DNA, 22 bp, Homo sapiens
atagagtgactccaagaacaat

SEQ ID NO: 3204095 - DNA, 14 bp, Homo sapiens
atagagtgtactta

SEQ ID NO: 3204096 - DNA, 19 bp, Homo sapiens
atagagtgtacttaactat

SEQ ID NO: 3204097 - DNA, 14 bp, Homo sapiens
atagagtgttatca

SEQ ID NO: 3204098 - DNA, 16 bp, Homo sapiens
atagagtttaacacaa

SEQ ID NO: 3204099 - DNA, 13 bp, Homo sapiens
atagatataatga

SEQ ID NO: 3204100 - DNA, 17 bp, Homo sapiens
atagatattttcacaat

SEQ ID NO: 3204101 - DNA, 15 bp, Homo sapiens
atagatcagtatttc

SEQ ID NO: 3204102 - DNA, 16 bp, Homo sapiens
atagatcagtatttca

SEQ ID NO: 3204103 - DNA, 13 bp, Homo sapiens
atagatctccagc

SEQ ID NO: 3204104 - DNA, 13 bp, Homo sapiens
atagatcttctga

SEQ ID NO: 3204105 - DNA, 17 bp, Homo sapiens
atagatgactttgcaga

SEQ ID NO: 3204106 - DNA, 19 bp, Homo sapiens
atagatgcaagatatttat

SEQ ID NO: 3204107 - DNA, 21 bp, Homo sapiens
atagatgcaagatatttatat

SEQ ID NO: 3204108 - DNA, 17 bp, Homo sapiens
atagattaatggcactg

SEQ ID NO: 3204109 - DNA, 14 bp, Homo sapiens
atagattagaaaaa

SEQ ID NO: 3204110 - DNA, 16 bp, Homo sapiens
atagattctaaagatt

SEQ ID NO: 3204111 - DNA, 15 bp, Homo sapiens
atagattgtatctct

SEQ ID NO: 3204112 - DNA, 20 bp, Homo sapiens
atagatttaccctttataga

SEQ ID NO: 3204113 - DNA, 16 bp, Homo sapiens
atagcaacaacaattg

SEQ ID NO: 3204114 - DNA, 15 bp, Homo sapiens
atagcaacagagcac

SEQ ID NO: 3204115 - DNA, 20 bp, Homo sapiens
atagcaagatattgatcaaa

SEQ ID NO: 3204116 - DNA, 22 bp, Homo sapiens
atagcaatccatgttagttttt

SEQ ID NO: 3204117 - DNA, 15 bp, Homo sapiens
atagcacctttcaac

SEQ ID NO: 3204118 - DNA, 11 bp, Homo sapiens
atagcactttc

SEQ ID NO: 3204119 - DNA, 15 bp, Homo sapiens
atagcactttcattg

SEQ ID NO: 3204120 - DNA, 13 bp, Homo sapiens
atagcactttgaa

SEQ ID NO: 3204121 - DNA, 15 bp, Homo sapiens
atagcactttgaaat

SEQ ID NO: 3204122 - DNA, 19 bp, Homo sapiens
atagcactttgaaatacct

SEQ ID NO: 3204123 - DNA, 21 bp, Homo sapiens
atagcactttgaaatacctca

SEQ ID NO: 3204124 - DNA, 22 bp, Homo sapiens
atagcactttgaaatacctcat

SEQ ID NO: 3204125 - DNA, 15 bp, Homo sapiens
atagcagaggggcca

SEQ ID NO: 3204126 - DNA, 16 bp, Homo sapiens
atagcagaggggccag

SEQ ID NO: 3204127 - DNA, 18 bp, Homo sapiens
atagcagaggggccaggc

SEQ ID NO: 3204128 - DNA, 14 bp, Homo sapiens
atagcagattttaa

SEQ ID NO: 3204129 - DNA, 22 bp, Homo sapiens
atagcagattttaattttgaat

SEQ ID NO: 3204130 - DNA, 20 bp, Homo sapiens
atagcagcaaaaatataaaa

SEQ ID NO: 3204131 - DNA, 13 bp, Homo sapiens
atagcagcctttc

SEQ ID NO: 3204132 - DNA, 20 bp, Homo sapiens
atagcagttataacagatgt

SEQ ID NO: 3204133 - DNA, 22 bp, Homo sapiens
atagcagttataacagatgtga

SEQ ID NO: 3204134 - DNA, 17 bp, Homo sapiens
atagcatccaagtggca

SEQ ID NO: 3204135 - DNA, 13 bp, Homo sapiens
atagcattaacta

SEQ ID NO: 3204136 - DNA, 15 bp, Homo sapiens
atagcattaactaat

SEQ ID NO: 3204137 - DNA, 21 bp, Homo sapiens
atagcattaactaatctattg

SEQ ID NO: 3204138 - DNA, 16 bp, Homo sapiens
atagcattgataatct

SEQ ID NO: 3204139 - DNA, 21 bp, Homo sapiens
atagcattgataatcttcagg

SEQ ID NO: 3204140 - DNA, 24 bp, Homo sapiens
atagcattgataatcttcaggtga

SEQ ID NO: 3204141 - DNA, 22 bp, Homo sapiens
atagcattgttttcttttacag

SEQ ID NO: 3204142 - DNA, 19 bp, Homo sapiens
atagcatttttgatttatg

SEQ ID NO: 3204143 - DNA, 23 bp, Homo sapiens
atagccaactgctaatgcaaatt

SEQ ID NO: 3204144 - DNA, 21 bp, Homo sapiens
atagccacatttggaatactt

SEQ ID NO: 3204145 - DNA, 16 bp, Homo sapiens
atagccaccccagaaa

SEQ ID NO: 3204146 - DNA, 13 bp, Homo sapiens
atagccagagagg

SEQ ID NO: 3204147 - DNA, 14 bp, Homo sapiens
atagccagagagga

SEQ ID NO: 3204148 - DNA, 15 bp, Homo sapiens
atagccagagaggag

SEQ ID NO: 3204149 - DNA, 22 bp, Homo sapiens
atagccagagaggagcacctga

SEQ ID NO: 3204150 - DNA, 19 bp, Homo sapiens
atagccctccccctcaacc

SEQ ID NO: 3204151 - DNA, 15 bp, Homo sapiens
atagcctaggtgaca

SEQ ID NO: 3204152 - DNA, 12 bp, Homo sapiens
atagcctatatt

SEQ ID NO: 3204153 - DNA, 19 bp, Homo sapiens
atagcctatatttacagtg

SEQ ID NO: 3204154 - DNA, 16 bp, Homo sapiens
atagcctgcctcagtg

SEQ ID NO: 3204155 - DNA, 21 bp, Homo sapiens
atagcgctgtttttgttgtgt

SEQ ID NO: 3204156 - DNA, 15 bp, Homo sapiens
atagctaacatttta

SEQ ID NO: 3204157 - DNA, 15 bp, Homo sapiens
atagctaataagtag

SEQ ID NO: 3204158 - DNA, 22 bp, Homo sapiens
atagctacatcagtttgataca

SEQ ID NO: 3204159 - DNA, 17 bp, Homo sapiens
atagctatatccatgta

SEQ ID NO: 3204160 - DNA, 18 bp, Homo sapiens
atagctattactgtctgg

SEQ ID NO: 3204161 - DNA, 20 bp, Homo sapiens
atagctcaggtgtccctgca

SEQ ID NO: 3204162 - DNA, 13 bp, Homo sapiens
atagctcagttta

SEQ ID NO: 3204163 - DNA, 15 bp, Homo sapiens
atagctcatccttaa

SEQ ID NO: 3204164 - DNA, 20 bp, Homo sapiens
atagctccttggagcaggca

SEQ ID NO: 3204165 - DNA, 13 bp, Homo sapiens
atagctctggggt

SEQ ID NO: 3204166 - DNA, 13 bp, Homo sapiens
atagctggggctt

SEQ ID NO: 3204167 - DNA, 16 bp, Homo sapiens
atagcttaactaattt

SEQ ID NO: 3204168 - DNA, 17 bp, Homo sapiens
atagcttgtatagtgta

SEQ ID NO: 3204169 - DNA, 10 bp, Homo sapiens
atagctttat

SEQ ID NO: 3204170 - DNA, 18 bp, Homo sapiens
atagctttattttttaag

SEQ ID NO: 3204171 - DNA, 19 bp, Homo sapiens
atagctttattttttaagt

SEQ ID NO: 3204172 - DNA, 14 bp, Homo sapiens
atagcttttattgt

SEQ ID NO: 3204173 - DNA, 15 bp, Homo sapiens
atagcttttattgta

SEQ ID NO: 3204174 - DNA, 17 bp, Homo sapiens
atagcttttattgtata

SEQ ID NO: 3204175 - DNA, 18 bp, Homo sapiens
ataggaaaagtacattta

SEQ ID NO: 3204176 - DNA, 19 bp, Homo sapiens
ataggaaaagtacatttaa

SEQ ID NO: 3204177 - DNA, 18 bp, Homo sapiens
ataggaacaatctttgct

SEQ ID NO: 3204178 - DNA, 19 bp, Homo sapiens
ataggaacaatctttgctg

SEQ ID NO: 3204179 - DNA, 21 bp, Homo sapiens
ataggaacatatgaaaataca

SEQ ID NO: 3204180 - DNA, 19 bp, Homo sapiens
ataggaagacgcagagcaa

SEQ ID NO: 3204181 - DNA, 17 bp, Homo sapiens
ataggaatagaggaaga

SEQ ID NO: 3204182 - DNA, 19 bp, Homo sapiens
ataggaatagaggaagaaa

SEQ ID NO: 3204183 - DNA, 18 bp, Homo sapiens
ataggaatcattcagaaa

SEQ ID NO: 3204184 - DNA, 14 bp, Homo sapiens
ataggacctttcca

SEQ ID NO: 3204185 - DNA, 15 bp, Homo sapiens
ataggagaagaggca

SEQ ID NO: 3204186 - DNA, 21 bp, Homo sapiens
ataggagtggtgatttgaaaa

SEQ ID NO: 3204187 - DNA, 16 bp, Homo sapiens
ataggatttcttaaat

SEQ ID NO: 3204188 - DNA, 20 bp, Homo sapiens
ataggccagggcatgtgtat

SEQ ID NO: 3204189 - DNA, 18 bp, Homo sapiens
ataggctattaaaaaagt

SEQ ID NO: 3204190 - DNA, 11 bp, Homo sapiens
ataggctctgc

SEQ ID NO: 3204191 - DNA, 22 bp, Homo sapiens
ataggctctgcacagatggatt

SEQ ID NO: 3204192 - DNA, 22 bp, Homo sapiens
atagggcctggtccctgggagg

SEQ ID NO: 3204193 - DNA, 21 bp, Homo sapiens
atagggtagaatgattaatca

SEQ ID NO: 3204194 - DNA, 15 bp, Homo sapiens
atagggtatttgacc

SEQ ID NO: 3204195 - DNA, 23 bp, Homo sapiens
ataggtaatcaatgaatattgaa

SEQ ID NO: 3204196 - DNA, 19 bp, Homo sapiens
ataggtagggggctttcac

SEQ ID NO: 3204197 - DNA, 22 bp, Homo sapiens
ataggtagtttggatatttttg

SEQ ID NO: 3204198 - DNA, 15 bp, Homo sapiens
ataggtcactcctgg

SEQ ID NO: 3204199 - DNA, 14 bp, Homo sapiens
ataggtctcttctc

SEQ ID NO: 3204200 - DNA, 15 bp, Homo sapiens
ataggtctcttctcc

SEQ ID NO: 3204201 - DNA, 17 bp, Homo sapiens
ataggtctcttctccca

SEQ ID NO: 3204202 - DNA, 20 bp, Homo sapiens
ataggtctcttctcccagaa

SEQ ID NO: 3204203 - DNA, 18 bp, Homo sapiens
ataggtgagaaaaaaaca

SEQ ID NO: 3204204 - DNA, 21 bp, Homo sapiens
ataggttaaaaaaaaaagtca

SEQ ID NO: 3204205 - DNA, 18 bp, Homo sapiens
atagtaaaagataacaag

SEQ ID NO: 3204206 - DNA, 19 bp, Homo sapiens
atagtaactgacatgatta

SEQ ID NO: 3204207 - DNA, 14 bp, Homo sapiens
atagtaccatttat

SEQ ID NO: 3204208 - DNA, 18 bp, Homo sapiens
atagtactctttgtagca

SEQ ID NO: 3204209 - DNA, 17 bp, Homo sapiens
atagtagcatacattta

SEQ ID NO: 3204210 - DNA, 15 bp, Homo sapiens
atagtatggtggctg

SEQ ID NO: 3204211 - DNA, 13 bp, Homo sapiens
atagtatgtgact

SEQ ID NO: 3204212 - DNA, 22 bp, Homo sapiens
atagtatgtgacttttctgatt

SEQ ID NO: 3204213 - DNA, 13 bp, Homo sapiens
atagtatttctcc

SEQ ID NO: 3204214 - DNA, 19 bp, Homo sapiens
atagtatttctcctttgca

SEQ ID NO: 3204215 - DNA, 23 bp, Homo sapiens
atagtcatctcctaatttgtttc

SEQ ID NO: 3204216 - DNA, 23 bp, Homo sapiens
atagtctaagactatatatataa

SEQ ID NO: 3204217 - DNA, 16 bp, Homo sapiens
atagtgaatacttact

SEQ ID NO: 3204218 - DNA, 23 bp, Homo sapiens
atagtgaatacttactataattt

SEQ ID NO: 3204219 - DNA, 18 bp, Homo sapiens
atagtgactatgaacttc

SEQ ID NO: 3204220 - DNA, 18 bp, Homo sapiens
atagtgcctaaaattgta

SEQ ID NO: 3204221 - DNA, 20 bp, Homo sapiens
atagtgctgggatggagggg

SEQ ID NO: 3204222 - DNA, 17 bp, Homo sapiens
atagtgcttaaaaatca

SEQ ID NO: 3204223 - DNA, 23 bp, Homo sapiens
atagtggaaatcgcttatatgtc

SEQ ID NO: 3204224 - DNA, 17 bp, Homo sapiens
atagtggcttaaaacaa

SEQ ID NO: 3204225 - DNA, 15 bp, Homo sapiens
atagtgggatttcca

SEQ ID NO: 3204226 - DNA, 17 bp, Homo sapiens
atagtggggcctgggag

SEQ ID NO: 3204227 - DNA, 13 bp, Homo sapiens
atagtgtaaaata

SEQ ID NO: 3204228 - DNA, 14 bp, Homo sapiens
atagtgtaaaataa

SEQ ID NO: 3204229 - DNA, 14 bp, Homo sapiens
atagtgtcacttcc

SEQ ID NO: 3204230 - DNA, 15 bp, Homo sapiens
atagtgtgaaatata

SEQ ID NO: 3204231 - DNA, 12 bp, Homo sapiens
atagtgtgttct

SEQ ID NO: 3204232 - DNA, 13 bp, Homo sapiens
atagtgtgttctg

SEQ ID NO: 3204233 - DNA, 21 bp, Homo sapiens
atagtgtgttctgattagaaa

SEQ ID NO: 3204234 - DNA, 15 bp, Homo sapiens
atagttaaaatgctg

SEQ ID NO: 3204235 - DNA, 18 bp, Homo sapiens
atagttactgtgtaatta

SEQ ID NO: 3204236 - DNA, 20 bp, Homo sapiens
atagttactgtgtaattagt

SEQ ID NO: 3204237 - DNA, 15 bp, Homo sapiens
atagttagaacctgg

SEQ ID NO: 3204238 - DNA, 23 bp, Homo sapiens
atagttaggatagcatttttgat

SEQ ID NO: 3204239 - DNA, 14 bp, Homo sapiens
atagttcaccccct

SEQ ID NO: 3204240 - DNA, 18 bp, Homo sapiens
atagttcagaatttagtg

SEQ ID NO: 3204241 - DNA, 18 bp, Homo sapiens
atagttcctaagaagctt

SEQ ID NO: 3204242 - DNA, 23 bp, Homo sapiens
atagttcctaagaagcttctaat

SEQ ID NO: 3204243 - DNA, 21 bp, Homo sapiens
atagttctatcaggaaaacaa

SEQ ID NO: 3204244 - DNA, 19 bp, Homo sapiens
atagttctgaggtccctgt

SEQ ID NO: 3204245 - DNA, 20 bp, Homo sapiens
atagttgcatagcagtatat

SEQ ID NO: 3204246 - DNA, 21 bp, Homo sapiens
atagttgcatagcagtatatg

SEQ ID NO: 3204247 - DNA, 18 bp, Homo sapiens
atagttgtagacaaagta

SEQ ID NO: 3204248 - DNA, 14 bp, Homo sapiens
atagtttacatgta

SEQ ID NO: 3204249 - DNA, 17 bp, Homo sapiens
atagtttacctgaataa

SEQ ID NO: 3204250 - DNA, 15 bp, Homo sapiens
atagtttatttttgt

SEQ ID NO: 3204251 - DNA, 21 bp, Homo sapiens
atagtttcagatatatatcat

SEQ ID NO: 3204252 - DNA, 13 bp, Homo sapiens
atagtttgtacat

SEQ ID NO: 3204253 - DNA, 15 bp, Homo sapiens
atagtttgtctattt

SEQ ID NO: 3204254 - DNA, 14 bp, Homo sapiens
atagtttgtgaatc

SEQ ID NO: 3204255 - DNA, 15 bp, Homo sapiens
atagttttactttta

SEQ ID NO: 3204256 - DNA, 19 bp, Homo sapiens
atagttttttacttctctt

SEQ ID NO: 3204257 - DNA, 17 bp, Homo sapiens
atataaaaagaaaagat

SEQ ID NO: 3204258 - DNA, 13 bp, Homo sapiens
atataaaagatat

SEQ ID NO: 3204259 - DNA, 14 bp, Homo sapiens
atataaaatagttg

SEQ ID NO: 3204260 - DNA, 17 bp, Homo sapiens
atataaaatgtattcaa

SEQ ID NO: 3204261 - DNA, 13 bp, Homo sapiens
atataaaatgtgc

SEQ ID NO: 3204262 - DNA, 12 bp, Homo sapiens
atataaaattat

SEQ ID NO: 3204263 - DNA, 20 bp, Homo sapiens
atataaacagaactcccttc

SEQ ID NO: 3204264 - DNA, 15 bp, Homo sapiens
atataaagatatata

SEQ ID NO: 3204265 - DNA, 19 bp, Homo sapiens
atataaagtagtcctgtga

SEQ ID NO: 3204266 - DNA, 14 bp, Homo sapiens
atataaagtataga

SEQ ID NO: 3204267 - DNA, 18 bp, Homo sapiens
atataaatggctggtttt

SEQ ID NO: 3204268 - DNA, 23 bp, Homo sapiens
atataaatggctggtttttagaa

SEQ ID NO: 3204269 - DNA, 14 bp, Homo sapiens
atataaattctgtg

SEQ ID NO: 3204270 - DNA, 15 bp, Homo sapiens
atataacacattttt

SEQ ID NO: 3204271 - DNA, 15 bp, Homo sapiens
atataacatgtaaaa

SEQ ID NO: 3204272 - DNA, 23 bp, Homo sapiens
atataaccctaacacacacagaa

SEQ ID NO: 3204273 - DNA, 16 bp, Homo sapiens
atataaccctaggaat

SEQ ID NO: 3204274 - DNA, 19 bp, Homo sapiens
atataaccctaggaattta

SEQ ID NO: 3204275 - DNA, 21 bp, Homo sapiens
atataacttaaaaatgtaaat

SEQ ID NO: 3204276 - DNA, 14 bp, Homo sapiens
atataagaaaatgc

SEQ ID NO: 3204277 - DNA, 12 bp, Homo sapiens
atataagatttt

SEQ ID NO: 3204278 - DNA, 11 bp, Homo sapiens
atataatgaac

SEQ ID NO: 3204279 - DNA, 22 bp, Homo sapiens
atataatggaagagaaatctca

SEQ ID NO: 3204280 - DNA, 12 bp, Homo sapiens
atataatgtatt

SEQ ID NO: 3204281 - DNA, 22 bp, Homo sapiens
atataatgttgttatttaaaga

SEQ ID NO: 3204282 - DNA, 21 bp, Homo sapiens
atataattatcggaagcagtg

SEQ ID NO: 3204283 - DNA, 17 bp, Homo sapiens
atataattctgtacata

SEQ ID NO: 3204284 - DNA, 19 bp, Homo sapiens
atataattttcacttctgt

SEQ ID NO: 3204285 - DNA, 21 bp, Homo sapiens
atataatttttttatgttttg

SEQ ID NO: 3204286 - DNA, 16 bp, Homo sapiens
atatacaaaactttat

SEQ ID NO: 3204287 - DNA, 22 bp, Homo sapiens
atatacagatgaaaatttgaga

SEQ ID NO: 3204288 - DNA, 23 bp, Homo sapiens
atatacagtaactttatgtgtaa

SEQ ID NO: 3204289 - DNA, 14 bp, Homo sapiens
atatacagttattt

SEQ ID NO: 3204290 - DNA, 16 bp, Homo sapiens
atatacagttattttg

SEQ ID NO: 3204291 - DNA, 16 bp, Homo sapiens
atatacatacacttgt

SEQ ID NO: 3204292 - DNA, 18 bp, Homo sapiens
atatacatactgcatctt

SEQ ID NO: 3204293 - DNA, 14 bp, Homo sapiens
atatacatatatat

SEQ ID NO: 3204294 - DNA, 21 bp, Homo sapiens
atatacatgtgtgtatatatg

SEQ ID NO: 3204295 - DNA, 18 bp, Homo sapiens
atatacattcaaacttaa

SEQ ID NO: 3204296 - DNA, 18 bp, Homo sapiens
atatacattctttatctt

SEQ ID NO: 3204297 - DNA, 11 bp, Homo sapiens
atatacattgt

SEQ ID NO: 3204298 - DNA, 15 bp, Homo sapiens
atatacattgtgtga

SEQ ID NO: 3204299 - DNA, 16 bp, Homo sapiens
atataccaaattaaaa

SEQ ID NO: 3204300 - DNA, 14 bp, Homo sapiens
atatacctataatg

SEQ ID NO: 3204301 - DNA, 19 bp, Homo sapiens
atatacctggcttttactt

SEQ ID NO: 3204302 - DNA, 22 bp, Homo sapiens
atatactaagatgttcactgtg

SEQ ID NO: 3204303 - DNA, 14 bp, Homo sapiens
atatactcaagttt

SEQ ID NO: 3204304 - DNA, 15 bp, Homo sapiens
atatactgattttga

SEQ ID NO: 3204305 - DNA, 21 bp, Homo sapiens
atatactgggttcttgtttta

SEQ ID NO: 3204306 - DNA, 14 bp, Homo sapiens
atatacttgactct

SEQ ID NO: 3204307 - DNA, 18 bp, Homo sapiens
atatacttgactctaata

SEQ ID NO: 3204308 - DNA, 21 bp, Homo sapiens
atatactttgtggaccaatta

SEQ ID NO: 3204309 - DNA, 20 bp, Homo sapiens
atatacttttaaattatgga

SEQ ID NO: 3204310 - DNA, 22 bp, Homo sapiens
atatacttttttcttatttaac

SEQ ID NO: 3204311 - DNA, 20 bp, Homo sapiens
atatacttttttttctttaa

SEQ ID NO: 3204312 - DNA, 14 bp, Homo sapiens
atatagaagcattt

SEQ ID NO: 3204313 - DNA, 13 bp, Homo sapiens
atatagaattgta

SEQ ID NO: 3204314 - DNA, 20 bp, Homo sapiens
atatagacagtccttaaaaa

SEQ ID NO: 3204315 - DNA, 17 bp, Homo sapiens
atatagagatgcattca

SEQ ID NO: 3204316 - DNA, 15 bp, Homo sapiens
atatagagatgtttt

SEQ ID NO: 3204317 - DNA, 16 bp, Homo sapiens
atatagagatgttttt

SEQ ID NO: 3204318 - DNA, 23 bp, Homo sapiens
atatagatcagttataagtagca

SEQ ID NO: 3204319 - DNA, 15 bp, Homo sapiens
atatagattagaaaa

SEQ ID NO: 3204320 - DNA, 21 bp, Homo sapiens
atatagcgttcccaacaacat

SEQ ID NO: 3204321 - DNA, 16 bp, Homo sapiens
atataggttgtgcaaa

SEQ ID NO: 3204322 - DNA, 22 bp, Homo sapiens
atataggttgtgcaaattaaca

SEQ ID NO: 3204323 - DNA, 15 bp, Homo sapiens
atatagtccagacac

SEQ ID NO: 3204324 - DNA, 16 bp, Homo sapiens
atatagtccagacact

SEQ ID NO: 3204325 - DNA, 16 bp, Homo sapiens
atatagttcctaagaa

SEQ ID NO: 3204326 - DNA, 21 bp, Homo sapiens
atatagttcctaagaagcttc

SEQ ID NO: 3204327 - DNA, 22 bp, Homo sapiens
atatagttcctaagaagcttct

SEQ ID NO: 3204328 - DNA, 21 bp, Homo sapiens
atatagtttttaccttttatg

SEQ ID NO: 3204329 - DNA, 16 bp, Homo sapiens
atatataaaatatcta

SEQ ID NO: 3204330 - DNA, 22 bp, Homo sapiens
atatataaacagaactcccttc

SEQ ID NO: 3204331 - DNA, 16 bp, Homo sapiens
atatataaagaatata

SEQ ID NO: 3204332 - DNA, 13 bp, Homo sapiens
atatataaagtat

SEQ ID NO: 3204333 - DNA, 18 bp, Homo sapiens
atatataacagatacatt

SEQ ID NO: 3204334 - DNA, 20 bp, Homo sapiens
atatataagtgtacatatgt

SEQ ID NO: 3204335 - DNA, 14 bp, Homo sapiens
atatataatatact

SEQ ID NO: 3204336 - DNA, 15 bp, Homo sapiens
atatataatatacta

SEQ ID NO: 3204337 - DNA, 15 bp, Homo sapiens
atatataattctgta

SEQ ID NO: 3204338 - DNA, 23 bp, Homo sapiens
atatatacagtaactttatgtgt

SEQ ID NO: 3204339 - DNA, 11 bp, Homo sapiens
atatatacata

SEQ ID NO: 3204340 - DNA, 16 bp, Homo sapiens
atatatacatacactt

SEQ ID NO: 3204341 - DNA, 14 bp, Homo sapiens
atatatacatatgt

SEQ ID NO: 3204342 - DNA, 15 bp, Homo sapiens
atatataccccccca

SEQ ID NO: 3204343 - DNA, 17 bp, Homo sapiens
atatatagaattgtaga

SEQ ID NO: 3204344 - DNA, 20 bp, Homo sapiens
atatatagtccagacactta

SEQ ID NO: 3204345 - DNA, 15 bp, Homo sapiens
atatatagtgctata

SEQ ID NO: 3204346 - DNA, 16 bp, Homo sapiens
atatatagtgctatat

SEQ ID NO: 3204347 - DNA, 11 bp, Homo sapiens
atatatatata

SEQ ID NO: 3204348 - DNA, 14 bp, Homo sapiens
atatatatataaag

SEQ ID NO: 3204349 - DNA, 14 bp, Homo sapiens
atatatatgaataa

SEQ ID NO: 3204350 - DNA, 16 bp, Homo sapiens
atatatatgccatgat

SEQ ID NO: 3204351 - DNA, 20 bp, Homo sapiens
atatatatgtgtgtgtatgt

SEQ ID NO: 3204352 - DNA, 10 bp, Homo sapiens
atatatattt

SEQ ID NO: 3204353 - DNA, 13 bp, Homo sapiens
atatatcatattg

SEQ ID NO: 3204354 - DNA, 20 bp, Homo sapiens
atatatcatattggtattca

SEQ ID NO: 3204355 - DNA, 16 bp, Homo sapiens
atatatcccagaaatt

SEQ ID NO: 3204356 - DNA, 24 bp, Homo sapiens
atatatctaccccagactagatgt

SEQ ID NO: 3204357 - DNA, 16 bp, Homo sapiens
atatatctctatttga

SEQ ID NO: 3204358 - DNA, 15 bp, Homo sapiens
atatatctgcttcag

SEQ ID NO: 3204359 - DNA, 17 bp, Homo sapiens
atatatgatcattgaaa

SEQ ID NO: 3204360 - DNA, 22 bp, Homo sapiens
atatatgatcattgaaatactt

SEQ ID NO: 3204361 - DNA, 20 bp, Homo sapiens
atatatgcacttaatttgtt

SEQ ID NO: 3204362 - DNA, 18 bp, Homo sapiens
atatatgcctttttccta

SEQ ID NO: 3204363 - DNA, 20 bp, Homo sapiens
atatattacggaggaacaga

SEQ ID NO: 3204364 - DNA, 15 bp, Homo sapiens
atatattatgtgaag

SEQ ID NO: 3204365 - DNA, 15 bp, Homo sapiens
atatattattgtaag

SEQ ID NO: 3204366 - DNA, 14 bp, Homo sapiens
atatattgaattaa

SEQ ID NO: 3204367 - DNA, 13 bp, Homo sapiens
atatattgtacaa

SEQ ID NO: 3204368 - DNA, 16 bp, Homo sapiens
atatattgtgttgact

SEQ ID NO: 3204369 - DNA, 23 bp, Homo sapiens
atatattgtgttgactttataaa

SEQ ID NO: 3204370 - DNA, 14 bp, Homo sapiens
atatattgttaatc

SEQ ID NO: 3204371 - DNA, 19 bp, Homo sapiens
atatattgttaatctctgt

SEQ ID NO: 3204372 - DNA, 20 bp, Homo sapiens
atatatttaatatattgaat

SEQ ID NO: 3204373 - DNA, 10 bp, Homo sapiens
atatatttat

SEQ ID NO: 3204374 - DNA, 15 bp, Homo sapiens
atatatttatttaaa

SEQ ID NO: 3204375 - DNA, 15 bp, Homo sapiens
atatatttattttat

SEQ ID NO: 3204376 - DNA, 22 bp, Homo sapiens
atatatttattttattctatgt

SEQ ID NO: 3204377 - DNA, 17 bp, Homo sapiens
atatatttcacttttgt

SEQ ID NO: 3204378 - DNA, 22 bp, Homo sapiens
atatatttcacttttgttctgc

SEQ ID NO: 3204379 - DNA, 13 bp, Homo sapiens
atatatttctatt

SEQ ID NO: 3204380 - DNA, 17 bp, Homo sapiens
atatatttctattatta

SEQ ID NO: 3204381 - DNA, 23 bp, Homo sapiens
atatatttctattattaattgca

SEQ ID NO: 3204382 - DNA, 14 bp, Homo sapiens
atatatttctttgt

SEQ ID NO: 3204383 - DNA, 18 bp, Homo sapiens
atatattttaaaaacact

SEQ ID NO: 3204384 - DNA, 16 bp, Homo sapiens
atatattttacaattt

SEQ ID NO: 3204385 - DNA, 18 bp, Homo sapiens
atatattttacaattttt

SEQ ID NO: 3204386 - DNA, 16 bp, Homo sapiens
atatattttcagtaca

SEQ ID NO: 3204387 - DNA, 12 bp, Homo sapiens
atatattttcat

SEQ ID NO: 3204388 - DNA, 20 bp, Homo sapiens
atatattttcatcctataag

SEQ ID NO: 3204389 - DNA, 22 bp, Homo sapiens
atatattttgtactttgtggag

SEQ ID NO: 3204390 - DNA, 14 bp, Homo sapiens
atatatttttatat

SEQ ID NO: 3204391 - DNA, 15 bp, Homo sapiens
atatatttttcacag

SEQ ID NO: 3204392 - DNA, 21 bp, Homo sapiens
atatatttttcacagtttttc

SEQ ID NO: 3204393 - DNA, 15 bp, Homo sapiens
atatatttttggttg

SEQ ID NO: 3204394 - DNA, 17 bp, Homo sapiens
atatattttttaatttg

SEQ ID NO: 3204395 - DNA, 23 bp, Homo sapiens
atatattttttaatttgatgaaa

SEQ ID NO: 3204396 - DNA, 16 bp, Homo sapiens
atatattttttgcttt

SEQ ID NO: 3204397 - DNA, 14 bp, Homo sapiens
atatcaaaattcta

SEQ ID NO: 3204398 - DNA, 14 bp, Homo sapiens
atatcaaagtattt

SEQ ID NO: 3204399 - DNA, 11 bp, Homo sapiens
atatcacttcc

SEQ ID NO: 3204400 - DNA, 14 bp, Homo sapiens
atatcagacaagca

SEQ ID NO: 3204401 - DNA, 12 bp, Homo sapiens
atatcagcctga

SEQ ID NO: 3204402 - DNA, 14 bp, Homo sapiens
atatcagcctgagt

SEQ ID NO: 3204403 - DNA, 20 bp, Homo sapiens
atatcagcctgagtctcctg

SEQ ID NO: 3204404 - DNA, 21 bp, Homo sapiens
atatcagcctgagtctcctgt

SEQ ID NO: 3204405 - DNA, 23 bp, Homo sapiens
atatcagtaacccccttaaattt

SEQ ID NO: 3204406 - DNA, 16 bp, Homo sapiens
atatcatctgtcatta

SEQ ID NO: 3204407 - DNA, 18 bp, Homo sapiens
atatcatctgtcattata

SEQ ID NO: 3204408 - DNA, 23 bp, Homo sapiens
atatcatctgtcattatattcta

SEQ ID NO: 3204409 - DNA, 21 bp, Homo sapiens
atatcatgagtgaataaatgt

SEQ ID NO: 3204410 - DNA, 20 bp, Homo sapiens
atatcatgctttaaagtgta

SEQ ID NO: 3204411 - DNA, 15 bp, Homo sapiens
atatcattctacaga

SEQ ID NO: 3204412 - DNA, 19 bp, Homo sapiens
atatcattttaaaaacttt

SEQ ID NO: 3204413 - DNA, 20 bp, Homo sapiens
atatcattttaaaaacttta

SEQ ID NO: 3204414 - DNA, 12 bp, Homo sapiens
atatccaaaagc

SEQ ID NO: 3204415 - DNA, 23 bp, Homo sapiens
atatccaagtaccaatgctgttg

SEQ ID NO: 3204416 - DNA, 14 bp, Homo sapiens
atatccaccacctc

SEQ ID NO: 3204417 - DNA, 16 bp, Homo sapiens
atatccaccacctccc

SEQ ID NO: 3204418 - DNA, 12 bp, Homo sapiens
atatccatcttt

SEQ ID NO: 3204419 - DNA, 14 bp, Homo sapiens
atatccatgtactg

SEQ ID NO: 3204420 - DNA, 18 bp, Homo sapiens
atatccatgtactgtagt

SEQ ID NO: 3204421 - DNA, 16 bp, Homo sapiens
atatccctacatgtat

SEQ ID NO: 3204422 - DNA, 14 bp, Homo sapiens
atatccctcttgta

SEQ ID NO: 3204423 - DNA, 15 bp, Homo sapiens
atatccctcttgtaa

SEQ ID NO: 3204424 - DNA, 13 bp, Homo sapiens
atatcctgagcca

SEQ ID NO: 3204425 - DNA, 15 bp, Homo sapiens
atatcctgagccatc

SEQ ID NO: 3204426 - DNA, 15 bp, Homo sapiens
atatcctttctaaca

SEQ ID NO: 3204427 - DNA, 18 bp, Homo sapiens
atatctaattatttccac

SEQ ID NO: 3204428 - DNA, 20 bp, Homo sapiens
atatctaattattttgcagt

SEQ ID NO: 3204429 - DNA, 23 bp, Homo sapiens
atatctacagatagagagttgtt

SEQ ID NO: 3204430 - DNA, 16 bp, Homo sapiens
atatctatattctata

SEQ ID NO: 3204431 - DNA, 12 bp, Homo sapiens
atatctattaat

SEQ ID NO: 3204432 - DNA, 14 bp, Homo sapiens
atatctattaatat

SEQ ID NO: 3204433 - DNA, 22 bp, Homo sapiens
atatctattaatatatgtatta

SEQ ID NO: 3204434 - DNA, 13 bp, Homo sapiens
atatctctatttg

SEQ ID NO: 3204435 - DNA, 21 bp, Homo sapiens
atatctcttggaaaataagac

SEQ ID NO: 3204436 - DNA, 20 bp, Homo sapiens
atatctgaaaatgtatgtgt

SEQ ID NO: 3204437 - DNA, 15 bp, Homo sapiens
atatctggacaagcc

SEQ ID NO: 3204438 - DNA, 14 bp, Homo sapiens
atatctggcactgt

SEQ ID NO: 3204439 - DNA, 12 bp, Homo sapiens
atatctgtaatg

SEQ ID NO: 3204440 - DNA, 17 bp, Homo sapiens
atatcttaagagtgcta

SEQ ID NO: 3204441 - DNA, 18 bp, Homo sapiens
atatcttgcgaatccaag

SEQ ID NO: 3204442 - DNA, 22 bp, Homo sapiens
atatctttattcaccttttctt

SEQ ID NO: 3204443 - DNA, 16 bp, Homo sapiens
atatctttgtgataat

SEQ ID NO: 3204444 - DNA, 21 bp, Homo sapiens
atatgaaactctacatttaaa

SEQ ID NO: 3204445 - DNA, 17 bp, Homo sapiens
atatgaacctattttca

SEQ ID NO: 3204446 - DNA, 22 bp, Homo sapiens
atatgaatacagggcatgcatt

SEQ ID NO: 3204447 - DNA, 13 bp, Homo sapiens
atatgaatctgct

SEQ ID NO: 3204448 - DNA, 15 bp, Homo sapiens
atatgactttttata

SEQ ID NO: 3204449 - DNA, 21 bp, Homo sapiens
atatgaggagacattctgtct

SEQ ID NO: 3204450 - DNA, 13 bp, Homo sapiens
atatgagtataca

SEQ ID NO: 3204451 - DNA, 22 bp, Homo sapiens
atatgagtatacaatatataaa

SEQ ID NO: 3204452 - DNA, 23 bp, Homo sapiens
atatgagtgtggaagccggaggg

SEQ ID NO: 3204453 - DNA, 18 bp, Homo sapiens
atatgatcagtgttactg

SEQ ID NO: 3204454 - DNA, 19 bp, Homo sapiens
atatgatcattgaaatact

SEQ ID NO: 3204455 - DNA, 15 bp, Homo sapiens
atatgatccagagca

SEQ ID NO: 3204456 - DNA, 12 bp, Homo sapiens
atatgatttata

SEQ ID NO: 3204457 - DNA, 18 bp, Homo sapiens
atatgatttcactagaaa

SEQ ID NO: 3204458 - DNA, 16 bp, Homo sapiens
atatgattttatttga

SEQ ID NO: 3204459 - DNA, 18 bp, Homo sapiens
atatgattttttaaaaga

SEQ ID NO: 3204460 - DNA, 22 bp, Homo sapiens
atatgattttttaaaagaaatt

SEQ ID NO: 3204461 - DNA, 15 bp, Homo sapiens
atatgcaccttgtgt

SEQ ID NO: 3204462 - DNA, 20 bp, Homo sapiens
atatgcaccttgtgtctgta

SEQ ID NO: 3204463 - DNA, 16 bp, Homo sapiens
atatgcactatgtata

SEQ ID NO: 3204464 - DNA, 18 bp, Homo sapiens
atatgcagaaatagacaa

SEQ ID NO: 3204465 - DNA, 22 bp, Homo sapiens
atatgcatctggcccaggaatt

SEQ ID NO: 3204466 - DNA, 17 bp, Homo sapiens
atatgccaagctaattt

SEQ ID NO: 3204467 - DNA, 21 bp, Homo sapiens
atatgccccttcttgggcccc

SEQ ID NO: 3204468 - DNA, 16 bp, Homo sapiens
atatgctctgcatgtt

SEQ ID NO: 3204469 - DNA, 20 bp, Homo sapiens
atatgctctgcatgttacat

SEQ ID NO: 3204470 - DNA, 19 bp, Homo sapiens
atatgctgaacgcagaaga

SEQ ID NO: 3204471 - DNA, 19 bp, Homo sapiens
atatgcttaaaataagcag

SEQ ID NO: 3204472 - DNA, 21 bp, Homo sapiens
atatgcttatacacttacact

SEQ ID NO: 3204473 - DNA, 19 bp, Homo sapiens
atatggaacttacattgtt

SEQ ID NO: 3204474 - DNA, 20 bp, Homo sapiens
atatggaacttctaatatat

SEQ ID NO: 3204475 - DNA, 14 bp, Homo sapiens
atatggaagaaagt

SEQ ID NO: 3204476 - DNA, 15 bp, Homo sapiens
atatggaagaaagta

SEQ ID NO: 3204477 - DNA, 20 bp, Homo sapiens
atatggacacttaatactac

SEQ ID NO: 3204478 - DNA, 18 bp, Homo sapiens
atatggagaattgctgaa

SEQ ID NO: 3204479 - DNA, 21 bp, Homo sapiens
atatggagaattgctgaaggg

SEQ ID NO: 3204480 - DNA, 13 bp, Homo sapiens
atatggatttctt

SEQ ID NO: 3204481 - DNA, 16 bp, Homo sapiens
atatggatttcttaga

SEQ ID NO: 3204482 - DNA, 22 bp, Homo sapiens
atatggattttctattgttact

SEQ ID NO: 3204483 - DNA, 19 bp, Homo sapiens
atatggcaagaaagctggt

SEQ ID NO: 3204484 - DNA, 17 bp, Homo sapiens
atatggcagaagacacc

SEQ ID NO: 3204485 - DNA, 23 bp, Homo sapiens
atatggccacagtagtcttgatg

SEQ ID NO: 3204486 - DNA, 19 bp, Homo sapiens
atatggcgttttgtctgtg

SEQ ID NO: 3204487 - DNA, 23 bp, Homo sapiens
atatggcgttttgtctgtgttgc

SEQ ID NO: 3204488 - DNA, 17 bp, Homo sapiens
atatggctagttttcaa

SEQ ID NO: 3204489 - DNA, 11 bp, Homo sapiens
atatggctgcc

SEQ ID NO: 3204490 - DNA, 14 bp, Homo sapiens
atatggcttcaagt

SEQ ID NO: 3204491 - DNA, 15 bp, Homo sapiens
atatggcttcaagtt

SEQ ID NO: 3204492 - DNA, 17 bp, Homo sapiens
atatgggcattgtagtt

SEQ ID NO: 3204493 - DNA, 22 bp, Homo sapiens
atatggggtattggacatagat

SEQ ID NO: 3204494 - DNA, 18 bp, Homo sapiens
atatggtcttgagccagt

SEQ ID NO: 3204495 - DNA, 23 bp, Homo sapiens
atatggtcttgagccagtaatct

SEQ ID NO: 3204496 - DNA, 21 bp, Homo sapiens
atatggtgcagagaagctgga

SEQ ID NO: 3204497 - DNA, 15 bp, Homo sapiens
atatgtacataaatt

SEQ ID NO: 3204498 - DNA, 19 bp, Homo sapiens
atatgtaccatgtacatga

SEQ ID NO: 3204499 - DNA, 17 bp, Homo sapiens
atatgtagaaacattta

SEQ ID NO: 3204500 - DNA, 18 bp, Homo sapiens
atatgtagactatataca

SEQ ID NO: 3204501 - DNA, 20 bp, Homo sapiens
atatgtagactatatacatg

SEQ ID NO: 3204502 - DNA, 18 bp, Homo sapiens
atatgtatatttttttaa

SEQ ID NO: 3204503 - DNA, 12 bp, Homo sapiens
atatgtatgggt

SEQ ID NO: 3204504 - DNA, 16 bp, Homo sapiens
atatgtattatttata

SEQ ID NO: 3204505 - DNA, 17 bp, Homo sapiens
atatgtattcccttgta

SEQ ID NO: 3204506 - DNA, 14 bp, Homo sapiens
atatgtattgtaaa

SEQ ID NO: 3204507 - DNA, 11 bp, Homo sapiens
atatgtgaatc

SEQ ID NO: 3204508 - DNA, 15 bp, Homo sapiens
atatgtgtatatata

SEQ ID NO: 3204509 - DNA, 19 bp, Homo sapiens
atatgtgtatatatacata

SEQ ID NO: 3204510 - DNA, 20 bp, Homo sapiens
atatgtgtatatatacatac

SEQ ID NO: 3204511 - DNA, 22 bp, Homo sapiens
atatgtgtatatatacatacac

SEQ ID NO: 3204512 - DNA, 12 bp, Homo sapiens
atatgtgtatgt

SEQ ID NO: 3204513 - DNA, 14 bp, Homo sapiens
atatgtgtatgtac

SEQ ID NO: 3204514 - DNA, 22 bp, Homo sapiens
atatgtgtatgtacgtttgtat

SEQ ID NO: 3204515 - DNA, 17 bp, Homo sapiens
atatgtgttacttcaag

SEQ ID NO: 3204516 - DNA, 14 bp, Homo sapiens
atatgttgaatact

SEQ ID NO: 3204517 - DNA, 16 bp, Homo sapiens
atatgttgaatacttt

SEQ ID NO: 3204518 - DNA, 17 bp, Homo sapiens
atatgttgaatactttt

SEQ ID NO: 3204519 - DNA, 13 bp, Homo sapiens
atatgttgctcag

SEQ ID NO: 3204520 - DNA, 23 bp, Homo sapiens
atatgttggggtttttttaagat

SEQ ID NO: 3204521 - DNA, 11 bp, Homo sapiens
atatgttgtaa

SEQ ID NO: 3204522 - DNA, 14 bp, Homo sapiens
atatgttgtaataa

SEQ ID NO: 3204523 - DNA, 21 bp, Homo sapiens
atatgttgtaatatttcttca

SEQ ID NO: 3204524 - DNA, 14 bp, Homo sapiens
atatgtttatatac

SEQ ID NO: 3204525 - DNA, 13 bp, Homo sapiens
atatgtttccttg

SEQ ID NO: 3204526 - DNA, 15 bp, Homo sapiens
atatgttttataatt

SEQ ID NO: 3204527 - DNA, 13 bp, Homo sapiens
atattaaaatgtc

SEQ ID NO: 3204528 - DNA, 18 bp, Homo sapiens
atattaaaatgtcggatt

SEQ ID NO: 3204529 - DNA, 16 bp, Homo sapiens
atattaaaattacaga

SEQ ID NO: 3204530 - DNA, 23 bp, Homo sapiens
atattaaaattacagatgtgaaa

SEQ ID NO: 3204531 - DNA, 12 bp, Homo sapiens
atattaaacaaa

SEQ ID NO: 3204532 - DNA, 21 bp, Homo sapiens
atattaaagattctctttaaa

SEQ ID NO: 3204533 - DNA, 15 bp, Homo sapiens
atattaaataaatgt

SEQ ID NO: 3204534 - DNA, 20 bp, Homo sapiens
atattaaattctcaaagttt

SEQ ID NO: 3204535 - DNA, 21 bp, Homo sapiens
atattaaattctcaaagtttt

SEQ ID NO: 3204536 - DNA, 14 bp, Homo sapiens
atattaacatgctt

SEQ ID NO: 3204537 - DNA, 16 bp, Homo sapiens
atattaagaaagacta

SEQ ID NO: 3204538 - DNA, 13 bp, Homo sapiens
atattaatcaaaa

SEQ ID NO: 3204539 - DNA, 21 bp, Homo sapiens
atattaatcaccttctttgta

SEQ ID NO: 3204540 - DNA, 23 bp, Homo sapiens
atattaccttaagatttttcttt

SEQ ID NO: 3204541 - DNA, 21 bp, Homo sapiens
atattactgtcttttctatta

SEQ ID NO: 3204542 - DNA, 15 bp, Homo sapiens
atattactgttgcat

SEQ ID NO: 3204543 - DNA, 17 bp, Homo sapiens
atattactgttgcattt

SEQ ID NO: 3204544 - DNA, 21 bp, Homo sapiens
atattactgttgcatttactt

SEQ ID NO: 3204545 - DNA, 20 bp, Homo sapiens
atattactgtttatttctgt

SEQ ID NO: 3204546 - DNA, 19 bp, Homo sapiens
atattactttatcactttt

SEQ ID NO: 3204547 - DNA, 21 bp, Homo sapiens
atattaggatctgcaaacaat

SEQ ID NO: 3204548 - DNA, 17 bp, Homo sapiens
atattaggggggaaagt

SEQ ID NO: 3204549 - DNA, 15 bp, Homo sapiens
atattagtgaagatg

SEQ ID NO: 3204550 - DNA, 14 bp, Homo sapiens
atattagtgattct

SEQ ID NO: 3204551 - DNA, 14 bp, Homo sapiens
atattagttaatga

SEQ ID NO: 3204552 - DNA, 16 bp, Homo sapiens
atattataactctgta

SEQ ID NO: 3204553 - DNA, 21 bp, Homo sapiens
atattataactctgtataata

SEQ ID NO: 3204554 - DNA, 22 bp, Homo sapiens
atattataatttttttcaatat

SEQ ID NO: 3204555 - DNA, 18 bp, Homo sapiens
atattatgcctgaatgac

SEQ ID NO: 3204556 - DNA, 19 bp, Homo sapiens
atattatgcctgaatgact

SEQ ID NO: 3204557 - DNA, 18 bp, Homo sapiens
atattatgtcttcttttg

SEQ ID NO: 3204558 - DNA, 16 bp, Homo sapiens
atattatgtgaagaat

SEQ ID NO: 3204559 - DNA, 18 bp, Homo sapiens
atattatgtgaagaattt

SEQ ID NO: 3204560 - DNA, 21 bp, Homo sapiens
atattatgtgaagaatttaga

SEQ ID NO: 3204561 - DNA, 14 bp, Homo sapiens
atattattaatata

SEQ ID NO: 3204562 - DNA, 19 bp, Homo sapiens
atattattagaaattagaa

SEQ ID NO: 3204563 - DNA, 15 bp, Homo sapiens
atattattatatata

SEQ ID NO: 3204564 - DNA, 16 bp, Homo sapiens
atattattattaattt

SEQ ID NO: 3204565 - DNA, 19 bp, Homo sapiens
atattattgtaagttgtac

SEQ ID NO: 3204566 - DNA, 23 bp, Homo sapiens
atattattgtaagttgtacaaat

SEQ ID NO: 3204567 - DNA, 20 bp, Homo sapiens
atattcatgcttcttcctta

SEQ ID NO: 3204568 - DNA, 19 bp, Homo sapiens
atattccatgaatgtatca

SEQ ID NO: 3204569 - DNA, 19 bp, Homo sapiens
atattcctttctatcattt

SEQ ID NO: 3204570 - DNA, 13 bp, Homo sapiens
atattctaagact

SEQ ID NO: 3204571 - DNA, 18 bp, Homo sapiens
atattctaattaaaattg

SEQ ID NO: 3204572 - DNA, 19 bp, Homo sapiens
atattctactgtacttttt

SEQ ID NO: 3204573 - DNA, 22 bp, Homo sapiens
atattctatacacaccctgccc

SEQ ID NO: 3204574 - DNA, 18 bp, Homo sapiens
atattctatatgaattta

SEQ ID NO: 3204575 - DNA, 22 bp, Homo sapiens
atattctattacattttcagtg

SEQ ID NO: 3204576 - DNA, 13 bp, Homo sapiens
atattctccccac

SEQ ID NO: 3204577 - DNA, 16 bp, Homo sapiens
atattctccccaccca

SEQ ID NO: 3204578 - DNA, 17 bp, Homo sapiens
atattctgaaaggaaat

SEQ ID NO: 3204579 - DNA, 22 bp, Homo sapiens
atattctgaaaggaaatacact

SEQ ID NO: 3204580 - DNA, 13 bp, Homo sapiens
atattcttataaa

SEQ ID NO: 3204581 - DNA, 13 bp, Homo sapiens
atattcttattgg

SEQ ID NO: 3204582 - DNA, 17 bp, Homo sapiens
atattcttattggaaat

SEQ ID NO: 3204583 - DNA, 21 bp, Homo sapiens
atattcttattggaaatgtac

SEQ ID NO: 3204584 - DNA, 20 bp, Homo sapiens
atattgaaaattgaaaagta

SEQ ID NO: 3204585 - DNA, 23 bp, Homo sapiens
atattgaaaattgaaaagtacaa

SEQ ID NO: 3204586 - DNA, 22 bp, Homo sapiens
atattgatcaaatatagaaagt

SEQ ID NO: 3204587 - DNA, 18 bp, Homo sapiens
atattgatctttttatca

SEQ ID NO: 3204588 - DNA, 21 bp, Homo sapiens
atattgatctttttatcatga

SEQ ID NO: 3204589 - DNA, 22 bp, Homo sapiens
atattgatctttttatcatgat

SEQ ID NO: 3204590 - DNA, 17 bp, Homo sapiens
atattgattctgaaatt

SEQ ID NO: 3204591 - DNA, 11 bp, Homo sapiens
atattgcctta

SEQ ID NO: 3204592 - DNA, 13 bp, Homo sapiens
atattgctactat

SEQ ID NO: 3204593 - DNA, 12 bp, Homo sapiens
atattggaactt

SEQ ID NO: 3204594 - DNA, 15 bp, Homo sapiens
atattggtattcact

SEQ ID NO: 3204595 - DNA, 22 bp, Homo sapiens
atattggtgcgtttttacagtt

SEQ ID NO: 3204596 - DNA, 16 bp, Homo sapiens
atattggtttgcacaa

SEQ ID NO: 3204597 - DNA, 16 bp, Homo sapiens
atattgtaaaacaggt

SEQ ID NO: 3204598 - DNA, 15 bp, Homo sapiens
atattgtcagatatt

SEQ ID NO: 3204599 - DNA, 21 bp, Homo sapiens
atattgtcatgtttattctaa

SEQ ID NO: 3204600 - DNA, 14 bp, Homo sapiens
atattgtgattctg

SEQ ID NO: 3204601 - DNA, 21 bp, Homo sapiens
atattgtgccaatatgtattg

SEQ ID NO: 3204602 - DNA, 18 bp, Homo sapiens
atattgtggatgtgttca

SEQ ID NO: 3204603 - DNA, 17 bp, Homo sapiens
atattgtgttgtgaatg

SEQ ID NO: 3204604 - DNA, 18 bp, Homo sapiens
atattgtgttgtgaatgt

SEQ ID NO: 3204605 - DNA, 15 bp, Homo sapiens
atattgttcaaacaa

SEQ ID NO: 3204606 - DNA, 18 bp, Homo sapiens
atattgttcaaacaatat

SEQ ID NO: 3204607 - DNA, 15 bp, Homo sapiens
atattgttgacaact

SEQ ID NO: 3204608 - DNA, 17 bp, Homo sapiens
atattgttggcacagaa

SEQ ID NO: 3204609 - DNA, 15 bp, Homo sapiens
atattgtttaaaatt

SEQ ID NO: 3204610 - DNA, 14 bp, Homo sapiens
atattgtttctgca

SEQ ID NO: 3204611 - DNA, 17 bp, Homo sapiens
atattgttttcagtgta

SEQ ID NO: 3204612 - DNA, 20 bp, Homo sapiens
atattgttttcagtgtacat

SEQ ID NO: 3204613 - DNA, 16 bp, Homo sapiens
atattgtttttgtatt

SEQ ID NO: 3204614 - DNA, 19 bp, Homo sapiens
atatttaaaaaattatgga

SEQ ID NO: 3204615 - DNA, 20 bp, Homo sapiens
atatttaaaaaattatggaa

SEQ ID NO: 3204616 - DNA, 16 bp, Homo sapiens
atatttaaaaattgtt

SEQ ID NO: 3204617 - DNA, 18 bp, Homo sapiens
atatttaaaaattgtttc

SEQ ID NO: 3204618 - DNA, 12 bp, Homo sapiens
atatttaaacag

SEQ ID NO: 3204619 - DNA, 12 bp, Homo sapiens
atatttaaactc

SEQ ID NO: 3204620 - DNA, 23 bp, Homo sapiens
atatttaaactcaagacaatgca

SEQ ID NO: 3204621 - DNA, 14 bp, Homo sapiens
atatttaagaaaat

SEQ ID NO: 3204622 - DNA, 18 bp, Homo sapiens
atatttaagaaaatacaa

SEQ ID NO: 3204623 - DNA, 12 bp, Homo sapiens
atatttaagcct

SEQ ID NO: 3204624 - DNA, 20 bp, Homo sapiens
atatttaagccttataaacc

SEQ ID NO: 3204625 - DNA, 15 bp, Homo sapiens
atatttaagtgtatt

SEQ ID NO: 3204626 - DNA, 13 bp, Homo sapiens
atatttaatgata

SEQ ID NO: 3204627 - DNA, 14 bp, Homo sapiens
atatttaatgcatt

SEQ ID NO: 3204628 - DNA, 19 bp, Homo sapiens
atatttaatgcattaaacc

SEQ ID NO: 3204629 - DNA, 23 bp, Homo sapiens
atatttactaagccacaagaaat

SEQ ID NO: 3204630 - DNA, 21 bp, Homo sapiens
atatttagttatagtttcaga

SEQ ID NO: 3204631 - DNA, 22 bp, Homo sapiens
atatttagttatagtttcagat

SEQ ID NO: 3204632 - DNA, 17 bp, Homo sapiens
atatttataaatgagca

SEQ ID NO: 3204633 - DNA, 11 bp, Homo sapiens
atatttataac

SEQ ID NO: 3204634 - DNA, 17 bp, Homo sapiens
atatttataactcatca

SEQ ID NO: 3204635 - DNA, 20 bp, Homo sapiens
atatttataactcatcataa

SEQ ID NO: 3204636 - DNA, 15 bp, Homo sapiens
atatttatatattta

SEQ ID NO: 3204637 - DNA, 12 bp, Homo sapiens
atatttatccaa

SEQ ID NO: 3204638 - DNA, 20 bp, Homo sapiens
atatttatccaaaatgtgta

SEQ ID NO: 3204639 - DNA, 20 bp, Homo sapiens
atatttatgtagatgtgcat

SEQ ID NO: 3204640 - DNA, 19 bp, Homo sapiens
atatttatgtctatttaag

SEQ ID NO: 3204641 - DNA, 23 bp, Homo sapiens
atatttattaaataaaatcaatt

SEQ ID NO: 3204642 - DNA, 21 bp, Homo sapiens
atatttattgcattgctggta

SEQ ID NO: 3204643 - DNA, 11 bp, Homo sapiens
atatttattgt

SEQ ID NO: 3204644 - DNA, 19 bp, Homo sapiens
atatttattgttagaaaat

SEQ ID NO: 3204645 - DNA, 18 bp, Homo sapiens
atatttatttttttaagc

SEQ ID NO: 3204646 - DNA, 18 bp, Homo sapiens
agtccgcagaagccctga

SEQ ID NO: 3204647 - DNA, 22 bp, Homo sapiens
agtccggacccacctcaccccg

SEQ ID NO: 3204648 - DNA, 16 bp, Homo sapiens
agtccgggagaatgct

SEQ ID NO: 3204649 - DNA, 15 bp, Homo sapiens
agtcctatggaaaaa

SEQ ID NO: 3204650 - DNA, 16 bp, Homo sapiens
agtcctattctattgc

SEQ ID NO: 3204651 - DNA, 15 bp, Homo sapiens
agtcctcactcccag

SEQ ID NO: 3204652 - DNA, 16 bp, Homo sapiens
agtcctcactcccagt

SEQ ID NO: 3204653 - DNA, 18 bp, Homo sapiens
agtcctcactcccagtcc

SEQ ID NO: 3204654 - DNA, 14 bp, Homo sapiens
agtcctcccctcac

SEQ ID NO: 3204655 - DNA, 19 bp, Homo sapiens
agtcctcccctcacagcct

SEQ ID NO: 3204656 - DNA, 20 bp, Homo sapiens
agtcctcccctcacagcctc

SEQ ID NO: 3204657 - DNA, 14 bp, Homo sapiens
agtcctcttttctg

SEQ ID NO: 3204658 - DNA, 19 bp, Homo sapiens
agtcctcttttctgagagg

SEQ ID NO: 3204659 - DNA, 13 bp, Homo sapiens
agtcctgaagagg

SEQ ID NO: 3204660 - DNA, 21 bp, Homo sapiens
agtcctgaagaggcgggccag

SEQ ID NO: 3204661 - DNA, 22 bp, Homo sapiens
agtcctgaagaggcgggccagc

SEQ ID NO: 3204662 - DNA, 13 bp, Homo sapiens
agtcctgcctggc

SEQ ID NO: 3204663 - DNA, 16 bp, Homo sapiens
agtcctgcctggccag

SEQ ID NO: 3204664 - DNA, 13 bp, Homo sapiens
agtcctgctccag

SEQ ID NO: 3204665 - DNA, 14 bp, Homo sapiens
agtcctgctccaga

SEQ ID NO: 3204666 - DNA, 22 bp, Homo sapiens
agtcctggaagccagctttccc

SEQ ID NO: 3204667 - DNA, 23 bp, Homo sapiens
agtcctggactcctgccaccagc

SEQ ID NO: 3204668 - DNA, 14 bp, Homo sapiens
agtcctgtactgta

SEQ ID NO: 3204669 - DNA, 16 bp, Homo sapiens
agtcctgtctctgcct

SEQ ID NO: 3204670 - DNA, 21 bp, Homo sapiens
agtcctgtctctgcctgcggc

SEQ ID NO: 3204671 - DNA, 21 bp, Homo sapiens
agtcctgtgaatgccactgcc

SEQ ID NO: 3204672 - DNA, 23 bp, Homo sapiens
agtcctgtgaatttcttcactgt

SEQ ID NO: 3204673 - DNA, 14 bp, Homo sapiens
agtccttaaaaatc

SEQ ID NO: 3204674 - DNA, 24 bp, Homo sapiens
agtccttaaaatgtaagattatag

SEQ ID NO: 3204675 - DNA, 21 bp, Homo sapiens
agtccttacctcttccggaga

SEQ ID NO: 3204676 - DNA, 14 bp, Homo sapiens
agtccttgaaaata

SEQ ID NO: 3204677 - DNA, 16 bp, Homo sapiens
agtccttgaaaatatt

SEQ ID NO: 3204678 - DNA, 18 bp, Homo sapiens
agtcctttaattaagact

SEQ ID NO: 3204679 - DNA, 14 bp, Homo sapiens
agtcctttatgtgg

SEQ ID NO: 3204680 - DNA, 18 bp, Homo sapiens
agtcctttctgccttggc

SEQ ID NO: 3204681 - DNA, 21 bp, Homo sapiens
agtcctttctgccttggcctc

SEQ ID NO: 3204682 - DNA, 15 bp, Homo sapiens
agtcgaaggatgctc

SEQ ID NO: 3204683 - DNA, 17 bp, Homo sapiens
agtcgcagaccagagct

SEQ ID NO: 3204684 - DNA, 20 bp, Homo sapiens
agtcgcaggatccgctgcca

SEQ ID NO: 3204685 - DNA, 23 bp, Homo sapiens
agtcgcaggatccgctgccacca

SEQ ID NO: 3204686 - DNA, 17 bp, Homo sapiens
agtcgcgagcacatgtt

SEQ ID NO: 3204687 - DNA, 15 bp, Homo sapiens
agtcgggggctggcc

SEQ ID NO: 3204688 - DNA, 21 bp, Homo sapiens
agtcgggggctggcctaggag

SEQ ID NO: 3204689 - DNA, 22 bp, Homo sapiens
agtcgtcatcacttttcagtga

SEQ ID NO: 3204690 - DNA, 18 bp, Homo sapiens
agtcgtcgcacagtctct

SEQ ID NO: 3204691 - DNA, 14 bp, Homo sapiens
agtcgtgcctgtgt

SEQ ID NO: 3204692 - DNA, 15 bp, Homo sapiens
agtcgtgcctgtgtc

SEQ ID NO: 3204693 - DNA, 21 bp, Homo sapiens
agtcgtggggtgtgctgggag

SEQ ID NO: 3204694 - DNA, 14 bp, Homo sapiens
agtcgttttccaaa

SEQ ID NO: 3204695 - DNA, 20 bp, Homo sapiens
agtctaaagatggagtttct

SEQ ID NO: 3204696 - DNA, 16 bp, Homo sapiens
agtctaaatatttcct

SEQ ID NO: 3204697 - DNA, 17 bp, Homo sapiens
agtctaaatatttcctt

SEQ ID NO: 3204698 - DNA, 18 bp, Homo sapiens
agtctaatctctaaatca

SEQ ID NO: 3204699 - DNA, 22 bp, Homo sapiens
agtctacaaaaaggtataaata

SEQ ID NO: 3204700 - DNA, 22 bp, Homo sapiens
agtctacctgctggacagcctc

SEQ ID NO: 3204701 - DNA, 23 bp, Homo sapiens
agtctacctgctggacagcctcc

SEQ ID NO: 3204702 - DNA, 15 bp, Homo sapiens
agtctagattcaaag

SEQ ID NO: 3204703 - DNA, 22 bp, Homo sapiens
agtctagattcaaaggttctag

SEQ ID NO: 3204704 - DNA, 20 bp, Homo sapiens
agtctagattctctggctgt

SEQ ID NO: 3204705 - DNA, 16 bp, Homo sapiens
agtctatccacagaga

SEQ ID NO: 3204706 - DNA, 20 bp, Homo sapiens
agtctatttttttaactgaa

SEQ ID NO: 3204707 - DNA, 17 bp, Homo sapiens
agtctcaaaaatacaaa

SEQ ID NO: 3204708 - DNA, 20 bp, Homo sapiens
agtctcactgcagtcttatt

SEQ ID NO: 3204709 - DNA, 21 bp, Homo sapiens
agtctcactgttgcccaggct

SEQ ID NO: 3204710 - DNA, 20 bp, Homo sapiens
agtctcagaaactcccctgg

SEQ ID NO: 3204711 - DNA, 13 bp, Homo sapiens
agtctcagaagag

SEQ ID NO: 3204712 - DNA, 19 bp, Homo sapiens
agtctcataggttaaaaaa

SEQ ID NO: 3204713 - DNA, 20 bp, Homo sapiens
agtctcataggttaaaaaaa

SEQ ID NO: 3204714 - DNA, 18 bp, Homo sapiens
agtctcattacttttgaa

SEQ ID NO: 3204715 - DNA, 23 bp, Homo sapiens
agtctcattcgcctttgtcttgt

SEQ ID NO: 3204716 - DNA, 22 bp, Homo sapiens
agtctccaacatgtttctgttt

SEQ ID NO: 3204717 - DNA, 12 bp, Homo sapiens
agttctgctcct

SEQ ID NO: 3204718 - DNA, 20 bp, Homo sapiens
agttctgctcctctccaggc

SEQ ID NO: 3204719 - DNA, 21 bp, Homo sapiens
agttctgctcctctccaggca

SEQ ID NO: 3204720 - DNA, 19 bp, Homo sapiens
agttctggaaaagaactgt

SEQ ID NO: 3204721 - DNA, 16 bp, Homo sapiens
agttctggtcaaagaa

SEQ ID NO: 3204722 - DNA, 13 bp, Homo sapiens
agttctgtgaaga

SEQ ID NO: 3204723 - DNA, 16 bp, Homo sapiens
agttctgtggtttcat

SEQ ID NO: 3204724 - DNA, 22 bp, Homo sapiens
agttctgtggtttcatgttagt

SEQ ID NO: 3204725 - DNA, 20 bp, Homo sapiens
agttctgtgtaaacagaagc

SEQ ID NO: 3204726 - DNA, 21 bp, Homo sapiens
agttctgtgtatttaattgta

SEQ ID NO: 3204727 - DNA, 22 bp, Homo sapiens
agttctgtgtatttaattgtaa

SEQ ID NO: 3204728 - DNA, 13 bp, Homo sapiens
agttctgtgttta

SEQ ID NO: 3204729 - DNA, 21 bp, Homo sapiens
agttctgttatatcccctgct

SEQ ID NO: 3204730 - DNA, 22 bp, Homo sapiens
agttctgttatatcccctgcta

SEQ ID NO: 3204731 - DNA, 15 bp, Homo sapiens
agttctgttttctgt

SEQ ID NO: 3204732 - DNA, 12 bp, Homo sapiens
agttcttcacct

SEQ ID NO: 3204733 - DNA, 15 bp, Homo sapiens
agttcttcacctcta

SEQ ID NO: 3204734 - DNA, 17 bp, Homo sapiens
agttcttggtgctctgt

SEQ ID NO: 3204735 - DNA, 22 bp, Homo sapiens
agttcttggtgctctgtgttcc

SEQ ID NO: 3204736 - DNA, 13 bp, Homo sapiens
agttcttgtgcca

SEQ ID NO: 3204737 - DNA, 15 bp, Homo sapiens
agttctttcctcccc

SEQ ID NO: 3204738 - DNA, 21 bp, Homo sapiens
agttctttttgtacacttaat

SEQ ID NO: 3204739 - DNA, 17 bp, Homo sapiens
agttgaaccattatact

SEQ ID NO: 3204740 - DNA, 20 bp, Homo sapiens
agttgaaccattatacttta

SEQ ID NO: 3204741 - DNA, 17 bp, Homo sapiens
agttgaagttagtggaa

SEQ ID NO: 3204742 - DNA, 16 bp, Homo sapiens
agttgaatataagaaa

SEQ ID NO: 3204743 - DNA, 19 bp, Homo sapiens
agttgaatgacaacagaag

SEQ ID NO: 3204744 - DNA, 21 bp, Homo sapiens
agttgaatgacaacagaagct

SEQ ID NO: 3204745 - DNA, 20 bp, Homo sapiens
agttgaatggcctgccttga

SEQ ID NO: 3204746 - DNA, 23 bp, Homo sapiens
agttgaattgaggggattaatat

SEQ ID NO: 3204747 - DNA, 22 bp, Homo sapiens
agttgacaaaaagctcttacac

SEQ ID NO: 3204748 - DNA, 19 bp, Homo sapiens
agttgacatccaaatctag

SEQ ID NO: 3204749 - DNA, 16 bp, Homo sapiens
agttgagccccaagtc

SEQ ID NO: 3204750 - DNA, 16 bp, Homo sapiens
agttgaggaactgtac

SEQ ID NO: 3204751 - DNA, 20 bp, Homo sapiens
agttgagtacagtgaggagg

SEQ ID NO: 3204752 - DNA, 13 bp, Homo sapiens
agttgatattcaa

SEQ ID NO: 3204753 - DNA, 21 bp, Homo sapiens
agttgatgggggtgtgatttg

SEQ ID NO: 3204754 - DNA, 15 bp, Homo sapiens
agttgatgttgcatt

SEQ ID NO: 3204755 - DNA, 19 bp, Homo sapiens
agttgcaattgaattaaat

SEQ ID NO: 3204756 - DNA, 20 bp, Homo sapiens
agttgcaattgaattaaatt

SEQ ID NO: 3204757 - DNA, 15 bp, Homo sapiens
agttgcactcaggtg

SEQ ID NO: 3204758 - DNA, 23 bp, Homo sapiens
ataaacattaattttgtgcattc

SEQ ID NO: 3204759 - DNA, 13 bp, Homo sapiens
ataaacattttat

SEQ ID NO: 3204760 - DNA, 14 bp, Homo sapiens
ataaacattttatt

SEQ ID NO: 3204761 - DNA, 20 bp, Homo sapiens
ataaaccaaaggacattatg

SEQ ID NO: 3204762 - DNA, 21 bp, Homo sapiens
ataaaccaaaggacattatgt

SEQ ID NO: 3204763 - DNA, 13 bp, Homo sapiens
ataaaccaaatat

SEQ ID NO: 3204764 - DNA, 14 bp, Homo sapiens
ataaacctccgcca

SEQ ID NO: 3204765 - DNA, 18 bp, Homo sapiens
ataaaccttcagaagcta

SEQ ID NO: 3204766 - DNA, 23 bp, Homo sapiens
ataaaccttcagaagctattttt

SEQ ID NO: 3204767 - DNA, 16 bp, Homo sapiens
ataaacggttcctggt

SEQ ID NO: 3204768 - DNA, 19 bp, Homo sapiens
ataaacggttcctggtgac

SEQ ID NO: 3204769 - DNA, 23 bp, Homo sapiens
ataaacggttcctggtgactcct

SEQ ID NO: 3204770 - DNA, 20 bp, Homo sapiens
ataaacgtgatgatcagctg

SEQ ID NO: 3204771 - DNA, 23 bp, Homo sapiens
ataaactcctactaaatccctcc

SEQ ID NO: 3204772 - DNA, 15 bp, Homo sapiens
ataaactctaaacat

SEQ ID NO: 3204773 - DNA, 12 bp, Homo sapiens
ataaactgaaaa

SEQ ID NO: 3204774 - DNA, 12 bp, Homo sapiens
ataaactgaata

SEQ ID NO: 3204775 - DNA, 14 bp, Homo sapiens
ataaactgaatatt

SEQ ID NO: 3204776 - DNA, 20 bp, Homo sapiens
ataaactgaatattttggaa

SEQ ID NO: 3204777 - DNA, 19 bp, Homo sapiens
ataaactgtattaaatctt

SEQ ID NO: 3204778 - DNA, 13 bp, Homo sapiens
ataaactgtcact

SEQ ID NO: 3204779 - DNA, 12 bp, Homo sapiens
ataaactgttta

SEQ ID NO: 3204780 - DNA, 18 bp, Homo sapiens
ataaacttagaggaaaat

SEQ ID NO: 3204781 - DNA, 16 bp, Homo sapiens
ataaactttaatataa

SEQ ID NO: 3204782 - DNA, 19 bp, Homo sapiens
ataaactttttttcaatgt

SEQ ID NO: 3204783 - DNA, 20 bp, Homo sapiens
ataaactttttttcaatgtg

SEQ ID NO: 3204784 - DNA, 18 bp, Homo sapiens
ataaacttttttttatga

SEQ ID NO: 3204785 - DNA, 21 bp, Homo sapiens
ataaagaacaaggtagttttt

SEQ ID NO: 3204786 - DNA, 11 bp, Homo sapiens
ataaagacaag

SEQ ID NO: 3204787 - DNA, 12 bp, Homo sapiens
ataaagacacct

SEQ ID NO: 3204788 - DNA, 17 bp, Homo sapiens
ataaagaccagaaattc

SEQ ID NO: 3204789 - DNA, 15 bp, Homo sapiens
ataaagagaaaatga

SEQ ID NO: 3204790 - DNA, 15 bp, Homo sapiens
ataaagatgagttgg

SEQ ID NO: 3204791 - DNA, 22 bp, Homo sapiens
ataaagcaactgttatgaaata

SEQ ID NO: 3204792 - DNA, 16 bp, Homo sapiens
ataaagcagaagcaac

SEQ ID NO: 3204793 - DNA, 21 bp, Homo sapiens
ataaagcagcctcattctgag

SEQ ID NO: 3204794 - DNA, 15 bp, Homo sapiens
ataaagcagcctgat

SEQ ID NO: 3204795 - DNA, 16 bp, Homo sapiens
ataaagcagcctgatt

SEQ ID NO: 3204796 - DNA, 23 bp, Homo sapiens
ataaagcagcctgattgaaaagc

SEQ ID NO: 3204797 - DNA, 14 bp, Homo sapiens
ataaagcataagta

SEQ ID NO: 3204798 - DNA, 12 bp, Homo sapiens
ataaagcattct

SEQ ID NO: 3204799 - DNA, 13 bp, Homo sapiens
ataaagcattctt

SEQ ID NO: 3204800 - DNA, 20 bp, Homo sapiens
ataaagcctgttttgtcttt

SEQ ID NO: 3204801 - DNA, 15 bp, Homo sapiens
ataaagccttttaaa

SEQ ID NO: 3204802 - DNA, 22 bp, Homo sapiens
ataaagctcaaatgaaatgtat

SEQ ID NO: 3204803 - DNA, 16 bp, Homo sapiens
ataaaggataactctg

SEQ ID NO: 3204804 - DNA, 19 bp, Homo sapiens
ataaaggataactctgtat

SEQ ID NO: 3204805 - DNA, 20 bp, Homo sapiens
ataaaggataactctgtatt

SEQ ID NO: 3204806 - DNA, 13 bp, Homo sapiens
ataaaggatgtga

SEQ ID NO: 3204807 - DNA, 17 bp, Homo sapiens
ataaaggatgtgattgt

SEQ ID NO: 3204808 - DNA, 13 bp, Homo sapiens
ataaaggcagctg

SEQ ID NO: 3204809 - DNA, 20 bp, Homo sapiens
ataaaggcagctgcctctgc

SEQ ID NO: 3204810 - DNA, 21 bp, Homo sapiens
ataaaggttgacaataaatgt

SEQ ID NO: 3204811 - DNA, 17 bp, Homo sapiens
ataaagtaaagctaaaa

SEQ ID NO: 3204812 - DNA, 16 bp, Homo sapiens
ataaagtagtcctgtg

SEQ ID NO: 3204813 - DNA, 17 bp, Homo sapiens
ataaagtataatgttta

SEQ ID NO: 3204814 - DNA, 11 bp, Homo sapiens
ataaagtatag

SEQ ID NO: 3204815 - DNA, 14 bp, Homo sapiens
ataaagtattcttt

SEQ ID NO: 3204816 - DNA, 13 bp, Homo sapiens
ataaagtgacaaa

SEQ ID NO: 3204817 - DNA, 19 bp, Homo sapiens
ataaagtgtaacaattgtg

SEQ ID NO: 3204818 - DNA, 13 bp, Homo sapiens
ataaagtgtaata

SEQ ID NO: 3204819 - DNA, 12 bp, Homo sapiens
ataaagtttgct

SEQ ID NO: 3204820 - DNA, 19 bp, Homo sapiens
ataaataaaaagcgctgca

SEQ ID NO: 3204821 - DNA, 14 bp, Homo sapiens
ataaataaaactga

SEQ ID NO: 3204822 - DNA, 16 bp, Homo sapiens
ataaataaaactgaat

SEQ ID NO: 3204823 - DNA, 16 bp, Homo sapiens
ataaataaataatcga

SEQ ID NO: 3204824 - DNA, 17 bp, Homo sapiens
ataaataacacttgtca

SEQ ID NO: 3204825 - DNA, 20 bp, Homo sapiens
ataaatacgtattacaaaca

SEQ ID NO: 3204826 - DNA, 14 bp, Homo sapiens
ataaatagctatat

SEQ ID NO: 3204827 - DNA, 15 bp, Homo sapiens
ataaatagtagaaaa

SEQ ID NO: 3204828 - DNA, 19 bp, Homo sapiens
ataaatatatataaagaat

SEQ ID NO: 3204829 - DNA, 20 bp, Homo sapiens
ataaatatttatgtagatgt

SEQ ID NO: 3204830 - DNA, 21 bp, Homo sapiens
ataaatatttggtaattctgt

SEQ ID NO: 3204831 - DNA, 15 bp, Homo sapiens
ataaatcacacattc

SEQ ID NO: 3204832 - DNA, 18 bp, Homo sapiens
ataaatcagccgcaagga

SEQ ID NO: 3204833 - DNA, 12 bp, Homo sapiens
ataaatcataaa

SEQ ID NO: 3204834 - DNA, 15 bp, Homo sapiens
ataaatccagttcta

SEQ ID NO: 3204835 - DNA, 18 bp, Homo sapiens
ataaatgaagcagcttta

SEQ ID NO: 3204836 - DNA, 11 bp, Homo sapiens
ataaatgaatg

SEQ ID NO: 3204837 - DNA, 12 bp, Homo sapiens
ataaatgagcaa

SEQ ID NO: 3204838 - DNA, 16 bp, Homo sapiens
ataaatgattcttagt

SEQ ID NO: 3204839 - DNA, 18 bp, Homo sapiens
ataaatgattcttagtga

SEQ ID NO: 3204840 - DNA, 15 bp, Homo sapiens
ataaatgctctattt

SEQ ID NO: 3204841 - DNA, 15 bp, Homo sapiens
ataaatggaaatcat

SEQ ID NO: 3204842 - DNA, 13 bp, Homo sapiens
ataaatggctggt

SEQ ID NO: 3204843 - DNA, 15 bp, Homo sapiens
ataaatgtacattaa

SEQ ID NO: 3204844 - DNA, 13 bp, Homo sapiens
ataaatgtatata

SEQ ID NO: 3204845 - DNA, 16 bp, Homo sapiens
ataaatgtatatacac

SEQ ID NO: 3204846 - DNA, 17 bp, Homo sapiens
ataaatgtatcatagaa

SEQ ID NO: 3204847 - DNA, 21 bp, Homo sapiens
ataaatgtatcatagaaatgt

SEQ ID NO: 3204848 - DNA, 15 bp, Homo sapiens
ataaatgtatcttat

SEQ ID NO: 3204849 - DNA, 18 bp, Homo sapiens
ataaatgtatcttattca

SEQ ID NO: 3204850 - DNA, 23 bp, Homo sapiens
ataaattagatttggcatctcct

SEQ ID NO: 3204851 - DNA, 14 bp, Homo sapiens
ataaattaggacca

SEQ ID NO: 3204852 - DNA, 15 bp, Homo sapiens
ataaattatacaaat

SEQ ID NO: 3204853 - DNA, 13 bp, Homo sapiens
ataaattcaaaac

SEQ ID NO: 3204854 - DNA, 21 bp, Homo sapiens
ataaattctataggaacatat

SEQ ID NO: 3204855 - DNA, 13 bp, Homo sapiens
ataaattgaaatt

SEQ ID NO: 3204856 - DNA, 17 bp, Homo sapiens
ataaattgaaattgtga

SEQ ID NO: 3204857 - DNA, 16 bp, Homo sapiens
ataaattgatcctttg

SEQ ID NO: 3204858 - DNA, 18 bp, Homo sapiens
ataaattgcataaagcat

SEQ ID NO: 3204859 - DNA, 21 bp, Homo sapiens
ataaattggtgataagtggaa

SEQ ID NO: 3204860 - DNA, 16 bp, Homo sapiens
ataaatttaactttaa

SEQ ID NO: 3204861 - DNA, 12 bp, Homo sapiens
ataaatttctgg

SEQ ID NO: 3204862 - DNA, 20 bp, Homo sapiens
ataaatttctgggatattta

SEQ ID NO: 3204863 - DNA, 21 bp, Homo sapiens
ataaatttctgggatatttaa

SEQ ID NO: 3204864 - DNA, 15 bp, Homo sapiens
ataaattttttataa

SEQ ID NO: 3204865 - DNA, 14 bp, Homo sapiens
ataaattttttgaa

SEQ ID NO: 3204866 - DNA, 15 bp, Homo sapiens
ataaattttttgaaa

SEQ ID NO: 3204867 - DNA, 17 bp, Homo sapiens
ataaattttttgaaaca

SEQ ID NO: 3204868 - DNA, 20 bp, Homo sapiens
ataacaactatttttgttgt

SEQ ID NO: 3204869 - DNA, 14 bp, Homo sapiens
ataacaagatcttt

SEQ ID NO: 3204870 - DNA, 16 bp, Homo sapiens
ataacaagatctttca

SEQ ID NO: 3204871 - DNA, 17 bp, Homo sapiens
ataacaagatctttcag

SEQ ID NO: 3204872 - DNA, 14 bp, Homo sapiens
ataacaatgttaag

SEQ ID NO: 3204873 - DNA, 16 bp, Homo sapiens
ataacaatgttaagga

SEQ ID NO: 3204874 - DNA, 15 bp, Homo sapiens
ataacaattgtttgg

SEQ ID NO: 3204875 - DNA, 12 bp, Homo sapiens
ataacacatttt

SEQ ID NO: 3204876 - DNA, 23 bp, Homo sapiens
ataacacatttttttgcatgcat

SEQ ID NO: 3204877 - DNA, 22 bp, Homo sapiens
ataacaccaatcccagggctgg

SEQ ID NO: 3204878 - DNA, 21 bp, Homo sapiens
ataacacccttccttctgtaa

SEQ ID NO: 3204879 - DNA, 12 bp, Homo sapiens
ataacagatgtg

SEQ ID NO: 3204880 - DNA, 13 bp, Homo sapiens
ataacagatgtga

SEQ ID NO: 3204881 - DNA, 20 bp, Homo sapiens
ataacagatgtgaaaatata

SEQ ID NO: 3204882 - DNA, 13 bp, Homo sapiens
ataacagctcctt

SEQ ID NO: 3204883 - DNA, 14 bp, Homo sapiens
ataacagtgccatt

SEQ ID NO: 3204884 - DNA, 15 bp, Homo sapiens
ataacagtgccattg

SEQ ID NO: 3204885 - DNA, 14 bp, Homo sapiens
ataacagttatatt

SEQ ID NO: 3204886 - DNA, 15 bp, Homo sapiens
ataacagttatattt

SEQ ID NO: 3204887 - DNA, 20 bp, Homo sapiens
ataacatgtaattaagtact

SEQ ID NO: 3204888 - DNA, 19 bp, Homo sapiens
ataacattaccttactgtg

SEQ ID NO: 3204889 - DNA, 20 bp, Homo sapiens
ataacattaccttactgtgg

SEQ ID NO: 3204890 - DNA, 14 bp, Homo sapiens
ataaccacaaggtc

SEQ ID NO: 3204891 - DNA, 19 bp, Homo sapiens
ataaccagctgtaacacag

SEQ ID NO: 3204892 - DNA, 16 bp, Homo sapiens
ataaccccagcctgac

SEQ ID NO: 3204893 - DNA, 16 bp, Homo sapiens
ataaccccattctttg

SEQ ID NO: 3204894 - DNA, 19 bp, Homo sapiens
ataacctagttaaagaaag

SEQ ID NO: 3204895 - DNA, 18 bp, Homo sapiens
ataacctctggcccttgg

SEQ ID NO: 3204896 - DNA, 18 bp, Homo sapiens
ataacgcttaaaggaagt

SEQ ID NO: 3204897 - DNA, 18 bp, Homo sapiens
ataactaaatttgatact

SEQ ID NO: 3204898 - DNA, 20 bp, Homo sapiens
ataactaaatttgatactta

SEQ ID NO: 3204899 - DNA, 13 bp, Homo sapiens
ataactactgtgt

SEQ ID NO: 3204900 - DNA, 20 bp, Homo sapiens
ataactcagaatattgtctg

SEQ ID NO: 3204901 - DNA, 20 bp, Homo sapiens
ataactctgctgaatgtaaa

SEQ ID NO: 3204902 - DNA, 22 bp, Homo sapiens
ataactctgtggcattattgca

SEQ ID NO: 3204903 - DNA, 15 bp, Homo sapiens
ataactgaaaatgtg

SEQ ID NO: 3204904 - DNA, 18 bp, Homo sapiens
ataactgaaccaaattgc

SEQ ID NO: 3204905 - DNA, 23 bp, Homo sapiens
ataactgaaccaaattgcactga

SEQ ID NO: 3204906 - DNA, 15 bp, Homo sapiens
ataactgaatttgga

SEQ ID NO: 3204907 - DNA, 13 bp, Homo sapiens
ataactgatttct

SEQ ID NO: 3204908 - DNA, 14 bp, Homo sapiens
ataactgatttcta

SEQ ID NO: 3204909 - DNA, 21 bp, Homo sapiens
ataactgatttctatggcttt

SEQ ID NO: 3204910 - DNA, 17 bp, Homo sapiens
ataactgtagctcaagt

SEQ ID NO: 3204911 - DNA, 12 bp, Homo sapiens
ataactgtgaag

SEQ ID NO: 3204912 - DNA, 12 bp, Homo sapiens
ataacttaaaat

SEQ ID NO: 3204913 - DNA, 15 bp, Homo sapiens
ataacttaaaataat

SEQ ID NO: 3204914 - DNA, 14 bp, Homo sapiens
ataacttcagtcct

SEQ ID NO: 3204915 - DNA, 12 bp, Homo sapiens
ataacttcctgt

SEQ ID NO: 3204916 - DNA, 22 bp, Homo sapiens
ataacttctatattttaataga

SEQ ID NO: 3204917 - DNA, 11 bp, Homo sapiens
ataacttctga

SEQ ID NO: 3204918 - DNA, 16 bp, Homo sapiens
ataacttgatgcatgt

SEQ ID NO: 3204919 - DNA, 19 bp, Homo sapiens
ataacttttttgagtcatt

SEQ ID NO: 3204920 - DNA, 22 bp, Homo sapiens
ataagaaagtgcgagtcctcca

SEQ ID NO: 3204921 - DNA, 21 bp, Homo sapiens
ataagaaataatgctacaatt

SEQ ID NO: 3204922 - DNA, 22 bp, Homo sapiens
ataagaaataatgctacaattt

SEQ ID NO: 3204923 - DNA, 22 bp, Homo sapiens
ataagaagccttaatttgcaca

SEQ ID NO: 3204924 - DNA, 17 bp, Homo sapiens
ataagacaatagtattt

SEQ ID NO: 3204925 - DNA, 21 bp, Homo sapiens
ataagacaatagtatttctcc

SEQ ID NO: 3204926 - DNA, 17 bp, Homo sapiens
ataagacataacgtttt

SEQ ID NO: 3204927 - DNA, 19 bp, Homo sapiens
ataagactgtttttaagta

SEQ ID NO: 3204928 - DNA, 12 bp, Homo sapiens
ataagagatttg

SEQ ID NO: 3204929 - DNA, 16 bp, Homo sapiens
ataagaggaatttctt

SEQ ID NO: 3204930 - DNA, 17 bp, Homo sapiens
ataagataaatgtgctg

SEQ ID NO: 3204931 - DNA, 14 bp, Homo sapiens
ataagattaaagga

SEQ ID NO: 3204932 - DNA, 21 bp, Homo sapiens
ataagattcatatttacttct

SEQ ID NO: 3204933 - DNA, 14 bp, Homo sapiens
ataagcaaatttca

SEQ ID NO: 3204934 - DNA, 20 bp, Homo sapiens
ataagcactgaaaaacaaca

SEQ ID NO: 3204935 - DNA, 14 bp, Homo sapiens
ataagcactgtgct

SEQ ID NO: 3204936 - DNA, 16 bp, Homo sapiens
ataagcagatttaaca

SEQ ID NO: 3204937 - DNA, 15 bp, Homo sapiens
ataagcattgaaatt

SEQ ID NO: 3204938 - DNA, 18 bp, Homo sapiens
ataagcgttaagggcaga

SEQ ID NO: 3204939 - DNA, 20 bp, Homo sapiens
ataagcgttaagggcagagt

SEQ ID NO: 3204940 - DNA, 13 bp, Homo sapiens
ataagctaaagag

SEQ ID NO: 3204941 - DNA, 23 bp, Homo sapiens
ataagctatcacctagcagcctc

SEQ ID NO: 3204942 - DNA, 15 bp, Homo sapiens
ataagcttaaatagg

SEQ ID NO: 3204943 - DNA, 14 bp, Homo sapiens
ataaggatcagaac

SEQ ID NO: 3204944 - DNA, 22 bp, Homo sapiens
ataaggatcagaacagcagagg

SEQ ID NO: 3204945 - DNA, 19 bp, Homo sapiens
ataaggccataaaacaggt

SEQ ID NO: 3204946 - DNA, 17 bp, Homo sapiens
ataaggccttaatatgt

SEQ ID NO: 3204947 - DNA, 18 bp, Homo sapiens
ataaggccttaatatgtt

SEQ ID NO: 3204948 - DNA, 11 bp, Homo sapiens
ataaggcttca

SEQ ID NO: 3204949 - DNA, 15 bp, Homo sapiens
ataagggaaaagata

SEQ ID NO: 3204950 - DNA, 17 bp, Homo sapiens
ataaggggtttgccatt

SEQ ID NO: 3204951 - DNA, 19 bp, Homo sapiens
ataaggtttcgtttctgta

SEQ ID NO: 3204952 - DNA, 17 bp, Homo sapiens
ataagtaattcaagaaa

SEQ ID NO: 3204953 - DNA, 13 bp, Homo sapiens
ataagtagttggt

SEQ ID NO: 3204954 - DNA, 14 bp, Homo sapiens
ataagtagttggtt

SEQ ID NO: 3204955 - DNA, 20 bp, Homo sapiens
ataagtagttggtttgtatg

SEQ ID NO: 3204956 - DNA, 15 bp, Homo sapiens
ataagtatacagttc

SEQ ID NO: 3204957 - DNA, 15 bp, Homo sapiens
ataagtcaaaaggaa

SEQ ID NO: 3204958 - DNA, 17 bp, Homo sapiens
ataagtcaaaaggaaca

SEQ ID NO: 3204959 - DNA, 13 bp, Homo sapiens
ataagtcaagcac

SEQ ID NO: 3204960 - DNA, 21 bp, Homo sapiens
ataagtcaagcacatgtaata

SEQ ID NO: 3204961 - DNA, 22 bp, Homo sapiens
ataagtcaagcacatgtaataa

SEQ ID NO: 3204962 - DNA, 16 bp, Homo sapiens
ataagtcattgtatgt

SEQ ID NO: 3204963 - DNA, 22 bp, Homo sapiens
ataagtccattttttaaaaatg

SEQ ID NO: 3204964 - DNA, 21 bp, Homo sapiens
ataagtgaaatggatactaca

SEQ ID NO: 3204965 - DNA, 22 bp, Homo sapiens
ataagtgaaatggatactacat

SEQ ID NO: 3204966 - DNA, 15 bp, Homo sapiens
ataagtgaatttata

SEQ ID NO: 3204967 - DNA, 23 bp, Homo sapiens
ataagtgcacacagaaatatata

SEQ ID NO: 3204968 - DNA, 18 bp, Homo sapiens
ataagtggaaaaaagaga

SEQ ID NO: 3204969 - DNA, 22 bp, Homo sapiens
ataagtggaaaaaagagaaaaa

SEQ ID NO: 3204970 - DNA, 22 bp, Homo sapiens
ataagtggacaaattttgagtt

SEQ ID NO: 3204971 - DNA, 13 bp, Homo sapiens
ataagtgtacata

SEQ ID NO: 3204972 - DNA, 20 bp, Homo sapiens
ataagtgtacatatgtgctg

SEQ ID NO: 3204973 - DNA, 22 bp, Homo sapiens
ataagttaacttccaatttaca

SEQ ID NO: 3204974 - DNA, 22 bp, Homo sapiens
ataagttatttttgtacatgtt

SEQ ID NO: 3204975 - DNA, 21 bp, Homo sapiens
ataagttcaaattcttctgaa

SEQ ID NO: 3204976 - DNA, 16 bp, Homo sapiens
ataagttcctttcctt

SEQ ID NO: 3204977 - DNA, 13 bp, Homo sapiens
ataagtttgaagg

SEQ ID NO: 3204978 - DNA, 19 bp, Homo sapiens
ataataaatcacacattca

SEQ ID NO: 3204979 - DNA, 12 bp, Homo sapiens
ataataaattga

SEQ ID NO: 3204980 - DNA, 23 bp, Homo sapiens
ataataaattgtttggcttcctc

SEQ ID NO: 3204981 - DNA, 13 bp, Homo sapiens
ataataagctaaa

SEQ ID NO: 3204982 - DNA, 15 bp, Homo sapiens
ataataagctaaaga

SEQ ID NO: 3204983 - DNA, 15 bp, Homo sapiens
ataataagtttcata

SEQ ID NO: 3204984 - DNA, 15 bp, Homo sapiens
ataataatataatga

SEQ ID NO: 3204985 - DNA, 19 bp, Homo sapiens
ataataatctaggcatgaa

SEQ ID NO: 3204986 - DNA, 22 bp, Homo sapiens
ataatacactaattcctttcta

SEQ ID NO: 3204987 - DNA, 21 bp, Homo sapiens
ataatacagaatcttgttttg

SEQ ID NO: 3204988 - DNA, 12 bp, Homo sapiens
ataatacctcaa

SEQ ID NO: 3204989 - DNA, 18 bp, Homo sapiens
ataatacctcaatgtttg

SEQ ID NO: 3204990 - DNA, 13 bp, Homo sapiens
ataatagaagaac

SEQ ID NO: 3204991 - DNA, 19 bp, Homo sapiens
ataataggtagtttggata

SEQ ID NO: 3204992 - DNA, 21 bp, Homo sapiens
ataataggtagtttggatatt

SEQ ID NO: 3204993 - DNA, 16 bp, Homo sapiens
ataatagtcaatttct

SEQ ID NO: 3204994 - DNA, 14 bp, Homo sapiens
ataatataatgaat

SEQ ID NO: 3204995 - DNA, 23 bp, Homo sapiens
ataatatactaaaccaactctaa

SEQ ID NO: 3204996 - DNA, 17 bp, Homo sapiens
ataatatattgtgttga

SEQ ID NO: 3204997 - DNA, 13 bp, Homo sapiens
ataatatggctat

SEQ ID NO: 3204998 - DNA, 17 bp, Homo sapiens
ataatatggctatgctt

SEQ ID NO: 3204999 - DNA, 23 bp, Homo sapiens
ataatatggctatgcttaaaagg

SEQ ID NO: 3205000 - DNA, 14 bp, Homo sapiens
ataatattcattgg

SEQ ID NO: 3205001 - DNA, 16 bp, Homo sapiens
ataatattcattggtt

SEQ ID NO: 3205002 - DNA, 16 bp, Homo sapiens
ataatattgaaaattg

SEQ ID NO: 3205003 - DNA, 19 bp, Homo sapiens
ataatattgaaaattgaaa

SEQ ID NO: 3205004 - DNA, 21 bp, Homo sapiens
ataatattgaaaattgaaaag

SEQ ID NO: 3205005 - DNA, 22 bp, Homo sapiens
ataatattgtttggtaaatgtt

SEQ ID NO: 3205006 - DNA, 16 bp, Homo sapiens
ataatattgtttttct

SEQ ID NO: 3205007 - DNA, 14 bp, Homo sapiens
ataatatttcaagt

SEQ ID NO: 3205008 - DNA, 15 bp, Homo sapiens
ataatcaaagctcat

SEQ ID NO: 3205009 - DNA, 16 bp, Homo sapiens
ataatcaaagctcata

SEQ ID NO: 3205010 - DNA, 19 bp, Homo sapiens
ataatcaaatgatttcata

SEQ ID NO: 3205011 - DNA, 17 bp, Homo sapiens
ataatcagaaaagtaat

SEQ ID NO: 3205012 - DNA, 15 bp, Homo sapiens
ataatcagcctctta

SEQ ID NO: 3205013 - DNA, 16 bp, Homo sapiens
ataatcccagcacttt

SEQ ID NO: 3205014 - DNA, 20 bp, Homo sapiens
ataatcctgtgaaaatatga

SEQ ID NO: 3205015 - DNA, 18 bp, Homo sapiens
ataatccttgataatata

SEQ ID NO: 3205016 - DNA, 12 bp, Homo sapiens
ataatctagaac

SEQ ID NO: 3205017 - DNA, 14 bp, Homo sapiens
ataatctcaaagga

SEQ ID NO: 3205018 - DNA, 15 bp, Homo sapiens
ataatctcaaaggag

SEQ ID NO: 3205019 - DNA, 15 bp, Homo sapiens
ataatctcatgctgt

SEQ ID NO: 3205020 - DNA, 14 bp, Homo sapiens
ataatctgaagata

SEQ ID NO: 3205021 - DNA, 20 bp, Homo sapiens
ataatctggactcctctgtc

SEQ ID NO: 3205022 - DNA, 13 bp, Homo sapiens
ataatctgtcaaa

SEQ ID NO: 3205023 - DNA, 19 bp, Homo sapiens
ataatctgtcaaaacactg

SEQ ID NO: 3205024 - DNA, 13 bp, Homo sapiens
ataatcttataca

SEQ ID NO: 3205025 - DNA, 15 bp, Homo sapiens
ataatcttattaggg

SEQ ID NO: 3205026 - DNA, 15 bp, Homo sapiens
ataatcttcaggtga

SEQ ID NO: 3205027 - DNA, 17 bp, Homo sapiens
ataatcttctgccttct

SEQ ID NO: 3205028 - DNA, 20 bp, Homo sapiens
ataatcttctgccttctcat

SEQ ID NO: 3205029 - DNA, 18 bp, Homo sapiens
ataatcttgtagacactt

SEQ ID NO: 3205030 - DNA, 17 bp, Homo sapiens
ataatgaataaactgaa

SEQ ID NO: 3205031 - DNA, 15 bp, Homo sapiens
ataatgaatgaaaca

SEQ ID NO: 3205032 - DNA, 13 bp, Homo sapiens
ataatgaattata

SEQ ID NO: 3205033 - DNA, 10 bp, Homo sapiens
ataatgcaat

SEQ ID NO: 3205034 - DNA, 17 bp, Homo sapiens
ataatgcaatcaaaaat

SEQ ID NO: 3205035 - DNA, 17 bp, Homo sapiens
ataatgctaatttaaag

SEQ ID NO: 3205036 - DNA, 17 bp, Homo sapiens
ataatgctacaatttta

SEQ ID NO: 3205037 - DNA, 15 bp, Homo sapiens
ataatgcttaatttc

SEQ ID NO: 3205038 - DNA, 15 bp, Homo sapiens
ataatgcttcagata

SEQ ID NO: 3205039 - DNA, 16 bp, Homo sapiens
ataatgctttggaaaa

SEQ ID NO: 3205040 - DNA, 18 bp, Homo sapiens
ataatggaaaaaaagact

SEQ ID NO: 3205041 - DNA, 22 bp, Homo sapiens
ataatggaaaatgccatgaatt

SEQ ID NO: 3205042 - DNA, 14 bp, Homo sapiens
ataatggaaacatt

SEQ ID NO: 3205043 - DNA, 21 bp, Homo sapiens
ataatggaaacattacagttc

SEQ ID NO: 3205044 - DNA, 16 bp, Homo sapiens
ataatggaagagaaat

SEQ ID NO: 3205045 - DNA, 18 bp, Homo sapiens
ataatggaagagaaatct

SEQ ID NO: 3205046 - DNA, 21 bp, Homo sapiens
ataatggaagagaaatctcat

SEQ ID NO: 3205047 - DNA, 17 bp, Homo sapiens
ataatggtgaacatttt

SEQ ID NO: 3205048 - DNA, 18 bp, Homo sapiens
ataatggtgaacatttta

SEQ ID NO: 3205049 - DNA, 17 bp, Homo sapiens
ataatggtgaatgttca

SEQ ID NO: 3205050 - DNA, 20 bp, Homo sapiens
ataatgtactgatttcagta

SEQ ID NO: 3205051 - DNA, 15 bp, Homo sapiens
ataatgtatgtacag

SEQ ID NO: 3205052 - DNA, 14 bp, Homo sapiens
ataatgtattttca

SEQ ID NO: 3205053 - DNA, 14 bp, Homo sapiens
ataatgtgaaatat

SEQ ID NO: 3205054 - DNA, 15 bp, Homo sapiens
ataatgtgtgtatgt

SEQ ID NO: 3205055 - DNA, 12 bp, Homo sapiens
ataatgtgttaa

SEQ ID NO: 3205056 - DNA, 16 bp, Homo sapiens
ataatgttaaatttgt

SEQ ID NO: 3205057 - DNA, 23 bp, Homo sapiens
ataatgttaaatttgtaagtttc

SEQ ID NO: 3205058 - DNA, 11 bp, Homo sapiens
ataatgttctt

SEQ ID NO: 3205059 - DNA, 12 bp, Homo sapiens
ataatgtttaaa

SEQ ID NO: 3205060 - DNA, 13 bp, Homo sapiens
ataatgtttaaat

SEQ ID NO: 3205061 - DNA, 15 bp, Homo sapiens
ataatgtttaaatca

SEQ ID NO: 3205062 - DNA, 17 bp, Homo sapiens
ataatgtttaaatcatg

SEQ ID NO: 3205063 - DNA, 18 bp, Homo sapiens
ataatgtttaaatcatgt

SEQ ID NO: 3205064 - DNA, 19 bp, Homo sapiens
ataatgtttttcctttctt

SEQ ID NO: 3205065 - DNA, 20 bp, Homo sapiens
ataatgtttttcctttctta

SEQ ID NO: 3205066 - DNA, 16 bp, Homo sapiens
ataattaattgtcatt

SEQ ID NO: 3205067 - DNA, 12 bp, Homo sapiens
ataattacattc

SEQ ID NO: 3205068 - DNA, 17 bp, Homo sapiens
ataattaggttaacatt

SEQ ID NO: 3205069 - DNA, 16 bp, Homo sapiens
ataattatcggaagca

SEQ ID NO: 3205070 - DNA, 20 bp, Homo sapiens
ataattatcggaagcagtgc

SEQ ID NO: 3205071 - DNA, 18 bp, Homo sapiens
ataattatttatttaata

SEQ ID NO: 3205072 - DNA, 20 bp, Homo sapiens
ataattcactcaagcactga

SEQ ID NO: 3205073 - DNA, 14 bp, Homo sapiens
ataattcatttgta

SEQ ID NO: 3205074 - DNA, 15 bp, Homo sapiens
ataattcatttgtat

SEQ ID NO: 3205075 - DNA, 17 bp, Homo sapiens
ataattcatttgtattg

SEQ ID NO: 3205076 - DNA, 12 bp, Homo sapiens
ataattccctat

SEQ ID NO: 3205077 - DNA, 12 bp, Homo sapiens
ataattctaaat

SEQ ID NO: 3205078 - DNA, 16 bp, Homo sapiens
ataattctaaatccct

SEQ ID NO: 3205079 - DNA, 23 bp, Homo sapiens
ataattctgtacatagcctatat

SEQ ID NO: 3205080 - DNA, 16 bp, Homo sapiens
ataattgctatttatt

SEQ ID NO: 3205081 - DNA, 18 bp, Homo sapiens
ataattgctttgccaaaa

SEQ ID NO: 3205082 - DNA, 16 bp, Homo sapiens
ataattggatttccta

SEQ ID NO: 3205083 - DNA, 18 bp, Homo sapiens
ataattggatttcctaat

SEQ ID NO: 3205084 - DNA, 18 bp, Homo sapiens
ataattggtgctatttga

SEQ ID NO: 3205085 - DNA, 15 bp, Homo sapiens
ataattgtacaaaat

SEQ ID NO: 3205086 - DNA, 21 bp, Homo sapiens
ataattgtacaaaattaagca

SEQ ID NO: 3205087 - DNA, 17 bp, Homo sapiens
ataattgtatcagaggc

SEQ ID NO: 3205088 - DNA, 15 bp, Homo sapiens
ataattgtggattat

SEQ ID NO: 3205089 - DNA, 18 bp, Homo sapiens
ataattgttgaaattttg

SEQ ID NO: 3205090 - DNA, 21 bp, Homo sapiens
ataattgttgaaattttgcaa

SEQ ID NO: 3205091 - DNA, 15 bp, Homo sapiens
ataatttagttgttt

SEQ ID NO: 3205092 - DNA, 18 bp, Homo sapiens
ataatttagttgtttcta

SEQ ID NO: 3205093 - DNA, 11 bp, Homo sapiens
ataatttccca

SEQ ID NO: 3205094 - DNA, 21 bp, Homo sapiens
ataatttcccaattaggaagt

SEQ ID NO: 3205095 - DNA, 22 bp, Homo sapiens
ataatttcccaattaggaagtg

SEQ ID NO: 3205096 - DNA, 13 bp, Homo sapiens
ataatttcgagat

SEQ ID NO: 3205097 - DNA, 15 bp, Homo sapiens
ataatttcgagattt

SEQ ID NO: 3205098 - DNA, 13 bp, Homo sapiens
ataatttgaaaaa

SEQ ID NO: 3205099 - DNA, 14 bp, Homo sapiens
ataattttaagaaa

SEQ ID NO: 3205100 - DNA, 15 bp, Homo sapiens
ataattttaagaaat

SEQ ID NO: 3205101 - DNA, 21 bp, Homo sapiens
ataattttaagaaatcaaaga

SEQ ID NO: 3205102 - DNA, 21 bp, Homo sapiens
ataattttatttataaactag

SEQ ID NO: 3205103 - DNA, 12 bp, Homo sapiens
ataattttgcat

SEQ ID NO: 3205104 - DNA, 13 bp, Homo sapiens
ataattttgctgg

SEQ ID NO: 3205105 - DNA, 18 bp, Homo sapiens
ataattttgtgttgtaca

SEQ ID NO: 3205106 - DNA, 20 bp, Homo sapiens
ataattttgtgttgtacaat

SEQ ID NO: 3205107 - DNA, 18 bp, Homo sapiens
ataatttttaaagtatat

SEQ ID NO: 3205108 - DNA, 19 bp, Homo sapiens
ataatttttatatttaatt

SEQ ID NO: 3205109 - DNA, 13 bp, Homo sapiens
ataatttttctag

SEQ ID NO: 3205110 - DNA, 13 bp, Homo sapiens
ataattttttgta

SEQ ID NO: 3205111 - DNA, 22 bp, Homo sapiens
ataattttttgtaatgtgtgaa

SEQ ID NO: 3205112 - DNA, 19 bp, Homo sapiens
ataattttttttaaagaag

SEQ ID NO: 3205113 - DNA, 16 bp, Homo sapiens
atacaaaagagcatgg

SEQ ID NO: 3205114 - DNA, 18 bp, Homo sapiens
atacaaacctaccaaaat

SEQ ID NO: 3205115 - DNA, 14 bp, Homo sapiens
atacaaagtaaata

SEQ ID NO: 3205116 - DNA, 16 bp, Homo sapiens
atacaaagtaaataca

SEQ ID NO: 3205117 - DNA, 16 bp, Homo sapiens
atacaaatagattttt

SEQ ID NO: 3205118 - DNA, 18 bp, Homo sapiens
aggggtcccagccacccc

SEQ ID NO: 3205119 - DNA, 15 bp, Homo sapiens
aggggtcccccctca

SEQ ID NO: 3205120 - DNA, 15 bp, Homo sapiens
aggggtcggctgacc

SEQ ID NO: 3205121 - DNA, 18 bp, Homo sapiens
aggggtctccctggctcc

SEQ ID NO: 3205122 - DNA, 20 bp, Homo sapiens
aggggtgccccctcctctcc

SEQ ID NO: 3205123 - DNA, 15 bp, Homo sapiens
aggggtggagactgc

SEQ ID NO: 3205124 - DNA, 20 bp, Homo sapiens
aggggtggagactgcttccc

SEQ ID NO: 3205125 - DNA, 18 bp, Homo sapiens
aggggtggggggtgcagg

SEQ ID NO: 3205126 - DNA, 22 bp, Homo sapiens
aggggtggtggagggggctggg

SEQ ID NO: 3205127 - DNA, 16 bp, Homo sapiens
aggggtgtggcagtgg

SEQ ID NO: 3205128 - DNA, 15 bp, Homo sapiens
aggggtgtggctcct

SEQ ID NO: 3205129 - DNA, 15 bp, Homo sapiens
aggggtgtgggaaga

SEQ ID NO: 3205130 - DNA, 15 bp, Homo sapiens
aggggtgttgtatgg

SEQ ID NO: 3205131 - DNA, 18 bp, Homo sapiens
aggggttaacttggtcag

SEQ ID NO: 3205132 - DNA, 15 bp, Homo sapiens
aggggttcgagacca

SEQ ID NO: 3205133 - DNA, 20 bp, Homo sapiens
aggggttcgagaccagtctg

SEQ ID NO: 3205134 - DNA, 14 bp, Homo sapiens
agggtacagtttgg

SEQ ID NO: 3205135 - DNA, 17 bp, Homo sapiens
agggtacccgcctgagc

SEQ ID NO: 3205136 - DNA, 19 bp, Homo sapiens
agggtactaaggaatcttt

SEQ ID NO: 3205137 - DNA, 16 bp, Homo sapiens
agggtatcaggtgctg

SEQ ID NO: 3205138 - DNA, 21 bp, Homo sapiens
agggtatcaggtgctgccatc

SEQ ID NO: 3205139 - DNA, 20 bp, Homo sapiens
agggtatccaagttggactg

SEQ ID NO: 3205140 - DNA, 21 bp, Homo sapiens
agggtatccaagttggactgg

SEQ ID NO: 3205141 - DNA, 22 bp, Homo sapiens
agggtatccaagttggactggg

SEQ ID NO: 3205142 - DNA, 18 bp, Homo sapiens
agggtcagccatttttaa

SEQ ID NO: 3205143 - DNA, 16 bp, Homo sapiens
agggtcatgtttgcag

SEQ ID NO: 3205144 - DNA, 15 bp, Homo sapiens
agggtccccacctgg

SEQ ID NO: 3205145 - DNA, 16 bp, Homo sapiens
agtcttccttgtctct

SEQ ID NO: 3205146 - DNA, 18 bp, Homo sapiens
agtcttctcatagcatta

SEQ ID NO: 3205147 - DNA, 21 bp, Homo sapiens
agtcttggcggcagcagccat

SEQ ID NO: 3205148 - DNA, 18 bp, Homo sapiens
agtcttgggcctggcccg

SEQ ID NO: 3205149 - DNA, 18 bp, Homo sapiens
agtcttgggtctgaattt

SEQ ID NO: 3205150 - DNA, 20 bp, Homo sapiens
agtctttaaaggcccagccc

SEQ ID NO: 3205151 - DNA, 13 bp, Homo sapiens
agtctttcccaat

SEQ ID NO: 3205152 - DNA, 17 bp, Homo sapiens
agtctttcccaatctct

SEQ ID NO: 3205153 - DNA, 14 bp, Homo sapiens
agtctttgaagctg

SEQ ID NO: 3205154 - DNA, 19 bp, Homo sapiens
agtctttgatcatcatgta

SEQ ID NO: 3205155 - DNA, 17 bp, Homo sapiens
agtctttgccagtcatt

SEQ ID NO: 3205156 - DNA, 15 bp, Homo sapiens
agtctttggttctaa

SEQ ID NO: 3205157 - DNA, 22 bp, Homo sapiens
agtcttttgcatgtcgcacaat

SEQ ID NO: 3205158 - DNA, 19 bp, Homo sapiens
agtcttttgcttttggcaa

SEQ ID NO: 3205159 - DNA, 22 bp, Homo sapiens
agtcttttgttcgcatggtcac

SEQ ID NO: 3205160 - DNA, 18 bp, Homo sapiens
agtctttttctgttgtaa

SEQ ID NO: 3205161 - DNA, 21 bp, Homo sapiens
agtctttttctgttgtaactt

SEQ ID NO: 3205162 - DNA, 15 bp, Homo sapiens
agtgaaaaactgctg

SEQ ID NO: 3205163 - DNA, 22 bp, Homo sapiens
agtgaaaatcttggagaccctg

SEQ ID NO: 3205164 - DNA, 21 bp, Homo sapiens
agtgaaaatttttacattcat

SEQ ID NO: 3205165 - DNA, 15 bp, Homo sapiens
agtgaaacacttgct

SEQ ID NO: 3205166 - DNA, 17 bp, Homo sapiens
agtgaaacacttgcttg

SEQ ID NO: 3205167 - DNA, 23 bp, Homo sapiens
agtgaaacacttgcttgccaact

SEQ ID NO: 3205168 - DNA, 20 bp, Homo sapiens
agtgaaaccaacatccagat

SEQ ID NO: 3205169 - DNA, 19 bp, Homo sapiens
agtgaaacctttagggcag

SEQ ID NO: 3205170 - DNA, 15 bp, Homo sapiens
agtgaaatggatact

SEQ ID NO: 3205171 - DNA, 12 bp, Homo sapiens
agtgaaatgtga

SEQ ID NO: 3205172 - DNA, 13 bp, Homo sapiens
agtgaaccatcat

SEQ ID NO: 3205173 - DNA, 16 bp, Homo sapiens
agtgaagactggaagc

SEQ ID NO: 3205174 - DNA, 20 bp, Homo sapiens
agtgaagaggggcagccctt

SEQ ID NO: 3205175 - DNA, 17 bp, Homo sapiens
agtgaaggagccacgtg

SEQ ID NO: 3205176 - DNA, 20 bp, Homo sapiens
agtgaaggagccacgtgaat

SEQ ID NO: 3205177 - DNA, 20 bp, Homo sapiens
agtgaatactgctacagcaa

SEQ ID NO: 3205178 - DNA, 15 bp, Homo sapiens
agtgaatcctctgtt

SEQ ID NO: 3205179 - DNA, 14 bp, Homo sapiens
agtgaatgaaagat

SEQ ID NO: 3205180 - DNA, 15 bp, Homo sapiens
agtgaatgaaagatt

SEQ ID NO: 3205181 - DNA, 14 bp, Homo sapiens
agtgaatgctggga

SEQ ID NO: 3205182 - DNA, 21 bp, Homo sapiens
agtgaattgtgaccaagttat

SEQ ID NO: 3205183 - DNA, 13 bp, Homo sapiens
agtgaatttgaat

SEQ ID NO: 3205184 - DNA, 14 bp, Homo sapiens
agtgaatttgaatg

SEQ ID NO: 3205185 - DNA, 13 bp, Homo sapiens
agtgacaaaccat

SEQ ID NO: 3205186 - DNA, 24 bp, Homo sapiens
agtgacaaataaattaggaccaag

SEQ ID NO: 3205187 - DNA, 15 bp, Homo sapiens
agtgacaagtgaaga

SEQ ID NO: 3205188 - DNA, 18 bp, Homo sapiens
agtgacaagtgaagaaca

SEQ ID NO: 3205189 - DNA, 21 bp, Homo sapiens
agtgacacttcagagagctgg

SEQ ID NO: 3205190 - DNA, 22 bp, Homo sapiens
agtgacacttcagagagctggt

SEQ ID NO: 3205191 - DNA, 23 bp, Homo sapiens
agtgacacttcagagagctggta

SEQ ID NO: 3205192 - DNA, 20 bp, Homo sapiens
agtgacataatatattctat

SEQ ID NO: 3205193 - DNA, 18 bp, Homo sapiens
agtgacatcaaagcctgg

SEQ ID NO: 3205194 - DNA, 20 bp, Homo sapiens
agtgacatcaaagcctggcc

SEQ ID NO: 3205195 - DNA, 20 bp, Homo sapiens
agtgaccttttcttcatttt

SEQ ID NO: 3205196 - DNA, 14 bp, Homo sapiens
agtgacgtgcacct

SEQ ID NO: 3205197 - DNA, 16 bp, Homo sapiens
agtgactagtacaaat

SEQ ID NO: 3205198 - DNA, 17 bp, Homo sapiens
agtgactagtacaaatt

SEQ ID NO: 3205199 - DNA, 22 bp, Homo sapiens
agtgactatgaacttctctcag

SEQ ID NO: 3205200 - DNA, 16 bp, Homo sapiens
agtgactcctgctggt

SEQ ID NO: 3205201 - DNA, 13 bp, Homo sapiens
agtgactggcagg

SEQ ID NO: 3205202 - DNA, 14 bp, Homo sapiens
agtgactggcaggt

SEQ ID NO: 3205203 - DNA, 22 bp, Homo sapiens
agtgactggcaggtgcagatgg

SEQ ID NO: 3205204 - DNA, 13 bp, Homo sapiens
agtgactgttgta

SEQ ID NO: 3205205 - DNA, 16 bp, Homo sapiens
agtgacttaatatcta

SEQ ID NO: 3205206 - DNA, 18 bp, Homo sapiens
agtgacttattttgtctt

SEQ ID NO: 3205207 - DNA, 13 bp, Homo sapiens
agtgacttctttt

SEQ ID NO: 3205208 - DNA, 13 bp, Homo sapiens
agtgactttgtat

SEQ ID NO: 3205209 - DNA, 20 bp, Homo sapiens
agtgactttttctgagcttt

SEQ ID NO: 3205210 - DNA, 19 bp, Homo sapiens
agtgagaaaaagctcctgt

SEQ ID NO: 3205211 - DNA, 20 bp, Homo sapiens
agtgagaaaaagctcctgtc

SEQ ID NO: 3205212 - DNA, 16 bp, Homo sapiens
agtgagacagtctgga

SEQ ID NO: 3205213 - DNA, 18 bp, Homo sapiens
agtgagacccctgtctcc

SEQ ID NO: 3205214 - DNA, 17 bp, Homo sapiens
agtgagaccctgtctct

SEQ ID NO: 3205215 - DNA, 14 bp, Homo sapiens
agtgagaccttgtc

SEQ ID NO: 3205216 - DNA, 13 bp, Homo sapiens
agtgagactctgt

SEQ ID NO: 3205217 - DNA, 16 bp, Homo sapiens
agtgagactctgtctc

SEQ ID NO: 3205218 - DNA, 22 bp, Homo sapiens
agtgagactctgtctcaaaaaa

SEQ ID NO: 3205219 - DNA, 11 bp, Homo sapiens
agtgagactga

SEQ ID NO: 3205220 - DNA, 12 bp, Homo sapiens
agtgagactgac

SEQ ID NO: 3205221 - DNA, 17 bp, Homo sapiens
agtgagactgactgcaa

SEQ ID NO: 3205222 - DNA, 13 bp, Homo sapiens
agtgagagagaca

SEQ ID NO: 3205223 - DNA, 14 bp, Homo sapiens
agtgagcaaccagc

SEQ ID NO: 3205224 - DNA, 14 bp, Homo sapiens
agtgagcactaagg

SEQ ID NO: 3205225 - DNA, 21 bp, Homo sapiens
agtgagcctgaattttgttgc

SEQ ID NO: 3205226 - DNA, 14 bp, Homo sapiens
agtgagcctggctc

SEQ ID NO: 3205227 - DNA, 12 bp, Homo sapiens
agtgagctggtt

SEQ ID NO: 3205228 - DNA, 21 bp, Homo sapiens
agtgaggaatagttgagcccc

SEQ ID NO: 3205229 - DNA, 17 bp, Homo sapiens
agtgagtaattttggat

SEQ ID NO: 3205230 - DNA, 15 bp, Homo sapiens
agtgagtcgaggaca

SEQ ID NO: 3205231 - DNA, 13 bp, Homo sapiens
agtgagtgagcct

SEQ ID NO: 3205232 - DNA, 12 bp, Homo sapiens
agtgagtgtaaa

SEQ ID NO: 3205233 - DNA, 18 bp, Homo sapiens
agtgagtgtgctgacttt

SEQ ID NO: 3205234 - DNA, 10 bp, Homo sapiens
agtgagttca

SEQ ID NO: 3205235 - DNA, 23 bp, Homo sapiens
agtgataattttatttataaact

SEQ ID NO: 3205236 - DNA, 14 bp, Homo sapiens
agtgatataaatca

SEQ ID NO: 3205237 - DNA, 17 bp, Homo sapiens
agtgatatgatccagag

SEQ ID NO: 3205238 - DNA, 20 bp, Homo sapiens
agtgatatgatccagagcag

SEQ ID NO: 3205239 - DNA, 19 bp, Homo sapiens
agtgatatggcagaagaca

SEQ ID NO: 3205240 - DNA, 22 bp, Homo sapiens
agtgatatggcagaagacacca

SEQ ID NO: 3205241 - DNA, 19 bp, Homo sapiens
agtgatcaataaaatgtga

SEQ ID NO: 3205242 - DNA, 14 bp, Homo sapiens
agtgatcctcccac

SEQ ID NO: 3205243 - DNA, 19 bp, Homo sapiens
agtgatcctcccacctcag

SEQ ID NO: 3205244 - DNA, 23 bp, Homo sapiens
agtgatcctcccacctcagcctc

SEQ ID NO: 3205245 - DNA, 16 bp, Homo sapiens
agtgatccttacaagt

SEQ ID NO: 3205246 - DNA, 16 bp, Homo sapiens
agtgatctatgtttgt

SEQ ID NO: 3205247 - DNA, 18 bp, Homo sapiens
agtgatctatgtttgtgt

SEQ ID NO: 3205248 - DNA, 14 bp, Homo sapiens
agtgatctccatat

SEQ ID NO: 3205249 - DNA, 22 bp, Homo sapiens
agtgatgcttttagttttaaaa

SEQ ID NO: 3205250 - DNA, 19 bp, Homo sapiens
agtgatggcgcgggaggca

SEQ ID NO: 3205251 - DNA, 17 bp, Homo sapiens
agtgatgggctttctct

SEQ ID NO: 3205252 - DNA, 19 bp, Homo sapiens
agtgatgggctttctcttt

SEQ ID NO: 3205253 - DNA, 13 bp, Homo sapiens
agtgatggtcaga

SEQ ID NO: 3205254 - DNA, 17 bp, Homo sapiens
agtgatgtttttatgat

SEQ ID NO: 3205255 - DNA, 15 bp, Homo sapiens
agtgattcactgtgc

SEQ ID NO: 3205256 - DNA, 22 bp, Homo sapiens
agtgattcactgtgcttcgagc

SEQ ID NO: 3205257 - DNA, 15 bp, Homo sapiens
agtgattctcctgcc

SEQ ID NO: 3205258 - DNA, 17 bp, Homo sapiens
agtgattctcctgcctc

SEQ ID NO: 3205259 - DNA, 22 bp, Homo sapiens
agtgattctcctgcctcagcct

SEQ ID NO: 3205260 - DNA, 18 bp, Homo sapiens
agtgattctgatttcagt

SEQ ID NO: 3205261 - DNA, 19 bp, Homo sapiens
agtgattctgatttcagtt

SEQ ID NO: 3205262 - DNA, 12 bp, Homo sapiens
agtgatttccat

SEQ ID NO: 3205263 - DNA, 17 bp, Homo sapiens
agtgcaagttcatgtgt

SEQ ID NO: 3205264 - DNA, 21 bp, Homo sapiens
agtgcaagttcatgtgtggaa

SEQ ID NO: 3205265 - DNA, 22 bp, Homo sapiens
agtgcaatggtataaatttcaa

SEQ ID NO: 3205266 - DNA, 17 bp, Homo sapiens
agtgcacacagaaatat

SEQ ID NO: 3205267 - DNA, 19 bp, Homo sapiens
agtgcacacagaaatatat

SEQ ID NO: 3205268 - DNA, 12 bp, Homo sapiens
agtgcacagctg

SEQ ID NO: 3205269 - DNA, 21 bp, Homo sapiens
agtgcactttctaatgtttct

SEQ ID NO: 3205270 - DNA, 13 bp, Homo sapiens
agtgcagacaggc

SEQ ID NO: 3205271 - DNA, 13 bp, Homo sapiens
agtgcagaggctc

SEQ ID NO: 3205272 - DNA, 14 bp, Homo sapiens
agtgcagcagagga

SEQ ID NO: 3205273 - DNA, 23 bp, Homo sapiens
agtgcagcagaggacagtctgga

SEQ ID NO: 3205274 - DNA, 21 bp, Homo sapiens
agtgggccccgggctggagaa

SEQ ID NO: 3205275 - DNA, 22 bp, Homo sapiens
agtgggccccgggctggagaaa

SEQ ID NO: 3205276 - DNA, 18 bp, Homo sapiens
agtgggcgggccatgagg

SEQ ID NO: 3205277 - DNA, 12 bp, Homo sapiens
agtggggaggga

SEQ ID NO: 3205278 - DNA, 20 bp, Homo sapiens
agtggggatggggcctccct

SEQ ID NO: 3205279 - DNA, 13 bp, Homo sapiens
agtggggcctgtg

SEQ ID NO: 3205280 - DNA, 15 bp, Homo sapiens
agtggggctcgccat

SEQ ID NO: 3205281 - DNA, 15 bp, Homo sapiens
agtggggggacagag

SEQ ID NO: 3205282 - DNA, 21 bp, Homo sapiens
agtggggtgctgggaggaggg

SEQ ID NO: 3205283 - DNA, 19 bp, Homo sapiens
agtggggttgcaaccactg

SEQ ID NO: 3205284 - DNA, 22 bp, Homo sapiens
agtggggttgcaaccactgcaa

SEQ ID NO: 3205285 - DNA, 19 bp, Homo sapiens
agtgggtgagatgctggag

SEQ ID NO: 3205286 - DNA, 14 bp, Homo sapiens
agtgggtggcacct

SEQ ID NO: 3205287 - DNA, 15 bp, Homo sapiens
agtggtaacagctct

SEQ ID NO: 3205288 - DNA, 20 bp, Homo sapiens
agtggtactagtgtggtgtg

SEQ ID NO: 3205289 - DNA, 22 bp, Homo sapiens
agtggtcgcttactttgagtga

SEQ ID NO: 3205290 - DNA, 13 bp, Homo sapiens
agtggtctttctg

SEQ ID NO: 3205291 - DNA, 16 bp, Homo sapiens
agtggtctttgtaaga

SEQ ID NO: 3205292 - DNA, 18 bp, Homo sapiens
agtggtctttgtaagagt

SEQ ID NO: 3205293 - DNA, 16 bp, Homo sapiens
agtggtggttcctttg

SEQ ID NO: 3205294 - DNA, 20 bp, Homo sapiens
agtggtgtgatctcggctca

SEQ ID NO: 3205295 - DNA, 12 bp, Homo sapiens
agtggtgtgtgg

SEQ ID NO: 3205296 - DNA, 15 bp, Homo sapiens
agtggttgcctgggg

SEQ ID NO: 3205297 - DNA, 19 bp, Homo sapiens
agtggttgttagttataga

SEQ ID NO: 3205298 - DNA, 20 bp, Homo sapiens
agtggtttccacatgctctg

SEQ ID NO: 3205299 - DNA, 22 bp, Homo sapiens
agtggtttccacatgctctgag

SEQ ID NO: 3205300 - DNA, 21 bp, Homo sapiens
agtggttttatactgaaggaa

SEQ ID NO: 3205301 - DNA, 13 bp, Homo sapiens
agtgtaaaataga

SEQ ID NO: 3205302 - DNA, 14 bp, Homo sapiens
agtgtaaataattt

SEQ ID NO: 3205303 - DNA, 22 bp, Homo sapiens
agtgtaaataattttaaataac

SEQ ID NO: 3205304 - DNA, 21 bp, Homo sapiens
agtgtaaatcctttttcttta

SEQ ID NO: 3205305 - DNA, 18 bp, Homo sapiens
agtgtaacagatatcagt

SEQ ID NO: 3205306 - DNA, 13 bp, Homo sapiens
agtgtaacagctg

SEQ ID NO: 3205307 - DNA, 17 bp, Homo sapiens
agtgtaacagctgaggt

SEQ ID NO: 3205308 - DNA, 19 bp, Homo sapiens
agtgtaatcccccaggaga

SEQ ID NO: 3205309 - DNA, 19 bp, Homo sapiens
agtgtaatgtagcgtgttt

SEQ ID NO: 3205310 - DNA, 16 bp, Homo sapiens
agtgtacaaaactgta

SEQ ID NO: 3205311 - DNA, 21 bp, Homo sapiens
agtgtacatggaataacatgt

SEQ ID NO: 3205312 - DNA, 13 bp, Homo sapiens
agtgtacctgtgt

SEQ ID NO: 3205313 - DNA, 17 bp, Homo sapiens
agtgtacctgtgtacat

SEQ ID NO: 3205314 - DNA, 20 bp, Homo sapiens
agtgtacctgtgtacataac

SEQ ID NO: 3205315 - DNA, 13 bp, Homo sapiens
agtgtagaagcat

SEQ ID NO: 3205316 - DNA, 19 bp, Homo sapiens
agtgtagaagcattccttc

SEQ ID NO: 3205317 - DNA, 22 bp, Homo sapiens
agtgtagaagcattccttcttt

SEQ ID NO: 3205318 - DNA, 18 bp, Homo sapiens
agtgtagcccacacttga

SEQ ID NO: 3205319 - DNA, 22 bp, Homo sapiens
agtgtagcctaaagggcagggc

SEQ ID NO: 3205320 - DNA, 13 bp, Homo sapiens
agtgtagctgtaa

SEQ ID NO: 3205321 - DNA, 20 bp, Homo sapiens
agtgtagttaaggagcctaa

SEQ ID NO: 3205322 - DNA, 16 bp, Homo sapiens
agtgtagttaatttat

SEQ ID NO: 3205323 - DNA, 17 bp, Homo sapiens
agtgtagttaatttatc

SEQ ID NO: 3205324 - DNA, 14 bp, Homo sapiens
agtgtatatcagaa

SEQ ID NO: 3205325 - DNA, 19 bp, Homo sapiens
agtgtatgattactggcct

SEQ ID NO: 3205326 - DNA, 22 bp, Homo sapiens
agtgtatggaaataaatgtatc

SEQ ID NO: 3205327 - DNA, 16 bp, Homo sapiens
agtgtatggggcagct

SEQ ID NO: 3205328 - DNA, 17 bp, Homo sapiens
agtgtattagatgtggt

SEQ ID NO: 3205329 - DNA, 21 bp, Homo sapiens
agtgtattatcactgtctgtt

SEQ ID NO: 3205330 - DNA, 14 bp, Homo sapiens
agtgtatttggaaa

SEQ ID NO: 3205331 - DNA, 23 bp, Homo sapiens
agtgtatttggaaataaagtcag

SEQ ID NO: 3205332 - DNA, 21 bp, Homo sapiens
agtgtatttttcaataaagca

SEQ ID NO: 3205333 - DNA, 18 bp, Homo sapiens
agtgtcaagttgtgcttg

SEQ ID NO: 3205334 - DNA, 22 bp, Homo sapiens
agtgtcaagttgtgcttgttta

SEQ ID NO: 3205335 - DNA, 20 bp, Homo sapiens
agtgtcacctctctcagagc

SEQ ID NO: 3205336 - DNA, 16 bp, Homo sapiens
agtgtcatcagaagat

SEQ ID NO: 3205337 - DNA, 19 bp, Homo sapiens
agtgtcatttatgaaaaga

SEQ ID NO: 3205338 - DNA, 23 bp, Homo sapiens
agtgtcattttattttttccctc

SEQ ID NO: 3205339 - DNA, 19 bp, Homo sapiens
agtgtctagagtcatgtga

SEQ ID NO: 3205340 - DNA, 21 bp, Homo sapiens
agtgtctggagcggctgctcg

SEQ ID NO: 3205341 - DNA, 15 bp, Homo sapiens
agtgtctgtgccatg

SEQ ID NO: 3205342 - DNA, 16 bp, Homo sapiens
agtgtctgtgccatgg

SEQ ID NO: 3205343 - DNA, 19 bp, Homo sapiens
agtgtctgtgccatggatt

SEQ ID NO: 3205344 - DNA, 16 bp, Homo sapiens
agtgtctgtgttttga

SEQ ID NO: 3205345 - DNA, 22 bp, Homo sapiens
agtgtctgtgttttgaaagaat

SEQ ID NO: 3205346 - DNA, 16 bp, Homo sapiens
agtgtcttctaacttt

SEQ ID NO: 3205347 - DNA, 16 bp, Homo sapiens
agtgtgaaatatatta

SEQ ID NO: 3205348 - DNA, 15 bp, Homo sapiens
agtgtgacagggcca

SEQ ID NO: 3205349 - DNA, 17 bp, Homo sapiens
agtgtgacagggccagt

SEQ ID NO: 3205350 - DNA, 14 bp, Homo sapiens
agtgtgaccaggca

SEQ ID NO: 3205351 - DNA, 18 bp, Homo sapiens
agtgtgaccccactgcca

SEQ ID NO: 3205352 - DNA, 18 bp, Homo sapiens
agtgtgagtaagagctgg

SEQ ID NO: 3205353 - DNA, 14 bp, Homo sapiens
agtgtgagtggcag

SEQ ID NO: 3205354 - DNA, 20 bp, Homo sapiens
agtgtgagtggcagccatgc

SEQ ID NO: 3205355 - DNA, 14 bp, Homo sapiens
agtgtgctaaaaat

SEQ ID NO: 3205356 - DNA, 19 bp, Homo sapiens
agtgtgctctttttttaaa

SEQ ID NO: 3205357 - DNA, 22 bp, Homo sapiens
agtgtgctctttttttaaaagg

SEQ ID NO: 3205358 - DNA, 14 bp, Homo sapiens
agtgtgctgacttt

SEQ ID NO: 3205359 - DNA, 17 bp, Homo sapiens
agtgtggacttggcagg

SEQ ID NO: 3205360 - DNA, 21 bp, Homo sapiens
agtgtggagaggggtgcaccc

SEQ ID NO: 3205361 - DNA, 15 bp, Homo sapiens
agtgtggggggtcct

SEQ ID NO: 3205362 - DNA, 22 bp, Homo sapiens
agtgtggttatgaactttatag

SEQ ID NO: 3205363 - DNA, 11 bp, Homo sapiens
agtgtgtaaag

SEQ ID NO: 3205364 - DNA, 15 bp, Homo sapiens
agtgtgtattgttcc

SEQ ID NO: 3205365 - DNA, 13 bp, Homo sapiens
agtgtgtcttcct

SEQ ID NO: 3205366 - DNA, 22 bp, Homo sapiens
agtgtgtgaactgctttcaagt

SEQ ID NO: 3205367 - DNA, 14 bp, Homo sapiens
agtgtgtgacttac

SEQ ID NO: 3205368 - DNA, 14 bp, Homo sapiens
agtgtgtgtgcaga

SEQ ID NO: 3205369 - DNA, 20 bp, Homo sapiens
agtgtgtgtgcagagtccat

SEQ ID NO: 3205370 - DNA, 21 bp, Homo sapiens
agtgtgttctgattagaaatg

SEQ ID NO: 3205371 - DNA, 22 bp, Homo sapiens
agtgttactacagccttaatat

SEQ ID NO: 3205372 - DNA, 19 bp, Homo sapiens
agtgttcctttttaaatgt

SEQ ID NO: 3205373 - DNA, 22 bp, Homo sapiens
agtgttcctttttaaatgtgaa

SEQ ID NO: 3205374 - DNA, 19 bp, Homo sapiens
agtgttctgcatggattca

SEQ ID NO: 3205375 - DNA, 18 bp, Homo sapiens
agtgttctgccagatctt

SEQ ID NO: 3205376 - DNA, 12 bp, Homo sapiens
agtgttgaaggg

SEQ ID NO: 3205377 - DNA, 14 bp, Homo sapiens
agtgttgctcttgg

SEQ ID NO: 3205378 - DNA, 18 bp, Homo sapiens
agtgttgctcttggaaag

SEQ ID NO: 3205379 - DNA, 17 bp, Homo sapiens
agtgttggaaaaaattt

SEQ ID NO: 3205380 - DNA, 13 bp, Homo sapiens
agtgttgtttgta

SEQ ID NO: 3205381 - DNA, 14 bp, Homo sapiens
agtgttgtttgtaa

SEQ ID NO: 3205382 - DNA, 17 bp, Homo sapiens
agtgtttcaaaaaatta

SEQ ID NO: 3205383 - DNA, 20 bp, Homo sapiens
agtgtttcaaaaaattatat

SEQ ID NO: 3205384 - DNA, 19 bp, Homo sapiens
agtgtttcgacagctgatt

SEQ ID NO: 3205385 - DNA, 21 bp, Homo sapiens
agtgtttctaataaacttgga

SEQ ID NO: 3205386 - DNA, 13 bp, Homo sapiens
agtgtttctgtta

SEQ ID NO: 3205387 - DNA, 23 bp, Homo sapiens
agtgtttgggggacgtttctcat

SEQ ID NO: 3205388 - DNA, 15 bp, Homo sapiens
agtgttttaaattct

SEQ ID NO: 3205389 - DNA, 13 bp, Homo sapiens
agtgttttactct

SEQ ID NO: 3205390 - DNA, 18 bp, Homo sapiens
agtgttttcagaagaaat

SEQ ID NO: 3205391 - DNA, 19 bp, Homo sapiens
agtgttttctcagaacagc

SEQ ID NO: 3205392 - DNA, 22 bp, Homo sapiens
agtgttttctcagaacagctga

SEQ ID NO: 3205393 - DNA, 18 bp, Homo sapiens
agtgttttggactccatc

SEQ ID NO: 3205394 - DNA, 20 bp, Homo sapiens
agtgttttggactccatctc

SEQ ID NO: 3205395 - DNA, 21 bp, Homo sapiens
agtgttttggactccatctct

SEQ ID NO: 3205396 - DNA, 23 bp, Homo sapiens
agtgttttggactccatctctca

SEQ ID NO: 3205397 - DNA, 18 bp, Homo sapiens
agttaaaagtaaaattgt

SEQ ID NO: 3205398 - DNA, 16 bp, Homo sapiens
agttaaactaaaaaaa

SEQ ID NO: 3205399 - DNA, 22 bp, Homo sapiens
agttaaactaaaaaaaaaaagg

SEQ ID NO: 3205400 - DNA, 14 bp, Homo sapiens
agttaaagaaagga

SEQ ID NO: 3205401 - DNA, 12 bp, Homo sapiens
agttaaataaat

SEQ ID NO: 3205402 - DNA, 17 bp, Homo sapiens
agttaacaaggaatgcc

SEQ ID NO: 3205403 - DNA, 19 bp, Homo sapiens
agttaacattaacatctat

SEQ ID NO: 3205404 - DNA, 17 bp, Homo sapiens
agttaagaagctgttgt

SEQ ID NO: 3205405 - DNA, 15 bp, Homo sapiens
agttaataacagctc

SEQ ID NO: 3205406 - DNA, 18 bp, Homo sapiens
agttaataacagctcctt

SEQ ID NO: 3205407 - DNA, 21 bp, Homo sapiens
agttaatctcctcagacagta

SEQ ID NO: 3205408 - DNA, 16 bp, Homo sapiens
agttaatgagccatca

SEQ ID NO: 3205409 - DNA, 19 bp, Homo sapiens
agttacaaagtaatttctt

SEQ ID NO: 3205410 - DNA, 20 bp, Homo sapiens
agttacagcctgttagtaac

SEQ ID NO: 3205411 - DNA, 13 bp, Homo sapiens
agttacagttctg

SEQ ID NO: 3205412 - DNA, 20 bp, Homo sapiens
agttacataatcagtatatt

SEQ ID NO: 3205413 - DNA, 23 bp, Homo sapiens
agttacattaaaataaaccaaat

SEQ ID NO: 3205414 - DNA, 17 bp, Homo sapiens
agttaccacacatctat

SEQ ID NO: 3205415 - DNA, 17 bp, Homo sapiens
agttaccttatagttac

SEQ ID NO: 3205416 - DNA, 19 bp, Homo sapiens
agttactaggtaacttcat

SEQ ID NO: 3205417 - DNA, 18 bp, Homo sapiens
agttactgattcactgca

SEQ ID NO: 3205418 - DNA, 21 bp, Homo sapiens
agttactgccggtttgaaaat

SEQ ID NO: 3205419 - DNA, 15 bp, Homo sapiens
agttacttcctatca

SEQ ID NO: 3205420 - DNA, 11 bp, Homo sapiens
agttactttgt

SEQ ID NO: 3205421 - DNA, 18 bp, Homo sapiens
agttactttgtaattttt

SEQ ID NO: 3205422 - DNA, 19 bp, Homo sapiens
agttactttgtcagaggca

SEQ ID NO: 3205423 - DNA, 23 bp, Homo sapiens
agttagaacaagcccaaatttaa

SEQ ID NO: 3205424 - DNA, 20 bp, Homo sapiens
agttagaaggaggttctaat

SEQ ID NO: 3205425 - DNA, 19 bp, Homo sapiens
agttagagaatatattttt

SEQ ID NO: 3205426 - DNA, 12 bp, Homo sapiens
agttagccctca

SEQ ID NO: 3205427 - DNA, 16 bp, Homo sapiens
agttagctcaggaggc

SEQ ID NO: 3205428 - DNA, 19 bp, Homo sapiens
agttagctcaggaggcttg

SEQ ID NO: 3205429 - DNA, 22 bp, Homo sapiens
agttagctcaggaggcttggaa

SEQ ID NO: 3205430 - DNA, 18 bp, Homo sapiens
agttaggatagcattttt

SEQ ID NO: 3205431 - DNA, 16 bp, Homo sapiens
agttagggtctatgta

SEQ ID NO: 3205432 - DNA, 16 bp, Homo sapiens
agttagggttttgcaa

SEQ ID NO: 3205433 - DNA, 14 bp, Homo sapiens
agttagtagcatgt

SEQ ID NO: 3205434 - DNA, 17 bp, Homo sapiens
agttagtagcatgttga

SEQ ID NO: 3205435 - DNA, 21 bp, Homo sapiens
agttagttgtgaaagaaagct

SEQ ID NO: 3205436 - DNA, 14 bp, Homo sapiens
agttataaaattaa

SEQ ID NO: 3205437 - DNA, 19 bp, Homo sapiens
agttataaaattaaaagtt

SEQ ID NO: 3205438 - DNA, 12 bp, Homo sapiens
agttataaatca

SEQ ID NO: 3205439 - DNA, 18 bp, Homo sapiens
agttataacagatgtgaa

SEQ ID NO: 3205440 - DNA, 19 bp, Homo sapiens
agttataacagatgtgaaa

SEQ ID NO: 3205441 - DNA, 20 bp, Homo sapiens
agttataacagatgtgaaaa

SEQ ID NO: 3205442 - DNA, 21 bp, Homo sapiens
agttataagtagcaggccaag

SEQ ID NO: 3205443 - DNA, 20 bp, Homo sapiens
agttatacttatttgtatat

SEQ ID NO: 3205444 - DNA, 14 bp, Homo sapiens
agttatagtgaata

SEQ ID NO: 3205445 - DNA, 20 bp, Homo sapiens
agttatagtgaatactgcta

SEQ ID NO: 3205446 - DNA, 16 bp, Homo sapiens
agttatattcacagtt

SEQ ID NO: 3205447 - DNA, 17 bp, Homo sapiens
agttatattttgctgtt

SEQ ID NO: 3205448 - DNA, 23 bp, Homo sapiens
agttatattttgctgtttatgat

SEQ ID NO: 3205449 - DNA, 18 bp, Homo sapiens
agttatcaactttagcta

SEQ ID NO: 3205450 - DNA, 16 bp, Homo sapiens
agttatcatgaatttt

SEQ ID NO: 3205451 - DNA, 18 bp, Homo sapiens
agttatcatgaattttaa

SEQ ID NO: 3205452 - DNA, 22 bp, Homo sapiens
agttatcctttgtgagcctatg

SEQ ID NO: 3205453 - DNA, 16 bp, Homo sapiens
agttatctaaaagaaa

SEQ ID NO: 3205454 - DNA, 18 bp, Homo sapiens
agttatggcctatacact

SEQ ID NO: 3205455 - DNA, 13 bp, Homo sapiens
agttatgtgaatg

SEQ ID NO: 3205456 - DNA, 22 bp, Homo sapiens
agttattcattctgtgatcatt

SEQ ID NO: 3205457 - DNA, 21 bp, Homo sapiens
agttattgtacagctgtttaa

SEQ ID NO: 3205458 - DNA, 13 bp, Homo sapiens
agttatttatgct

SEQ ID NO: 3205459 - DNA, 14 bp, Homo sapiens
agttattttggata

SEQ ID NO: 3205460 - DNA, 16 bp, Homo sapiens
agttattttggatata

SEQ ID NO: 3205461 - DNA, 17 bp, Homo sapiens
agttattttggatatat

SEQ ID NO: 3205462 - DNA, 21 bp, Homo sapiens
agttattttggatatattatt

SEQ ID NO: 3205463 - DNA, 14 bp, Homo sapiens
agttcaaagtgtat

SEQ ID NO: 3205464 - DNA, 18 bp, Homo sapiens
agttcaaagtgtatattt

SEQ ID NO: 3205465 - DNA, 21 bp, Homo sapiens
agttcaacctggtggcaccag

SEQ ID NO: 3205466 - DNA, 15 bp, Homo sapiens
agttcaagaccagcc

SEQ ID NO: 3205467 - DNA, 22 bp, Homo sapiens
agttcaagcctgtgggagtaga

SEQ ID NO: 3205468 - DNA, 23 bp, Homo sapiens
agttcaataaacttaactttaac

SEQ ID NO: 3205469 - DNA, 14 bp, Homo sapiens
agttcacaccctgc

SEQ ID NO: 3205470 - DNA, 13 bp, Homo sapiens
agttcacaggagg

SEQ ID NO: 3205471 - DNA, 18 bp, Homo sapiens
agttcacaggaggccagt

SEQ ID NO: 3205472 - DNA, 18 bp, Homo sapiens
agttcacattagaattag

SEQ ID NO: 3205473 - DNA, 15 bp, Homo sapiens
agttcagaatttagt

SEQ ID NO: 3205474 - DNA, 18 bp, Homo sapiens
agttcagcaccaccctag

SEQ ID NO: 3205475 - DNA, 21 bp, Homo sapiens
agttcagcatccgcaggtgct

SEQ ID NO: 3205476 - DNA, 18 bp, Homo sapiens
agttcaggtaacaggcag

SEQ ID NO: 3205477 - DNA, 19 bp, Homo sapiens
agttcaggtaacaggcaga

SEQ ID NO: 3205478 - DNA, 18 bp, Homo sapiens
agttcagtggcagggctc

SEQ ID NO: 3205479 - DNA, 18 bp, Homo sapiens
agttcataacagtgccat

SEQ ID NO: 3205480 - DNA, 20 bp, Homo sapiens
agttcataacagtgccattg

SEQ ID NO: 3205481 - DNA, 18 bp, Homo sapiens
agttcatacctaagtact

SEQ ID NO: 3205482 - DNA, 18 bp, Homo sapiens
agttcatatgtaccatgt

SEQ ID NO: 3205483 - DNA, 16 bp, Homo sapiens
agttcatccaatcctc

SEQ ID NO: 3205484 - DNA, 13 bp, Homo sapiens
agttcatgagaat

SEQ ID NO: 3205485 - DNA, 14 bp, Homo sapiens
agttccaagagtct

SEQ ID NO: 3205486 - DNA, 15 bp, Homo sapiens
agttccatagaaaag

SEQ ID NO: 3205487 - DNA, 19 bp, Homo sapiens
agttcccagctccccccgc

SEQ ID NO: 3205488 - DNA, 16 bp, Homo sapiens
agttccccaaatacaa

SEQ ID NO: 3205489 - DNA, 23 bp, Homo sapiens
agttcccccatcagttcccccag

SEQ ID NO: 3205490 - DNA, 18 bp, Homo sapiens
agttcccggagcacagcc

SEQ ID NO: 3205491 - DNA, 21 bp, Homo sapiens
agttcccggagcacagccctg

SEQ ID NO: 3205492 - DNA, 15 bp, Homo sapiens
agttccctacttcct

SEQ ID NO: 3205493 - DNA, 14 bp, Homo sapiens
agttccctctgctc

SEQ ID NO: 3205494 - DNA, 22 bp, Homo sapiens
agttccctctgctcagccaagc

SEQ ID NO: 3205495 - DNA, 17 bp, Homo sapiens
agttcccttgaaacttt

SEQ ID NO: 3205496 - DNA, 13 bp, Homo sapiens
agttcccttggcc

SEQ ID NO: 3205497 - DNA, 20 bp, Homo sapiens
agttccctttatttcacata

SEQ ID NO: 3205498 - DNA, 22 bp, Homo sapiens
agttcctaagaagcttctaata

SEQ ID NO: 3205499 - DNA, 15 bp, Homo sapiens
agttcctaatggatt

SEQ ID NO: 3205500 - DNA, 16 bp, Homo sapiens
agttcctgtatgaaag

SEQ ID NO: 3205501 - DNA, 18 bp, Homo sapiens
agttcctgtggccaggag

SEQ ID NO: 3205502 - DNA, 16 bp, Homo sapiens
agttcctttgtgtgta

SEQ ID NO: 3205503 - DNA, 17 bp, Homo sapiens
agttcgagaccagcctc

SEQ ID NO: 3205504 - DNA, 18 bp, Homo sapiens
agttcgagaccagcctcg

SEQ ID NO: 3205505 - DNA, 19 bp, Homo sapiens
agttcgagaccagcctggc

SEQ ID NO: 3205506 - DNA, 21 bp, Homo sapiens
agttcgtaccgcttccttaga

SEQ ID NO: 3205507 - DNA, 23 bp, Homo sapiens
agttctaacagtgaagttttact

SEQ ID NO: 3205508 - DNA, 13 bp, Homo sapiens
agttctaagattc

SEQ ID NO: 3205509 - DNA, 14 bp, Homo sapiens
agttctaagattct

SEQ ID NO: 3205510 - DNA, 18 bp, Homo sapiens
agttctaagattctaatg

SEQ ID NO: 3205511 - DNA, 15 bp, Homo sapiens
agttctaagattctg

SEQ ID NO: 3205512 - DNA, 16 bp, Homo sapiens
agttctaataatttct

SEQ ID NO: 3205513 - DNA, 21 bp, Homo sapiens
agttctaataatttctaatgt

SEQ ID NO: 3205514 - DNA, 22 bp, Homo sapiens
agttctacctcaggcagctcaa

SEQ ID NO: 3205515 - DNA, 17 bp, Homo sapiens
agttctagaaccacttc

SEQ ID NO: 3205516 - DNA, 21 bp, Homo sapiens
agttctagacatggaggttct

SEQ ID NO: 3205517 - DNA, 14 bp, Homo sapiens
agttctaggcactg

SEQ ID NO: 3205518 - DNA, 23 bp, Homo sapiens
agttctaggggagaagagccctg

SEQ ID NO: 3205519 - DNA, 13 bp, Homo sapiens
agttctcactcct

SEQ ID NO: 3205520 - DNA, 17 bp, Homo sapiens
agttctcactcctagga

SEQ ID NO: 3205521 - DNA, 14 bp, Homo sapiens
agttctcagggctc

SEQ ID NO: 3205522 - DNA, 15 bp, Homo sapiens
agttctcagggctcc

SEQ ID NO: 3205523 - DNA, 23 bp, Homo sapiens
agttctcagggctcctgccttct

SEQ ID NO: 3205524 - DNA, 13 bp, Homo sapiens
agttctccctgta

SEQ ID NO: 3205525 - DNA, 16 bp, Homo sapiens
agttctcttatctttg

SEQ ID NO: 3205526 - DNA, 17 bp, Homo sapiens
agttctcttatctttga

SEQ ID NO: 3205527 - DNA, 19 bp, Homo sapiens
agttctgaactggaacatg

SEQ ID NO: 3205528 - DNA, 13 bp, Homo sapiens
agttctgaagaat

SEQ ID NO: 3205529 - DNA, 15 bp, Homo sapiens
agttctgagtgtttt

SEQ ID NO: 3205530 - DNA, 22 bp, Homo sapiens
agttctgagtgtttttactaca

SEQ ID NO: 3205531 - DNA, 22 bp, Homo sapiens
agggaggtgtttaaagagaggt

SEQ ID NO: 3205532 - DNA, 15 bp, Homo sapiens
agggagtacctgctg

SEQ ID NO: 3205533 - DNA, 16 bp, Homo sapiens
agggagtacctgctgc

SEQ ID NO: 3205534 - DNA, 19 bp, Homo sapiens
agggagtacctgctgcccc

SEQ ID NO: 3205535 - DNA, 19 bp, Homo sapiens
agggagtgacagaggcagc

SEQ ID NO: 3205536 - DNA, 23 bp, Homo sapiens
agggagtgctggctcacagtaca

SEQ ID NO: 3205537 - DNA, 13 bp, Homo sapiens
agggatcacaggg

SEQ ID NO: 3205538 - DNA, 17 bp, Homo sapiens
agggatcacagggcccc

SEQ ID NO: 3205539 - DNA, 19 bp, Homo sapiens
agggatctctctacaagag

SEQ ID NO: 3205540 - DNA, 20 bp, Homo sapiens
agggatctgccattgggacc

SEQ ID NO: 3205541 - DNA, 16 bp, Homo sapiens
agggatctgcttaaag

SEQ ID NO: 3205542 - DNA, 20 bp, Homo sapiens
agggatgcggatcctgctgg

SEQ ID NO: 3205543 - DNA, 23 bp, Homo sapiens
agggatgcggatcctgctggggc

SEQ ID NO: 3205544 - DNA, 18 bp, Homo sapiens
agggatgctgctccgccc

SEQ ID NO: 3205545 - DNA, 16 bp, Homo sapiens
agggatgctgggctgg

SEQ ID NO: 3205546 - DNA, 17 bp, Homo sapiens
agggatgctgggctggg

SEQ ID NO: 3205547 - DNA, 16 bp, Homo sapiens
agggatggagaaagaa

SEQ ID NO: 3205548 - DNA, 17 bp, Homo sapiens
agggatggagaggcggc

SEQ ID NO: 3205549 - DNA, 20 bp, Homo sapiens
agggatgggggatgggccag

SEQ ID NO: 3205550 - DNA, 15 bp, Homo sapiens
agggatgggggtggc

SEQ ID NO: 3205551 - DNA, 19 bp, Homo sapiens
agggattaacctctgcact

SEQ ID NO: 3205552 - DNA, 14 bp, Homo sapiens
agggattcaggctg

SEQ ID NO: 3205553 - DNA, 16 bp, Homo sapiens
agggattcaggctgct

SEQ ID NO: 3205554 - DNA, 18 bp, Homo sapiens
agggattcaggctgcttg

SEQ ID NO: 3205555 - DNA, 13 bp, Homo sapiens
agggattctggga

SEQ ID NO: 3205556 - DNA, 18 bp, Homo sapiens
agggcaaatgacatgcac

SEQ ID NO: 3205557 - DNA, 21 bp, Homo sapiens
agggcaaatgacatgcactga

SEQ ID NO: 3205558 - DNA, 19 bp, Homo sapiens
agggcaagtggatgggaat

SEQ ID NO: 3205559 - DNA, 22 bp, Homo sapiens
agggcaagtggatgggaatttg

SEQ ID NO: 3205560 - DNA, 17 bp, Homo sapiens
agggcaattggaacaaa

SEQ ID NO: 3205561 - DNA, 16 bp, Homo sapiens
agggcacaaagatgga

SEQ ID NO: 3205562 - DNA, 17 bp, Homo sapiens
agggcacaccgggcact

SEQ ID NO: 3205563 - DNA, 19 bp, Homo sapiens
agggcacagccctccgacc

SEQ ID NO: 3205564 - DNA, 13 bp, Homo sapiens
agggcaccagagg

SEQ ID NO: 3205565 - DNA, 15 bp, Homo sapiens
agggcaccagaggcc

SEQ ID NO: 3205566 - DNA, 17 bp, Homo sapiens
agggcaccagaggccga

SEQ ID NO: 3205567 - DNA, 21 bp, Homo sapiens
agggcaccaggggtttctcgc

SEQ ID NO: 3205568 - DNA, 21 bp, Homo sapiens
agggcaccctagttctacctc

SEQ ID NO: 3205569 - DNA, 21 bp, Homo sapiens
agggcaccctgtggccctggc

SEQ ID NO: 3205570 - DNA, 14 bp, Homo sapiens
agggcactgggctg

SEQ ID NO: 3205571 - DNA, 17 bp, Homo sapiens
agggcactggtggcccg

SEQ ID NO: 3205572 - DNA, 16 bp, Homo sapiens
agggcacttaatttgt

SEQ ID NO: 3205573 - DNA, 22 bp, Homo sapiens
agggcacttaatttgtaaactt

SEQ ID NO: 3205574 - DNA, 23 bp, Homo sapiens
agggcacttaatttgtaaacttc

SEQ ID NO: 3205575 - DNA, 20 bp, Homo sapiens
agggcagactggggcatcct

SEQ ID NO: 3205576 - DNA, 12 bp, Homo sapiens
agggcagagcca

SEQ ID NO: 3205577 - DNA, 13 bp, Homo sapiens
agggcagagccat

SEQ ID NO: 3205578 - DNA, 13 bp, Homo sapiens
agggcagccccac

SEQ ID NO: 3205579 - DNA, 17 bp, Homo sapiens
agggcagcttgccccgg

SEQ ID NO: 3205580 - DNA, 23 bp, Homo sapiens
agggcaggaaggagagcctgctg

SEQ ID NO: 3205581 - DNA, 12 bp, Homo sapiens
agggcagggcca

SEQ ID NO: 3205582 - DNA, 21 bp, Homo sapiens
agggcagtgcccatgtgtaca

SEQ ID NO: 3205583 - DNA, 21 bp, Homo sapiens
agggcagtgctagtgagctgg

SEQ ID NO: 3205584 - DNA, 22 bp, Homo sapiens
agggcagtgctagtgagctggg

SEQ ID NO: 3205585 - DNA, 16 bp, Homo sapiens
agggcatcaggcactg

SEQ ID NO: 3205586 - DNA, 14 bp, Homo sapiens
agggcatccatacc

SEQ ID NO: 3205587 - DNA, 12 bp, Homo sapiens
agggcatctcct

SEQ ID NO: 3205588 - DNA, 13 bp, Homo sapiens
agggcatctcctg

SEQ ID NO: 3205589 - DNA, 16 bp, Homo sapiens
agggcatctcctgtgc

SEQ ID NO: 3205590 - DNA, 21 bp, Homo sapiens
agggcatctcctgtgcatggg

SEQ ID NO: 3205591 - DNA, 23 bp, Homo sapiens
agggcatctcctgtgcatgggtg

SEQ ID NO: 3205592 - DNA, 19 bp, Homo sapiens
agggcatgaagctgcatat

SEQ ID NO: 3205593 - DNA, 21 bp, Homo sapiens
agggcatgccccggccacctc

SEQ ID NO: 3205594 - DNA, 15 bp, Homo sapiens
agggcatgccttgtg

SEQ ID NO: 3205595 - DNA, 14 bp, Homo sapiens
agggcattctttcc

SEQ ID NO: 3205596 - DNA, 16 bp, Homo sapiens
agggccaagacttggc

SEQ ID NO: 3205597 - DNA, 18 bp, Homo sapiens
agggccacactattacca

SEQ ID NO: 3205598 - DNA, 17 bp, Homo sapiens
agggccaccccactcta

SEQ ID NO: 3205599 - DNA, 19 bp, Homo sapiens
agggccagaaggagggcag

SEQ ID NO: 3205600 - DNA, 16 bp, Homo sapiens
agggccagagggagct

SEQ ID NO: 3205601 - DNA, 15 bp, Homo sapiens
agggccaggaaggac

SEQ ID NO: 3205602 - DNA, 10 bp, Homo sapiens
agggccaggc

SEQ ID NO: 3205603 - DNA, 11 bp, Homo sapiens
agggccaggct

SEQ ID NO: 3205604 - DNA, 14 bp, Homo sapiens
agggccagggccct

SEQ ID NO: 3205605 - DNA, 23 bp, Homo sapiens
agggccagtcctcctgggagccc

SEQ ID NO: 3205606 - DNA, 20 bp, Homo sapiens
agggccagtggggcctgtgg

SEQ ID NO: 3205607 - DNA, 23 bp, Homo sapiens
agggccagtggggcctgtggaat

SEQ ID NO: 3205608 - DNA, 20 bp, Homo sapiens
agggccatgctgaggcctgg

SEQ ID NO: 3205609 - DNA, 19 bp, Homo sapiens
agggcccacccatgtcacc

SEQ ID NO: 3205610 - DNA, 11 bp, Homo sapiens
agggcccagag

SEQ ID NO: 3205611 - DNA, 13 bp, Homo sapiens
agggcccagagag

SEQ ID NO: 3205612 - DNA, 14 bp, Homo sapiens
agggcccagagagg

SEQ ID NO: 3205613 - DNA, 18 bp, Homo sapiens
agggcccagagagggtgg

SEQ ID NO: 3205614 - DNA, 12 bp, Homo sapiens
agggcccagagc

SEQ ID NO: 3205615 - DNA, 15 bp, Homo sapiens
agggcccagaggctg

SEQ ID NO: 3205616 - DNA, 23 bp, Homo sapiens
agggcccagcccagagccacctg

SEQ ID NO: 3205617 - DNA, 23 bp, Homo sapiens
agggcccagctgtagccatggct

SEQ ID NO: 3205618 - DNA, 15 bp, Homo sapiens
agggcccaggcaggc

SEQ ID NO: 3205619 - DNA, 18 bp, Homo sapiens
agggccccagaaggcagg

SEQ ID NO: 3205620 - DNA, 21 bp, Homo sapiens
agggccccccaaatcccaggg

SEQ ID NO: 3205621 - DNA, 19 bp, Homo sapiens
agggcccctcaccctgcct

SEQ ID NO: 3205622 - DNA, 13 bp, Homo sapiens
agggccctacctg

SEQ ID NO: 3205623 - DNA, 13 bp, Homo sapiens
agggccctaggcc

SEQ ID NO: 3205624 - DNA, 16 bp, Homo sapiens
agggccgtaccccacc

SEQ ID NO: 3205625 - DNA, 17 bp, Homo sapiens
agggccgtaccccaccc

SEQ ID NO: 3205626 - DNA, 17 bp, Homo sapiens
agggcctgcctggcccc

SEQ ID NO: 3205627 - DNA, 16 bp, Homo sapiens
agggcctgcttcccct

SEQ ID NO: 3205628 - DNA, 15 bp, Homo sapiens
agggcctggcaggcc

SEQ ID NO: 3205629 - DNA, 17 bp, Homo sapiens
agggcctggcaggccag

SEQ ID NO: 3205630 - DNA, 23 bp, Homo sapiens
agggcctggcaggccagtgtctg

SEQ ID NO: 3205631 - DNA, 12 bp, Homo sapiens
agggcctgtggg

SEQ ID NO: 3205632 - DNA, 21 bp, Homo sapiens
agggccttggaaattcctgta

SEQ ID NO: 3205633 - DNA, 20 bp, Homo sapiens
agggcgaacgacaatagctt

SEQ ID NO: 3205634 - DNA, 17 bp, Homo sapiens
agggcgccgccggccct

SEQ ID NO: 3205635 - DNA, 15 bp, Homo sapiens
agggcgctcagacgg

SEQ ID NO: 3205636 - DNA, 15 bp, Homo sapiens
agggcgctgggaagg

SEQ ID NO: 3205637 - DNA, 19 bp, Homo sapiens
agggcggcaggggcctgga

SEQ ID NO: 3205638 - DNA, 19 bp, Homo sapiens
agggcgggaggatgttctg

SEQ ID NO: 3205639 - DNA, 20 bp, Homo sapiens
agggcgggcagagggctgga

SEQ ID NO: 3205640 - DNA, 23 bp, Homo sapiens
agggcggggcacagattggagag

SEQ ID NO: 3205641 - DNA, 20 bp, Homo sapiens
agggctagggaggtggggta

SEQ ID NO: 3205642 - DNA, 14 bp, Homo sapiens
agggctatggcaag

SEQ ID NO: 3205643 - DNA, 23 bp, Homo sapiens
agggctccagcatccagcctgtg

SEQ ID NO: 3205644 - DNA, 15 bp, Homo sapiens
agggctccctgccct

SEQ ID NO: 3205645 - DNA, 20 bp, Homo sapiens
agggctcccttatgtccacc

SEQ ID NO: 3205646 - DNA, 11 bp, Homo sapiens
agggctcctcc

SEQ ID NO: 3205647 - DNA, 13 bp, Homo sapiens
agggctcctccca

SEQ ID NO: 3205648 - DNA, 15 bp, Homo sapiens
agggctcctgccttc

SEQ ID NO: 3205649 - DNA, 17 bp, Homo sapiens
agggctctgatattcca

SEQ ID NO: 3205650 - DNA, 12 bp, Homo sapiens
agggctctgccc

SEQ ID NO: 3205651 - DNA, 18 bp, Homo sapiens
agggctctgtgctgacat

SEQ ID NO: 3205652 - DNA, 17 bp, Homo sapiens
agggctgacctgcctct

SEQ ID NO: 3205653 - DNA, 19 bp, Homo sapiens
agggctgacctgcctctca

SEQ ID NO: 3205654 - DNA, 23 bp, Homo sapiens
agggctgacctgcctctcacaca

SEQ ID NO: 3205655 - DNA, 17 bp, Homo sapiens
agggctgagctctctgt

SEQ ID NO: 3205656 - DNA, 17 bp, Homo sapiens
agggctgatggaggaaa

SEQ ID NO: 3205657 - DNA, 18 bp, Homo sapiens
agggctgatggaggaaaa

SEQ ID NO: 3205658 - DNA, 13 bp, Homo sapiens
agggctgccacca

SEQ ID NO: 3205659 - DNA, 23 bp, Homo sapiens
agggctgccctgagaagctgctc

SEQ ID NO: 3205660 - DNA, 20 bp, Homo sapiens
agggctgccttctggccttg

SEQ ID NO: 3205661 - DNA, 13 bp, Homo sapiens
agggctggaccta

SEQ ID NO: 3205662 - DNA, 15 bp, Homo sapiens
agggctggaggccca

SEQ ID NO: 3205663 - DNA, 19 bp, Homo sapiens
agggctggccccagggcac

SEQ ID NO: 3205664 - DNA, 14 bp, Homo sapiens
agggctggctctgc

SEQ ID NO: 3205665 - DNA, 18 bp, Homo sapiens
agggctggctctgcacta

SEQ ID NO: 3205666 - DNA, 23 bp, Homo sapiens
agggctggctctgcactaagaga

SEQ ID NO: 3205667 - DNA, 10 bp, Homo sapiens
agggctgggg

SEQ ID NO: 3205668 - DNA, 16 bp, Homo sapiens
agggctggtctctgct

SEQ ID NO: 3205669 - DNA, 15 bp, Homo sapiens
agggcttactatttc

SEQ ID NO: 3205670 - DNA, 12 bp, Homo sapiens
agggcttcctct

SEQ ID NO: 3205671 - DNA, 13 bp, Homo sapiens
agggcttcctctt

SEQ ID NO: 3205672 - DNA, 17 bp, Homo sapiens
agggcttctgcaccctc

SEQ ID NO: 3205673 - DNA, 15 bp, Homo sapiens
agggcttggcccagc

SEQ ID NO: 3205674 - DNA, 21 bp, Homo sapiens
agggcttggcccagcgccaag

SEQ ID NO: 3205675 - DNA, 13 bp, Homo sapiens
aggggaacctgcc

SEQ ID NO: 3205676 - DNA, 18 bp, Homo sapiens
aggcacacagcagccccc

SEQ ID NO: 3205677 - DNA, 23 bp, Homo sapiens
aggcacacagcagccccccagca

SEQ ID NO: 3205678 - DNA, 13 bp, Homo sapiens
aggcacagggccc

SEQ ID NO: 3205679 - DNA, 14 bp, Homo sapiens
aggcacagggcccg

SEQ ID NO: 3205680 - DNA, 16 bp, Homo sapiens
aggcacagggcccgca

SEQ ID NO: 3205681 - DNA, 17 bp, Homo sapiens
aggcacagtgggagctg

SEQ ID NO: 3205682 - DNA, 19 bp, Homo sapiens
aggcacagtgggagctgag

SEQ ID NO: 3205683 - DNA, 17 bp, Homo sapiens
aggcacatggaggagct

SEQ ID NO: 3205684 - DNA, 14 bp, Homo sapiens
aggcaccagaagaa

SEQ ID NO: 3205685 - DNA, 13 bp, Homo sapiens
aggcaccagcatc

SEQ ID NO: 3205686 - DNA, 14 bp, Homo sapiens
aggcaccagcatcc

SEQ ID NO: 3205687 - DNA, 13 bp, Homo sapiens
aggcaccagctct

SEQ ID NO: 3205688 - DNA, 22 bp, Homo sapiens
aggcaccagctctgtggcctgt

SEQ ID NO: 3205689 - DNA, 14 bp, Homo sapiens
aggcaccatctccc

SEQ ID NO: 3205690 - DNA, 20 bp, Homo sapiens
aggcacccggggccagagac

SEQ ID NO: 3205691 - DNA, 20 bp, Homo sapiens
aggcacccttctttcctctt

SEQ ID NO: 3205692 - DNA, 18 bp, Homo sapiens
aggcaccgagaatgttgt

SEQ ID NO: 3205693 - DNA, 14 bp, Homo sapiens
aggcaccgccacgt

SEQ ID NO: 3205694 - DNA, 17 bp, Homo sapiens
aggcaccgctgatgggg

SEQ ID NO: 3205695 - DNA, 15 bp, Homo sapiens
aggcaccggcgctgc

SEQ ID NO: 3205696 - DNA, 17 bp, Homo sapiens
aggcaccggcgctgcag

SEQ ID NO: 3205697 - DNA, 19 bp, Homo sapiens
aggcaccggcgctgcaggt

SEQ ID NO: 3205698 - DNA, 17 bp, Homo sapiens
aggcacctagcaattcc

SEQ ID NO: 3205699 - DNA, 18 bp, Homo sapiens
aggcacctctcctgcccc

SEQ ID NO: 3205700 - DNA, 15 bp, Homo sapiens
aggcacctggcctgc

SEQ ID NO: 3205701 - DNA, 17 bp, Homo sapiens
aggcacctggcctgctg

SEQ ID NO: 3205702 - DNA, 13 bp, Homo sapiens
aggcactagcctt

SEQ ID NO: 3205703 - DNA, 23 bp, Homo sapiens
aggcactagcctttggctctgga

SEQ ID NO: 3205704 - DNA, 15 bp, Homo sapiens
aggcactctagattc

SEQ ID NO: 3205705 - DNA, 19 bp, Homo sapiens
aggcactctgttatttaga

SEQ ID NO: 3205706 - DNA, 20 bp, Homo sapiens
aggcactctgttatttagac

SEQ ID NO: 3205707 - DNA, 17 bp, Homo sapiens
aggcactgaagtgctta

SEQ ID NO: 3205708 - DNA, 14 bp, Homo sapiens
aggcactgctgccc

SEQ ID NO: 3205709 - DNA, 14 bp, Homo sapiens
aggcacttattgta

SEQ ID NO: 3205710 - DNA, 17 bp, Homo sapiens
aggcacttattgtaaat

SEQ ID NO: 3205711 - DNA, 21 bp, Homo sapiens
aggcacttattgtaaatttta

SEQ ID NO: 3205712 - DNA, 17 bp, Homo sapiens
aggcactttgagatgtg

SEQ ID NO: 3205713 - DNA, 14 bp, Homo sapiens
aggcactttggggg

SEQ ID NO: 3205714 - DNA, 22 bp, Homo sapiens
aggcactttgggggtttgaggg

SEQ ID NO: 3205715 - DNA, 15 bp, Homo sapiens
aggcagaactcagaa

SEQ ID NO: 3205716 - DNA, 19 bp, Homo sapiens
aggcagacagcaggcagcg

SEQ ID NO: 3205717 - DNA, 18 bp, Homo sapiens
aggcagactacacaggat

SEQ ID NO: 3205718 - DNA, 18 bp, Homo sapiens
aggcagagacctccaata

SEQ ID NO: 3205719 - DNA, 21 bp, Homo sapiens
aggcagagctgacgggaggcc

SEQ ID NO: 3205720 - DNA, 19 bp, Homo sapiens
aggcagagttctgtgaaga

SEQ ID NO: 3205721 - DNA, 15 bp, Homo sapiens
aggcagatctgtgcc

SEQ ID NO: 3205722 - DNA, 16 bp, Homo sapiens
aggcagatctgtgccc

SEQ ID NO: 3205723 - DNA, 21 bp, Homo sapiens
aggcagatctgtgccccatgc

SEQ ID NO: 3205724 - DNA, 17 bp, Homo sapiens
aggcagatggagcccat

SEQ ID NO: 3205725 - DNA, 19 bp, Homo sapiens
aggcagccaacctaagcaa

SEQ ID NO: 3205726 - DNA, 19 bp, Homo sapiens
aggcagccccattctgcct

SEQ ID NO: 3205727 - DNA, 20 bp, Homo sapiens
aggcagccccattctgcctg

SEQ ID NO: 3205728 - DNA, 21 bp, Homo sapiens
aggcagccccattctgcctgc

SEQ ID NO: 3205729 - DNA, 15 bp, Homo sapiens
aggcagccccctcca

SEQ ID NO: 3205730 - DNA, 16 bp, Homo sapiens
aggcagcctccagagc

SEQ ID NO: 3205731 - DNA, 19 bp, Homo sapiens
aggcagcgccaagcaacct

SEQ ID NO: 3205732 - DNA, 15 bp, Homo sapiens
aggcagctcacccct

SEQ ID NO: 3205733 - DNA, 15 bp, Homo sapiens
aggcagctgcctctg

SEQ ID NO: 3205734 - DNA, 17 bp, Homo sapiens
aggcagctgcctctgct

SEQ ID NO: 3205735 - DNA, 20 bp, Homo sapiens
aggcagctgcctctgctccc

SEQ ID NO: 3205736 - DNA, 22 bp, Homo sapiens
aggcagctggatgagacttcca

SEQ ID NO: 3205737 - DNA, 19 bp, Homo sapiens
aggcagcttcaagtgcctt

SEQ ID NO: 3205738 - DNA, 22 bp, Homo sapiens
aggcaggccagatggcccctcc

SEQ ID NO: 3205739 - DNA, 13 bp, Homo sapiens
aggcagggagggg

SEQ ID NO: 3205740 - DNA, 16 bp, Homo sapiens
aggcagggcagaggga

SEQ ID NO: 3205741 - DNA, 19 bp, Homo sapiens
aggcaggggtgggggtgga

SEQ ID NO: 3205742 - DNA, 23 bp, Homo sapiens
aggcaggggtgggggtggaggct

SEQ ID NO: 3205743 - DNA, 21 bp, Homo sapiens
aggcagggtcccatttctcac

SEQ ID NO: 3205744 - DNA, 12 bp, Homo sapiens
aggcagggtctc

SEQ ID NO: 3205745 - DNA, 21 bp, Homo sapiens
aggcagggtctcactctgtcg

SEQ ID NO: 3205746 - DNA, 14 bp, Homo sapiens
aggcaggtgcctcc

SEQ ID NO: 3205747 - DNA, 23 bp, Homo sapiens
aggcagtctctatattatgtctt

SEQ ID NO: 3205748 - DNA, 11 bp, Homo sapiens
aggcagtctga

SEQ ID NO: 3205749 - DNA, 15 bp, Homo sapiens
aggcagtctgaaccc

SEQ ID NO: 3205750 - DNA, 14 bp, Homo sapiens
aggcagtggcaggg

SEQ ID NO: 3205751 - DNA, 18 bp, Homo sapiens
aggcagtggcaggggagc

SEQ ID NO: 3205752 - DNA, 12 bp, Homo sapiens
aggcagttttct

SEQ ID NO: 3205753 - DNA, 20 bp, Homo sapiens
aggcatacgagagcagaggt

SEQ ID NO: 3205754 - DNA, 15 bp, Homo sapiens
aggcatagaggcttc

SEQ ID NO: 3205755 - DNA, 19 bp, Homo sapiens
aggcataggcctgggtgct

SEQ ID NO: 3205756 - DNA, 17 bp, Homo sapiens
aggcatcaaaaaaacaa

SEQ ID NO: 3205757 - DNA, 17 bp, Homo sapiens
aggcatcctgcctgggt

SEQ ID NO: 3205758 - DNA, 18 bp, Homo sapiens
aggcatcctgcctgggtg

SEQ ID NO: 3205759 - DNA, 19 bp, Homo sapiens
aggcatcctgcctgggtgg

SEQ ID NO: 3205760 - DNA, 21 bp, Homo sapiens
aggcatcgggggtgaatcttg

SEQ ID NO: 3205761 - DNA, 14 bp, Homo sapiens
aggcatctgcaccc

SEQ ID NO: 3205762 - DNA, 14 bp, Homo sapiens
aggcatgagaaaga

SEQ ID NO: 3205763 - DNA, 18 bp, Homo sapiens
aggcatgagccactgagc

SEQ ID NO: 3205764 - DNA, 20 bp, Homo sapiens
aggcatgagggatcacaggg

SEQ ID NO: 3205765 - DNA, 13 bp, Homo sapiens
aggcatgcctctg

SEQ ID NO: 3205766 - DNA, 12 bp, Homo sapiens
aggcatggccct

SEQ ID NO: 3205767 - DNA, 15 bp, Homo sapiens
aggcatggccctggg

SEQ ID NO: 3205768 - DNA, 17 bp, Homo sapiens
aggcatggctcagagct

SEQ ID NO: 3205769 - DNA, 23 bp, Homo sapiens
aggcatggctcagagcttgaaga

SEQ ID NO: 3205770 - DNA, 19 bp, Homo sapiens
aggcatgggtgcaaggaaa

SEQ ID NO: 3205771 - DNA, 20 bp, Homo sapiens
aggcatgggtgcaaggaaaa

SEQ ID NO: 3205772 - DNA, 20 bp, Homo sapiens
aggcatggtcccttaaggca

SEQ ID NO: 3205773 - DNA, 17 bp, Homo sapiens
aggcatgtcccacccac

SEQ ID NO: 3205774 - DNA, 18 bp, Homo sapiens
aggcatgtcccacccacc

SEQ ID NO: 3205775 - DNA, 17 bp, Homo sapiens
aggcatgttctctgagg

SEQ ID NO: 3205776 - DNA, 13 bp, Homo sapiens
aggcattaacaca

SEQ ID NO: 3205777 - DNA, 13 bp, Homo sapiens
aggcattaatgtt

SEQ ID NO: 3205778 - DNA, 20 bp, Homo sapiens
aggcattaatgtttctatct

SEQ ID NO: 3205779 - DNA, 14 bp, Homo sapiens
aggcattgaggaag

SEQ ID NO: 3205780 - DNA, 19 bp, Homo sapiens
aggcattgaggaagagtct

SEQ ID NO: 3205781 - DNA, 14 bp, Homo sapiens
aggcattggatatt

SEQ ID NO: 3205782 - DNA, 21 bp, Homo sapiens
aggcattgttagtttagtgtg

SEQ ID NO: 3205783 - DNA, 21 bp, Homo sapiens
aggcatttgcagggtcctctt

SEQ ID NO: 3205784 - DNA, 17 bp, Homo sapiens
aggccaaactgctggac

SEQ ID NO: 3205785 - DNA, 17 bp, Homo sapiens
aggccaaaggctggtgg

SEQ ID NO: 3205786 - DNA, 16 bp, Homo sapiens
aggccaaatgcacaag

SEQ ID NO: 3205787 - DNA, 22 bp, Homo sapiens
aggccaaatgcacaagctcaga

SEQ ID NO: 3205788 - DNA, 18 bp, Homo sapiens
aggccaacagcacctccc

SEQ ID NO: 3205789 - DNA, 14 bp, Homo sapiens
aggccaagaaacgt

SEQ ID NO: 3205790 - DNA, 17 bp, Homo sapiens
aggccaagaaacgtctt

SEQ ID NO: 3205791 - DNA, 21 bp, Homo sapiens
aggccaagaaacgtcttctaa

SEQ ID NO: 3205792 - DNA, 17 bp, Homo sapiens
aggccaagagcagaggc

SEQ ID NO: 3205793 - DNA, 14 bp, Homo sapiens
aggccaataaaaag

SEQ ID NO: 3205794 - DNA, 15 bp, Homo sapiens
aggccaataaaaagt

SEQ ID NO: 3205795 - DNA, 17 bp, Homo sapiens
aggccaataaaaagttc

SEQ ID NO: 3205796 - DNA, 15 bp, Homo sapiens
aggccacatacctct

SEQ ID NO: 3205797 - DNA, 22 bp, Homo sapiens
aggccaccatattcagtgctgt

SEQ ID NO: 3205798 - DNA, 14 bp, Homo sapiens
aggccacctcccca

SEQ ID NO: 3205799 - DNA, 17 bp, Homo sapiens
aggccacctccccagca

SEQ ID NO: 3205800 - DNA, 17 bp, Homo sapiens
aggccacctctccaagg

SEQ ID NO: 3205801 - DNA, 19 bp, Homo sapiens
aggccacctctccaagggc

SEQ ID NO: 3205802 - DNA, 23 bp, Homo sapiens
aggccacctctccaagggcttct

SEQ ID NO: 3205803 - DNA, 14 bp, Homo sapiens
aggccactgtggcc

SEQ ID NO: 3205804 - DNA, 22 bp, Homo sapiens
aggccagaggcccccagcccag

SEQ ID NO: 3205805 - DNA, 16 bp, Homo sapiens
aggccagagtggcctg

SEQ ID NO: 3205806 - DNA, 17 bp, Homo sapiens
aggccagagtggcctgg

SEQ ID NO: 3205807 - DNA, 20 bp, Homo sapiens
aggccagagtggcctggcca

SEQ ID NO: 3205808 - DNA, 15 bp, Homo sapiens
aggccagatggcccc

SEQ ID NO: 3205809 - DNA, 22 bp, Homo sapiens
aggccagatggcccctccactg

SEQ ID NO: 3205810 - DNA, 17 bp, Homo sapiens
aggccagcaacgcttgt

SEQ ID NO: 3205811 - DNA, 11 bp, Homo sapiens
aggccagccca

SEQ ID NO: 3205812 - DNA, 12 bp, Homo sapiens
aggccagcccag

SEQ ID NO: 3205813 - DNA, 17 bp, Homo sapiens
aggccagcccagccagg

SEQ ID NO: 3205814 - DNA, 18 bp, Homo sapiens
aggccagcccagccaggc

SEQ ID NO: 3205815 - DNA, 13 bp, Homo sapiens
aggccagccccac

SEQ ID NO: 3205816 - DNA, 14 bp, Homo sapiens
aggccagccccacc

SEQ ID NO: 3205817 - DNA, 17 bp, Homo sapiens
aggccagccccacccag

SEQ ID NO: 3205818 - DNA, 11 bp, Homo sapiens
aggccagcctc

SEQ ID NO: 3205819 - DNA, 14 bp, Homo sapiens
aggccagcctccga

SEQ ID NO: 3205820 - DNA, 17 bp, Homo sapiens
aggccagcctccgagag

SEQ ID NO: 3205821 - DNA, 18 bp, Homo sapiens
aggccagcctccgagagg

SEQ ID NO: 3205822 - DNA, 12 bp, Homo sapiens
aggccaggacca

SEQ ID NO: 3205823 - DNA, 14 bp, Homo sapiens
aggccagggaaagc

SEQ ID NO: 3205824 - DNA, 15 bp, Homo sapiens
aggccatctcaggag

SEQ ID NO: 3205825 - DNA, 19 bp, Homo sapiens
aggccatgaaaaaaatgat

SEQ ID NO: 3205826 - DNA, 12 bp, Homo sapiens
aggccatggctc

SEQ ID NO: 3205827 - DNA, 17 bp, Homo sapiens
aggccatgggcctcctg

SEQ ID NO: 3205828 - DNA, 18 bp, Homo sapiens
aggccatgggcctcctgt

SEQ ID NO: 3205829 - DNA, 19 bp, Homo sapiens
aggccatgtgagccaccgc

SEQ ID NO: 3205830 - DNA, 22 bp, Homo sapiens
aggccatgtgagccaccgctgc

SEQ ID NO: 3205831 - DNA, 16 bp, Homo sapiens
aggccattctgccgcc

SEQ ID NO: 3205832 - DNA, 14 bp, Homo sapiens
aggccatttttggt

SEQ ID NO: 3205833 - DNA, 13 bp, Homo sapiens
aggcccaaatgat

SEQ ID NO: 3205834 - DNA, 14 bp, Homo sapiens
aggcccaaatgatg

SEQ ID NO: 3205835 - DNA, 17 bp, Homo sapiens
aggcccaagagccctgt

SEQ ID NO: 3205836 - DNA, 17 bp, Homo sapiens
aggcccaaggctcccgg

SEQ ID NO: 3205837 - DNA, 13 bp, Homo sapiens
aggcccacaggag

SEQ ID NO: 3205838 - DNA, 13 bp, Homo sapiens
aggcccagcattg

SEQ ID NO: 3205839 - DNA, 20 bp, Homo sapiens
aggcccagcattgctggttc

SEQ ID NO: 3205840 - DNA, 20 bp, Homo sapiens
aggcccagccagttggtggg

SEQ ID NO: 3205841 - DNA, 23 bp, Homo sapiens
aggcccagccagttggtggggcc

SEQ ID NO: 3205842 - DNA, 13 bp, Homo sapiens
aggcccagcccct

SEQ ID NO: 3205843 - DNA, 15 bp, Homo sapiens
aggcccagcgcggcc

SEQ ID NO: 3205844 - DNA, 15 bp, Homo sapiens
aggcccaggcagagc

SEQ ID NO: 3205845 - DNA, 17 bp, Homo sapiens
aggcccaggcagagctg

SEQ ID NO: 3205846 - DNA, 17 bp, Homo sapiens
aggcccaggcctgggtt

SEQ ID NO: 3205847 - DNA, 15 bp, Homo sapiens
aggcccaggctggga

SEQ ID NO: 3205848 - DNA, 13 bp, Homo sapiens
aggcccatagcag

SEQ ID NO: 3205849 - DNA, 13 bp, Homo sapiens
aggccccaaagga

SEQ ID NO: 3205850 - DNA, 13 bp, Homo sapiens
aggccccactgat

SEQ ID NO: 3205851 - DNA, 15 bp, Homo sapiens
aggccccactgatgc

SEQ ID NO: 3205852 - DNA, 13 bp, Homo sapiens
aggccccagaggc

SEQ ID NO: 3205853 - DNA, 14 bp, Homo sapiens
aggccccagaggcc

SEQ ID NO: 3205854 - DNA, 15 bp, Homo sapiens
aggccccagaggccc

SEQ ID NO: 3205855 - DNA, 15 bp, Homo sapiens
aggccccagctctga

SEQ ID NO: 3205856 - DNA, 21 bp, Homo sapiens
aggcccccaaacatagcccct

SEQ ID NO: 3205857 - DNA, 14 bp, Homo sapiens
aggcccccacttct

SEQ ID NO: 3205858 - DNA, 22 bp, Homo sapiens
aggccccgtggtgacatttccc

SEQ ID NO: 3205859 - DNA, 15 bp, Homo sapiens
aggcccctgaggact

SEQ ID NO: 3205860 - DNA, 21 bp, Homo sapiens
aggcccctgaggactggagac

SEQ ID NO: 3205861 - DNA, 17 bp, Homo sapiens
aggcccctgccaccctg

SEQ ID NO: 3205862 - DNA, 17 bp, Homo sapiens
aggcccctggacaagca

SEQ ID NO: 3205863 - DNA, 13 bp, Homo sapiens
aggcccggctcca

SEQ ID NO: 3205864 - DNA, 14 bp, Homo sapiens
aggcccggctccag

SEQ ID NO: 3205865 - DNA, 12 bp, Homo sapiens
aggccctcagtg

SEQ ID NO: 3205866 - DNA, 12 bp, Homo sapiens
aggccctccagt

SEQ ID NO: 3205867 - DNA, 13 bp, Homo sapiens
aggccctccagtg

SEQ ID NO: 3205868 - DNA, 18 bp, Homo sapiens
aggccctccatgggctag

SEQ ID NO: 3205869 - DNA, 10 bp, Homo sapiens
aggccctccc

SEQ ID NO: 3205870 - DNA, 17 bp, Homo sapiens
aggccctccctgactcc

SEQ ID NO: 3205871 - DNA, 23 bp, Homo sapiens
aggccctccctgactccctgtgg

SEQ ID NO: 3205872 - DNA, 23 bp, Homo sapiens
aggccctcctctcccatccttga

SEQ ID NO: 3205873 - DNA, 21 bp, Homo sapiens
aggccctgccccctcccactc

SEQ ID NO: 3205874 - DNA, 19 bp, Homo sapiens
aggccctgctttttttctt

SEQ ID NO: 3205875 - DNA, 20 bp, Homo sapiens
aggccctgctttttttctta

SEQ ID NO: 3205876 - DNA, 13 bp, Homo sapiens
aggccctggaggt

SEQ ID NO: 3205877 - DNA, 12 bp, Homo sapiens
aggccctggccc

SEQ ID NO: 3205878 - DNA, 13 bp, Homo sapiens
aggccctggccct

SEQ ID NO: 3205879 - DNA, 19 bp, Homo sapiens
aggccctggccctttcccc

SEQ ID NO: 3205880 - DNA, 21 bp, Homo sapiens
aggccctggcctcccctgcca

SEQ ID NO: 3205881 - DNA, 22 bp, Homo sapiens
aggccctggcctcccctgccac

SEQ ID NO: 3205882 - DNA, 14 bp, Homo sapiens
aggccctgtctgta

SEQ ID NO: 3205883 - DNA, 20 bp, Homo sapiens
aggcccttattttcaagaaa

SEQ ID NO: 3205884 - DNA, 22 bp, Homo sapiens
aggcccttattttcaagaaact

SEQ ID NO: 3205885 - DNA, 13 bp, Homo sapiens
aggcccttcctct

SEQ ID NO: 3205886 - DNA, 15 bp, Homo sapiens
aggcccttcctctcc

SEQ ID NO: 3205887 - DNA, 17 bp, Homo sapiens
aggcccttcctctccac

SEQ ID NO: 3205888 - DNA, 18 bp, Homo sapiens
aggcccttcctctccact

SEQ ID NO: 3205889 - DNA, 19 bp, Homo sapiens
aggcccttcctctccactg

SEQ ID NO: 3205890 - DNA, 22 bp, Homo sapiens
aggcccttcctctccactgcct

SEQ ID NO: 3205891 - DNA, 13 bp, Homo sapiens
aggcccttgtcct

SEQ ID NO: 3205892 - DNA, 15 bp, Homo sapiens
aggcccttgtcctgc

SEQ ID NO: 3205893 - DNA, 17 bp, Homo sapiens
aggcccttgtcctgcca

SEQ ID NO: 3205894 - DNA, 21 bp, Homo sapiens
aggcccttgtcctgccagctg

SEQ ID NO: 3205895 - DNA, 21 bp, Homo sapiens
aggccctttgaagcctcagct

SEQ ID NO: 3205896 - DNA, 16 bp, Homo sapiens
aggccgaagctctggc

SEQ ID NO: 3205897 - DNA, 17 bp, Homo sapiens
aggccgaaggtgcctca

SEQ ID NO: 3205898 - DNA, 20 bp, Homo sapiens
aggccgaaggtgcctcagac

SEQ ID NO: 3205899 - DNA, 21 bp, Homo sapiens
aggccgaaggtgcctcagact

SEQ ID NO: 3205900 - DNA, 24 bp, Homo sapiens
aggccgagccaggttcacactcag

SEQ ID NO: 3205901 - DNA, 17 bp, Homo sapiens
aggccgagcgttcccag

SEQ ID NO: 3205902 - DNA, 21 bp, Homo sapiens
aggccgagcgttcccagcagg

SEQ ID NO: 3205903 - DNA, 18 bp, Homo sapiens
aggccgcagctcttgccc

SEQ ID NO: 3205904 - DNA, 22 bp, Homo sapiens
aggccgcagctcttgcccttcc

SEQ ID NO: 3205905 - DNA, 21 bp, Homo sapiens
aggccggaaccacagggccag

SEQ ID NO: 3205906 - DNA, 22 bp, Homo sapiens
aggccggaaccacagggccaga

SEQ ID NO: 3205907 - DNA, 23 bp, Homo sapiens
aggccggaaccacagggccagag

SEQ ID NO: 3205908 - DNA, 13 bp, Homo sapiens
aggccgtgtctct

SEQ ID NO: 3205909 - DNA, 18 bp, Homo sapiens
aggccgttccccttggct

SEQ ID NO: 3205910 - DNA, 23 bp, Homo sapiens
aggccgttccccttggcttcctc

SEQ ID NO: 3205911 - DNA, 22 bp, Homo sapiens
aggcctaatctcatacctctga

SEQ ID NO: 3205912 - DNA, 19 bp, Homo sapiens
aggcctaccccgcagacac

SEQ ID NO: 3205913 - DNA, 21 bp, Homo sapiens
aggcctagactctgtctacct

SEQ ID NO: 3205914 - DNA, 16 bp, Homo sapiens
aggcctaggattctaa

SEQ ID NO: 3205915 - DNA, 17 bp, Homo sapiens
aggcctaggattctaaa

SEQ ID NO: 3205916 - DNA, 15 bp, Homo sapiens
aggcctaggctagga

SEQ ID NO: 3205917 - DNA, 17 bp, Homo sapiens
aggcctaggctaggacg

SEQ ID NO: 3205918 - DNA, 19 bp, Homo sapiens
aggcctaggctaggacgtt

SEQ ID NO: 3205919 - DNA, 23 bp, Homo sapiens
aggcctaggctaggacgttggcc

SEQ ID NO: 3205920 - DNA, 21 bp, Homo sapiens
aggcctataaaattaaatgcc

SEQ ID NO: 3205921 - DNA, 13 bp, Homo sapiens
aggcctcatccct

SEQ ID NO: 3205922 - DNA, 16 bp, Homo sapiens
aggcctcatccctcgg

SEQ ID NO: 3205923 - DNA, 17 bp, Homo sapiens
aggcctcatgcctgctg

SEQ ID NO: 3205924 - DNA, 19 bp, Homo sapiens
aggcctcatgcctgctgag

SEQ ID NO: 3205925 - DNA, 21 bp, Homo sapiens
aggcctccagcctctcccggc

SEQ ID NO: 3205926 - DNA, 22 bp, Homo sapiens
aggcctccagcctctcccggct

SEQ ID NO: 3205927 - DNA, 16 bp, Homo sapiens
aggcctcctcccccac

SEQ ID NO: 3205928 - DNA, 16 bp, Homo sapiens
aggcctcgagcagaga

SEQ ID NO: 3205929 - DNA, 16 bp, Homo sapiens
aggcctctgagcccaa

SEQ ID NO: 3205930 - DNA, 18 bp, Homo sapiens
aggcctctgagcccaagc

SEQ ID NO: 3205931 - DNA, 12 bp, Homo sapiens
aggcctctggcc

SEQ ID NO: 3205932 - DNA, 15 bp, Homo sapiens
aggcctctggccctc

SEQ ID NO: 3205933 - DNA, 23 bp, Homo sapiens
aggcctctgtgctgtcctgccct

SEQ ID NO: 3205934 - DNA, 14 bp, Homo sapiens
aggcctctgtgtcc

SEQ ID NO: 3205935 - DNA, 15 bp, Homo sapiens
agagcacaaacattt

SEQ ID NO: 3205936 - DNA, 16 bp, Homo sapiens
agagcacaaacatttt

SEQ ID NO: 3205937 - DNA, 14 bp, Homo sapiens
agagcacaaacttc

SEQ ID NO: 3205938 - DNA, 18 bp, Homo sapiens
agagcacacagagaaggg

SEQ ID NO: 3205939 - DNA, 18 bp, Homo sapiens
agagcacctagtccagtg

SEQ ID NO: 3205940 - DNA, 14 bp, Homo sapiens
agagcaccttcctc

SEQ ID NO: 3205941 - DNA, 21 bp, Homo sapiens
agagcaccttcctcacttcca

SEQ ID NO: 3205942 - DNA, 21 bp, Homo sapiens
agagcactaggttcaattccc

SEQ ID NO: 3205943 - DNA, 14 bp, Homo sapiens
agagcagaggcagc

SEQ ID NO: 3205944 - DNA, 15 bp, Homo sapiens
agagcagagtctggg

SEQ ID NO: 3205945 - DNA, 12 bp, Homo sapiens
agagcagatgca

SEQ ID NO: 3205946 - DNA, 14 bp, Homo sapiens
agagcagatgcaga

SEQ ID NO: 3205947 - DNA, 16 bp, Homo sapiens
agagcagcctgatggc

SEQ ID NO: 3205948 - DNA, 19 bp, Homo sapiens
agagcagcctgatggccaa

SEQ ID NO: 3205949 - DNA, 12 bp, Homo sapiens
agagcagcctgg

SEQ ID NO: 3205950 - DNA, 19 bp, Homo sapiens
agagcagcctgtggcatct

SEQ ID NO: 3205951 - DNA, 15 bp, Homo sapiens
agagcaggactccag

SEQ ID NO: 3205952 - DNA, 17 bp, Homo sapiens
agagcaggactccaggc

SEQ ID NO: 3205953 - DNA, 21 bp, Homo sapiens
agagcaggactccaggcccaa

SEQ ID NO: 3205954 - DNA, 23 bp, Homo sapiens
agagcaggctggcagctctccag

SEQ ID NO: 3205955 - DNA, 16 bp, Homo sapiens
agagcaggggctccag

SEQ ID NO: 3205956 - DNA, 19 bp, Homo sapiens
agagcagtaccagcgctct

SEQ ID NO: 3205957 - DNA, 19 bp, Homo sapiens
agagcatcgtgacccttca

SEQ ID NO: 3205958 - DNA, 20 bp, Homo sapiens
agagcatcgtgacccttcag

SEQ ID NO: 3205959 - DNA, 22 bp, Homo sapiens
agagcatcgtgacccttcaggg

SEQ ID NO: 3205960 - DNA, 13 bp, Homo sapiens
agagcatggatgc

SEQ ID NO: 3205961 - DNA, 19 bp, Homo sapiens
agagcatggatgcatttca

SEQ ID NO: 3205962 - DNA, 16 bp, Homo sapiens
agagcattagctggcg

SEQ ID NO: 3205963 - DNA, 19 bp, Homo sapiens
agagcattgaattggagag

SEQ ID NO: 3205964 - DNA, 17 bp, Homo sapiens
agagcatttaaggaaac

SEQ ID NO: 3205965 - DNA, 15 bp, Homo sapiens
agagccaacctcggc

SEQ ID NO: 3205966 - DNA, 13 bp, Homo sapiens
agagccaagtcct

SEQ ID NO: 3205967 - DNA, 14 bp, Homo sapiens
agagccagatgcag

SEQ ID NO: 3205968 - DNA, 18 bp, Homo sapiens
agagccagatgcaggaca

SEQ ID NO: 3205969 - DNA, 20 bp, Homo sapiens
agagccagatgcaggacagg

SEQ ID NO: 3205970 - DNA, 12 bp, Homo sapiens
agagccagcctg

SEQ ID NO: 3205971 - DNA, 15 bp, Homo sapiens
agagccagcctggga

SEQ ID NO: 3205972 - DNA, 17 bp, Homo sapiens
agagccagcctgggact

SEQ ID NO: 3205973 - DNA, 18 bp, Homo sapiens
agagccagcctgggactc

SEQ ID NO: 3205974 - DNA, 11 bp, Homo sapiens
agagccagctt

SEQ ID NO: 3205975 - DNA, 13 bp, Homo sapiens
agagccagggtct

SEQ ID NO: 3205976 - DNA, 19 bp, Homo sapiens
agagccatataagtttgaa

SEQ ID NO: 3205977 - DNA, 17 bp, Homo sapiens
agagccatgaagcatta

SEQ ID NO: 3205978 - DNA, 16 bp, Homo sapiens
agagccatgctgggaa

SEQ ID NO: 3205979 - DNA, 13 bp, Homo sapiens
agagccatgggcc

SEQ ID NO: 3205980 - DNA, 17 bp, Homo sapiens
agagccattttgtgaat

SEQ ID NO: 3205981 - DNA, 19 bp, Homo sapiens
agagcccaccttggctcaa

SEQ ID NO: 3205982 - DNA, 14 bp, Homo sapiens
agagcccagccatt

SEQ ID NO: 3205983 - DNA, 22 bp, Homo sapiens
agcccttccatgtcgcctctgc

SEQ ID NO: 3205984 - DNA, 17 bp, Homo sapiens
agcccttcctccctgtc

SEQ ID NO: 3205985 - DNA, 21 bp, Homo sapiens
agcccttcctctcactcctgc

SEQ ID NO: 3205986 - DNA, 17 bp, Homo sapiens
agcccttcggtcacctg

SEQ ID NO: 3205987 - DNA, 16 bp, Homo sapiens
agcccttgcctcccca

SEQ ID NO: 3205988 - DNA, 13 bp, Homo sapiens
agcccttgggcag

SEQ ID NO: 3205989 - DNA, 22 bp, Homo sapiens
agcccttgggcagttctcactc

SEQ ID NO: 3205990 - DNA, 15 bp, Homo sapiens
agcccttggggaggg

SEQ ID NO: 3205991 - DNA, 12 bp, Homo sapiens
agccctttctgt

SEQ ID NO: 3205992 - DNA, 16 bp, Homo sapiens
agccctttctgtgtgc

SEQ ID NO: 3205993 - DNA, 17 bp, Homo sapiens
agccctttctgtgtgca

SEQ ID NO: 3205994 - DNA, 23 bp, Homo sapiens
agcccttttgttgagccaggcct

SEQ ID NO: 3205995 - DNA, 18 bp, Homo sapiens
agccgactctggccctgg

SEQ ID NO: 3205996 - DNA, 21 bp, Homo sapiens
agccgactctggccctggccc

SEQ ID NO: 3205997 - DNA, 18 bp, Homo sapiens
agccgagccgggcctggg

SEQ ID NO: 3205998 - DNA, 15 bp, Homo sapiens
agccgcaaggatcct

SEQ ID NO: 3205999 - DNA, 18 bp, Homo sapiens
agccgccattgccaccag

SEQ ID NO: 3206000 - DNA, 19 bp, Homo sapiens
agccgccattgccaccagg

SEQ ID NO: 3206001 - DNA, 12 bp, Homo sapiens
agccgccctggg

SEQ ID NO: 3206002 - DNA, 19 bp, Homo sapiens
agccgcctgaaagccacaa

SEQ ID NO: 3206003 - DNA, 18 bp, Homo sapiens
agccgctaggagagactg

SEQ ID NO: 3206004 - DNA, 19 bp, Homo sapiens
agccgctaggagagactga

SEQ ID NO: 3206005 - DNA, 14 bp, Homo sapiens
agccggcacagggt

SEQ ID NO: 3206006 - DNA, 15 bp, Homo sapiens
agccggcacagggtc

SEQ ID NO: 3206007 - DNA, 16 bp, Homo sapiens
agccggcacagggtct

SEQ ID NO: 3206008 - DNA, 14 bp, Homo sapiens
agccggcctctctg

SEQ ID NO: 3206009 - DNA, 21 bp, Homo sapiens
agccggcgtggcaaatataaa

SEQ ID NO: 3206010 - DNA, 16 bp, Homo sapiens
agccgggcccctgggc

SEQ ID NO: 3206011 - DNA, 21 bp, Homo sapiens
agccggggagtttctttcctg

SEQ ID NO: 3206012 - DNA, 20 bp, Homo sapiens
agccggggggccgggggagg

SEQ ID NO: 3206013 - DNA, 12 bp, Homo sapiens
agccggtgcctg

SEQ ID NO: 3206014 - DNA, 16 bp, Homo sapiens
agcctgagtcacctgc

SEQ ID NO: 3206015 - DNA, 17 bp, Homo sapiens
agcctgagtcagggccc

SEQ ID NO: 3206016 - DNA, 15 bp, Homo sapiens
agcctgagtctcctg

SEQ ID NO: 3206017 - DNA, 18 bp, Homo sapiens
agcctgagtctcctgtgc

SEQ ID NO: 3206018 - DNA, 13 bp, Homo sapiens
agcctgatctctt

SEQ ID NO: 3206019 - DNA, 16 bp, Homo sapiens
agcctgatctcttcct

SEQ ID NO: 3206020 - DNA, 13 bp, Homo sapiens
agcctgatggcca

SEQ ID NO: 3206021 - DNA, 19 bp, Homo sapiens
agcctgatggccaaggggg

SEQ ID NO: 3206022 - DNA, 17 bp, Homo sapiens
agcctgcaaagctggtt

SEQ ID NO: 3206023 - DNA, 23 bp, Homo sapiens
agcctgcagttattaacactaac

SEQ ID NO: 3206024 - DNA, 19 bp, Homo sapiens
agcctgccctccagctgct

SEQ ID NO: 3206025 - DNA, 19 bp, Homo sapiens
agcctgcctaaccaggccc

SEQ ID NO: 3206026 - DNA, 16 bp, Homo sapiens
agcctgcctcagtggc

SEQ ID NO: 3206027 - DNA, 15 bp, Homo sapiens
agcctgcctcccaag

SEQ ID NO: 3206028 - DNA, 21 bp, Homo sapiens
agcctgcgccaccgcccagag

SEQ ID NO: 3206029 - DNA, 19 bp, Homo sapiens
agcctgcgctcggcaggaa

SEQ ID NO: 3206030 - DNA, 23 bp, Homo sapiens
agcctgcgctcggcaggaaggag

SEQ ID NO: 3206031 - DNA, 21 bp, Homo sapiens
agcctgcgttggtccagagcg

SEQ ID NO: 3206032 - DNA, 10 bp, Homo sapiens
agcctgctca

SEQ ID NO: 3206033 - DNA, 18 bp, Homo sapiens
agcctgctgagagccccc

SEQ ID NO: 3206034 - DNA, 13 bp, Homo sapiens
agcctgctggctg

SEQ ID NO: 3206035 - DNA, 17 bp, Homo sapiens
agcctggacccccagct

SEQ ID NO: 3206036 - DNA, 19 bp, Homo sapiens
agcctggagacccacccca

SEQ ID NO: 3206037 - DNA, 24 bp, Homo sapiens
agcctggagacccaccccacctgc

SEQ ID NO: 3206038 - DNA, 19 bp, Homo sapiens
agcctggcacaggactgat

SEQ ID NO: 3206039 - DNA, 18 bp, Homo sapiens
agcctgggactcccagtg

SEQ ID NO: 3206040 - DNA, 17 bp, Homo sapiens
agcctgggagcccagag

SEQ ID NO: 3206041 - DNA, 18 bp, Homo sapiens
agcctgggagcccagagg

SEQ ID NO: 3206042 - DNA, 13 bp, Homo sapiens
agcctgggcaaca

SEQ ID NO: 3206043 - DNA, 14 bp, Homo sapiens
agcctgggcgacag

SEQ ID NO: 3206044 - DNA, 22 bp, Homo sapiens
agcctgggcgtacagagcacat

SEQ ID NO: 3206045 - DNA, 20 bp, Homo sapiens
agcctgggcttgagctgcag

SEQ ID NO: 3206046 - DNA, 22 bp, Homo sapiens
agcctgggcttgagctgcagaa

SEQ ID NO: 3206047 - DNA, 19 bp, Homo sapiens
agcctggggcactcctcct

SEQ ID NO: 3206048 - DNA, 14 bp, Homo sapiens
agcctggggcctgg

SEQ ID NO: 3206049 - DNA, 15 bp, Homo sapiens
agcctggggcctggc

SEQ ID NO: 3206050 - DNA, 17 bp, Homo sapiens
agcctggggcctggcag

SEQ ID NO: 3206051 - DNA, 11 bp, Homo sapiens
agcctggggct

SEQ ID NO: 3206052 - DNA, 18 bp, Homo sapiens
agcctggggctccctctc

SEQ ID NO: 3206053 - DNA, 17 bp, Homo sapiens
agcctggtgcccatcct

SEQ ID NO: 3206054 - DNA, 17 bp, Homo sapiens
agcctggttttcacata

SEQ ID NO: 3206055 - DNA, 22 bp, Homo sapiens
agcctgtcatccttggtctttg

SEQ ID NO: 3206056 - DNA, 21 bp, Homo sapiens
agcctgtgcctctgggactgg

SEQ ID NO: 3206057 - DNA, 19 bp, Homo sapiens
agcctgtgcgtcccagctg

SEQ ID NO: 3206058 - DNA, 23 bp, Homo sapiens
agcctgtgcgtcccagctgaagg

SEQ ID NO: 3206059 - DNA, 17 bp, Homo sapiens
agcctgtgctgtggcat

SEQ ID NO: 3206060 - DNA, 22 bp, Homo sapiens
agcctgtgctgtggcatagaca

SEQ ID NO: 3206061 - DNA, 11 bp, Homo sapiens
agcctgtggca

SEQ ID NO: 3206062 - DNA, 17 bp, Homo sapiens
agcctgtgggagtagaa

SEQ ID NO: 3206063 - DNA, 20 bp, Homo sapiens
agcctgtgggagtagaaaaa

SEQ ID NO: 3206064 - DNA, 19 bp, Homo sapiens
agcctgtggttacagtgca

SEQ ID NO: 3206065 - DNA, 20 bp, Homo sapiens
agcctgttcccctcactgga

SEQ ID NO: 3206066 - DNA, 13 bp, Homo sapiens
agccttaaaaata

SEQ ID NO: 3206067 - DNA, 15 bp, Homo sapiens
agccttaaaatgcat

SEQ ID NO: 3206068 - DNA, 19 bp, Homo sapiens
agccttaaaatgcattgaa

SEQ ID NO: 3206069 - DNA, 18 bp, Homo sapiens
agccttaatcaggtcctc

SEQ ID NO: 3206070 - DNA, 15 bp, Homo sapiens
agccttaatttgcac

SEQ ID NO: 3206071 - DNA, 17 bp, Homo sapiens
agccttaatttgcacag

SEQ ID NO: 3206072 - DNA, 18 bp, Homo sapiens
agccttaatttgcacagt

SEQ ID NO: 3206073 - DNA, 15 bp, Homo sapiens
agccttacatttgtg

SEQ ID NO: 3206074 - DNA, 16 bp, Homo sapiens
agccttagctcccagc

SEQ ID NO: 3206075 - DNA, 15 bp, Homo sapiens
agccttagggaagct

SEQ ID NO: 3206076 - DNA, 20 bp, Homo sapiens
agccttataaaccaatctta

SEQ ID NO: 3206077 - DNA, 18 bp, Homo sapiens
agccttatcaagtgtctt

SEQ ID NO: 3206078 - DNA, 19 bp, Homo sapiens
agccttatcaagtgtcttc

SEQ ID NO: 3206079 - DNA, 21 bp, Homo sapiens
agccttcaaaactatagcttg

SEQ ID NO: 3206080 - DNA, 22 bp, Homo sapiens
agccttcaaaactatagcttgc

SEQ ID NO: 3206081 - DNA, 17 bp, Homo sapiens
agccttcaagtgccaaa

SEQ ID NO: 3206082 - DNA, 20 bp, Homo sapiens
agccttctccctagctcctc

SEQ ID NO: 3206083 - DNA, 16 bp, Homo sapiens
agccttctgcagcagg

SEQ ID NO: 3206084 - DNA, 22 bp, Homo sapiens
agccttcttccatcccaggaca

SEQ ID NO: 3206085 - DNA, 19 bp, Homo sapiens
agccttgcactaggttgca

SEQ ID NO: 3206086 - DNA, 23 bp, Homo sapiens
agccttgcactaggttgcagaga

SEQ ID NO: 3206087 - DNA, 22 bp, Homo sapiens
agccttgcctaaatttaatgct

SEQ ID NO: 3206088 - DNA, 18 bp, Homo sapiens
agccttggctcctgagaa

SEQ ID NO: 3206089 - DNA, 20 bp, Homo sapiens
agccttggttcatcagtgtt

SEQ ID NO: 3206090 - DNA, 16 bp, Homo sapiens
agccttgtaattctaa

SEQ ID NO: 3206091 - DNA, 18 bp, Homo sapiens
agccttgtaattctaaat

SEQ ID NO: 3206092 - DNA, 15 bp, Homo sapiens
agccttgtccccctc

SEQ ID NO: 3206093 - DNA, 13 bp, Homo sapiens
agccttgtgagat

SEQ ID NO: 3206094 - DNA, 14 bp, Homo sapiens
agccttgtgccctg

SEQ ID NO: 3206095 - DNA, 20 bp, Homo sapiens
agccttgtgtatatttgtat

SEQ ID NO: 3206096 - DNA, 18 bp, Homo sapiens
agcctttacctgtgaagt

SEQ ID NO: 3206097 - DNA, 16 bp, Homo sapiens
agcctttactgtttga

SEQ ID NO: 3206098 - DNA, 19 bp, Homo sapiens
agcctttactgtttgatat

SEQ ID NO: 3206099 - DNA, 18 bp, Homo sapiens
agcctttagtatcagtgt

SEQ ID NO: 3206100 - DNA, 23 bp, Homo sapiens
agcctttccataaggaatgtagc

SEQ ID NO: 3206101 - DNA, 23 bp, Homo sapiens
agcctttctctctttatacagct

SEQ ID NO: 3206102 - DNA, 13 bp, Homo sapiens
agcctttgccctg

SEQ ID NO: 3206103 - DNA, 16 bp, Homo sapiens
agcctttgccctgtca

SEQ ID NO: 3206104 - DNA, 17 bp, Homo sapiens
agcctttggccttggct

SEQ ID NO: 3206105 - DNA, 17 bp, Homo sapiens
agcctttggctctggag

SEQ ID NO: 3206106 - DNA, 18 bp, Homo sapiens
agcctttggctctggaga

SEQ ID NO: 3206107 - DNA, 18 bp, Homo sapiens
agcctttggttctggcca

SEQ ID NO: 3206108 - DNA, 19 bp, Homo sapiens
agcctttggttctggccag

SEQ ID NO: 3206109 - DNA, 13 bp, Homo sapiens
agccttttaaatc

SEQ ID NO: 3206110 - DNA, 18 bp, Homo sapiens
agccttttccctctttgg

SEQ ID NO: 3206111 - DNA, 13 bp, Homo sapiens
agccttttgtaac

SEQ ID NO: 3206112 - DNA, 23 bp, Homo sapiens
agccttttgtttcccttgctttg

SEQ ID NO: 3206113 - DNA, 21 bp, Homo sapiens
agcctttttgtataaaataga

SEQ ID NO: 3206114 - DNA, 19 bp, Homo sapiens
agcgaaatctaaatttctt

SEQ ID NO: 3206115 - DNA, 18 bp, Homo sapiens
agcgaagacccggccagg

SEQ ID NO: 3206116 - DNA, 20 bp, Homo sapiens
agcgactccgttggccactc

SEQ ID NO: 3206117 - DNA, 13 bp, Homo sapiens
agcgaggaaagga

SEQ ID NO: 3206118 - DNA, 19 bp, Homo sapiens
agcgaggaaaggattttac

SEQ ID NO: 3206119 - DNA, 18 bp, Homo sapiens
agcgaggaggcgcggcct

SEQ ID NO: 3206120 - DNA, 23 bp, Homo sapiens
agcgaggcacccttactggctta

SEQ ID NO: 3206121 - DNA, 24 bp, Homo sapiens
agcgaggctgagcctacagatgaa

SEQ ID NO: 3206122 - DNA, 14 bp, Homo sapiens
agcgagggcagctg

SEQ ID NO: 3206123 - DNA, 21 bp, Homo sapiens
agcgagttgtggaaagcctct

SEQ ID NO: 3206124 - DNA, 17 bp, Homo sapiens
agcgatatacagatgaa

SEQ ID NO: 3206125 - DNA, 18 bp, Homo sapiens
agcgcacctgccccctgg

SEQ ID NO: 3206126 - DNA, 19 bp, Homo sapiens
agcgcacctgccccctggt

SEQ ID NO: 3206127 - DNA, 21 bp, Homo sapiens
agcgccaagcaacctgggtcc

SEQ ID NO: 3206128 - DNA, 15 bp, Homo sapiens
agcgccaagtgcgtg

SEQ ID NO: 3206129 - DNA, 13 bp, Homo sapiens
agcgccagaaaga

SEQ ID NO: 3206130 - DNA, 13 bp, Homo sapiens
agcgcccctgctg

SEQ ID NO: 3206131 - DNA, 15 bp, Homo sapiens
agcgcccctgctgtc

SEQ ID NO: 3206132 - DNA, 19 bp, Homo sapiens
agcgccgtgagttctcagg

SEQ ID NO: 3206133 - DNA, 20 bp, Homo sapiens
agcgccgtgagttctcaggg

SEQ ID NO: 3206134 - DNA, 22 bp, Homo sapiens
agcgccgtgagttctcagggct

SEQ ID NO: 3206135 - DNA, 22 bp, Homo sapiens
agcgcctccatccaaggccagg

SEQ ID NO: 3206136 - DNA, 15 bp, Homo sapiens
agcgcctgtgcacac

SEQ ID NO: 3206137 - DNA, 16 bp, Homo sapiens
agcgcctgtgcacaca

SEQ ID NO: 3206138 - DNA, 12 bp, Homo sapiens
agcgcgccactc

SEQ ID NO: 3206139 - DNA, 20 bp, Homo sapiens
agcgcgccactcgcttcccc

SEQ ID NO: 3206140 - DNA, 15 bp, Homo sapiens
agcgcggccagcgtc

SEQ ID NO: 3206141 - DNA, 14 bp, Homo sapiens
agcgcggctggctc

SEQ ID NO: 3206142 - DNA, 17 bp, Homo sapiens
agcgcggctggctctgt

SEQ ID NO: 3206143 - DNA, 18 bp, Homo sapiens
agcgctatcttcacatag

SEQ ID NO: 3206144 - DNA, 17 bp, Homo sapiens
agcgctcccagcctgcc

SEQ ID NO: 3206145 - DNA, 19 bp, Homo sapiens
agcgctcccagcctgccct

SEQ ID NO: 3206146 - DNA, 12 bp, Homo sapiens
agcgctcctcct

SEQ ID NO: 3206147 - DNA, 19 bp, Homo sapiens
agcgctcctcctgtgtgac

SEQ ID NO: 3206148 - DNA, 22 bp, Homo sapiens
agcggaacaaggagtcagacat

SEQ ID NO: 3206149 - DNA, 20 bp, Homo sapiens
agcggactcctcctttctcc

SEQ ID NO: 3206150 - DNA, 18 bp, Homo sapiens
agcggagacggagtccca

SEQ ID NO: 3206151 - DNA, 16 bp, Homo sapiens
agcggagcccagcctg

SEQ ID NO: 3206152 - DNA, 17 bp, Homo sapiens
agcggagcccagcctgg

SEQ ID NO: 3206153 - DNA, 16 bp, Homo sapiens
agcggaggctgtgtgc

SEQ ID NO: 3206154 - DNA, 14 bp, Homo sapiens
agcggaggtgtgga

SEQ ID NO: 3206155 - DNA, 23 bp, Homo sapiens
agcggaggttgcagggagccgag

SEQ ID NO: 3206156 - DNA, 13 bp, Homo sapiens
agcggatttccag

SEQ ID NO: 3206157 - DNA, 20 bp, Homo sapiens
agcggcgccctggacttggt

SEQ ID NO: 3206158 - DNA, 19 bp, Homo sapiens
agcggctgctcgcccagga

SEQ ID NO: 3206159 - DNA, 22 bp, Homo sapiens
agcggctgctcgcccaggaagg

SEQ ID NO: 3206160 - DNA, 20 bp, Homo sapiens
agcggctgttccccctgccg

SEQ ID NO: 3206161 - DNA, 11 bp, Homo sapiens
agcgggagccc

SEQ ID NO: 3206162 - DNA, 18 bp, Homo sapiens
agcgggcacagggcacca

SEQ ID NO: 3206163 - DNA, 14 bp, Homo sapiens
agcgggcagatggg

SEQ ID NO: 3206164 - DNA, 19 bp, Homo sapiens
agcgggcaggttctgcctg

SEQ ID NO: 3206165 - DNA, 14 bp, Homo sapiens
agcgggccaggccc

SEQ ID NO: 3206166 - DNA, 16 bp, Homo sapiens
agcgggccaggcccgc

SEQ ID NO: 3206167 - DNA, 13 bp, Homo sapiens
agcgggcggaggg

SEQ ID NO: 3206168 - DNA, 17 bp, Homo sapiens
agcggggacagctcctt

SEQ ID NO: 3206169 - DNA, 18 bp, Homo sapiens
agcgggggcctaaaaaaa

SEQ ID NO: 3206170 - DNA, 13 bp, Homo sapiens
agcggggggaggg

SEQ ID NO: 3206171 - DNA, 22 bp, Homo sapiens
agcggtctcaggctggtgggag

SEQ ID NO: 3206172 - DNA, 15 bp, Homo sapiens
agcggtggccctgtc

SEQ ID NO: 3206173 - DNA, 20 bp, Homo sapiens
agcggtgggggaggagggtt

SEQ ID NO: 3206174 - DNA, 22 bp, Homo sapiens
agcggtttggggagcagagaca

SEQ ID NO: 3206175 - DNA, 13 bp, Homo sapiens
agcgtccctggcg

SEQ ID NO: 3206176 - DNA, 17 bp, Homo sapiens
agcgtgacggagcccac

SEQ ID NO: 3206177 - DNA, 22 bp, Homo sapiens
agcgtgagacgccaccattcct

SEQ ID NO: 3206178 - DNA, 13 bp, Homo sapiens
agcgtgagccact

SEQ ID NO: 3206179 - DNA, 16 bp, Homo sapiens
agcgtgagccactgca

SEQ ID NO: 3206180 - DNA, 23 bp, Homo sapiens
agcgtgtctgtatttatgtgtga

SEQ ID NO: 3206181 - DNA, 14 bp, Homo sapiens
agcgtgtgggtccc

SEQ ID NO: 3206182 - DNA, 11 bp, Homo sapiens
agcgtgtgtat

SEQ ID NO: 3206183 - DNA, 18 bp, Homo sapiens
agcgtgtgtatccgactc

SEQ ID NO: 3206184 - DNA, 16 bp, Homo sapiens
agcgttaagggcagag

SEQ ID NO: 3206185 - DNA, 14 bp, Homo sapiens
agcgttgcatgtcg

SEQ ID NO: 3206186 - DNA, 17 bp, Homo sapiens
agcgtttttaacctgtt

SEQ ID NO: 3206187 - DNA, 16 bp, Homo sapiens
agctaaaatatataat

SEQ ID NO: 3206188 - DNA, 17 bp, Homo sapiens
agctaaacggattccaa

SEQ ID NO: 3206189 - DNA, 13 bp, Homo sapiens
agctaaagaggct

SEQ ID NO: 3206190 - DNA, 15 bp, Homo sapiens
agctaaagaggctga

SEQ ID NO: 3206191 - DNA, 17 bp, Homo sapiens
agctaacattttaaata

SEQ ID NO: 3206192 - DNA, 20 bp, Homo sapiens
agctaacattttaaataaaa

SEQ ID NO: 3206193 - DNA, 16 bp, Homo sapiens
agctaaggacatttcc

SEQ ID NO: 3206194 - DNA, 15 bp, Homo sapiens
agctaaggctctatg

SEQ ID NO: 3206195 - DNA, 16 bp, Homo sapiens
agctaagggtgggtgc

SEQ ID NO: 3206196 - DNA, 19 bp, Homo sapiens
agctaagtgaaaaggtcat

SEQ ID NO: 3206197 - DNA, 19 bp, Homo sapiens
agctaataaatctcttctt

SEQ ID NO: 3206198 - DNA, 23 bp, Homo sapiens
agctaatgtaataactgtgaagt

SEQ ID NO: 3206199 - DNA, 15 bp, Homo sapiens
agctacaagggaagc

SEQ ID NO: 3206200 - DNA, 20 bp, Homo sapiens
agctacagctttcttgctcc

SEQ ID NO: 3206201 - DNA, 22 bp, Homo sapiens
agctacagctttcttgctccct

SEQ ID NO: 3206202 - DNA, 22 bp, Homo sapiens
agctacccaggaggctgaggtg

SEQ ID NO: 3206203 - DNA, 15 bp, Homo sapiens
agctaccctgtgtat

SEQ ID NO: 3206204 - DNA, 21 bp, Homo sapiens
agctacccttttcctttgtgg

SEQ ID NO: 3206205 - DNA, 22 bp, Homo sapiens
agctacccttttcctttgtggt

SEQ ID NO: 3206206 - DNA, 21 bp, Homo sapiens
agctaccctttttctccagct

SEQ ID NO: 3206207 - DNA, 22 bp, Homo sapiens
agctacctacatgctgaaaaat

SEQ ID NO: 3206208 - DNA, 23 bp, Homo sapiens
agctacctacatgctgaaaaata

SEQ ID NO: 3206209 - DNA, 16 bp, Homo sapiens
agctacctcaaacttc

SEQ ID NO: 3206210 - DNA, 12 bp, Homo sapiens
agctacctgaga

SEQ ID NO: 3206211 - DNA, 15 bp, Homo sapiens
agctactcagaagcc

SEQ ID NO: 3206212 - DNA, 20 bp, Homo sapiens
agctactcagaagcctgagg

SEQ ID NO: 3206213 - DNA, 22 bp, Homo sapiens
agctactctccccacgagggct

SEQ ID NO: 3206214 - DNA, 18 bp, Homo sapiens
agctactctgtccaggcc

SEQ ID NO: 3206215 - DNA, 16 bp, Homo sapiens
agctactgatttttgt

SEQ ID NO: 3206216 - DNA, 18 bp, Homo sapiens
agctactggattcttatt

SEQ ID NO: 3206217 - DNA, 17 bp, Homo sapiens
agctacttgggaggctg

SEQ ID NO: 3206218 - DNA, 19 bp, Homo sapiens
agctactttccatttggta

SEQ ID NO: 3206219 - DNA, 13 bp, Homo sapiens
agctagctctttg

SEQ ID NO: 3206220 - DNA, 20 bp, Homo sapiens
agctagcttttaggaaaatc

SEQ ID NO: 3206221 - DNA, 20 bp, Homo sapiens
agctaggatggttctgtgac

SEQ ID NO: 3206222 - DNA, 21 bp, Homo sapiens
agctaggatggttctgtgacc

SEQ ID NO: 3206223 - DNA, 23 bp, Homo sapiens
agctaggccccagaggccctgga

SEQ ID NO: 3206224 - DNA, 12 bp, Homo sapiens
agctaggcctgg

SEQ ID NO: 3206225 - DNA, 20 bp, Homo sapiens
agctagggggcgttatttat

SEQ ID NO: 3206226 - DNA, 13 bp, Homo sapiens
agctagtatcttc

SEQ ID NO: 3206227 - DNA, 18 bp, Homo sapiens
agctagtgtacctcctct

SEQ ID NO: 3206228 - DNA, 22 bp, Homo sapiens
agctagttttattcttggtttt

SEQ ID NO: 3206229 - DNA, 12 bp, Homo sapiens
agctagttttct

SEQ ID NO: 3206230 - DNA, 14 bp, Homo sapiens
agctatatccatgt

SEQ ID NO: 3206231 - DNA, 20 bp, Homo sapiens
agctatatccatgtactgta

SEQ ID NO: 3206232 - DNA, 15 bp, Homo sapiens
agctatatctatata

SEQ ID NO: 3206233 - DNA, 17 bp, Homo sapiens
agctatatctatatata

SEQ ID NO: 3206234 - DNA, 22 bp, Homo sapiens
agctatcaagtgtgctttagct

SEQ ID NO: 3206235 - DNA, 23 bp, Homo sapiens
agctatcaagtgtgctttagctt

SEQ ID NO: 3206236 - DNA, 20 bp, Homo sapiens
agctatcagaagaccacaaa

SEQ ID NO: 3206237 - DNA, 14 bp, Homo sapiens
agctatcaggaaca

SEQ ID NO: 3206238 - DNA, 15 bp, Homo sapiens
agctatctaaagttt

SEQ ID NO: 3206239 - DNA, 18 bp, Homo sapiens
agctatctgtcatctctc

SEQ ID NO: 3206240 - DNA, 18 bp, Homo sapiens
agctatgattatgccact

SEQ ID NO: 3206241 - DNA, 19 bp, Homo sapiens
agctatgattatgccactg

SEQ ID NO: 3206242 - DNA, 19 bp, Homo sapiens
agctatgggagccccaggg

SEQ ID NO: 3206243 - DNA, 18 bp, Homo sapiens
agctatgtcaagaggctg

SEQ ID NO: 3206244 - DNA, 19 bp, Homo sapiens
agctattcagtaataactc

SEQ ID NO: 3206245 - DNA, 12 bp, Homo sapiens
agctatttaata

SEQ ID NO: 3206246 - DNA, 22 bp, Homo sapiens
agctatttaatatctggcactg

SEQ ID NO: 3206247 - DNA, 23 bp, Homo sapiens
agctatttaatatctggcactgt

SEQ ID NO: 3206248 - DNA, 13 bp, Homo sapiens
agctatttcatct

SEQ ID NO: 3206249 - DNA, 14 bp, Homo sapiens
agctatttcatcta

SEQ ID NO: 3206250 - DNA, 16 bp, Homo sapiens
agctcaaatgaaatgt

SEQ ID NO: 3206251 - DNA, 23 bp, Homo sapiens
agctcaaatgaaatgtatgcatt

SEQ ID NO: 3206252 - DNA, 22 bp, Homo sapiens
agctcaagcccttggggagggg

SEQ ID NO: 3206253 - DNA, 21 bp, Homo sapiens
agctcaattgttaatgtgatg

SEQ ID NO: 3206254 - DNA, 13 bp, Homo sapiens
agctcaccagccc

SEQ ID NO: 3206255 - DNA, 14 bp, Homo sapiens
agctcaccagcccc

SEQ ID NO: 3206256 - DNA, 16 bp, Homo sapiens
agctcacccctgggca

SEQ ID NO: 3206257 - DNA, 18 bp, Homo sapiens
agctcacccctgggcagg

SEQ ID NO: 3206258 - DNA, 17 bp, Homo sapiens
agctcaccctgcccgct

SEQ ID NO: 3206259 - DNA, 20 bp, Homo sapiens
agctcaccctgcccgctccc

SEQ ID NO: 3206260 - DNA, 16 bp, Homo sapiens
agctgtactcagagca

SEQ ID NO: 3206261 - DNA, 21 bp, Homo sapiens
agctgtacttcgtcttctaat

SEQ ID NO: 3206262 - DNA, 19 bp, Homo sapiens
agctgtacttcttgaatat

SEQ ID NO: 3206263 - DNA, 15 bp, Homo sapiens
agctgtagccatggc

SEQ ID NO: 3206264 - DNA, 16 bp, Homo sapiens
agctgtagccatggct

SEQ ID NO: 3206265 - DNA, 20 bp, Homo sapiens
agctgtagccatggctcagg

SEQ ID NO: 3206266 - DNA, 23 bp, Homo sapiens
agctgtataattaattgtcatta

SEQ ID NO: 3206267 - DNA, 14 bp, Homo sapiens
agctgtccctgcag

SEQ ID NO: 3206268 - DNA, 15 bp, Homo sapiens
agctgtcctccctcc

SEQ ID NO: 3206269 - DNA, 16 bp, Homo sapiens
agctgtcctgcagcaa

SEQ ID NO: 3206270 - DNA, 18 bp, Homo sapiens
agctgtgacttctccagg

SEQ ID NO: 3206271 - DNA, 16 bp, Homo sapiens
agctgtgagccttggc

SEQ ID NO: 3206272 - DNA, 17 bp, Homo sapiens
agctgtgagccttggct

SEQ ID NO: 3206273 - DNA, 17 bp, Homo sapiens
agctgtgctctggacag

SEQ ID NO: 3206274 - DNA, 18 bp, Homo sapiens
agctgtgctctggacagg

SEQ ID NO: 3206275 - DNA, 19 bp, Homo sapiens
agctgtgctctggacaggc

SEQ ID NO: 3206276 - DNA, 17 bp, Homo sapiens
agctgtgctgtggagag

SEQ ID NO: 3206277 - DNA, 18 bp, Homo sapiens
agctgtggcagagttaca

SEQ ID NO: 3206278 - DNA, 21 bp, Homo sapiens
agctgtggcagagttacagtt

SEQ ID NO: 3206279 - DNA, 22 bp, Homo sapiens
agctgtggcagagttacagttc

SEQ ID NO: 3206280 - DNA, 20 bp, Homo sapiens
agctgtgttgaaacagaaaa

SEQ ID NO: 3206281 - DNA, 11 bp, Homo sapiens
agctgtgttta

SEQ ID NO: 3206282 - DNA, 22 bp, Homo sapiens
agctgttaaactgttagcactg

SEQ ID NO: 3206283 - DNA, 23 bp, Homo sapiens
agctgttattttgcatatatgtt

SEQ ID NO: 3206284 - DNA, 20 bp, Homo sapiens
agctgttccttggtcctagt

SEQ ID NO: 3206285 - DNA, 13 bp, Homo sapiens
agctgttgagctg

SEQ ID NO: 3206286 - DNA, 17 bp, Homo sapiens
agctgttgagctgtttt

SEQ ID NO: 3206287 - DNA, 16 bp, Homo sapiens
agctgttgtacattta

SEQ ID NO: 3206288 - DNA, 18 bp, Homo sapiens
agctgttgtacatttatg

SEQ ID NO: 3206289 - DNA, 23 bp, Homo sapiens
agctgttgtacatttatgattta

SEQ ID NO: 3206290 - DNA, 18 bp, Homo sapiens
agctgtttatggcctcag

SEQ ID NO: 3206291 - DNA, 12 bp, Homo sapiens
agctgtttatgt

SEQ ID NO: 3206292 - DNA, 18 bp, Homo sapiens
agctgttttccctgacct

SEQ ID NO: 3206293 - DNA, 14 bp, Homo sapiens
agctgttttcttct

SEQ ID NO: 3206294 - DNA, 21 bp, Homo sapiens
agctgtttttaggctgttcct

SEQ ID NO: 3206295 - DNA, 20 bp, Homo sapiens
agcttaaaataaacagttgt

SEQ ID NO: 3206296 - DNA, 23 bp, Homo sapiens
agcttaaaataaacagttgtgaa

SEQ ID NO: 3206297 - DNA, 15 bp, Homo sapiens
agcttaacaatgcaa

SEQ ID NO: 3206298 - DNA, 16 bp, Homo sapiens
agcttaatagccctcc

SEQ ID NO: 3206299 - DNA, 22 bp, Homo sapiens
agcttaccagaagcttccatag

SEQ ID NO: 3206300 - DNA, 15 bp, Homo sapiens
agcttacctgacaca

SEQ ID NO: 3206301 - DNA, 10 bp, Homo sapiens
agcttagaac

SEQ ID NO: 3206302 - DNA, 13 bp, Homo sapiens
agcttagatttca

SEQ ID NO: 3206303 - DNA, 15 bp, Homo sapiens
agcttagatttcata

SEQ ID NO: 3206304 - DNA, 20 bp, Homo sapiens
agcttagccttgtgccctgc

SEQ ID NO: 3206305 - DNA, 19 bp, Homo sapiens
agcttagcggcaagaagcc

SEQ ID NO: 3206306 - DNA, 14 bp, Homo sapiens
agcttatagaataa

SEQ ID NO: 3206307 - DNA, 19 bp, Homo sapiens
agcttatctcttttatatt

SEQ ID NO: 3206308 - DNA, 17 bp, Homo sapiens
agcttatctttctttcc

SEQ ID NO: 3206309 - DNA, 17 bp, Homo sapiens
agcttattacagaaaaa

SEQ ID NO: 3206310 - DNA, 18 bp, Homo sapiens
agcttcaggcaccagcat

SEQ ID NO: 3206311 - DNA, 13 bp, Homo sapiens
agcttcaggttat

SEQ ID NO: 3206312 - DNA, 16 bp, Homo sapiens
agcttcagttgcttgt

SEQ ID NO: 3206313 - DNA, 15 bp, Homo sapiens
agcttcatgcctttg

SEQ ID NO: 3206314 - DNA, 18 bp, Homo sapiens
agcttcatgcctttgtaa

SEQ ID NO: 3206315 - DNA, 21 bp, Homo sapiens
agcttcattctccttgttgtt

SEQ ID NO: 3206316 - DNA, 22 bp, Homo sapiens
agctttctgtccttttggcact

SEQ ID NO: 3206317 - DNA, 16 bp, Homo sapiens
agctttcttgctccct

SEQ ID NO: 3206318 - DNA, 21 bp, Homo sapiens
agctttctttgcacttaaaaa

SEQ ID NO: 3206319 - DNA, 21 bp, Homo sapiens
agctttgcaaacccattaagg

SEQ ID NO: 3206320 - DNA, 11 bp, Homo sapiens
agctttgcagt

SEQ ID NO: 3206321 - DNA, 22 bp, Homo sapiens
agctttgcccaacaccagcccc

SEQ ID NO: 3206322 - DNA, 18 bp, Homo sapiens
agctttgctacaaattta

SEQ ID NO: 3206323 - DNA, 22 bp, Homo sapiens
agctttgctacaaatttatgca

SEQ ID NO: 3206324 - DNA, 18 bp, Homo sapiens
agctttgctctttggtag

SEQ ID NO: 3206325 - DNA, 18 bp, Homo sapiens
agctttggacctaatcca

SEQ ID NO: 3206326 - DNA, 15 bp, Homo sapiens
agctttgggatccca

SEQ ID NO: 3206327 - DNA, 13 bp, Homo sapiens
agcttttatggat

SEQ ID NO: 3206328 - DNA, 17 bp, Homo sapiens
agcttttattgtataaa

SEQ ID NO: 3206329 - DNA, 13 bp, Homo sapiens
agcttttcccttc

SEQ ID NO: 3206330 - DNA, 14 bp, Homo sapiens
agcttttcctccct

SEQ ID NO: 3206331 - DNA, 18 bp, Homo sapiens
agcttttgccagtattat

SEQ ID NO: 3206332 - DNA, 22 bp, Homo sapiens
agcttttgccagtattatgcat

SEQ ID NO: 3206333 - DNA, 17 bp, Homo sapiens
agctttttaattgttgt

SEQ ID NO: 3206334 - DNA, 21 bp, Homo sapiens
agctttttaattgttgtttct

SEQ ID NO: 3206335 - DNA, 22 bp, Homo sapiens
agctttttaattgttgtttctt

SEQ ID NO: 3206336 - DNA, 15 bp, Homo sapiens
agctttttcctcctg

SEQ ID NO: 3206337 - DNA, 17 bp, Homo sapiens
agctttttcctcctgga

SEQ ID NO: 3206338 - DNA, 21 bp, Homo sapiens
agctttttgatcctctactgt

SEQ ID NO: 3206339 - DNA, 13 bp, Homo sapiens
agctttttggaat

SEQ ID NO: 3206340 - DNA, 14 bp, Homo sapiens
agctttttggaatc

SEQ ID NO: 3206341 - DNA, 14 bp, Homo sapiens
agcttttttacaca

SEQ ID NO: 3206342 - DNA, 14 bp, Homo sapiens
aggaaaaaaatgac

SEQ ID NO: 3206343 - DNA, 13 bp, Homo sapiens
aggaaaaaagaac

SEQ ID NO: 3206344 - DNA, 15 bp, Homo sapiens
aggaaaaaagaacca

SEQ ID NO: 3206345 - DNA, 17 bp, Homo sapiens
aggaaaaagcacaagaa

SEQ ID NO: 3206346 - DNA, 18 bp, Homo sapiens
aggaaaaagcacaagaag

SEQ ID NO: 3206347 - DNA, 12 bp, Homo sapiens
aggaaaagcaag

SEQ ID NO: 3206348 - DNA, 21 bp, Homo sapiens
aggaaaagcaagaaacagttt

SEQ ID NO: 3206349 - DNA, 12 bp, Homo sapiens
aggaaaaggaaa

SEQ ID NO: 3206350 - DNA, 16 bp, Homo sapiens
aggaaaagggagctat

SEQ ID NO: 3206351 - DNA, 16 bp, Homo sapiens
aggaaaatagtaatgt

SEQ ID NO: 3206352 - DNA, 21 bp, Homo sapiens
aggaaactccacatctgcctt

SEQ ID NO: 3206353 - DNA, 12 bp, Homo sapiens
aggaaactctta

SEQ ID NO: 3206354 - DNA, 13 bp, Homo sapiens
aggaaactcttat

SEQ ID NO: 3206355 - DNA, 17 bp, Homo sapiens
aggaaactcttatctca

SEQ ID NO: 3206356 - DNA, 22 bp, Homo sapiens
aggaaactcttatctcagtcat

SEQ ID NO: 3206357 - DNA, 18 bp, Homo sapiens
aggaaagaagggggccct

SEQ ID NO: 3206358 - DNA, 19 bp, Homo sapiens
aggaaagaagggggccctg

SEQ ID NO: 3206359 - DNA, 18 bp, Homo sapiens
aggaaagcaataaatgaa

SEQ ID NO: 3206360 - DNA, 19 bp, Homo sapiens
aggaaagcaataaatgaat

SEQ ID NO: 3206361 - DNA, 23 bp, Homo sapiens
aggaaagccctcccccttcccct

SEQ ID NO: 3206362 - DNA, 22 bp, Homo sapiens
aggaaaggattttaccaaagca

SEQ ID NO: 3206363 - DNA, 18 bp, Homo sapiens
aggaaagtcaagaagaat

SEQ ID NO: 3206364 - DNA, 15 bp, Homo sapiens
aggaaagtttcttca

SEQ ID NO: 3206365 - DNA, 20 bp, Homo sapiens
aggaaataaaaaagtctcta

SEQ ID NO: 3206366 - DNA, 20 bp, Homo sapiens
aggaaataaaacctttcaaa

SEQ ID NO: 3206367 - DNA, 21 bp, Homo sapiens
aggaaataaaacctttcaaat

SEQ ID NO: 3206368 - DNA, 11 bp, Homo sapiens
aggaaatccat

SEQ ID NO: 3206369 - DNA, 19 bp, Homo sapiens
aggaaatccattgtttaaa

SEQ ID NO: 3206370 - DNA, 14 bp, Homo sapiens
aggaaatctcaccc

SEQ ID NO: 3206371 - DNA, 18 bp, Homo sapiens
aggaacaaaaaaaccaca

SEQ ID NO: 3206372 - DNA, 22 bp, Homo sapiens
aggaacaaaaaaaccacaaagg

SEQ ID NO: 3206373 - DNA, 21 bp, Homo sapiens
aggaacaaaaattacaaagaa

SEQ ID NO: 3206374 - DNA, 13 bp, Homo sapiens
aggaacaaacagg

SEQ ID NO: 3206375 - DNA, 17 bp, Homo sapiens
aggaacaatctttgctg

SEQ ID NO: 3206376 - DNA, 19 bp, Homo sapiens
aggaacaatctttgctgta

SEQ ID NO: 3206377 - DNA, 15 bp, Homo sapiens
aggaatataaatatt

SEQ ID NO: 3206378 - DNA, 15 bp, Homo sapiens
aggaatattttccaa

SEQ ID NO: 3206379 - DNA, 20 bp, Homo sapiens
aggaatattttccaaagagt

SEQ ID NO: 3206380 - DNA, 23 bp, Homo sapiens
aggaatccagacccggctgcgtg

SEQ ID NO: 3206381 - DNA, 19 bp, Homo sapiens
aggaatcctggcagcccag

SEQ ID NO: 3206382 - DNA, 20 bp, Homo sapiens
aggaatcctggcagcccaga

SEQ ID NO: 3206383 - DNA, 16 bp, Homo sapiens
aggaatcggctgggga

SEQ ID NO: 3206384 - DNA, 13 bp, Homo sapiens
aggaatgaacttg

SEQ ID NO: 3206385 - DNA, 13 bp, Homo sapiens
aggaatgaagaac

SEQ ID NO: 3206386 - DNA, 17 bp, Homo sapiens
aggaatgaagaactgtt

SEQ ID NO: 3206387 - DNA, 20 bp, Homo sapiens
aggaatgaagaactgttgcc

SEQ ID NO: 3206388 - DNA, 24 bp, Homo sapiens
aggaatgcctcctccctgggcaga

SEQ ID NO: 3206389 - DNA, 14 bp, Homo sapiens
aggaatgcctgtgc

SEQ ID NO: 3206390 - DNA, 17 bp, Homo sapiens
aggaatgcctgtgccaa

SEQ ID NO: 3206391 - DNA, 21 bp, Homo sapiens
aggaatgcctgtgccaataaa

SEQ ID NO: 3206392 - DNA, 14 bp, Homo sapiens
aggaatgctctgtg

SEQ ID NO: 3206393 - DNA, 15 bp, Homo sapiens
aggaatgctctgtgc

SEQ ID NO: 3206394 - DNA, 15 bp, Homo sapiens
aggaatgctggactg

SEQ ID NO: 3206395 - DNA, 16 bp, Homo sapiens
aggaatgctggactgg

SEQ ID NO: 3206396 - DNA, 16 bp, Homo sapiens
aggaatggaatcttct

SEQ ID NO: 3206397 - DNA, 14 bp, Homo sapiens
aggaatttataaca

SEQ ID NO: 3206398 - DNA, 20 bp, Homo sapiens
aggaatttgtacttcttatt

SEQ ID NO: 3206399 - DNA, 23 bp, Homo sapiens
aggaattttattttgctgagttg

SEQ ID NO: 3206400 - DNA, 14 bp, Homo sapiens
aggaattttctttg

SEQ ID NO: 3206401 - DNA, 16 bp, Homo sapiens
aggaattttctttgtg

SEQ ID NO: 3206402 - DNA, 12 bp, Homo sapiens
aggacaaaactt

SEQ ID NO: 3206403 - DNA, 15 bp, Homo sapiens
aggacaaaacttctt

SEQ ID NO: 3206404 - DNA, 20 bp, Homo sapiens
aggacaaaacttcttgtcag

SEQ ID NO: 3206405 - DNA, 16 bp, Homo sapiens
aggacaatactggggt

SEQ ID NO: 3206406 - DNA, 15 bp, Homo sapiens
aggacacagttcctg

SEQ ID NO: 3206407 - DNA, 16 bp, Homo sapiens
aggacacagttcctgg

SEQ ID NO: 3206408 - DNA, 21 bp, Homo sapiens
aggacacagttcctgggaaca

SEQ ID NO: 3206409 - DNA, 17 bp, Homo sapiens
aggacaccagtgaaaga

SEQ ID NO: 3206410 - DNA, 19 bp, Homo sapiens
aggacactaaccacgctgg

SEQ ID NO: 3206411 - DNA, 13 bp, Homo sapiens
aggacagactggc

SEQ ID NO: 3206412 - DNA, 18 bp, Homo sapiens
aggacagactggccgggc

SEQ ID NO: 3206413 - DNA, 23 bp, Homo sapiens
aggacagactggccgggcaggcg

SEQ ID NO: 3206414 - DNA, 14 bp, Homo sapiens
aggacagagttcac

SEQ ID NO: 3206415 - DNA, 20 bp, Homo sapiens
aggacagagttcacaggagg

SEQ ID NO: 3206416 - DNA, 23 bp, Homo sapiens
aggacagagttcacaggaggcca

SEQ ID NO: 3206417 - DNA, 17 bp, Homo sapiens
aggacaggcaggccaga

SEQ ID NO: 3206418 - DNA, 22 bp, Homo sapiens
aggacagggaggtgaccccagg

SEQ ID NO: 3206419 - DNA, 20 bp, Homo sapiens
aggacagtctggagaaggta

SEQ ID NO: 3206420 - DNA, 17 bp, Homo sapiens
aggacagtgcttcagcc

SEQ ID NO: 3206421 - DNA, 18 bp, Homo sapiens
aggacagtgcttcagcct

SEQ ID NO: 3206422 - DNA, 19 bp, Homo sapiens
aggacagtgcttcagcctg

SEQ ID NO: 3206423 - DNA, 20 bp, Homo sapiens
aggacagtgcttcagcctga

SEQ ID NO: 3206424 - DNA, 21 bp, Homo sapiens
aggacatagaggtatattgga

SEQ ID NO: 3206425 - DNA, 22 bp, Homo sapiens
aggacatagaggtatattggaa

SEQ ID NO: 3206426 - DNA, 21 bp, Homo sapiens
aggacatgatggagcgcacct

SEQ ID NO: 3206427 - DNA, 13 bp, Homo sapiens
aggacatgcaata

SEQ ID NO: 3206428 - DNA, 21 bp, Homo sapiens
aggacatgcaataaaatttaa

SEQ ID NO: 3206429 - DNA, 15 bp, Homo sapiens
aggacatgtttttgt

SEQ ID NO: 3206430 - DNA, 15 bp, Homo sapiens
aggacattatgtgtg

SEQ ID NO: 3206431 - DNA, 17 bp, Homo sapiens
aggacattatgtgtgca

SEQ ID NO: 3206432 - DNA, 18 bp, Homo sapiens
aggacattgcggacagcc

SEQ ID NO: 3206433 - DNA, 13 bp, Homo sapiens
aggaccacacagt

SEQ ID NO: 3206434 - DNA, 14 bp, Homo sapiens
aggaccacacagtc

SEQ ID NO: 3206435 - DNA, 15 bp, Homo sapiens
aggaccacacagtcc

SEQ ID NO: 3206436 - DNA, 23 bp, Homo sapiens
aggaccacagagctcctggccct

SEQ ID NO: 3206437 - DNA, 16 bp, Homo sapiens
aggaccacagtgggtg

SEQ ID NO: 3206438 - DNA, 19 bp, Homo sapiens
aggaccactcagcccctag

SEQ ID NO: 3206439 - DNA, 12 bp, Homo sapiens
aggaccactcct

SEQ ID NO: 3206440 - DNA, 16 bp, Homo sapiens
aggaccactcctgtac

SEQ ID NO: 3206441 - DNA, 14 bp, Homo sapiens
aggaccagctgggg

SEQ ID NO: 3206442 - DNA, 12 bp, Homo sapiens
aggaccaggact

SEQ ID NO: 3206443 - DNA, 21 bp, Homo sapiens
aggaccaggactccctcctca

SEQ ID NO: 3206444 - DNA, 12 bp, Homo sapiens
aggagaccacgg

SEQ ID NO: 3206445 - DNA, 21 bp, Homo sapiens
aggagacctggcactggatgc

SEQ ID NO: 3206446 - DNA, 13 bp, Homo sapiens
aggagactgaggc

SEQ ID NO: 3206447 - DNA, 16 bp, Homo sapiens
aggagagactgaaagc

SEQ ID NO: 3206448 - DNA, 12 bp, Homo sapiens
aggagagagacc

SEQ ID NO: 3206449 - DNA, 14 bp, Homo sapiens
aggagagagacccc

SEQ ID NO: 3206450 - DNA, 16 bp, Homo sapiens
aggagagagaccccgc

SEQ ID NO: 3206451 - DNA, 21 bp, Homo sapiens
aggagagattgggagaaatca

SEQ ID NO: 3206452 - DNA, 18 bp, Homo sapiens
aggagagccaacctcggc

SEQ ID NO: 3206453 - DNA, 12 bp, Homo sapiens
aggagagcctgc

SEQ ID NO: 3206454 - DNA, 15 bp, Homo sapiens
aggagaggaaaagta

SEQ ID NO: 3206455 - DNA, 21 bp, Homo sapiens
aggagaggatgagagcccaga

SEQ ID NO: 3206456 - DNA, 20 bp, Homo sapiens
aggagaggcaacatccaaaa

SEQ ID NO: 3206457 - DNA, 16 bp, Homo sapiens
aggagaggctgggctg

SEQ ID NO: 3206458 - DNA, 20 bp, Homo sapiens
aggagagtggttgttgccaa

SEQ ID NO: 3206459 - DNA, 20 bp, Homo sapiens
aggagatatctgagggagga

SEQ ID NO: 3206460 - DNA, 23 bp, Homo sapiens
aggagatcgagaccatcctggct

SEQ ID NO: 3206461 - DNA, 14 bp, Homo sapiens
aggagatgaccagg

SEQ ID NO: 3206462 - DNA, 22 bp, Homo sapiens
aggagatgaccagggatgctgg

SEQ ID NO: 3206463 - DNA, 14 bp, Homo sapiens
aggagatggccata

SEQ ID NO: 3206464 - DNA, 11 bp, Homo sapiens
aggagattcca

SEQ ID NO: 3206465 - DNA, 18 bp, Homo sapiens
aggagattccacacaggg

SEQ ID NO: 3206466 - DNA, 16 bp, Homo sapiens
aggagattgagaagga

SEQ ID NO: 3206467 - DNA, 16 bp, Homo sapiens
aggagcacaagccaca

SEQ ID NO: 3206468 - DNA, 14 bp, Homo sapiens
aggagcagaaatgc

SEQ ID NO: 3206469 - DNA, 13 bp, Homo sapiens
aggagcagcattg

SEQ ID NO: 3206470 - DNA, 19 bp, Homo sapiens
aggagcagcttccttctgg

SEQ ID NO: 3206471 - DNA, 22 bp, Homo sapiens
aggagcagcttccttctgggac

SEQ ID NO: 3206472 - DNA, 14 bp, Homo sapiens
aggagccaccagtt

SEQ ID NO: 3206473 - DNA, 12 bp, Homo sapiens
aggagccaggca

SEQ ID NO: 3206474 - DNA, 19 bp, Homo sapiens
aggagccaggcaacttcag

SEQ ID NO: 3206475 - DNA, 24 bp, Homo sapiens
aggagcccacggctaagaggctgc

SEQ ID NO: 3206476 - DNA, 22 bp, Homo sapiens
aggagccccgaggccttctctg

SEQ ID NO: 3206477 - DNA, 19 bp, Homo sapiens
aggagcctagcggagccca

SEQ ID NO: 3206478 - DNA, 21 bp, Homo sapiens
aggagcctagcggagcccagc

SEQ ID NO: 3206479 - DNA, 22 bp, Homo sapiens
aggagcctagcggagcccagcc

SEQ ID NO: 3206480 - DNA, 12 bp, Homo sapiens
aggagcctgtgc

SEQ ID NO: 3206481 - DNA, 23 bp, Homo sapiens
aggagcctgtgcgtcccagctga

SEQ ID NO: 3206482 - DNA, 17 bp, Homo sapiens
aggagcgcaagatagat

SEQ ID NO: 3206483 - DNA, 15 bp, Homo sapiens
aggagcggcgccctg

SEQ ID NO: 3206484 - DNA, 17 bp, Homo sapiens
aggagcggcgccctgga

SEQ ID NO: 3206485 - DNA, 22 bp, Homo sapiens
aggagcggcgccctggacttgg

SEQ ID NO: 3206486 - DNA, 18 bp, Homo sapiens
aggagcgtgaaggactta

SEQ ID NO: 3206487 - DNA, 19 bp, Homo sapiens
aggagcgtgaaggacttag

SEQ ID NO: 3206488 - DNA, 17 bp, Homo sapiens
aggagctaaggctctat

SEQ ID NO: 3206489 - DNA, 14 bp, Homo sapiens
aggagctcaccctg

SEQ ID NO: 3206490 - DNA, 18 bp, Homo sapiens
aggagctcaccctgcccg

SEQ ID NO: 3206491 - DNA, 19 bp, Homo sapiens
aggagctctaccctgctcc

SEQ ID NO: 3206492 - DNA, 23 bp, Homo sapiens
aggagctctaccctgctccctgc

SEQ ID NO: 3206493 - DNA, 19 bp, Homo sapiens
aggagctcttcaggcctcc

SEQ ID NO: 3206494 - DNA, 18 bp, Homo sapiens
aggagctgatttccaggc

SEQ ID NO: 3206495 - DNA, 19 bp, Homo sapiens
aggagctgccttggctcag

SEQ ID NO: 3206496 - DNA, 14 bp, Homo sapiens
aggagctgctggct

SEQ ID NO: 3206497 - DNA, 21 bp, Homo sapiens
aggagctgctggcttgcagtg

SEQ ID NO: 3206498 - DNA, 12 bp, Homo sapiens
aggagctgggcc

SEQ ID NO: 3206499 - DNA, 17 bp, Homo sapiens
aggaggaaggcaagagg

SEQ ID NO: 3206500 - DNA, 23 bp, Homo sapiens
aggaggaatcatgtcaggcctgt

SEQ ID NO: 3206501 - DNA, 17 bp, Homo sapiens
aggaggagggagaagag

SEQ ID NO: 3206502 - DNA, 16 bp, Homo sapiens
aggaggagggaggccg

SEQ ID NO: 3206503 - DNA, 15 bp, Homo sapiens
aggaggatgtccctg

SEQ ID NO: 3206504 - DNA, 20 bp, Homo sapiens
aggaggcagaggttgcagtg

SEQ ID NO: 3206505 - DNA, 19 bp, Homo sapiens
aggaggcagccccctccac

SEQ ID NO: 3206506 - DNA, 14 bp, Homo sapiens
aggaggcaggacct

SEQ ID NO: 3206507 - DNA, 20 bp, Homo sapiens
aggaggccaataaaaagttc

SEQ ID NO: 3206508 - DNA, 12 bp, Homo sapiens
aggaggccacct

SEQ ID NO: 3206509 - DNA, 13 bp, Homo sapiens
aggaggccacctc

SEQ ID NO: 3206510 - DNA, 15 bp, Homo sapiens
aggaggccacctctc

SEQ ID NO: 3206511 - DNA, 20 bp, Homo sapiens
aggaggccacctctccaagg

SEQ ID NO: 3206512 - DNA, 22 bp, Homo sapiens
aggaggccacctctccaagggc

SEQ ID NO: 3206513 - DNA, 20 bp, Homo sapiens
aggaggccccccgtgtggac

SEQ ID NO: 3206514 - DNA, 23 bp, Homo sapiens
aggaggccgcctcctcggggctc

SEQ ID NO: 3206515 - DNA, 22 bp, Homo sapiens
aggaggcctggggaggccctag

SEQ ID NO: 3206516 - DNA, 16 bp, Homo sapiens
aggaggcgcggcctcc

SEQ ID NO: 3206517 - DNA, 13 bp, Homo sapiens
aggaggctgaggt

SEQ ID NO: 3206518 - DNA, 16 bp, Homo sapiens
aggaggctggaggaag

SEQ ID NO: 3206519 - DNA, 18 bp, Homo sapiens
aggaggctggaggaaggg

SEQ ID NO: 3206520 - DNA, 16 bp, Homo sapiens
aggaggctggcaggta

SEQ ID NO: 3206521 - DNA, 16 bp, Homo sapiens
aggaggctggtgacag

SEQ ID NO: 3206522 - DNA, 15 bp, Homo sapiens
aggagggagaagaga

SEQ ID NO: 3206523 - DNA, 23 bp, Homo sapiens
aggagggagacactggcccctca

SEQ ID NO: 3206524 - DNA, 19 bp, Homo sapiens
aggagggatgctgcctgag

SEQ ID NO: 3206525 - DNA, 21 bp, Homo sapiens
aggagggatgctgctccgccc

SEQ ID NO: 3206526 - DNA, 14 bp, Homo sapiens
aggaggggaagctg

SEQ ID NO: 3206527 - DNA, 19 bp, Homo sapiens
aggaggggaagctgcagct

SEQ ID NO: 3206528 - DNA, 17 bp, Homo sapiens
aggaggggatagagaga

SEQ ID NO: 3206529 - DNA, 20 bp, Homo sapiens
aggaggggcccggtggcggc

SEQ ID NO: 3206530 - DNA, 17 bp, Homo sapiens
aggagggggccgggcgc

SEQ ID NO: 3206531 - DNA, 19 bp, Homo sapiens
aggagggggccgggcgcgg

SEQ ID NO: 3206532 - DNA, 16 bp, Homo sapiens
aggagggtggaggaag

SEQ ID NO: 3206533 - DNA, 14 bp, Homo sapiens
aggaggtgcctgga

SEQ ID NO: 3206534 - DNA, 17 bp, Homo sapiens
aggaggtggcagccctg

SEQ ID NO: 3206535 - DNA, 20 bp, Homo sapiens
aggagtctctgccacccact

SEQ ID NO: 3206536 - DNA, 21 bp, Homo sapiens
aggagtctctgccacccactc

SEQ ID NO: 3206537 - DNA, 16 bp, Homo sapiens
aggagtctgtgctctt

SEQ ID NO: 3206538 - DNA, 23 bp, Homo sapiens
aggagtgaaacctttagggcagc

SEQ ID NO: 3206539 - DNA, 18 bp, Homo sapiens
aggagtggtgcagacaga

SEQ ID NO: 3206540 - DNA, 15 bp, Homo sapiens
aggagtgtcctgccc

SEQ ID NO: 3206541 - DNA, 18 bp, Homo sapiens
aggagtgtcctgcccatg

SEQ ID NO: 3206542 - DNA, 20 bp, Homo sapiens
aggagtgtgtgacattccag

SEQ ID NO: 3206543 - DNA, 21 bp, Homo sapiens
aggagttcgagaccagcctgg

SEQ ID NO: 3206544 - DNA, 17 bp, Homo sapiens
aggagtttgagacaagc

SEQ ID NO: 3206545 - DNA, 24 bp, Homo sapiens
aggagtttgagacaagccctggca

SEQ ID NO: 3206546 - DNA, 19 bp, Homo sapiens
aggagtttgaggctgcagc

SEQ ID NO: 3206547 - DNA, 24 bp, Homo sapiens
aggagtttgaggctgcagcgagct

SEQ ID NO: 3206548 - DNA, 14 bp, Homo sapiens
aggataatatattt

SEQ ID NO: 3206549 - DNA, 17 bp, Homo sapiens
aggataatgaaataatc

SEQ ID NO: 3206550 - DNA, 18 bp, Homo sapiens
aggataatgaaataatca

SEQ ID NO: 3206551 - DNA, 14 bp, Homo sapiens
aggatacatgtgcc

SEQ ID NO: 3206552 - DNA, 21 bp, Homo sapiens
aggatacatgtgccgaatgtg

SEQ ID NO: 3206553 - DNA, 16 bp, Homo sapiens
aggataccttcttatt

SEQ ID NO: 3206554 - DNA, 13 bp, Homo sapiens
aggatactctgtc

SEQ ID NO: 3206555 - DNA, 23 bp, Homo sapiens
aggatagaagtatacctgatttt

SEQ ID NO: 3206556 - DNA, 14 bp, Homo sapiens
aggatagcattttt

SEQ ID NO: 3206557 - DNA, 18 bp, Homo sapiens
aggatatactgcagcttt

SEQ ID NO: 3206558 - DNA, 14 bp, Homo sapiens
aggatatattttca

SEQ ID NO: 3206559 - DNA, 13 bp, Homo sapiens
aggatattctact

SEQ ID NO: 3206560 - DNA, 15 bp, Homo sapiens
aggatcaagaaagtg

SEQ ID NO: 3206561 - DNA, 14 bp, Homo sapiens
aggatcactggagc

SEQ ID NO: 3206562 - DNA, 16 bp, Homo sapiens
aggatcactggagccc

SEQ ID NO: 3206563 - DNA, 18 bp, Homo sapiens
aggatcactggagcccag

SEQ ID NO: 3206564 - DNA, 17 bp, Homo sapiens
aggatcagccccgctcc

SEQ ID NO: 3206565 - DNA, 15 bp, Homo sapiens
aggatccgctgccac

SEQ ID NO: 3206566 - DNA, 16 bp, Homo sapiens
aggatccgctgccacc

SEQ ID NO: 3206567 - DNA, 17 bp, Homo sapiens
aggatccgctgccacca

SEQ ID NO: 3206568 - DNA, 14 bp, Homo sapiens
aggatccttccctg

SEQ ID NO: 3206569 - DNA, 22 bp, Homo sapiens
aggatctccactgataagactg

SEQ ID NO: 3206570 - DNA, 13 bp, Homo sapiens
aggatctctcagg

SEQ ID NO: 3206571 - DNA, 14 bp, Homo sapiens
aggatctctcagga

SEQ ID NO: 3206572 - DNA, 15 bp, Homo sapiens
aggatctctcaggag

SEQ ID NO: 3206573 - DNA, 23 bp, Homo sapiens
aggatctctgagaccacagaggc

SEQ ID NO: 3206574 - DNA, 20 bp, Homo sapiens
aggatgaagaacacagcatg

SEQ ID NO: 3206575 - DNA, 23 bp, Homo sapiens
aggatgactaacaagatttgtaa

SEQ ID NO: 3206576 - DNA, 17 bp, Homo sapiens
aggatgagagcccagag

SEQ ID NO: 3206577 - DNA, 20 bp, Homo sapiens
aggatgagcagaccagcttt

SEQ ID NO: 3206578 - DNA, 12 bp, Homo sapiens
aggatgccagcc

SEQ ID NO: 3206579 - DNA, 16 bp, Homo sapiens
aggatgccagcccctg

SEQ ID NO: 3206580 - DNA, 21 bp, Homo sapiens
aggatgccagcccctgcctgg

SEQ ID NO: 3206581 - DNA, 17 bp, Homo sapiens
aggatgctaacatctaa

SEQ ID NO: 3206582 - DNA, 13 bp, Homo sapiens
aggatgctctttc

SEQ ID NO: 3206583 - DNA, 21 bp, Homo sapiens
aggatgctctttcccttttct

SEQ ID NO: 3206584 - DNA, 17 bp, Homo sapiens
aggatgctgcagcagag

SEQ ID NO: 3206585 - DNA, 13 bp, Homo sapiens
aggatgctgctgt

SEQ ID NO: 3206586 - DNA, 15 bp, Homo sapiens
aggatgctgggtggc

SEQ ID NO: 3206587 - DNA, 14 bp, Homo sapiens
aggatggagagagg

SEQ ID NO: 3206588 - DNA, 15 bp, Homo sapiens
aggatggagagaggg

SEQ ID NO: 3206589 - DNA, 19 bp, Homo sapiens
aggatggagagaggggaat

SEQ ID NO: 3206590 - DNA, 19 bp, Homo sapiens
aggatggaggggtggtcct

SEQ ID NO: 3206591 - DNA, 21 bp, Homo sapiens
aggatggatagaaggaaacat

SEQ ID NO: 3206592 - DNA, 16 bp, Homo sapiens
aggatggggctcccag

SEQ ID NO: 3206593 - DNA, 21 bp, Homo sapiens
aggatggtctcgatctcctga

SEQ ID NO: 3206594 - DNA, 23 bp, Homo sapiens
aggatggtctcgatctcctgacc

SEQ ID NO: 3206595 - DNA, 22 bp, Homo sapiens
aggatgtagttctgccaggcaa

SEQ ID NO: 3206596 - DNA, 18 bp, Homo sapiens
aggatgtgatatataagt

SEQ ID NO: 3206597 - DNA, 20 bp, Homo sapiens
aggatgtgattgtggaatgg

SEQ ID NO: 3206598 - DNA, 20 bp, Homo sapiens
aggatgttctgggacacagt

SEQ ID NO: 3206599 - DNA, 20 bp, Homo sapiens
aggattaaaatggatttaat

SEQ ID NO: 3206600 - DNA, 15 bp, Homo sapiens
aggattatggaaaaa

SEQ ID NO: 3206601 - DNA, 16 bp, Homo sapiens
aggattcccccagcca

SEQ ID NO: 3206602 - DNA, 19 bp, Homo sapiens
aggattctgggaatcatgt

SEQ ID NO: 3206603 - DNA, 22 bp, Homo sapiens
aggattgctactgtcctaccca

SEQ ID NO: 3206604 - DNA, 13 bp, Homo sapiens
aggattgtaaaaa

SEQ ID NO: 3206605 - DNA, 23 bp, Homo sapiens
aggattgtaaaaaaaaatgcctt

SEQ ID NO: 3206606 - DNA, 15 bp, Homo sapiens
aggattgtggaaaac

SEQ ID NO: 3206607 - DNA, 18 bp, Homo sapiens
aggattgtggaaaaccag

SEQ ID NO: 3206608 - DNA, 19 bp, Homo sapiens
aggattgtggaaaaccagg

SEQ ID NO: 3206609 - DNA, 12 bp, Homo sapiens
aggatttaacag

SEQ ID NO: 3206610 - DNA, 18 bp, Homo sapiens
aggatttaacagtcattt

SEQ ID NO: 3206611 - DNA, 14 bp, Homo sapiens
aggatttcaagcct

SEQ ID NO: 3206612 - DNA, 15 bp, Homo sapiens
aggatttcaagcctg

SEQ ID NO: 3206613 - DNA, 18 bp, Homo sapiens
aggatttcaccagaagtt

SEQ ID NO: 3206614 - DNA, 13 bp, Homo sapiens
aggatttcttaaa

SEQ ID NO: 3206615 - DNA, 15 bp, Homo sapiens
aggatttcttaaatt

SEQ ID NO: 3206616 - DNA, 23 bp, Homo sapiens
aggattttaacaaaagcaagact

SEQ ID NO: 3206617 - DNA, 13 bp, Homo sapiens
aggattttaccaa

SEQ ID NO: 3206618 - DNA, 16 bp, Homo sapiens
aggattttaccaaagc

SEQ ID NO: 3206619 - DNA, 18 bp, Homo sapiens
aggattttaccaaagcat

SEQ ID NO: 3206620 - DNA, 13 bp, Homo sapiens
aggattttatacc

SEQ ID NO: 3206621 - DNA, 17 bp, Homo sapiens
aggatttttttctgagc

SEQ ID NO: 3206622 - DNA, 21 bp, Homo sapiens
aggatttttttttttttttga

SEQ ID NO: 3206623 - DNA, 20 bp, Homo sapiens
aggcaaaaaagggacagcat

SEQ ID NO: 3206624 - DNA, 15 bp, Homo sapiens
aggcaaaaatatcag

SEQ ID NO: 3206625 - DNA, 17 bp, Homo sapiens
aggcaaaatccttgctt

SEQ ID NO: 3206626 - DNA, 20 bp, Homo sapiens
aggcaaaattgcaaatcttg

SEQ ID NO: 3206627 - DNA, 21 bp, Homo sapiens
aggcaaacaatcccaatcttt

SEQ ID NO: 3206628 - DNA, 15 bp, Homo sapiens
aggcaacctgattgt

SEQ ID NO: 3206629 - DNA, 19 bp, Homo sapiens
aggcaacctgattgtaaac

SEQ ID NO: 3206630 - DNA, 17 bp, Homo sapiens
aggcaactattaataat

SEQ ID NO: 3206631 - DNA, 19 bp, Homo sapiens
aggcaacttttaaagctca

SEQ ID NO: 3206632 - DNA, 18 bp, Homo sapiens
aggcaagaaaaggacaaa

SEQ ID NO: 3206633 - DNA, 12 bp, Homo sapiens
aggcaagagaat

SEQ ID NO: 3206634 - DNA, 17 bp, Homo sapiens
aggcaagcacctcctgc

SEQ ID NO: 3206635 - DNA, 19 bp, Homo sapiens
aggcaagcacctcctgcct

SEQ ID NO: 3206636 - DNA, 20 bp, Homo sapiens
aggcaagcacctcctgcctc

SEQ ID NO: 3206637 - DNA, 16 bp, Homo sapiens
aggcaagcaggacctg

SEQ ID NO: 3206638 - DNA, 17 bp, Homo sapiens
aggcaagcaggacctgg

SEQ ID NO: 3206639 - DNA, 14 bp, Homo sapiens
aggcaagcccctca

SEQ ID NO: 3206640 - DNA, 15 bp, Homo sapiens
aggcaaggcaggtgc

SEQ ID NO: 3206641 - DNA, 19 bp, Homo sapiens
aggcaaggcaggtgcctcc

SEQ ID NO: 3206642 - DNA, 18 bp, Homo sapiens
aggcaagtttctagctag

SEQ ID NO: 3206643 - DNA, 17 bp, Homo sapiens
aggcaatgctgtacttt

SEQ ID NO: 3206644 - DNA, 21 bp, Homo sapiens
agactatatatataaatgtat

SEQ ID NO: 3206645 - DNA, 19 bp, Homo sapiens
agactatctaaatgttgaa

SEQ ID NO: 3206646 - DNA, 16 bp, Homo sapiens
agactatggagcctgg

SEQ ID NO: 3206647 - DNA, 22 bp, Homo sapiens
agactatggcctcgcctcccca

SEQ ID NO: 3206648 - DNA, 23 bp, Homo sapiens
agactatggcctcgcctccccac

SEQ ID NO: 3206649 - DNA, 17 bp, Homo sapiens
agactatttaaacttat

SEQ ID NO: 3206650 - DNA, 16 bp, Homo sapiens
agactcaaaccacatg

SEQ ID NO: 3206651 - DNA, 16 bp, Homo sapiens
agactcaaatgttcta

SEQ ID NO: 3206652 - DNA, 20 bp, Homo sapiens
agactcaaatgttctaagtt

SEQ ID NO: 3206653 - DNA, 23 bp, Homo sapiens
agactcaaatgttctaagtttct

SEQ ID NO: 3206654 - DNA, 15 bp, Homo sapiens
agactcagctggaag

SEQ ID NO: 3206655 - DNA, 16 bp, Homo sapiens
agactcatcttactgt

SEQ ID NO: 3206656 - DNA, 17 bp, Homo sapiens
agactcatcttactgta

SEQ ID NO: 3206657 - DNA, 18 bp, Homo sapiens
agactcatcttactgtac

SEQ ID NO: 3206658 - DNA, 18 bp, Homo sapiens
agactcattcttctgtac

SEQ ID NO: 3206659 - DNA, 14 bp, Homo sapiens
agactccagaatct

SEQ ID NO: 3206660 - DNA, 16 bp, Homo sapiens
agactccgccctcctc

SEQ ID NO: 3206661 - DNA, 12 bp, Homo sapiens
agactcctctgg

SEQ ID NO: 3206662 - DNA, 13 bp, Homo sapiens
agactcctctggg

SEQ ID NO: 3206663 - DNA, 14 bp, Homo sapiens
agactcctgccctg

SEQ ID NO: 3206664 - DNA, 19 bp, Homo sapiens
agactctacccatattaca

SEQ ID NO: 3206665 - DNA, 15 bp, Homo sapiens
agactctaggttata

SEQ ID NO: 3206666 - DNA, 15 bp, Homo sapiens
agactctagtattta

SEQ ID NO: 3206667 - DNA, 17 bp, Homo sapiens
agactctagtatttatg

SEQ ID NO: 3206668 - DNA, 16 bp, Homo sapiens
agactctcagcccaga

SEQ ID NO: 3206669 - DNA, 17 bp, Homo sapiens
agactctcagcccagaa

SEQ ID NO: 3206670 - DNA, 11 bp, Homo sapiens
agactctgagc

SEQ ID NO: 3206671 - DNA, 17 bp, Homo sapiens
agactctgagctgctca

SEQ ID NO: 3206672 - DNA, 22 bp, Homo sapiens
agactctttaataaattgctta

SEQ ID NO: 3206673 - DNA, 15 bp, Homo sapiens
agactctttgcatat

SEQ ID NO: 3206674 - DNA, 19 bp, Homo sapiens
agactgaacatgtttacag

SEQ ID NO: 3206675 - DNA, 19 bp, Homo sapiens
agactgaggtataaagaca

SEQ ID NO: 3206676 - DNA, 18 bp, Homo sapiens
agactgagtcagatgggt

SEQ ID NO: 3206677 - DNA, 19 bp, Homo sapiens
agactgatccaaaaattat

SEQ ID NO: 3206678 - DNA, 19 bp, Homo sapiens
agactgatgttttagcatt

SEQ ID NO: 3206679 - DNA, 15 bp, Homo sapiens
agactgcaaactttt

SEQ ID NO: 3206680 - DNA, 21 bp, Homo sapiens
agactgcaggttggaccccag

SEQ ID NO: 3206681 - DNA, 23 bp, Homo sapiens
agactgcatcccgtacctcttcc

SEQ ID NO: 3206682 - DNA, 15 bp, Homo sapiens
agactgccttctcca

SEQ ID NO: 3206683 - DNA, 23 bp, Homo sapiens
agactgcgatttgtcccaggtcc

SEQ ID NO: 3206684 - DNA, 22 bp, Homo sapiens
agactgctgggactggccaggt

SEQ ID NO: 3206685 - DNA, 14 bp, Homo sapiens
agactgcttcccat

SEQ ID NO: 3206686 - DNA, 23 bp, Homo sapiens
agactgcttcccatcctaccctc

SEQ ID NO: 3206687 - DNA, 18 bp, Homo sapiens
agactggaagacacttca

SEQ ID NO: 3206688 - DNA, 17 bp, Homo sapiens
agactggaagcacagct

SEQ ID NO: 3206689 - DNA, 21 bp, Homo sapiens
agactggaagctaatttgcat

SEQ ID NO: 3206690 - DNA, 21 bp, Homo sapiens
agactggagtgaggcttccag

SEQ ID NO: 3206691 - DNA, 16 bp, Homo sapiens
agactggcaataaact

SEQ ID NO: 3206692 - DNA, 14 bp, Homo sapiens
agactggcaggcgg

SEQ ID NO: 3206693 - DNA, 15 bp, Homo sapiens
agactggccgggcag

SEQ ID NO: 3206694 - DNA, 18 bp, Homo sapiens
agactggccgggcaggcg

SEQ ID NO: 3206695 - DNA, 19 bp, Homo sapiens
agactggccgggcaggcgt

SEQ ID NO: 3206696 - DNA, 14 bp, Homo sapiens
agactggctggctg

SEQ ID NO: 3206697 - DNA, 20 bp, Homo sapiens
agactggctggctgcagtga

SEQ ID NO: 3206698 - DNA, 20 bp, Homo sapiens
agactgggaccttagaaatc

SEQ ID NO: 3206699 - DNA, 22 bp, Homo sapiens
agactgggagccacttctcccc

SEQ ID NO: 3206700 - DNA, 18 bp, Homo sapiens
agactggggggcttgaaa

SEQ ID NO: 3206701 - DNA, 21 bp, Homo sapiens
agactgggtgaggataacaca

SEQ ID NO: 3206702 - DNA, 22 bp, Homo sapiens
agactggtctcgaactcctggc

SEQ ID NO: 3206703 - DNA, 18 bp, Homo sapiens
agactggttttctgccaa

SEQ ID NO: 3206704 - DNA, 14 bp, Homo sapiens
agactgtaagatgt

SEQ ID NO: 3206705 - DNA, 17 bp, Homo sapiens
agactgtagatatgtat

SEQ ID NO: 3206706 - DNA, 15 bp, Homo sapiens
agactgtgaacttga

SEQ ID NO: 3206707 - DNA, 16 bp, Homo sapiens
agactgtgattcagaa

SEQ ID NO: 3206708 - DNA, 17 bp, Homo sapiens
agactgtgctctctgtg

SEQ ID NO: 3206709 - DNA, 14 bp, Homo sapiens
agactgttgctcaa

SEQ ID NO: 3206710 - DNA, 15 bp, Homo sapiens
agactgttgctcaaa

SEQ ID NO: 3206711 - DNA, 14 bp, Homo sapiens
agactgttgtgatc

SEQ ID NO: 3206712 - DNA, 15 bp, Homo sapiens
agactgttgtgatct

SEQ ID NO: 3206713 - DNA, 19 bp, Homo sapiens
agactgtttttaagtaact

SEQ ID NO: 3206714 - DNA, 22 bp, Homo sapiens
agacttaaaaaatacttgcatg

SEQ ID NO: 3206715 - DNA, 15 bp, Homo sapiens
agacttactctaaga

SEQ ID NO: 3206716 - DNA, 16 bp, Homo sapiens
agacttactctaagat

SEQ ID NO: 3206717 - DNA, 22 bp, Homo sapiens
agacttactgggtgaggaaatc

SEQ ID NO: 3206718 - DNA, 16 bp, Homo sapiens
agacttagggcaccag

SEQ ID NO: 3206719 - DNA, 17 bp, Homo sapiens
agacttagggcaccagg

SEQ ID NO: 3206720 - DNA, 22 bp, Homo sapiens
agacttagtatattttcttttc

SEQ ID NO: 3206721 - DNA, 18 bp, Homo sapiens
agacttcaaaaataaaaa

SEQ ID NO: 3206722 - DNA, 21 bp, Homo sapiens
agacttccaaacctgacagat

SEQ ID NO: 3206723 - DNA, 18 bp, Homo sapiens
agacttcccaacagcctt

SEQ ID NO: 3206724 - DNA, 14 bp, Homo sapiens
agacttcccagcta

SEQ ID NO: 3206725 - DNA, 16 bp, Homo sapiens
agacttccttgagaca

SEQ ID NO: 3206726 - DNA, 16 bp, Homo sapiens
agacttcgactcagga

SEQ ID NO: 3206727 - DNA, 18 bp, Homo sapiens
agacttctgcttttcaac

SEQ ID NO: 3206728 - DNA, 22 bp, Homo sapiens
agacttctggaaggctggctga

SEQ ID NO: 3206729 - DNA, 18 bp, Homo sapiens
agacttctggttgtattt

SEQ ID NO: 3206730 - DNA, 12 bp, Homo sapiens
agacttgaaagt

SEQ ID NO: 3206731 - DNA, 14 bp, Homo sapiens
agacttgaaagttt

SEQ ID NO: 3206732 - DNA, 23 bp, Homo sapiens
agacttgccaacaccacagaaat

SEQ ID NO: 3206733 - DNA, 17 bp, Homo sapiens
agacttggcaacagaag

SEQ ID NO: 3206734 - DNA, 17 bp, Homo sapiens
agactttagaaataaat

SEQ ID NO: 3206735 - DNA, 21 bp, Homo sapiens
agactttagtgccctgccccc

SEQ ID NO: 3206736 - DNA, 18 bp, Homo sapiens
agacttttaatcagacaa

SEQ ID NO: 3206737 - DNA, 23 bp, Homo sapiens
agactttttggtggatgtaaata

SEQ ID NO: 3206738 - DNA, 13 bp, Homo sapiens
agagaaaaaagaa

SEQ ID NO: 3206739 - DNA, 17 bp, Homo sapiens
agagaaaaaagaagtgt

SEQ ID NO: 3206740 - DNA, 16 bp, Homo sapiens
agagaaaaaccaatga

SEQ ID NO: 3206741 - DNA, 17 bp, Homo sapiens
agagaaaaagtgcccct

SEQ ID NO: 3206742 - DNA, 14 bp, Homo sapiens
agagaaaagcaggc

SEQ ID NO: 3206743 - DNA, 18 bp, Homo sapiens
agagaaacaataaagaga

SEQ ID NO: 3206744 - DNA, 21 bp, Homo sapiens
agagaaaccgtcctctttttc

SEQ ID NO: 3206745 - DNA, 19 bp, Homo sapiens
agagaaactttgtgctaca

SEQ ID NO: 3206746 - DNA, 15 bp, Homo sapiens
agagaaagaaaatga

SEQ ID NO: 3206747 - DNA, 12 bp, Homo sapiens
agagaaagagaa

SEQ ID NO: 3206748 - DNA, 14 bp, Homo sapiens
agagaaagagagaa

SEQ ID NO: 3206749 - DNA, 16 bp, Homo sapiens
agagaaagagagaagc

SEQ ID NO: 3206750 - DNA, 20 bp, Homo sapiens
agagaaagagagaagccagc

SEQ ID NO: 3206751 - DNA, 13 bp, Homo sapiens
agagaaagccagg

SEQ ID NO: 3206752 - DNA, 17 bp, Homo sapiens
agagaaagccaggcagg

SEQ ID NO: 3206753 - DNA, 19 bp, Homo sapiens
agagaaagccaggcaggta

SEQ ID NO: 3206754 - DNA, 19 bp, Homo sapiens
agagaaaggcctgcacaca

SEQ ID NO: 3206755 - DNA, 14 bp, Homo sapiens
agagaaatcacagg

SEQ ID NO: 3206756 - DNA, 13 bp, Homo sapiens
agagaaattctgt

SEQ ID NO: 3206757 - DNA, 21 bp, Homo sapiens
agagaaccgagcaaagatcaa

SEQ ID NO: 3206758 - DNA, 18 bp, Homo sapiens
agagaactactaaggaaa

SEQ ID NO: 3206759 - DNA, 16 bp, Homo sapiens
agagaagagggcccag

SEQ ID NO: 3206760 - DNA, 20 bp, Homo sapiens
agagaagagggcccagccca

SEQ ID NO: 3206761 - DNA, 21 bp, Homo sapiens
agagaagagggcccagcccag

SEQ ID NO: 3206762 - DNA, 15 bp, Homo sapiens
agagaagataattgt

SEQ ID NO: 3206763 - DNA, 13 bp, Homo sapiens
agagaagcaattt

SEQ ID NO: 3206764 - DNA, 17 bp, Homo sapiens
agagaagcatcctccac

SEQ ID NO: 3206765 - DNA, 17 bp, Homo sapiens
agagaagccacgctgtc

SEQ ID NO: 3206766 - DNA, 20 bp, Homo sapiens
agagaagccacgctgtcctc

SEQ ID NO: 3206767 - DNA, 13 bp, Homo sapiens
agagaagccagcc

SEQ ID NO: 3206768 - DNA, 13 bp, Homo sapiens
agagaagctggac

SEQ ID NO: 3206769 - DNA, 14 bp, Homo sapiens
agagaagctggact

SEQ ID NO: 3206770 - DNA, 21 bp, Homo sapiens
agagaagctggacttctgtgg

SEQ ID NO: 3206771 - DNA, 23 bp, Homo sapiens
agagaagctggacttctgtgggc

SEQ ID NO: 3206772 - DNA, 16 bp, Homo sapiens
agagaaggaaaagact

SEQ ID NO: 3206773 - DNA, 18 bp, Homo sapiens
agagaaggcctccctagc

SEQ ID NO: 3206774 - DNA, 20 bp, Homo sapiens
agagaaggcctcttgtgctc

SEQ ID NO: 3206775 - DNA, 15 bp, Homo sapiens
agagaagtctcattc

SEQ ID NO: 3206776 - DNA, 14 bp, Homo sapiens
agagaagttctcaa

SEQ ID NO: 3206777 - DNA, 18 bp, Homo sapiens
agagaatatatttttgat

SEQ ID NO: 3206778 - DNA, 14 bp, Homo sapiens
agagaatggagaca

SEQ ID NO: 3206779 - DNA, 17 bp, Homo sapiens
agagaatggctgggtca

SEQ ID NO: 3206780 - DNA, 15 bp, Homo sapiens
agagaattggctcaa

SEQ ID NO: 3206781 - DNA, 19 bp, Homo sapiens
agagacaaacacctcccag

SEQ ID NO: 3206782 - DNA, 20 bp, Homo sapiens
agagacaaacacctcccagg

SEQ ID NO: 3206783 - DNA, 21 bp, Homo sapiens
agagacaaacacctcccagga

SEQ ID NO: 3206784 - DNA, 13 bp, Homo sapiens
agagacaaatctt

SEQ ID NO: 3206785 - DNA, 14 bp, Homo sapiens
agagacaagtaatt

SEQ ID NO: 3206786 - DNA, 15 bp, Homo sapiens
agagacaagtaattt

SEQ ID NO: 3206787 - DNA, 18 bp, Homo sapiens
agagacagcccaggatac

SEQ ID NO: 3206788 - DNA, 20 bp, Homo sapiens
agagacaggcccaagagatg

SEQ ID NO: 3206789 - DNA, 22 bp, Homo sapiens
agagacagttatttatagtcat

SEQ ID NO: 3206790 - DNA, 12 bp, Homo sapiens
agagacattcct

SEQ ID NO: 3206791 - DNA, 13 bp, Homo sapiens
agagacccccagg

SEQ ID NO: 3206792 - DNA, 19 bp, Homo sapiens
agagaccctctgccaccag

SEQ ID NO: 3206793 - DNA, 21 bp, Homo sapiens
agagaccctctgccaccagag

SEQ ID NO: 3206794 - DNA, 23 bp, Homo sapiens
agagaccctctgccaccagagac

SEQ ID NO: 3206795 - DNA, 22 bp, Homo sapiens
agagaccgtcctcacccctgtc

SEQ ID NO: 3206796 - DNA, 18 bp, Homo sapiens
agagacctacctcaggtt

SEQ ID NO: 3206797 - DNA, 13 bp, Homo sapiens
agagacctcatca

SEQ ID NO: 3206798 - DNA, 16 bp, Homo sapiens
agagacctcatcagga

SEQ ID NO: 3206799 - DNA, 15 bp, Homo sapiens
agagacctgaagtgt

SEQ ID NO: 3206800 - DNA, 20 bp, Homo sapiens
agagactcagcgctcctcct

SEQ ID NO: 3206801 - DNA, 16 bp, Homo sapiens
agagactgaaagcagc

SEQ ID NO: 3206802 - DNA, 19 bp, Homo sapiens
agagactgaaagcagcagc

SEQ ID NO: 3206803 - DNA, 22 bp, Homo sapiens
agagactgaatagatatgaaag

SEQ ID NO: 3206804 - DNA, 15 bp, Homo sapiens
agagactgagcagcc

SEQ ID NO: 3206805 - DNA, 21 bp, Homo sapiens
agagactgatccaaaaattat

SEQ ID NO: 3206806 - DNA, 13 bp, Homo sapiens
agagactgtagat

SEQ ID NO: 3206807 - DNA, 19 bp, Homo sapiens
agagacttgtgctcaagga

SEQ ID NO: 3206808 - DNA, 17 bp, Homo sapiens
agagacttttaatcaga

SEQ ID NO: 3206809 - DNA, 19 bp, Homo sapiens
agagacttttaatcagaca

SEQ ID NO: 3206810 - DNA, 12 bp, Homo sapiens
agagagaaaaag

SEQ ID NO: 3206811 - DNA, 13 bp, Homo sapiens
agagagaaattct

SEQ ID NO: 3206812 - DNA, 15 bp, Homo sapiens
agagagacaggcagc

SEQ ID NO: 3206813 - DNA, 16 bp, Homo sapiens
agagagacatggaaaa

SEQ ID NO: 3206814 - DNA, 17 bp, Homo sapiens
agagagaccccgcaccc

SEQ ID NO: 3206815 - DNA, 14 bp, Homo sapiens
agagagatgttttg

SEQ ID NO: 3206816 - DNA, 13 bp, Homo sapiens
agagagccatttt

SEQ ID NO: 3206817 - DNA, 15 bp, Homo sapiens
agagagccattttgt

SEQ ID NO: 3206818 - DNA, 12 bp, Homo sapiens
agagagctggta

SEQ ID NO: 3206819 - DNA, 23 bp, Homo sapiens
agagagctggtagttagtagcat

SEQ ID NO: 3206820 - DNA, 14 bp, Homo sapiens
agagaggagccaga

SEQ ID NO: 3206821 - DNA, 18 bp, Homo sapiens
agagaggaggcagccccc

SEQ ID NO: 3206822 - DNA, 20 bp, Homo sapiens
agagaggaggcagccccctc

SEQ ID NO: 3206823 - DNA, 16 bp, Homo sapiens
agagaggcagagagcg

SEQ ID NO: 3206824 - DNA, 16 bp, Homo sapiens
agagagggatgggttc

SEQ ID NO: 3206825 - DNA, 20 bp, Homo sapiens
agagagggccatgcaattca

SEQ ID NO: 3206826 - DNA, 12 bp, Homo sapiens
agagagggccca

SEQ ID NO: 3206827 - DNA, 22 bp, Homo sapiens
agagaggggaataatagaagaa

SEQ ID NO: 3206828 - DNA, 15 bp, Homo sapiens
agagagtcccactgc

SEQ ID NO: 3206829 - DNA, 21 bp, Homo sapiens
agagagtcccactgcctcagg

SEQ ID NO: 3206830 - DNA, 15 bp, Homo sapiens
agagagtgtacatca

SEQ ID NO: 3206831 - DNA, 13 bp, Homo sapiens
agagatacagagg

SEQ ID NO: 3206832 - DNA, 20 bp, Homo sapiens
agagataccaagatgccatc

SEQ ID NO: 3206833 - DNA, 22 bp, Homo sapiens
agagataccaagatgccatctg

SEQ ID NO: 3206834 - DNA, 13 bp, Homo sapiens
agagatatatata

SEQ ID NO: 3206835 - DNA, 16 bp, Homo sapiens
agagatattgatattg

SEQ ID NO: 3206836 - DNA, 19 bp, Homo sapiens
agagatgaagagtgagagg

SEQ ID NO: 3206837 - DNA, 13 bp, Homo sapiens
agagatgcattca

SEQ ID NO: 3206838 - DNA, 23 bp, Homo sapiens
agagatgctgtaacttaaaatag

SEQ ID NO: 3206839 - DNA, 22 bp, Homo sapiens
agagatggacagttcacaccct

SEQ ID NO: 3206840 - DNA, 19 bp, Homo sapiens
agagattagaacatttaat

SEQ ID NO: 3206841 - DNA, 21 bp, Homo sapiens
agagatttatataaatgtaaa

SEQ ID NO: 3206842 - DNA, 23 bp, Homo sapiens
agagatttatataaatgtaaaaa

SEQ ID NO: 3206843 - DNA, 14 bp, Homo sapiens
agagatttatcttt

SEQ ID NO: 3206844 - DNA, 16 bp, Homo sapiens
agagatttcaacatat

SEQ ID NO: 3206845 - DNA, 21 bp, Homo sapiens
agagatttcaacatatcattt

SEQ ID NO: 3206846 - DNA, 13 bp, Homo sapiens
agagatttctcat

SEQ ID NO: 3206847 - DNA, 17 bp, Homo sapiens
agagatttgtctaattg

SEQ ID NO: 3206848 - DNA, 18 bp, Homo sapiens
agagcaaaataattttaa

SEQ ID NO: 3206849 - DNA, 12 bp, Homo sapiens
agagcaagaagg

SEQ ID NO: 3206850 - DNA, 13 bp, Homo sapiens
agagcaagaagga

SEQ ID NO: 3206851 - DNA, 15 bp, Homo sapiens
agagcaagaaggaaa

SEQ ID NO: 3206852 - DNA, 21 bp, Homo sapiens
agagcaatgcccgtaatgctt

SEQ ID NO: 3206853 - DNA, 17 bp, Homo sapiens
agagcacaaacattttt

SEQ ID NO: 3206854 - DNA, 19 bp, Homo sapiens
agagcacctagtccagtga

SEQ ID NO: 3206855 - DNA, 20 bp, Homo sapiens
agagcacctttgcacaggat

SEQ ID NO: 3206856 - DNA, 20 bp, Homo sapiens
agagcactgggttgcagggg

SEQ ID NO: 3206857 - DNA, 21 bp, Homo sapiens
agagcactgggttgcagggga

SEQ ID NO: 3206858 - DNA, 20 bp, Homo sapiens
agagcagaacagatctttta

SEQ ID NO: 3206859 - DNA, 23 bp, Homo sapiens
agagcagaacggagccccaggcc

SEQ ID NO: 3206860 - DNA, 18 bp, Homo sapiens
agagcagagcaaatgagg

SEQ ID NO: 3206861 - DNA, 12 bp, Homo sapiens
agagcagaggtc

SEQ ID NO: 3206862 - DNA, 14 bp, Homo sapiens
agagcagagtctgg

SEQ ID NO: 3206863 - DNA, 15 bp, Homo sapiens
agagcagatgcagag

SEQ ID NO: 3206864 - DNA, 11 bp, Homo sapiens
agagcagcctg

SEQ ID NO: 3206865 - DNA, 17 bp, Homo sapiens
agagcagcctgtggcat

SEQ ID NO: 3206866 - DNA, 18 bp, Homo sapiens
agagcaggaagcattcag

SEQ ID NO: 3206867 - DNA, 20 bp, Homo sapiens
agagcaggaagcattcagag

SEQ ID NO: 3206868 - DNA, 13 bp, Homo sapiens
agagcaggacctc

SEQ ID NO: 3206869 - DNA, 20 bp, Homo sapiens
agagcaggactccaggccca

SEQ ID NO: 3206870 - DNA, 22 bp, Homo sapiens
agagcaggactccaggcccaag

SEQ ID NO: 3206871 - DNA, 18 bp, Homo sapiens
agagcaggcacatggagg

SEQ ID NO: 3206872 - DNA, 19 bp, Homo sapiens
agagcaggcacatggagga

SEQ ID NO: 3206873 - DNA, 17 bp, Homo sapiens
agagcaggctggcagct

SEQ ID NO: 3206874 - DNA, 17 bp, Homo sapiens
agagcagtctaaacaga

SEQ ID NO: 3206875 - DNA, 12 bp, Homo sapiens
agagcatatttg

SEQ ID NO: 3206876 - DNA, 18 bp, Homo sapiens
agagcatggatgcatttc

SEQ ID NO: 3206877 - DNA, 21 bp, Homo sapiens
agagcatgtgtcagagtgttg

SEQ ID NO: 3206878 - DNA, 20 bp, Homo sapiens
agagcatttccaacaccaca

SEQ ID NO: 3206879 - DNA, 16 bp, Homo sapiens
agagccaacctcggct

SEQ ID NO: 3206880 - DNA, 21 bp, Homo sapiens
agagccaacctcggcttgtgg

SEQ ID NO: 3206881 - DNA, 16 bp, Homo sapiens
agagccactctatgag

SEQ ID NO: 3206882 - DNA, 16 bp, Homo sapiens
agagccagcctgggac

SEQ ID NO: 3206883 - DNA, 16 bp, Homo sapiens
agagccatgaagcatt

SEQ ID NO: 3206884 - DNA, 15 bp, Homo sapiens
agagccatgggcctg

SEQ ID NO: 3206885 - DNA, 19 bp, Homo sapiens
agagccatgggcctgggcc

SEQ ID NO: 3206886 - DNA, 20 bp, Homo sapiens
agagccatgggcctgggcct

SEQ ID NO: 3206887 - DNA, 16 bp, Homo sapiens
agagccattttgtgaa

SEQ ID NO: 3206888 - DNA, 16 bp, Homo sapiens
agagcccagaggtaac

SEQ ID NO: 3206889 - DNA, 20 bp, Homo sapiens
agagcccagaggtaacagaa

SEQ ID NO: 3206890 - DNA, 15 bp, Homo sapiens
agagcccccaccttg

SEQ ID NO: 3206891 - DNA, 12 bp, Homo sapiens
agagcccccagg

SEQ ID NO: 3206892 - DNA, 13 bp, Homo sapiens
agagcccccagga

SEQ ID NO: 3206893 - DNA, 23 bp, Homo sapiens
agagcccctcctccagcccctgt

SEQ ID NO: 3206894 - DNA, 15 bp, Homo sapiens
agagcccctggggcc

SEQ ID NO: 3206895 - DNA, 19 bp, Homo sapiens
agagcccctggggcctaga

SEQ ID NO: 3206896 - DNA, 20 bp, Homo sapiens
agagccctcaactattctgt

SEQ ID NO: 3206897 - DNA, 14 bp, Homo sapiens
agagccctgaggcc

SEQ ID NO: 3206898 - DNA, 18 bp, Homo sapiens
agagccctgaggcctaga

SEQ ID NO: 3206899 - DNA, 13 bp, Homo sapiens
agagccctgctgt

SEQ ID NO: 3206900 - DNA, 19 bp, Homo sapiens
agagccctggccagccctt

SEQ ID NO: 3206901 - DNA, 21 bp, Homo sapiens
agagccctggccagcccttcc

SEQ ID NO: 3206902 - DNA, 13 bp, Homo sapiens
agatcacagcctc

SEQ ID NO: 3206903 - DNA, 15 bp, Homo sapiens
agatcacagcctcca

SEQ ID NO: 3206904 - DNA, 16 bp, Homo sapiens
agatcacagcctccag

SEQ ID NO: 3206905 - DNA, 17 bp, Homo sapiens
agatcacagcctccagg

SEQ ID NO: 3206906 - DNA, 14 bp, Homo sapiens
agatcaccagcccg

SEQ ID NO: 3206907 - DNA, 22 bp, Homo sapiens
agatcacgccactgcactccag

SEQ ID NO: 3206908 - DNA, 15 bp, Homo sapiens
agatcacgctccccg

SEQ ID NO: 3206909 - DNA, 22 bp, Homo sapiens
agatcacgctccccgcctgttc

SEQ ID NO: 3206910 - DNA, 14 bp, Homo sapiens
agatcactgccaca

SEQ ID NO: 3206911 - DNA, 14 bp, Homo sapiens
agatcactgtgctt

SEQ ID NO: 3206912 - DNA, 14 bp, Homo sapiens
agatcagaacattc

SEQ ID NO: 3206913 - DNA, 17 bp, Homo sapiens
agatcagaacattcagc

SEQ ID NO: 3206914 - DNA, 18 bp, Homo sapiens
agatcagaacattcagct

SEQ ID NO: 3206915 - DNA, 18 bp, Homo sapiens
agatcagatgctccaaga

SEQ ID NO: 3206916 - DNA, 23 bp, Homo sapiens
agatcagatgctccaagattcta

SEQ ID NO: 3206917 - DNA, 21 bp, Homo sapiens
agatcagtgtaccatttgcct

SEQ ID NO: 3206918 - DNA, 18 bp, Homo sapiens
agatccacacacagagga

SEQ ID NO: 3206919 - DNA, 13 bp, Homo sapiens
agatccaccccct

SEQ ID NO: 3206920 - DNA, 13 bp, Homo sapiens
agatccagactgt

SEQ ID NO: 3206921 - DNA, 20 bp, Homo sapiens
agatccagatccagactgta

SEQ ID NO: 3206922 - DNA, 18 bp, Homo sapiens
agatccatttccattgct

SEQ ID NO: 3206923 - DNA, 20 bp, Homo sapiens
agatccatttgcctttctgg

SEQ ID NO: 3206924 - DNA, 15 bp, Homo sapiens
agatcccactggaag

SEQ ID NO: 3206925 - DNA, 23 bp, Homo sapiens
agatcccactggaagatcccctc

SEQ ID NO: 3206926 - DNA, 14 bp, Homo sapiens
agatcctaagggtc

SEQ ID NO: 3206927 - DNA, 21 bp, Homo sapiens
agatcctaagggtcgaaagct

SEQ ID NO: 3206928 - DNA, 17 bp, Homo sapiens
agatcctgcgggtgggg

SEQ ID NO: 3206929 - DNA, 12 bp, Homo sapiens
agatccttcaca

SEQ ID NO: 3206930 - DNA, 16 bp, Homo sapiens
agatccttcacaggca

SEQ ID NO: 3206931 - DNA, 17 bp, Homo sapiens
agatccttcacaggcag

SEQ ID NO: 3206932 - DNA, 17 bp, Homo sapiens
agatcctttcaaaagaa

SEQ ID NO: 3206933 - DNA, 21 bp, Homo sapiens
agatcgagaccatcctggcta

SEQ ID NO: 3206934 - DNA, 15 bp, Homo sapiens
agatcgcagtttgcc

SEQ ID NO: 3206935 - DNA, 17 bp, Homo sapiens
agatcgctcactgttgt

SEQ ID NO: 3206936 - DNA, 17 bp, Homo sapiens
agatcgttagtatctaa

SEQ ID NO: 3206937 - DNA, 20 bp, Homo sapiens
agatctaagcctttccataa

SEQ ID NO: 3206938 - DNA, 16 bp, Homo sapiens
agatctacaggacaaa

SEQ ID NO: 3206939 - DNA, 13 bp, Homo sapiens
agatctgcatctg

SEQ ID NO: 3206940 - DNA, 14 bp, Homo sapiens
agatctgcctgggc

SEQ ID NO: 3206941 - DNA, 24 bp, Homo sapiens
agatctgcctgggcctgtgcagca

SEQ ID NO: 3206942 - DNA, 15 bp, Homo sapiens
agatctggttttgct

SEQ ID NO: 3206943 - DNA, 17 bp, Homo sapiens
agatctggttttgctat

SEQ ID NO: 3206944 - DNA, 20 bp, Homo sapiens
agatctgtgccatagaacaa

SEQ ID NO: 3206945 - DNA, 21 bp, Homo sapiens
agatctgttttgaaggcaaaa

SEQ ID NO: 3206946 - DNA, 23 bp, Homo sapiens
agatctgttttgtggtttggaat

SEQ ID NO: 3206947 - DNA, 14 bp, Homo sapiens
agatcttagattct

SEQ ID NO: 3206948 - DNA, 13 bp, Homo sapiens
agagtggctcctc

SEQ ID NO: 3206949 - DNA, 19 bp, Homo sapiens
agagtggctcctcccggtg

SEQ ID NO: 3206950 - DNA, 23 bp, Homo sapiens
agagtggctcctcccggtgccca

SEQ ID NO: 3206951 - DNA, 18 bp, Homo sapiens
agagtgggggagagcagg

SEQ ID NO: 3206952 - DNA, 16 bp, Homo sapiens
agagtggttgttgcca

SEQ ID NO: 3206953 - DNA, 12 bp, Homo sapiens
agagtgtagaag

SEQ ID NO: 3206954 - DNA, 14 bp, Homo sapiens
agagtgtagaagca

SEQ ID NO: 3206955 - DNA, 16 bp, Homo sapiens
agagtgtagaagcatt

SEQ ID NO: 3206956 - DNA, 22 bp, Homo sapiens
agagtgtagaagcattccttct

SEQ ID NO: 3206957 - DNA, 18 bp, Homo sapiens
agagtgtagactgtggct

SEQ ID NO: 3206958 - DNA, 22 bp, Homo sapiens
agagtgtagcctaaagggcagg

SEQ ID NO: 3206959 - DNA, 20 bp, Homo sapiens
agagtgtagctgtaagggca

SEQ ID NO: 3206960 - DNA, 23 bp, Homo sapiens
agagtgtagctgtaagggcagtg

SEQ ID NO: 3206961 - DNA, 12 bp, Homo sapiens
agagttaagaag

SEQ ID NO: 3206962 - DNA, 15 bp, Homo sapiens
agagttaagaagctg

SEQ ID NO: 3206963 - DNA, 17 bp, Homo sapiens
agagttaagaagctgtt

SEQ ID NO: 3206964 - DNA, 20 bp, Homo sapiens
agagttaagaagctgttgta

SEQ ID NO: 3206965 - DNA, 21 bp, Homo sapiens
agagttaagaagctgttgtac

SEQ ID NO: 3206966 - DNA, 13 bp, Homo sapiens
agagttaagaatg

SEQ ID NO: 3206967 - DNA, 14 bp, Homo sapiens
agagttaagaatgt

SEQ ID NO: 3206968 - DNA, 11 bp, Homo sapiens
agagttacagt

SEQ ID NO: 3206969 - DNA, 22 bp, Homo sapiens
agagttacagttctgtggtttc

SEQ ID NO: 3206970 - DNA, 19 bp, Homo sapiens
agagttattgaatcttaat

SEQ ID NO: 3206971 - DNA, 13 bp, Homo sapiens
agagttcacagga

SEQ ID NO: 3206972 - DNA, 15 bp, Homo sapiens
agagttcacaggagg

SEQ ID NO: 3206973 - DNA, 22 bp, Homo sapiens
agagttgggtgtctccttaagc

SEQ ID NO: 3206974 - DNA, 22 bp, Homo sapiens
agagtttaacacaagtcctgtg

SEQ ID NO: 3206975 - DNA, 16 bp, Homo sapiens
agagtttactgatgaa

SEQ ID NO: 3206976 - DNA, 17 bp, Homo sapiens
agagtttgtgtgtattt

SEQ ID NO: 3206977 - DNA, 23 bp, Homo sapiens
agagtttgtgtgtatttgtatta

SEQ ID NO: 3206978 - DNA, 22 bp, Homo sapiens
agagtttgttctgttctggggg

SEQ ID NO: 3206979 - DNA, 16 bp, Homo sapiens
agagttttagagaaaa

SEQ ID NO: 3206980 - DNA, 16 bp, Homo sapiens
agagttttgtcttgaa

SEQ ID NO: 3206981 - DNA, 19 bp, Homo sapiens
agagttttgtcttgaatgt

SEQ ID NO: 3206982 - DNA, 21 bp, Homo sapiens
agataaaaacctgaactttca

SEQ ID NO: 3206983 - DNA, 14 bp, Homo sapiens
agataaaaagatgg

SEQ ID NO: 3206984 - DNA, 21 bp, Homo sapiens
agataaaaagatggcctttgc

SEQ ID NO: 3206985 - DNA, 19 bp, Homo sapiens
agataaaccgtttttaaca

SEQ ID NO: 3206986 - DNA, 17 bp, Homo sapiens
agataaagaccagaaat

SEQ ID NO: 3206987 - DNA, 13 bp, Homo sapiens
agagccctggctg

SEQ ID NO: 3206988 - DNA, 14 bp, Homo sapiens
agagccctggctgg

SEQ ID NO: 3206989 - DNA, 15 bp, Homo sapiens
agagccctgtggccg

SEQ ID NO: 3206990 - DNA, 20 bp, Homo sapiens
agagccctgtggccgactct

SEQ ID NO: 3206991 - DNA, 22 bp, Homo sapiens
agagccctgtggccgactctgc

SEQ ID NO: 3206992 - DNA, 15 bp, Homo sapiens
agagcccttcactgc

SEQ ID NO: 3206993 - DNA, 19 bp, Homo sapiens
agagcccttcactgccatg

SEQ ID NO: 3206994 - DNA, 15 bp, Homo sapiens
agagcccttcatttg

SEQ ID NO: 3206995 - DNA, 16 bp, Homo sapiens
agagccgggaagcgat

SEQ ID NO: 3206996 - DNA, 20 bp, Homo sapiens
agagcctgatctcttcctgt

SEQ ID NO: 3206997 - DNA, 21 bp, Homo sapiens
agagcctgcctaaccaggccc

SEQ ID NO: 3206998 - DNA, 11 bp, Homo sapiens
agagcctgctg

SEQ ID NO: 3206999 - DNA, 19 bp, Homo sapiens
agagcctgctggcacccac

SEQ ID NO: 3207000 - DNA, 15 bp, Homo sapiens
agagccttcaagtgc

SEQ ID NO: 3207001 - DNA, 14 bp, Homo sapiens
agagccttcagaat

SEQ ID NO: 3207002 - DNA, 20 bp, Homo sapiens
agagccttccacagtgaatg

SEQ ID NO: 3207003 - DNA, 17 bp, Homo sapiens
agagcgagagtctgtct

SEQ ID NO: 3207004 - DNA, 21 bp, Homo sapiens
agagcgaggaaaggattttac

SEQ ID NO: 3207005 - DNA, 12 bp, Homo sapiens
agagcgaggctg

SEQ ID NO: 3207006 - DNA, 22 bp, Homo sapiens
agagcgccgtgagttctcaggg

SEQ ID NO: 3207007 - DNA, 15 bp, Homo sapiens
agagcgcggctggct

SEQ ID NO: 3207008 - DNA, 18 bp, Homo sapiens
agagcgcggctggctctg

SEQ ID NO: 3207009 - DNA, 20 bp, Homo sapiens
agagcgtggctgtgctctca

SEQ ID NO: 3207010 - DNA, 22 bp, Homo sapiens
agagctaagggtgggtgctcag

SEQ ID NO: 3207011 - DNA, 15 bp, Homo sapiens
agagctctccagctc

SEQ ID NO: 3207012 - DNA, 16 bp, Homo sapiens
agagctctccagctcc

SEQ ID NO: 3207013 - DNA, 15 bp, Homo sapiens
agagctcttaatgtt

SEQ ID NO: 3207014 - DNA, 19 bp, Homo sapiens
agagctcttcaagctgtcc

SEQ ID NO: 3207015 - DNA, 22 bp, Homo sapiens
agagctcttcaagctgtcccct

SEQ ID NO: 3207016 - DNA, 23 bp, Homo sapiens
agagctgacccagagtggagtct

SEQ ID NO: 3207017 - DNA, 21 bp, Homo sapiens
agagctgagccagttgtccta

SEQ ID NO: 3207018 - DNA, 20 bp, Homo sapiens
agagctgattgcagaaagga

SEQ ID NO: 3207019 - DNA, 15 bp, Homo sapiens
agagctgcctggatg

SEQ ID NO: 3207020 - DNA, 16 bp, Homo sapiens
agagctgcctggatga

SEQ ID NO: 3207021 - DNA, 17 bp, Homo sapiens
agagctggaaggcaggg

SEQ ID NO: 3207022 - DNA, 20 bp, Homo sapiens
agagctggaaggcagggcag

SEQ ID NO: 3207023 - DNA, 12 bp, Homo sapiens
agagctggctct

SEQ ID NO: 3207024 - DNA, 15 bp, Homo sapiens
agagctggctctgag

SEQ ID NO: 3207025 - DNA, 21 bp, Homo sapiens
agagctggtagttagtagcat

SEQ ID NO: 3207026 - DNA, 13 bp, Homo sapiens
agagctggtgccc

SEQ ID NO: 3207027 - DNA, 11 bp, Homo sapiens
agagctggtgt

SEQ ID NO: 3207028 - DNA, 17 bp, Homo sapiens
agagctggtgtctgatt

SEQ ID NO: 3207029 - DNA, 13 bp, Homo sapiens
agagctgtgccag

SEQ ID NO: 3207030 - DNA, 20 bp, Homo sapiens
agagctgtttatggcctcag

SEQ ID NO: 3207031 - DNA, 18 bp, Homo sapiens
agagcttagcctggagca

SEQ ID NO: 3207032 - DNA, 15 bp, Homo sapiens
agagcttctggcact

SEQ ID NO: 3207033 - DNA, 16 bp, Homo sapiens
agagcttgtaataaat

SEQ ID NO: 3207034 - DNA, 16 bp, Homo sapiens
agagcttttaaaaatg

SEQ ID NO: 3207035 - DNA, 19 bp, Homo sapiens
agaggaaaagtaaggtgca

SEQ ID NO: 3207036 - DNA, 21 bp, Homo sapiens
agaggaaaagtaaggtgcagt

SEQ ID NO: 3207037 - DNA, 12 bp, Homo sapiens
agaggaactgtc

SEQ ID NO: 3207038 - DNA, 18 bp, Homo sapiens
agaggaactgtccagaga

SEQ ID NO: 3207039 - DNA, 11 bp, Homo sapiens
agaggaagaaa

SEQ ID NO: 3207040 - DNA, 14 bp, Homo sapiens
agaggaagaaatgt

SEQ ID NO: 3207041 - DNA, 13 bp, Homo sapiens
agaggaagagcag

SEQ ID NO: 3207042 - DNA, 21 bp, Homo sapiens
agaggaatcctggcagcccag

SEQ ID NO: 3207043 - DNA, 14 bp, Homo sapiens
agaggaattatgaa

SEQ ID NO: 3207044 - DNA, 18 bp, Homo sapiens
agaggactcccaaccctg

SEQ ID NO: 3207045 - DNA, 14 bp, Homo sapiens
agaggacttttctt

SEQ ID NO: 3207046 - DNA, 21 bp, Homo sapiens
agaggacttttctttgtggct

SEQ ID NO: 3207047 - DNA, 16 bp, Homo sapiens
agaggagaccctggaa

SEQ ID NO: 3207048 - DNA, 12 bp, Homo sapiens
agaggagagagg

SEQ ID NO: 3207049 - DNA, 13 bp, Homo sapiens
agaggagagaggc

SEQ ID NO: 3207050 - DNA, 15 bp, Homo sapiens
agaggagagaggcag

SEQ ID NO: 3207051 - DNA, 16 bp, Homo sapiens
agaggagaggagagag

SEQ ID NO: 3207052 - DNA, 17 bp, Homo sapiens
agaggagaggagagagg

SEQ ID NO: 3207053 - DNA, 14 bp, Homo sapiens
agaggagcacctga

SEQ ID NO: 3207054 - DNA, 15 bp, Homo sapiens
agaggagccctcatc

SEQ ID NO: 3207055 - DNA, 13 bp, Homo sapiens
agaggaggcagcc

SEQ ID NO: 3207056 - DNA, 21 bp, Homo sapiens
agaggaggcagccccctccac

SEQ ID NO: 3207057 - DNA, 17 bp, Homo sapiens
agaggagggatgctgcc

SEQ ID NO: 3207058 - DNA, 20 bp, Homo sapiens
agaggatgaatgtatgtgca

SEQ ID NO: 3207059 - DNA, 21 bp, Homo sapiens
agaggatgaatgtatgtgcac

SEQ ID NO: 3207060 - DNA, 13 bp, Homo sapiens
agaggatgtgcaa

SEQ ID NO: 3207061 - DNA, 21 bp, Homo sapiens
agaggatttttttctgagcga

SEQ ID NO: 3207062 - DNA, 13 bp, Homo sapiens
agaggcagagagc

SEQ ID NO: 3207063 - DNA, 13 bp, Homo sapiens
agaggcagcccca

SEQ ID NO: 3207064 - DNA, 22 bp, Homo sapiens
agaggcagccccattctgcctg

SEQ ID NO: 3207065 - DNA, 21 bp, Homo sapiens
agaggcagcctctgcactccc

SEQ ID NO: 3207066 - DNA, 10 bp, Homo sapiens
agaggcaggc

SEQ ID NO: 3207067 - DNA, 21 bp, Homo sapiens
agaggcagggtctcactctgt

SEQ ID NO: 3207068 - DNA, 15 bp, Homo sapiens
agaggcatcctgcct

SEQ ID NO: 3207069 - DNA, 15 bp, Homo sapiens
agaggcattgttagt

SEQ ID NO: 3207070 - DNA, 18 bp, Homo sapiens
agaggccaaaggctggtg

SEQ ID NO: 3207071 - DNA, 13 bp, Homo sapiens
agaggccaatgcc

SEQ ID NO: 3207072 - DNA, 13 bp, Homo sapiens
agaggccagaggc

SEQ ID NO: 3207073 - DNA, 20 bp, Homo sapiens
agaggcccccagcccagggc

SEQ ID NO: 3207074 - DNA, 22 bp, Homo sapiens
agaggcccccagcccagggctc

SEQ ID NO: 3207075 - DNA, 16 bp, Homo sapiens
agaggccctggaggtc

SEQ ID NO: 3207076 - DNA, 22 bp, Homo sapiens
agaggccctggaggtctccagg

SEQ ID NO: 3207077 - DNA, 20 bp, Homo sapiens
agaggccgaaggtgcctcag

SEQ ID NO: 3207078 - DNA, 23 bp, Homo sapiens
agaggccgaaggtgcctcagact

SEQ ID NO: 3207079 - DNA, 23 bp, Homo sapiens
agaggcctgctgccagtgcagcc

SEQ ID NO: 3207080 - DNA, 23 bp, Homo sapiens
agaggcctggggccggtagaggc

SEQ ID NO: 3207081 - DNA, 19 bp, Homo sapiens
agaggccttttggaatgtg

SEQ ID NO: 3207082 - DNA, 12 bp, Homo sapiens
agaggcggcctc

SEQ ID NO: 3207083 - DNA, 17 bp, Homo sapiens
agaggcgggccagccag

SEQ ID NO: 3207084 - DNA, 19 bp, Homo sapiens
agaggcgggccagccaggc

SEQ ID NO: 3207085 - DNA, 20 bp, Homo sapiens
agaggcgggccagccaggcg

SEQ ID NO: 3207086 - DNA, 16 bp, Homo sapiens
agaggctagcttctgc

SEQ ID NO: 3207087 - DNA, 19 bp, Homo sapiens
agaggctattattttcact

SEQ ID NO: 3207088 - DNA, 18 bp, Homo sapiens
agaggctccccagggctc

SEQ ID NO: 3207089 - DNA, 13 bp, Homo sapiens
agaggctgaaaga

SEQ ID NO: 3207090 - DNA, 18 bp, Homo sapiens
agaggctgaggcctggac

SEQ ID NO: 3207091 - DNA, 22 bp, Homo sapiens
agaggctgcctctcccatcact

SEQ ID NO: 3207092 - DNA, 13 bp, Homo sapiens
agaggctgggagc

SEQ ID NO: 3207093 - DNA, 15 bp, Homo sapiens
agaggctgtctgggg

SEQ ID NO: 3207094 - DNA, 20 bp, Homo sapiens
agaggcttctccgccagcct

SEQ ID NO: 3207095 - DNA, 22 bp, Homo sapiens
agaggcttctccgccagcctcc

SEQ ID NO: 3207096 - DNA, 21 bp, Homo sapiens
agagggaaaatgtgaaatctc

SEQ ID NO: 3207097 - DNA, 15 bp, Homo sapiens
agagggaacaaaact

SEQ ID NO: 3207098 - DNA, 21 bp, Homo sapiens
agagggaacaaaactgttctt

SEQ ID NO: 3207099 - DNA, 18 bp, Homo sapiens
agagggaatgttccctgc

SEQ ID NO: 3207100 - DNA, 15 bp, Homo sapiens
agagggacaggctga

SEQ ID NO: 3207101 - DNA, 18 bp, Homo sapiens
agagggacaggctgaaga

SEQ ID NO: 3207102 - DNA, 16 bp, Homo sapiens
agagggagaagcatga

SEQ ID NO: 3207103 - DNA, 12 bp, Homo sapiens
agagggagagag

SEQ ID NO: 3207104 - DNA, 18 bp, Homo sapiens
agagggagctggaacccg

SEQ ID NO: 3207105 - DNA, 20 bp, Homo sapiens
agagggagtgacagaggcag

SEQ ID NO: 3207106 - DNA, 18 bp, Homo sapiens
agagggcagactgtgaac

SEQ ID NO: 3207107 - DNA, 16 bp, Homo sapiens
agagggcagtacctgg

SEQ ID NO: 3207108 - DNA, 19 bp, Homo sapiens
agagggccatgcaattcat

SEQ ID NO: 3207109 - DNA, 13 bp, Homo sapiens
agagggcccagcc

SEQ ID NO: 3207110 - DNA, 15 bp, Homo sapiens
agagggcccagccca

SEQ ID NO: 3207111 - DNA, 17 bp, Homo sapiens
agagggcccagcccaga

SEQ ID NO: 3207112 - DNA, 21 bp, Homo sapiens
agagggcccagcccagagcca

SEQ ID NO: 3207113 - DNA, 13 bp, Homo sapiens
agagggcccagct

SEQ ID NO: 3207114 - DNA, 15 bp, Homo sapiens
agagggcccagctgt

SEQ ID NO: 3207115 - DNA, 14 bp, Homo sapiens
agagggcccaggca

SEQ ID NO: 3207116 - DNA, 14 bp, Homo sapiens
agagggctagggag

SEQ ID NO: 3207117 - DNA, 16 bp, Homo sapiens
aggatactctgtcaga

SEQ ID NO: 3207118 - DNA, 14 bp, Homo sapiens
aggatagtattttt

SEQ ID NO: 3207119 - DNA, 17 bp, Homo sapiens
aggatagttgatgcatg

SEQ ID NO: 3207120 - DNA, 21 bp, Homo sapiens
aggatatattttcactttgtg

SEQ ID NO: 3207121 - DNA, 21 bp, Homo sapiens
aggatatccttatcagagcta

SEQ ID NO: 3207122 - DNA, 15 bp, Homo sapiens
aggatattcttctct

SEQ ID NO: 3207123 - DNA, 17 bp, Homo sapiens
aggatatttaagaaaat

SEQ ID NO: 3207124 - DNA, 15 bp, Homo sapiens
aggatcactggagcc

SEQ ID NO: 3207125 - DNA, 19 bp, Homo sapiens
aggatcacttgagcccagg

SEQ ID NO: 3207126 - DNA, 22 bp, Homo sapiens
aggatcagttttttgttttaca

SEQ ID NO: 3207127 - DNA, 15 bp, Homo sapiens
aggatcatggtgtaa

SEQ ID NO: 3207128 - DNA, 20 bp, Homo sapiens
aggatcatttgttggaatga

SEQ ID NO: 3207129 - DNA, 21 bp, Homo sapiens
aggatcatttgttggaatgaa

SEQ ID NO: 3207130 - DNA, 12 bp, Homo sapiens
aggatccgctgc

SEQ ID NO: 3207131 - DNA, 14 bp, Homo sapiens
aggatccggaaaga

SEQ ID NO: 3207132 - DNA, 16 bp, Homo sapiens
aggatccggaaagaag

SEQ ID NO: 3207133 - DNA, 15 bp, Homo sapiens
aggatccgtgctgtc

SEQ ID NO: 3207134 - DNA, 13 bp, Homo sapiens
aggatcctctcca

SEQ ID NO: 3207135 - DNA, 21 bp, Homo sapiens
agctttacatgcaatttatta

SEQ ID NO: 3207136 - DNA, 13 bp, Homo sapiens
agctttaccctca

SEQ ID NO: 3207137 - DNA, 18 bp, Homo sapiens
agctttatacgtgtagct

SEQ ID NO: 3207138 - DNA, 17 bp, Homo sapiens
agctttattatggcttg

SEQ ID NO: 3207139 - DNA, 14 bp, Homo sapiens
agctttattcttca

SEQ ID NO: 3207140 - DNA, 23 bp, Homo sapiens
agctttattgttcacacaaagcc

SEQ ID NO: 3207141 - DNA, 14 bp, Homo sapiens
agctttatttctag

SEQ ID NO: 3207142 - DNA, 16 bp, Homo sapiens
agctttcaagtgcctt

SEQ ID NO: 3207143 - DNA, 12 bp, Homo sapiens
agctttcagagc

SEQ ID NO: 3207144 - DNA, 13 bp, Homo sapiens
agctttcctgccc

SEQ ID NO: 3207145 - DNA, 23 bp, Homo sapiens
agctttcctgccccaggcctgaa

SEQ ID NO: 3207146 - DNA, 18 bp, Homo sapiens
agctttcctggtccctca

SEQ ID NO: 3207147 - DNA, 15 bp, Homo sapiens
agctttcctgtttcc

SEQ ID NO: 3207148 - DNA, 22 bp, Homo sapiens
agctttcctttttcccaataaa

SEQ ID NO: 3207149 - DNA, 23 bp, Homo sapiens
agctttctagaagtttcccttcc

SEQ ID NO: 3207150 - DNA, 13 bp, Homo sapiens
agctttctccccg

SEQ ID NO: 3207151 - DNA, 14 bp, Homo sapiens
agctttctctcaga

SEQ ID NO: 3207152 - DNA, 17 bp, Homo sapiens
agctttcttgctccctt

SEQ ID NO: 3207153 - DNA, 19 bp, Homo sapiens
agctttgatttagattgag

SEQ ID NO: 3207154 - DNA, 20 bp, Homo sapiens
agctttgctacaaatttatg

SEQ ID NO: 3207155 - DNA, 21 bp, Homo sapiens
agctttgctaccaaagcacct

SEQ ID NO: 3207156 - DNA, 10 bp, Homo sapiens
agctttgctc

SEQ ID NO: 3207157 - DNA, 22 bp, Homo sapiens
agctttgctccgctcccaccgc

SEQ ID NO: 3207158 - DNA, 19 bp, Homo sapiens
agctttggacccaaggaaa

SEQ ID NO: 3207159 - DNA, 19 bp, Homo sapiens
agctttggacctaatccaa

SEQ ID NO: 3207160 - DNA, 21 bp, Homo sapiens
agctttgggatcccaccctgg

SEQ ID NO: 3207161 - DNA, 19 bp, Homo sapiens
agctttgtttcaaccaagt

SEQ ID NO: 3207162 - DNA, 18 bp, Homo sapiens
agctttgttttatatatt

SEQ ID NO: 3207163 - DNA, 22 bp, Homo sapiens
agcttttacgtagtaaaagtca

SEQ ID NO: 3207164 - DNA, 17 bp, Homo sapiens
agcttttatggatgatt

SEQ ID NO: 3207165 - DNA, 16 bp, Homo sapiens
agcttttcaaacaaga

SEQ ID NO: 3207166 - DNA, 23 bp, Homo sapiens
agcttttcatggaagtggcagtg

SEQ ID NO: 3207167 - DNA, 14 bp, Homo sapiens
agcttttctgtaga

SEQ ID NO: 3207168 - DNA, 17 bp, Homo sapiens
agcttttgccagtatta

SEQ ID NO: 3207169 - DNA, 13 bp, Homo sapiens
agcttttgttgtt

SEQ ID NO: 3207170 - DNA, 15 bp, Homo sapiens
agctttttaaaacat

SEQ ID NO: 3207171 - DNA, 12 bp, Homo sapiens
agctttttaatt

SEQ ID NO: 3207172 - DNA, 17 bp, Homo sapiens
agctttttaattaagca

SEQ ID NO: 3207173 - DNA, 12 bp, Homo sapiens
agctttttctca

SEQ ID NO: 3207174 - DNA, 14 bp, Homo sapiens
agcttttttcttta

SEQ ID NO: 3207175 - DNA, 16 bp, Homo sapiens
agctttttttcttgct

SEQ ID NO: 3207176 - DNA, 17 bp, Homo sapiens
agctttttttcttgcta

SEQ ID NO: 3207177 - DNA, 13 bp, Homo sapiens
aggaaaaaaactg

SEQ ID NO: 3207178 - DNA, 19 bp, Homo sapiens
aggaaaaaaactgggataa

SEQ ID NO: 3207179 - DNA, 22 bp, Homo sapiens
aggaaaaaaactgggataactg

SEQ ID NO: 3207180 - DNA, 20 bp, Homo sapiens
aggaaaaaagaaccaaaact

SEQ ID NO: 3207181 - DNA, 16 bp, Homo sapiens
aggaaaacctgaagac

SEQ ID NO: 3207182 - DNA, 17 bp, Homo sapiens
aggaaaacgtgaacaaa

SEQ ID NO: 3207183 - DNA, 14 bp, Homo sapiens
aggaaaactgcatg

SEQ ID NO: 3207184 - DNA, 14 bp, Homo sapiens
aggaaaagctgctg

SEQ ID NO: 3207185 - DNA, 16 bp, Homo sapiens
aggaaaagctgctgac

SEQ ID NO: 3207186 - DNA, 15 bp, Homo sapiens
aggaaaaggaaaaaa

SEQ ID NO: 3207187 - DNA, 19 bp, Homo sapiens
aggaaaagtacatttaata

SEQ ID NO: 3207188 - DNA, 15 bp, Homo sapiens
aggaaaagttaaact

SEQ ID NO: 3207189 - DNA, 16 bp, Homo sapiens
aggaaaatgagtattt

SEQ ID NO: 3207190 - DNA, 22 bp, Homo sapiens
aggaaacgccccgggcaaaggg

SEQ ID NO: 3207191 - DNA, 16 bp, Homo sapiens
aggaaacgctacctct

SEQ ID NO: 3207192 - DNA, 13 bp, Homo sapiens
aggaaacggaagc

SEQ ID NO: 3207193 - DNA, 16 bp, Homo sapiens
aggaaactccacatct

SEQ ID NO: 3207194 - DNA, 22 bp, Homo sapiens
aggaaactccacatctgcctta

SEQ ID NO: 3207195 - DNA, 21 bp, Homo sapiens
aggaaactctgcattctagta

SEQ ID NO: 3207196 - DNA, 14 bp, Homo sapiens
aggaaagaaccgaa

SEQ ID NO: 3207197 - DNA, 21 bp, Homo sapiens
aggaaagaagggggccctgct

SEQ ID NO: 3207198 - DNA, 14 bp, Homo sapiens
aggaaagccctccc

SEQ ID NO: 3207199 - DNA, 12 bp, Homo sapiens
aggaaaggattt

SEQ ID NO: 3207200 - DNA, 23 bp, Homo sapiens
aggaaaggattttaccaaagcat

SEQ ID NO: 3207201 - DNA, 17 bp, Homo sapiens
aggaaataaaaaagtct

SEQ ID NO: 3207202 - DNA, 18 bp, Homo sapiens
aggaaataaaaaagtctc

SEQ ID NO: 3207203 - DNA, 22 bp, Homo sapiens
aggaaataaaaaagtctctatt

SEQ ID NO: 3207204 - DNA, 16 bp, Homo sapiens
aggaaataaaaccttt

SEQ ID NO: 3207205 - DNA, 20 bp, Homo sapiens
aggaaatatatatgtgtgtg

SEQ ID NO: 3207206 - DNA, 16 bp, Homo sapiens
aggaaatctcacccca

SEQ ID NO: 3207207 - DNA, 23 bp, Homo sapiens
aggaaatgctattgttgtgggct

SEQ ID NO: 3207208 - DNA, 17 bp, Homo sapiens
aggaaatttgtttgtat

SEQ ID NO: 3207209 - DNA, 15 bp, Homo sapiens
aggaacaaaaaaacc

SEQ ID NO: 3207210 - DNA, 16 bp, Homo sapiens
aggaacaaaaaaacca

SEQ ID NO: 3207211 - DNA, 14 bp, Homo sapiens
aggaacaaacaggg

SEQ ID NO: 3207212 - DNA, 16 bp, Homo sapiens
aggaacagtggctggg

SEQ ID NO: 3207213 - DNA, 18 bp, Homo sapiens
aggaacagtggctgggtg

SEQ ID NO: 3207214 - DNA, 23 bp, Homo sapiens
aggaacccttgcatccattgttg

SEQ ID NO: 3207215 - DNA, 19 bp, Homo sapiens
aggaaccttccttcctgct

SEQ ID NO: 3207216 - DNA, 18 bp, Homo sapiens
aggaacgagcactggcca

SEQ ID NO: 3207217 - DNA, 15 bp, Homo sapiens
aggaactgtacagaa

SEQ ID NO: 3207218 - DNA, 14 bp, Homo sapiens
aggaacttccaggt

SEQ ID NO: 3207219 - DNA, 13 bp, Homo sapiens
aggaactttcccc

SEQ ID NO: 3207220 - DNA, 20 bp, Homo sapiens
aggaagaagacaaatgacag

SEQ ID NO: 3207221 - DNA, 17 bp, Homo sapiens
aggaagaagagatgcac

SEQ ID NO: 3207222 - DNA, 15 bp, Homo sapiens
aggaagaaggcagtg

SEQ ID NO: 3207223 - DNA, 18 bp, Homo sapiens
aggaagaagtggtactag

SEQ ID NO: 3207224 - DNA, 15 bp, Homo sapiens
aggaagagtcttggt

SEQ ID NO: 3207225 - DNA, 22 bp, Homo sapiens
aggaagatgggggcaagaagat

SEQ ID NO: 3207226 - DNA, 19 bp, Homo sapiens
aggaagcattcagagagca

SEQ ID NO: 3207227 - DNA, 19 bp, Homo sapiens
aggaagcctgcagtcctgg

SEQ ID NO: 3207228 - DNA, 15 bp, Homo sapiens
aggaagctccactgt

SEQ ID NO: 3207229 - DNA, 14 bp, Homo sapiens
aggaagctccagat

SEQ ID NO: 3207230 - DNA, 22 bp, Homo sapiens
aggaagctgcctggtgtggagt

SEQ ID NO: 3207231 - DNA, 19 bp, Homo sapiens
aggaagctgtgttgaaaca

SEQ ID NO: 3207232 - DNA, 13 bp, Homo sapiens
aggaaggaaaact

SEQ ID NO: 3207233 - DNA, 14 bp, Homo sapiens
aggaaggattgtaa

SEQ ID NO: 3207234 - DNA, 18 bp, Homo sapiens
aggaaggattgtaaaaaa

SEQ ID NO: 3207235 - DNA, 12 bp, Homo sapiens
aggaaggcagct

SEQ ID NO: 3207236 - DNA, 13 bp, Homo sapiens
aggaaggcagctg

SEQ ID NO: 3207237 - DNA, 18 bp, Homo sapiens
aggaaggcagctgctctt

SEQ ID NO: 3207238 - DNA, 15 bp, Homo sapiens
aggaaggcctaggct

SEQ ID NO: 3207239 - DNA, 16 bp, Homo sapiens
aggaagggaccaaggc

SEQ ID NO: 3207240 - DNA, 23 bp, Homo sapiens
aggaagggaccaaggcaaggcag

SEQ ID NO: 3207241 - DNA, 13 bp, Homo sapiens
aggaagggcagag

SEQ ID NO: 3207242 - DNA, 16 bp, Homo sapiens
aggaagggggttgtgg

SEQ ID NO: 3207243 - DNA, 16 bp, Homo sapiens
aggaaggtctcattct

SEQ ID NO: 3207244 - DNA, 14 bp, Homo sapiens
aggaaggtgctgag

SEQ ID NO: 3207245 - DNA, 17 bp, Homo sapiens
aggaaggtgctgagctt

SEQ ID NO: 3207246 - DNA, 15 bp, Homo sapiens
aggaagtccagccac

SEQ ID NO: 3207247 - DNA, 16 bp, Homo sapiens
aggaagtgtggaaaaa

SEQ ID NO: 3207248 - DNA, 19 bp, Homo sapiens
aggaataaattgctccttg

SEQ ID NO: 3207249 - DNA, 16 bp, Homo sapiens
aggaataacctttctg

SEQ ID NO: 3207250 - DNA, 17 bp, Homo sapiens
aggaataattatttatt

SEQ ID NO: 3207251 - DNA, 17 bp, Homo sapiens
aggaatagaggaagaaa

SEQ ID NO: 3207252 - DNA, 20 bp, Homo sapiens
aggaatagaggaagaaatgt

SEQ ID NO: 3207253 - DNA, 14 bp, Homo sapiens
aggaatagccagag

SEQ ID NO: 3207254 - DNA, 15 bp, Homo sapiens
aggaatagccagaga

SEQ ID NO: 3207255 - DNA, 22 bp, Homo sapiens
aggaatatgacggaagaacata

SEQ ID NO: 3207256 - DNA, 21 bp, Homo sapiens
aggaatcatgtcaggcctgtg

SEQ ID NO: 3207257 - DNA, 23 bp, Homo sapiens
aggaatcatgtcaggcctgtgtg

SEQ ID NO: 3207258 - DNA, 22 bp, Homo sapiens
aggaatcattcagaaatgttga

SEQ ID NO: 3207259 - DNA, 16 bp, Homo sapiens
aggacttggtctgatt

SEQ ID NO: 3207260 - DNA, 16 bp, Homo sapiens
aggacttgtgtctctg

SEQ ID NO: 3207261 - DNA, 21 bp, Homo sapiens
aggactttcctaaatgtttaa

SEQ ID NO: 3207262 - DNA, 19 bp, Homo sapiens
aggacttttctttgtggct

SEQ ID NO: 3207263 - DNA, 12 bp, Homo sapiens
aggagaaacaca

SEQ ID NO: 3207264 - DNA, 13 bp, Homo sapiens
aggagaaacacat

SEQ ID NO: 3207265 - DNA, 19 bp, Homo sapiens
aggagaaccaaatctggaa

SEQ ID NO: 3207266 - DNA, 14 bp, Homo sapiens
aggagaaccactac

SEQ ID NO: 3207267 - DNA, 17 bp, Homo sapiens
aggagaagaggcatcct

SEQ ID NO: 3207268 - DNA, 22 bp, Homo sapiens
aggagaagaggcatcctgcctg

SEQ ID NO: 3207269 - DNA, 23 bp, Homo sapiens
aggagaagaggcatcctgcctgg

SEQ ID NO: 3207270 - DNA, 18 bp, Homo sapiens
agctgtaaaacgctgtca

SEQ ID NO: 3207271 - DNA, 19 bp, Homo sapiens
agctgtaaaacgctgtcaa

SEQ ID NO: 3207272 - DNA, 23 bp, Homo sapiens
agctgtaagaaaatgctgtcaca

SEQ ID NO: 3207273 - DNA, 21 bp, Homo sapiens
agctgtactcagagcagagca

SEQ ID NO: 3207274 - DNA, 21 bp, Homo sapiens
agctgtagccatggctcaggc

SEQ ID NO: 3207275 - DNA, 22 bp, Homo sapiens
agctgtagccatggctcaggca

SEQ ID NO: 3207276 - DNA, 22 bp, Homo sapiens
agctgtagtagccctttctgtg

SEQ ID NO: 3207277 - DNA, 23 bp, Homo sapiens
agctgtagtagccctttctgtgt

SEQ ID NO: 3207278 - DNA, 17 bp, Homo sapiens
agctgtatgatttgttt

SEQ ID NO: 3207279 - DNA, 18 bp, Homo sapiens
agctgtcaccaaggaaac

SEQ ID NO: 3207280 - DNA, 17 bp, Homo sapiens
agctgtcccctctgtca

SEQ ID NO: 3207281 - DNA, 15 bp, Homo sapiens
agctgtcctgcagca

SEQ ID NO: 3207282 - DNA, 19 bp, Homo sapiens
agctgtctatgcagcctgc

SEQ ID NO: 3207283 - DNA, 15 bp, Homo sapiens
agctgtctctaactt

SEQ ID NO: 3207284 - DNA, 15 bp, Homo sapiens
agctgtgaacaggct

SEQ ID NO: 3207285 - DNA, 18 bp, Homo sapiens
agctgtgagccttggctg

SEQ ID NO: 3207286 - DNA, 19 bp, Homo sapiens
agctgtgagttctccctgt

SEQ ID NO: 3207287 - DNA, 18 bp, Homo sapiens
agctgtggcctcaccctg

SEQ ID NO: 3207288 - DNA, 19 bp, Homo sapiens
agctgtggcctcaccctga

SEQ ID NO: 3207289 - DNA, 14 bp, Homo sapiens
agctgtgtgaaata

SEQ ID NO: 3207290 - DNA, 23 bp, Homo sapiens
agctgtgtgaaataccagtgtgg

SEQ ID NO: 3207291 - DNA, 21 bp, Homo sapiens
agctgtgtgaatacctgctca

SEQ ID NO: 3207292 - DNA, 13 bp, Homo sapiens
agctgtgttgaaa

SEQ ID NO: 3207293 - DNA, 19 bp, Homo sapiens
agctgtgttgaaacagaaa

SEQ ID NO: 3207294 - DNA, 14 bp, Homo sapiens
agctgttaaactgt

SEQ ID NO: 3207295 - DNA, 16 bp, Homo sapiens
agctgttaccattcac

SEQ ID NO: 3207296 - DNA, 17 bp, Homo sapiens
agctgttaccattcaca

SEQ ID NO: 3207297 - DNA, 16 bp, Homo sapiens
agctgttactttcttt

SEQ ID NO: 3207298 - DNA, 17 bp, Homo sapiens
agctgttactttctttc

SEQ ID NO: 3207299 - DNA, 23 bp, Homo sapiens
agctgttactttctttcagatgt

SEQ ID NO: 3207300 - DNA, 16 bp, Homo sapiens
agctgttgagctgttt

SEQ ID NO: 3207301 - DNA, 15 bp, Homo sapiens
agctgttgtacattt

SEQ ID NO: 3207302 - DNA, 20 bp, Homo sapiens
agctgttgtacatttatgat

SEQ ID NO: 3207303 - DNA, 12 bp, Homo sapiens
agctgtttaaga

SEQ ID NO: 3207304 - DNA, 16 bp, Homo sapiens
agctgtttaagatggg

SEQ ID NO: 3207305 - DNA, 17 bp, Homo sapiens
agctgtttatggcctca

SEQ ID NO: 3207306 - DNA, 18 bp, Homo sapiens
agctgtttatgtttttat

SEQ ID NO: 3207307 - DNA, 13 bp, Homo sapiens
agctgtttgtcat

SEQ ID NO: 3207308 - DNA, 15 bp, Homo sapiens
agctgttttccctga

SEQ ID NO: 3207309 - DNA, 23 bp, Homo sapiens
agcttaaattgcttttgttgtga

SEQ ID NO: 3207310 - DNA, 21 bp, Homo sapiens
agcttaacaatgcaactttta

SEQ ID NO: 3207311 - DNA, 15 bp, Homo sapiens
agcttaactaatttg

SEQ ID NO: 3207312 - DNA, 17 bp, Homo sapiens
agcttaactaatttgaa

SEQ ID NO: 3207313 - DNA, 17 bp, Homo sapiens
agcttaatagccctccc

SEQ ID NO: 3207314 - DNA, 17 bp, Homo sapiens
agcttacatagttttaa

SEQ ID NO: 3207315 - DNA, 22 bp, Homo sapiens
agcttacatagttttaaactca

SEQ ID NO: 3207316 - DNA, 20 bp, Homo sapiens
agcttaccagaagcttccat

SEQ ID NO: 3207317 - DNA, 13 bp, Homo sapiens
agcttacctgaca

SEQ ID NO: 3207318 - DNA, 17 bp, Homo sapiens
agcttacctgacacaag

SEQ ID NO: 3207319 - DNA, 13 bp, Homo sapiens
agcttagccttgt

SEQ ID NO: 3207320 - DNA, 15 bp, Homo sapiens
agcttagccttgtgc

SEQ ID NO: 3207321 - DNA, 16 bp, Homo sapiens
agcttagccttgtgcc

SEQ ID NO: 3207322 - DNA, 22 bp, Homo sapiens
agcttagccttgtgccctgccc

SEQ ID NO: 3207323 - DNA, 19 bp, Homo sapiens
agcttagtttcagagacct

SEQ ID NO: 3207324 - DNA, 14 bp, Homo sapiens
agcttatctctttt

SEQ ID NO: 3207325 - DNA, 17 bp, Homo sapiens
agcttatctcttttata

SEQ ID NO: 3207326 - DNA, 22 bp, Homo sapiens
agcttatgggatccttgtcttt

SEQ ID NO: 3207327 - DNA, 16 bp, Homo sapiens
agcttatgtgacatgg

SEQ ID NO: 3207328 - DNA, 15 bp, Homo sapiens
agcttcaagtgcctt

SEQ ID NO: 3207329 - DNA, 17 bp, Homo sapiens
agcttcaagtgcctttt

SEQ ID NO: 3207330 - DNA, 17 bp, Homo sapiens
agcttcaatatttttct

SEQ ID NO: 3207331 - DNA, 18 bp, Homo sapiens
agcttcacagtacccaaa

SEQ ID NO: 3207332 - DNA, 16 bp, Homo sapiens
agcttcaccctgtcaa

SEQ ID NO: 3207333 - DNA, 13 bp, Homo sapiens
agcttcaggcacc

SEQ ID NO: 3207334 - DNA, 21 bp, Homo sapiens
agcttcaggcaccagcatcca

SEQ ID NO: 3207335 - DNA, 11 bp, Homo sapiens
agcttcaggtt

SEQ ID NO: 3207336 - DNA, 15 bp, Homo sapiens
agcttcagttgcttg

SEQ ID NO: 3207337 - DNA, 17 bp, Homo sapiens
agcttcatataccagca

SEQ ID NO: 3207338 - DNA, 20 bp, Homo sapiens
agcttcatgcctttgtaagt

SEQ ID NO: 3207339 - DNA, 18 bp, Homo sapiens
agcttcattatctgagtt

SEQ ID NO: 3207340 - DNA, 20 bp, Homo sapiens
agcttcattatctgagttgc

SEQ ID NO: 3207341 - DNA, 22 bp, Homo sapiens
agcttcattatctgagttgcat

SEQ ID NO: 3207342 - DNA, 17 bp, Homo sapiens
agcttcatttgtgtcaa

SEQ ID NO: 3207343 - DNA, 19 bp, Homo sapiens
agcttcatttgtgtcaatg

SEQ ID NO: 3207344 - DNA, 14 bp, Homo sapiens
agcttcccagccat

SEQ ID NO: 3207345 - DNA, 23 bp, Homo sapiens
agcttcccagccatgcccaggac

SEQ ID NO: 3207346 - DNA, 14 bp, Homo sapiens
agcttccgctttga

SEQ ID NO: 3207347 - DNA, 23 bp, Homo sapiens
agcttccgctttgaaagaagcaa

SEQ ID NO: 3207348 - DNA, 13 bp, Homo sapiens
agcttccttctgg

SEQ ID NO: 3207349 - DNA, 19 bp, Homo sapiens
agcttcggagggcccctgc

SEQ ID NO: 3207350 - DNA, 22 bp, Homo sapiens
agcttcgttagaatgtctgcct

SEQ ID NO: 3207351 - DNA, 20 bp, Homo sapiens
agcttcgtttattttcaaga

SEQ ID NO: 3207352 - DNA, 18 bp, Homo sapiens
agcttctaataaattata

SEQ ID NO: 3207353 - DNA, 17 bp, Homo sapiens
agcttctatcccaggag

SEQ ID NO: 3207354 - DNA, 12 bp, Homo sapiens
agcttctctgca

SEQ ID NO: 3207355 - DNA, 23 bp, Homo sapiens
agcttctctgctagatttctaca

SEQ ID NO: 3207356 - DNA, 13 bp, Homo sapiens
agcttctctgtga

SEQ ID NO: 3207357 - DNA, 14 bp, Homo sapiens
agcttctctgtgaa

SEQ ID NO: 3207358 - DNA, 19 bp, Homo sapiens
agcttctggtactctccta

SEQ ID NO: 3207359 - DNA, 20 bp, Homo sapiens
agcttctggtactctcctag

SEQ ID NO: 3207360 - DNA, 23 bp, Homo sapiens
agcttctggtactctcctagaga

SEQ ID NO: 3207361 - DNA, 14 bp, Homo sapiens
agcttcttaattaa

SEQ ID NO: 3207362 - DNA, 18 bp, Homo sapiens
agcttcttaattaatttg

SEQ ID NO: 3207363 - DNA, 19 bp, Homo sapiens
agcttcttaattaatttga

SEQ ID NO: 3207364 - DNA, 20 bp, Homo sapiens
agcttgaaaagattctgaaa

SEQ ID NO: 3207365 - DNA, 17 bp, Homo sapiens
agcttgaaagttttcag

SEQ ID NO: 3207366 - DNA, 22 bp, Homo sapiens
agcttgaaagttttcagaacct

SEQ ID NO: 3207367 - DNA, 23 bp, Homo sapiens
agcttgaagattaggagaaacac

SEQ ID NO: 3207368 - DNA, 17 bp, Homo sapiens
agcttgacacagtcagc

SEQ ID NO: 3207369 - DNA, 18 bp, Homo sapiens
agcttgacacagtcagca

SEQ ID NO: 3207370 - DNA, 14 bp, Homo sapiens
agcttgacctgagg

SEQ ID NO: 3207371 - DNA, 18 bp, Homo sapiens
agcttgagggttgggctg

SEQ ID NO: 3207372 - DNA, 18 bp, Homo sapiens
agcttgccccggccccgg

SEQ ID NO: 3207373 - DNA, 15 bp, Homo sapiens
agcttgctccctgtg

SEQ ID NO: 3207374 - DNA, 17 bp, Homo sapiens
agcttgctccctgtgtc

SEQ ID NO: 3207375 - DNA, 21 bp, Homo sapiens
agcttgcttgctttctttttt

SEQ ID NO: 3207376 - DNA, 12 bp, Homo sapiens
agcttgctttga

SEQ ID NO: 3207377 - DNA, 15 bp, Homo sapiens
agcttgggagagccc

SEQ ID NO: 3207378 - DNA, 24 bp, Homo sapiens
agcttgggagagcccctggggcct

SEQ ID NO: 3207379 - DNA, 20 bp, Homo sapiens
agcttggggaacccatgagt

SEQ ID NO: 3207380 - DNA, 21 bp, Homo sapiens
agcttgggggatgactagagg

SEQ ID NO: 3207381 - DNA, 18 bp, Homo sapiens
agcttgggtttttgttac

SEQ ID NO: 3207382 - DNA, 18 bp, Homo sapiens
agcttgtaaatagctcag

SEQ ID NO: 3207383 - DNA, 19 bp, Homo sapiens
agcttgtaaatagctcagg

SEQ ID NO: 3207384 - DNA, 20 bp, Homo sapiens
agcttgtaaatagctcaggt

SEQ ID NO: 3207385 - DNA, 18 bp, Homo sapiens
agcttgtaataaatactg

SEQ ID NO: 3207386 - DNA, 18 bp, Homo sapiens
agcttgtcttttctgctg

SEQ ID NO: 3207387 - DNA, 20 bp, Homo sapiens
agcttgtcttttctgctgag

SEQ ID NO: 3207388 - DNA, 23 bp, Homo sapiens
agcttgtggccccttttactttt

SEQ ID NO: 3207389 - DNA, 16 bp, Homo sapiens
agcttgttatttataa

SEQ ID NO: 3207390 - DNA, 15 bp, Homo sapiens
agcttgttctgggct

SEQ ID NO: 3207391 - DNA, 15 bp, Homo sapiens
agctttaaacaaatt

SEQ ID NO: 3207392 - DNA, 17 bp, Homo sapiens
agctttaaattatgtga

SEQ ID NO: 3207393 - DNA, 13 bp, Homo sapiens
agctttacacaca

SEQ ID NO: 3207394 - DNA, 21 bp, Homo sapiens
agctcaggcatttgaggctgt

SEQ ID NO: 3207395 - DNA, 10 bp, Homo sapiens
agctcaggtg

SEQ ID NO: 3207396 - DNA, 17 bp, Homo sapiens
agctcaggtgtccctgc

SEQ ID NO: 3207397 - DNA, 18 bp, Homo sapiens
agctcaggtgtccctgca

SEQ ID NO: 3207398 - DNA, 18 bp, Homo sapiens
agctcataaaatggaagc

SEQ ID NO: 3207399 - DNA, 16 bp, Homo sapiens
agctcatctgcaaaag

SEQ ID NO: 3207400 - DNA, 20 bp, Homo sapiens
agctccaagacctgttggtt

SEQ ID NO: 3207401 - DNA, 15 bp, Homo sapiens
agctccaagccccat

SEQ ID NO: 3207402 - DNA, 21 bp, Homo sapiens
agctccacggtgcgtggctgt

SEQ ID NO: 3207403 - DNA, 23 bp, Homo sapiens
agctccacggtgcgtggctgtgg

SEQ ID NO: 3207404 - DNA, 12 bp, Homo sapiens
agctccactctg

SEQ ID NO: 3207405 - DNA, 14 bp, Homo sapiens
agctccactctgct

SEQ ID NO: 3207406 - DNA, 24 bp, Homo sapiens
agctccactctgcttctctgactt

SEQ ID NO: 3207407 - DNA, 19 bp, Homo sapiens
agctccagctcaccagccc

SEQ ID NO: 3207408 - DNA, 16 bp, Homo sapiens
agctccatctccactc

SEQ ID NO: 3207409 - DNA, 21 bp, Homo sapiens
agctccatctccactccagat

SEQ ID NO: 3207410 - DNA, 14 bp, Homo sapiens
agctccccagatct

SEQ ID NO: 3207411 - DNA, 18 bp, Homo sapiens
agctccccccgcccaccc

SEQ ID NO: 3207412 - DNA, 13 bp, Homo sapiens
agctccccctgtc

SEQ ID NO: 3207413 - DNA, 17 bp, Homo sapiens
agctccccctgtcccct

SEQ ID NO: 3207414 - DNA, 19 bp, Homo sapiens
agctccccctgtcccctca

SEQ ID NO: 3207415 - DNA, 17 bp, Homo sapiens
agctccctagactgcat

SEQ ID NO: 3207416 - DNA, 13 bp, Homo sapiens
agctccctgccaa

SEQ ID NO: 3207417 - DNA, 14 bp, Homo sapiens
agctcccttctctg

SEQ ID NO: 3207418 - DNA, 23 bp, Homo sapiens
agctccgctttctacccagcgag

SEQ ID NO: 3207419 - DNA, 23 bp, Homo sapiens
agctcctcaactcacctaatgtt

SEQ ID NO: 3207420 - DNA, 16 bp, Homo sapiens
agctcctcctcggaac

SEQ ID NO: 3207421 - DNA, 22 bp, Homo sapiens
agctcctctccttgggctcctg

SEQ ID NO: 3207422 - DNA, 21 bp, Homo sapiens
agctcctctgtcctgcttctg

SEQ ID NO: 3207423 - DNA, 14 bp, Homo sapiens
agctcctgctgcgg

SEQ ID NO: 3207424 - DNA, 13 bp, Homo sapiens
agctcctggccag

SEQ ID NO: 3207425 - DNA, 21 bp, Homo sapiens
agctcctgtcctcccatcccc

SEQ ID NO: 3207426 - DNA, 12 bp, Homo sapiens
agctcctgtggc

SEQ ID NO: 3207427 - DNA, 21 bp, Homo sapiens
agctccttattggaaggtatt

SEQ ID NO: 3207428 - DNA, 22 bp, Homo sapiens
agctccttttccgttctgttct

SEQ ID NO: 3207429 - DNA, 13 bp, Homo sapiens
agctccttttgtc

SEQ ID NO: 3207430 - DNA, 17 bp, Homo sapiens
agctccttttgtcccca

SEQ ID NO: 3207431 - DNA, 21 bp, Homo sapiens
agctccttttgtccccagggc

SEQ ID NO: 3207432 - DNA, 22 bp, Homo sapiens
agctccttttgtccccagggcc

SEQ ID NO: 3207433 - DNA, 19 bp, Homo sapiens
agctcgaggcccccgacca

SEQ ID NO: 3207434 - DNA, 20 bp, Homo sapiens
agctcgcacccccctgttct

SEQ ID NO: 3207435 - DNA, 21 bp, Homo sapiens
agctcgcacccccctgttcta

SEQ ID NO: 3207436 - DNA, 14 bp, Homo sapiens
agctcgccccacct

SEQ ID NO: 3207437 - DNA, 18 bp, Homo sapiens
agctctaccctgctccct

SEQ ID NO: 3207438 - DNA, 15 bp, Homo sapiens
agctctagaatctgc

SEQ ID NO: 3207439 - DNA, 17 bp, Homo sapiens
agctctattttaaagta

SEQ ID NO: 3207440 - DNA, 14 bp, Homo sapiens
agctctccagctcc

SEQ ID NO: 3207441 - DNA, 17 bp, Homo sapiens
agctctccagctccaag

SEQ ID NO: 3207442 - DNA, 18 bp, Homo sapiens
agctctccggtctctctc

SEQ ID NO: 3207443 - DNA, 20 bp, Homo sapiens
agctctcctggctccctccc

SEQ ID NO: 3207444 - DNA, 16 bp, Homo sapiens
agctctctaggcctct

SEQ ID NO: 3207445 - DNA, 18 bp, Homo sapiens
agctctctgggacctcct

SEQ ID NO: 3207446 - DNA, 18 bp, Homo sapiens
agctctctgtataaacat

SEQ ID NO: 3207447 - DNA, 16 bp, Homo sapiens
agctctcttcttactc

SEQ ID NO: 3207448 - DNA, 16 bp, Homo sapiens
agctctcttgccgagg

SEQ ID NO: 3207449 - DNA, 13 bp, Homo sapiens
agctctgaaatct

SEQ ID NO: 3207450 - DNA, 16 bp, Homo sapiens
agctctgaaatcttcc

SEQ ID NO: 3207451 - DNA, 22 bp, Homo sapiens
agctctgaagaactctctggaa

SEQ ID NO: 3207452 - DNA, 17 bp, Homo sapiens
agctctgacatcccttc

SEQ ID NO: 3207453 - DNA, 22 bp, Homo sapiens
agctctgacatcccttcctgga

SEQ ID NO: 3207454 - DNA, 13 bp, Homo sapiens
agctctgaccctt

SEQ ID NO: 3207455 - DNA, 16 bp, Homo sapiens
agctctgacccttggg

SEQ ID NO: 3207456 - DNA, 19 bp, Homo sapiens
agctctgagatcctggagt

SEQ ID NO: 3207457 - DNA, 14 bp, Homo sapiens
agctctgagccaga

SEQ ID NO: 3207458 - DNA, 16 bp, Homo sapiens
agctctgagccagatt

SEQ ID NO: 3207459 - DNA, 15 bp, Homo sapiens
agctctgaggggagg

SEQ ID NO: 3207460 - DNA, 18 bp, Homo sapiens
agctctgaggggaggggg

SEQ ID NO: 3207461 - DNA, 16 bp, Homo sapiens
agctctgcatctcctg

SEQ ID NO: 3207462 - DNA, 19 bp, Homo sapiens
agctctgcatctcctgtct

SEQ ID NO: 3207463 - DNA, 13 bp, Homo sapiens
agctctgcattat

SEQ ID NO: 3207464 - DNA, 11 bp, Homo sapiens
agctctggaga

SEQ ID NO: 3207465 - DNA, 16 bp, Homo sapiens
agctctggaggggagg

SEQ ID NO: 3207466 - DNA, 17 bp, Homo sapiens
agctctggaggggaggg

SEQ ID NO: 3207467 - DNA, 20 bp, Homo sapiens
agctctggaggggaggggga

SEQ ID NO: 3207468 - DNA, 23 bp, Homo sapiens
agctctggctgaaccctgtgctg

SEQ ID NO: 3207469 - DNA, 12 bp, Homo sapiens
agctctggcttc

SEQ ID NO: 3207470 - DNA, 15 bp, Homo sapiens
agctctgggagagga

SEQ ID NO: 3207471 - DNA, 18 bp, Homo sapiens
agctctgggagaggattt

SEQ ID NO: 3207472 - DNA, 15 bp, Homo sapiens
agctctggggggcag

SEQ ID NO: 3207473 - DNA, 19 bp, Homo sapiens
agctctggggtgggcagtt

SEQ ID NO: 3207474 - DNA, 21 bp, Homo sapiens
agctctggggtgggcagtttt

SEQ ID NO: 3207475 - DNA, 23 bp, Homo sapiens
agctctggtgagtcttggcggca

SEQ ID NO: 3207476 - DNA, 12 bp, Homo sapiens
agctctgtcctg

SEQ ID NO: 3207477 - DNA, 21 bp, Homo sapiens
agctctgtcctgggagtgagc

SEQ ID NO: 3207478 - DNA, 12 bp, Homo sapiens
agctctgtggcc

SEQ ID NO: 3207479 - DNA, 17 bp, Homo sapiens
agctctgtggcctgtgt

SEQ ID NO: 3207480 - DNA, 16 bp, Homo sapiens
agctctgtgttgccat

SEQ ID NO: 3207481 - DNA, 16 bp, Homo sapiens
agctctgttgcaatta

SEQ ID NO: 3207482 - DNA, 14 bp, Homo sapiens
agctcttcaagctg

SEQ ID NO: 3207483 - DNA, 13 bp, Homo sapiens
agctcttcaggcc

SEQ ID NO: 3207484 - DNA, 15 bp, Homo sapiens
agctcttcaggcctc

SEQ ID NO: 3207485 - DNA, 18 bp, Homo sapiens
agctcttcaggcctccct

SEQ ID NO: 3207486 - DNA, 21 bp, Homo sapiens
agctcttgaaatatgtagtat

SEQ ID NO: 3207487 - DNA, 14 bp, Homo sapiens
agctcttgcccttc

SEQ ID NO: 3207488 - DNA, 20 bp, Homo sapiens
agctcttgctaatcagtgtc

SEQ ID NO: 3207489 - DNA, 23 bp, Homo sapiens
agctcttgctaatcagtgtctca

SEQ ID NO: 3207490 - DNA, 15 bp, Homo sapiens
agctcttggcctttg

SEQ ID NO: 3207491 - DNA, 18 bp, Homo sapiens
agctcttggcctttgcat

SEQ ID NO: 3207492 - DNA, 19 bp, Homo sapiens
agctctttggtctattttc

SEQ ID NO: 3207493 - DNA, 13 bp, Homo sapiens
agctgaaatttta

SEQ ID NO: 3207494 - DNA, 20 bp, Homo sapiens
agctgaaattttagaaatat

SEQ ID NO: 3207495 - DNA, 22 bp, Homo sapiens
agctgaacaataggctgttccc

SEQ ID NO: 3207496 - DNA, 19 bp, Homo sapiens
agctgaagaaaaaatcaga

SEQ ID NO: 3207497 - DNA, 16 bp, Homo sapiens
agctgaagaccatgga

SEQ ID NO: 3207498 - DNA, 12 bp, Homo sapiens
agctgaaggcag

SEQ ID NO: 3207499 - DNA, 19 bp, Homo sapiens
agctgaaggcagtggcagg

SEQ ID NO: 3207500 - DNA, 21 bp, Homo sapiens
agctgaatgcctcctgtgggg

SEQ ID NO: 3207501 - DNA, 12 bp, Homo sapiens
agctgacataat

SEQ ID NO: 3207502 - DNA, 17 bp, Homo sapiens
agctgacccagagtgga

SEQ ID NO: 3207503 - DNA, 23 bp, Homo sapiens
agctgacgggaggccccagctct

SEQ ID NO: 3207504 - DNA, 23 bp, Homo sapiens
agctgactaaactttttttctgt

SEQ ID NO: 3207505 - DNA, 13 bp, Homo sapiens
agctgactcacac

SEQ ID NO: 3207506 - DNA, 16 bp, Homo sapiens
agctgactgaatgcag

SEQ ID NO: 3207507 - DNA, 21 bp, Homo sapiens
agatcttatattggtttgcac

SEQ ID NO: 3207508 - DNA, 22 bp, Homo sapiens
agatcttccgtggtcagagtgc

SEQ ID NO: 3207509 - DNA, 19 bp, Homo sapiens
agatgaactctgaactttg

SEQ ID NO: 3207510 - DNA, 19 bp, Homo sapiens
agatgaactgactgaagga

SEQ ID NO: 3207511 - DNA, 22 bp, Homo sapiens
agatgaactgactgaaggaaaa

SEQ ID NO: 3207512 - DNA, 12 bp, Homo sapiens
agatgaagaagc

SEQ ID NO: 3207513 - DNA, 16 bp, Homo sapiens
agatgaagaagccttt

SEQ ID NO: 3207514 - DNA, 19 bp, Homo sapiens
agatgaagagtgagagggc

SEQ ID NO: 3207515 - DNA, 16 bp, Homo sapiens
agatgaaggagaggca

SEQ ID NO: 3207516 - DNA, 17 bp, Homo sapiens
agatgacaaattatatt

SEQ ID NO: 3207517 - DNA, 17 bp, Homo sapiens
agatgaccataattttt

SEQ ID NO: 3207518 - DNA, 14 bp, Homo sapiens
agatgactgagtcc

SEQ ID NO: 3207519 - DNA, 15 bp, Homo sapiens
agatgactttgcaga

SEQ ID NO: 3207520 - DNA, 11 bp, Homo sapiens
agatgagaaca

SEQ ID NO: 3207521 - DNA, 13 bp, Homo sapiens
agatgagaacaaa

SEQ ID NO: 3207522 - DNA, 19 bp, Homo sapiens
agatgagatttgccagcac

SEQ ID NO: 3207523 - DNA, 21 bp, Homo sapiens
agatgagcccagccctgttct

SEQ ID NO: 3207524 - DNA, 18 bp, Homo sapiens
agatgaggagtaaaattc

SEQ ID NO: 3207525 - DNA, 16 bp, Homo sapiens
agatgaggttctgaga

SEQ ID NO: 3207526 - DNA, 16 bp, Homo sapiens
agatgataaagagaca

SEQ ID NO: 3207527 - DNA, 24 bp, Homo sapiens
agatgatacttccaagtgataatt

SEQ ID NO: 3207528 - DNA, 14 bp, Homo sapiens
agatgatgagaatt

SEQ ID NO: 3207529 - DNA, 18 bp, Homo sapiens
agatgatgagaatttcta

SEQ ID NO: 3207530 - DNA, 20 bp, Homo sapiens
agatgatgagaatttctaaa

SEQ ID NO: 3207531 - DNA, 16 bp, Homo sapiens
agatgatggatgccaa

SEQ ID NO: 3207532 - DNA, 19 bp, Homo sapiens
agatgatggatgccaatat

SEQ ID NO: 3207533 - DNA, 19 bp, Homo sapiens
agatgattaaataagattc

SEQ ID NO: 3207534 - DNA, 22 bp, Homo sapiens
agatgattaaataagattctaa

SEQ ID NO: 3207535 - DNA, 21 bp, Homo sapiens
agatgattctggctgaaaaag

SEQ ID NO: 3207536 - DNA, 16 bp, Homo sapiens
agatgcaacctcacta

SEQ ID NO: 3207537 - DNA, 19 bp, Homo sapiens
agatgcaacctcactatgg

SEQ ID NO: 3207538 - DNA, 17 bp, Homo sapiens
agatgcaaggaccagga

SEQ ID NO: 3207539 - DNA, 20 bp, Homo sapiens
agatgcaaggaccaggactc

SEQ ID NO: 3207540 - DNA, 18 bp, Homo sapiens
agatgcaccaccaagcca

SEQ ID NO: 3207541 - DNA, 23 bp, Homo sapiens
agatgcaccaccaagccaaggga

SEQ ID NO: 3207542 - DNA, 22 bp, Homo sapiens
agatgcactgaaaacttagcca

SEQ ID NO: 3207543 - DNA, 15 bp, Homo sapiens
agatgcagagagcca

SEQ ID NO: 3207544 - DNA, 17 bp, Homo sapiens
agatgcaggacaggagg

SEQ ID NO: 3207545 - DNA, 18 bp, Homo sapiens
agatgcaggacaggaggc

SEQ ID NO: 3207546 - DNA, 21 bp, Homo sapiens
agatgcatcgggaaagaagaa

SEQ ID NO: 3207547 - DNA, 22 bp, Homo sapiens
agatgcatcgggaaagaagaaa

SEQ ID NO: 3207548 - DNA, 15 bp, Homo sapiens
agatgccattcatag

SEQ ID NO: 3207549 - DNA, 16 bp, Homo sapiens
agatgccattcataga

SEQ ID NO: 3207550 - DNA, 21 bp, Homo sapiens
agatgcccagagggcccaggc

SEQ ID NO: 3207551 - DNA, 22 bp, Homo sapiens
agatgcccagagggcccaggca

SEQ ID NO: 3207552 - DNA, 21 bp, Homo sapiens
agatgccctttggaaagccat

SEQ ID NO: 3207553 - DNA, 16 bp, Homo sapiens
agatgccgcatttgga

SEQ ID NO: 3207554 - DNA, 13 bp, Homo sapiens
agatgctccaaga

SEQ ID NO: 3207555 - DNA, 18 bp, Homo sapiens
agatgctccaagattcta

SEQ ID NO: 3207556 - DNA, 13 bp, Homo sapiens
agatgctgaatat

SEQ ID NO: 3207557 - DNA, 18 bp, Homo sapiens
agatgctggagaagagag

SEQ ID NO: 3207558 - DNA, 20 bp, Homo sapiens
agatgctgtgagtctttggt

SEQ ID NO: 3207559 - DNA, 21 bp, Homo sapiens
agatggaaaaataacaactat

SEQ ID NO: 3207560 - DNA, 16 bp, Homo sapiens
agatggaaaaatgtga

SEQ ID NO: 3207561 - DNA, 22 bp, Homo sapiens
agatggaaaattcattttttaa

SEQ ID NO: 3207562 - DNA, 13 bp, Homo sapiens
agatggaaagagg

SEQ ID NO: 3207563 - DNA, 22 bp, Homo sapiens
agatggaaatttttacctttat

SEQ ID NO: 3207564 - DNA, 22 bp, Homo sapiens
agatggaagttgcagtgagctg

SEQ ID NO: 3207565 - DNA, 23 bp, Homo sapiens
agatggaagttgcagtgagctga

SEQ ID NO: 3207566 - DNA, 22 bp, Homo sapiens
agatggactaattgacttgcaa

SEQ ID NO: 3207567 - DNA, 17 bp, Homo sapiens
agatggagggcttggcc

SEQ ID NO: 3207568 - DNA, 15 bp, Homo sapiens
agatggagtttctaa

SEQ ID NO: 3207569 - DNA, 16 bp, Homo sapiens
agatggagtttctaag

SEQ ID NO: 3207570 - DNA, 17 bp, Homo sapiens
agatggagtttctaagg

SEQ ID NO: 3207571 - DNA, 18 bp, Homo sapiens
agatggagtttctaaggt

SEQ ID NO: 3207572 - DNA, 15 bp, Homo sapiens
agatggataaactga

SEQ ID NO: 3207573 - DNA, 20 bp, Homo sapiens
agatggataaactgagcctc

SEQ ID NO: 3207574 - DNA, 20 bp, Homo sapiens
agatggatttgcctgtgcca

SEQ ID NO: 3207575 - DNA, 16 bp, Homo sapiens
agatggcaaatgacca

SEQ ID NO: 3207576 - DNA, 14 bp, Homo sapiens
agatggcactttga

SEQ ID NO: 3207577 - DNA, 16 bp, Homo sapiens
agatggccataggaga

SEQ ID NO: 3207578 - DNA, 14 bp, Homo sapiens
agatggcctttgct

SEQ ID NO: 3207579 - DNA, 14 bp, Homo sapiens
agatggctgtgcct

SEQ ID NO: 3207580 - DNA, 17 bp, Homo sapiens
agatggctgtgcctctg

SEQ ID NO: 3207581 - DNA, 18 bp, Homo sapiens
agatgggaatgaggtggg

SEQ ID NO: 3207582 - DNA, 18 bp, Homo sapiens
agatgggcttgttttctt

SEQ ID NO: 3207583 - DNA, 22 bp, Homo sapiens
agcatcgggagcacccagagca

SEQ ID NO: 3207584 - DNA, 12 bp, Homo sapiens
agcatctaagtt

SEQ ID NO: 3207585 - DNA, 20 bp, Homo sapiens
agcatctcagcctaccatga

SEQ ID NO: 3207586 - DNA, 18 bp, Homo sapiens
agcatctggctctaattc

SEQ ID NO: 3207587 - DNA, 23 bp, Homo sapiens
agcatcttcacttctaaatgcat

SEQ ID NO: 3207588 - DNA, 19 bp, Homo sapiens
agcatcttgggggggtggc

SEQ ID NO: 3207589 - DNA, 23 bp, Homo sapiens
agcatcttgggggggtggccgct

SEQ ID NO: 3207590 - DNA, 21 bp, Homo sapiens
agcatgaataaaacactcatc

SEQ ID NO: 3207591 - DNA, 15 bp, Homo sapiens
agcatgacaactttt

SEQ ID NO: 3207592 - DNA, 20 bp, Homo sapiens
agcatgacaacttttaaaga

SEQ ID NO: 3207593 - DNA, 22 bp, Homo sapiens
agcatgacctgtgaccagcact

SEQ ID NO: 3207594 - DNA, 23 bp, Homo sapiens
agcatgacctgtgaccagcactg

SEQ ID NO: 3207595 - DNA, 23 bp, Homo sapiens
agcatgactatgtatttttctat

SEQ ID NO: 3207596 - DNA, 13 bp, Homo sapiens
agcatgatgggaa

SEQ ID NO: 3207597 - DNA, 17 bp, Homo sapiens
agcatgatgggaaaata

SEQ ID NO: 3207598 - DNA, 19 bp, Homo sapiens
agcatgattctttaataga

SEQ ID NO: 3207599 - DNA, 16 bp, Homo sapiens
agcatgcacaaagtgt

SEQ ID NO: 3207600 - DNA, 17 bp, Homo sapiens
agcatgcagctttgcaa

SEQ ID NO: 3207601 - DNA, 19 bp, Homo sapiens
agcatgccccttggctgga

SEQ ID NO: 3207602 - DNA, 23 bp, Homo sapiens
agcatgcttgggctgacccagca

SEQ ID NO: 3207603 - DNA, 16 bp, Homo sapiens
agcatgctttgctgct

SEQ ID NO: 3207604 - DNA, 19 bp, Homo sapiens
agcatgctttgctgctatg

SEQ ID NO: 3207605 - DNA, 13 bp, Homo sapiens
agcatggaaaaat

SEQ ID NO: 3207606 - DNA, 16 bp, Homo sapiens
agcatggaaaaatggt

SEQ ID NO: 3207607 - DNA, 17 bp, Homo sapiens
agcatggacatttagaa

SEQ ID NO: 3207608 - DNA, 20 bp, Homo sapiens
agcatggagagaggcctgtg

SEQ ID NO: 3207609 - DNA, 21 bp, Homo sapiens
agcatggaggaggagggaggc

SEQ ID NO: 3207610 - DNA, 18 bp, Homo sapiens
agcatggatgcatttcaa

SEQ ID NO: 3207611 - DNA, 20 bp, Homo sapiens
agcatggatgcatttcaaat

SEQ ID NO: 3207612 - DNA, 21 bp, Homo sapiens
agcatggatgcatttcaaatg

SEQ ID NO: 3207613 - DNA, 22 bp, Homo sapiens
agcatggatgcatttcaaatgt

SEQ ID NO: 3207614 - DNA, 13 bp, Homo sapiens
agcatggcagctg

SEQ ID NO: 3207615 - DNA, 17 bp, Homo sapiens
agcatggcatagccccg

SEQ ID NO: 3207616 - DNA, 20 bp, Homo sapiens
agcatggcatagccccggcc

SEQ ID NO: 3207617 - DNA, 17 bp, Homo sapiens
agcatgtctattcagct

SEQ ID NO: 3207618 - DNA, 13 bp, Homo sapiens
agcatgtgtcaga

SEQ ID NO: 3207619 - DNA, 15 bp, Homo sapiens
agcatgtgtcagagt

SEQ ID NO: 3207620 - DNA, 16 bp, Homo sapiens
agcatgtgtcagagtg

SEQ ID NO: 3207621 - DNA, 16 bp, Homo sapiens
agcatgtgtcccagga

SEQ ID NO: 3207622 - DNA, 16 bp, Homo sapiens
agcatgtgttgaaaaa

SEQ ID NO: 3207623 - DNA, 16 bp, Homo sapiens
agcatgttaactttat

SEQ ID NO: 3207624 - DNA, 21 bp, Homo sapiens
agcatgttgagccaggcctgg

SEQ ID NO: 3207625 - DNA, 21 bp, Homo sapiens
agcatgtttcatgttttgtga

SEQ ID NO: 3207626 - DNA, 16 bp, Homo sapiens
agcatgtttgctgaac

SEQ ID NO: 3207627 - DNA, 20 bp, Homo sapiens
agcatgtttgctgaacacct

SEQ ID NO: 3207628 - DNA, 19 bp, Homo sapiens
agcatgttttgtatacaaa

SEQ ID NO: 3207629 - DNA, 20 bp, Homo sapiens
agcattcatttgttttttca

SEQ ID NO: 3207630 - DNA, 16 bp, Homo sapiens
agcattccagacttca

SEQ ID NO: 3207631 - DNA, 20 bp, Homo sapiens
agcattccagacttcaaaaa

SEQ ID NO: 3207632 - DNA, 16 bp, Homo sapiens
agcattccagtaactt

SEQ ID NO: 3207633 - DNA, 22 bp, Homo sapiens
agcattccagtaacttttttgt

SEQ ID NO: 3207634 - DNA, 17 bp, Homo sapiens
agcattccttctttgat

SEQ ID NO: 3207635 - DNA, 18 bp, Homo sapiens
agcattccttctttgata

SEQ ID NO: 3207636 - DNA, 21 bp, Homo sapiens
agcattccttctttgataatg

SEQ ID NO: 3207637 - DNA, 23 bp, Homo sapiens
agcattccttctttgataatgtt

SEQ ID NO: 3207638 - DNA, 24 bp, Homo sapiens
agcattccttctttgataatgtta

SEQ ID NO: 3207639 - DNA, 22 bp, Homo sapiens
agcattctcactcctacctggt

SEQ ID NO: 3207640 - DNA, 17 bp, Homo sapiens
agcattctccccagtgt

SEQ ID NO: 3207641 - DNA, 16 bp, Homo sapiens
agcattcttgtcacaa

SEQ ID NO: 3207642 - DNA, 20 bp, Homo sapiens
agcattcttgtcacaataaa

SEQ ID NO: 3207643 - DNA, 15 bp, Homo sapiens
agcattctttaacag

SEQ ID NO: 3207644 - DNA, 16 bp, Homo sapiens
agcattgaaattatag

SEQ ID NO: 3207645 - DNA, 18 bp, Homo sapiens
agcattgataatcttcag

SEQ ID NO: 3207646 - DNA, 16 bp, Homo sapiens
agcattgctttctgaa

SEQ ID NO: 3207647 - DNA, 21 bp, Homo sapiens
agcattgcttttattttgaaa

SEQ ID NO: 3207648 - DNA, 22 bp, Homo sapiens
agcattgtaaaattatttcatg

SEQ ID NO: 3207649 - DNA, 13 bp, Homo sapiens
agcattgtctctc

SEQ ID NO: 3207650 - DNA, 17 bp, Homo sapiens
agcattgtcttgttctg

SEQ ID NO: 3207651 - DNA, 18 bp, Homo sapiens
agcattgtcttgttctgt

SEQ ID NO: 3207652 - DNA, 18 bp, Homo sapiens
agcattgtctttgctgta

SEQ ID NO: 3207653 - DNA, 19 bp, Homo sapiens
agcattgtctttgctgtac

SEQ ID NO: 3207654 - DNA, 22 bp, Homo sapiens
agcattgtttgcttattgttcc

SEQ ID NO: 3207655 - DNA, 20 bp, Homo sapiens
agcatttaatggcagctagt

SEQ ID NO: 3207656 - DNA, 14 bp, Homo sapiens
agcatttataaatt

SEQ ID NO: 3207657 - DNA, 20 bp, Homo sapiens
agcatttcattcttctctag

SEQ ID NO: 3207658 - DNA, 21 bp, Homo sapiens
agcatttcattcttctctagc

SEQ ID NO: 3207659 - DNA, 17 bp, Homo sapiens
agcatttccaacaccac

SEQ ID NO: 3207660 - DNA, 21 bp, Homo sapiens
agcatttccaacaccacagac

SEQ ID NO: 3207661 - DNA, 13 bp, Homo sapiens
agcatttgtattt

SEQ ID NO: 3207662 - DNA, 15 bp, Homo sapiens
agcattttaattctc

SEQ ID NO: 3207663 - DNA, 23 bp, Homo sapiens
agcattttagcaatttatacaat

SEQ ID NO: 3207664 - DNA, 19 bp, Homo sapiens
agcattttatatccacatc

SEQ ID NO: 3207665 - DNA, 14 bp, Homo sapiens
agcatttttaaggg

SEQ ID NO: 3207666 - DNA, 16 bp, Homo sapiens
agcatttttgatttat

SEQ ID NO: 3207667 - DNA, 13 bp, Homo sapiens
agccaaacaagcc

SEQ ID NO: 3207668 - DNA, 18 bp, Homo sapiens
agccaaacaagccttagc

SEQ ID NO: 3207669 - DNA, 14 bp, Homo sapiens
agccaaaccctgtc

SEQ ID NO: 3207670 - DNA, 14 bp, Homo sapiens
agccaaactctgcc

SEQ ID NO: 3207671 - DNA, 15 bp, Homo sapiens
agccaaactctgcca

SEQ ID NO: 3207672 - DNA, 15 bp, Homo sapiens
agccaaagaaacaag

SEQ ID NO: 3207673 - DNA, 21 bp, Homo sapiens
agccaaagaaacaagctgtgc

SEQ ID NO: 3207674 - DNA, 19 bp, Homo sapiens
agccaaagaaatgaacatt

SEQ ID NO: 3207675 - DNA, 16 bp, Homo sapiens
agccaaagctaggcct

SEQ ID NO: 3207676 - DNA, 18 bp, Homo sapiens
agccaaagctaggcctgg

SEQ ID NO: 3207677 - DNA, 20 bp, Homo sapiens
agccaaagctaggcctggcc

SEQ ID NO: 3207678 - DNA, 12 bp, Homo sapiens
agccaaatttaa

SEQ ID NO: 3207679 - DNA, 19 bp, Homo sapiens
agccaaatttaaaactgtt

SEQ ID NO: 3207680 - DNA, 16 bp, Homo sapiens
agccaaatttatcaaa

SEQ ID NO: 3207681 - DNA, 18 bp, Homo sapiens
agccaacagaagcttcca

SEQ ID NO: 3207682 - DNA, 20 bp, Homo sapiens
agccaaccttcaaagaaact

SEQ ID NO: 3207683 - DNA, 16 bp, Homo sapiens
agccaactagcccctg

SEQ ID NO: 3207684 - DNA, 17 bp, Homo sapiens
agccaactagcccctgg

SEQ ID NO: 3207685 - DNA, 18 bp, Homo sapiens
agccaactctaacaggca

SEQ ID NO: 3207686 - DNA, 13 bp, Homo sapiens
agccaactgctgc

SEQ ID NO: 3207687 - DNA, 21 bp, Homo sapiens
agccaactgctgctttttgag

SEQ ID NO: 3207688 - DNA, 17 bp, Homo sapiens
agccaactgtttccctg

SEQ ID NO: 3207689 - DNA, 15 bp, Homo sapiens
agccaacttgtaaat

SEQ ID NO: 3207690 - DNA, 20 bp, Homo sapiens
agccaacttgtaaatacacc

SEQ ID NO: 3207691 - DNA, 20 bp, Homo sapiens
agccaagattttcctcttgt

SEQ ID NO: 3207692 - DNA, 17 bp, Homo sapiens
agccaagctccctggag

SEQ ID NO: 3207693 - DNA, 19 bp, Homo sapiens
agccaagctccctggagcc

SEQ ID NO: 3207694 - DNA, 20 bp, Homo sapiens
agccaagctccctggagccc

SEQ ID NO: 3207695 - DNA, 21 bp, Homo sapiens
agccaagcttgttatcagctt

SEQ ID NO: 3207696 - DNA, 15 bp, Homo sapiens
agccaagctttaaat

SEQ ID NO: 3207697 - DNA, 22 bp, Homo sapiens
agccaagctttaaattatgtga

SEQ ID NO: 3207698 - DNA, 15 bp, Homo sapiens
agccaaggaggcctg

SEQ ID NO: 3207699 - DNA, 20 bp, Homo sapiens
agccaaggccgaagctctgg

SEQ ID NO: 3207700 - DNA, 22 bp, Homo sapiens
agccaaggccgaagctctggct

SEQ ID NO: 3207701 - DNA, 16 bp, Homo sapiens
agccaagggaaagggg

SEQ ID NO: 3207702 - DNA, 19 bp, Homo sapiens
agccaagggaacctgtgtc

SEQ ID NO: 3207703 - DNA, 19 bp, Homo sapiens
agccaaggtgggctgagcc

SEQ ID NO: 3207704 - DNA, 13 bp, Homo sapiens
agccaagtggggt

SEQ ID NO: 3207705 - DNA, 20 bp, Homo sapiens
agccaagtggggtgctggga

SEQ ID NO: 3207706 - DNA, 20 bp, Homo sapiens
agccaatattaaaagagacc

SEQ ID NO: 3207707 - DNA, 15 bp, Homo sapiens
agccatggctcaggc

SEQ ID NO: 3207708 - DNA, 16 bp, Homo sapiens
agccatggctcaggca

SEQ ID NO: 3207709 - DNA, 19 bp, Homo sapiens
agccatggctcaggcaagc

SEQ ID NO: 3207710 - DNA, 22 bp, Homo sapiens
agccatggctcaggcaagcccc

SEQ ID NO: 3207711 - DNA, 18 bp, Homo sapiens
agccatgggcctgggcct

SEQ ID NO: 3207712 - DNA, 20 bp, Homo sapiens
agccatgggcctgggcctgc

SEQ ID NO: 3207713 - DNA, 17 bp, Homo sapiens
agccattaaatgaatat

SEQ ID NO: 3207714 - DNA, 18 bp, Homo sapiens
agccattaaatgaatatt

SEQ ID NO: 3207715 - DNA, 18 bp, Homo sapiens
agccattaccatggagac

SEQ ID NO: 3207716 - DNA, 17 bp, Homo sapiens
agccatttccccctcct

SEQ ID NO: 3207717 - DNA, 12 bp, Homo sapiens
agccatttgaga

SEQ ID NO: 3207718 - DNA, 17 bp, Homo sapiens
agccattttgtgaatgg

SEQ ID NO: 3207719 - DNA, 14 bp, Homo sapiens
agccatttttaatg

SEQ ID NO: 3207720 - DNA, 16 bp, Homo sapiens
agcccaaagctgttgg

SEQ ID NO: 3207721 - DNA, 23 bp, Homo sapiens
agcccaaaggggacaggcctcac

SEQ ID NO: 3207722 - DNA, 20 bp, Homo sapiens
agcccaagaggtctgagccc

SEQ ID NO: 3207723 - DNA, 23 bp, Homo sapiens
agcccaaggtgctgatgtcaaag

SEQ ID NO: 3207724 - DNA, 23 bp, Homo sapiens
agcccaagttcatgcagctgtgg

SEQ ID NO: 3207725 - DNA, 16 bp, Homo sapiens
agcccaataaacctct

SEQ ID NO: 3207726 - DNA, 16 bp, Homo sapiens
agcccaatgaaatgaa

SEQ ID NO: 3207727 - DNA, 17 bp, Homo sapiens
agcccacaaagccttat

SEQ ID NO: 3207728 - DNA, 16 bp, Homo sapiens
agcccacactatgcac

SEQ ID NO: 3207729 - DNA, 18 bp, Homo sapiens
agcccacactatgcacag

SEQ ID NO: 3207730 - DNA, 19 bp, Homo sapiens
agcccacactatgcacaga

SEQ ID NO: 3207731 - DNA, 20 bp, Homo sapiens
agcccacactatgcacagag

SEQ ID NO: 3207732 - DNA, 12 bp, Homo sapiens
agcccacagcac

SEQ ID NO: 3207733 - DNA, 14 bp, Homo sapiens
agcccaccctgctg

SEQ ID NO: 3207734 - DNA, 14 bp, Homo sapiens
agcccaccttggct

SEQ ID NO: 3207735 - DNA, 16 bp, Homo sapiens
agcccaccttggctca

SEQ ID NO: 3207736 - DNA, 19 bp, Homo sapiens
agcccactgcccaccccct

SEQ ID NO: 3207737 - DNA, 15 bp, Homo sapiens
agcccacttctgcca

SEQ ID NO: 3207738 - DNA, 17 bp, Homo sapiens
agcccagaacaaaaaga

SEQ ID NO: 3207739 - DNA, 20 bp, Homo sapiens
agcccagaacaaaaagaaat

SEQ ID NO: 3207740 - DNA, 12 bp, Homo sapiens
agcccagaagaa

SEQ ID NO: 3207741 - DNA, 14 bp, Homo sapiens
agcccagagaacag

SEQ ID NO: 3207742 - DNA, 13 bp, Homo sapiens
agcccagagccac

SEQ ID NO: 3207743 - DNA, 14 bp, Homo sapiens
agcccagagccacc

SEQ ID NO: 3207744 - DNA, 18 bp, Homo sapiens
agcccagagccacctgga

SEQ ID NO: 3207745 - DNA, 17 bp, Homo sapiens
agcccagaggtaacaga

SEQ ID NO: 3207746 - DNA, 20 bp, Homo sapiens
agcccagatggaaagacgtt

SEQ ID NO: 3207747 - DNA, 20 bp, Homo sapiens
agcccagcagggcctcaaag

SEQ ID NO: 3207748 - DNA, 15 bp, Homo sapiens
agcccagccaggcca

SEQ ID NO: 3207749 - DNA, 23 bp, Homo sapiens
agcccagccattaccatggagac

SEQ ID NO: 3207750 - DNA, 17 bp, Homo sapiens
agcccagcctgggagcc

SEQ ID NO: 3207751 - DNA, 17 bp, Homo sapiens
agcccagcgctctgcct

SEQ ID NO: 3207752 - DNA, 13 bp, Homo sapiens
agcccaggagaga

SEQ ID NO: 3207753 - DNA, 19 bp, Homo sapiens
agcccaggagagagaaagc

SEQ ID NO: 3207754 - DNA, 19 bp, Homo sapiens
agcccaggatactggcaca

SEQ ID NO: 3207755 - DNA, 17 bp, Homo sapiens
agcccaggcatctcctt

SEQ ID NO: 3207756 - DNA, 21 bp, Homo sapiens
agcccaggcatctccttgggc

SEQ ID NO: 3207757 - DNA, 13 bp, Homo sapiens
agcccaggcccct

SEQ ID NO: 3207758 - DNA, 13 bp, Homo sapiens
agcccaggccgtt

SEQ ID NO: 3207759 - DNA, 21 bp, Homo sapiens
agcccaggccgttccccttgg

SEQ ID NO: 3207760 - DNA, 23 bp, Homo sapiens
agcccaggccgttccccttggct

SEQ ID NO: 3207761 - DNA, 19 bp, Homo sapiens
agcccaggctgatgcttga

SEQ ID NO: 3207762 - DNA, 15 bp, Homo sapiens
agcccagggctcctg

SEQ ID NO: 3207763 - DNA, 17 bp, Homo sapiens
agcccagggctcctgca

SEQ ID NO: 3207764 - DNA, 17 bp, Homo sapiens
agcccaggtcagctgtt

SEQ ID NO: 3207765 - DNA, 22 bp, Homo sapiens
agcccaggtgccagcctgaggc

SEQ ID NO: 3207766 - DNA, 18 bp, Homo sapiens
agcccagtagaccttgtt

SEQ ID NO: 3207767 - DNA, 17 bp, Homo sapiens
agcccagtgaagcctct

SEQ ID NO: 3207768 - DNA, 22 bp, Homo sapiens
agcccatccatagtaactgaca

SEQ ID NO: 3207769 - DNA, 21 bp, Homo sapiens
agcccatccattaggccagca

SEQ ID NO: 3207770 - DNA, 17 bp, Homo sapiens
agcccatgagtccttga

SEQ ID NO: 3207771 - DNA, 16 bp, Homo sapiens
agcccatgcccacctg

SEQ ID NO: 3207772 - DNA, 16 bp, Homo sapiens
agcccatggcccccaa

SEQ ID NO: 3207773 - DNA, 17 bp, Homo sapiens
agcccatggcccccaat

SEQ ID NO: 3207774 - DNA, 16 bp, Homo sapiens
agcccatggccctgtg

SEQ ID NO: 3207775 - DNA, 17 bp, Homo sapiens
agcccatgttctgcccc

SEQ ID NO: 3207776 - DNA, 19 bp, Homo sapiens
agcccatgttctgccccca

SEQ ID NO: 3207777 - DNA, 21 bp, Homo sapiens
agcccatgttctgcccccagc

SEQ ID NO: 3207778 - DNA, 22 bp, Homo sapiens
agcccatgttctgcccccagcc

SEQ ID NO: 3207779 - DNA, 13 bp, Homo sapiens
agccccaacggga

SEQ ID NO: 3207780 - DNA, 17 bp, Homo sapiens
agccccaacgggaaagg

SEQ ID NO: 3207781 - DNA, 16 bp, Homo sapiens
agccccacccaggagg

SEQ ID NO: 3207782 - DNA, 17 bp, Homo sapiens
agccccacccccagcca

SEQ ID NO: 3207783 - DNA, 22 bp, Homo sapiens
agccccacccccagccaggcta

SEQ ID NO: 3207784 - DNA, 18 bp, Homo sapiens
agcctgcaaactcactgc

SEQ ID NO: 3207785 - DNA, 21 bp, Homo sapiens
agcctgcaatttcatatgctg

SEQ ID NO: 3207786 - DNA, 21 bp, Homo sapiens
agcctgcatcccaggatgctg

SEQ ID NO: 3207787 - DNA, 22 bp, Homo sapiens
agcctgcattgagcttgcatgc

SEQ ID NO: 3207788 - DNA, 22 bp, Homo sapiens
agcctgcccaagcccaggccac

SEQ ID NO: 3207789 - DNA, 14 bp, Homo sapiens
agcctgccctccag

SEQ ID NO: 3207790 - DNA, 15 bp, Homo sapiens
agcctgccctccagc

SEQ ID NO: 3207791 - DNA, 18 bp, Homo sapiens
agcctgccctccagctgc

SEQ ID NO: 3207792 - DNA, 14 bp, Homo sapiens
agcctgcccttgtc

SEQ ID NO: 3207793 - DNA, 23 bp, Homo sapiens
agcctgcccttgtctgagatgct

SEQ ID NO: 3207794 - DNA, 17 bp, Homo sapiens
agcctgcctaaccaggc

SEQ ID NO: 3207795 - DNA, 20 bp, Homo sapiens
agcctgcctaaccaggccca

SEQ ID NO: 3207796 - DNA, 22 bp, Homo sapiens
agcctgcctaaccaggcccagc

SEQ ID NO: 3207797 - DNA, 13 bp, Homo sapiens
agcctgcctcagt

SEQ ID NO: 3207798 - DNA, 15 bp, Homo sapiens
agcctgcctcagtgg

SEQ ID NO: 3207799 - DNA, 18 bp, Homo sapiens
agcctgcctcagtggcag

SEQ ID NO: 3207800 - DNA, 18 bp, Homo sapiens
agcctgcgctcggcagga

SEQ ID NO: 3207801 - DNA, 20 bp, Homo sapiens
agcctgcgctcggcaggaag

SEQ ID NO: 3207802 - DNA, 21 bp, Homo sapiens
agcctgcgctcggcaggaagg

SEQ ID NO: 3207803 - DNA, 15 bp, Homo sapiens
agcctgctgagagcc

SEQ ID NO: 3207804 - DNA, 17 bp, Homo sapiens
agcctgctgagagcccc

SEQ ID NO: 3207805 - DNA, 11 bp, Homo sapiens
agcctgctgca

SEQ ID NO: 3207806 - DNA, 12 bp, Homo sapiens
agcctgctgcat

SEQ ID NO: 3207807 - DNA, 13 bp, Homo sapiens
agcctgctgccca

SEQ ID NO: 3207808 - DNA, 17 bp, Homo sapiens
agcctgctgcccaggct

SEQ ID NO: 3207809 - DNA, 10 bp, Homo sapiens
agcctgctgg

SEQ ID NO: 3207810 - DNA, 11 bp, Homo sapiens
agcctgctggc

SEQ ID NO: 3207811 - DNA, 18 bp, Homo sapiens
agcctgctggcacccacc

SEQ ID NO: 3207812 - DNA, 12 bp, Homo sapiens
agcctgctggct

SEQ ID NO: 3207813 - DNA, 15 bp, Homo sapiens
agcctgctggctgcg

SEQ ID NO: 3207814 - DNA, 20 bp, Homo sapiens
agcggggacagctccttctg

SEQ ID NO: 3207815 - DNA, 21 bp, Homo sapiens
agcggggccccagggctaccc

SEQ ID NO: 3207816 - DNA, 17 bp, Homo sapiens
agcggtccctgtccctc

SEQ ID NO: 3207817 - DNA, 13 bp, Homo sapiens
agcggtctcaggc

SEQ ID NO: 3207818 - DNA, 23 bp, Homo sapiens
agcggtctcaggctggtgggagg

SEQ ID NO: 3207819 - DNA, 12 bp, Homo sapiens
agcggtggccct

SEQ ID NO: 3207820 - DNA, 23 bp, Homo sapiens
agcgtcagggttggtgtgctgag

SEQ ID NO: 3207821 - DNA, 20 bp, Homo sapiens
agcgtcccctgctactcctg

SEQ ID NO: 3207822 - DNA, 17 bp, Homo sapiens
agcgtcctcgttcaaaa

SEQ ID NO: 3207823 - DNA, 23 bp, Homo sapiens
agcgtcctcgttcaaaacattcc

SEQ ID NO: 3207824 - DNA, 19 bp, Homo sapiens
agcgtctttaagagactca

SEQ ID NO: 3207825 - DNA, 22 bp, Homo sapiens
agcgtctttaagagactcactg

SEQ ID NO: 3207826 - DNA, 12 bp, Homo sapiens
agcgtgaaggac

SEQ ID NO: 3207827 - DNA, 15 bp, Homo sapiens
agcgtgagccactgc

SEQ ID NO: 3207828 - DNA, 17 bp, Homo sapiens
agcgtggctgtgctctc

SEQ ID NO: 3207829 - DNA, 13 bp, Homo sapiens
agcgtgtgtatcc

SEQ ID NO: 3207830 - DNA, 23 bp, Homo sapiens
agcgtgtgtatccgactctaagc

SEQ ID NO: 3207831 - DNA, 17 bp, Homo sapiens
agcgttaagggcagagt

SEQ ID NO: 3207832 - DNA, 15 bp, Homo sapiens
agcgttctctgtcct

SEQ ID NO: 3207833 - DNA, 17 bp, Homo sapiens
agcgtttctttacttct

SEQ ID NO: 3207834 - DNA, 21 bp, Homo sapiens
agcgtttgaggggctggcctt

SEQ ID NO: 3207835 - DNA, 14 bp, Homo sapiens
agcgtttttctcaa

SEQ ID NO: 3207836 - DNA, 12 bp, Homo sapiens
agctaaaaatat

SEQ ID NO: 3207837 - DNA, 18 bp, Homo sapiens
agctaacattttaaataa

SEQ ID NO: 3207838 - DNA, 23 bp, Homo sapiens
agctaacattttaaataaaagaa

SEQ ID NO: 3207839 - DNA, 13 bp, Homo sapiens
agctaaccctagt

SEQ ID NO: 3207840 - DNA, 16 bp, Homo sapiens
agctaactgtaaatca

SEQ ID NO: 3207841 - DNA, 14 bp, Homo sapiens
agctaagaaaagat

SEQ ID NO: 3207842 - DNA, 17 bp, Homo sapiens
agctaagctaggaatga

SEQ ID NO: 3207843 - DNA, 18 bp, Homo sapiens
agctaagctaggaatgaa

SEQ ID NO: 3207844 - DNA, 18 bp, Homo sapiens
agctaaggctctatgagt

SEQ ID NO: 3207845 - DNA, 23 bp, Homo sapiens
agctaagggtgggtgctcagaat

SEQ ID NO: 3207846 - DNA, 16 bp, Homo sapiens
agctaatcagcattct

SEQ ID NO: 3207847 - DNA, 14 bp, Homo sapiens
agctaatgggacac

SEQ ID NO: 3207848 - DNA, 16 bp, Homo sapiens
agctaatttatagcaa

SEQ ID NO: 3207849 - DNA, 14 bp, Homo sapiens
agctaatttgcatt

SEQ ID NO: 3207850 - DNA, 22 bp, Homo sapiens
agctaatttgcattaaattcac

SEQ ID NO: 3207851 - DNA, 23 bp, Homo sapiens
agctacagagccgagcaatattt

SEQ ID NO: 3207852 - DNA, 22 bp, Homo sapiens
agctacaggaagcaccccatgc

SEQ ID NO: 3207853 - DNA, 18 bp, Homo sapiens
agctacagtgcatagttg

SEQ ID NO: 3207854 - DNA, 16 bp, Homo sapiens
agctaccccttctttg

SEQ ID NO: 3207855 - DNA, 21 bp, Homo sapiens
agctacctgagacgggcatcg

SEQ ID NO: 3207856 - DNA, 14 bp, Homo sapiens
agctactaaaatca

SEQ ID NO: 3207857 - DNA, 18 bp, Homo sapiens
agctactcagaagcctga

SEQ ID NO: 3207858 - DNA, 19 bp, Homo sapiens
agctactcagaagcctgag

SEQ ID NO: 3207859 - DNA, 23 bp, Homo sapiens
agctactctccccacgagggctg

SEQ ID NO: 3207860 - DNA, 12 bp, Homo sapiens
agctactctgtc

SEQ ID NO: 3207861 - DNA, 14 bp, Homo sapiens
agctactctgtcca

SEQ ID NO: 3207862 - DNA, 19 bp, Homo sapiens
agctactctgtccaggcca

SEQ ID NO: 3207863 - DNA, 22 bp, Homo sapiens
agctactctgtccaggccactg

SEQ ID NO: 3207864 - DNA, 16 bp, Homo sapiens
agctactgtatgcaaa

SEQ ID NO: 3207865 - DNA, 15 bp, Homo sapiens
agctactgtgtgtgt

SEQ ID NO: 3207866 - DNA, 20 bp, Homo sapiens
agctactgtgtgtgtgaatg

SEQ ID NO: 3207867 - DNA, 17 bp, Homo sapiens
agctacttaagagaaat

SEQ ID NO: 3207868 - DNA, 18 bp, Homo sapiens
agctacttaagagaaatg

SEQ ID NO: 3207869 - DNA, 21 bp, Homo sapiens
agctacttaagagaaatggca

SEQ ID NO: 3207870 - DNA, 22 bp, Homo sapiens
agctacttgggaagctgaggcg

SEQ ID NO: 3207871 - DNA, 18 bp, Homo sapiens
agctacttgggaggctga

SEQ ID NO: 3207872 - DNA, 14 bp, Homo sapiens
agctacttggtttg

SEQ ID NO: 3207873 - DNA, 16 bp, Homo sapiens
agctacttggtttgtg

SEQ ID NO: 3207874 - DNA, 17 bp, Homo sapiens
agctacttggtttgtgt

SEQ ID NO: 3207875 - DNA, 21 bp, Homo sapiens
agctacttggtttgtgttctt

SEQ ID NO: 3207876 - DNA, 13 bp, Homo sapiens
agctactttccat

SEQ ID NO: 3207877 - DNA, 16 bp, Homo sapiens
agctactttccatttg

SEQ ID NO: 3207878 - DNA, 21 bp, Homo sapiens
agctactttccatttggtatt

SEQ ID NO: 3207879 - DNA, 15 bp, Homo sapiens
agctagaaatatgat

SEQ ID NO: 3207880 - DNA, 20 bp, Homo sapiens
agctagccagagggtgggag

SEQ ID NO: 3207881 - DNA, 17 bp, Homo sapiens
agctagcctgaaggatt

SEQ ID NO: 3207882 - DNA, 15 bp, Homo sapiens
agctagcgatttcag

SEQ ID NO: 3207883 - DNA, 23 bp, Homo sapiens
agctagctctttggtctattttc

SEQ ID NO: 3207884 - DNA, 15 bp, Homo sapiens
agctagcttttagga

SEQ ID NO: 3207885 - DNA, 12 bp, Homo sapiens
agctaggaatga

SEQ ID NO: 3207886 - DNA, 15 bp, Homo sapiens
agctaggactgagga

SEQ ID NO: 3207887 - DNA, 17 bp, Homo sapiens
agctaggactgaggagt

SEQ ID NO: 3207888 - DNA, 15 bp, Homo sapiens
agctaggccccagag

SEQ ID NO: 3207889 - DNA, 18 bp, Homo sapiens
agctaggccccagaggcc

SEQ ID NO: 3207890 - DNA, 21 bp, Homo sapiens
agctaggccccagaggccctg

SEQ ID NO: 3207891 - DNA, 15 bp, Homo sapiens
agctaggcctggcca

SEQ ID NO: 3207892 - DNA, 16 bp, Homo sapiens
agctaggcctggccag

SEQ ID NO: 3207893 - DNA, 21 bp, Homo sapiens
agctagtgcctttagagggta

SEQ ID NO: 3207894 - DNA, 22 bp, Homo sapiens
agctagtgtacctcctctcagt

SEQ ID NO: 3207895 - DNA, 17 bp, Homo sapiens
agctagttcgtagcttt

SEQ ID NO: 3207896 - DNA, 15 bp, Homo sapiens
agctataaagtatat

SEQ ID NO: 3207897 - DNA, 17 bp, Homo sapiens
agctataaagtatatat

SEQ ID NO: 3207898 - DNA, 22 bp, Homo sapiens
agctatatccatgtactgtagt

SEQ ID NO: 3207899 - DNA, 19 bp, Homo sapiens
agctatatctatatataat

SEQ ID NO: 3207900 - DNA, 17 bp, Homo sapiens
agctatcaagtgtgctt

SEQ ID NO: 3207901 - DNA, 12 bp, Homo sapiens
agctatcagcaa

SEQ ID NO: 3207902 - DNA, 17 bp, Homo sapiens
agctatcgaacttcaca

SEQ ID NO: 3207903 - DNA, 18 bp, Homo sapiens
agctatctaaagtttgtt

SEQ ID NO: 3207904 - DNA, 15 bp, Homo sapiens
agctatctaggtgga

SEQ ID NO: 3207905 - DNA, 20 bp, Homo sapiens
agctatgatttttttttcca

SEQ ID NO: 3207906 - DNA, 23 bp, Homo sapiens
agctatgctggtaggctcctgcc

SEQ ID NO: 3207907 - DNA, 22 bp, Homo sapiens
agctatgggagccccagggtct

SEQ ID NO: 3207908 - DNA, 17 bp, Homo sapiens
agctatgtcaagaggct

SEQ ID NO: 3207909 - DNA, 20 bp, Homo sapiens
agctattactgtctggtttt

SEQ ID NO: 3207910 - DNA, 14 bp, Homo sapiens
agctattagccagg

SEQ ID NO: 3207911 - DNA, 20 bp, Homo sapiens
agctattagccaggatcatg

SEQ ID NO: 3207912 - DNA, 17 bp, Homo sapiens
agctatttcatctattt

SEQ ID NO: 3207913 - DNA, 21 bp, Homo sapiens
agctatttcatctatttttgg

SEQ ID NO: 3207914 - DNA, 20 bp, Homo sapiens
agctatttccattccagaat

SEQ ID NO: 3207915 - DNA, 17 bp, Homo sapiens
agctcaaataaaaataa

SEQ ID NO: 3207916 - DNA, 12 bp, Homo sapiens
agctcaaatgaa

SEQ ID NO: 3207917 - DNA, 14 bp, Homo sapiens
agctcaagtttaaa

SEQ ID NO: 3207918 - DNA, 14 bp, Homo sapiens
agctcaatggactg

SEQ ID NO: 3207919 - DNA, 16 bp, Homo sapiens
agcccctagaaaccca

SEQ ID NO: 3207920 - DNA, 12 bp, Homo sapiens
agcccctagccc

SEQ ID NO: 3207921 - DNA, 16 bp, Homo sapiens
agcccctagcccagga

SEQ ID NO: 3207922 - DNA, 22 bp, Homo sapiens
agcccctagcccaggagagaga

SEQ ID NO: 3207923 - DNA, 18 bp, Homo sapiens
agcccctcagcccttgcc

SEQ ID NO: 3207924 - DNA, 21 bp, Homo sapiens
agcccctcagcccttgccccc

SEQ ID NO: 3207925 - DNA, 18 bp, Homo sapiens
agcccctcccccatctcc

SEQ ID NO: 3207926 - DNA, 20 bp, Homo sapiens
agcccctcccccatctccca

SEQ ID NO: 3207927 - DNA, 13 bp, Homo sapiens
agcccctcctcca

SEQ ID NO: 3207928 - DNA, 21 bp, Homo sapiens
agcccctcctccagcccctgt

SEQ ID NO: 3207929 - DNA, 22 bp, Homo sapiens
agcccctcctccagcccctgtc

SEQ ID NO: 3207930 - DNA, 18 bp, Homo sapiens
agcccctgccccagccca

SEQ ID NO: 3207931 - DNA, 14 bp, Homo sapiens
agcccctgcctggg

SEQ ID NO: 3207932 - DNA, 15 bp, Homo sapiens
agcccctgcctgggt

SEQ ID NO: 3207933 - DNA, 23 bp, Homo sapiens
agcccctgcctgggttgggggca

SEQ ID NO: 3207934 - DNA, 17 bp, Homo sapiens
agcccctggggcctaga

SEQ ID NO: 3207935 - DNA, 11 bp, Homo sapiens
agcccctgtcc

SEQ ID NO: 3207936 - DNA, 13 bp, Homo sapiens
agcccctgtccca

SEQ ID NO: 3207937 - DNA, 16 bp, Homo sapiens
agccccttcctgggta

SEQ ID NO: 3207938 - DNA, 13 bp, Homo sapiens
agccccttctccc

SEQ ID NO: 3207939 - DNA, 18 bp, Homo sapiens
agcccgaagtctgctgct

SEQ ID NO: 3207940 - DNA, 15 bp, Homo sapiens
agcccgacagtgcca

SEQ ID NO: 3207941 - DNA, 15 bp, Homo sapiens
agcccgcaactctcc

SEQ ID NO: 3207942 - DNA, 16 bp, Homo sapiens
agcccgcaactctcca

SEQ ID NO: 3207943 - DNA, 18 bp, Homo sapiens
agcccgcaactctccagc

SEQ ID NO: 3207944 - DNA, 13 bp, Homo sapiens
agcccgcctgaca

SEQ ID NO: 3207945 - DNA, 20 bp, Homo sapiens
agcccggcctgctcccagca

SEQ ID NO: 3207946 - DNA, 20 bp, Homo sapiens
agcccggcgccaccatcctg

SEQ ID NO: 3207947 - DNA, 13 bp, Homo sapiens
agcccggctggtt

SEQ ID NO: 3207948 - DNA, 15 bp, Homo sapiens
agcccgggagcctag

SEQ ID NO: 3207949 - DNA, 16 bp, Homo sapiens
agcccgggagcctagg

SEQ ID NO: 3207950 - DNA, 17 bp, Homo sapiens
agcccgggagcctagga

SEQ ID NO: 3207951 - DNA, 18 bp, Homo sapiens
agcccgggagcctaggac

SEQ ID NO: 3207952 - DNA, 12 bp, Homo sapiens
agcccgggctgc

SEQ ID NO: 3207953 - DNA, 16 bp, Homo sapiens
agcccgggctgcctgg

SEQ ID NO: 3207954 - DNA, 17 bp, Homo sapiens
agcccggtggcgtggca

SEQ ID NO: 3207955 - DNA, 19 bp, Homo sapiens
agccctaaaaatccagact

SEQ ID NO: 3207956 - DNA, 21 bp, Homo sapiens
agccctaaccccttccagatc

SEQ ID NO: 3207957 - DNA, 17 bp, Homo sapiens
agccctactccctgcag

SEQ ID NO: 3207958 - DNA, 18 bp, Homo sapiens
agccctactccctgcaga

SEQ ID NO: 3207959 - DNA, 20 bp, Homo sapiens
agccctactccctgcagatg

SEQ ID NO: 3207960 - DNA, 15 bp, Homo sapiens
agccctatggatgtg

SEQ ID NO: 3207961 - DNA, 16 bp, Homo sapiens
agccctatggatgtgg

SEQ ID NO: 3207962 - DNA, 18 bp, Homo sapiens
agccctcaacaggcccag

SEQ ID NO: 3207963 - DNA, 22 bp, Homo sapiens
agccctcaacaggcccagggag

SEQ ID NO: 3207964 - DNA, 13 bp, Homo sapiens
agccctcagaaca

SEQ ID NO: 3207965 - DNA, 15 bp, Homo sapiens
agccctccaaaagca

SEQ ID NO: 3207966 - DNA, 19 bp, Homo sapiens
agccctccccatggagcca

SEQ ID NO: 3207967 - DNA, 21 bp, Homo sapiens
agccctccccatggagccagc

SEQ ID NO: 3207968 - DNA, 16 bp, Homo sapiens
agccctcccccttccc

SEQ ID NO: 3207969 - DNA, 20 bp, Homo sapiens
agccctcccccttccccttc

SEQ ID NO: 3207970 - DNA, 22 bp, Homo sapiens
agccctccctatgtctgcaaag

SEQ ID NO: 3207971 - DNA, 15 bp, Homo sapiens
agccctccctgcccc

SEQ ID NO: 3207972 - DNA, 22 bp, Homo sapiens
agccctccctgcccctcccttc

SEQ ID NO: 3207973 - DNA, 23 bp, Homo sapiens
agccctccctgcccctcccttca

SEQ ID NO: 3207974 - DNA, 23 bp, Homo sapiens
agccctcgaaccaaggcagcctc

SEQ ID NO: 3207975 - DNA, 19 bp, Homo sapiens
agccctgacgcaatgaaaa

SEQ ID NO: 3207976 - DNA, 15 bp, Homo sapiens
agccctgaggcctga

SEQ ID NO: 3207977 - DNA, 19 bp, Homo sapiens
agccctgaggcctgaggcc

SEQ ID NO: 3207978 - DNA, 20 bp, Homo sapiens
agccctgaggcctgaggcct

SEQ ID NO: 3207979 - DNA, 13 bp, Homo sapiens
agccctgccctgc

SEQ ID NO: 3207980 - DNA, 14 bp, Homo sapiens
agccctgccctgca

SEQ ID NO: 3207981 - DNA, 15 bp, Homo sapiens
agccctgctgtggga

SEQ ID NO: 3207982 - DNA, 16 bp, Homo sapiens
agccctgcttttgcat

SEQ ID NO: 3207983 - DNA, 21 bp, Homo sapiens
agccctggacacccctgctct

SEQ ID NO: 3207984 - DNA, 12 bp, Homo sapiens
agccctggagac

SEQ ID NO: 3207985 - DNA, 18 bp, Homo sapiens
agccctggagccaactgc

SEQ ID NO: 3207986 - DNA, 20 bp, Homo sapiens
agccctggagccaactgctg

SEQ ID NO: 3207987 - DNA, 21 bp, Homo sapiens
agccctggcaggatgaccctg

SEQ ID NO: 3207988 - DNA, 12 bp, Homo sapiens
agccctggccag

SEQ ID NO: 3207989 - DNA, 15 bp, Homo sapiens
agccctggccagccc

SEQ ID NO: 3207990 - DNA, 19 bp, Homo sapiens
agccctggccagcccttcc

SEQ ID NO: 3207991 - DNA, 15 bp, Homo sapiens
agccctggctctgca

SEQ ID NO: 3207992 - DNA, 22 bp, Homo sapiens
agccctggggactgttccaaag

SEQ ID NO: 3207993 - DNA, 12 bp, Homo sapiens
agccctggggct

SEQ ID NO: 3207994 - DNA, 15 bp, Homo sapiens
agccctggggctggg

SEQ ID NO: 3207995 - DNA, 18 bp, Homo sapiens
agccctggggctgggccc

SEQ ID NO: 3207996 - DNA, 15 bp, Homo sapiens
agccctggtggcagt

SEQ ID NO: 3207997 - DNA, 16 bp, Homo sapiens
agccctggtggcagtg

SEQ ID NO: 3207998 - DNA, 21 bp, Homo sapiens
agccctggtggcagtgggagc

SEQ ID NO: 3207999 - DNA, 17 bp, Homo sapiens
agccctgtcgagacact

SEQ ID NO: 3208000 - DNA, 18 bp, Homo sapiens
agccctgtggccgccacc

SEQ ID NO: 3208001 - DNA, 16 bp, Homo sapiens
agcccttcaggaagca

SEQ ID NO: 3208002 - DNA, 14 bp, Homo sapiens
agcccttcatttgg

SEQ ID NO: 3208003 - DNA, 12 bp, Homo sapiens
agcccttcctct

SEQ ID NO: 3208004 - DNA, 16 bp, Homo sapiens
agcccttcggtcacct

SEQ ID NO: 3208005 - DNA, 18 bp, Homo sapiens
agcccttctgcctttctc

SEQ ID NO: 3208006 - DNA, 13 bp, Homo sapiens
agcccttgaggga

SEQ ID NO: 3208007 - DNA, 15 bp, Homo sapiens
agcccttgcccccat

SEQ ID NO: 3208008 - DNA, 22 bp, Homo sapiens
agcccttgcccccatccctcgg

SEQ ID NO: 3208009 - DNA, 13 bp, Homo sapiens
agcccttgcctcc

SEQ ID NO: 3208010 - DNA, 14 bp, Homo sapiens
agcccttgcctccc

SEQ ID NO: 3208011 - DNA, 12 bp, Homo sapiens
agcccttgggca

SEQ ID NO: 3208012 - DNA, 15 bp, Homo sapiens
agccgactctggccc

SEQ ID NO: 3208013 - DNA, 20 bp, Homo sapiens
agccgactctggccctggcc

SEQ ID NO: 3208014 - DNA, 23 bp, Homo sapiens
agccgactgcacagcggcccctg

SEQ ID NO: 3208015 - DNA, 18 bp, Homo sapiens
agccgagatcacgccact

SEQ ID NO: 3208016 - DNA, 19 bp, Homo sapiens
agccgagatcacgccactg

SEQ ID NO: 3208017 - DNA, 22 bp, Homo sapiens
agccgagattgcaccactgcac

SEQ ID NO: 3208018 - DNA, 18 bp, Homo sapiens
agccgagattgcgccact

SEQ ID NO: 3208019 - DNA, 21 bp, Homo sapiens
agccgagccgggcctggggct

SEQ ID NO: 3208020 - DNA, 14 bp, Homo sapiens
agccgcaccctgca

SEQ ID NO: 3208021 - DNA, 19 bp, Homo sapiens
agccgcaccctgcacctgc

SEQ ID NO: 3208022 - DNA, 20 bp, Homo sapiens
agccgcaccctgcacctgct

SEQ ID NO: 3208023 - DNA, 13 bp, Homo sapiens
agccgccagctgg

SEQ ID NO: 3208024 - DNA, 23 bp, Homo sapiens
agccgccagctgggagcactggt

SEQ ID NO: 3208025 - DNA, 17 bp, Homo sapiens
agccgccattgccacca

SEQ ID NO: 3208026 - DNA, 13 bp, Homo sapiens
agccgccccagcc

SEQ ID NO: 3208027 - DNA, 14 bp, Homo sapiens
agccgccccagccc

SEQ ID NO: 3208028 - DNA, 22 bp, Homo sapiens
agccgccctgggctgtctgtca

SEQ ID NO: 3208029 - DNA, 21 bp, Homo sapiens
agccgcctgaaagccacaatg

SEQ ID NO: 3208030 - DNA, 15 bp, Homo sapiens
agccgccttccttga

SEQ ID NO: 3208031 - DNA, 16 bp, Homo sapiens
agccgccttccttgac

SEQ ID NO: 3208032 - DNA, 17 bp, Homo sapiens
agccgccttccttgacc

SEQ ID NO: 3208033 - DNA, 14 bp, Homo sapiens
agccgcctttgggt

SEQ ID NO: 3208034 - DNA, 18 bp, Homo sapiens
agccgcctttgggttcca

SEQ ID NO: 3208035 - DNA, 12 bp, Homo sapiens
agccgctcggag

SEQ ID NO: 3208036 - DNA, 19 bp, Homo sapiens
agccgctgcagggctccca

SEQ ID NO: 3208037 - DNA, 18 bp, Homo sapiens
agccggccaatggaaacc

SEQ ID NO: 3208038 - DNA, 20 bp, Homo sapiens
agccggccaccagatgctga

SEQ ID NO: 3208039 - DNA, 18 bp, Homo sapiens
agccgggcccctgggctt

SEQ ID NO: 3208040 - DNA, 13 bp, Homo sapiens
agccgggcctggg

SEQ ID NO: 3208041 - DNA, 19 bp, Homo sapiens
agccgggcctggggctcct

SEQ ID NO: 3208042 - DNA, 18 bp, Homo sapiens
agccgtattttacatgaa

SEQ ID NO: 3208043 - DNA, 16 bp, Homo sapiens
agccgtccatggcacc

SEQ ID NO: 3208044 - DNA, 22 bp, Homo sapiens
agccgtccatggcaccagcccc

SEQ ID NO: 3208045 - DNA, 19 bp, Homo sapiens
agtccccctatccttggca

SEQ ID NO: 3208046 - DNA, 15 bp, Homo sapiens
agtccccgtgccccg

SEQ ID NO: 3208047 - DNA, 16 bp, Homo sapiens
agtcccctcacctcct

SEQ ID NO: 3208048 - DNA, 15 bp, Homo sapiens
agtcccctccaggaa

SEQ ID NO: 3208049 - DNA, 20 bp, Homo sapiens
agtccctatgtatttgcagt

SEQ ID NO: 3208050 - DNA, 19 bp, Homo sapiens
agtccctgactctctgtga

SEQ ID NO: 3208051 - DNA, 23 bp, Homo sapiens
agtccctgtcatttgaacctgga

SEQ ID NO: 3208052 - DNA, 21 bp, Homo sapiens
agtccctgtgaagactgggtg

SEQ ID NO: 3208053 - DNA, 19 bp, Homo sapiens
agtccctgttttctgagcc

SEQ ID NO: 3208054 - DNA, 15 bp, Homo sapiens
agtcccttcccctcc

SEQ ID NO: 3208055 - DNA, 19 bp, Homo sapiens
agtcccttcccctccctgg

SEQ ID NO: 3208056 - DNA, 23 bp, Homo sapiens
agtccgaaagggacttggaagct

SEQ ID NO: 3208057 - DNA, 19 bp, Homo sapiens
agtcctatggaaaaaacca

SEQ ID NO: 3208058 - DNA, 18 bp, Homo sapiens
agtcctcataaaaagcaa

SEQ ID NO: 3208059 - DNA, 13 bp, Homo sapiens
agtcctcccctca

SEQ ID NO: 3208060 - DNA, 15 bp, Homo sapiens
agtcctcccctcaca

SEQ ID NO: 3208061 - DNA, 23 bp, Homo sapiens
agtcctcccctcacagcctctga

SEQ ID NO: 3208062 - DNA, 15 bp, Homo sapiens
agtcctcctgggagc

SEQ ID NO: 3208063 - DNA, 17 bp, Homo sapiens
agtcctctagcaggcct

SEQ ID NO: 3208064 - DNA, 22 bp, Homo sapiens
agtcctcttttctgagaggact

SEQ ID NO: 3208065 - DNA, 14 bp, Homo sapiens
agtcctgaagaggc

SEQ ID NO: 3208066 - DNA, 19 bp, Homo sapiens
agtcctgaagaggcgggcc

SEQ ID NO: 3208067 - DNA, 14 bp, Homo sapiens
agtcctgaaggaca

SEQ ID NO: 3208068 - DNA, 16 bp, Homo sapiens
agtcctgcctcagcct

SEQ ID NO: 3208069 - DNA, 18 bp, Homo sapiens
agtcctgctccagaattt

SEQ ID NO: 3208070 - DNA, 23 bp, Homo sapiens
agtcctgctccagaatttggaaa

SEQ ID NO: 3208071 - DNA, 18 bp, Homo sapiens
agtcctggatgttgtgtg

SEQ ID NO: 3208072 - DNA, 16 bp, Homo sapiens
agtcctgggagaccca

SEQ ID NO: 3208073 - DNA, 20 bp, Homo sapiens
agtcctggtccctctgaggc

SEQ ID NO: 3208074 - DNA, 17 bp, Homo sapiens
agtcctgtctctgcctg

SEQ ID NO: 3208075 - DNA, 20 bp, Homo sapiens
agtcctgtgaatgccactgc

SEQ ID NO: 3208076 - DNA, 22 bp, Homo sapiens
agtcctgtgaatgccactgcct

SEQ ID NO: 3208077 - DNA, 15 bp, Homo sapiens
agtcctgtgctgaat

SEQ ID NO: 3208078 - DNA, 21 bp, Homo sapiens
agtccttaaaaatcacactgt

SEQ ID NO: 3208079 - DNA, 15 bp, Homo sapiens
agtccttacctcttc

SEQ ID NO: 3208080 - DNA, 15 bp, Homo sapiens
agtccttattcttct

SEQ ID NO: 3208081 - DNA, 20 bp, Homo sapiens
agtccttattcttctcataa

SEQ ID NO: 3208082 - DNA, 17 bp, Homo sapiens
agtccttgaaaatattt

SEQ ID NO: 3208083 - DNA, 23 bp, Homo sapiens
agtccttgatttcaaagttttgt

SEQ ID NO: 3208084 - DNA, 17 bp, Homo sapiens
agtcctttatgtggaaa

SEQ ID NO: 3208085 - DNA, 17 bp, Homo sapiens
agtcctttctgccttgg

SEQ ID NO: 3208086 - DNA, 13 bp, Homo sapiens
agtcgaaggatgc

SEQ ID NO: 3208087 - DNA, 21 bp, Homo sapiens
agtcgaaggatgctctttccc

SEQ ID NO: 3208088 - DNA, 18 bp, Homo sapiens
agtcgaattaatagcttt

SEQ ID NO: 3208089 - DNA, 21 bp, Homo sapiens
agtcgaattaatagcttttat

SEQ ID NO: 3208090 - DNA, 17 bp, Homo sapiens
agtcgaccgcacttatg

SEQ ID NO: 3208091 - DNA, 21 bp, Homo sapiens
agtcgaccgcacttatggtaa

SEQ ID NO: 3208092 - DNA, 16 bp, Homo sapiens
agtcgaggacagggag

SEQ ID NO: 3208093 - DNA, 16 bp, Homo sapiens
agtcggaaaagcgtct

SEQ ID NO: 3208094 - DNA, 15 bp, Homo sapiens
agtcggccccatctc

SEQ ID NO: 3208095 - DNA, 18 bp, Homo sapiens
agtcgtacagaaagctgc

SEQ ID NO: 3208096 - DNA, 13 bp, Homo sapiens
agtcgtgcctgtg

SEQ ID NO: 3208097 - DNA, 13 bp, Homo sapiens
agtgaatgaaaca

SEQ ID NO: 3208098 - DNA, 19 bp, Homo sapiens
agtgaatgctgggactcag

SEQ ID NO: 3208099 - DNA, 20 bp, Homo sapiens
agtgaatgtgtctggacctc

SEQ ID NO: 3208100 - DNA, 20 bp, Homo sapiens
agtgaattcttgaaggaaaa

SEQ ID NO: 3208101 - DNA, 19 bp, Homo sapiens
agtgaatttgaatgaaaaa

SEQ ID NO: 3208102 - DNA, 14 bp, Homo sapiens
agtgacaaaataga

SEQ ID NO: 3208103 - DNA, 18 bp, Homo sapiens
agtgacaaagactcctct

SEQ ID NO: 3208104 - DNA, 23 bp, Homo sapiens
agtgacacagcagcttcaccaga

SEQ ID NO: 3208105 - DNA, 15 bp, Homo sapiens
agtgacacttcagag

SEQ ID NO: 3208106 - DNA, 20 bp, Homo sapiens
agtgacacttcagagagctg

SEQ ID NO: 3208107 - DNA, 19 bp, Homo sapiens
agtgacagaggcagcccca

SEQ ID NO: 3208108 - DNA, 15 bp, Homo sapiens
agtgacagagttcac

SEQ ID NO: 3208109 - DNA, 19 bp, Homo sapiens
agtgacagagttcactata

SEQ ID NO: 3208110 - DNA, 22 bp, Homo sapiens
agtgacataatatattctattt

SEQ ID NO: 3208111 - DNA, 19 bp, Homo sapiens
agtgacatcaaagcctggc

SEQ ID NO: 3208112 - DNA, 15 bp, Homo sapiens
agtgaccacttattc

SEQ ID NO: 3208113 - DNA, 13 bp, Homo sapiens
agtgaccccagaa

SEQ ID NO: 3208114 - DNA, 14 bp, Homo sapiens
agtgacctgtttat

SEQ ID NO: 3208115 - DNA, 18 bp, Homo sapiens
agtgactagtacaaatta

SEQ ID NO: 3208116 - DNA, 18 bp, Homo sapiens
agtgactccaagaacaat

SEQ ID NO: 3208117 - DNA, 22 bp, Homo sapiens
agtgactcctgctggtacctgc

SEQ ID NO: 3208118 - DNA, 21 bp, Homo sapiens
agtgactgatggctaatgtac

SEQ ID NO: 3208119 - DNA, 17 bp, Homo sapiens
agtgactggcaggtgca

SEQ ID NO: 3208120 - DNA, 14 bp, Homo sapiens
agtgactgttgtac

SEQ ID NO: 3208121 - DNA, 19 bp, Homo sapiens
agtgacttattttgtctta

SEQ ID NO: 3208122 - DNA, 16 bp, Homo sapiens
agtgacttgtgtccca

SEQ ID NO: 3208123 - DNA, 18 bp, Homo sapiens
agtgagaaaaagctcctg

SEQ ID NO: 3208124 - DNA, 19 bp, Homo sapiens
agtgagacaaaattttagt

SEQ ID NO: 3208125 - DNA, 12 bp, Homo sapiens
agtgagacagaa

SEQ ID NO: 3208126 - DNA, 17 bp, Homo sapiens
agtgagactctgtctca

SEQ ID NO: 3208127 - DNA, 18 bp, Homo sapiens
agtgagagagacaagaag

SEQ ID NO: 3208128 - DNA, 14 bp, Homo sapiens
agtgagagctgggt

SEQ ID NO: 3208129 - DNA, 22 bp, Homo sapiens
agtgagagggcatgcgcacaag

SEQ ID NO: 3208130 - DNA, 17 bp, Homo sapiens
agtgagcaagggggccc

SEQ ID NO: 3208131 - DNA, 18 bp, Homo sapiens
agtgaggagggtggagga

SEQ ID NO: 3208132 - DNA, 16 bp, Homo sapiens
agtgaggcttccaggc

SEQ ID NO: 3208133 - DNA, 16 bp, Homo sapiens
agtgaggtgtgtcaca

SEQ ID NO: 3208134 - DNA, 20 bp, Homo sapiens
agtgagtaattttggatttt

SEQ ID NO: 3208135 - DNA, 16 bp, Homo sapiens
agtgagtctcttcaga

SEQ ID NO: 3208136 - DNA, 14 bp, Homo sapiens
agtgagtctgtcag

SEQ ID NO: 3208137 - DNA, 16 bp, Homo sapiens
agtgagtgagcctggc

SEQ ID NO: 3208138 - DNA, 18 bp, Homo sapiens
agtgagttcaactacatg

SEQ ID NO: 3208139 - DNA, 20 bp, Homo sapiens
agtgatactatccagttact

SEQ ID NO: 3208140 - DNA, 21 bp, Homo sapiens
agtgatagtcttttgcttttg

SEQ ID NO: 3208141 - DNA, 21 bp, Homo sapiens
agtgatatggcagaagacacc

SEQ ID NO: 3208142 - DNA, 15 bp, Homo sapiens
agtgatattggaact

SEQ ID NO: 3208143 - DNA, 17 bp, Homo sapiens
agtgatcaataaaatgt

SEQ ID NO: 3208144 - DNA, 20 bp, Homo sapiens
agtgatcaataaaatgtgat

SEQ ID NO: 3208145 - DNA, 15 bp, Homo sapiens
agtgatcctcccacc

SEQ ID NO: 3208146 - DNA, 18 bp, Homo sapiens
agtgatcctcccacctca

SEQ ID NO: 3208147 - DNA, 22 bp, Homo sapiens
agtgatcctcccacctcagcct

SEQ ID NO: 3208148 - DNA, 15 bp, Homo sapiens
agtgatctatgtttg

SEQ ID NO: 3208149 - DNA, 13 bp, Homo sapiens
agtgatctccata

SEQ ID NO: 3208150 - DNA, 22 bp, Homo sapiens
agtgatgatttgggggaggctt

SEQ ID NO: 3208151 - DNA, 23 bp, Homo sapiens
agtgatggcgcgggaggcaccag

SEQ ID NO: 3208152 - DNA, 15 bp, Homo sapiens
agtgatgttcagatt

SEQ ID NO: 3208153 - DNA, 17 bp, Homo sapiens
agtgattcactgtgctt

SEQ ID NO: 3208154 - DNA, 18 bp, Homo sapiens
agtgattctcctgcctca

SEQ ID NO: 3208155 - DNA, 19 bp, Homo sapiens
agtgattctcctgcctcag

SEQ ID NO: 3208156 - DNA, 20 bp, Homo sapiens
agtgattctcctgcctcagc

SEQ ID NO: 3208157 - DNA, 24 bp, Homo sapiens
agtgattctcctgcctcagcctcc

SEQ ID NO: 3208158 - DNA, 14 bp, Homo sapiens
agtgattctgattt

SEQ ID NO: 3208159 - DNA, 17 bp, Homo sapiens
agtgattctgatttcag

SEQ ID NO: 3208160 - DNA, 16 bp, Homo sapiens
agtgattgaaccagct

SEQ ID NO: 3208161 - DNA, 13 bp, Homo sapiens
agtgatttctaga

SEQ ID NO: 3208162 - DNA, 20 bp, Homo sapiens
agtgcaacagcactggctct

SEQ ID NO: 3208163 - DNA, 16 bp, Homo sapiens
agtgcaagttcatgtg

SEQ ID NO: 3208164 - DNA, 14 bp, Homo sapiens
agtgcacagctgtc

SEQ ID NO: 3208165 - DNA, 18 bp, Homo sapiens
agtgcactttctaatgtt

SEQ ID NO: 3208166 - DNA, 21 bp, Homo sapiens
agtgcacttttttatgaagaa

SEQ ID NO: 3208167 - DNA, 15 bp, Homo sapiens
agtgcagccactggc

SEQ ID NO: 3208168 - DNA, 14 bp, Homo sapiens
agtgcagctgattt

SEQ ID NO: 3208169 - DNA, 16 bp, Homo sapiens
agtgcagctgatttta

SEQ ID NO: 3208170 - DNA, 17 bp, Homo sapiens
agtgcagctgattttaa

SEQ ID NO: 3208171 - DNA, 14 bp, Homo sapiens
agtgcatattcctt

SEQ ID NO: 3208172 - DNA, 12 bp, Homo sapiens
agtgcatcatta

SEQ ID NO: 3208173 - DNA, 14 bp, Homo sapiens
agtgcatctcagcc

SEQ ID NO: 3208174 - DNA, 17 bp, Homo sapiens
agtgcatctcagcccac

SEQ ID NO: 3208175 - DNA, 15 bp, Homo sapiens
agtgcatttctgaat

SEQ ID NO: 3208176 - DNA, 21 bp, Homo sapiens
agtgcatttctgaatagaaat

SEQ ID NO: 3208177 - DNA, 22 bp, Homo sapiens
agtgcatttctgaatagaaatg

SEQ ID NO: 3208178 - DNA, 20 bp, Homo sapiens
agtgccacccgcagatgaca

SEQ ID NO: 3208179 - DNA, 18 bp, Homo sapiens
agtgccacttaatgtatg

SEQ ID NO: 3208180 - DNA, 18 bp, Homo sapiens
agggtttacccagtggga

SEQ ID NO: 3208181 - DNA, 23 bp, Homo sapiens
agggtttcgactggtccagctct

SEQ ID NO: 3208182 - DNA, 22 bp, Homo sapiens
agggtttgaattgttttcttta

SEQ ID NO: 3208183 - DNA, 23 bp, Homo sapiens
agggtttgaattgttttctttaa

SEQ ID NO: 3208184 - DNA, 19 bp, Homo sapiens
agggtttgaggattcctga

SEQ ID NO: 3208185 - DNA, 13 bp, Homo sapiens
agggttttgcccc
